US009238822B2

(12) United States Patent
Baum et al.

(10) Patent No.: US 9,238,822 B2
(45) Date of Patent: *Jan. 19, 2016

(54) COMPOSITIONS AND METHODS FOR CONTROL OF INSECT INFESTATIONS IN PLANTS

(75) Inventors: James A. Baum, Webster Groves, MO (US); Larry A. Gilbertson, Chesterfield, MO (US); David K. Kovalic, Clayton, MO (US); Thomas J. LaRosa, Fenton, MO (US); Maolong Lu, Hillsborough, NJ (US); Tichafa R. I. Munyikwa, Ballwin, MO (US); James K. Roberts, Chesterfield, MO (US); Wei Wu, Chesterfield, MO (US); Bei Zhang, Chesterfield, MO (US)

(73) Assignee: Monsanto Technology LLC, St. Louis, MO (US)

( * ) Notice: Subject to any disclaimer, the term of this patent is extended or adjusted under 35 U.S.C. 154(b) by 0 days.

This patent is subject to a terminal disclaimer.

(21) Appl. No.: 13/226,353

(22) Filed: Sep. 6, 2011

(65) Prior Publication Data
US 2012/0164205 A1 Jun. 28, 2012

Related U.S. Application Data

(63) Continuation of application No. 11/547,764, filed as application No. PCT/US2005/011816 on Apr. 8, 2005.

(60) Provisional application No. 60/560,842, filed on Apr. 9, 2004, provisional application No. 60/565,632, filed on Apr. 27, 2004, provisional application No. 60/579,062, filed on Jun. 11, 2004, provisional application No. 60/603,421, filed on Aug. 20, 2004, provisional application No. 60/617,261, filed on Oct. 11, 2004, provisional application No. 60/669,175, filed on Apr. 7, 2005.

(51) Int. Cl.
C12N 15/82 (2006.01)
C12N 15/87 (2006.01)
A01H 1/00 (2006.01)
A01N 63/02 (2006.01)

(52) U.S. Cl.
CPC ............ *C12N 15/8286* (2013.01); *A01N 63/02* (2013.01); *C12N 15/8275* (2013.01); *C12N 15/8279* (2013.01); *C12N 15/8285* (2013.01)

(58) Field of Classification Search
CPC ........... C12N 15/8286; C12N 15/8279; C12N 15/8285; C12N 15/8275; A01N 63/02
USPC ....................................................... 800/285
See application file for complete search history.

(56) References Cited

U.S. PATENT DOCUMENTS 3,937,813 A 2/1976 Clark
4,948,734 A 8/1990 Edwards et al. ........... 435/252.5
5,107,065 A 4/1992 Shewmaker et al. ......... 800/298
5,231,020 A 7/1993 Jorgensen et al. ............ 800/281
5,283,184 A 2/1994 Jorgensen et al. ............ 800/285
5,629,469 A 5/1997 Deluca-Flaherty et al. .. 800/205
5,759,829 A 6/1998 Shewmaker et al. ......... 800/286
5,858,353 A * 1/1999 Miller et al. ................. 424/93.6
5,866,784 A 2/1999 Van Mellaert et al.
5,914,318 A * 6/1999 Baum et al. ................... 424/780
6,326,193 B1 12/2001 Liu et al. ..................... 435/320.1
6,433,247 B1 8/2002 Schnabel
6,506,559 B1 1/2003 Driver et al. ...................... 435/6
6,573,099 B2 6/2003 Graham
6,586,365 B2 7/2003 Asrar et al.
6,703,491 B1 3/2004 Homburger et al. ......... 536/23.1
6,753,139 B1 6/2004 Baulcombe
7,030,290 B2 4/2006 Verwaerde
7,109,393 B2 9/2006 Gutterson
7,314,974 B2 1/2008 Cao et al.
7,348,410 B2 3/2008 Gaines et al.
7,358,069 B2 4/2008 Plaetinck
7,612,194 B2 11/2009 Andersen et al.
7,618,814 B2 11/2009 Bentwich
7,741,118 B1 6/2010 Fischhoff et al.
7,741,531 B2 6/2010 Baltz et al. ................... 800/279
7,754,697 B2 7/2010 Graham et al.
7,812,219 B2 10/2010 Baum et al.

(Continued)

FOREIGN PATENT DOCUMENTS

AR 047897 A1 3/2006
CA 2 094 658 10/1993

(Continued)

OTHER PUBLICATIONS

GenBank Accession No. U46682, dated Apr. 25, 1996.
GenBank Accession No. AF025809, dated Jan. 31, 2001.
U.S. Appl. No. 60/068,562, filed Dec. 23, 1997, Fire et al.
U.S. Appl. No. 60/167,307, filed Nov. 24, 1999, Tobias et al.
U.S. Appl. No. 60/560,842, filed Apr. 9, 2004, Baum.
Advisory Action regarding U.S. Appl. No. 11/547,764 dated Aug. 22, 2012.
Response to Office Action regarding U.S. Appl. No. 11/547,764, filed Oct. 12, 2012.
Bucher et al., "Parental RNAi in Tribolium (Coleoptera)," *Current Biology*, 12:R85-R86, 2002.
Kulkarni et al., "Evidence of off-target effects associated with long dsRNAs in *Drosophila melanogaster* cell-based assays," *Nature Methods*, 3(10):833-838, 2006.
Lehner et al., "How to use RNA interference," *Briefings in Funct. Genomics and Proteomics*, 3(1):68-83, 2004.

(Continued)

Primary Examiner — Li Zheng
(74) Attorney, Agent, or Firm — Dentons US LLP; Amanda Carmany-Rampey

(57) ABSTRACT

The present invention is directed to controlling pest infestation by inhibiting one or more biological functions in an invertebrate pest. The invention discloses methods and compositions for use in controlling pest infestation by feeding one or more different recombinant double stranded RNA molecules to the pest in order to achieve a reduction in pest infestation through suppression of gene expression. The invention is also directed to methods for making transgenic plants that express the double stranded RNA molecules, and to particular combinations of transgenic pesticidal agents for use in protecting plants from pest infestation.

18 Claims, No Drawings

(56) References Cited

U.S. PATENT DOCUMENTS

| | | | |
|---|---|---|---|
| 7,943,819 B2* | 5/2011 | Baum et al. | 800/285 |
| 7,999,148 B2 | 8/2011 | Rathore et al. | |
| 8,404,927 B2 | 3/2013 | Allen et al. | |
| 2001/0016953 A1 | 8/2001 | Barry et al. | |
| 2002/0048814 A1 | 4/2002 | Oeller | 435/455 |
| 2002/0129400 A1 | 9/2002 | Snell | |
| 2002/0137710 A1* | 9/2002 | Liu et al. | 514/44 |
| 2003/0018993 A1 | 1/2003 | Gutterson et al. | 800/286 |
| 2003/0054391 A1* | 3/2003 | Bulla et al. | 435/6 |
| 2003/0061626 A1 | 3/2003 | Plaetinck et al. | 514/44 |
| 2003/0150017 A1 | 8/2003 | Mesa et al. | 800/279 |
| 2003/0154508 A1 | 8/2003 | Stevens et al. | |
| 2003/0175965 A1 | 9/2003 | Lowe et al. | 435/455 |
| 2004/0029283 A1 | 2/2004 | Fillatti | 435/468 |
| 2004/0053876 A1 | 3/2004 | Turner et al. | |
| 2004/0123343 A1 | 6/2004 | La Rosa et al. | |
| 2004/0133943 A1 | 7/2004 | Plaetinck et al. | 435/6 |
| 2004/0220199 A1* | 11/2004 | Asrar et al. | 514/269 |
| 2004/0241651 A1 | 12/2004 | Olek et al. | |
| 2005/0095199 A1 | 5/2005 | Whyard et al. | |
| 2006/0021087 A1 | 1/2006 | Baum et al. | 800/302 |
| 2006/0035344 A1 | 2/2006 | Pachuk et al. | |
| 2006/0174380 A1 | 8/2006 | Carrington et al. | 800/285 |
| 2006/0200878 A1 | 9/2006 | Lutfiyya et al. | |
| 2006/0272049 A1* | 11/2006 | Waterhouse et al. | 800/279 |
| 2007/0011775 A1 | 1/2007 | Allen et al. | |
| 2007/0050860 A1 | 3/2007 | Andersen et al. | 800/278 |
| 2007/0061918 A1 | 3/2007 | Baltz et al. | 800/279 |
| 2007/0124836 A1 | 5/2007 | Baum et al. | |
| 2009/0307803 A1 | 12/2009 | Baum et al. | 800/285 |
| 2010/0192265 A1 | 7/2010 | Andersen et al. | 800/298 |
| 2011/0154545 A1 | 6/2011 | Andersen et al. | |
| 2012/0137387 A1 | 5/2012 | Baum et al. | |
| 2012/0164205 A1 | 6/2012 | Baum et al. | |
| 2014/0194306 A1 | 7/2014 | Andersen et al. | |

FOREIGN PATENT DOCUMENTS

| | | |
|---|---|---|
| CA | 2582550 | 5/2006 |
| CN | 88102497 A | 11/1988 |
| CN | 1412311 A | 4/2003 |
| CN | 1307641 A | 8/2008 |
| EP | 0289479 | 11/1996 |
| EP | 1 644 480 | 3/2005 |
| RU | 2157644 | 1/2000 |
| RU | 2198221 | 2/2003 |
| WO | WO 94/01550 | 1/1994 |
| WO | WO 2007/083193 | 7/1997 |
| WO | WO 98/05770 | 2/1998 |
| WO | WO 99/05315 | 2/1999 |
| WO | WO 99/31253 | 6/1999 |
| WO | WO 99/36520 | 7/1999 |
| WO | WO 99/49029 | 9/1999 |
| WO | WO 99/53050 | 10/1999 |
| WO | WO 99/61631 | 12/1999 |
| WO | WO 00/01846 | 1/2000 |
| WO | WO 00/66742 | 11/2000 |
| WO | WO 01/09301 | 2/2001 |
| WO | WO 01/34815 | 5/2001 |
| WO | WO 01/37654 | 5/2001 |
| WO | WO 01/48183 | 7/2001 |
| WO | WO 01/70929 | 9/2001 |
| WO | WO 01/77384 | 10/2001 |
| WO | WO 01/88121 | 11/2001 |
| WO | WO 02/06940 | 1/2002 |
| WO | WO 02/13609 | 2/2002 |
| WO | WO 02/33405 | 4/2002 |
| WO | WO 02/46432 | 6/2002 |
| WO | WO 02/077183 | 10/2002 |
| WO | WO 03/004644 | 1/2003 |
| WO | WO 03/018810 | 3/2003 |
| WO | WO 03/031577 A2 | 4/2003 |
| WO | WO 03/076619 | 9/2003 |
| WO | WO 2004/013169 | 2/2004 |
| WO | WO 2004/022771 | 3/2004 |
| WO | WO 2004/073390 | 9/2004 |
| WO | WO 2004/108899 | 12/2004 |
| WO | WO 2005/019408 | 3/2005 |
| WO | WO 2005/049841 | 6/2005 |
| WO | WO 2005/071091 | 8/2005 |
| WO | WO 2005/082932 | 9/2005 |
| WO | WO 2005/110068 | 11/2005 |
| WO | WO 2006/045590 | 5/2006 |
| WO | WO 2006/045591 | 5/2006 |
| WO | WO 2006/046148 | 5/2006 |
| WO | WO 2006/070227 | 7/2006 |
| WO | WO 2006/129204 | 12/2006 |
| WO | WO 2007/074405 | 7/2007 |
| WO | WO 2007/095496 | 8/2007 |
| WO | WO 2009/021288 | 2/2009 |

OTHER PUBLICATIONS

Potier et al., "Development of Microarrays to Study Gene Expression in Tissue and Single Cells: Analysis of Neural Transmission," *Microarrays for the Neurosciences: An Essential Guide, MIT Press*, 237-254, 2002.
de Maagd et al., "*Bacillus thuringiensis* toxin-mediated insect resistance in plants," *Trends in Plant Science* 4(1):9-13, 1999.
U.S. Appl. No. 14/102,397, filed Dec. 10, 2013, Andersen et al.
Response to Office Action regarding U.S. Appl. No. 13/783,125, dated Feb. 5, 2014.
Supplemental Response to Office Action regarding U.S. Appl. No. 13/783,125, dated Feb. 11, 2014.
USPTO: Final Office Action regarding U.S. Appl. No. 11/547,764, dated Mar. 11, 2014.
USPTO: Final Office Action regarding U.S. Appl. No. 13/783,125, dated Apr. 3, 2014.
U.S. Appl. No. 13/783,125, filed Mar. 1, 2013, Baum et al.
U.S. Appl. No. 13/855,328, filed Apr. 2, 2013, Baum et al.
Adang et al., "The reconstruction and expression of a Bacillus thuringiensis cryIIIA gene in protoplasts and potato plants," *Plant Mol. Biol.* 21:1131-1145 (see pp. 1140-1142), 1993.
Allan et al.,"Genome-wide survey of V-ATPase genes in *Drosophila* reveals a conserved renal phenotype for lethal allels," *Physiol. Genomics* 22:128-138, 2005.
Baum et al., "Control of Coleopteran Insect Pests through RNA Interference," *Nature Biotechnology* 25(11):1322-1326, 2007.
Bjorklund et al., "Identification of pathways regulating cell size and cell progression by RNAi," *Nature* 439(7079):1009-13, 2006.
Chang Jinhong et al., "Resistance of Human Hepatitis Delta Virus RNAs to Dicer Activity," *Journal of Virology* 77(22):11910-11917, 2003.
GenBank Accession No. AF 208003.1, Oct. 12, 2000.
GenBank Accession No. BX649259.2, dated Oct. 10, 2003.
GenBank Accession No. CN497371, dated Apr. 6, 2005.
GenBank Accession No. CN497479, dated Apr. 6, 2005.
GenBank Accession No. CN497520, dated Apr. 6, 2005.
GenBank Accession No. CN497812, dated Apr. 6, 2005.
GenBank Accession No. CN497854, dated Apr. 6, 2005.
GenBank Accession No. CN497874, dated Apr. 6, 2005.
GenBank Accession No. CN497975, dated Apr. 6, 2005.
GenBank Accession No. CN497996, dated Apr. 6, 2005.
GenBank Accession No. CN498033, dated Apr. 6, 2005.
GenBank Accession No. CN498106, dated Apr. 6, 2005.
GenBank Accession No. CN498213, dated Apr. 6, 2005.
GenBank Accession No. CN498337, dated Apr. 6, 2005.
GenBank Accession No. CN498392, dated Apr. 6, 2005.
GenBank Accession No. CN498536, dated Apr. 6, 2005.
GenBank Accession No. CN498542, dated Apr. 6, 2005.
GenBank Accession No. CN498581, dated Apr. 6, 2005.
GenBank Accession No. CN498583, dated Apr. 6, 2005.
GenBank Accession No. CN498642, dated Apr. 6, 2005.
GenBank Accession No. CN498647, dated Apr. 6, 2005.
GenBank Accession No. CN498664, dated Apr. 6, 2005.
GenBank Accession No. CN498753, dated Apr. 6, 2005.
GenBank Accession No. CN498764, dated Apr. 6, 2005.
Gordon et al., "RNAi for Insect-Proof Plants," *Nature Biotechnology* 25(11):1231-1232, 2007.

(56) References Cited

OTHER PUBLICATIONS

Hanawa et al., "Phytoalexins from Pinus strobus bark infected with pinewood nematode, Bursaphelenchus xylophilus," *Phytochemistry* 57:223-228 (see pp. 223-226), 2001.

Hjalt et al., "Bulged-out nucleotides protect an antisense RNA are required for rapid target RNA binding in vitro and inhibition in vivo," *Nucl. Acids Res.* 23(4):580-587, 1995.

Hjalt et al., "Bulged-out nucleotides protect an antisense RNA from RNase III cleavage," *Nucl. Acids Res.* 23(4):571-579, 1995.

Huntley et al., "Interference with brome mosaic virus replication by targeting the minus strand promoter," *J. Virol.* 74:2445-2452, 1993.

Khvorova et al., "Functional siRNAs and miRNAs Exhibit Strand Bias," *Cell* 115:209-216, 2003.

Klahre et al., "High molecular weight RNAs and small interfering RNAs induce systemic posttranscriptional gene silencing in plants," *PNAS* 99:11981-11986, 2002.

Llave et al., "Endogenous and silencing-associated small RNAs in plants," *Plant Cell* 14:1605-1619, 2002.

McManus et al., "Gene silencing using micro-RNA designed hairpins," *RNA* 8(6):842-850, 2002.

Miklos et al., "The Role of the Genome Project in Determining Gene Function: Insights from Model Organisms," *Cell* 86:521-529, 1996.

Myers et al., "Recombinant dicer efficiently converts large dsRNAs into siRNAs suitable for gene silencing," *Nature Biotechnology* 21(3):324-328, 2003.

Peter et al., "β-Cop is essential for Transport of Protein from the Endioplasmic Reticulum to the Golgi in Vitro," *J Cell Biol* 122(6):1155-67, 1993.

Siegfried et al., "Expressed sequence tags from *Diabrotica virgifera virgifera* midgut identify a coleopteran cadherin and a diversity of cathepsins," *Insect Mol. Biol.* 14(2):137-143, 2005.

Smith et al., "Total silencing by intro-spliced hairpin RNAs," *Nature* 407:319-320, 2000.

Thomas et al., "Size constraints for targeting post-transcriptional gene silencing and for RNA-directed methylation in *Nicotiana benthamiana* using a potato virus X vector," *Plant J.* 25(4):417-425, 2001.

Urwin et al., "Ingestion of Double-Stranded RNA by Preparasitic Juvenile Cyst Nematodes Leads to RNA Interference," *MPMI* 15(8):747-752 (see 748-751), 2002.

Xie et al., "DICER-LIKE 4 functions in trans-acting small interfering RNA biogenesis and vegetative phase change in Arabidopsis thaliana," 102:12984-12989, 2005.

Xu-Gang Xia, "Multiple shRNAs expressed by an individual pol II promoter can knock down the expression of multiple target genes," *BioTechniques*, 41(1):64-68, 2006.

Office Action regarding Russian Application No. 2008114846, dated Jun. 28, 2011.

USPTO; Non-final Office Action for U.S. Appl. No. 11/547,764 dated Jan. 9, 2012.

Response to Office Action filed Feb. 6, 2012 regarding U.S. Appl. No. 11/547,764.

Supplemental Response to Office Action filed Apr. 5, 2012 regarding U.S. Appl. No. 11/547,764.

USPTO; Final Office Action for U.S. Appl. No. 11/547,764 dated Apr. 13, 2012.

Response to Office Action filed Aug. 13, 2012 regarding U.S. Appl. No. 11/547,764.

USPTO; Advisory Action for U.S. Appl. No. 11/547,764 dated Aug. 22, 2013.

Response to Office Action filed Oct. 12, 2012 regarding U.S. Appl. No. 11/547,764.

USPTO; Non-final Office Action for U.S. Appl. No. 11/547,764 dated Sep. 24, 2013.

Response to Office Action filed Jan. 22, 2014 regarding U.S. Appl. No. 11/547,764.

Preliminary Amendment in U.S. Appl. No. 13/226,353 dated Mar. 1, 2013.

Preliminary Amendment in U.S. Appl. No. 13/855,328 dated Apr. 2, 2013.

USPTO; Non-final Office Action for U.S. Appl. No. 13/783,125 dated Nov. 5, 2013.

Rupar et al., "Two Novel Strains of *Bacillus thuringiensis* Toxic to Coleopterans," *Applied and Environmental Microbiology* 57(11):3337-3344, 1991.

Von Tersch et al., "Membrane-Permeabilizing Activities of *Bacillus thuringiensis* Coleopteran-Active Toxin CryIIIB2 and CryIIIB2 Domain I Peptide," *Applied and Environmental Microbiology* 60(10):3711-3717, 1994.

Moellenbeck et al., "Insecticidal proteins from *Bacillus thuringiensis* protect corn from corn rootworms," *Nature Biotechnology* 19:668-672, 2001.

Herman et al., "Binary Insecticidal Crystal Protein from *Bacillus thuringiensis*, Strain PS149B1: Effects of Individual Protein Components and Mixtures in Laboratory Bioassays," *Journal of Economic Entomology* 95(3):635-639, 2002.

Ellis et al., "Novel *Bacillus thuringiensis* Binary Insecticidal Crystal Proteins Active on Western Corn Rootworm, *Diabrotica virgifera virgifera* LeConte," *Applied and Environmental Microbiology* 68(3):1137-1145, 2002.

Lewis et al., "Distinct roles of the homeotic genes Ubx and abd-A in beetle embryonic abdominal appendage development," *PNAS* 97(9):4504-4509, 2000.

Snippy et al., "Analysis of *maxillopedia* Expression Pattern and Larval Cuticular Phenotype in Wild-Type and Mutant Triboliumm," *Genetics* 155:721-731, 2000.

Response to Office Action regarding European Patent Application 05777174.3, dated Feb. 17, 2009.

Soller et al., "Prediction of synergistic multi-compound mixtures—A generalized Colby approach," *Crop Protection* 42:180-185, 2012.

MacIntosh et al., "Specificity and Efficacy of Purified *Bacillus thuringiensis* Proteins against Agronomically Important Insects," *Journal of Invertebrate Pathology* 56:258-266, 1990.

Donovan et al., "Characterization of Two Genes Encoding *Bacillus thuringiensis* Insecticidal Crystal Proteins Toxic to *Celeoptera* Species," *Applied and Environmental Microbiology* 58(12):3921-3927, 1992.

Response to Office Action regarding European Patent Application 05777174.3, dated Mar. 29, 2010.

Response to Office Action regarding European Patent Application 05777174.3, dated Apr. 29, 2011.

Roush, "Two-toxin strategies for management of insecticidal transgenic crops: can pyramiding succeed where pesticide mixtures have not?," *Phil Trans R Soc Lond B* 353:1777-1786, 1998.

Campbell et al., "Engineering pathogen resistance in crop plants," *Transgenic Research* 11:599-613, 2002.

Communication of a Notice of Opposition regarding European Patent Application 05777174.3, dated Aug. 13, 2014, enclosing oppositions filed by Syngenta Crop Protection AG (filed on Aug. 6, 2014) and John Gerard Leeming (filed Aug. 6, 2014).

Response to Advisory Action regarding U.S. Appl. No. 11/547,764, dated Aug. 11, 2014.

USPTO: Advisory Action regarding U.S. Appl. No. 11/547,764, dated Aug. 20, 2014.

Response to Advisory Action regarding U.S. Appl. No. 11/547,764, dated Sep. 4, 2014.

USPTO: Notice of Allowance and Fees Due regarding U.S. Appl. No. 11/547,764, dated Sep. 15, 2014.

Response to Advisory Action regarding U.S. Appl. No. 13/783,125, dated Oct. 3, 2014.

Response to Final Office Action regarding U.S. Appl. No. 11/547,764, dated Jun. 11, 2014.

Declaration of James Roberts, Ph.D. Under 37 C.F.R. § 1.132, dated Jun. 9, 2014.

USPTO: Advisory Action regarding U.S. Appl. No. 11/547,764, dated Jun. 25, 2014.

Examination report issued in Argentina Application No. P050101401 on Apr. 21, 2014.

Response to Final Office Action regarding U.S. Appl. No. 13/783,125, dated Jul. 18, 2014.

Declaration of James Roberts, Ph.D. Under 37 C.F.R. § 1.132, filed Jul. 18, 2014.

(56) References Cited

OTHER PUBLICATIONS

USPTO: Advisory Action regarding U.S. Appl. No. 13/783,125, issued Jul. 25, 2014.
Examination report issued in Ecuador Application No. SP-06-6908 on Jun. 2, 2014.
Baum et al., "Progress Towards RNAi-Mediated Insect Pest Management," *Advances in Insect Physiology* 47:249-295, 2014.
USPTO: Final Office Action issued in U.S. Appl. No. 13/783,125, mailed Aug. 3, 2015.
U.S. Appl. No. 12/973,783, filed Dec. 20, 2010, Baum et al.
Beegle et al., "Invitation paper (CP Alexander Fund): history of bacillus thuringiensis Berliner Research and Development," *Can. Entomol.*, 124:587-616, 1992.
Dalmay et al., "An RNA-dependent RNA polymerase gene in Arabidopsis is required for posttranscriptional gene silencing mediated by a transgene but not by a virus," *Cell*, 101:543-553, 2000.
Database EMBL, "*Drosophila melanogaster* RE24065 full length cDNA," Database accession No. AY071192, 2001.
Dow et al., "Molecular genetic analysis of V-ATPase function in *Drosophila melanogaster*," *J. Exp. Biol.*, 200(Pt. 2):237-245, 1997.
Dow, "The multifunctional *Drosophila melanogaster* V-ATPase is encoded by a multigene family," *J. Bioenerg. Biomembr.*, 31(1):75-83, 1999.
Elbashir et al., "Analysis of gene function in somatic mammalian cells using small interfering RNAs," *Methods*, 26(2):199-213, 2002.
Elbashir et al., "RNA interference is mediated by 21- and 22-nucleotide RNAs," *Genes Dev.*, 15:188-200, 2001.
Feitelson et al., "Bacilhus thuringiensis: insects and beyond," *Bio/Technology*, 10:271-275, 1992.
Feitelson, "The bacillus thuringiensis family tree," In: Advanced Engineered Pesticides, Kim Ed., Marcel Dekker, Inc., New York, NY, pp. 63-71,1993.
Fire, RNA-triggered gene silencing , *Trends in Genetic, Elsevier Science Publishers* 15(9):358-363(1999).
GenBank Accession No. AF008922, dated Jun. 17, 1997.
GenBank Accession No. AM048926, dated Jul. 16, 2005.
GenBank Accession No. AY166605, dated Dec. 10, 2008.
GenBank Accession No. L09234, dated Jun. 12, 1993.
GenPept Accession No. NP_001682, dated May 10, 2002.
GenPept Accession No. Q4GXU7, dated Nov. 28, 2006.
Gill et al., "Isolation of the V-ATPase A and c subunit cDNAs from mosquito midgut and malpighian tubules," *Archives of Insect Biochemistry and Physiology*, 37:80-90, 1998.
Gill et al., "The mode of action of bacillus thuringiensis endotoxins,"*Annu. Rev. Entomol.*, 37:615-636, 1992.
Graf et al., Cloning and sequencing of cDNA encoding the putative insect plasma membrane V-ATPase subunit A, *FEBS Letters* 300(2):119-122, 1992.
Hamilton et al., "A species of small antisense RNA in post-transcriptional gene silencing in plants," *Science*, 286(5441):950-952, 1999.
Hofmann et al., "Specificity of B. thuringiensis delta-endotoxins is correlated with the presence of high-affinity binding sites in the brush border membrane of target insect midguts," *Proc. Natl. Acad. Sci. USA*, 85:7844-7848, 1988.
Kennerdell et al., "Heritable gene silencing in *Drosophila* using double-stranded RNA," *Nat. Biotechnol.*, 18:896-898, 2000.
Kennerdell et al., "Use of dsRNA-mediated genetic interference to demonstrate that frizzled and frizzled 2 act in the wingless pathway," *Cell*, 95:1017-1026, 1998.
Lamberton, J.S. et al., "Varying the nucleic acid composition of siRNA molecules dramatically varies the duration and degree of gene silencing," *Molecular Biotechnology*, 24(2):111-119(2003).
Manocharan M, Oligonucleotide conjugates as potential antisense drugs with improved uptake, biodistribution, targeted delivery, and mechanism of action, *Antisense & Nucleic Acid Drug Development* 12:103-128(2002).
Montgomery et al., Double-stranded RNA as a mediator in sequence-specific genetic, silencing and co-suppression, *Trends in Genetics, Elsevier Science Publishers* 14(7):255-258(1998).
Mourrain et al., "Arabidopsis SGS2 and SGS3 genes are required for posttranscriptional gene silencing and natural virus resistance," *Cell*, 101:533, 2000.

NCBI Accession No. AW671389, dated Jul. 19, 2000.
NCBI Accession No. U29488, dated Jun. 28, 2001.
New England Biolabs Catalog, 1996/1997, p. 111, undated.
Peragine et al., "SGS3 and SGS2/SDE1/RDR6 are required for juvenile development and the production of trans-acting siRNAs in Arabidopsis," *Genes Dev.*, 18(19):2368-2379, 2004.
Rajagopal et al., "Silencing of midgut aminopeptidase N of Spodoptera litura by double-stranded RNA establishes its role as Bacillus thuringiensis toxin receptor," *J. Biol. Chem.*, 277:46849-46851, 2002.
Soares, C et al., "Capillary feeding of specific dsRNA induces silencing of ISAC gene in nymphal ixodes scapularis ticks," *Insect Molecular Biology* 14:(4):443-452(2005).
Tabara et al., "RNAi in C. elegans: soaking in the genome sequence," *Science*, 282(5388):430-431, 1998.
Tabashnik, "Evaluation of synergism among Bacillus thuringiensis toxins," *Appl. Environ. Microbiol.*, 58(10):3343-3346, 1992.
Timmons et al., Specific interference by ingested dsRNA, *Nature, Macmillan Journals Ltd.*, 395(6705):854(1998).
Titarenko et al., cDNA cloning biochemical characterization and inhibition by plant inhibitors of the alpha-amylases of the Western corn rootworm, Diabrotica virgifera virgifera, *Insect Biochemistry and Molecular Biology*, 30(10):979-990, 2000.
Van Rie et al., "Receptors on the brush border membrane of the insect midgut as determinants of the specificity of bacillus thuringiensis delta-endotoxins," *Appl. Environ. Microbiol.*, 56(5):1378-1385, 1990.
Van Rie et al., "Specificity of bacillus thuringiensis δ-endotoxins," *Eur. J. Biochem.*, 186:239-247, 1989.
Vazquez et al., "Endogenous trans-acting siRNAs regulate the accumulation of Arabidopsis mRNAs," *Mol. Cell*, 16(1):69-79, 2004.
Yadav et al., "Host-generated double stranded RNA induces RNAi in plant-parasitic nematodes and protects the host from infection," *Molec. Biochem. Parasitol.*, 148(2):219-222, 2006.
Non-Final Office Action regarding U.S. Appl. No. 13/783,125, dated Dec. 18, 2014.
Database EMBL, "Xenopus laevis coatomer protein complex, subunit beta 2 (beta prime), mRNA (cDNA clone MGC:53629 IMAGE:4724864), complete cds", Database accession No. BC041755, 2003.
Database EMBL,"ACAH-aaa65d11.g1 Hydra_EST_UCI-10 Hydra magnipapillata cDNA 5' similar to gb|AAH41755.1|Similar to coatomer protein complex, subunit beta 2 (beta prime) [Xenopus laevis], mRNA sequence", Database accession No. DT616329, 2005.
Database EMBL,"ID0AAA22AE01RM1 ApMS Acyrthosiphon pisum cDNA clone ID0AAA22AE01 5', mRNA sequence", Database accession No. CN758397, 2004.
Database EMBL, "Platyamoeba placidactin mRNA, partial cds", Database accession No. AY294153, 2003.
Database EMBL,"*Homo sapiens* coatomer protein complex, subunit beta, mRNA (cDNA clone IMAGE:4105407), with apparent retained intron", Database accession No. BC012572, 2001.
Geneseq Accession No. ADM97371, dated Jul. 1, 2004.
Geneseq Accession No. ABH49620, dated Feb. 22, 2002.
Geneseq Accession No. ABH11708, dated Feb. 22, 2002.
Geneseq Accession No. ACL42115, dated Mar. 25, 2005.
Geneseq Accession No. AEC05831, dated Nov. 3, 2005.
Geneseq Accession No. ADW86626, dated Apr. 21, 2005.
Geneseq Accession No. AFU05583, dated May 1, 2008.
Search Report and Opinion regarding European Application No. 11191393.5, dated Feb. 16, 2012.
Search Report and Opinion regarding European Application No. 11191399.2, dated Feb. 2, 2012.
Search Report and Opinion regarding European Application No. 11191400.8, dated Mar. 12, 2012.
Search Report and Opinion regarding European Application No. 11191405.7, dated Mar. 12, 2012.
Response to Final Office Action regarding U.S. Appl. No. 13/783,125, filed Oct. 21, 2015.
USPTO: Advisory Action regarding U.S. Appl. No. 13/783,125, mailed Oct. 28, 2015, 2015.
Supplemental Response to Final Office Action regarding U.S. Appl. No. 13/783,125, filed Dec. 2, 2015.

\* cited by examiner

US 9,238,822 B2

COMPOSITIONS AND METHODS FOR CONTROL OF INSECT INFESTATIONS IN PLANTS

CROSS REFERENCE TO RELATED APPLICATIONS

This application is a continuation of co-pending U.S. application Ser. No. 11/547,764, filed Oct. 6, 2006, which is a 35 U.S.C. 371 National Stage Entry of PCT/US05/11816, filed Apr. 8, 2005, which claims priority to US Provisional Applications 60/560,842, filed Apr. 9, 2004, 60/565,632, filed Apr. 27, 2004, 60/579,062, filed Jun. 11, 2004, 60/603,421, filed Aug. 20, 2004, 60/617,261, filed Oct. 11, 2004, and Ser. No. 60/669,175, filed Apr. 7, 2005, each incorporated herein by reference in its entirety.

FIELD OF THE INVENTION

The present invention relates generally to genetic control of pest infestations in plants and in and on animals. More specifically, the present invention relates to the methods for modifying endogenous expression of coding sequences in the cell or tissue of a particular pest. More specifically, the present invention utilizes recombinant DNA technologies to post-transcriptionally repress or inhibit expression of a target coding sequence in the cell of a pest, by feeding to the pest one or more double stranded or small interfering ribonucleic acid (RNA) molecules transcribed from all or a portion of a target coding sequence, thereby controlling the infestation. Therefore, the present invention relates to sequence-specific inhibition of expression of coding sequences using double-stranded RNA (dsRNA) or small interfering RNA (siRNA) to achieve the intended levels of pest control.

Novel isolated and substantially purified nucleic acid molecules including but not limited to non-naturally occurring nucleotide sequences and recombinant DNA constructs for transcribing the dsRNA or siRNA molecules of the present invention are also provided that suppress or inhibit the expression of an endogenous coding sequence or a target coding sequence in the pest when introduced thereto. Transgenic plants that (a) contain nucleotide sequences encoding the isolated and substantially purified nucleic acid molecules and the non-naturally occurring recombinant DNA constructs for transcribing the dsRNA or siRNA molecules for controlling plant pest infestations, and (b) display resistance and/or enhanced tolerance to the insect infestations, are also provided. Compositions containing the dsRNA nucleotide sequences of the present invention for use in topical applications onto plants or onto animals or into the environment of an animal to achieve the elimination or reduction of pest infestation are also described.

BACKGROUND OF THE INVENTION

The environment in which humans live is replete with pest infestation. Pests including insects, arachnids, crustaceans, fungi, bacteria, viruses, nematodes, flatworms, roundworms, pinworms, hookworms, tapeworms, trypanosomes, schistosomes, botflies, fleas, ticks, mites, and lice and the like are pervasive in the human environment, and a multitude of means have been utilized for attempting to control infestations by these pests. Compositions for controlling infestations by microscopic pests such as bacteria, fungi, and viruses have been provided in the form of antibiotic compositions, antiviral compositions, and antifungal compositions. Compositions for controlling infestations by larger pests such as nematodes, flatworm, roundworms, pinworms, heartworms, tapeworms, trypanosomes, schistosomes, and the like have typically been in the form of chemical compositions which can either be applied to the surfaces of substrates on which pests are known to infest, or to be ingested by an infested animal in the form of pellets, powders, tablets, pastes, or capsules and the like. The present invention is directed to providing an improved means for controlling pest infestation compared to the compositions known in the art.

Commercial crops are often the targets of insect attack. Substantial progress has been made in the last a few decades towards developing more efficient methods and compositions for controlling insect infestations in plants. Chemical pesticides have been very effective in eradicating pest infestations. However, there are several disadvantages to using chemical pesticidal agents. Chemical pesticidal agents are not selective. Applications of chemical pesticides are intended to control invertebrate pests that are harmful to various crops and other plants. However, because of the lack of selectivity, the chemical pesticidal agents exert their effects on non-target fauna as well, often effectively sterilizing a field for a period of time over which the pesticidal agents have been applied. Chemical pesticidal agents persist in the environment and generally are slow to be metabolized, if at all. They accumulate in the food chain, and particularly in the higher predator species. Accumulations of these chemical pesticidal agents results in the development of resistance to the agents and in species higher up the evolutionary ladder, act as mutagens and/or carcinogens often causing irreversible and deleterious genetic modifications. Thus there has been a long felt need for environmentally friendly methods for controlling or eradicating insect infestation on or in plants, i.e., methods which are selective, environmentally inert, non-persistent, and biodegradable, and that fit well into pest resistance management schemes.

Compositions that include *Bacillus thuringiensis* (B.t.) bacteria have been commercially available and used as environmentally safe and acceptable insecticides for more than thirty years. The insecticidal effect of Bt bacteria arises as a result of proteins that are produced exclusively by these bacteria that do not persist in the environment, that are highly selective as to the target species affected, exert their effects only upon ingestion by a target pest, and have been shown to be harmless to plants and other non-targeted organisms, including humans. Transgenic plants containing one or more genes encoding insecticidal B.t. protein are also available in the art and are remarkably efficient in controlling insect pest infestation. A substantial result of the use of recombinant plants expressing Bt insecticidal proteins is a marked decrease in the amount of chemical pesticidal agents that are applied to the environment to control pest infestation in crop fields in areas in which such transgenic crops are used. The decrease in application of chemical pesticidal agents has resulted in cleaner soils and cleaner waters running off of the soils into the surrounding streams, rivers, ponds and lakes. In addition to these environmental benefits, there has been a noticeable increase in the numbers of beneficial insects in crop fields in which transgenic insect resistant crops are grown because of the decrease in the use of chemical insecticidal agents.

The adventitious use of recombinant plants expressing an insecticidal crystal protein toxin has strengthened the concern about the spontaneous development of resistance to the toxin in the target pest population. One means for delaying or eliminating the onset of resistance in the pest population is to combine the recombinant toxin with a second means for controlling the pests in which the second means exerts its effects through a different mode of action in comparison to the recombinant toxin. One means for deploying two or more toxins would be to incorporate a seed treatment containing some insecticidal composition that is effective at very low doses and which infuses into the soil or into the growing recombinant plant after sprouting. This means has been shown to be effective and economical, but has the disadvantage of subjecting the environment to a chemical pesticide that may accumulate in the food chain and that may persist in the environment. Another means would be to deploy a recombinant plant that expresses at least two different insecticidal toxins, each toxin being toxic to the same insect pest, and each toxin exerting its effects through a different mode of action. In the short term this second approach is cost effective and likely sufficient to delay the development of resistance in the pest population. However, there may be at least two disadvantages to this approach as well. One disadvantage is that any development of resistance to one of the insecticidal toxins deployed into the environment of the pest immediately increases the likelihood that resistance could develop sooner than anticipated to a second or even a third toxin. Also, there is a limited number of insecticidal crystal protein toxins that are toxic to the same insect pest that are available for use that, when combined with another insecticidal protein, would fall within the defined scope of exerting its effects through a different mode of action than toxins presently in use. Therefore, additional compositions and methods for controlling pest infestation are needed, and in particular, methods and compositions are needed for use in delaying or minimizing the development of resistance to present pest control agents.

Chemical pesticidal agents typically exert their effects by inhibiting one or more proteins within the target pest either by binding irreversibly to an active site within a particular protein, by inhibiting the protein from acting upon a naturally occurring substrate, or by poisoning a respiratory or chemical gradient pathway. Recombinant methods and compositions have typically targeted cell membrane systems by producing proteins that, upon ingestion by a pest, introduce pores that result in the loss of chemical or other gradients across disrupted cell membranes. Other than chemical compositions that directly exert their effects upon proteins involved in transcription or translation mechanisms, no method has been reported for controlling pest infestation by inhibiting in the target pest the production of essential proteins through RNA mediated interference by providing one or more double stranded RNA molecules in the diet of the pest.

Antisense methods and compositions have been reported in the art and are believed to exert their effects through the synthesis of a single-stranded RNA molecule that in theory hybridizes in vivo to a substantially complementary sense strand RNA molecule. It is believed that the antisense methods function in much the same way as double stranded RNA mediated interference methods are believed to function, except that the effectiveness of the antisense response is often substantially less than desirable, intermittent, or not evident at all. Furthermore, there has never been a report in which antisense was contemplated as a means for suppressing expression of a gene in a cell remote from the cell or biological system in which the antisense sequence was expressed. Antisense technology has only been applied as a means for achieving gene-specific interference of expression within the cell or biological system in which the antisense sequence is expressed. Antisense technology has been difficult to employ in many systems for three principle reasons. First, the antisense sequence expressed in the transformed cell is unstable. Second, the instability of the antisense sequence expressed in the transformed cell concomitantly creates difficulty in delivery of the sequence to a host, cell type, or biological system remote from the transgenic cell. Third, the difficulties encountered with instability and delivery of the antisense sequence create difficulties in attempting to provide a dose within the recombinant cell expressing the antisense sequence that can effectively modulate the level of expression of the target sense nucleotide sequence.

The phenomenon of double-stranded RNA (dsRNA) induced silencing has been known for a number of years in plant systems. One form of dsRNA induced silencing is referred to as co-suppression and as virus-induced gene silencing (VIGS) and is reviewed in Matzke et al. (Adv. Genet., 2002, 46:235-275). Co-suppression and VIGS effects in recombinant plant systems were observed but unexplained before dsRNA was identified in animal systems as the trigger for induction of the evolutionarily conserved mechanism of gene suppression. Guo et al. first observed that the use of sense RNA as a control was as effective as antisense RNA in specific silencing of a targeted gene in *C. elegans* (Guo et al., 1995, Cell 81:611-620). Fire et al. suspected that the single stranded RNA preparations used by Guo et al. were contaminated with dsRNA, and subsequently demonstrated that dsRNA was a much more potent trigger than single stranded RNA for achieving gene specific silencing. The observations by Fire et al. distinguished the physical attribute of double stranded RNA suppression from antisense suppression (Fire et al., 1998, Nature 391:806-811). It is believed that the post-transcriptional gene silencing effects observed in plants (Jorgensen, 1990, Trends Biotechnol. 8:340-344) and the quelling effect in fungi (Romano et al., 1992, Mol. Microbiol. 6:3343-3353; Bernstein et al., 2001, RNA 7:1509-1521) using single stranded RNA is a result of contamination of samples with double stranded RNA sequences (Dykxhoorn et al., 2003, Nature Reviews 4:457-467; Hannon et al., 2002, Nature 418:244-251). It is now clear, however, that double stranded RNA mediated inhibition of gene expression, co-suppression, and virus-induced gene silencing are triggered by dsRNA and operate by similar mechanisms (Stevenson, 2003, Nature Reviews 3:851-858; Bernstein et al., 2001, RNA 7:1509-1521).

The lack of understanding of the specific mechanisms involved in these phenomena has meant that there have been few improvements in technologies for modulating the level of gene expression within a cell, tissue, or organism, and in particular, a lack of developed technologies for delaying, repressing or otherwise reducing the expression of specific genes using recombinant DNA technology. Furthermore, as a consequence of the unpredictability of these approaches, no commercially viable means for modulating the level of expression of a specific gene in a eukaryotic or prokaryotic organism is available.

Double stranded RNA mediated inhibition of specific genes in various pests has been previously demonstrated. dsRNA mediated approaches to genetic control have been tested in the fruit fly *Drosophila melanogaster* (Tabara et al., 1998, Science 282:430-431). Tabara et. al. describe a method for delivery of dsRNA involved generating transgenic insects that express double stranded RNA molecules or injecting dsRNA solutions into the insect body or within the egg sac prior to or during embryonic development. Research investigators have previously demonstrated that double stranded RNA mediated gene suppression can be achieved in nematodes either by feeding or by soaking the nematodes in solutions containing double stranded or small interfering RNA molecules and by injection of the dsRNA molecules. Rajagopal et. al. described failed attempts to suppress an endogenous gene in larvae of the insect pest *Spodoptera litura* by feeding or by soaking neonate larvae in solutions containing dsRNA specific for the target gene, but was successful in suppression after larvae were injected with dsRNA into the hemolymph of 5$^{th}$ instar larvae using a microapplicator (J. Biol. Chem., 2002, 277:46849-46851). Similarly, Mesa et al. (US 2003/0150017) prophetically described a preferred locus for inhibition of the lepidopteran larvae *Helicoverpa armigera* using dsRNA delivered to the larvae by ingestion of a plant transformed to produce the dsRNA. It is believed that it would be impractical to provide dsRNA molecules in the diet of most invertebrate pest species or to inject compositions containing dsRNA into the bodies of invertebrate pests. The diet method of providing dsRNA molecules to invertebrate pests is impractical because RNA molecules, even stabilized double stranded RNA molecules, are in effect highly unstable in mildly alkaline or acidic environments such as those found in the digestive tracts of most invertebrate pests, and easily degraded by nucleases in the environment. Therefore it is unlikely that feeding dsRNA to a lepidopteran larvae having a digestive tract pH in the extreme alkaline range would result in the suppression of any gene within the cells of the larvae. It would also be impractical to formulate compositions containing dsRNA molecules, such as recombinant bacteria expressing such dsRNA molecules, as a food source for nematodes, that could be applied to broad expanses of soil to control invertebrate pest infestations of crop plants.

Therefore, there exists a need for improved methods of modulating gene expression by repressing, delaying or otherwise reducing gene expression within a particular invertebrate pest for the purpose of controlling pest infestation or to introduce novel phenotypic traits.

SUMMARY OF THE INVENTION

The present invention, in one embodiment, comprises a method of inhibiting expression of a target gene in an invertebrate pest. Specifically, the present invention comprises a method of modulating or inhibiting expression of one or more target genes in an invertebrate pest, in particular, in Western corn rootworm (WCR, *Diabrotica virgifera* virgifera LeConte) and the like, that cause cessation of feeding, growth, development, reproduction and infectivity and eventually result in the death of the insect. The method comprises introduction of partial or fully, stabilized double-stranded RNA (dsRNA) or its modified forms such as small interfering RNA (siRNA) sequences, into the cells or into the extracellular environment, such as the midgut, within an invertebrate pest body wherein the dsRNA or siRNA enters the cells and inhibits expression of at least one or more target genes and wherein inhibition of the one or more target genes exerts a deleterious effect upon the invertebrate pest. It is specifically contemplated that the methods and compositions of the present invention will be useful in limiting or eliminating invertebrate pest infestation in or on any pest host, pest symbiont, or environment in which a pest prefers by providing one or more compositions comprising dsRNA molecules in the diet of the pest so long as the pest digestive system pH is within the range of from about 4.5 to about 9.5, from about 5 to about 9, from about 6 to about 8, and from about pH 7.0.

The present application discloses an exemplary sequence listing containing the both the nucleotide and amino acid sequences from Western Corn Rootworm (WCR, *Diabrotica virgifera*), as set forth in SEQ ID NO:1 through SEQ ID NO:40746, and from other coleopteran insects including Colorado Potato Beetle (CPB, *Leptinotarsa decemlineata*) and Red Flour Beetle (RFB, *Tribolium castaneum*), from lepidopteran insects including European Corn Borer (ECB, *Ostrinia nubilalis*), Black Cutworm (BCW, *Agrotis ipsilon*), Corn Earworm (CEW, *Helicoverpa zea*), Fall Armyworm (FAW, *Spodoptera frugiperda*), Cotton Ball Weevil (BWV, *Anthonomus grandis*), silkworms (*Bombyx mori*) and *Manduca sexta* and from Dipteran insects including *Drosophila melanogaster*, *Anopheles gambiae*, and *Aedes aegypti*, as set forth in SEQ ID NO:40747 through SEQ ID NO:40771. The sequence listing is included along with the paper copy of this application on one CD-ROM diskette.

The computer readable form at file corresponding to the sequence listing is labeled as SeqListing.TXT and contains the sequence listing information for corn rootworm Unigene sequences and EST sequences (SEQ ID NO:1 through SEQ ID NO:20303 and SEQ ID NO:40701 through SEQ ID NO:40746), corn rootworm specific probe sequences, primer sequences, amplicon sequences, and sequences encoding double stranded RNA sequences (SEQ ID NO:40607 through SEQ ID NO:40700) and the v-ATPase and ribosomal protein L19 orthologs from other insects as described above (SEQ ID NO:40747 through SEQ ID NO:40771).

The present invention provides a method for suppression of gene expression in an invertebrate pest such as a corn rootworm or related species comprises the step of providing in the diet of the pest a gene suppressive amount of at least one dsRNA molecule transcribed from a nucleotide sequence as set forth in SEQ ID NO:1 through SEQ ID NO:20303, SEQ ID NO:40701 through SEQ ID NO:40746 and SEQ ID NO:40607 through SEQ ID NO:40700 in the sequence listing, at least one segment of which is complementary to an mRNA sequence formed within the cells of the pest, and observing the death, inhibition, stunting, or cessation of feeding of the pest.

In another aspect of the present invention, the method comprises the step of feeding to the pest one (or more) stabilized dsRNA molecules or its modified form such as an siRNA molecule the nucleotide sequence of which is at least from about 80, 81, 82, 83, 84, 85, 86, 87, 88 89, 90, 91, 92, 93, 94, 95, 96, 97, 98, 99, or about 100% identical to an RNA molecule transcribed from a nucleotide sequence selected from the group consisting of SEQ ID NO:1 through SEQ ID NO:20303, SEQ ID NO:40701 through SEQ ID NO:40746, and SEQ ID NO:40607 through SEQ ID NO:40700.

Accordingly, in another aspect of the present invention, a set of isolated and purified nucleotide sequences as set forth in SEQ ID NO:1 through SEQ ID NO:20303, SEQ ID NO:40701 through SEQ ID NO:40746, and SEQ ID NO:40607 through SEQ ID NO:40700 as set forth in the sequence listing is provided. The nucleotide sequences disclosed herein as set forth in SEQ ID NO:1 through SEQ ID NO:20303 and SEQ ID NO:40701 through SEQ ID NO:40746 were isolated and substantially purified from complementary DNA (cDNA) libraries, made from WCR insect larvae. The nucleotide sequences disclosed herein as set forth in SEQ ID NO:40607 through SEQ ID NO:40700 in the sequence listing were isolated and substantially purified from the genomic DNA of the Southern corn rootworm insect pest, or from mRNA pools isolated from the insect pest, from cDNA nucleotide sequences derived from such mRNA pools, or synthesized denovo based on nucleotide sequences disclosed herein or known in the art as T7 phage RNA polymerase promoter sequences. The present invention provides a stabilized dsRNA or siRNA molecule or the expression of one or more miRNAs for inhibition of expression of a target gene in an invertebrate pest such as a WCR insect. A stabilized dsRNA, miRNA or siRNA molecule can comprise at least two coding sequences that are arranged in a sense and an antisense orientation relative to at least one promoter, wherein the nucleotide sequence that comprises a sense strand and an antisense strand are linked or connected by a spacer sequence of at least from about five to about one thousand nucleotides, wherein the sense strand and the antisense strand are different in length, and wherein each of the two coding sequences shares at least 80% sequence identity, at least 90%, at least 95%, at least 98%, or even 100% sequence identity, to a nucleotide sequence as set forth in one of SEQ ID NO:1 through SEQ ID NO:20303, and SEQ ID NO:40701 through SEQ ID NO:40746 in the sequence listing.

The invention also provides non-naturally occurring (NNO) nucleotide sequences that may be used to target genes in the invertebrate pest for double stranded RNA mediated suppression in order to achieve desired inhibition of the target genes. Any one of the nucleotide sequences as set forth in SEQ ID NO:1 through SEQ ID NO:20303, and SEQ ID NO:40701 through SEQ ID NO:40746 or in SEQ ID NO:40607 through SEQ ID NO:40700 (CRW sequences set forth in the sequence listing) may be used to construct such a NNO nucleotide sequence.

The present invention also provides a recombinant DNA construct encoding the dsRNA molecules contemplated herein for introduction into a host cell. The recombinant DNA construct comprises a nucleotide sequence that is transcribed into RNA by the host cell. The transcribed RNA forms at least one dsRNA molecule, such that one strand of the dsRNA molecule is coded by a portion of the nucleotide sequence which is at least from about 80% to about 100% identical to a nucleotide sequence selected from the group consisting of SEQ ID NO:1 through SEQ ID NO:20303 and SEQ ID NO:40701 through SEQ ID NO:40746 and SEQ ID NO:40607 through SEQ ID NO:40700. The recombinant DNA construct is capable of producing dsRNA molecules in the host cell and inhibiting the expression of the endogenous gene or the target gene or a derivative thereof or a complementary sequence thereto in the host cell, or in a pest cell upon ingestion of the transformed host cell by an invertebrate pest. A nucleotide sequence of the present invention is placed under the control of a promoter sequence that is operable in the host cell and expressed to produce ribonucleic acid sequences that form dsRNA molecules within the host cell. The dsRNA molecules may be further processed either in the host cell or in an invertebrate pest to form siRNA molecules.

The present invention also provides a recombinant DNA sequence for plant transformation constructed to contain at least one non-naturally occurring nucleotide sequence that can be transcribed into a single stranded RNA molecule. The single stranded RNA molecule forms a double stranded RNA molecule in vivo through intermolecular hybridization that, when provided in the diet of an invertebrate pest, inhibits the expression of at least one target gene in a cell of the invertebrate pest. The non-naturally occurring nucleotide sequence is operably linked to at least one promoter sequence that functions in a transgenic plant cell to transcribe the operably linked non-naturally occurring nucleotide sequence into one or more ribonucleic acid sequences. The RNA sequences self assemble into double stranded RNA molecules and are provided in the diet of an invertebrate pest that feeds upon the transgenic plant. The provision of the dsRNA molecules in the diet of the pest achieves the desired inhibition of expression of one or more target genes within the pest.

The present invention also provides a recombinant host cell having in its genome at least one recombinant DNA sequence that is transcribed in the host cell to produce at least one dsRNA molecule that functions when ingested by an invertebrate pest to inhibit the expression of a target gene in the pest. The dsRNA molecule is coded by a portion of a nucleotide sequence that exhibits at least from about 80 to about 100% identity to a nucleotide sequence as set forth in SEQ ID NO:1 through SEQ ID NO:20303 and SEQ ID NO:40701 through SEQ ID NO:40746 or SEQ ID NO:40607 through SEQ ID NO:40700 in the sequence listing. Exemplary nucleotide sequences for use in constructing dsRNA agents that target WCR genes for suppression are as set forth in SEQ ID NO:1 through SEQ ID NO:20303, SEQ ID NO:40701 through SEQ ID NO:40746 and SEQ ID NO:40607 through SEQ ID NO:40700 in the sequence listing.

The present invention also provides a recombinant DNA construct for plant transformation that consists of at least two different non-naturally occurring sequences which, when expressed in vivo as RNA sequences and provided in the diet of an invertebrate pest, inhibit the expression of at least two different target genes in the cell of the invertebrate pest. The first non-naturally occurring sequence is transcribed into RNA that forms at least one first dsRNA molecule. One portion of the first dsRNA molecule is encoded by a portion of the first non-naturally occurring sequence and exhibits at least from about 80 to about 100% identity to at least one of the nucleotide sequences as set forth in SEQ ID NO:1 through SEQ ID NO:20303, in SEQ ID NO:40701 through SEQ ID NO:40746 or in SEQ ID NO:40607 through SEQ ID NO:40700 in the sequence listing, and to the nucleotide sequence of the first target gene, derivative thereof, or sequence complementary thereto. The second non-naturally occurring sequence is transcribed into RNA that forms a second dsRNA molecule. One portion of the second dsRNA molecule is encoded by a portion of the second non-naturally occurring sequence and exhibits at least from about 80 to about 100% identity to a nucleotide sequence selected from the group as set forth in SEQ ID NO:1 through SEQ ID NO:20303, in SEQ ID NO:40701 through SEQ ID NO:40746 and in SEQ ID NO:40607 through SEQ ID NO:40700 in the sequence listing and to the nucleotide sequence of the second target gene, derivative thereof, or sequence complementary thereto. The two non-naturally occurring sequences are placed operably under the control of at least one promoter sequence. The promoter sequence functions to express the first and second dsRNA molecules in the transgenic plant cell. The dsRNA molecules are provided in a pest inhibitory concentration in the diet of an invertebrate pest feeding on the transgenic plant, and ingestion of plant cells by the pest achieves the desired inhibition of expression of the target genes in the pest.

The present invention also provides a transformed plant cell having in its genome at least one of the aforementioned recombinant DNA sequences for plant transformation. Transgenic plants are generated from the transformed plant cell, and progeny plants, seeds, and plant products, each comprising the recombinant DNA, are produced from the transgenic plants.

The methods and compositions of the present invention may be applied to any monocot and dicot plant, depending on the invertebrate pest control desired, or may be applied to through pharmaceutically acceptable formulations to vertebrate animals in order to provide some level of reduction of invertebrate pest infestation. Specifically, the plants are intended to comprise without limitation alfalfa, aneth, apple, apricot, artichoke, arugula, asparagus, avocado, banana, barley, beans, beet, blackberry, blueberry, broccoli, brussel sprouts, cabbage, canola, cantaloupe, carrot, cassava, cauliflower, celery, cherry, cilantro, citrus, clementine, coffee, corn, cotton, cucumber, Douglas fir, eggplant, endive, escarole, eucalyptus, fennel, figs, gourd, grape, grapefruit, honey dew, jicama, kiwifruit, lettuce, leeks, lemon, lime, Loblolly pine, mango, melon, mushroom, nut, oat, okra, onion, orange, an ornamental plant, papaya, parsley, pea, peach, peanut, pear, pepper, persimmon, pine, pineapple, plantain, plum, pomegranate, poplar, potato, pumpkin, quince, radiata pine, radicchio, radish, raspberry, rice, rye, sorghum, Southern pine, soybean, spinach, squash, strawberry, sugarbeet, sugarcane, sunflower, sweet potato, sweetgum, tangerine, tea, tobacco, tomato, turf, a vine, watermelon, wheat, yams, and zucchini plants.

The present invention also provides a pest control agent comprising a dsRNA molecule transcribed from a nucleotide sequence of the present invention. The nucleotide sequence shares at least from about 80 to about 100% sequence identity to at least one of the nucleotide sequences as set forth in SEQ ID NO:1 through SEQ ID NO:20303, in SEQ ID NO:40701 through SEQ ID NO:40746 or in SEQ ID NO:40607 through SEQ ID NO:40700 in the sequence listing. In one form, the pest control agents comprise dsRNA molecules. In another form, the pest control agents comprise siRNA molecules. In still another form, the pest control agents comprise recombinant DNA sequences that encode mRNA molecules that form the dsRNA or siRNA molecules for introduction into plants and microbes. In yet another form, the pest control agents are microbes that contain recombinant DNA sequences that encode the RNA molecules that form the dsRNA or siRNA molecules. The pest control agent is preferably an insect or a nematode pest control agent.

It is intended that the pest control agent act to reduce or eliminate infestation of a corn rootworm, but it is also contemplated that the methods and compositions set forth herein are capable of being utilized to derive related sequences from other pests and utilize those derivatives for controlling infestation of the other pest(s). It is further contemplated that the insect pest may be selected from any genus, family, or order of insect. For corn rootworms, it is contemplated that the pest be selected from the same genus, same family, or order to which a corn rootworm belongs. Further, the present inventors contemplate that the present invention may be used and applied to control any species from the insect kingdom and from nematodes, fungal pathogens, virus, bacteria and any other invertebrate plant pests.

The invention also provides combinations of methods and compositions for controlling invertebrate pest infestations. One means provides the dsRNA methods and compositions described herein for protecting plants from insect infestation along with one or more insecticidal agents that exhibit features different from those exhibited by the dsRNA methods and compositions. For example, when Bt proteins are provided in the diet of insect pests a mode of action for controlling the insect pest is exhibited that is dramatically different from the mode of action of the methods and compositions of the present invention. A composition, either formulated for topical application or one derived using a transgenic approach that combines dsRNA methods and compositions with Bt methods and compositions results in synergies that were not known previously in the art for controlling insect infestation. Transgenic plants that produce one or more dsRNA or siRNA molecules that inhibit some essential biological function in a target pest along with one or more B.t. insecticidal proteins that are toxic to the target pest provide surprising synergies. One synergy is the reduction in the level of expression required for either the dsRNA(s) or the Bt protein(s). When combined together, a lower effective dose of each pest control agent is required. It is believed that the Bt insecticidal proteins create entry pores through which the dsRNA or siRNA molecules are able to penetrate more effectively into spaces remote from the gut of the insect pest, or more efficiently into the cells in the proximity of lesions created by the Bt proteins, thus requiring less of either the Bt or the dsRNA to achieve the desired insecticidal result or the desired inhibition or suppression of a targeted biological function in the target pest.

The inventors herein describe a plurality of inventions, including a method for controlling invertebrate pest infestations by providing a diet to an invertebrate pest an agent comprising or consisting of a ribonucleic acid that functions upon ingestion by the pest to inhibit the expression of a target nucleotide sequence that is within the cells of the pest. The ribonucleic acid that is provided in the diet consists of a ribonucleotide sequence that is, or that is complementary to, the target nucleotide sequence. The ribonucleotide sequence is transcribed from a contiguous DNA sequence that is at least from about 19 to about 5000 nucleotides in length and that is selected from the group consisting of SEQ ID NO: 1 through SEQ ID NO:20303, SEQ ID NO:40701 through SEQ ID NO:40746, SEQ ID NO:40607 through SEQ ID NO:40700, and the complement thereof. The method provides for the construction of a nucleotide sequence that can be used to express an RNA molecule that can be ingested by the pest in a diet provided to the pest. The diet can be an artificial diet formulated to meet the particular nutritional requirements for maintaining a pest on such diet, and be supplemented with a pest controlling amount of the RNA that has been purified from a separate expression system, the supplementation of the diet being for the purpose of determining the pest controlling amount of the RNA composition, or determining whether one or more particular RNA's constructed specifically to bind or hybridize in part to one or more target sequences within the pest are functional in achieving some gene suppressive activity upon ingestion of the supplemented diet by the pest. The diet can also be a recombinant cell transformed with a DNA sequence constructed for expression of the agent, the RNA, or the gene suppression agent. Upon ingestion of one or more such transformed cells by the pest, a desired genotypic or phenotypic result is observed, indicating that the agent has functioned to inhibit the expression of a target nucleotide sequence that is within the cells of the pest.

The invertebrate pest is preferably an insect, an arachnid, a nematode, a platyhelminthe, an aschelminthe, a fungal pest, or any other invertebrate pest for which the gene suppression technology is amenable. More preferably, the invertebrate pest is one that is particularly problematic in terms of infestation of animals or plants. More particularly, the invertebrate pest is an insect or a nematode or a fungal pest that preferentially infests crop plants, ornamentals, and/or grasses.

A DNA sequence that is selected for use in expression of a gene suppression agent of the present invention is preferably at least about 19 to about 5000 nucleotides in length, and is at least in part substantially identical in sequence to the sense or the antisense strand of a target sequence present in the DNA of one or more particular target pest species. The phrase "at least in part" is intended to refer to the concept that the DNA sequence selected for use in expression of a gene suppression agent can be constructed from a single sequence derived from one or more target pests and intended for use in expression of an RNA that functions in the suppression of a single gene or gene family in the one or more target pests, or that the DNA sequence can be constructed as a chimera from a plurality of DNA sequences. The plurality of DNA sequences can be each be derived from one or more nucleotide sequences from within a single pest, or can be derived one or more nucleotide sequences from a plurality of different pests. In particular the selected sequence should exhibit from about 80 to about 100% nucleotide sequence identity to a nucleotide sequence from the DNA of the pest species. The DNA of the pest species can be identified by directly isolating the DNA from the pest species or by identification of RNA sequences within the pest species and reverse translating the RNA sequences to DNA. Sequences exemplifying DNA from corn rootworm pest species are set forth herein in the sequence listing as SEQ ID NO:1 through SEQ ID NO:20303, SEQ ID NO:40701 through SEQ ID NO:40746, SEQ ID NO:40607 through SEQ ID NO:40700, and the complements thereof.

The DNA sequences selected for use in expression of a gene suppressive RNA molecule can be included in a polynucleotide composition for use in a plant cell. In particular the DNA sequences can be incorporated into a vector for use in transforming the genome of a plant cell, and can be incorporated into an expression cassette containing at least a plant functional promoter operably linked to the selected DNA sequence along with any other expression control elements desired to achieve an appropriate cellular temporal or plant spatial level of expression. The introduction of the polynucleotide composition into the genome of a plant cell provides a transformed cell that can be selected, providing that appropriate selective means have been included along with the polynucleotide composition, and regenerated into a transgenic recombinant plant. The transgenic plant, an event, can be provided in the diet of the pest or pests to achieve control of a pest infestation. The transgenic plant can give rise to progeny plants, plant cells, and seeds each containing the polynucleotide composition.

The present invention provides a method for protecting a plant from insect infestation by providing to the insec pest one or more of the plants' cells each expressing a gene suppressive RNA molecule from a DNA sequence that is selected from the group consisting of the sequences exemplified herein. The ingestion of the plant cells containing the gene suppressive RNA, the pest or insect control agent, results in the inhibition of one or more biological functions in the pest or insect.

The present invention provides a composition that contains two or more different pesticidal agents each toxic to the same pest or insect species. As indicated herein, one of these pesticidal agents can be a RNA molecule that functions to suppress an essential biological function in one or more cells of the pest. A second pesticidal agent can be included along with the first. The second agent can be a second gene suppressive RNA that is different from the first, or the second agent can be an agent selected from the group consisting of a patatin, a *Bacillus thuringiensis* insecticidal protein, a *Xenorhabdus* insecticidal protein, a *Photorhabdus* insecticidal protein, a *Bacillus laterosporous* insecticidal protein, a *Bacillus sphearicus* insecticidal protein, and a lignin. A *Bacillus thuringiensis* insecticidal protein can be any of a number of insecticidal proteins including but not limited to a Cry1, a Cry3, a TIC851, a CryET70, a Cry22, a binary insecticidal protein CryET33 and CryET34, a binary insecticidal protein CryET80 and CryET76, a binary insecticidal protein TIC100 and TIC101, a binary insecticidal protein PS149B1, a VIP insecticidal protein, a TIC900 or related protein, a TIC901, TIC1201, TIC407, TIC417, and insecticidal chimeras of any of the preceding insecticidal proteins.

The gene targeted for suppression, or the function in a pest cell or as a physiological or metatabooic aspect of the pest that is enabled by the expression of the gene targeted for suppression, can encode an essential protein, the predicted function of which is selected from the group consisting of muscle formation, juvenile hormone formation, juvenile hormone regulation, ion regulation and transport, digestive enzyme synthesis, maintenance of cell membrane potential, amino acid biosynthesis, amino acid degradation, sperm formation, pheromone synthesis, pheromone sensing, antennae formation, wing formation, leg formation, development and differentiation, egg formation, larval maturation, digestive enzyme formation, haemolymph synthesis, haemolymph maintenance, neurotransmission, cell division, energy metabolism, respiration, and apoptosis. It is preferred that the DNA sequence selected for constructing the suppression construct be derived from the nucleotide sequences set forth in the sequence listing for suppression of a corn rootworm gene. It is envisioned that the method for controlling invertebrate pest infestation will include providing in the diet of the invertebrate pest an agent, for example, a first ribonucleotide sequence expressed from a first DNA sequence that functions upon ingestion by the pest to inhibit a biological function within said pest, and that the first DNA sequence exhibits from about 85 to about 100% nucleotide sequence identity to a coding sequence derived form said pest. The first ribonucleotide sequence may be hybridized to a second ribonucleotide sequence that is complimentary or substantially complimentary to the first ribonucleotide sequence, and the second ribonucleotide sequence is expressed from a second DNA sequence that corresponds to a coding sequence derived from the invertebrate pest, selected from the sequences set forth herein in the sequence listing, or the complements thereof. It is preferred that the first and the second DNA sequence comprise a contiguous sequence of identity to one or more of the sequences set forth in the sequence listing, and be from about 14 to about 25 or more contiguous nucleotides.

The invention functions at optimum when a diet containing a pest gene suppressive amount of an insecticidal agent, such as one or more RNA molecules produced from the expression of one or more sequences set forth herein in the sequence listing, are provided to an invertebrate pest that exhibits a digestive system pH that is from about 4.5 to about 9.5, or from about 5.0 to about 9.0, or from about 5.5 to about 8.5, or from about 6.0 to about 8.0, or from about 6.5 to about 7.0, or about 7.0. Any of the methods, nucleic acids, ribonucleic acids, ribonucleotide sequences, compositions, plants, plant cells, progeny plants, seeds, insect control agents, pest control agents, expression cassettes, described herein are optionally functional when provided in a diet to one or more pests that comprise such a digestive tract pH.

The diet of the present invention can be any pest sufficient diet including but not limited to an artificial diet or formulation, a plant cell, a plurality of plant cells, a plant tissue, a plant root, a plant seed, and a plant grown from a plant seed, wherein the diet comprises a pest inhibitory amount of an RNA molecule encoded from a DNA sequence that is or is complimentary to, or is substantially or is substantially complimentary to one or more contiguous at least from about 19 to about 5000 nucleotides selected from the nucleotide sequences set forth in the sequence listing, or selected from nucleotide sequences derived from a particular invertebrate pest species.

Agronomically and commercially important products and/or compositions of matter including but not limited to animal feed, commodities, and corn products and by-products that are intended for use as food for human consumption or for use in compositions and commodities that are intended for human consumption including but not limited to corn flour, corn meal, corn syrup, corn oil, corn starch, popcorn, corn cakes, cereals containing corn and corn by-products, and the like are intended to be within the scope of the present invention if these products and compositions of matter contain detectable amounts of the nucleotide sequences set forth herein as being diagnostic for any transgenic event containing such nucleotide sequences. These products are useful at least because they are likely to be derived from crops and produce that are propagated in fields containing fewer pesticides and organophosphates as a result of their incorporation of the nucleotides of the present invention for controlling the infestation of invertebrate pests in plants. Such commodities and commodity products are produced from seed produced from a transgenic plant, wherein the transgenic plant expresses RNA from one or more contiguous nucleotides of the present invention or nucleotides of one or more invertebrate pests and the compliments thereof. Such commodities and commodity products may also be useful in controlling invertebrate pests of such commodity and commodity products, such as for example, control of flour weevils, because of the presence in the commodity or commodity product of the pest gene suppressive RNA expressed from a gene sequence as set forth in the present invention.

The invention also provides a computer readable medium having recorded thereon one or more of the nucleotide sequences as set forth in SEQ ID NO:1 through SEQ ID NO:20303, in SEQ ID NO:40701 through SEQ ID NO:40746 or in SEQ ID NO:40607 through SEQ ID NO:40700 as set forth in the sequence listing, or complements thereof, for use in a number of computer based applications, including but not limited to DNA identity and similarity searching, protein identity and similarity searching, transcription profiling characterizations, comparisons between genomes, and artificial hybridization analyses.

DETAILED DESCRIPTION OF THE INVENTION

The following is a detailed description of the invention provided to aid those skilled in the art in practicing the present invention. Those of ordinary skill in the art may make modifications and variations in the embodiments described herein without departing from the spirit or scope of the present invention.

The inventors have herein discovered that, contrary to the teachings in the prior art, feeding a composition containing double stranded RNA molecules consisting of sequences found within one or more expressed nucleotide sequences of an invertebrate species to the invertebrate species from which the nucleotide sequences were obtained results in the inhibition of one or more biological functions within the invertebrate species. Particularly, the inventors have discovered that feeding double stranded RNA molecules consisting of corn rootworm RNA sequences respectively to corn rootworms or *lygus* bugs surprisingly results in the death or inhibition of development and differentiation of the corn rootworms that ingest these compositions.

The inventors have identified the nucleotide sequence of thousands of cDNA sequences obtained from each of the invertebrate pest species. Amino acid sequences as set forth in SEQ ID NO:20304 through SEQ ID NO:40606 encoded by the cDNA sequences were deduced and compared to all known amino acid sequences. Many of the cDNA sequences are predicted to encode proteins that have some annotation information associated with them. The annotation information that is associated with a particular nucleotide sequence and protein sequence encoded therefrom is based on homology or similarity between the amino acid sequences deduced through translation of the cDNA sequences described herein as set forth in SEQ ID NO:20304 through SEQ ID NO:40606 and amino acid sequences that are known in the art in publicly available databases. The deduced amino acid sequences as set forth herein were BLASTX-ed against all known amino acid sequences, and likely functionalities of each of the deduced amino acid sequences were assigned based on the alignment results. cDNA sequences encoding proteins or parts of proteins known in the art to be essential for survival, such as amino acid sequences involved in various metabolic or catabolic biochemical pathways, cell division, reproduction, energy metabolism, digestion, neurological function and the like were selected for use in preparing double stranded RNA molecules that were provided in the diet of an invertebrate pest. As described herein, ingestion by a target pest of compositions containing one or more dsRNA's, at least one segment of which corresponds to at least a substantially identical segment of RNA produced in the cells of the target pest, resulted in death, stunting, or other inhibition of the target pest. These results indicated that a nucleotide sequence, either DNA or RNA, derived from an invertebrate pest can be used to construct a recombinant pest host or symbiont that is a target for infestation by the pest. The pest host or symbiont can be transformed to contain one or more of the nucleotide sequences derived from the invertebrate pest. The nucleotide sequence transformed into the pest host or symbiont encodes one or more RNA's that form into a dsRNA sequence in the cells or biological fluids within the transformed host or symbiont, thus making the dsRNA available in the diet of the pest if/when the pest feeds upon the transgenic host or symbiont, resulting in the suppression of expression of one or more genes in the cells of the pest and ultimately the death, stunting, or other inhibition of the pest.

The present invention relates generally to genetic control of invertebrate pest infestations in host organisms. More particularly, the present invention includes the methods for delivery of pest control agents to an invertebrate pest. Such pest control agents cause, directly or indirectly, an impairment in the ability of the pest to maintain itself, grow or otherwise infest a target host or symbiont. The present invention provides methods for employing stabilized dsRNA molecules in the diet of the pest as a means for suppression of targeted genes in the pest, thus achieving desired control of pest infestations in, or about the host or symbiont targeted by the pest. Transgenic plants can be produced using the methods of the present invention that express recombinant stabilized dsRNA or siRNA molecules.

In accomplishing the foregoing, the present invention provides a method of inhibiting expression of a target gene in an invertebrate pest, and in particular, in Western corn rootworm (WCR) or other coleopteran insect species, resulting in the cessation of feeding, growth, development, reproduction, infectivity, and eventually may result in the death of the pest. The method comprises introducing partial or fully, stabilized double-stranded RNA (dsRNA) nucleotide molecules or their modified forms such as small interfering RNA (siRNA) molecules into a nutritional composition that the pest relies on as a food source, and making the nutritional composition available to the pest for feeding. Ingestion of the nutritional composition containing the double stranded or siRNA molecules results in the uptake of the molecules by the cells of the pest, resulting in the inhibition of expression of at least one target gene in the cells of the pest. Inhibition of the target gene exerts a deleterious effect upon the pest. dsRNA molecules or siRNA molecules consist of nucleotide sequences as set forth in any of SEQ ID NO:1 through SEQ ID NO:20303, SEQ ID NO:40701 through SEQ ID NO:40746 and SEQ ID NO:40607 through SEQ ID NO:40700 (sequence listing), the inhibition of which results in the reduction or removal of a protein or nucleotide sequence agent that is essential for the pests' growth and development or other biological function. The nucleotide sequence selected exhibits from about 80% to at least about 100% sequence identity to one of the nucleotide sequences as set forth in SEQ ID NO:1 through SEQ ID NO:20303, SEQ ID NO:40701 through SEQ ID NO:40746 and SEQ ID NO:40607 through SEQ ID NO:40700 as set forth in the sequence listing, or the complement thereof. Such inhibition is specific in that a nucleotide sequence from a portion of the target gene is chosen from which the inhibitory dsRNA or siRNA is transcribed. The method is effective in inhibiting the expression of at least one target gene and can be used to inhibit many different types of target genes in the pest.

The present invention also provides different forms of the pest control agents to achieve the desired reduction in pest infestation. In one form, the pest control agents comprise dsRNA molecules. In another form, the pest control agents comprise siRNA molecules. In still another form, the pest control agents comprise recombinant DNA constructs that can be used to stably transform microorganisms or plants, enabling the transformed microbes or plants to encode the dsRNA or siRNA molecules. In another form, the pest control agents are microbes that contain the recombinant DNA constructs encoding the dsRNA or siRNA molecules.

Pairs of isolated and purified nucleotide sequences are provided from cDNA library and/or genomic library information. The pairs of nucleotide sequences are derived from any preferred invertebrate pest for use as thermal amplification primers to generate the dsRNA and siRNA molecules of the present invention.

The present invention provides recombinant DNA constructs for use in achieving stable transformation of particular host or symbiont pest targets. Transformed host or symbiont pest targets express pesticidally effective levels of preferred dsRNA or siRNA molecules from the recombinant DNA constructs, and provide the molecules in the diet of the pest.

The present invention also provides, as an example of a transformed host or symbiont pest target organism, transformed plant cells and transformed plants and their progeny. The transformed plant cells and transformed plants express one or more of the dsRNA or siRNA sequences of the present invention from one or more of the DNA sequences as set forth in SEQ ID NO:1 through SEQ ID NO:20303, SEQ ID NO:40701 through SEQ ID NO:40746 and SEQ ID NO:40607 through SEQ ID NO:40700 as set forth in the sequence listing, or the complement thereof.

As used herein the words "gene suppression", when taken together, are intended to refer to any of the well-known methods for reducing the levels of protein produced as a result of gene transcription to mRNA and subsequent translation of the mRNA. Gene suppression is also intended to mean the reduction of protein expression from a gene or a coding sequence including posttranscriptional gene suppression and transcriptional suppression. Posttranscriptional gene suppression is mediated by the homology between of all or a part of a mRNA transcribed from a gene or coding sequence targeted for suppression and the corresponding double stranded RNA used for suppression, and refers to the substantial and measurable reduction of the amount of available mRNA available in the cell for binding by ribosomes. The transcribed RNA can be in the sense orientation to effect what is called co-suppression, in the anti-sense orientation to effect what is called anti-sense suppression, or in both orientations producing a dsRNA to effect what is called RNA interference (RNAi). Transcriptional suppression is mediated by the presence in the cell of a dsRNA, a gene suppression agent, exhibiting substantial sequence identity to a promoter DNA sequence or the complement thereof to effect what is referred to as promoter trans suppression. Gene suppression may be effective against a native plant gene associated with a trait, e.g., to provide plants with reduced levels of a protein encoded by the native gene or with enhanced or reduced levels of an affected metabolite. Gene suppression can also be effective against target genes in plant pests that may ingest or contact plant material containing gene suppression agents, specifically designed to inhibit or suppress the expression of one or more homologous or complementary sequences in the cells of the pest.

Post-transcriptional gene suppression by anti-sense or sense oriented RNA to regulate gene expression in plant cells is disclosed in U.S. Pat. Nos. 5,107,065, 5,759,829, 5,283,184, and 5,231,020. The use of dsRNA to suppress genes in plants is disclosed in WO 99/53050, WO 99/49029, U.S. Patent Application Publication No. 2003/0175965, 2003/0061626, and 2004/0029283, and U.S. Pat. Nos. 6,506,559, and 6,326,193.

A preferred method of post transcriptional gene suppression in plants employs both sense-oriented and anti-sense-oriented, transcribed RNA which is stabilized, e.g., as a hairpin and stem and loop structure. A preferred DNA construct for effecting post transcriptional gene suppression one in which a first segment encodes an RNA exhibiting an anti-sense orientation exhibiting substantial identity to a segment of a gene targeted for suppression, which is linked to a second segment encoding an RNA exhibiting substantial complementarity to the first segment. Such a construct would be expected to form a stem and loop structure by hybridization of the first segment with the second segment and a loop structure from the nucleotide sequences linking the two segments (see WO94/01550, WO98/05770, US 2002/0048814, and US 2003/0018993).

As used herein, the term "nucleic acid" refers to a single or double-stranded polymer of deoxyribonucleotide or ribonucleotide bases read from the 5' to the 3' end. The "nucleic acid" may also optionally contain non-naturally occurring or altered nucleotide bases that permit correct read through by a polymerase and do not reduce expression of a polypeptide encoded by that nucleic acid. The term "nucleotide sequence" or "nucleic acid sequence" refers to both the sense and anti-sense strands of a nucleic acid as either individual single strands or in the duplex. The term "ribonucleic acid" (RNA) is inclusive of RNAi (inhibitory RNA), dsRNA (double stranded RNA), siRNA (small interfering RNA), mRNA (messenger RNA), miRNA (micro-RNA), tRNA (transfer RNA, whether charged or discharged with a corresponding acylated amino acid), and cRNA (complementary RNA) and the term "deoxyribonucleic acid" (DNA) is inclusive of cDNA and genomic DNA and DNA-RNA hybrids. The words "nucleic acid segment", "nucleotide sequence segment", or more generally "segment" will be understood by those in the art as a functional term that includes both genomic sequences, ribosomal RNA sequences, transfer RNA sequences, messenger RNA sequences, operon sequences and smaller engineered nucleotide sequences that express or may be adapted to express, proteins, polypeptides or peptides.

As used herein, the term "pest" refers to insects, arachnids, crustaceans, fungi, bacteria, viruses, nematodes, flatworms, roundworms, pinworms, hookworms, tapeworms, trypanosomes, schistosomes, botflies, fleas, ticks, mites, and lice and the like that are pervasive in the human environment and that may ingest or contact one or more cells, tissues, or fluids produced by a pest host or symbiont transformed to express or coated with a double stranded gene suppression agent or that may ingest plant material containing the gene suppression agent. As used herein, a "pest resistance" trait is a characteristic of a transgenic plant, transgenic animal, transgenic host or transgenic symbiont that causes the plant, animal, host, or symbiont to be resistant to attack from a pest that typically is capable of inflicting damage or loss to the plant, animal, host or symbiont. Such pest resistance can arise from a natural mutation or more typically from incorporation of recombinant DNA that confers pest resistance. To impart insect resistance to a transgenic plant a recombinant DNA can, for example, encode an insect lethal or insect inhibitory protein such as a delta endotoxin derived from a *B. thuringiensis* bacterium, e.g. as is used in commercially available varieties of cotton and corn, or be transcribed into a RNA molecule that forms a dsRNA molecule within the tissues or fluids of the recombinant plant. The dsRNA molecule is comprised in part of a segment of RNA that is identical to a corresponding RNA segment encoded from a DNA sequence within an insect pest that prefers to feed on the recombinant plant. Expression of the gene within the target insect pest is suppressed by the dsRNA, and the suppression of expression of the gene in the target insect pest results in the plant being insect resistant. Fire et al. (U.S. Pat. No. 6,506,599) generically described inhibition of pest infestation, providing specifics only about several nucleotide sequences that were effective for inhibition of gene function in the nematode species *Caenorhabditis elegans*. Similarly, Plaetinck et al. (US 2003/0061626) describe the use of dsRNA for inhibiting gene function in a variety of nematode pests. Mesa et al. (US 2003/0150017) describe using dsDNA sequences to transform host cells to express corresponding dsRNA sequences that are substantially identical to target sequences in specific pathogens, and particularly describe constructing recombinant plants expressing such dsRNA sequences for ingestion by various plant pests, facilitating down-regulation of a gene in the genome of the pest and improving the resistance of the plant to the pest infestation.

The present invention provides for inhibiting gene expression of one or multiple target genes in a target insect using stabilized dsRNA methods. The invention is particularly useful in the modulation of eukaryotic gene expression, in particular the modulation of expression of genes present in insects that exhibit a digestive system pH level that is from about 4.5 to about 9.5, more preferably from about 5.0 to about 8.0, and even more preferably from about 6.5 to about 7.5. Plant pests with a digestive system that exhibits pH levels outside of these ranges are not preferred candidates for double stranded RNA mediated methods for gene suppression using a delivery method that requires ingestion of the preferred dsRNA molecules. The modulatory effect is applicable to a variety of genes expressed in the pests including, for example, endogenous genes responsible for cellular metabolism or cellular transformation, including house keeping genes, transcription factors and other genes which encode polypeptides involved in cellular metabolism.

As used herein, the term "expression" refers to the transcription and stable accumulation of sense or antisense RNA derived from the nucleic acids disclosed in the present invention. Expression may also refer to translation of mRNA into a polypeptide or protein. As used herein, the term "sense" RNA refers to an RNA transcript corresponding to a sequence or segment that, when produced by the target pest, is in the form of a mRNA that is capable of being translated into protein by the target pest cell. As used herein, the term "antisense RNA" refers to an RNA transcript that is complementary to all or a part of a mRNA that is normally produced in a cell of a target pest. The complementarity of an antisense RNA may be with any part of the specific gene transcript, i.e., at the 5' non-coding sequence, 3' non-translated sequence, introns, or the coding sequence. As used herein, the term "RNA transcript" refers to the product resulting from RNA polymerase-catalyzed transcription of a DNA sequence. When the RNA transcript is a perfect complementary copy of the DNA sequence, it is referred to as the primary transcript or it may be an RNA sequence derived from post-transcriptional processing of the primary transcript and is referred to as the mature RNA.

As used herein, the phrase "inhibition of gene expression" or "inhibiting expression of a target gene in the cell of an insect" refers to the absence (or observable decrease) in the level of protein and/or mRNA product from the target gene. Specificity refers to the ability to inhibit the target gene without manifest effects on other genes of the cell and without any effects on any gene within the cell that is producing the dsRNA molecule. The inhibition of gene expression of the target gene in the insect pest may result in novel phenotypic traits in the insect pest.

Without limiting the scope of the present invention, there is provided, in one aspect, a method for controlling infestation of a target insect using the stabilized dsRNA strategies. The method involves generating stabilized dsRNA molecules as one type of the insect control agents to induce gene silencing in an insect pest. The insect control agents of the present invention induce directly or indirectly post-transcriptional gene silencing events of target genes in the insect. Down-regulation of expression of the target gene prevents or at least retards the insect's growth, development, reproduction and infectivity to hosts. As used herein, the phrase "generating stabilized dsRNA molecule" refers to the methods of employing recombinant DNA technologies readily available in the art (e.g., by Sambrook, et al., In: *Molecular Cloning, A Laboratory Manual, 2nd Edition, Cold Spring Harbor Press*, Cold Spring Harbor, N.Y., 1989) to construct a DNA nucleotide sequence that transcript the stabilized dsRNA. The detailed construction methods of the present invention are disclosed below in this disclosure. As used herein, the term "silencing" refers the effective "down-regulation" of expression of the targeted nucleotide sequence and, hence, the elimination of the ability of the sequence to cause an effect within the insect's cell.

The present invention provides in part a delivery system for the delivery of the insect control agents to insects through their exposure to a diet containing the insect control agents of the present invention. In accordance with one of the embodiments, the stabilized dsRNA or siRNA molecules may be incorporated in the insect diet or may be overlaid on the top of the diet for consumption by an insect.

The present invention also provides in part a delivery system for the delivery of the insect control agents to insects through their exposure to an microorganism or a host such as a plant containing the insect control agents of the present invention by ingestion of the microorganism or the host cells or the contents of the cells. In accordance with another one of the embodiments, the present invention involves generating a transgenic plant cell or a plant that contains a recombinant DNA construct transcribing the stabilized dsRNA molecules of the present invention. As used herein, the phrase "generating a transgenic plant cell or a plant" refers to the methods of employing the recombinant DNA technologies readily available in the art (e.g., by Sambrook, et al.) to construct a plant transformation vector transcribing the stabilized dsRNA molecules of the present invention, to transform the plant cell or the plant and to generate the transgenic plant cell or the transgenic plant that contain the transcribed, stabilized dsRNA molecules. In particular, the method of the present invention may comprise the recombinant construct in a cell of a plant that results in dsRNA transcripts that are substantially homologous to an RNA sequence encoded by a nucleotide sequence within the genome of an insect. Where the nucleotide sequence within the genome of an insect encodes a gene essential to the viability and infectivity of the insect, its down-regulation results in a reduced capability of the insect to survive and infect host cells. Hence, such down-regulation results in a "deleterious effect" on the maintenance viability and infectivity of the insect, in that it prevents or reduces the insect's ability to feed off and survive on nutrients derived from the host cells. By virtue of this reduction in the insect's viability and infectivity, resistance and/or enhanced tolerance to infection by an insect is facilitated in the cells of a plant. Genes in the insect may be targeted at the mature (adult), immature (larval), or egg stages.

In still another embodiment, non-pathogenic, attenuated strains of microorganisms may be used as a carrier for the insect control agents and, in this perspective, the microorganisms carrying such agents are also referred to as insect control agents. The microorganisms may be engineered to express a nucleotide sequence of a target gene to produce RNA molecules comprising RNA sequences homologous or complementary to RNA sequences typically found within the cells of an insect. Exposure of the insects to the microorganisms result in ingestion of the microorganisms and down-regulation of expression of target genes mediated directly or indirectly by the RNA molecules or fragments or derivatives thereof.

The present invention alternatively provides exposure of an insect to the insect control agents of the present invention incorporated in a spray mixer and applied to the surface of a host, such as a host plant. In an exemplary embodiment, ingestion of the insect control agents by an insect delivers the insect control agents to the gut of the insect and subsequently to the cells within the body of the insect. In another embodiment, infection of the insect by the insect control agents through other means such as by injection or other physical methods also permits delivery of the insect control agents. In yet another embodiment, the RNA molecules themselves are encapsulated in a synthetic matrix such as a polymer and applied to the surface of a host such as a plant. Ingestion of the host cells by an insect permits delivery of the insect control agents to the insect and results in down-regulation of a target gene in the host.

It is envisioned that the compositions of the present invention can be incorporated within the seeds of a plant species either as a product of expression from a recombinant gene incorporated into a genome of the plant cells, or incorporated into a coating or seed treatment that is applied to the seed before planting. The plant cell containing a recombinant gene is considered herein to be a transgenic event.

It is believed that a pesticidal seed treatment can provide significant advantages when combined with a transgenic event that provides protection from invertebrate pest infestation that is within the preferred effectiveness range against a target pest. In addition, it is believed that there are situations that are well known to those having skill in the art, where it is advantageous to have such transgenic events within the preferred range of effectiveness.

The present invention also includes seeds and plants having more that one transgenic event. Such combinations are referred to as "stacked" transgenic events. These stacked transgenic events can be events that are directed at the same target pest, or they can be directed at different target pests. In one preferred method, a seed having the ability to express a Cry 3 protein or insecticidal variant thereof also has the ability to express at least one other insecticidal agent including but not limited to a protein that is different from a Cry 3 protein and/or an RNA molecule the sequence of which is derived from the sequence of an RNA expressed in a target pest and that forms a double stranded RNA structure upon expressing in the seed or cells of a plant grown from the seed, wherein the ingestion of one or more cells of the plant by the target pest results in the suppression of expression of the RNA in the cells of the target pest.

In another preferred method, the seed having the ability to express a dsRNA the sequence of which is derived from a target pest also has a transgenic event that provides herbicide tolerance. It is preferred that the transgenic event that provides herbicide tolerance is an event that provides resistance to glyphosate, N-(phosphonomethyl) glycine, including the isopropylamine salt form of such herbicide.

In the present method, a seed comprising a transgenic event is treated with a pesticide. It is believed that the combination of a transgenic seed exhibiting bioactivity against a target pest as a result of the production of an insecticidal amount of an insecticidal dsRNA within the cells of the transgenic seed or plant grown from the seed coupled with treatment of the seed with certain chemical or protein pesticides provides unexpected synergistic advantages to seeds having such treatment, including unexpectedly superior efficacy for protection against damage to the resulting transgenic plant by the target pest. In particular, it is believed that the treatment of a transgenic seed that is capable of expressing certain constructs that form dsRNA molecules, the sequence of which are derived from one or more sequences expressed in a corn rootworm, with from about 100 gm to about 400 gm of certain pesticides per 100 kg of seed provided unexpectedly superior protection against corn rootworm. In addition, it is believed that such combinations are also effective to protect the emergent corn plants against damage by black cutworm. The seeds of the present invention are also believed to have the property of decreasing the cost of pesticide use, because less of the pesticide can be used to obtain a required amount of protection than if the innovative composition and method is not used. Moreover, because less pesticide is used and because it is applied prior to planting and without a separate field application, it is believed that the subject method is therefore safer to the operator and to the environment, and is potentially less expensive than conventional methods.

When it is said that some effects are "synergistic", it is meant to include the synergistic effects of the combination on the pesticidal activity (or efficacy) of the combination of the transgenic event and the pesticide. However, it is not intended that such synergistic effects be limited to the pesticidal activity, but that they should also include such unexpected advantages as increased scope of activity, advantageous activity profile as related to type and amount of damage reduction, decreased cost of pesticide and application, decreased pesticide distribution in the environment, decreased pesticide exposure of personnel who produce, handle and plant corn seeds, and other advantages known to those skilled in the art.

Pesticides and insecticides that are useful in compositions in combination with the methods and compositions of the present invention, including as seed treatments and coatings as well as methods for using such compositions can be found, for example, in U.S. Pat. No. 6,551,962, the entirety of which is incorporated herein by reference.

It has been found that the present invention is useful to protect seeds and plants against a wide array of agricultural pests, including insects, mites, fungi, yeasts, molds, bacteria, nematodes, weeds, and parasitic and saprophytic plants.

It is preferred that the seed treatments and coatings described herein be used along with transgenic seeds of the present invention, in particular by application of a pesticidal agent other than the dsRNA molecules derived from the sequences described herein as set forth in SEQ ID NO:1 through SEQ ID NO:20303, SEQ ID NO:40701 through SEQ ID NO:40746 and SEQ ID NO:40607 through SEQ ID NO:40700 as set forth in the sequence listing, or the complements thereof to a transgenic seed. Although it is believed that the seed treatments can be applied to a transgenic seed in any physiological state, it is preferred that the seed be in a sufficiently durable state that it incurs no damage during the treatment process. Typically, the seed would be a seed that had been harvested from the field; removed from the transgenic plant; and separated from any other non-seed plant material. The seed would preferably also be biologically stable to the extent that the treatment would cause no biological damage to the seed. In one embodiment, for example, the treatment can be applied to seed corn that has been harvested, cleaned and dried to a moisture content below about 15% by weight. In an alternative embodiment, the seed can be one that has been dried and then primed with water and/or another material and then re-dried before or during the treatment with the pesticide. Within the limitations just described, it is believed that the treatment can be applied to the seed at any time between harvest of the seed and sowing of the seed. As used herein, the term "unsown seed" is meant to include seed at any period between the harvest of the seed and the sowing of the seed in the ground for the purpose of germination and growth of the plant.

When it is said that unsown seed is "treated" with the pesticide, such treatment is not meant to include those practices in which the pesticide is applied to the soil, rather than to the seed. For example, such treatments as the application of the pesticide in bands, "T"-bands, or in-furrow, at the same time as the seed is sowed are not considered to be included in the present invention.

The pesticide, or combination of pesticides, can be applied "neat", that is, without any diluting or additional components present. However, the pesticide is typically applied to the seeds in the form of a pesticide formulation. This formulation may contain one or more other desirable components including but not limited to liquid diluents, binders to serve as a matrix for the pesticide, fillers for protecting the seeds during stress conditions, and plasticizers to improve flexibility, adhesion and/or spreadability of the coating. In addition, for oily pesticide formulations containing little or no filler, it may be desirable to add to the formulation drying agents such as calcium carbonate, kaolin or bentonite clay, perlite, diatomaceous earth or any other adsorbent material. Use of such components in seed treatments is known in the art. See, e.g., U.S. Pat. No. 5,876,739. The skilled artisan can readily select desirable components to use in the pesticide formulation depending on the seed type to be treated and the particular pesticide that is selected. In addition, readily available commercial formulations of known pesticides may be used, as demonstrated in the examples below.

The subject pesticides can be applied to a seed as a component of a seed coating. Seed coating methods and compositions that are known in the art are useful when they are modified by the addition of one of the embodiments of the combination of pesticides of the present invention. Such coating methods and apparatus for their application are disclosed in, for example, U.S. Pat. Nos. 5,918,413, 5,891,246, 5,554,445, 5,389,399, 5,107,787, 5,080,925, 4,759,945 and 4,465,017. Seed coating compositions are disclosed, for example, in U.S. Pat. Nos. 5,939,356, 5,882,713, 5,876,739, 5,849,320, 5,834,447, 5,791,084, 5,661,103, 5,622,003, 5,580,544, 5,328,942, 5,300,127, 4,735,015, 4,634,587, 4,383,391, 4,372,080, 4,339,456, 4,272,417 and 4,245,432, among others.

The pesticides that are useful in the coating are those pesticides that are described herein. The amount of pesticide that is used for the treatment of the seed will vary depending upon the type of seed and the type of active ingredients, but the treatment will comprise contacting the seeds with an amount of the combination of pesticides that is pesticidally effective. When insects are the target pest, that amount will be an amount of the insecticide that is insecticidally effective. As used herein, an insecticidally effective amount means that amount of insecticide that will kill insect pests in the larvae or pupal state of growth, or will consistently reduce or retard the amount of damage produced by insect pests.

In general, the amount of pesticide that is applied to the seed in the treatment will range from about 10 gm to about 2000 gm of the active ingredient of the pesticide per 100 kg of the weight of the seed. Preferably, the amount of pesticide will be within the range of about 50 gm to about 1000 gm active per 100 kg of seed, more preferably within the range of about 100 gm to about 600 gm active per 100 kg of seed, and even more preferably within the range of about 200 gm to about 500 gm of active per 100 kg of seed weight. Alternatively, it has been found to be preferred that the amount of the pesticide be over about 60 gm of the active ingredient of the pesticide per 100 kg of the seed, and more preferably over about 80 gm per 100 kg of seed.

The pesticides that are used in the treatment must not inhibit germination of the seed and should be efficacious in protecting the seed and/or the plant during that time in the target insect's life cycle in which it causes injury to the seed or plant. In general, the coating will be efficacious for approximately 0 to 120 days after sowing.

The pesticides of the subject invention can be applied to the seed in the form of a coating. The use of a coating is particularly effective in accommodating high pesticidal loads, as can be required to treat typically refractory pests, such as corn rootworm, while at the same time preventing unacceptable phytotoxicity due to the increased pesticidal load.

The coatings formed with a pesticide composition contemplated herein are preferably capable of effecting a slow rate of release of the pesticide by diffusion or movement through the matrix to the surrounding medium.

In addition to the coating layer, the seed may be treated with one or more of the following ingredients: other pesticides including fungicides and herbicides; herbicidal safeners; fertilizers and/or biocontrol agents. These ingredients may be added as a separate layer or alternatively may be added in the pesticidal coating layer.

The pesticide formulation may be applied to the seeds using conventional coating techniques and machines, such as fluidized bed techniques, the roller mill method, rotostatic seed treaters, and drum coaters. Other methods, such as spouted beds may also be useful. The seeds may be presized before coating. After coating, the seeds are typically dried and then transferred to a sizing machine for sizing. Such procedures are known in the art.

As used herein, the term "insect control agent", or "gene suppression agent" refers to a particular RNA molecule consisting of a first RNA segment and a second RNA segment linked by a third RNA segment. The first and the second RNA segments lie within the length of the RNA molecule and are substantially inverted repeats of each other and are linked together by the third RNA segment. The complementarity between the first and the second RNA segments results in the ability of the two segments to hybridize in vivo and in vitro to form a double stranded molecule, i.e., a stem, linked together at one end of each of the first and second segments by the third segment which forms a loop, so that the entire structure forms into a stem and loop structure, or even more tightly hybridizing structures may form into a stem-loop knotted structure.

The first and the second segments correspond invariably and not respectively to a sense and an antisense sequence with respect to the target RNA transcribed from the target gene in the target insect pest that is suppressed by the ingestion of the dsRNA molecule. The insect control agent can also be a substantially purified (or isolated) nucleic acid molecule and more specifically nucleic acid molecules or nucleic acid fragment molecules thereof from a genomic DNA (gDNA) or cDNA library. Alternatively, the fragments may comprise smaller oligonucleotides having from about 15 to about 250 nucleotide residues, and more preferably, about 15 to about 30 nucleotide residues. The "insect control agent" may also refer to a DNA construct that comprises the isolated and purified nucleic acid molecules or nucleic acid fragment molecules thereof from a gDNA or cDNA library. The "insect control agent" may further refer to a microorganism comprising such a DNA construct that comprises the isolated and purified nucleic acid molecules or nucleic acid fragment molecules thereof from a gDNA or cDNA library. As used herein, the phrase "generating an insect control agent" refers to the methods of employing the recombinant DNA technologies readily available in the art (e.g., by Sambrook, et al.) to prepare a recombinant DNA construct transcribing the stabilized dsRNA or siRNA molecules, to construct a vector transcribing the stabilized dsRNA or siRNA molecules, and/or to transform and generate the cells or the microorganisms that contain the transcribed, stabilized dsRNA or siRNA molecules. The method of the present invention provides for the production of a dsRNA transcript, the nucleotide sequence of which is substantially homologous to a targeted RNA sequence encoded by a target nucleotide sequence within the genome of a target insect pest.

As used herein, the term "genome" as it applies to cells of an insect or a host encompasses not only chromosomal DNA found within the nucleus, but organelle DNA found within subcellular components of the cell. The DNA's of the present invention introduced into plant cells can therefore be either chromosomally integrated or organelle-localized. The term "genome" as it applies to bacteria encompasses both the chromosome and plasmids within a bacterial host cell. The DNA's of the present invention introduced into bacterial host cells can therefore be either chromosomally integrated or plasmid-localized.

Inhibition of target gene expression may be quantified by measuring either the endogenous target RNA or the protein produced by translation of the target RNA and the consequences of inhibition can be confirmed by examination of the outward properties of the cell or organism. Techniques for quantifying RNA and proteins are well known to one of ordinary skill in the art. Multiple selectable markers are available that confer resistance to ampicillin, bleomycin, chloramphenicol, gentamycin, hygromycin, kanamycin, lincomycin, methotrexate, phosphinothricin, puromycin, spectinomycin, rifampicin, and tetracyclin, and the like.

In certain preferred embodiments gene expression is inhibited by at least 10%, preferably by at least 33%, more preferably by at least 50%, and yet more preferably by at least 80%. In particularly preferred embodiments of the invention gene expression is inhibited by at least 80%, more preferably by at least 90%, more preferably by at least 95%, or by at least 99% within cells in the insect so a significant inhibition takes place. Significant inhibition is intended to refer to sufficient inhibition that results in a detectable phenotype (e.g., cessation of larval growth, paralysis or mortality, etc.) or a detectable decrease in RNA and/or protein corresponding to the target gene being inhibited. Although in certain embodiments of the invention inhibition occurs in substantially all cells of the insect, in other preferred embodiments inhibition occurs in only a subset of cells expressing the gene. For example, if the gene to be inhibited plays an essential role in cells in the insect alimentary tract, inhibition of the gene within these cells is sufficient to exert a deleterious effect on the insect.

The advantages of the present invention may include, but are not limited to, the following: the ease of introducing dsRNA into the insect cells, the low concentration of dsRNA or siRNA which can be used, the stability of dsRNA or siRNA, and the effectiveness of the inhibition. The ability to use a low concentration of a stabilized dsRNA avoids several disadvantages of anti-sense interference. The present invention is not limited to in vitro use or to specific sequence compositions, to a particular set of target genes, a particular portion of the target gene's nucleotide sequence, or a particular transgene or to a particular delivery method, as opposed to the some of the available techniques known in the art, such as antisense and co-suppression. Furthermore, genetic manipulation becomes possible in organisms that are not classical genetic models.

In practicing the present invention, it is important that the presence of the nucleotide sequences that are transcribed from the recombinant construct are neither harmful to cells of the plant in which they are expressed in accordance with the invention, nor harmful to an animal food chain and in particular humans. Because the produce of the plant may be made available for human ingestion, the down-regulation of expression of the target nucleotide sequence occurs only in the insect.

Therefore, in order to achieve inhibition of a target gene selectively within an insect species that it is desired to control, the target gene should preferably exhibit a low degree of sequence identity with corresponding genes in a plant or a vertebrate animal. Preferably the degree of the sequence identity is less than approximately 80%. More preferably the degree of the sequence identity is less than approximately 70%. Most preferably the degree of the sequence identity is less than approximately 60%.

According to one embodiment of the present invention, there is provided a nucleotide sequence, for which in vitro expression results in transcription of a stabilized RNA sequence that is substantially homologous to an RNA molecule of a targeted gene in an insect that comprises an RNA sequence encoded by a nucleotide sequence within the genome of the insect. Thus, after the insect ingests the stabilized RNA sequence incorporated in a diet or sprayed on a plant surface, a down-regulation of the nucleotide sequence corresponding to the target gene in the cells of a target insect is affected. The down-regulated nucleotide sequence in the insect results in a deleterious effect on the maintenance, viability, proliferation, reproduction and infectivity of the insect. Therefore, the nucleotide sequence of the present invention may be useful in modulating or controlling infestation by a range of insects.

According to another embodiment of the present invention, there is provided a nucleotide sequence, the expression of which in a microbial cell results in a transcription of an RNA sequence which is substantially homologous to an RNA molecule of a targeted gene in an insect that comprises an RNA sequence encoded by a nucleotide sequence within the genome of the insect. Thus, after the insect ingests the stabilized RNA sequence contained in the cell of the microorganism, it will affect down-regulation of the nucleotide sequence of the target gene in the cells of the insect. The down-regulated nucleotide sequence in the insect results in a deleterious effect on the maintenance, viability, proliferation, reproduction and infestation of the insect. Therefore, the nucleotide sequence of the present invention may be useful in modulating or controlling infestation by a range of insects.

According to yet another embodiment of the present invention, there is provided a nucleotide sequence, the expression of which in a plant cell results in a transcription of an RNA sequence which is substantially homologous to an RNA molecule of a targeted gene in an insect that comprises an RNA sequence encoded by a nucleotide sequence within the genome of the insect. Thus, after the insect ingests the stabilized RNA sequence contained in the cell of the plant, it will affect down-regulation of the nucleotide sequence of the target gene in the cells of the insect. The down-regulated nucleotide sequence in the insect results in a deleterious effect on the maintenance, viability, proliferation, reproduction and infestation of the insect. Therefore, the nucleotide sequence of the present invention may be useful in modulating or controlling infestation by a range of insects in plants.

As used herein, the term "substantially homologous" or "substantial homology", with reference to a nucleic acid sequence, refers to a nucleotide sequence that hybridizes under stringent conditions to the coding sequence as set forth in any of SEQ ID NO:1 through SEQ ID NO:20303, SEQ ID NO:40701 through SEQ ID NO:40746 or in any of SEQ ID NO:40607 through SEQ ID NO:40700 as set forth in the sequence listing, or the complements thereof. Sequences that hybridize under stringent conditions to any of SEQ ID NO:1 through SEQ ID NO:20303, or any of SEQ ID NO:40701 through SEQ ID NO:40746 or any of SEQ ID NO:40607 through SEQ ID NO:40700 as set forth in the sequence listing, or the complements thereof, are those that allow an antiparallel alignment to take place between the two sequences, and the two sequences are then able, under stringent conditions, to form hydrogen bonds with corresponding bases on the opposite strand to form a duplex molecule that is sufficiently stable under the stringent conditions to be detectable using methods well known in the art. Such substantially homologous sequences have preferably from about 65% to about 70% sequence identity, or more preferably from about 80% to about 85% sequence identity, or most preferable from about 90% to about 95% sequence identity, to about 99% sequence identity, to the referent nucleotide sequences as set forth in any of SEQ ID NO:1 through SEQ ID NO:20303, or in any of SEQ ID NO:40701 through SEQ ID NO:40746 or in any of SEQ ID NO:40607 through SEQ ID NO:40700 as set forth in the sequence listing, or the complements thereof.

As used herein, the term "sequence identity", "sequence similarity" or "homology" is used to describe sequence relationships between two or more nucleotide sequences. The percentage of "sequence identity" between two sequences is determined by comparing two optimally aligned sequences over a comparison window, wherein the portion of the sequence in the comparison window may comprise additions or deletions (i.e., gaps) as compared to the reference sequence (which does not comprise additions or deletions) for optimal alignment of the two sequences. The percentage is calculated by determining the number of positions at which the identical nucleic acid base or amino acid residue occurs in both sequences to yield the number of matched positions, dividing the number of matched positions by the total number of positions in the window of comparison, and multiplying the result by 100 to yield the percentage of sequence identity. A sequence that is identical at every position in comparison to a reference sequence is said to be identical to the reference sequence and vice-versa. A first nucleotide sequence when observed in the 5' to 3' direction is said to be a "complement" of, or complementary to, a second or reference nucleotide sequence observed in the 3' to 5' direction if the first nucleotide sequence exhibits complete complementarity with the second or reference sequence. As used herein, nucleic acid sequence molecules are said to exhibit "complete complementarity" when every nucleotide of one of the sequences read 5' to 3' is complementary to every nucleotide of the other sequence when read 3' to 5'. A nucleotide sequence that is complementary to a reference nucleotide sequence will exhibit a sequence identical to the reverse complement sequence of the reference nucleotide sequence. These terms and descriptions are well defined in the art and are easily understood by those of ordinary skill in the art.

As used herein, a "comparison window" refers to a conceptual segment of at least 6 contiguous positions, usually about 50 to about 100, more usually about 100 to about 150, in which a sequence is compared to a reference sequence of the same number of contiguous positions after the two sequences are optimally aligned. The comparison window may comprise additions or deletions (i.e. gaps) of about 20% or less as compared to the reference sequence (which does not comprise additions or deletions) for optimal alignment of the two sequences Those skilled in the art should refer to the detailed methods used for sequence alignment in the Wisconsin Genetics Software Package Release 7.0, Genetics Computer Group, 575 Science Drive Madison, Wis., USA) or refer to Ausubel et al. (1998) for a detailed discussion of sequence analysis.

The target gene of the present invention is derived from an insect cell or alternatively, a foreign gene such as a foreign genetic sequence from a virus, a fungus, an insect or a nematode, among others. By "derived" it is intended that a sequence is all or a part of the naturally occurring nucleotide sequence of the target gene from the genome of an insect cell, particularly all or a part of the naturally occurring nucleotide sequence of the capped, spliced, and polyadenylated mRNA expressed from the naturally occurring DNA sequence as found in the cell if the gene is a structural gene, or the sequence of all or a part of an RNA that is other than a structural gene including but not limited to a tRNA, a catalytic RNA, a ribosomal RNA, a micro-RNA, and the like. A sequence is derived from one of these naturally occurring RNA sequences if the derived sequence is produced based on the nucleotide sequence of the native RNA, exhibits from about 80% to about 100% sequence identity to the native sequence, and hybridizes to the native sequence under stringent hybridization conditions. In one embodiment, the target gene comprises a nucleotide sequence as set forth in any of SEQ ID NO:1 through SEQ ID NO:20303, or in any of SEQ ID NO:40701 through SEQ ID NO:40746 or in any of SEQ ID NO:40607 through SEQ ID NO:40700 as set forth in the sequence listing, or the complements thereof. Depending on the particular target gene and the dose of dsRNA molecules delivered, this process may provide partial or complete loss of function for the target gene, or any desired level of suppression in between.

The present invention also provides an artificial DNA sequence capable of being expressed in a cell or microorganism and which is capable of inhibiting target gene expression in a cell, tissue or organ of an insect, wherein the artificial DNA sequence at least comprises a dsDNA molecule coding for one or more different nucleotide sequences, wherein each of the different nucleotide sequences comprises a sense nucleotide sequence and an antisense nucleotide sequence connected by a spacer sequence coding for a dsRNA molecule of the present invention. The spacer sequence constitutes part of the sense nucleotide sequence or the antisense nucleotide sequence and will form within the dsRNA molecule between the sense and antisense sequences. The sense nucleotide sequence or the antisense nucleotide sequence is substantially identical to the nucleotide sequence of the target gene or a derivative thereof or a complementary sequence thereto. The dsDNA molecule is placed operably under the control of a promoter sequence that functions in the cell, tissue or organ of the host expressing the dsDNA to produce dsRNA molecules. In one embodiment, the artificial DNA sequence may be derived from a nucleotide sequence as set forth in SEQ ID NO:1 through SEQ ID NO:20303, in SEQ ID NO:40701 through SEQ ID NO:40746 or in SEQ ID NO:40607 through SEQ ID NO:40700 as set forth in the sequence listing.

The invention also provides an artificial DNA sequence for expression in a cell of a plant, and that, upon expression of the DNA to RNA and ingestion by a target pest achieves suppression of a target gene in a cell, tissue or organ of an insect pest. The dsRNA at least comprises one or multiple structural gene sequences, wherein each of the structural gene sequences comprises a sense nucleotide sequence and an antisense nucleotide sequence connected by a spacer sequence that forms a loop within the complementary and antisense sequences. The sense nucleotide sequence or the antisense nucleotide sequence is substantially identical to the nucleotide sequence of the target gene, derivative thereof, or sequence complementary thereto. The one or more structural gene sequences is placed operably under the control of one or more promoter sequences, at least one of which is operable in the cell, tissue or organ of a prokaryotic or eukaryotic organism, particularly an insect. In one embodiment, the artificial DNA sequence comprises from about SEQ ID NO:1 through SEQ ID NO:20303, from about SEQ ID NO:40701 through about SEQ ID NO:40746, or from about SEQ ID NO:40607 through about SEQ ID NO:40700 as set forth in the sequence listing or the complements thereof.

As used herein, the term "non naturally occurring gene", "non-naturally occurring coding sequences", "artificial sequence", or "synthetic coding sequences" for transcribing the dsRNA or siRNA of the present invention or fragments thereof refers to those prepared in a manner involving any sort of genetic isolation or manipulation that results in the preparation of a coding sequence that transcribes a dsRNA or a siRNA of the present invention or fragments thereof. This includes isolation of the coding sequence from its naturally occurring state, manipulation of the coding sequence as by (1) nucleotide insertion, deletion, or substitution, (2) segment insertion, deletion, or substitution, (3) chemical synthesis such as phosphoramidite chemistry and the like, site-specific mutagenesis, truncation of the coding sequence or any other manipulative or isolative method.

The non-naturally occurring gene sequence or fragment thereof according to this aspect of the invention for WCR control may be cloned between two tissue specific promoters, such as two root specific promoters which are operable in a transgenic plant cell and therein expressed to produce mRNA in the transgenic plant cell that form dsRNA molecules thereto. The dsRNA molecules contained in plant tissues are ingested by an insect so that the intended suppression of the target gene expression is achieved.

The present invention also provides a method for obtaining a nucleic acid comprising a nucleotide sequence for producing a dsRNA or siRNA of the present invention. In a preferred embodiment, the method of the present invention for obtaining the nucleic acid comprising: (a) probing a cDNA or gDNA library with a hybridization probe comprising all or a portion of a nucleotide sequence or a homolog thereof from a targeted insect; (b) identifying a DNA clone that hybridizes with the hybridization probe; (c) isolating the DNA clone identified in step (b); and (d) sequencing the cDNA or gDNA fragment that comprises the clone isolated in step (c) wherein the sequenced nucleic acid molecule transcribes all or a substantial portion of the RNA nucleotide acid sequence or a homolog thereof.

In another preferred embodiment, the method of the present invention for obtaining a nucleic acid fragment comprising a nucleotide sequence for producing a substantial portion of a dsRNA or siRNA of the present invention comprising: (a) synthesizing a first and a second oligonucleotide primers corresponding to a portion of one of the nucleotide sequences from a targeted insect; and (b) amplifying a cDNA or gDNA insert present in a cloning vector using the first and second oligonucleotide primers of step (a) wherein the amplified nucleic acid molecule transcribes a substantial portion of the a substantial portion of a dsRNA or siRNA of the present invention.

In practicing the present invention, a target gene may be derived from a corn rootworm (CRW), such as a WCR or a SCR, or any insect species that cause damages to the crop plants and subsequent yield losses. The present inventors contemplate that several criteria may be employed in the selection of preferred target genes. The gene is one whose protein product has a rapid turnover rate, so that dsRNA inhibition will result in a rapid decrease in protein levels. In certain embodiments it is advantageous to select a gene for which a small drop in expression level results in deleterious effects for the insect. If it is desired to target a broad range of insect species a gene is selected that is highly conserved across these species. Conversely, for the purpose of conferring specificity, in certain embodiments of the invention, a gene is selected that contains regions that are poorly conserved between individual insect species, or between insects and other organisms. In certain embodiments it may be desirable to select a gene that has no known homologs in other organisms.

As used herein, the term "derived from" refers to a specified nucleotide sequence that may be obtained from a particular specified source or species, albeit not necessarily directly from that specified source or species.

In one embodiment, a gene is selected that is expressed in the insect gut. Targeting genes expressed in the gut avoids the requirement for the dsRNA to spread within the insect. Target genes for use in the present invention may include, for example, those that share substantial homologies to the nucleotide sequences of known gut-expressed genes that encode protein components of the plasma membrane proton V-ATPase (Dow et al., 1997, J. Exp. Biol., 200:237-245; Dow, Bioenerg. Biomemb., 1999, 31:75-83). This protein complex is the sole energizer of epithelial ion transport and is responsible for alkalinization of the midgut lumen. The V-ATPase is also expressed in the Malpighian tubule, an outgrowth of the insect hindgut that functions in fluid balance and detoxification of foreign compounds in a manner analogous to a kidney organ of a mammal.

In another embodiment, a gene is selected that is essentially involved in the growth, development, and reproduction of an insect. Exemplary genes include but are not limited to a CHD3 gene and a β-tubulin gene. The CHD3 gene in *Drosophila melanogaster* encodes a protein with ATP-dependent DNA helicase activity that is involved in chromatin assembly/disassembly in the nucleus. Similar sequences have been found in diverse organisms such as *Arabidopsis thaliana, Caenorhabditis elegans*, and *Saccharomyces cerevisiae*. The beta-tubulin gene family encodes microtubule-associated proteins that are a constituent of the cellular cytoskeleton.

Related sequences are found in such diverse organisms as *Caenorhabditis elegans*, and *Manduca Sexta*.

Other target genes for use in the present invention may include, for example, those that play important roles in the viability, growth, development, reproduction and infectivity. These target genes may be one of the house keeping genes, transcription factors and insect specific genes or lethal knock-out mutations in *Drosophila*. The target genes for use in the present invention may also be those that are from other organisms, e.g., from a nematode (e.g., *C. elegans*). Additionally, the nucleotide sequences for use in the present invention may also be derived from plant, viral, bacterial or fungal genes whose functions have been established from literature and the nucleotide sequences of which share substantial similarity with the target genes in the genome of an insect. According to one aspect of the present invention for WCR control, the target sequences may essentially be derived from the targeted WCR insect. Some of the exemplary target sequences from cDNA library from WCR that encode *D. v. virgifera* proteins or fragments thereof which are homologues of known proteins may be found in the Sequence Listing.

Nucleic acid molecules from *D. virgifera* encoding homologs of known proteins are known (Andersen et al., U.S. Pat. No. 7,612,194).

Although the sequences described in Andersen et al. are primarily in reference to WCR, it is preferred in the practice of the invention to use DNA segments whose sequences exhibit at least from about 80% identity, or at least from 90% identity, or at least from 95% identity, or at least from 98% identity, or at least about 100% identity to sequences corresponding to genes or coding sequences within the pest for which control is desired. Sequences less than about 80% identical to a target gene are less effective. Inhibition is specific to the pests' gene or genes, the sequence of which corresponds to the dsRNA. Expression of unrelated genes is not affected. This specificity allows the selective targeting of pest species, resulting in no effect on other organisms exposed to the compositions of the present invention.

A DNA segment for use in the present invention is at least from about 19 to about 23, or about 23 to about 100 nucleotides, but less than about 2000 nucleotides, in length.

The invention is not limited to the specific genes described herein but encompasses any gene, the inhibition of which exerts a deleterious effect on an insect pest.

For many of the insects that are potential targets for control by the present invention, there may be limited information regarding the sequences of most genes or the phenotype resulting from mutation of particular genes. Therefore, the present inventors contemplate that selection of appropriate genes from insect pests for use in the present invention may be accomplished through use of information available from study of the corresponding genes in a model organism such in *Drosophila*, in some other insect species, or even in a nematode species, in a fungal species, in a plant species, in which the genes have been characterized. In some cases it will be possible to obtain the sequence of a corresponding gene from a target insect by searching databases such as GenBank using either the name of the gene or the sequence from, for example, *Drosophila*, another insect, a nematode, a fungus, or a plant from which the gene has been cloned. Once the sequence is obtained, PCR may be used to amplify an appropriately selected segment of the gene in the insect for use in the present invention.

In order to obtain a DNA segment from the corresponding gene in an insect species, PCR primers are designed based on the sequence as found in WCR or other insects from which the gene has been cloned. The primers are designed to amplify a DNA segment of sufficient length for use in the present invention. DNA (either genomic DNA or cDNA) is prepared from the insect species, and the PCR primers are used to amplify the DNA segment. Amplification conditions are selected so that amplification will occur even if the primers do not exactly match the target sequence. Alternately, the gene (or a portion thereof) may be cloned from a gDNA or cDNA library prepared from the insect pest species, using the WCR gene or another known insect gene as a probe. Techniques for performing PCR and cloning from libraries are known. Further details of the process by which DNA segments from target insect pest species may be isolated based on the sequence of genes previously cloned from WCR or other insect species are provided in the Examples. One of ordinary skill in the art will recognize that a variety of techniques may be used to isolate gene segments from insect pest species that correspond to genes previously isolated from other species.

Insects that may cause damage in plants generally belong to three categories based upon their methods of feeding and these three categories are, respectively, chewing, sucking and boring insects that belong to the Orders Coleoptera, Lepidoptera, Diptera, Orthoptera, Heteroptera, Ctenophalides, Arachnidiae, and Hymenoptera. The chewing insects that eat plant tissue, such as roots, leaves, flowers, buds and twigs, cause major damage. Examples from this large insect category include beetles and their larvae. WCR and SCR belong to the chewing insects. Their larvae feed on roots of a plant, in particular, a corn plant, and adults mainly on the foliage. Genes derived from the WCR or SCR or from any one species of the above listed orders may be considered as targets for performing the present invention.

It has been found that the present method is useful to protect seeds and plants against a wide array of agricultural pests, including insects, mites, fungi, yeasts, molds, bacteria, nematodes, weeds, and parasitic and saprophytic plants, and the like.

When an insect is the target pest for the present invention, such pests include but are not limited to: from the order Lepidoptera, for example,

*Acleris* spp. *Adoxophyes* spp., *Aegeria* spp., *Agrotis* spp., *Alabama argillaceae*, *Amylois* spp., *Anticarsia gemmatalis*, *Archips* spp, *Argyrotaenia* spp., *Autographa* spp., *Busseola fitsca*, *Cadra cautella*, *Carposina nipponensis*, *Chilo* spp., *Choristoneura* spp., *Clysia ambiguella*, *Cnaphalocrocis* spp., *Cnephasia* spp., *Cochylis* spp., *Coleophora* spp., *Crocidolomia binotalis*, *Cryptophlebia leucotreta*, *Cydia* spp., *Diatraea* spp., *Diparopsis castanea*, *Earias* spp., *Ephestia* spp., *Eucosma* spp., *Eupoecilia ambiguella*, *Euproctis* spp., *Euxoa* spp., *Grapholita* spp., *Hedya nubiferana*, *Heliothis* spp., *Hellula undalis*, *Hyphantria cunea*. *Keiferia lycopersicella*, *Leucoptera scitella*, *Lithocollethis* spp., *Lobesia botrana*, *Lymantria* spp., *Lyonetia* spp., *Malacosoma* spp., *Mamestra brassicae*, *Manduca sexta*, *Operophtera* spp., *Ostrinia Nubilalis*, *Pammene* spp., *Pandemis* spp., *Panolis flammea*, *Pectinophora gossypiella*, *Phthorimaea opercule-lla*, *Pieris rapae*, *Pieris* spp., *Plutella xylostella*, *Prays* spp., *Scirpophaga* spp., *Sesamia* spp., *Sparganothis* spp., *Spodoptera* spp., *Synanthedon* spp., *Thaumetopoea* spp., *Tortrix* spp., *Trichoplusia ni* and *Yponomeuta* spp.;

from the order Coleoptera, for example,

*Agriotes* spp., *Anthonomus* spp., *Atomaria linearis*, *Chaetocnema tibialis*, *Cosmopolites* spp., *Curculio* spp., *Dermestes* spp., *Diabrotica* spp., *Epilachna* spp., *Eremnus* spp., *Leptinotarsa decemlineata*, *Lissorlzoptrus* spp., *Melolontha* spp., *Orycaephilus* spp., *Otiorhynchus* spp., *Phlyctinus* spp.,

*Popillia* spp., *Psylliodes* spp., *Rhizopertha* spp., Scarabeidae, *Sitophilus* spp., *Sitotroga* spp., *Tenebrio* spp., *Tribolium* spp. and *Trogoderma* spp.;

from the order Orthoptera, for example,

*Blatta* spp., *Blattella* spp., *Gryllotalpa* spp., *Leucophaea maderae, Locusta* spp., *Periplaneta* spp., and *Schistocerca* spp.;

from the order Isoptera, for example,

*Reticulitemes* spp.;

from the order Psocoptera, for example,

*Liposcelis* spp.;

from the order Anoplura, for example,

*Haematopinus* spp., *Linognathus* spp., *Pediculus* spp., *Pemphigus* spp. and *Phylloxera* spp.;

from the order Mallophaga, for example,

*Damalinea* spp. and *Trichodectes* spp.;

from the order Thysanoptera, for example,

*Franklinella* spp., *Hercinothrips* spp., *Taeniothrips* spp., *Thrips palmi, Thrips tabaci* and *Scirtothrips aurantii;* from the order Heteroptera, for example,

*Cimex* spp., *Distantiella theobroma, Dysdercus* spp., *Euchistus* spp., *Eurygaster* spp., *Leptocorisa* spp., *Nezara* spp., *Piesma* spp., *Rhodnius* spp., *Sahlbergella singularis, Scotinophara* spp., *Triatoma* spp., Miridae family spp. such as *Lygus hesperus* and *Lygus lineoloris*, Lygaeidae family spp. such as *Blissus leucopterus*, and Pentatomidae family spp.;

from the order Homoptera, for example,

*Aleurothrixus floccosus. Aleyrodes brassicae, Aonidiella* spp., *Aphididae, Aphis* spp., *Aspidiotus* spp., *Bernisia tabaci, Ceroplaster* spp., *Chrysomphalus aonidium, Chrysomphalus dictyospermi, Coccus hesperidum, Empoasca* spp., *Eriosoma larigerum, Erythroneura* spp., *Gascardia* spp., *Laodelphax* spp., *Lacanium corni, Lepidosaphes* spp., *Macrosiphus* spp., *Myzus* spp., *Nehotettix* spp., *Nilaparvata* spp., *Paratoria* spp., *Pemphigus* spp., *Planococcus* spp., *Pseudaulacaspis* spp., *Pseudococcus* spp. *Psylla* spp., *Pulvinaria aethiopica, Quadraspidiouts* spp., *Rhopalosiphum* spp., *Saissetia* spp., *Scaplzoideus* spp., *Schizaphis* spp., *Sitobion* spp., *Trialeurodes vaporariorum, Trioza* erytreae and *Unaspis citri;* from the order Hymenoptera, for example,

Acromyrmex, *Atta* spp., *Cephus* spp., *Diprion* spp., *Diprionidae, Gilpinia polytoma, Hoplocampa* spp., *Lasius* spp., *Monomorium pharaonis, Neodiprion spp, Solenopsis* spp. and *Vespa* spp.;

from the order Diptera, for example,

*Aedes* spp., *Antherigona soccata, Bibio hortulanus, Calliphora erythrocephala, Ceratitis* spp., *Chrysomyia* spp., *Culex* spp., *Cuterebra* spp., *Dacus* spp., *Drosophila melanogaster, Fannia* spp., *Gastrophilus* spp., *Glossina* spp., *Hypoderma* spp., *Hyppobosca* spp., *Lirionzysa* spp., *Lucilia* spp., *Melanagromyza* spp., *Musca* spp., *Oestrus* spp., *Orseolia* spp., *Oscinella frit, Pegomyia hyoscyami, Plzorbia* spp., *Rhagoletis pomonella, Sciara* spp., *Stomoxys* spp., *Tabanus* spp., *Tannia* spp. and *Tipula* spp., from the order Siphonaptera, for example,

*Ceratophyllus* spp. and *Xenopsylla cheopis* and from the order Thysanura, for example,

*Lepisma saccharina.*

It has been found that the present invention is particularly effective when the insect pest is a *Diabrotica* spp., and especially when the pest is *Diabrotica virgifera* virgifera (Western Corn Rootworm, WCR), *Diabrotica barberi* (Northern Corn Rootworm, NCR), *Diabrotica virgifera* zeae (Mexican Corn Rootworm, MCR), *Diabrotica balteata* (Brazilian Corn Rootworm (BZR) or Brazilian Corn Rootworm complex (BCR) consisting of *Diabrotica viridula* and *Diabrotica speciosa*), or *Diabrotica undecimpunctata howardii* (Southern Corn Rootworm, SCR).

The present invention is also particularly effective for controlling species of insects that pierce and/or suck the fluids from the cells and tissues of plants, including but not limited to stinkbugs (Pentatomidae family species), and plant bugs in the Miridae family such as western tarnished plant bugs (*Lygus hesperus* species), tarnished plant bugs (*Lygus lineolaris* species), and pale legume bugs (*Lygus elisus*).

Modifications of the methods disclosed herein are also surprisingly particularly useful in controlling crop pests within the order lepidopteran.

The present invention provides stabilized dsRNA or siRNA molecules for control of insect infestations. The dsRNA or siRNA nucleotide sequences comprise double strands of polymerized ribonucleotide and may include modifications to either the phosphate-sugar backbone or the nucleoside. Modifications in RNA structure may be tailored to allow specific genetic inhibition.

In one embodiment, the dsRNA molecules may be modified through an enzymatic process so the siRNA molecules may be generated. The siRNA can efficiently mediate the down-regulation effect for some target genes in some insects. This enzymatic process may be accomplished by utilizing an RNAse III enzyme or a DICER enzyme, present in the cells of an insect, a vertebrate animal, a fungus or a plant in the eukaryotic RNAi pathway (Elbashir et al., 2002, Methods, 26(2):199-213; Hamilton and Baulcombe, 1999, Science 286:950-952). This process may also utilize a recombinant DICER or RNAse III introduced into the cells of a target insect through recombinant DNA techniques that are readily known to the skilled in the art. Both the DICER enzyme and RNAse III, being naturally occurring in an insect or being made through recombinant DNA techniques, cleave larger dsRNA strands into smaller oligonucleotides. The DICER enzymes specifically cut the dsRNA molecules into siRNA pieces each of which is about 19-25 nucleotides in length while the RNAse III enzymes normally cleave the dsRNA molecules into 12-15 base-pair siRNA. The siRNA molecules produced by the either of the enzymes have 2 to 3 nucleotide 3' overhangs, and 5' phosphate and 3' hydroxyl termini. The siRNA molecules generated by RNAse III enzyme are the same as those produced by Dicer enzymes in the eukaryotic RNAi pathway and are hence then targeted and degraded by an inherent cellular RNA-degrading mechanism after they are subsequently unwound, separated into single-stranded RNA and hybridize with the RNA sequences transcribed by the target gene. This process results in the effective degradation or removal of the RNA sequence encoded by the nucleotide sequence of the target gene in the insect. The outcome is the silencing of a particularly targeted nucleotide sequence within the insect. Detailed descriptions of enzymatic processes can be found in Hannon (2002, Nature, 418:244-251).

Inhibition of a target gene using the stabilized dsRNA technology of the present invention is sequence-specific in that nucleotide sequences corresponding to the duplex region of the RNA are targeted for genetic inhibition. RNA containing a nucleotide sequences identical to a portion of the target gene is preferred for inhibition. RNA sequences with insertions, deletions, and single point mutations relative to the target sequence have also been found to be effective for inhibition. In performance of the present invention, it is preferred that the inhibitory dsRNA and the portion of the target gene share at least from about 80% sequence identity, or from about 90% sequence identity, or from about 95% sequence identity, or from about 99% sequence identity, or even about 100% sequence identity. Alternatively, the duplex region of the RNA may be defined functionally as a nucleotide sequence that is capable of hybridizing with a portion of the target gene transcript. A less than full length sequence exhibiting a greater homology compensates for a longer less homologous sequence. The length of the identical nucleotide sequences may be at least about 25, 50, 100, 200, 300, 400, 500 or at least about 1000 bases. Normally, a sequence of greater than 20-100 nucleotides should be used, though a sequence of greater than about 200-300 nucleotides would be preferred, and a sequence of greater than about 500-1000 nucleotides would be especially preferred depending on the size of the target gene. The invention has the advantage of being able to tolerate sequence variations that might be expected due to genetic mutation, strain polymorphism, or evolutionary divergence. The introduced nucleic acid molecule may not need to be absolute homology, may not need to be full length, relative to either the primary transcription product or fully processed mRNA of the target gene. Therefore, those skilled in the art need to realize that, as disclosed herein, 100% sequence identity between the RNA and the target gene is not required to practice the present invention.

The dsRNA molecules may be synthesized either in vivo or in vitro. The dsRNA may be formed by a single self-complementary RNA strand or from two complementary RNA strands. Endogenous RNA polymerase of the cell may mediate transcription in vivo, or cloned RNA polymerase can be used for transcription in vivo or in vitro. Inhibition may be targeted by specific transcription in an organ, tissue, or cell type; stimulation of an environmental condition (e.g., infection, stress, temperature, chemical inducers); and/or engineering transcription at a developmental stage or age. The RNA strands may or may not be polyadenylated; the RNA strands may or may not be capable of being translated into a polypeptide by a cell's translational apparatus.

The RNA, dsRNA, siRNA, or miRNA of the present invention may be produced chemically or enzymatically by one skilled in the art through manual or automated reactions or in vivo in another organism. RNA may also be produced by partial or total organic synthesis; any modified ribonucleotide can be introduced by in vitro enzymatic or organic synthesis. The RNA may be synthesized by a cellular RNA polymerase or a bacteriophage RNA polymerase (e.g., T3, T7, SP6). The use and production of an expression construct are known in the art (see, for example, WO 97/32016; U.S. Pat. Nos. 5,593, 874, 5,698,425, 5,712,135, 5,789,214, and 5,804,693). If synthesized chemically or by in vitro enzymatic synthesis, the RNA may be purified prior to introduction into the cell. For example, RNA can be purified from a mixture by extraction with a solvent or resin, precipitation, electrophoresis, chromatography, or a combination thereof. Alternatively, the RNA may be used with no or a minimum of purification to avoid losses due to sample processing. The RNA may be dried for storage or dissolved in an aqueous solution. The solution may contain buffers or salts to promote annealing, and/or stabilization of the duplex strands.

For transcription from a transgene in vivo or an expression construct, a regulatory region (e.g., promoter, enhancer, silencer, and polyadenylation) may be used to transcribe the RNA strand (or strands). Therefore, in one embodiment, the nucleotide sequences for use in producing RNA molecules may be operably linked to one or more promoter sequences functional in a microorganism, a fungus or a plant host cell. Ideally, the nucleotide sequences are placed under the control of an endogenous promoter, normally resident in the host genome. The nucleotide sequence of the present invention, under the control of an operably linked promoter sequence, may further be flanked by additional sequences that advantageously affect its transcription and/or the stability of a resulting transcript. Such sequences are generally located upstream of the operably linked promoter and/or downstream of the 3' end of the expression construct and may occur both upstream of the promoter and downstream of the 3' end of the expression construct, although such an upstream sequence only is also contemplated.

In another embodiment, the nucleotide sequence of the present invention may comprise an inverted repeat separated by a "spacer sequence". The spacer sequence may be a region comprising any sequence of nucleotides that facilitates secondary structure formation between each repeat, where this is required. In one embodiment of the present invention, the spacer sequence is part of the sense or antisense coding sequence for mRNA. The spacer sequence may alternatively comprise any combination of nucleotides or homologues thereof that are capable of being linked covalently to a nucleic acid molecule. The spacer sequence may comprise a sequence of nucleotides of at least about 10-100 nucleotides in length, or alternatively at least about 100-200 nucleotides in length, at least 200-400 about nucleotides in length, or at least about 400-500 nucleotides in length.

For the purpose of the present invention, the dsRNA or siRNA molecules may be obtained from the CRW by polymerase chain (PCR) amplification of a target CRW gene sequences derived from a corn rootworm gDNA or cDNA library or portions thereof. The WCR larvae may be prepared using methods known to the ordinary skilled in the art and DNA/RNA may be extracted. Larvae with various sizes ranging from $1^{st}$ instars to fully-grown CRWs may be used for the purpose of the present invention for DNA/RNA extraction. Genomic DNA or cDNA libraries generated from WCR may be used for PCR amplification for production of the dsRNA or siRNA.

The target genes may be then be PCR amplified and sequenced using the methods readily available in the art. One skilled in the art may be able to modify the PCR conditions to ensure optimal PCR product formation. The confirmed PCR product may be used as a template for in vitro transcription to generate sense and antisense RNA with the included minimal promoters.

The present inventors contemplate that nucleic acid sequences identified and isolated from any insect species in the insect kingdom may be used in the present invention for control of WCR and another targeted insects. In one aspect of the present invention, the nucleic acid may be derived from a species from a coleopteran species. Specifically, the nucleic acid may be derived from leaf beetles belonging to the genus *Diabrotica* (Coleoptera, *Chrysomelidae*) and more specifically the nucleic acid molecules of the present invention may be derived from species in the virgifera group. Most specifically, the nucleic acid molecules of the present invention may be derived from *Diabrotica virgifera* virgifera LeConte that is normally referred to as WCR. The isolated nucleic acids may be useful, for example, in identifying a target gene and in constructing a recombinant vector that produce stabilized dsRNAs or siRNAs of the present invention for protecting plants from WCR insect infestations.

Therefore, in one embodiment, the present invention comprises isolated and purified nucleotide sequences from WCR or *Lygus* that may be used as the insect control agents. The isolated and purified nucleotide sequences comprise those as set forth in SEQ ID NO:1 through SEQ ID NO:20303, in SEQ ID NO:40701 through SEQ ID NO:40746 or in SEQ ID NO:40607 through SEQ ID NO:40700 as set forth in the sequence listing.

The nucleic acids from WCR or other insects that may be used in the present invention may also comprise isolated and substantially purified Unigenes and EST nucleic acid molecules or nucleic acid fragment molecules thereof. EST nucleic acid molecules may encode significant portions of, or indeed most of, the polypeptides. Alternatively, the fragments may comprise smaller oligonucleotides having from about 15 to about 250 nucleotide residues, and more preferably, about 15 to about 30 nucleotide residues. Alternatively, the nucleic acid molecules for use in the present invention may be from cDNA libraries from WCR, from *Lygus*, or from any other invertebrate pest species.

As used herein, the phrase "a substantially purified nucleic acid", "an artificial sequence", "an isolated and substantially purified nucleic acid", or "an isolated and substantially purified nucleotide sequence" refers to a nucleic acid that is no longer accompanied by some of materials with which it is associated in its natural state or to a nucleic acid the structure of which is not identical to that of any of naturally occurring nucleic acid. Examples of a substantially purified nucleic acid include: (1) DNAs which have the sequence of part of a naturally occurring genomic DNA molecules but are not flanked by two coding sequences that flank that part of the molecule in the genome of the organism in which it naturally occurs; (2) a nucleic acid incorporated into a vector or into the genomic DNA of a prokaryote or eukaryote in a manner such that the resulting molecule is not identical to any naturally occurring vector or genomic DNA; (3) a separate molecule such as a cDNA, a genomic fragment, a fragment produced by polymerase chain reaction (PCR), or a restriction fragment; (4) recombinant DNAs; and (5) synthetic DNAs. A substantially purified nucleic acid may also be comprised of one or more segments of cDNA, genomic DNA or synthetic DNA.

Nucleic acid molecules and fragments thereof from WCR, *Lygus*, or other invertebrate pest species may be employed to obtain other nucleic acid molecules from other species for use in the present invention to produce desired dsRNA and siRNA molecules. Such nucleic acid molecules include the nucleic acid molecules that encode the complete coding sequence of a protein and promoters and flanking sequences of such molecules. In addition, such nucleic acid molecules include nucleic acid molecules that encode for gene family members. Such molecules can be readily obtained by using the above-described nucleic acid molecules or fragments thereof to screen cDNA or gDNA libraries obtained from *D. v. virgifera* or from *Lygus hesperus*. Methods for forming such libraries are well known in the art.

Nucleic acid molecules and fragments thereof from WCR or *Lygus* may also be employed to obtain other nucleic acid molecules such as nucleic acid homologues for use in the present invention to produce desired dsRNA and siRNA molecules. Such homologues include the nucleic acid molecules that encode, in whole or in part, protein homologues of other species, plants or other organisms. Such molecules can be readily obtained by using the above-described nucleic acid molecules or fragments thereof to screen EST, cDNA or gDNA libraries. Methods for forming such libraries are well known in the art. Such homologue molecules may differ in their nucleotide sequences from those found in one or more of SEQ ID NO:1 through SEQ ID NO:20303, in SEQ ID NO:40701 through SEQ ID NO:40746 or in SEQ ID NO:40607 through SEQ ID NO:40700 as set forth in the sequence listing or complements thereof disclosed herein, because complete complementarity is not needed for stable hybridization. These nucleic acid molecules also include molecules that, although capable of specifically hybridizing with the nucleic acid molecules may lack complete complementarity. In a particular embodiment, methods for 3' or 5' RACE may be used to obtain such sequences (Frohman, M. A. et al., Proc. Natl. Acad. Sci. (U.S.A.) 85:8998-9002 (1988); Ohara, O. et al., Proc. Natl. Acad. Sci. (U.S.A.) 86:5673-5677 (1989)). In general, any of the above described nucleic acid molecules or fragments may be used to generate dsRNAs or siRNAs that are suitable for use in a diet, in a spray-on mixer or in a recombinant DNA construct of the present invention.

As used herein, the phrase "coding sequence", "structural nucleotide sequence" or "structural nucleic acid molecule" refers to a nucleotide sequence that is translated into a polypeptide, usually via mRNA, when placed under the control of appropriate regulatory sequences. The boundaries of the coding sequence are determined by a translation start codon at the 5'-terminus and a translation stop codon at the 3'-terminus. A coding sequence can include, but is not limited to, genomic DNA, cDNA, EST and recombinant nucleotide sequences.

The term "recombinant DNA" or "recombinant nucleotide sequence" refers to DNA that contains a genetically engineered modification through manipulation via mutagenesis, restriction enzymes, and the like.

The nucleic acid molecules or fragment of the nucleic acid molecules or other nucleic acid molecules from WCR are capable of specifically hybridizing to other nucleic acid molecules under certain circumstances. As used herein, two nucleic acid molecules are said to be capable of specifically hybridizing to one another if the two molecules are capable of forming an anti-parallel, double-stranded nucleic acid structure. A nucleic acid molecule is said to be the complement of another nucleic acid molecule if they exhibit complete complementarity. Two molecules are said to be "minimally complementary" if they can hybridize to one another with sufficient stability to permit them to remain annealed to one another under at least conventional "low-stringency" conditions. Similarly, the molecules are said to be complementary if they can hybridize to one another with sufficient stability to permit them to remain annealed to one another under conventional "high-stringency" conditions. Conventional stringency conditions are described by Sambrook, et al., and by Haymes, et al. In: *Nucleic Acid Hybridization, A Practical Approach*, IRL Press, Washington, D.C. (1985).

Departures from complete complementarity are therefore permissible, as long as such departures do not completely preclude the capacity of the molecules to form a double-stranded structure. Thus, in order for a nucleic acid molecule or a fragment of the nucleic acid molecule to serve as a primer or probe it needs only be sufficiently complementary in sequence to be able to form a stable double-stranded structure under the particular solvent and salt concentrations employed.

Appropriate stringency conditions which promote DNA hybridization are, for example, 6.0× sodium chloride/sodium citrate (SSC) at about 45° C., followed by a wash of 2.0×SSC at 50° C., are known to those skilled in the art or can be found in *Current Protocols in Molecular Biology*, John Wiley & Sons, N.Y. (1989), 6.3.1-6.3.6. For example, the salt concentration in the wash step can be selected from a low stringency of about 2.0×SSC at 50° C. to a high stringency of about 0.2×SSC at 50° C. In addition, the temperature in the wash step can be increased from low stringency conditions at room temperature, about 22° C., to high stringency conditions at about 65° C. Both temperature and salt may be varied, or either the temperature or the salt concentration may be held constant while the other variable is changed.

A nucleic acid for use in the present invention may specifically hybridize to one or more of nucleic acid molecules from WCR or complements thereof under moderately stringent conditions, for example at about 2.0×SSC and about 65° C. A nucleic acid for use in the present invention will include those nucleic acid molecules that specifically hybridize to one or more of the nucleic acid molecules disclosed therein as set forth in SEQ ID NO:1 through SEQ ID NO:20303, in SEQ ID NO:40701 through SEQ ID NO:40746 or in SEQ ID NO:40607 through SEQ ID NO:40700 as set forth in the sequence listing or complements thereof under high stringency conditions. Preferably, a nucleic acid for use in the present invention will exhibit at least from about 80%, or at least from about 90%, or at least from about 95%, or at least from about 98% or even about 100% sequence identity with one or more nucleic acid molecules as set forth in SEQ ID NO:1 through SEQ ID NO:20303, in SEQ ID NO:40701 through SEQ ID NO:40746 or in SEQ ID NO:40607 through SEQ ID NO:40700 as set forth in the sequence listing, or as disclosed herein; or a nucleic acid for use in the present invention will exhibit at from about 80%, or at least from about 90%, or at least from about 95%, or at least from about 98% or even about 100% sequence identity with one or more nucleic acid molecules as set forth in SEQ ID NO:1 through SEQ ID NO:20303, in SEQ ID NO:40701 through SEQ ID NO:40746 or in SEQ ID NO:40607 through SEQ ID NO:40700 as set forth in the sequence listing isolated from the genomic DNA of an insect pest.

All or a substantial portion of the nucleic acids from WCR may be used to isolate cDNAs, gDNAs and nucleic acids encoding *Diabrotica* protein homologues or fragments thereof from the same or other species. The detailed descriptions of the techniques on isolation and identification of nucleic acids of the present invention from cDNA or gDNA libraries are disclosed in the examples.

Nucleic acids of the present invention may also be synthesized, either completely or in part, especially where it is desirable to provide plant-preferred sequences, by methods known in the art. Thus, all or a portion of the nucleic acids of the present invention may be synthesized using codons preferred by a selected host. Species-preferred codons may be determined, for example, from the codons used most frequently in the proteins expressed in a particular host species. Other modifications of the nucleotide sequences may result in mutants having slightly altered activity.

The present invention provides in part a delivery system for the delivery of insect control agents to insects. The stabilized dsRNA or siRNA molecules of the present invention may be directly introduced into the cells of an insect, or introduced into an extracellular cavity, interstitial space, lymph system, digestive system, into the circulation of the insect through oral ingestion or other means that one skilled in the art may employ. Methods for oral introduction may include direct mixing of RNA with food of the insect, as well as engineered approaches in which a species that is used as food is engineered to express the dsRNA or siRNA, then fed to the insect to be affected. In one embodiment, for example, the dsRNA or siRNA molecules may be incorporated into, or overlaid on the top of, the insect's diet. In another embodiment, the RNA may be sprayed onto a plant surface. In still another embodiment, the dsRNA or siRNA may be expressed by microorganisms and the microorganisms may be applied onto a plant surface or introduced into a root, stem by a physical means such as an injection. In still another embodiment, a plant may be genetically engineered to express the dsRNA or siRNA in an amount sufficient to kill the insects known to infect the plant.

Specifically, in practicing the present invention in WCR, the stabilized dsRNA or siRNA may be introduced in the midgut inside the insect and achieve the desired inhibition of the targeted genes. The dsRNA or siRNA molecules may be incorporated into a diet or be overlaid on the diet as discussed above and may be ingested by the insects. In any event, the dsRNA's of the present invention are provided in the diet of the target pest. The target pest of the present invention will exhibit a digestive tract pH from about 4.5 to about 9.5, or from about 5 to about 8.5, or from about 6 to about 8, or from about 6.5 to about 7.7, or about 7.0. The digestive tract of a target pest is defined herein as the location within the pest that food that is ingested by the target pest is exposed to an environment that is favorable for the uptake of the dsRNA molecules of the present invention without suffering a pH so extreme that the hydrogen bonding between the double-strands of the dsRNA are caused to dissociate and form single stranded molecules.

Further, for the purpose of controlling insect infestations in plants, delivery of insect control dsRNAs to the surfaces of a plant via a spray-on application affords another means of protecting the plants. In this instance, a bacterium engineered to produce and accumulate dsRNAs may be fermented and the products of the fermentation formulated as a spray-on product compatible with common agricultural practices. The formulations may include the appropriate stickers and wetters required for efficient foliar coverage as well as UV protectants to protect dsRNAs from UV damage. Such additives are commonly used in the bioinsecticide industry and are well known to those skilled in the art. Likewise, formulations for soil application may include granular formulations that serve as a bait for larvae of soil insect pests such as the corn rootworm.

It is also anticipated that dsRNA's produced by chemical or enzymatic synthesis may be formulated in a manner consistent with common agricultural practices and used as spray-on products for controlling insect infestations. The formulations may include the appropriate stickers and wetters required for efficient foliar coverage as well as UV protectants to protect dsRNAs from UV damage. Such additives are commonly used in the bioinsecticide industry and are well known to those skilled in the art. Such applications could be combined with other spray-on insecticide applications, biologically based or not, to enhance plant protection from insect feeding damage.

The present inventors contemplate that bacterial strains producing insecticidal proteins may be used to produce dsRNAs for insect control purposes. These strains may exhibit improved insect control properties. A variety of different bacterial hosts may be used to produce insect control dsRNAs. Exemplary bacteria may include *E. coli, B. thuringiensis, Pseudomonas* sp., *Photorhadbus* sp., *Xenorhabdus* sp., *Serratia entomophila* and related *Serratia* sp. *B. sphaericus, B. cereus, B. laterosporus, B. popilliae, Clostridium bifermentans* and other *Clostridium* species, or other spore-forming gram-positive bacteria.

The present invention also relates to recombinant DNA constructs for expression in a microorganism. Exogenous nucleic acids from which an RNA of interest is transcribed can be introduced into a microbial host cell, such as a bacterial cell or a fungal cell, using methods known in the art.

The nucleotide sequences of the present invention may be introduced into a wide variety of prokaryotic and eukaryotic microorganism hosts to produce the stabilized dsRNA or siRNA molecules. The term "microorganism" includes prokaryotic and eukaryotic microbial species such as bacteria and fungi. Fungi include yeasts and filamentous fungi, among others. Illustrative prokaryotes, both Gram-negative and Gram-positive, include Enterobacteriaceae, such as *Escherichia, Erwinia, Shigella, Salmonella,* and *Proteus*; Bacillaceae; Rhizobiceae, such as *Rhizobium*; Spirillaceae, such as photobacterium, *Zymomonas, Serratia, Aeromonas, Vibrio, Desulfovibrio, Spirillum*; Lactobacillaceae; Pseudomonadaceae, such as *Pseudomonas* and *Acetobacter*; Azotobacteraceae, Actinomycetales, and Nitrobacteraceae. Among eukaryotes are fungi, such as Phycomycetes and Ascomycetes, which includes yeast, such as *Saccharomyces* and *Schizosaccharomyces*; and Basidiomycetes yeast, such as *Rhodotorula, Aureobasidium, Sporobolomyces,* and the like.

For the purpose of plant protection against insects, a large number of microorganisms known to inhabit the phylloplane (the surface of the plant leaves) and/or the rhizosphere (the soil surrounding plant roots) of a wide variety of important crops may also be desirable host cells for manipulation, propagation, storage, delivery and/or mutagenesis of the disclosed recombinant constructs. These microorganisms include bacteria, algae, and fungi. Of particular interest are microorganisms, such as bacteria, e.g., genera *Bacillus* (including the species and subspecies *B. thuringiensis kurstaki* HD-1, *B. thuringiensis kurstaki* HD-73, *B. thuringiensis sotto, B. thuringiensis berliner, B. thuringiensis thuringiensis, B. thuringiensis tolworthi, B. thuringiensis dendrolimus, B. thuringiensis alesti, B. thuringiensis galleriae, B. thuringiensis aizawai, B. thuringiensis* subtoxicus, *B. thuringiensis entomocidus, B. thuringiensis tenebrionis* and *B. thuringiensis* san diego); *Pseudomonas, Erwinia, Serratia, Klebsiella, Zanthomonas, Streptomyces, Rhizobium, Rhodopseudomonas, Methylophilius, Agrobacterium, Acetobacter, Lactobacillus, Arthrobacter, Azotobacter, Leuconostoc,* and *Alcaligenes*; fungi, particularly yeast, e.g., genera *Saccharomyces, Cryptococcus, Kluyveromyces, Sporobolomyces, Rhodotorula,* and *Aureobasidium*. Of particular interest are such phytosphere bacterial species as *Pseudomonas syringae, Pseudomonas fluorescens, Serratia marcescens, Acetobacter xylinum, Agrobacterium tumefaciens, Rhodobacter sphaeroides, Xanthomonas campestris, Rhizobium melioti, Alcaligenes eutrophus,* and *Azotobacter vinlandii*; and phytosphere yeast species such as *Rhodotorula rubra, R. glutinis, R. marina, R. aurantiaca, Cryptococcus albidus, C. diffluens, C. laurentii, Saccharomyces rosei, S. pretoriensis, S. cerevisiae, Sporobolomyces roseus, S. odorus, Kluyveromyces veronae,* and *Aureobasidium pollulans*.

A bacterial recombinant DNA vector may be a linear or a closed circular plasmid. The vector system may be a single vector or plasmid or two or more vectors or plasmids that together contain the total DNA to be introduced into the genome of the bacterial host. In addition, the bacterial vector may be an expression vector. Nucleic acid molecules as set forth in SEQ ID NO:1 through SEQ ID NO:20303, in SEQ ID NO:40701 through SEQ ID NO:40746 or in SEQ ID NO:40607 through SEQ ID NO:40700 as set forth in the sequence listing or fragments thereof can, for example, be suitably inserted into a vector under the control of a suitable promoter that functions in one or more microbial hosts to drive expression of a linked coding sequence or other DNA sequence. Many vectors are available for this purpose, and selection of the appropriate vector will depend mainly on the size of the nucleic acid to be inserted into the vector and the particular host cell to be transformed with the vector. Each vector contains various components depending on its function (amplification of DNA or expression of DNA) and the particular host cell with which it is compatible. The vector components for bacterial transformation generally include, but are not limited to, one or more of the following: a signal sequence, an origin of replication, one or more selectable marker genes, and an inducible promoter allowing the expression of exogenous DNA.

Expression and cloning vectors generally contain a selection gene, also referred to as a selectable marker. This gene encodes a protein necessary for the survival or growth of transformed host cells grown in a selective culture medium. Typical selection genes encode proteins that (a) confer resistance to antibiotics or other toxins, e.g., ampicillin, neomycin, methotrexate, or tetracycline, (b) complement auxotrophic deficiencies, or (c) supply critical nutrients not available from complex media, e.g., the gene encoding D-alanine racemase for Bacilli. Those cells that are successfully transformed with a heterologous protein or fragment thereof produce a protein conferring drug resistance and thus survive the selection regimen.

An expression vector for producing a mRNA can also contains an inducible promoter that is recognized by the host bacterial organism and is operably linked to the nucleic acid encoding, for example, the nucleic acid molecule coding the *D. v. virgifera* mRNA or fragment thereof of interest. Inducible promoters suitable for use with bacterial hosts include β-lactamase promoter, *E. coli* λ phage $P_L$ and $P_R$ promoters, and *E. coli* galactose promoter, arabinose promoter, alkaline phosphatase promoter, tryptophan (trp) promoter, and the lactose operon promoter and variations thereof and hybrid promoters such as the tac promoter. However, other known bacterial inducible promoters are suitable.

The term "operably linked", as used in reference to a regulatory sequence and a structural nucleotide sequence, means that the regulatory sequence causes regulated expression of the linked structural nucleotide sequence. "Regulatory sequences" or "control elements" refer to nucleotide sequences located upstream (5' noncoding sequences), within, or downstream (3' non-translated sequences) of a structural nucleotide sequence, and which influence the timing and level or amount of transcription, RNA processing or stability, or translation of the associated structural nucleotide sequence. Regulatory sequences may include promoters, translation leader sequences, introns, enhancers, stem-loop structures, repressor binding sequences, and polyadenylation recognition sequences and the like.

Alternatively, the expression constructs can be integrated into the bacterial genome with an integrating vector. Integrating vectors typically contain at least one sequence homologous to the bacterial chromosome that allows the vector to integrate. Integrations appear to result from recombinations between homologous DNA in the vector and the bacterial chromosome. For example, integrating vectors constructed with DNA from various *Bacillus* strains integrate into the *Bacillus* chromosome (EP 0 127,328). Integrating vectors may also be comprised of bacteriophage or transposon sequences. Suicide vectors are also known in the art.

Construction of suitable vectors containing one or more of the above-listed components employs standard recombinant DNA techniques. Isolated plasmids or DNA fragments are cleaved, tailored, and re-ligated in the form desired to generate the plasmids required. Examples of available bacterial expression vectors include, but are not limited to, the multifunctional *E. coli* cloning and expression vectors such as Bluescript™ (Stratagene, La Jolla, Calif.), in which, for example, a *D. v. virgifera* protein or fragment thereof, may be ligated into the vector in frame with sequences for the amino-terminal Met and the subsequent 7 residues of β-galactosidase so that a hybrid protein is produced; pIN vectors (Van Heeke and Schuster, 1989, *J. Biol. Chem.* 264:5503-5509); and the like.

A yeast recombinant construct can typically include one or more of the following: a promoter sequence, fusion partner sequence, leader sequence, transcription termination sequence, a selectable marker. These elements can be combined into an expression cassette, which may be maintained in a replicon, such as an extrachromosomal element (e.g., plasmids) capable of stable maintenance in a host, such as yeast or bacteria. The replicon may have two replication systems, thus allowing it to be maintained, for example, in yeast for expression and in a prokaryotic host for cloning and amplification. Examples of such yeast-bacteria shuttle vectors include YEp24 (Botstein et al., 1979, Gene, 8:17-24), pCl/1 (Brake et al., 1984, Proc. Natl. Acad. Sci. USA, 81:4642-4646), and YRp17 (Stinchcomb et al., 1982, J. Mol. Biol., 158:157). In addition, a replicon may be either a high or low copy number plasmid. A high copy number plasmid will generally have a copy number ranging from about 5 to about 200, and typically about 10 to about 150. A host containing a high copy number plasmid will preferably have at least about 10, and more preferably at least about 20.

Useful yeast promoter sequences can be derived from genes encoding enzymes in the metabolic pathway. Examples of such genes include alcohol dehydrogenase (ADH) (EP 0 284044), enolase, glucokinase, glucose-6-phosphate isomerase, glyceraldehyde-3-phosphate-dehydrogenase (GAP or GAPDH), hexokinase, phosphofructokinase, 3-phosphoglycerate mutase, and pyruvate kinase (PyK) (EP 0 3215447). The yeast PHO5 gene, encoding acid phosphatase, also provides useful promoter sequences (Myanohara et al., Proc. Natl. Acad. Sci. USA, 80:1, 1983). In addition, synthetic promoters that do not occur in nature also function as yeast promoters. Examples of such hybrid promoters include the ADH regulatory sequence linked to the GAP transcription activation region (U.S. Pat. Nos. 4,876,197 and 4,880,734). Other examples of hybrid promoters include promoters which consist of the regulatory sequences of the ADH2, GAL4, GAL10, or PHO5 genes, combined with the transcriptional activation region of a glycolytic enzyme gene such as GAP or PyK (EP 0 164556). Furthermore, a yeast promoter can include naturally occurring promoters of non-yeast origin that have the ability to bind yeast RNA polymerase and initiate transcription.

Examples of transcription terminator sequences and other yeast-recognized termination sequences, such as those coding for glycolytic enzymes, are known to those of skill in the art.

Alternatively, the expression constructs can be integrated into the yeast genome with an integrating vector. Integrating vectors typically contain at least one sequence homologous to a yeast chromosome that allows the vector to integrate, and preferably contain two homologous sequences flanking the expression construct. Integrations appear to result from recombinations between homologous DNA in the vector and the yeast chromosome (Orr-Weaver et al., 1983, Methods in Enzymol., 101:228-245). An integrating vector may be directed to a specific locus in yeast by selecting the appropriate homologous sequence for inclusion in the vector. See Off-Weaver et al., supra. One or more expression constructs may integrate, possibly affecting levels of recombinant protein produced (Rine et al., 1983, Proc. Natl. Acad. Sci. USA, 80:6750). The chromosomal sequences included in the vector can occur either as a single segment in the vector, which results in the integration of the entire vector, or as two segments homologous to adjacent segments in the chromosome and flanking the expression construct in the vector, which results in the stable integration of only the expression construct.

The present invention also contemplates transformation of a nucleotide sequence of the present invention into a plant to achieve pest inhibitory levels of expression of one or more dsRNA molecules. A transformation vector can be readily prepared using methods available in the art. The transformation vector comprises one or more nucleotide sequences that is/are capable of being transcribed to an RNA molecule and that is/are substantially homologous and/or complementary to one or more nucleotide sequences encoded by the genome of the insect, such that upon uptake of the RNA transcribed from the one or more nucleotide sequences molecules by the insect, there is down-regulation of expression of at least one of the respective nucleotide sequences of the genome of the insect.

The transformation vector may further mean a dsDNA construct and may also be regarded inter alia as a recombinant molecule, an insect control agent, a genetic molecule or a chimeric genetic construct. A chimeric genetic construct of the present invention may comprise, for example, nucleotide sequences encoding one or more antisense transcripts, one or more sense transcripts, one or more of each of the aforementioned, wherein all or part of a transcript therefrom is homologous to all or part of an RNA molecule comprising an RNA sequence encoded by a nucleotide sequence within the genome of an insect.

In one embodiment the plant transformation vector is an isolated and purified DNA molecule comprising a promoter operatively linked to one or more nucleotide sequences of the present invention. The nucleotide sequence is selected from the group consisting of SEQ ID NO: 1 through SEQ ID NO:20303, SEQ ID NO:40701 through SEQ ID NO:40746 and SEQ ID NO:40607 through SEQ ID NO:40700 as set forth in the sequence listing. The nucleotide sequence includes a segment coding all or part of an RNA present within a targeted pest RNA transcript and may comprise inverted repeats of all or a part of a targeted pest RNA. The DNA molecule comprising the expression vector may also contain a functional intron sequence positioned either upstream of the coding sequence or even within the coding sequence, and may also contain a five prime (5') untranslated leader sequence (i.e., a UTR or 5'-UTR) positioned between the promoter and the point of translation initiation.

A plant transformation vector may contain sequences from more than one gene, thus allowing production of more than one dsRNA for inhibiting expression of two or more genes in cells of a target pest. One skilled in the art will readily appreciate that segments of DNA whose sequence corresponds to that present in different genes can be combined into a single composite DNA segment for expression in a transgenic plant. Alternatively, a plasmid of the present invention already containing at least one DNA segment can be modified by the sequential insertion of additional DNA segments between the enhancer and promoter and terminator sequences. In the insect control agent of the present invention designed for the inhibition of multiple genes, the genes to be inhibited can be obtained from the same insect species in order to enhance the effectiveness of the insect control agent. In certain embodiments, the genes can be derived from different insects in order to broaden the range of insects against which the agent is effective. When multiple genes are targeted for suppression or a combination of expression and suppression, a polycistronic DNA element can be fabricated as illustrated and disclosed in Fillatti, Application Publication No. US 2004-0029283.

Where a nucleotide sequence of the present invention is to be used to transform a plant, a promoter exhibiting the ability to drive expression of the coding sequence in that particular species of plant is selected. Promoters that function in different plant species are also well known in the art. Promoters useful for expression of polypeptides in plants are those that are inducible, viral, synthetic, or constitutive as described in Odell et al. (1985, Nature 313:810-812), and/or promoters that are temporally regulated, spatially regulated, and spatio-temporally regulated. Preferred promoters include the enhanced CaMV35S promoters, and the FMV35S promoter. For the purpose of the present invention, e.g., for optimum control of species that feed on roots, it is preferable to achieve the highest levels of expression of these genes within the roots of plants. A number of root-enhanced promoters have been identified and are known in the art. (Lu et al., 2000, J. Plant Phys., 156(2):277-283; U.S. Pat. Nos. 5,837,848 and 6,489, 542). A recombinant DNA vector or construct of the present invention will typically comprise a selectable marker that confers a selectable phenotype on plant cells. Selectable markers may also be used to select for plants or plant cells that contain the exogenous nucleic acids encoding polypeptides or proteins of the present invention. The marker may encode biocide resistance, antibiotic resistance (e.g., kanamycin, G418 bleomycin, hygromycin, etc.), or herbicide resistance (e.g., glyphosate, etc.). Examples of selectable markers include, but are not limited to, a neo gene which codes for kanamycin resistance and can be selected for using kanamycin, G418, etc.; a bar gene which codes for bialaphos resistance; a mutant EPSP synthase gene which encodes glyphosate resistance; a nitrilase gene which confers resistance to bromoxynil; a mutant acetolactate synthase gene (ALS) which confers imidazolinone or sulphonylurea resistance; and a methotrexate resistant DHFR gene.

A recombinant vector or construct of the present invention may also include a screenable marker. Screenable markers may be used to monitor expression. Exemplary screenable markers include a β-glucuronidase or uidA gene (GUS) which encodes an enzyme for which various chromogenic substrates are known (Jefferson, 1987, *Plant Mol. Biol, Rep.* 5:387-405; Jefferson et al., 1987, *EMBO J.* 6:3901-3907); an R-locus gene, which encodes a product that regulates the production of anthocyanin pigments (red color) in plant tissues (Dellaporta et al., 1988, Stadler Symposium/1:263-282); a β-lactamase gene (Sutcliffe et al., 1978, *Proc. Natl. Acad. Sci.* 75:3737-3741), a gene which encodes an enzyme for which various chromogenic substrates are known (e.g., PADAC, a chromogenic cephalosporin); a luciferase gene (Ow et al., 1986, *Science* 234:856-859) a xylE gene (Zukowsky et al., 1983, *Proc. Natl. Acad. Sci.* 80:1101-1105) which encodes a catechol dioxygenase that can convert chromogenic catechols; an α-amylase gene (Ikatu et al., 1990, *Bio/Technol.* 8:241-242); a tyrosinase gene (Katz et al., 1983, *J. Gen. Microbiol.* 129:2703-2714) which encodes an enzyme capable of oxidizing tyrosine to DOPA and dopaquinone which in turn condenses to melanin; an α-galactosidase, which catalyzes a chromogenic α-galactose substrate.

In general it is preferred to introduce a functional recombinant DNA at a non-specific location in a plant genome. In special cases it may be useful to insert a recombinant DNA construct by site-specific integration. Several site-specific recombination systems exist which are known to function implants include cre-lox as disclosed in U.S. Pat. No. 4,959, 317 and FLP-FRT as disclosed in U.S. Pat. No. 5,527,695.

In practice DNA is introduced into only a small percentage of target cells in any single transformation experiment. Genes encoding selectable markers are used to provide an efficient system for identification of those cells that are stably transformed by receiving and integrating a transgenic DNA construct into their genomes. Preferred marker genes provide selective markers that confer resistance to a selective agent, such as an antibiotic or herbicide. Any of the herbicides to which plants of this invention may be resistant are useful agents for selective markers. Potentially transformed cells are exposed to the selective agent. In the population of surviving cells will be those cells where, generally, the resistance-conferring gene is integrated and expressed at sufficient levels to permit cell survival. Cells may be tested further to confirm stable integration of the exogenous DNA. Commonly used selective marker genes include those conferring resistance to antibiotics such as kanamycin (nptII), hygromycin B (aph IV) and gentamycin (aac3 and aacC4) or resistance/tolerance to herbicides such as glufosinate (bar or pat), glyphosate (EPSPS), and AMPA (phnO). Examples of such selectable markers are illustrated in U.S. Pat. Nos. 5,550,318; 5,633, 435; 5,780,708 and 6,118,047. Screenable markers which provide an ability to visually identify transformants can also be employed, e.g., a gene expressing a colored or fluorescent protein such as a luciferase or green fluorescent protein (GFP) or a gene expressing a beta-glucuronidase or uidA gene (GUS) for which various chromogenic substrates are known.

Preferred plant transformation vectors include those derived from a Ti plasmid of *Agrobacterium tumefaciens* (e.g. U.S. Pat. Nos. 4,536,475, 4,693,977, 4,886,937, 5,501,967 and EP 0 122 791). *Agrobacterium rhizogenes* plasmids (or "Ri") are also useful and known in the art. Other preferred plant transformation vectors include those disclosed, e.g., by Herrera-Estrella (1983, Nature 303:209-213), Bevan (1983, Nature 304:184-187), Klee (1985, Bio/Technol. 3:637-642) and EP 0 120 516.

Methods and compositions for transforming plants by introducing a recombinant DNA construct into a plant genome includes any of a number of methods known in the art. One method for constructing transformed plants is microprojectile bombardment as illustrated in U.S. Pat. Nos. 5,015, 580, 5,550,318, 5,538,880, 6,153,812, 6,160,208, 6,288,312 and 6,399,861. Another method for constructing transformed plants is *Agrobacterium*-mediated transformation as illustrated in U.S. Pat. Nos. 5,159,135, 5,824,877, 5,591,616 and 6,384,301. Alternatively, other non-Agrobacterium species can be used, such as for example *Rhizobium* and other prokaryotic cells that exhibit the capacity for plant cell infection and introduction of heterologous nucleotide sequences into the genome(s) of the infected plant cell.

The DNA constructs of the present invention may be introduced into the genome of a desired plant host by a variety of conventional transformation techniques, which are well known to those skilled in the art. Suitable plant transformation vectors for the purpose of *Agrobacterium* mediated transformation include those derived from a Ti plasmid of *Agrobacterium tumefaciens*. In addition to *Agrobacterium* mediated plant transformation vectors, alternative methods can be used to insert the DNA constructs of the present invention into plant cells. Such methods may involve, but are not limited to, for example, the use of liposomes, electroporation, chemicals that increase free DNA uptake, free DNA delivery via microprojectile bombardment, and transformation using viruses or pollen.

Any of the isolated nucleic acid molecules of the present invention may be introduced into a plant cell in a permanent or transient manner in combination with other genetic elements such as promoters, introns, enhancers, and untranslated leader sequences, etc. Any of the nucleic acid molecules encoding a coleopteran species RNA or an RNA from a piercing and sucking insect species, or preferably a *D. v. virgifera* RNA or a *Lygus hesperus* RNA, may be fabricated and introduced into a plant cell in a manner that allows for production of the dsRNA molecules within the plant cell, providing an insecticidal amount of one or more particular dsRNA's in the diet of a target insect pest.

The term "transgenic plant cell" or "transgenic plant" refers to a plant cell or a plant that contains an exogenous nucleic acid, which can be derived from WCR, or from a different insect species or any other non-insect species. The transgenic plants are also meant to comprise progeny (decedent, offspring, etc.) of any generation of such a transgenic plant or a seed of any generation of all such transgenic plants wherein said progeny or seed comprises a DNA sequence encoding the RNA, sRNA, dsRNA, siRNA, or fragment thereof of the present invention is also an important aspect of the invention.

A transgenic plant formed using *Agrobacterium* transformation methods typically contains a single simple recombinant DNA sequence inserted into one chromosome and is referred to as a transgenic event. Such transgenic plants can be referred to as being heterozygous for the inserted exogenous sequence. A transgenic plant homozygous with respect to a transgene can be obtained by sexually mating (setting) an independent segregant transgenic plant that contains a single exogenous gene sequence to itself, for example an F0 plant, to produce F1 seed. One fourth of the F1 seed produced will be heterozygous with respect to the transgene. Germinating F1 seed results in plants that can be tested for heterozygosity, typically using a SNP assay or a thermal amplification assay that allows for the distinction between heterozygotes and homozygotes (i.e., a zygosity assay). Crossing a heterozygous plant with itself or another heterozygous plant results in only heterozygous progeny.

In addition to direct transformation of a plant with a recombinant DNA construct, transgenic plants can be prepared by crossing a first plant having a recombinant DNA construct with a second plant lacking the construct. For example, recombinant DNA for gene suppression can be introduced into first plant line that is amenable to transformation to produce a transgenic plant that can be crossed with a second plant line to introgress the recombinant DNA for gene suppression into the second plant line.

Transgenic plants, that can be generated by practice of the present invention, include but are not limited to alfalfa, aneth, apple, apricot, artichoke, arugula, asparagus, avocado, banana, barley, beans, beet, blackberry, blueberry, broccoli, brussel sprouts, cabbage, canola, cantaloupe, carrot, cassava, cauliflower, celery, cherry, cilantro, citrus, clementine, coffee, corn, cotton, cucumber, Douglas fir, eggplant, endive, escarole, eucalyptus, fennel, figs, gourd, grape, grapefruit, honey dew, jicama, kiwifruit, lettuce, leeks, lemon, lime, Loblolly pine, mango, melon, mushroom, nut, oat, okra, onion, orange, an ornamental plant, papaya, parsley, pea, peach, peanut, pear, pepper, persimmon, pine, pineapple, plantain, plum, pomegranate, poplar, potato, pumpkin, quince, radiata pine, radicchio, radish, raspberry, rice, rye, sorghum, Southern pine, soybean, spinach, squash, strawberry, sugarbeet, sugarcane, sunflower, sweet potato, sweetgum, tangerine, tea, tobacco, tomato, turf, a vine, watermelon, wheat, yams, and zucchini.

The present invention can be, in practice, combined with other insect control traits in a plant to achieve desired traits for enhanced control of insect infestation. Combining insect control traits that employ distinct modes-of-action can provide insect-protected transgenic plants with superior durability over plants harboring a single insect control trait because of the reduced probability that resistance will develop in the field.

The mechanism of insecticidal activity of *B. thuringiensis* crystal proteins has been studied extensively in the past decade. It has been shown that the crystal proteins are toxic to the larval form of the insect only after ingestion of the protein. In lepidopteran larvae, an alkaline pH and proteolytic enzymes in the insect mid-gut solubilize the proteins, thereby allowing the release of components that are toxic to the insect. These toxic components disrupt the mid-gut cells, cause the insect to cease feeding, and, eventually, bring about insect death. For this reason, *B. thuringiensis* toxins have proven themselves to be effective and environmentally safe insecticides in dealing with various insect pests. Coleopteran and hemipteran insects, and likely dipteran, *lygus* and other piercing and sucking insects exhibit a gut pH that is slightly acidic, and so the Bt toxins that are effective against lepidopteran larvae are ineffective against these pests. The slightly acidic pH of the gut of these insects is also believed to be more hospitable to the compositions of the present invention, and without intending to be limited to a particular theory, it is likely that the alkaline pH of the gut of lepidopteran larvae is the reason that prior attempts to exhibit dsRNA efficacy has failed (Fire et al. U.S. Pat. No. 6,506,559; Mesa et al. Patent Publication No. US2003/0150017; Rajagopal et al., 2002, J. Biol. Chem. 277:46849-46851; Tabara et al., 1998, Science 282:430-431). It is believed therefore that the dsRNA methods disclosed herein should be preferentially used in compositions and in plants to control coleopteran, dipteran, hemipteran, *lygus*, and piercing and sucking insects. The methods and compositions set forth herein are particularly useful for targeting genes for suppression in insects exhibiting a gut pH of from about 4.5 to about 9.5, or from about 5.0 to about 9.0, or from about 5.5 to about 8.5, or from about 6.0 to about 8.0, or from about 6.5 to about 7.7, or from about 6.8 to about 7.6, or about 7.0. However, insects and other pest species that exhibit a gut pH of from about 7.5 to about 11.5, or from about 8.0 to about 11.0, or from about 9.0 to about 10.0, such as lepidopteran insect larvae, are also intended to be within the scope of the present invention. This is particularly true when a dsRNA specific for inhibiting a gene in a lepidopteran larvae is provided in the diet of the larvae along with one or more Bt proteins, that, with respect to the Bt protein would ordinarily be toxic to that lepidopteran larvae when provided at or above a threshold level. The presence of one or more Bt toxins toxic to the same insect species would effectively reduce the gut pH, providing a stable environment for the double stranded RNA molecules to exert their effects in suppressing a target gene in the insect pest.

It would be useful to combine one or more stabilized dsRNA constructs producing dsRNA molecules of the present invention in the diet of a target insect pest along with one or more insecticidal proteins, such that the dsRNA and the insecticidal protein are toxic to the same insect pest. The insecticidal protein could be derived from *B. thuringiensis* but also from other organisms known in the art to produce insecticidal proteins such as bacterial symbionts of entomopathogenic nematodes (e.g. *Photorhabdus* sp., *Xenorhabdus* sp.), *Serratia entomophila* and related *Serratia* sp., *B. sphaericus, B. cereus, B. laterosporus, B. popilliae, Clostridium bifermenrans*, or other spore-forming gram-positive bacteria that exhibit insecticidal properties. Likewise, it is envisioned that two or more different stabilized dsRNA constructs producing dsRNA molecules of the present invention could be provided together within a single plant to ensure durability of the insect control phenotype. These dsRNA molecules could target the same gene for silencing or, alternatively, target different genes for silencing. Two or more different dsRNA's can be combined together in the same plant, each dsRNA being toxic to a different insect pest, neither of the dsRNA's being toxic to the same insect species.

It is anticipated that the combination of certain stabilized dsRNA constructs with one or more insect control protein genes will result in synergies that enhance the insect control phenotype of a transgenic plant. Insect bioassays employing artificial diet- or whole plant tissue can be used to define dose-responses for larval mortality or growth inhibition using both dsRNAs and insect control proteins. One skilled in the art can test mixtures of dsRNA molecules and insect control proteins in bioassay to identify combinations of actives that are synergistic and desirable for deployment in insect-protected plants (Tabashnik, 1992). Synergy in killing insect pests has been reported between different insect control proteins (for review, see Schnepf et al., 1998). It is anticipated that synergies will exist between certain dsRNAs and between certain dsRNAs and certain insect control proteins.

It is also anticipated that combinations of dsRNA's will reveal unexpected toxicity towards certain insect pests. Rajagopol et al (2002, J Biol. Chem. 277:46849-46851) reported that feeding dsRNAs to larvae of the lepidopteran pest *S. litura* was ineffective in silencing a gene encoding a midgut aminopeptidase. It is worth noting that the alkaline pH environment of the typical lepidopteran midgut may be a hostile environment for dsRNAs since the denaturation of RNA duplexes at alkaline pH would be expected to lead to rapid degradation. Pores formed by *B. thuringiensis* toxin proteins inserted into the midgut epithelial membrane, result in a neutralization of the midgut pH (reviewed in Gill, 1995, Mem. Inst. Osaldo Cruz, Rio de Janeiro, 90:69-74). Accordingly, *B. thuringiensis* toxin proteins that are only capable of forming transient ion channels in the lepidopteran midgut epithelial membrane without causing mortality may be sufficient to reduce the midgut pH to levels more conducive for the uptake of dsRNAs by midgut epithelial cells. As one example, it is known that the Cry1Ac protein is not an effective toxin against the beet armyworm, *Spodoptera exigua* (Chambers et al., 1991, J. Bacteriol. 173:3966-3976). Nevertheless, transient reductions in midgut pH caused by the Cry1 Ac protein could serve to stabilize co-ingested dsRNAs and render them effective in silencing *S. exigua* target genes, thereby providing an unexpected means of controlling this insect pest. This effect could be observed with any protein, insecticidal or not, that disrupts the ion regulation of lepidopteran insect midgut cells, and may also be effective in coleopteran, dipteran, hemipteran, *lygus* bug and other piercing and sucking insect species, and the like.

Some insecticidal proteins from *B. thuringiensis*, such as the Cyt proteins, may cause transient openings in the midgut epithelial membrane of sensitive insect larvae due to the formation of structured pores or to the general detergent-like activity of the protein (Butko, 2003, Appl. Environ. Microbiol. 69:2415-2422). Such openings could facilitate the passage of dsRNA molecules into midgut epithelial cells even at protein concentrations that are sub-optimal for causing mortality. It is anticipated that any protein, insecticidal or not, that causes transient openings in the epithelial membranes of insects could facilitate the passage of dsRNA molecules into insect cells and promote gene silencing.

The nucleotide sequences provided as set forth in SEQ ID NO:1 through SEQ ID NO:20303, in SEQ ID NO:40701 through SEQ ID NO:40746 or in SEQ ID NO:40607 through SEQ ID NO:40700 as set forth in the sequence listing or fragments thereof, or complements thereof, can be "provided" in a variety of mediums to facilitate use. Such a medium can also provide a subset thereof in a form that allows a skilled artisan to examine the sequences.

Commodity products containing one or more of the sequences of the present invention, and produced from a recombinant plant or seed containing one or more of the nucleotide sequences of the present invention are specifically contemplated as embodiments of the present invention. A commodity product containing one or more of the sequences of the present invention is intended to include, but not be limited to, meals, oils, crushed or whole grains or seeds of a plant, or any food product comprising any meal, oil, or crushed or whole grain of a recombinant plant or seed containing one or more for the sequences of the present invention. The detection of one or more of the sequences of the present invention in one or more commodity or commodity products contemplated herein is defacto evidence that the commodity or commodity product is composed of a transgenic plant designed to express one or more of the nucleotides sequences of the present invention for the purpose of controlling insect infestation using dsRNA mediated gene suppression methods.

In one application of this embodiment, a nucleotide sequence of the present invention can be recorded on computer readable media. As used herein, "computer readable media" refers to any tangible medium of expression that can be read and accessed directly by a computer. Such media include, but are not limited to: magnetic storage media, such as floppy discs, hard disc, storage medium, and magnetic tape: optical storage media such as CD-ROM; electrical storage media such as RAM and ROM; optical character recognition formatted computer files, and hybrids of these categories such as magnetic/optical storage media. A skilled artisan can readily appreciate that any of the presently known computer readable mediums can be used to create a manufacture comprising computer readable medium having recorded thereon a nucleotide sequence of the present invention.

As used herein, "recorded" refers to a process for storing information on computer readable medium. A skilled artisan can readily adopt any of the presently known methods for recording information on computer readable medium to generate media comprising the nucleotide sequence information of the present invention. A variety of data storage structures are available to a skilled artisan for creating a computer readable medium having recorded thereon a nucleotide sequence of the present invention. The choice of the data storage structure will generally be based on the means chosen to access the stored information. In addition, a variety of data processor programs and formats can be used to store the nucleotide sequence information of the present invention on computer readable medium. The sequence information can be represented in a word processing text file, formatted in commercially-available software such as WordPerfect and Microsoft Word, or represented in the form of an ASCII text file, stored in a database application, such as DB2, Sybase, Oracle, or the like. The skilled artisan can readily adapt any number of data processor structuring formats (e.g. text file or database) in order to obtain computer readable medium having recorded thereon the nucleotide sequence information of the present invention.

Computer software is publicly available which allows a skilled artisan to access sequence information provided in a computer readable medium. Software that implements the BLAST (Altschul et al., *J. Mol. Biol.* 215: 403-410 (1990)) and BLAZE (Brutlag, et al., *Comp. Chem.* 17: 203-207 (1993)) search algorithms on a Sybase system can be used to identify open reading frames (ORFs) within sequences such as the Unigenes and EST's that are provided herein and that contain homology to ORFs or proteins from other organisms. Such ORFs are protein-encoding fragments within the sequences of the present invention and are useful in producing commercially important proteins such as enzymes used in amino acid biosynthesis, metabolism, transcription, translation, RNA processing, nucleic acid and a protein degradation, protein modification, and DNA replication, restriction, modification, recombination, and repair.

The present invention further provides systems, particularly computer-based systems, which contain the sequence information described herein. Such systems are designed to identify commercially important fragments of the nucleic acid molecule of the present invention. As used herein, "a computer-based system" refers to the hardware means, software means, and data storage means used to analyze the nucleotide sequence information of the present invention. The minimum hardware means of the computer-based systems of the present invention comprises a central processing unit (CPU), input means, output means, and data storage means. A skilled artisan can readily appreciate that any one of the currently available computer-based system are suitable for use in the present invention.

The most preferred sequence length of a target sequence is from about 10 to about 100 amino acids or from about 23 to about 300 nucleotide residues.

As used herein, "a target structural motif," or "target motif," refers to any rationally selected sequence or combination of sequences in which the sequences or sequence(s) are chosen based on a three-dimensional configuration that is formed upon the folding of the target motif. There are a variety of target motifs known in the art. Protein target motifs include, but are not limited to, enzymatic active sites and signal sequences. Nucleic acid target motifs include, but are not limited to, promoter sequences, cis elements, hairpin structures and inducible expression elements (protein binding sequences).

EXAMPLES

The inventors herein have identified a means for controlling invertebrate pest infestation by providing a double stranded ribonucleic acid molecule in the diet of the pest. Surprisingly, the inventors have discovered that a double stranded ribonucleic acid molecule functions upon ingestion by the pest to inhibit a biological function in the pest, resulting in one or more of the following attributes: reduction in feeding by the pest, reduction in viability of the pest, death of the pest, inhibition of differentiation and development of the pest, absence of or reduced capacity for sexual reproduction by the pest, muscle formation, juvenile hormone formation, juvenile hormone regulation, ion regulation and transport, maintenance of cell membrane potential, amino acid biosynthesis, amino acid degradation, sperm formation, pheromone synthesis, pheromone sensing, antennae formation, wing formation, leg formation, development and differentiation, egg formation, larval maturation, digestive enzyme formation, haemolymph synthesis, haemolymph maintenance, neurotransmission, cell division, energy metabolism, respiration, apoptosis, and any component of a eukaryotic cells' cytoskeletal structure, such as, for example, actins and tubulins. Any one or any combination of these attributes can result in an effective inhibition of pest infestation, and in the case of a plant pest, inhibition of plant infestation. For example, when used as a diet composition containing a pest inhibitory sufficient amount of one or more double stranded ribonucleic acid molecules provided topically to a plant, as a seed treatment, as a soil application around a plant, or when produced by a plant from a recombinant DNA molecule present within the cells of a plant, plant pest infestation is unexpectedly dramatically reduced. The Examples set forth herein below are illustrative of the invention when applied to a single pest. However, the skilled artisan will recognize that the methods, formulae, and ideas presented in the Examples are not intended to be limiting, and are applicable to all invertebrate pest species that can consume food sources that can be formulated to contain a sufficient amount of a pest inhibitory agent consisting at least of one or more double stranded RNA molecules exemplified herein intended to suppress some essential feature about or function within the pest.

Example 1

This example illustrates the identification of nucleotide sequences that, when provided in the form of double stranded RNA molecules in the diet of a corn rootworm, are useful for controlling corn rootworms.

Corn rootworm cDNA libraries (LIB149, LIB 150, LIB3027, LIB3373) were constructed from whole larvae and from dissected midgut sections, and nucleotide sequence information was obtained (see Andersen et al., U.S. Pat. No. 7,612,194 filed Jul. 24, 2002, incorporated herein specifically by reference in its entirety). In addition, cDNA libraries were constructed from whole larvae at different developmental stages and at different times within each developmental stage in order to maximize the number of different EST sequences from the *Diabrotica* species. Libraries LIB5444 and LIB5462 were constructed respectively from mRNA pools obtained from first (1 gram) and third (2.9 grams) instar Western Corn Rootworm larvae. Harvested insects were rapidly frozen by insertion into liquid nitrogen. The insects were ground in a mortar and pestle maintained at or below −20C by chilling on dry ice and/or with the addition of liquid nitrogen to the mortar until the tissue was ground into a fine powder. RNA was extracted using TRIzol® reagent (Invitrogen) according to the manufacturer's instructions. Poly A+ RNA was isolated from the total RNA prep using Dynabeads Oligo dT (Dynal Inc., NY) following the manufacturer's instructions. A cDNA library was constructed from the Poly A+ RNA using the SuperScript™ Plasmid System (Invitrogen). cDNA was size fractionated using chromatography. The fourth and fifth fractions were collected and ligated into the pSPORT1 vector (Life Technologies Inc., Gaithersburg MD) between the Sal1 and Not1 restriction endonucleases recognition sites, and transformed into *E. coli* DH10B electro-competent cells by electroporation. The first instar larvae library yielded about 420,000 colony-forming units. The third instar larvae library yielded about $2.78 \times 10^6$ colony forming units. Colonies from LIB149, LIB150 were washed from the plates, mixed to uniformity by vortexing briefly, and pooled into Tris-EDTA buffer. Half of the wash was brought to 10% glycerol, aliquoted into cryovials, and stored at −70C. The other half was used to produce plasmid DNA using a Quiagen midi-prep purification column, or its equivalent. Purified plasmid DNA was aliquoted to microcentrifuge tubes and stored at −20C.

Colonies from the *Diabrotica virgifera* cDNA libraries LIB5444 and LIB5462 were amplified individually in a high viscosity medium. Approximately 200,000 colony-forming units from LIB5444 and 600,000 colony-forming units from LIB5462 were mixed on a stir plate separately in 500 ml LB medium containing 0.3% SeaPrep Agarose® and 50 mg/l carbenecillin at 37° C. and then rapidly cooled in a water/ice bath for 1 hour allowing uniform suspension of the bacterial colonies. The inoculated libraries were then grown at 30° C. for 42 hours. After incubation, the cells were mixed for 5 minutes on a stir plate. The medium was then transferred to two 250 ml centrifuge bottles. The bacterial cells were pelleted at 10,000×g for 10 minutes. The medium was removed from the bottles and the cells were resuspended in a total of 20 ml of LB medium with 50 mg/l carbenecillin. Dimethyl sulfoxide was added to 10% to preserve the cells in freezing. Both libraries were amplified to a final titer of $10^8$ colony-forming units per milliliter. Samples of the *Diabrotica virgifera* cDNA libraries LIB5444 and LIB5462 were combined and adjusted to a DNA concentration of about 1.25 micrograms per microliter in sterile distilled and deionized water and aliquoted into twenty five cryovials, each cryovial containing about 8.75 micrograms of DNA. These samples were deposited by the applicant(s)/inventors with the American Type Culture Collection (ATCC) located at 10801 University Boulevard, Manassas, Va., USA ZIP 20110-2209 on Jun. 10, 2004 and referred to as LIB5444/62. The ATCC provided the Applicant with a deposit receipt, assigning the ATCC Deposit Accession No. PTA-6072.

Corn rootworm high molecular weight cDNA libraries, i.e., LIB5496 and LIB5498, were prepared essentially as described above for the production of corn rootworm cDNA libraries. Libraries LIB5496 and LIB5498 were constructed respectively from mRNA pools obtained from first (1 gram) and second and third (1 gram) instar Western Corn Rootworm larvae. Briefly, insects were quickly frozen in liquid nitrogen. The frozen insects were reduced to a fine powder by grinding in a mortar and pestle. RNA was extracted using TRIzol® reagent (Invitrogen) following the manufacturer's instructions. Poly A+ RNA was isolated from the total RNA prep using Dynabeads Oligo dT (Dynal Inc., NY). A high molecular weight cDNA library was made from 20 micrograms of Poly A+ RNA using the SuperScript™ Plasmid System (Invitrogen). The cDNA was size fractionated on a 1% agarose gel in TAE, and cDNA between the range of 1 Kb to 10 Kb was collected and ligated into the pSPORT1 vector in between the SalI and NotI restriction sites and transformed into *E. coli* DH10B electro-competent cells by electroporation. LIB5496 yielded a total titer of about $3.5 \times 10^6$ colony forming units. LIB5498 yielded a total titer of about $1.0 \times 10^6$ colony forming units. Colonies from the corn rootworm high molecular weight cDNA libraries LIB5496 and LIB5498 were amplified individually in a high viscosity medium. Approximately 600,000 colony-forming units from LIB5496 and LIB5498 were mixed on a stir plate separately in 500 ml LB medium containing 0.3% SeaPrep Agarose® and 50 mg/l carbenecillin at 37° C. and then rapidly cooled in a water/ice bath for 1 hour allowing uniform suspension of the bacterial colonies. The libraries were then grown at 30° C. for 42 hours. After incubation, the cells were mixed for 5 minutes on a stir plate. The medium was then transferred to two 250 mL centrifuge bottles. The bacterial cells were pelleted at $10,000 \times g$ for 10 minutes. The medium was removed from the bottles and the cells were resuspended in a total of 20 mL of LB medium with 50 mg/L carbenecillin. Dimethyl sulfoxide was added to 10% to preserve the cells in freezing. Both libraries were amplified to a final titer of $10^8$ colony-forming units per milliliter. Inserted cDNA sequence information was obtained from the corn rootworm species-specific plasmid libraries.

The Andersen et al. rootworm libraries together with additional sequences from the libraries LIB5444 and LIB5462 initially produced about 18,415 individual EST sequences consisting of approximately $1.0 \times 10^7$ nucleotide residues. The average length of an EST sequence was about 586 nucleotide residues. These EST sequences were subjected to bioinformatics algorithms that resulted in the assembly of contig sequences referred to herein as UNIGENE sequences, and individual EST sequences that could not be compiled by overlap identity with other EST sequences, referred to herein as singletons. The LIB5444 and LIB5462 libraries were then sequenced much deeper, resulting in additional individual EST sequences. EST sequences obtained from libraries, i.e., LIB149, LIB150, LIB3027, LIB3373, LIB5444, LIB5462, LIB5496 and LIB5503, are set forth in the sequence listing from SEQ ID NO:1 through SEQ ID NO:20303, SEQ ID NO:40701 through SEQ ID NO:40746 and SEQ ID NO:40607 through SEQ ID NO:40700.

EST sequences isolated from CRW cDNA libraries were assembled, where possible, into UNIGENE sets and these assembled Unigene sequences are listed in the sequence listing as set forth in SEQ ID NO:1 through SEQ ID NO:20303. A UNIGENE is a gene-oriented cluster formed from the overlap of individual EST sequences within regions of sequence identity to form a larger sequence. Pontius et al., Nucl Acids Res 31:28-33 (2003). Each nucleotide sequence as set forth in the sequence listing was analyzed to identify the presence of open reading frames. Amino acid sequence information deduced from open reading frames was compared to known amino acid sequence information available in public databases in order to deduce the extent of amino acid sequence identity or similarity to those known amino acid sequences. Biological function, if any, associated with known amino acid sequences in public databases was annotated to the amino acid sequences deduced from the cDNA library nucleotide sequence information. Annotations provided information that was suggestive of the function of a protein that may be expressed from a particular gene that gave rise to a particular cDNA sequence, but was not outcome determinative. Based on the suggestive annotation information, certain cDNA sequences were characterized as those that encoded a protein that was likely involved in some biological function within corn rootworm cells that was either essential to life, or that was necessary for ensuring health and vitality to a cell, or were likely to be involved in cellular integrity, cell maintenance, reproductive capacity, and the like.

Several cDNA sequences were selected from this subset of cDNA sequences likely encoding proteins, the inhibition of which was likely to cause morbidity or mortality to CRW or to other invertebrate species cells. These sequences were then used in the construction of double stranded RNA molecules for incorporation into CRW diet.

Thermal amplification primer pairs were designed based on the cDNA sequences reported in the CRW cDNA library. Primer pairs were constructed either as a pair of nucleotide sequences, each member of a primer pair exhibiting perfect complementarity either to a sense or to an antisense sequence. Some primer pair sequences were constructed so that each member of the pair exhibited a sequence containing a T7 phage RNA polymerase promoter at it's 5' end as set forth, for example, in SEQ ID NO:40608 from nucleotide position 1 through nucleotide position 23. Preferably a higher fidelity first amplification reaction was carried out using a first primer pair lacking a T7 promoter to generate a first amplicon using CRW genomic DNA as template. Preferably a cDNA or a mRNA sequence is used as the template for the synthesis of a dsRNA molecule for use in the present invention because eukaryotic genome sequences are recognized in the art to contain sequences that are not present within the mature RNA molecule. A sample of the first amplicon generated from the higher fidelity first amplification reaction was then used as template in a second thermal amplification reaction with a second primer pair containing the T7 promoter sequence to produce a second amplicon that contained a T7 promoter at or embedded within the 5' end of each strand of the second amplicon. The complete nucleotide sequence of the second amplicon was obtained in both directions and compared to the nucleotide sequence as reported for the cDNA, and discrepancies between the two sequences, if any, were noted. Generally, sequences prepared using genome DNA as template were inconsistent with further use as dsRNA molecules for use in achieving significant levels of suppression because of variations within the genome sequences that were not present within the mRNA or cDNA sequence.

An in vitro transcription reaction typically contained from about 1 to about 2 micrograms of linearized DNA template, T7 polymerase reaction buffer from a 10× concentrate, ribonucleotides ATP, CTP, GTP, and UTP at a final concentration of from between 50 and 100 mM each, and 1 unit of T7 RNA polymerase enzyme. The RNA polymerase reaction was incubated at about 37 C, depending on the optimal temperature of the RNA polymerase used according to the manufacturers' instructions, for a period of time ranging from several minutes to several hours. Generally, reactions were carried out for from about 2 to about 6 hours for transcription of template sequences up to about 400 nucleotides in length, and for up to 20 hours for transcription of template sequences greater than about 400 nucleotides in length. Heating the reaction to 65 C for fifteen minutes termintes RNA transcription. RNA transcription products were precipitated in ethanol, washed, air dried and resuspended in RNAse free water to a concentration of about 1 microgram per microliter. Most transcripts which took advantage of the opposing T7 promoter strategy outlined above produced double stranded RNA in the in vitro transcription reaction, however, a higher yield of double stranded RNA was obtained by heating the purified RNA to 65 C and then slowly cooling to room temperature to ensure proper annealing of sense and antisense RNA segments. Double stranded RNA products were then incubated with DNAse I and RNAse at 37 C for one hour to remove any DNA or single stranded RNA present in the mixture. Double stranded RNA products were purified over a column according to the manufacturers' instructions (AMBION MEGASCRIPT RNAi KIT) and resuspended in 10 mM Tris-HCl buffer (pH 7.5) or RNAse free water to a concentration of between 0.1 and 1.0 microgram per microliter.

A sample of double stranded RNA was either added directly to each well containing insect diet as indicated above, or was modified prior to being added to insect diet. Modification of double stranded RNA followed the instructions for RNAse III (AMBION CORPORATION, Austin, Tex.) or DICER (STRATAGENE, La Jolla, Calif.) provided by the manufacturer. RNAse III digestion of double stranded RNA produced twenty-one and twenty-two nucleotide duplexes containing 5' phosphorylated ends and 3' hydroxyl ends with 2-3 base overhangs, similar to the ~21-26 base pair duplexed short interfering RNA (siRNA) fragments produced by the dicer enzyme in the eukaryotic pathway identified by Hamilton et. al. (Science, 1999, 286:950-952) and Elbashir et. al. (Genes & Development, 2001, 15:188-200). This collection of short interfering RNA duplexes was further purified and a sample characterized by polyacrylamide gel electrophoresis to determine the integrity and efficiency of duplex formation. The purity and quantity of the sample was then determined by spectrophotometry at a wavelength of 250 nanometers, and unused sample retained for further use by storage at −20 C.

Samples of siRNA or full length double stranded RNA (dsRNA) were subjected to bioassay with a selected number of target pests. Varying does of dsRNA or siRNA were applied as an overlay to corn rootworm artificial diet according to the following procedure. *Diabrotica virgifera* virgifera (WCR) eggs were obtained from Crop Characteristics, Inc., Farmington, Minn. The non-diapausing WCR eggs were incubated in soil for about 13 days at 24 C, 60% relative humidity, in complete darkness. On day 13 the soil containing WCR eggs was placed between #30 and #60 mesh sieves and the eggs were washed out of the soil using a high pressure garden hose. The eggs were surface disinfested by soaking in LYSOL for three minutes, rinsed three times with sterile water, washed one time with a 10% formalin solution and then rinsed three additional times in sterile water. Eggs treated in this way were dispensed onto sterile coffee filters and hatched overnight at 27 C, 60% relative humidity, in complete darkness.

Insect diet was prepared essentially according to Pleau et al. (Entomologia Experimentalis et Applicata, 2002, 105:1-11), with the following modifications. 9.4 grams of SERVA agar was dispensed into 540 milliliters of purified water and agitated until the agar was thoroughly distributed. The water/agar mixture was heated to boiling to completely dissolve the agar, and then poured into a WARING blender. The blender was maintained at low speed while 62.7 grams of BIO-SERV DIET mix (F9757), 3.75 grams lyophilized corn root, 1.25 milliliters of green food coloring, and 0.6 milliliters of formalin was added to the hot agar mixture. The mixture was then adjusted to pH 9.0 with the addition of a 10% potassium hydroxide stock solution. The approximately 600 milliliter volume of liquid diet was continually mixed at high speed and maintained at from about 48 C to about 60 C using a sterilized NALGENE coated magnetic stir bar on a magnetic stirring hot plate while being dispensed in aliquots of 200 microliters into each well of FALCON 96-well round bottom microtiter plates. The diet in the plates was allowed to solidify and air dry in a sterile biohood for about ten minutes.

Thirty (30) microliter volumes of test samples containing either control reagents or double stranded RNA in varying quantities was overlayed onto the surface of the insect diet in each well using a micro-pipettor repeater. Insect diet was allowed to stand in a sterile biohood for up to one half hour after application of test samples to allow the reagents to diffuse into the diet and to allow the surface of the diet to dry. One WCR neonate larva was deposited to each well with a fine paintbrush. Plates were then sealed with MYLAR and ventilated using an insect pin. 12-72 insect larvae were tested per dose depending on the design of the assay. The bioassay plates were incubated at 27 C, 60% relative humidity in complete darkness for 12-14 days. The number of surviving larvae per dose was recorded at the 12-14 day time point. Larval mass was determined using a suitable microbalance for each surviving larva. Data was analyzed using JMP®4 statistical software (SAS Institute, 1995) and a full factorial ANOVA was conducted with a Dunnet's tet to look for treatment effects compared to the untreated control (P<0.05). A Tukey-Kramer post hoc test was performed to compare all pairs of the treatments (P<0.05).

The following nucleotide sequences were derived first as cDNA sequences identified in a corn rootworm mid-gut cDNA library (Andersen et al., ibid), and were adapted for use in constructing double stranded RNA molecules for use in testing the efficacy of inhibiting a biological function in a pest by feeding double stranded RNA molecules in the diet of the pest.

A Chd3 Homologous Sequence

CHD genes have been identified in numerous eukaryotes, and the corresponding proteins are proposed to function as chromatin-remodeling factors. The term CHD is derived from the three domains of sequence homology found in CHD proteins: a chromo (chromatin organization modifier) domain, a SNF2-related helicase/ATPase domain, and a DNA-binding domain, each of which is believed to confer a distinct chromatin-related activity. CHD proteins are separated into two categories based on the presence or absence of another domain of sequence homology, a PHD zinc finger domain, typically associated with chromatin related activity. CHD3 related proteins possess a PHD zinc finger domain, but CHD1 related proteins do not. Experimental observations have suggested a role for CHD3 proteins in repression of transcription, and in some species have been shown to be a component of a complex that contains histone deacetylase as a subunit. Deacetylation of histones is correlated with transcriptional inactivation, and so CHD3 proteins have been implicated to function as repressors of transcription by virtue of being a component of a histone deacetylase complex (Ogas et al., 1999, PNAS 96:13839-13844). Thus, suppression of CHD3 protein synthesis may be a useful target for double stranded RNA mediated inhibition of invertebrate pests.

SEQ ID NO:40607 corresponds to a CRW midgut cDNA nucleotide sequence, the amino acid sequence translation of which was annotated to be homologous to a *Drosophila melanogaster* CHD3 amino acid sequence (GenBank accession No. AF007780). SEQ ID NO:40608 and SEQ ID NO:40609 correspond respectively to forward and reverse genome amplification primers (i.e., a primer pair) for use in producing an amplicon from CRW genomic DNA, from CRW mRNA pools, or from a cDNA produced from such pools. The sequence of such an amplicon corresponds to a part of a CRW gene encoding a homolog of a *D. melanogaster* CHD3 amino acid sequence. SEQ ID NO:40608 contains a T7 polymerase promoter sequence at its 5' end (nucleotides 1-23) linked to a CRW genome primer sequence (arbitrarily assigned as the forward primer sequence) depicted as set forth at SEQ ID NO:40608 from nucleotide position 24-45, which corresponds to nucleotide position 31 through nucleotide position 52 as set forth in SEQ ID NO:40607. SEQ ID NO:40609 contains a T7 polymerase promoter sequence at its 5' end as set forth from nucleotide position 1-23. The T7 promoter sequence is linked at its 3' end to an arbitrarily assigned reverse genome primer sequence corresponding to nucleotide position 24-44 as set forth in SEQ ID NO:40609, the reverse complement of the sequence as set forth in SEQ ID NO:40607 from nucleotide position 298-319. Using the primer pair consisting of SEQ ID NO:40608 and SEQ ID NO:40609 in an amplification reaction with CRW genomic DNA as a template, a 335 base pair amplicon comprising the nucleotide sequence as set forth in SEQ ID NO:40610 is produced, corresponding to a part of the CRW genome that encodes a protein exhibiting about 66% identity to a *Drosophila melanogaster* CHD3 amino acid sequence. Nucleotides at position 1-23 and the reverse complement of nucleotides at position 314-335 as set forth in SEQ ID NO:40610 correspond to the T7 promoter sequences at either end of the amplicon. The amplified genomic nucleotide sequence as set forth in SEQ ID NO:40610 from nucleotide 24 through nucleotide 313 corresponds substantially to the reported cDNA nucleotide sequence as set forth at SEQ ID NO:40607 from nucleotide 31 through nucleotide 319, except that nucleotides at positions 63, 87, 117, 177, 198, 213, 219-220, 246, 249, and 261 as set forth in SEQ ID NO:40607 were reported to be T, T, G, G, G, T, T, T, C, C, and A respectively while the corresponding positions in alignment with SEQ ID NO:40610 contained C, C, A, A, A, C, A, C, G A, and G at nucleotide positions 56, 80, 110, 170, 191, 206, 212-213, 239, 242, and 254. This difference corresponds to about a 4% difference in the nucleotide sequence composition between the previously reported cDNA sequence and the sequence of the amplicon produced from genome DNA template, consistent with the earlier report that the cDNA sequence was likely less than 99% accurate (Andersen et al., ibid.).

An amplicon exhibiting the sequence corresponding to SEQ ID NO:40610 was cloned into a plasmid vector capable of replication in *E. coli* and sufficient amounts of plasmid DNA was recovered to allow for in vitro T7 RNA polymerase transcription from the embedded convergent T7 promoters at either end of the cloned fragment. Double stranded RNA was produced and subjected to bioassay; one RNA segment consisting of the sequence as set forth in SEQ ID NO:40610 from about nucleotide position 24 at least through about nucleotide position 313 except that a uridine residue is present at each position in which a thymidine residue is shown in SEQ ID NO:40610, the other RNA segment being substantially the reverse complement of the nucleotide sequence as set forth in SEQ ID NO:40610 from about nucleotide position 313 at least through about nucleotide position 24, uridines appropriately positioned in place of thymidines. A sample of double stranded RNA (dsRNA) was treated with DICER or with RNAse III to produce sufficient quantities of small interfering RNA's (siRNA). Samples containing 0.15 parts per million siRNA or dsRNA were overlayed onto CRW diet bioassay as described above and larvae were allowed to feed for 13 days. CRW larvae feeding on diet containing dsRNA corresponding to all or a part of the sequence as set forth at SEQ ID NO:40607 exhibited significant growth inhibition and mortality compared to controls.

Other nucleotide sequences derived from CRW were also tested in bioassay in parallel with the CHD3 sequences including nucleotide sequences annotated to likely encode CRW equivalents of proteins such as beta-tubulin protein, 40 kDa V-ATPase subunit protein, elongation factor proteins EF1α and EF1α 48D, 26S proteosome subunit p28 protein, juvenile hormone epoxide hydrolase protein, swelling dependent chloride channel protein, glucose-6-phosphate 1-dehydrogenase protein, actin 42A protein, ADP-ribosylation factor 1 protein, transcription factor IIB, chitinase proteins, and a ubiquitin conjugating enzyme.

A Beta-Tubulin Homologous Sequence

Tubulin proteins are important structural components of many cellular structures in all eukaryote cells and principally in the formation of microtubules. Inhibition of microtubule formation in cells results in catastrophic effects including interference with the formation of mitotic spindles, blockage of cell division, and the like. Therefore, suppression of tubulin protein formation may be a useful target for double stranded RNA mediated inhibition.

A beta-tubulin related sequence derived from CRW was identified for use in the present invention. SEQ ID NO:40621 corresponds to a CRW midgut cDNA nucleotide sequence, the amino acid sequence translation of which was annotated to be homologous in part to a *Manduca sexta* beta-1-tubulin amino acid sequence and in part to a *Drosophila melanogaster* beta-1-tubulin amino acid sequence (GenBank accession No.'s AF030547 and M20419 respectively). SEQ ID NO:40622 and SEQ ID NO:40623 correspond respectively to forward and reverse genome amplification primers (i.e., a primer pair) for use in producing an amplicon from CRW genomic DNA, from CRW mRNA pools, or from a cDNA produced from such pools. The sequence of such an amplicon corresponds to all or a part of a CRW gene encoding a beta-tubulin protein. SEQ ID NO:40622 and SEQ ID NO:40623 each contain a 23 nucleotide T7 promoter sequence from nucleotide positions 1-23 respectively. Nucleotides 24-44 as set forth in SEQ ID NO:40622 correspond to nucleotides 96-116 as set forth in SEQ ID NO:40621. Nucleotides 24-44 as set forth in SEQ ID NO:40623 correspond to the reverse complement of the sequence as set forth in SEQ ID NO:40621 from nucleotides 428-448. Using the primer pair consisting of SEQ ID NO:40622 and SEQ ID NO:40623 in an amplification reaction with CRW genomic DNA as a template, a 399 base pair amplicon comprising the nucleotide sequence as set forth in SEQ ID NO:40624 is produced, corresponding substantially to a part of the CRW genome encoding a protein exhibiting substantial identity to a beta-tubulin protein homolog present in Drosophila melanogaster and Manduca sexta. The nucleotide sequence as set forth in SEQ ID NO:40624 corresponds substantially to the nucleotide sequence as set forth at SEQ ID NO:40621 from nucleotides 96-448. No sequence differences were observed between the genome amplicon sequence and the corresponding sequence within the cDNA sequence.

An amplicon exhibiting the sequence corresponding to SEQ ID NO:40624 was cloned into a plasmid vector, and sufficient amounts of plasmid DNA was recovered to allow for in vitro T7 RNA polymerase transcription from the embedded convergent T7 promoters at either end of the cloned amplicon. Double stranded RNA was produced and a sample was subjected to bioassay; one RNA segment, the sense strand, consisting of the sequence as set forth in SEQ ID NO:40624 from about nucleotide position 24 at least through about nucleotide position 376 except that a uridine residue is present at each position in which a thymidine residue is shown in SEQ ID NO:40624, the reverse complement RNA segment, or the anti-sense strand, being substantially the reverse complement of the nucleotide sequence as set forth in SEQ ID NO:40624 from about nucleotide position 376 at least through about nucleotide position 24, uridines appropriately positioned in place of thymidines. A sample of double stranded RNA (dsRNA) was treated with DICER or with RNAse III to produce sufficient quantities of small interfering RNA's (siRNA). Samples containing 0.15 parts per million siRNA or dsRNA were overlayed onto CRW diet bioassay as described above and larvae were allowed to feed for 13 days. CRW larvae feeding on diet containing dsRNA corresponding to all or a part of the sequence as set forth at SEQ ID NO:40621 exhibited significant growth inhibition and mortality compared to controls.

A 40 kDa V-ATPase Homologous Sequence

Energy metabolism within subcellular organelles in eukaryotic systems is an essential function. Vacuolar ATP synthases are involved in maintaining sufficient levels of ATP within vacuoles. Therefore, vacuolar ATP synthases may be a useful target for double stranded RNA mediated inhibition.

A nucleotide sequence encoding a protein that displayed similarity to a 40 kDa V-ATPase was derived from CRW. An amino acid sequence translation of SEQ ID NO:40635 exhibited homology to a Manduca sexta 40-kDa V-ATPase subunit amino acid sequence (GenBank accession No. X98825). SEQ ID NO:40636 and SEQ ID NO:40637 correspond respectively to forward and reverse genome amplification primers (i.e., a primer pair) for use in producing an amplicon from CRW genomic DNA, CRW mRNA pools, or a CRW cDNA derived from such pools. The sequence of such an amplicon should correspond to all or a part of a CRW gene encoding a 40 kDa V-ATPase homologous protein. However, the nucleotide sequence of an amplicon derived using CRW genomic DNA as template was inconsistent with the reported cDNA sequence as set forth in SEQ ID NO:40635.

SEQ ID NO:40636 and SEQ ID NO:40637 represent thermal amplification primers. Each primer contains a 23 nucleotide T7 promoter sequence from nucleotide positions 1-23 respectively. Nucleotides 24-40 as set forth in SEQ ID NO:40636 correspond to nucleotides 95-111 as set forth in SEQ ID NO:40635. Nucleotides 24-43 as set forth in SEQ ID NO:40637 correspond to the reverse complement of the sequence as set forth in SEQ ID NO:40635 from nucleotides 362-381. Using the primer pair consisting of SEQ ID NO:40636 and SEQ ID NO:40637 in an amplification reaction with CRW genomic DNA template, a 291 base pair amplicon comprising the nucleotide sequence as set forth in SEQ ID NO:40638 is produced. SEQ ID NO:40638 from nucleotide 24 through nucleotide 268 exhibited only about 50% homology to the nucleotide sequence as set forth in SEQ ID NO:40635 based on a Martinez/Needleman-Wunsch DNA alignment. The amplicon sequence derived using the selected thermal amplification primer pair was inconsistent with the reported sequence as set forth in SEQ ID NO:40635. Preferably, an amplicon is produced using a CRW mRNA pool or a cDNA derived from such pool.

An amplicon exhibiting the sequence corresponding to SEQ ID NO:40635 from about nucleotide position 95 through about nucleotide position 381 was produced and cloned into a plasmid vector, and sufficient amounts of plasmid DNA were recovered to allow for in vitro T7 RNA polymerase transcription from the embedded convergent T7 promoters at either end of the cloned amplicon. Double stranded RNA was produced and a sample subjected to bioassay; one RNA segment, the sense strand, consisting of the sequence as set forth in SEQ ID NO:40635 from about nucleotide position 95 at least through about nucleotide position 381 except that a uridine residue is present at each position in which a thymidine residue is shown in SEQ ID NO:40635, and the reverse complement RNA segment, or the anti-sense strand, being substantially the reverse complement of the nucleotide sequence as set forth in SEQ ID NO:40635 from about nucleotide position 381 at least through about nucleotide position 95, uridines appropriately positioned in place of thymidines. A sample of double stranded RNA (dsRNA) was treated with DICER or with RNAse III to produce sufficient quantities of small interfering RNA's (siRNA). Samples containing 0.15 parts per million siRNA or dsRNA were overlayed onto CRW diet bioassay as described above and larvae were allowed to feed for 13 days. CRW larvae feeding on diet containing dsRNA corresponding to all or a part of the sequence as set forth at SEQ ID NO:40635 exhibited significant growth inhibition and mortality compared to controls.

A EF1α Homologous Sequence

Transcription elongation and transcription termination factors are essential to metabolism and may be advantageous targets for double stranded RNA mediated inhibition.

At least two CRW cDNA sequences were identified for use in the present invention that were predicted to encode elongation factor 1 alpha (EF1α) homologs.

The amino acid sequence translation of a singleton CRW cDNA sequence as set forth in SEQ ID NO:40639 exhibited homology to a Drosophila melanogaster EF-1-alpha amino acid sequence (GenBank Accession No. X06870). Other sequences predicted to encode EF1α homologous proteins were also identified from within the CRW cDNA midgut library. These sequences were aligned to produce a UNI-GENE sequence as set forth in SEQ ID NO:40643 which was predicted to encode an EF1α protein homolog referred to herein as 48D. Several of the sequences comprised within this singleton were predicted to encode amino acid sequences exhibiting homology to various EF1α homologous protein sequences including but not limited to a Bombyx mori EF1α

(GenBank Accession No. D13338), a *Alternia* species EF1α (GenBank Accession No. X03704), a *Spragueia leo* EF1α (GenBank Accession No. U85680), a *Apis mellifera* EF1α (GenBank Accession No. AF015267), a *Anisakis simplex* EF1α (GenBank Accession No. AJ250539), a *Papaipema* species EF1α (GenBank Accession No. AF151628), a *Ephedrus persicae* EF1α (GenBank Accession No. Z83663), a *Papilio garamas* EF1α (GenBank Accession No. AF044833), a *Alysia lucicola* EF1α (GenBank Accession No. Z83667), a *Bracon* species EF1α (GenBank Accession No. Z83669), a *Histeromerus mystacinus* EF1α (GenBank Accession No. Z83666), and a *Caenorhabditis elegans* EF1α (GenBank Accession No. U41534).

One CRW cDNA sequence predicted to encode a part of an EF1α homolog is referred to herein as the B2 sequence and is set forth at SEQ ID NO:40639. SEQ ID NO:40640 and SEQ ID NO:40641 correspond respectively to forward and reverse genome amplification primers (i.e., a primer pair, with reference to corresponding or reverse complement sequences as set forth in SEQ ID NO:40639) for use in producing an amplicon from CRW genomic DNA, CRW mRNA pools, or from a cDNA derived from such mRNA pools. The sequence of such an amplicon should correspond to all or a part of a CRW gene encoding an EF1α homologous protein. However, the nucleotide sequence of an amplicon derived when CRW genomic DNA was used as template was inconsistent with the reported cDNA sequence as set forth in SEQ ID NO:40639.

SEQ ID NO:40640 and SEQ ID NO:40641 represent sequences for thermal amplification primers. Each primer contains a 23 nucleotide T7 promoter sequence from nucleotide positions 1-23 respectively. Nucleotides 24-44 as set forth in SEQ ID NO:40640 correspond to nucleotides 8-29 as set forth in SEQ ID NO:40639. Nucleotides 24-42 as set forth in SEQ ID NO:40641 correspond to the reverse complement of the sequence as set forth in SEQ ID NO:40639 from nucleotides 310-328. Using the primer pair consisting of SEQ ID NO:40640 and SEQ ID NO:40641 in an amplification reaction with CRW genomic DNA as a template, a 933 base pair amplicon comprising the nucleotide sequence as set forth in SEQ ID NO:40642 was produced. The nucleotide sequence as set forth in SEQ ID NO:40642 was inconsistent with the nucleotide sequence from nucleotide position 8 through nucleotide position 328 as set forth in SEQ ID NO:40639. Preferably an amplicon is produced using a CRW mRNA pool or a cDNA derived from such pool, such as for example, SEQ ID NO:40639.

An amplicon exhibiting the sequence corresponding to SEQ ID NO:40639 from about nucleotide position 8 through about nucleotide position 328 was produced using CRW mRNA pools or cDNA prepared from such pools, and cloned into a plasmid vector. Sufficient amounts of plasmid DNA were recovered to allow for in vitro T7 RNA polymerase transcription from the embedded convergent T7 promoters at either end of the cloned amplicon. Double stranded RNA was produced and a sample subjected to bioassay; one RNA segment, the sense strand, consisting of the sequence as set forth in SEQ ID NO:40639 from about nucleotide position 8 at least through about nucleotide position 328 except that a uridine residue is present at each position in which a thymidine residue is shown in SEQ ID NO:40639, and the reverse complement RNA segment, or the anti-sense strand, being substantially the reverse complement of the nucleotide sequence as set forth in SEQ ID NO:40639 from about nucleotide position 328 at least through about nucleotide position 8, uridines appropriately positioned in place of thymidines. A sample of double stranded RNA (dsRNA) was treated with DICER or with RNAse III to produce sufficient quantities of small interfering RNA's (siRNA). Samples containing 0.15 parts per million siRNA or dsRNA were overlayed onto CRW diet bioassay as described above and larvae were allowed to feed for 13 days. CRW larvae feeding on diet containing dsRNA corresponding to all or a part of the sequence as set forth at SEQ ID NO:40639 exhibited significant growth inhibition and mortality compared to controls.

The sequence as set forth in SEQ ID NO:40643 was used to design a primer pair for use in amplifying a CRW genomic DNA sequence encoding a EF1α 48D homologous protein sequence. SEQ ID NO:40644 and SEQ ID NO:40645 correspond respectively to forward and reverse genome amplification primers (i.e., a primer pair). SEQ ID NO:40644 and SEQ ID NO:40645 each contain a 23 nucleotide T7 promoter sequence from nucleotide positions 1-23 respectively. Nucleotides 24-41 as set forth in SEQ ID NO:40644 correspond to nucleotides 61-79 as set forth in SEQ ID NO:40643. Nucleotides 24-45 as set forth in SEQ ID NO:40645 correspond to the reverse complement of the sequence as set forth in SEQ ID NO:40643 from nucleotides 562-583. Using the primer pair consisting of SEQ ID NO:40644 and SEQ ID NO:40645 in an amplification reaction with CRW genomic DNA as a template, a 569 base pair amplicon comprising the nucleotide sequence as set forth in SEQ ID NO:40646 is produced, corresponding substantially to a part of the CRW genome encoding a protein exhibiting substantial identity to a EF1α protein also present in *Drosophila melanogaster*. The nucleotide sequence as set forth in SEQ ID NO:40646 from about nucleotide 24 through about nucleotide 546 corresponds substantially to the nucleotide sequence as set forth at SEQ ID NO:40643 from about nucleotides 61-583. No sequence differences were observed between the genome amplicon sequence and the corresponding sequence within the cDNA sequence.

The amplicon exhibiting the sequence corresponding to SEQ ID NO:40646 was cloned into a plasmid vector, and sufficient amounts of plasmid DNA was recovered to allow for in vitro T7 RNA polymerase transcription from the embedded convergent T7 promoters at either end of the cloned amplicon. Double stranded RNA was produced and a sample was subjected to bioassay; one RNA segment, the sense strand, consisting of the sequence as set forth in SEQ ID NO:40646 from about nucleotide position 24 at least through about nucleotide position 546 except that a uridine residue is present at each position in which a thymidine residue is shown in SEQ ID NO:40646, and the reverse complement RNA segment, or the anti-sense strand, being substantially the reverse complement of the nucleotide sequence as set forth in SEQ ID NO:40646 from about nucleotide position 546 at least through about nucleotide position 24, uridines appropriately positioned in place of thymidines. A sample of double stranded RNA (dsRNA) was treated with DICER or with RNAse III to produce sufficient quantities of small interfering RNA's (siRNA). Samples containing 0.15 parts per million siRNA or dsRNA were overlayed onto CRW diet bioassay as described above and larvae were allowed to feed for 13 days. CRW larvae feeding on diet containing dsRNA corresponding to all or a part of the sequence as set forth at SEQ ID NO:40646 exhibited significant growth inhibition and mortality compared to controls.

A 26S Proteosome Subunit p28 Homologous Sequence

The 26S proteasome is a large, ATP-dependent, multi-subunit protease that is highly conserved in all eukaryotes. It has a general function in the selective removal of various short-lived proteins that are first covalently linked to ubiquitin and then subsequently degraded by the 26S proteasome complex. The ubiquitin pathway plays an important role in the control of the cell cycle by the specific degradation of a number of regulatory proteins including mitotic cyclins and inhibitors of cyclin-dependent kinases such as p27 of mammalian cells. Thus, the suppression of 26S proteasome synthesis and suppression of synthesis of its component subunits may be preferred targets for double stranded RNA mediated inhibition. (Smith et al., Plant Phys. 1997, 113:281-291).

A cDNA sequence derived from a CRW mid-gut library was identified as being partially homologous to a 26S proteosome subunit amino acid sequence and was used in the present invention. SEQ ID NO:40647 corresponds substantially to a CRW midgut cDNA nucleotide sequence. An amino acid sequence translation of SEQ ID NO:40647 exhibited homology to a 26S proteasome subunit p28 protein (GenBank Accession No. AB009619). SEQ ID NO:40648 and SEQ ID NO:40649 correspond respectively to forward and reverse genome amplification primers (i.e., a primer pair) for use in producing an amplicon from CRW genomic DNA, from CRW mRNA pools, and from cDNA produced from such pools. An amplicon produced in this way should exhibit a sequence that encodes all or a part of a CRW gene encoding a homolog of a 26S proteosome subunit protein. SEQ ID NO:40648 and SEQ ID NO:40649 each contain a 23 nucleotide T7 promoter sequence from nucleotide positions 1-23 respectively. Nucleotides 24-46 as set forth in SEQ ID NO:40648 correspond to nucleotides 130-152 as set forth in SEQ ID NO:40637. Nucleotides 24-41 as set forth in SEQ ID NO:40649 correspond to the reverse complement of the sequence as set forth in SEQ ID NO:40647 from nucleotides 423-440. Using the primer pair consisting of SEQ ID NO:40647 and SEQ ID NO:40649 in an amplification reaction with CRW genomic DNA as a template, a 1113 base pair amplicon comprising the nucleotide sequence as set forth in SEQ ID NO:40650 was produced. The sequence as set forth in SEQ ID NO:40650 did not correspond to the sequence as set forth in SEQ ID NO:40647, and therefore was inconsistent with the reported cDNA sequence as set forth in SEQ ID NO:40647. It is preferred that an amplicon is produced using a CRW mRNA pool or a cDNA derived from such pool.

An amplicon exhibiting the sequence corresponding to SEQ ID NO:40647 from about nucleotide 130 through about nucleotide 440 was produced and cloned into a plasmid vector, and sufficient amounts of plasmid DNA were recovered to allow for in vitro T7 RNA polymerase transcription from the embedded convergent T7 promoters at either end of the cloned amplicon. Double stranded RNA was produced and a sample subjected to bioassay; one RNA segment, the sense strand, consisting of the sequence as set forth in SEQ ID NO:40647 from about nucleotide position 130 at least through about nucleotide position 440 except that a uridine residue is present at each position in which a thymidine residue is shown in SEQ ID NO:40647, and the reverse complement RNA segment, or the anti-sense strand, being substantially the reverse complement of the nucleotide sequence as set forth in SEQ ID NO:40647 from about nucleotide position 440 at least through about nucleotide position 110, uridines appropriately positioned in place of thymidines. A sample of double stranded RNA (dsRNA) was treated with DICER or with RNAse III to produce sufficient quantities of small interfering RNA's (siRNA). Samples containing 0.15 parts per million siRNA or dsRNA were overlayed onto CRW diet bioassay as described above and larvae were allowed to feed for 13 days. CRW larvae feeding on diet containing dsRNA corresponding to all or a part of the sequence as set forth at SEQ ID NO:40647 exhibited significant growth inhibition and mortality compared to controls.

A Juvenile Hormone Epoxide Hydrolase Homologous Sequence

Insect juvenile hormone controls and regulates a variety of necessary biological processes within the insect life cycle including but not necessarily limited to metamorphosis, reproduction, and diapause. Juvenile hormone (JH) concentrations are required to peak at appropriate times within the haemolymph of the larval form of an insect pest, in particular lepidopteran and coleopteran larvae, and then must be degraded in order to terminate the effects of the hormone response. Enzymes involved in decreasing the concentration of juvenile hormone are effective through two primary pathways of metabolic degradation. One pathway involves juvenile hormone esterse (JHE), which hydrolyzes the methyl ester providing the corresponding acid. The second pathway utilizes juvenile hormone epoxide hydrolase (JHEH) to achieve hydrolysis of the epoxide, resulting in formation of the diol. The contribution of JHE in the degradation of JH is well understood and has been found to be invariate between the lepidoptera and coleoptera species. Inhibition of JH esterase has been associated with severe morphological changes including but not limited to larval wandering, deferred pupation, and development of malformed intermediates. In contrast, the contribution of JHEH in JH metabolism is less well understood and had been shown to vary between the species, but recent studies point to evidence that suggests that JHEH may be the primary route of metabolism of JH (Brandon J. Fetterolf, Doctoral Dissertation, North Carolina State University (Feb. 10, 2002) Synthesis and Analysis of Mechanism Based Inhibitors of Juvenile Hormone Epoxide Hydrolase from Insect *Trichoplusia ni*). In any event, disruption of either JH degradation pathway using gene suppression technology could be an effective target for double stranded RNA mediated pest inhibition.

An insect juvenile hormone epoxide hydrolase homologous sequence derived from CRW was identified for use in the present invention. SEQ ID NO:40651 corresponds substantially to a CRW midgut cDNA nucleotide sequence. An amino acid sequence translation of SEQ ID NO:40651 predicted homology to a juvenile hormone epoxide hydrolase (JHEH) in *Manduca Sexta* (GenBank Accession No. U46682). SEQ ID NO:40652 and SEQ ID NO:40653 correspond respectively to forward and reverse amplification primers (i.e., a primer pair) for use in producing an amplicon from CRW genomic DNA, CRW mRNA pools, or a CRW cDNA derived from such pools. The sequence of such an amplicon should correspond to all or a part of a CRW gene encoding a JHEH homologous protein. SEQ ID NO:40652 and SEQ ID NO:40653 each contain a 23 nucleotide T7 promoter sequence from nucleotide positions 1-23 respectively. Nucleotides 24-42 as set forth in SEQ ID NO:40652 correspond to nucleotides 7-26 as set forth in SEQ ID NO:40651. Nucleotides 24-44 as set forth in SEQ ID NO:40653 correspond to the reverse complement of the sequence as set forth in SEQ ID NO:40651 from nucleotides 360-380. Using the primer pair consisting of SEQ ID NO:40652 and SEQ ID NO:40653 in an amplification reaction with CRW genomic DNA as a template, a 95 base pair amplicon comprising the nucleotide sequence as set forth in SEQ ID NO:40655 was produced. The amplicon sequence did not correspond to the cDNA sequence as set forth in SEQ ID NO:40651. Preferably, an amplicon is produced using a CRW mRNA pool or a cDNA derived from such pool as the template nucleotide sequence in the amplification reaction.

An amplicon exhibiting the sequence corresponding to SEQ ID NO:40651 is cloned into a plasmid vector, and sufficient amounts of plasmid DNA are recovered to allow for in vitro T7 RNA polymerase transcription from the embedded convergent T7 promoters at either end of the cloned amplicon. Double stranded RNA is produced and a sample is subjected to bioassay; one RNA segment, the sense strand, consisting of the sequence as set forth in SEQ ID NO:40651 from about nucleotide position 7 at least through about nucleotide position 380 except that a uridine residue is present at each position in which a thymidine residue is shown in SEQ ID NO:40651, and the reverse complement RNA segment, or the anti-sense strand, being substantially the reverse complement of the nucleotide sequence as set forth in SEQ ID NO:40651 from about nucleotide position 380 at least through about nucleotide position 7, uridines appropriately positioned in place of thymidines. A sample of double stranded RNA (dsRNA) is treated with DICER or with RNAse III to produce sufficient quantities of small interfering RNA's (siRNA). Samples containing 0.15 parts per million siRNA or dsRNA are overlayed onto CRW diet bioassay as described above and larvae are allowed to feed for 13 days. CRW larvae feeding on diet containing dsRNA corresponding to all or a part of the sequence as set forth at SEQ ID NO:40651 exhibit significant growth inhibition and mortality compared to controls.

A Swelling Dependent Chloride Channel Protein Homologous Sequence

Swelling dependent chloride channel proteins have been postulated to play a critical role in osmoregulation in eukaryotic animal cell systems. Therefore, a nucleotide sequence exhibiting the ability to express an amino acid sequence that exhibits homology to previously identified swelling dependent chloride channel proteins may be a useful target for RNA inhibition in a pest.

A swelling dependent chloride channel (SDCC) amino acid sequence homolog was deduced from a CRW cDNA library and used in the present invention. SEQ ID NO:40656 corresponds substantially to a CRW midgut cDNA nucleotide sequence. The amino acid sequence translation of SEQ ID NO:40656 was determined to be homologous to a SDCC protein in the zebra fish *Danio rerio* (GenBank Accession No. Y08484). SEQ ID NO:40657 and SEQ ID NO:40658SEQ ID NO:40658 correspond respectively to forward and reverse thermal amplification primers (i.e., a primer pair) for use in producing an amplicon from CRW genomic DNA, from CRW mRNA pools, or from cDNA derived from such pools. The sequence of such an amplicon should correspond to all or a part of a CRW gene encoding a SDCC homologous protein. SEQ ID NO:40657 and SEQ ID NO:40658 each contain a 23 nucleotide T7 promoter sequence from nucleotide positions 1-23 respectively. Nucleotides 24-43 as set forth in SEQ ID NO:40657 correspond to nucleotides 78-97 as set forth in SEQ ID NO:40656. Nucleotides 24-41 as set forth in SEQ ID NO:40658. SEQ ID NO:40658 correspond to the reverse complement of the sequence as set forth in SEQ ID NO:40656 from nucleotides 332-349. Using the primer pair consisting of SEQ ID NO:40657 and SEQ ID NO:40658 in an amplification reaction with CRW genomic DNA as a template, a 318 base pair amplicon comprising the nucleotide sequence as set forth in SEQ ID NO:40659 is produced, corresponding substantially to a part of the CRW genome encoding a protein exhibiting substantial identity to a SDCC protein. The nucleotide sequence as set forth in SEQ ID NO:40659 from about nucleotide 24 through about nucleotide 295 corresponds substantially to the nucleotide sequence as set forth at SEQ ID NO:40656 from nucleotides 78-349.

The amplicon exhibiting the sequence corresponding to SEQ ID NO:40659 is cloned into a plasmid vector, and sufficient amounts of plasmid DNA are recovered to allow for in vitro T7 RNA polymerase transcription from the embedded convergent T7 promoters at either end of the cloned amplicon. Double stranded RNA is produced and a sample subjected to bioassay; one RNA segment, the sense strand, consisting of the sequence as set forth in SEQ ID NO:40659 from about nucleotide position 24 at least through about nucleotide position 295 except that a uridine residue is present at each position in which a thymidine residue is shown in SEQ ID NO:40659, and the reverse complement RNA segment, or the anti-sense strand, being substantially the reverse complement of the nucleotide sequence as set forth in SEQ ID NO:40659 from about nucleotide position 295 at least through about nucleotide position 24, uridines appropriately positioned in place of thymidines. A sample of double stranded RNA (dsRNA) is treated with DICER or with RNAse III to produce sufficient quantities of small interfering RNA's (siRNA). Samples containing 0.15 parts per million siRNA or dsRNA are overlayed onto CRW diet bioassay as described above and larvae allowed to feed for 13 days. CRW larvae feeding on diet containing dsRNA corresponding to all or a part of the sequence as set forth at SEQ ID NO:40659 exhibit significant growth inhibition and mortality compared to controls.

A Glucose-6-Phosphate 1-Dehydrogenase Protein Homologous Sequence

Glucose-6-phosphate 1-dehydrogenase protein (G6PD) catalyzes the oxidation of glucose-6-phosphate to 6-phosphogluconate while concomitantly reducing the oxidized form of nicotinamide adenine dinucleotide phosphate (NADP+) to NADPH. NADPH is known in the art as a required cofactor in many eukaryotic biosynthetic reactions, and is known to maintain glutathione in its reduced form. Reduced glutathione acts as a scavenger for dangerous oxidative metabolites in eukaryotic cells, and with the assistance of the enzyme glutathione peroxidase, convert harmful hydrogen peroxide to water (Beutler et al., 1991, N. Engl. J. Med. 324:169-174). Therefore, G6PD may be a preferable target for double stranded RNA mediated inhibition in an invertebrate pest.

A glucose-6-phosphate 1-dehydrogenase protein (G6PD) homologous amino acid sequence was deduced from a CRW cDNA library and used in the present invention. SEQ ID NO:40660 corresponds substantially to a CRW midgut cDNA nucleotide sequence. The amino acid sequence translation of SEQ ID NO:40660 was determined to exhibit homology to a G6PD protein in a ray-finned fish species (GenBank Accession No. U72484). SEQ ID NO:40661 and SEQ ID NO:40662 correspond respectively to forward and reverse genome amplification primers (i.e., a primer pair) for use in producing an amplicon from CRW genomic DNA, from CRW mRNA pools, or from cDNA derived from such pools. The sequence of such an amplicon should correspond to all or a part of a CRW gene encoding a G6PD homologous protein. SEQ ID NO:40661 and SEQ ID NO:40662 each contain a 23 nucleotide T7 promoter sequence from nucleotide positions 1-23 respectively. Nucleotides 24-46 as set forth in SEQ ID NO:40661 correspond to nucleotides 113-136 as set forth in SEQ ID NO:40660. Nucleotides 24-45 as set forth in SEQ ID NO:40662 correspond to the reverse complement of the sequence as set forth in SEQ ID NO:40660 from nucleotides 373-394. Using the primer pair consisting of SEQ ID NO:40661 and SEQ ID NO:40662 in an amplification reaction with CRW genomic DNA as a template, a 328 base pair amplicon comprising the nucleotide sequence as set forth in SEQ ID NO:40663 is produced, corresponding substantially to a part of the CRW genome encoding a protein exhibiting homology to a G6PD protein. The nucleotide sequence as set forth in SEQ ID NO:40663 from about nucleotide 24 through about nucleotide 305 corresponds substantially to the nucleotide sequence as set forth at SEQ ID NO:40660 from nucleotides 113-394.

An amplicon exhibiting the sequence corresponding to SEQ ID NO:40663 is cloned into a plasmid vector, and sufficient amounts of plasmid DNA are recovered to allow for in vitro T7 RNA polymerase transcription from the embedded convergent T7 promoters at either end of the cloned amplicon. Double stranded RNA is produced and a sample subjected to bioassay; one RNA segment, the sense strand, consisting of the sequence as set forth in SEQ ID NO:40663 from about nucleotide position 24 at least through about nucleotide position 305 except that a uridine residue is present at each position in which a thymidine residue is shown in SEQ ID NO:40663, and the reverse complement RNA segment, or the anti-sense strand, being substantially the reverse complement of the nucleotide sequence as set forth in SEQ ID NO:40663 from about nucleotide position 305 at least through about nucleotide position 24, uridines appropriately positioned in place of thymidines. A sample of double stranded RNA (dsRNA) is treated with DICER or with RNAse III to produce sufficient quantities of small interfering RNA's (siRNA). Samples containing 0.15 parts per million siRNA or dsRNA are overlayed onto CRW diet bioassay as described above and larvae allowed to feed for 13 days. CRW larvae feeding on diet containing dsRNA corresponding to all or a part of the sequence as set forth at SEQ ID NO:40663 exhibit significant growth inhibition and mortality compared to controls.

An Act42A Protein Homologous Sequence

Actin is a ubiquitous and highly conserved eukaryotic protein required for cell motility and locomotion (Lovato et al., 2001, Insect Mol. Biol. 20:333-340). A number of CRW cDNA sequences were identified that were predicted to likely encode actin or proteins exhibiting amino acid sequence structure related to actin proteins. Therefore, genes encoding actin homologues in a pest cell may be useful targets for double stranded RNA mediated inhibition.

One UNIGENE cluster identified within a corn rootworm midgut cDNA library (Cluster 156_1) consisted of several singleton EST sequences that were each predicted to encode all or part of actin homologous proteins. Upon alignment of these singletons into the cluster, a consensus sequence was derived as set forth in SEQ ID NO:40664 that was predicted to encode an actin protein homolog. Homologous actin protein sequences within the annotation group included but were not limited to *Drosophila melanogaster* actin 3 fragments, a *Helicoverpa armigera* cytoplasmin actin A3a (GenBank Accession No. X97614), a *Drosophila melanogaster* actin (GenBank Accession No. X06383), a hemichordate *Saccoglossus kowalevskii* actin messenger RNA sequence, and a *Strongylocentrotus purpuratus* actin (GenBank Accession No. X05739).

SEQ ID NO:40665 and SEQ ID NO:40666 correspond respectively to forward and reverse genome amplification primers (i.e., a primer pair) for use in producing an amplicon from CRW genomic DNA, CRW mRNA pools, or from a cDNA derived from such pools. The sequence of such an amplicon should correspond to all or a part of a CRW gene encoding an actin homologous protein. SEQ ID NO:40665 and SEQ ID NO:40666 each contain a 23 nucleotide T7 promoter sequence from nucleotide positions 1-23 respectively. Nucleotides 24-45 as set forth in SEQ ID NO:40665 correspond to nucleotides 14-35 as set forth in SEQ ID NO:40664. Nucleotides 24-45 as set forth in SEQ ID NO:40666 correspond to the reverse complement of the sequence as set forth in SEQ ID NO:40664 from nucleotides 449-470. Using the primer pair consisting of SEQ ID NO:40665 and SEQ ID NO:40666 in an amplification reaction with CRW genomic DNA as a template, a 503 base pair amplicon comprising the nucleotide sequence as set forth in SEQ ID NO:40667 is produced, corresponding substantially to a part of the CRW genome encoding a protein exhibiting homology to an actin protein. The nucleotide sequence as set forth in SEQ ID NO:40667 from about nucleotide 24 through about nucleotide 480 corresponds substantially to the nucleotide sequence as set forth at SEQ ID NO:40664 from nucleotides 14-470.

An amplicon exhibiting the sequence corresponding to SEQ ID NO:40667 is cloned into a plasmid vector, and sufficient amounts of plasmid DNA recovered to allow for in vitro T7 RNA polymerase transcription from the embedded convergent T7 promoters at either end of the cloned amplicon. Double stranded RNA is produced and a sample subjected to bioassay; one RNA segment, the sense strand, consisting of the sequence as set forth in SEQ ID NO:40667 from about nucleotide position 24 at least through about nucleotide position 480 except that a uridine residue is present at each position in which a thymidine residue is shown in SEQ ID NO:40667, and the reverse complement RNA segment, or the anti-sense strand, being substantially the reverse complement of the nucleotide sequence as set forth in SEQ ID NO:40667 from about nucleotide position 480 at least through about nucleotide position 24, uridines appropriately positioned in place of thymidines. A sample of double stranded RNA (dsRNA) is treated with DICER or with RNAse III to produce sufficient quantities of small interfering RNA's (siRNA). Samples containing 0.15 parts per million siRNA or dsRNA are overlayed onto CRW diet bioassay as described above and larvae allowed to feed for 13 days. CRW larvae feeding on diet containing dsRNA corresponding to all or a part of the sequence as set forth at SEQ ID NO:40667 exhibit significant growth inhibition and mortality compared to controls.

A ADP-Ribosylation Factor 1 Homologous Sequence

ADP ribosylation factors have been demonstrated to be essential in cell function in that they play integral roles in the processes of DNA damage repair, carcinogenesis, cell death, and genomic stability. Thus, it would be useful to be able to selectively disrupt transcription of ADP-ribosylation factors in invertebrate pest species using double stranded RNA mediated inhibition.

A number of CRW cDNA sequences were identified that were predicted to encode amino acid sequences exhibiting homology to ADP-ribosylation factor proteins. One UNIGENE cluster in particular (Cluster 88_1) was composed of about thirty (30) EST singletons that were each predicted to encode all or part of actin homologous proteins. Upon alignment of these singletons into the cluster, a consensus sequence was derived as set forth in SEQ ID NO:40668. An amino acid sequence translation of the singleton CRW cDNA sequence comprising this cluster predicted an amino acid sequence exhibiting homology to ADP-ribosylation factor homologs. ADP-ribosylation factor protein sequences exhibiting significant homology to the deduced amino acid sequence from the ORF within SEQ ID NO:40668 included but were not limited to a *Drosophila melanogaster* ADP-ribosylation factor (GenBank Accession No. Y10618), a *Drosophila obscura* ADP-ribosylation factor (GenBank Accession No. AF025798), a *Anopheles gambiae* ADP-ribosylation factor (GenBank Accession No. L11617), and a Australian sheep blowfly (*Lucilia cuprina*) ADP-ribosylation factor (GenBank Accession No. AF218587).

SEQ ID NO:40669 and SEQ ID NO:40670 correspond respectively to forward and reverse amplification primers (i.e., a primer pair) for use in producing an amplicon from CRW genomic DNA, CRW mRNA pools, or from cDNA sequences derived from such pools. The sequence of such an amplicon should correspond to all or a part of a CRW gene encoding an ADP-ribosylation factor homologous protein. SEQ ID NO:40669 and SEQ ID NO:40670 each contain a 23 nucleotide T7 promoter sequence from nucleotide positions 1-23 respectively. Nucleotides 24-42 as set forth in SEQ ID NO:40669 correspond to nucleotides 70-88 as set forth in SEQ ID NO:40668. Nucleotides 24-40 as set forth in SEQ ID NO:40670 correspond to the reverse complement of the sequence as set forth in SEQ ID NO:40668 from nucleotides 352-368. Using the primer pair consisting of SEQ ID NO:40669 and SEQ ID NO:40670 in an amplification reaction with CRW genomic DNA as a template, a 345 base pair amplicon comprising the nucleotide sequence as set forth in SEQ ID NO:40671 is produced, corresponding substantially to a part of the CRW genome encoding a protein exhibiting homology to an ADP-ribosylation factor protein. The nucleotide sequence as set forth in SEQ ID NO:40671 from about nucleotide 24 through about nucleotide 322 corresponds substantially to the nucleotide sequence as set forth at SEQ ID NO:40668 from nucleotides 70-368.

An amplicon exhibiting the sequence corresponding to SEQ ID NO:40671 is cloned into a plasmid vector, and sufficient amounts of plasmid DNA recovered to allow for in vitro T7 RNA polymerase transcription from the embedded convergent T7 promoters at either end of the cloned amplicon. Double stranded RNA is produced and a sample subjected to bioassay; one RNA segment, the sense strand, consisting of the sequence as set forth in SEQ ID NO:40671 from about nucleotide position 24 at least through about nucleotide position 322 except that a uridine residue is present at each position in which a thymidine residue is shown in SEQ ID NO:40671, and the reverse complement RNA segment, or the anti-sense strand, being substantially the reverse complement of the nucleotide sequence as set forth in SEQ ID NO:40671, from about nucleotide position 322 at least through about nucleotide position 24, uridines appropriately positioned in place of thymidines. A sample of double stranded RNA (dsRNA) is treated with DICER or with RNAse III to produce sufficient quantities of small interfering RNA's (siRNA). Samples containing 0.15 parts per million siRNA or dsRNA are overlayed onto CRW diet bioassay as described above and larvae allowed to feed for 13 days. CRW larvae feeding on diet containing dsRNA corresponding to all or a part of the sequence as set forth at SEQ ID NO:40671 exhibit significant growth inhibition and mortality compared to controls.

A Transcription Factor IIB Protein Homologous Sequence

Transcription elongation and transcription termination factors, as indicated above, are essential to metabolism and may be advantageous targets for double stranded RNA mediated inhibition to control or eliminate invertebrate pest infestation.

A CRW cDNA sequence was identified that was predicted to encode an amino acid sequence exhibiting homology to a transcription factor IIB protein. SEQ ID NO:40672 served as the basis for constructing a primer pair for use in amplifying a sequence from within the CRW genome encoding the mRNA that formed the basis for this cDNA sequence.

SEQ ID NO:40673 and SEQ ID NO:40674 correspond respectively to forward and reverse thermal amplification primers (i.e., a primer pair) for use in producing an amplicon from CRW genomic DNA, from CRW mRNA pools, or from cDNA derived from such pools. The sequence of such an amplicon should correspond to all or a part of a CRW gene encoding a transcription factor IIB homologous protein. SEQ ID NO:40673 and SEQ ID NO:40674 each contain a 23 nucleotide T7 promoter sequence from nucleotide positions 1-23 respectively. Nucleotides 24-44 as set forth in SEQ ID NO:40673 correspond to nucleotides 4-24 as set forth in SEQ ID NO:40672. Nucleotides 24-44 as set forth in SEQ ID NO:40674 correspond to the reverse complement of the sequence as set forth in SEQ ID NO:40672 from nucleotides 409-429. Using the primer pair consisting of SEQ ID NO:40673 and SEQ ID NO:40674 in an amplification reaction with CRW genomic DNA as a template, a 472 base pair amplicon comprising the nucleotide sequence as set forth in SEQ ID NO:40675 is produced, corresponding substantially to a part of the CRW genome encoding a protein exhibiting homology to a transcription factor IIB protein. The nucleotide sequence as set forth in SEQ ID NO:40675 from about nucleotide 24 through about nucleotide 449 corresponds substantially to the nucleotide sequence as set forth at SEQ ID NO:40672 from nucleotides 4-429.

An amplicon exhibiting the sequence corresponding to SEQ ID NO:40675 is cloned into a plasmid vector, and sufficient amounts of plasmid DNA recovered to allow for in vitro T7 RNA polymerase transcription from the embedded convergent T7 promoters at either end of the cloned amplicon. Double stranded RNA is produced and a sample subjected to bioassay; one RNA segment, the sense strand, consisting of the sequence as set forth in SEQ ID NO:40675 from about nucleotide position 24 at least through about nucleotide position 449 except that a uridine residue is present at each position in which a thymidine residue is shown in SEQ ID NO:40675, and the reverse complement RNA segment, or the anti-sense strand, being substantially the reverse complement of the nucleotide sequence as set forth in SEQ ID NO:40675, from about nucleotide position 449 at least through about nucleotide position 24, uridines appropriately positioned in place of thymidines. A sample of double stranded RNA (dsRNA) is treated with DICER or with RNAse III to produce sufficient quantities of small interfering RNA's (siRNA). Samples containing 0.15 parts per million siRNA or dsRNA are overlayed onto CRW diet bioassay as described above and larvae allowed to feed for 13 days. CRW larvae feeding on diet containing dsRNA corresponding to all or a part of the sequence as set forth at SEQ ID NO:40675 exhibit significant growth inhibition and mortality compared to controls.

Chitinase Homologous Sequences

Chitin is a $\beta(1{\rightarrow}4)$homopolymer of N-acetylglucosamine and is found in insect exoskeletons. Chitin is formed from UDP-N-acetylglucosamine in a reaction catalyzed by chitin synthase. Chitin is a structural homopolymer polysaccharide, and there are many enzymatic steps involved in the construction of this highly branched and cross-linked structure. Chitin gives shape, rigidity and support to insects and provides a scaffolding to which internal organs such as muscles are attached. Chitin must also be degraded to some extent to mediate the steps involved in the insect molting process. Therefore, it is believed that double stranded RNA mediated inhibition of proteins in these pathways would be useful as a means for controlling invertebrate pest infestation.

Amino acid sequence information was identified from translation of corn rootworm midgut cDNA library sequences that exhibited homology to chitinase proteins. One chitinase consensus sequence (UNIGENE Cluster No. 716_1; SEQ ID NO:40676) was generated from the alignment of two singleton EST sequences. A second chitinase consensus sequence (UNIGENE Cluster No. 1238_1; SEQ ID NO:40680) was generated from the alignment of four singleton sequences. Amino acid sequence translations derived from ORF's within these UNIGENE's were annotated to a mustard beetle (*Phaedon cochleariae*) chitinase amino acid sequence (GenBank Accession No. Y18011). SEQ ID NO:40676 and SEQ ID NO:40680 served as the basis for constructing primer pairs for use in amplifying two sequences from within the CRW genome, from CRW mRNA pools, or from cDNA sequences derived from such mRNA pools. The nucleotide sequence of such amplicons should correspond to all or a part of a gene encoding a chitinase homologous protein.

SEQ ID NO:40677 and SEQ ID NO:40678 correspond respectively to forward and reverse thermal amplification primers (i.e., a primer pair) for use in producing an amplicon from nucleotide sequences derived from a corn rootworm. The sequence of such an amplicon should correspond to all or a part of a CRW gene as set forth in SEQ ID NO:40676 encoding a chitinase homologous protein. SEQ ID NO:40677 and SEQ ID NO:40678 each contain a 23 nucleotide T7 promoter sequence from nucleotide positions 1-23 respectively. Nucleotides 24-42 as set forth in SEQ ID NO:40677 correspond to nucleotides 1-19 as set forth in SEQ ID NO:40676. Nucleotides 24-47 as set forth in SEQ ID NO:40678 correspond to the reverse complement of the sequence as set forth in SEQ ID NO:40676 from nucleotides 470-493. Using the primer pair consisting of SEQ ID NO:40677 and SEQ ID NO:40678 in an amplification reaction with CRW genomic DNA as a template, a 472 base pair amplicon comprising the nucleotide sequence as set forth in SEQ ID NO:40679 is produced, corresponding substantially to a part of the CRW genome encoding a protein exhibiting homology to a chitinase protein. The nucleotide sequence as set forth in SEQ ID NO:40679 from about nucleotide 24 through about nucleotide 516 corresponds substantially to the nucleotide sequence as set forth at SEQ ID NO:40679 from nucleotides 1-493.

An amplicon exhibiting the sequence corresponding to SEQ ID NO:40679 is cloned into a plasmid vector, and sufficient amounts of plasmid DNA recovered to allow for in vitro T7 RNA polymerase transcription from the embedded convergent T7 promoters at either end of the cloned amplicon. Double stranded RNA is produced and a sample subjected to bioassay; one RNA segment, the sense strand, consisting of the sequence as set forth in SEQ ID NO:40679 from about nucleotide position 24 at least through about nucleotide position 516 except that a uridine residue is present at each position in which a thymidine residue is shown in SEQ ID NO:40679, and the reverse complement RNA segment, or the anti-sense strand, being substantially the reverse complement of the nucleotide sequence as set forth in SEQ ID NO:40679, from about nucleotide position 516 at least through about nucleotide position 24, uridines appropriately positioned in place of thymidines. A sample of double stranded RNA (dsRNA) is treated with DICER or with RNAse III to produce sufficient quantities of small interfering RNA's (siRNA). Samples containing 0.15 parts per million siRNA or dsRNA are overlayed onto CRW diet bioassay as described above and larvae allowed to feed for 13 days. CRW larvae feeding on diet containing dsRNA corresponding to all or a part of the sequence as set forth at SEQ ID NO:40679 exhibit significant growth inhibition and mortality compared to controls.

SEQ ID NO:40681 and SEQ ID NO:40682 correspond respectively to forward and reverse genome amplification primers (i.e., a primer pair) for use in producing an amplicon from CRW genomic DNA, CRW mRNA pools, or from cDNA sequences derived from such mRNA pools. The sequence of such an amplicon should correspond to all or a part of a CRW gene as set forth in SEQ ID NO:40680 encoding a chitinase homologous protein. SEQ ID NO:40681 and SEQ ID NO:40682 each contain a 23 nucleotide T7 promoter sequence from nucleotide positions 1-23 respectively. Nucleotides 24-44 as set forth in SEQ ID NO:40681 correspond to nucleotides 64-84 as set forth in SEQ ID NO:40680. Nucleotides 24-44 as set forth in SEQ ID NO:40682 correspond to the reverse complement of the sequence as set forth in SEQ ID NO:40680 from nucleotides 779-799. Using the primer pair consisting of SEQ ID NO:40681 and SEQ ID NO:40682 in an amplification reaction with CRW genomic DNA as a template, a 912 base pair amplicon comprising the nucleotide sequence as set forth in SEQ ID NO:40683 was produced. An alignment of the cDNA sequence as set forth in SEQ ID NO:40680 and the amplicon sequence revealed that there was substantial dissimilarity between the two sequences, resulting only in an about 32% sequence identity. Preferably, an amplicon is produced using primer pairs such as these as set forth at SEQ ID NO:'s 40681 and 40682 and mRNA or cDNA as template in order to avoid such inconsistencies.

An amplicon exhibiting the sequence corresponding substantially to SEQ ID NO:40680 is cloned into a plasmid vector, and sufficient amounts of plasmid DNA are recovered to allow for in vitro T7 RNA polymerase transcription from the embedded convergent T7 promoters at either end of the cloned amplicon. Double stranded RNA is produced and a sample is subjected to bioassay; one RNA segment, the sense strand, consisting of the sequence as set forth in SEQ ID NO:40680 from about nucleotide position 64 at least through about nucleotide position 799 except that a uridine residue is present at each position in which a thymidine residue is shown in SEQ ID NO:40680, and the reverse complement RNA segment, or the anti-sense strand, being substantially the reverse complement of the nucleotide sequence as set forth in SEQ ID NO:40680, from about nucleotide position 799 at least through about nucleotide position 64, uridines appropriately positioned in place of thymidines. A sample of double stranded RNA (dsRNA) is treated with DICER or with RNAse III to produce sufficient quantities of small interfering RNA's (siRNA). Samples containing 0.15 parts per million siRNA or dsRNA are overlayed onto CRW diet bioassay as described above and larvae are allowed to feed for 13 days. CRW larvae feeding on diet containing dsRNA corresponding to allor a part of the sequence as set forth at SEQ ID NO:40680 exhibit significant growth inhibition and mortality compared to controls.

A Ubiquitin Conjugating Enzyme Homologous Sequence

The ubiquitin pathway plays an important role in the control of the cell cycle by the specific degradation of a number of regulatory proteins including mitotic cyclins and inhibitors of cyclin-dependent kinases such as p27 of mammalian cells.

Thus, genes encoding ubiquitin and associated components may be a preferred target for double stranded RNA mediated inhibition. (Smith et al., Plant Phys. 1997, 113:281-291). The ubiquitin-dependent proteolytic pathway is one of the major routes by which intracellular proteins are selectively destroyed in eukaryotes. Conjugation of ubiquitin to substrate proteins is mediated by a remarkably diverse array of enzymes. Proteolytic targeting may also be regulated at steps between ubiquitination of the substrate and its degradation to peptides by the multi-subunit 26S protease. The complexity of the ubiquitin system suggests a central role for protein turnover in eukaryotic cell regulation, and implicates other proteins in the pathway including ubiquitin-activating enzyme, ubiquitin-conjugating enzyme, ubiquitin-protein ligase, and 26S proteasome subunit components. Therefore, it is believed that double stranded RNA mediated inhibition of proteins in this pathway would be useful as a means for controlling invertebrate pest infestation.

A CRW cDNA library sequence was identified that was predicted to encode an amino acid sequence exhibiting homology to a ubiquitin conjugating enzyme. SEQ ID NO:40684 served as the basis for constructing a primer pair for use in producing an amplicon comprising all or a part of a ubiquitin conjugating enzyme from corn rootworm.

SEQ ID NO:40685 and SEQ ID NO:40686 correspond respectively to forward and reverse genome amplification primers (i.e., a primer pair) for use in producing an amplicon from CRW genomic DNA, from CRW mRNA pools, or from a cDNA derived from such mRNA pools. The sequence of such amplicon should correspond to all or a part of a CRW gene encoding a ubiquitin conjugating enzyme homologous protein. SEQ ID NO:40685 and SEQ ID NO:40686 each contain a 23 nucleotide T7 promoter sequence from nucleotide positions 1-23 respectively. Nucleotides 24-42 as set forth in SEQ ID NO:40685 correspond to nucleotides 16-34 as set forth in SEQ ID NO:40684. Nucleotides 24-42 as set forth in SEQ ID NO:40686 correspond to the reverse complement of the sequence as set forth in SEQ ID NO:40684 from nucleotides 295-313. Using the primer pair consisting of SEQ ID NO:40685 and SEQ ID NO:40686 in an amplification reaction with CRW genomic DNA as a template, a 344 base pair amplicon comprising the nucleotide sequence as set forth in SEQ ID NO:40687 is produced, corresponding substantially to a part of the CRW genome encoding a protein exhibiting homology to a ubiquitin conjugating enzyme. The nucleotide sequence as set forth in SEQ ID NO:40687 from about nucleotide 24 through about nucleotide 321 corresponds substantially to the nucleotide sequence as set forth at SEQ ID NO:40684 from nucleotides 16-313.

An amplicon exhibiting the sequence corresponding to SEQ ID NO:40687 is cloned into a plasmid vector, and sufficient amounts of plasmid DNA are recovered to allow for in vitro T7 RNA polymerase transcription from the embedded convergent T7 promoters at either end of the cloned amplicon. Double stranded RNA is produced and a sample subjected to bioassay; one RNA segment, the sense strand, consisting of the sequence as set forth in SEQ ID NO:40687 from about nucleotide position 24 at least through about nucleotide position 253 except that a uridine residue is present at each position in which a thymidine residue is shown in SEQ ID NO:40687, and the reverse complement RNA segment, or the anti-sense strand, being substantially the reverse complement of the nucleotide sequence as set forth in SEQ ID NO:40687, from about nucleotide position 253 at least through about nucleotide position 24, uridines appropriately positioned in place of thymidines. A sample of double stranded RNA (dsRNA) is treated with DICER or with RNAse III to produce sufficient quantities of small interfering RNA's (siRNA). Samples containing 0.15 parts per million siRNA or dsRNA are overlayed onto CRW diet bioassay as described above and larvae allowed to feed for 13 days. CRW larvae feeding on diet containing dsRNA corresponding to all or a part of the sequence as set forth in SEQ ID NO:40687 exhibit significant growth inhibition and mortality compared to controls.

A Glyceraldehyde-3-Phosphate Dehydrogenase Homologous Sequence

The glycolytic pathway is an essential pathway in most organisms and is involved in the production of metabolic energy from the degradation of glucose. One important enzyme in the second stage of the glycolytic pathway is glyceraldehyde-3-phosphate dehydrogenase (G3PDH), which, in the presence of NAD+ and inorganic phosphate, catalyzes the oxidation of 3-phospho-glyceraldehyde to 3-phosphoglyceroyl-phosphate along with the formation of NADH. The important component of this reaction is the storage of energy through the formation of NADH. Genes encoding enzymes associated with the glycolytic pathway, and particularly genes encoding enzymes involved in the steps useful in formation of energy reserves may be particularly useful targets for double stranded RNA mediated inhibition in invertebrate pest species.

A CRW cDNA library sequence was identified that was predicted to encode an amino acid sequence exhibiting homology to a glyceraldehyde-3-phosphate dehydrogenase (G3PDH) protein. The consensus sequence for the cluster set forth at SEQ ID NO:40688 was assembled from the overlapping sequences of three singleton EST sequences. An amino acid sequence translation of an ORF within the nucleotide sequence SEQ ID NO:40688 exhibited homology with a G3PDH amino acid sequence derived from a *Crytococcus curvatus* G3PDH gene (GenBank Accession No. AF126158) and with a G3PDH protein amino acid sequence from the organism *Drosophila pseudoobscura* (GenBank Accession No. AF025809). Thus, an amino acid sequence translation of the sequence as set forth at SEQ ID NO:40688 was predicted to be a part of a CRW G3PDH enzyme protein. The nucleotide sequence as set forth at SEQ ID NO:40688 served as the basis for constructing a thermal amplification primer pair for use in amplifying a sequence encoding a CRW G3PDH enzyme sequence.

SEQ ID NO:40689 and SEQ ID NO:40690 correspond respectively to forward and reverse thermal amplification primers (i.e., a primer pair) for use in producing an amplicon from CRW nucleotide sequences, either genome DNA, mRNA pools, or from cDNA sequences derived from such mRNA pools. The sequence of such an amplicon should correspond to all or a part of a CRW gene encoding a G3PDH homologous protein. SEQ ID NO:40689 and SEQ ID NO:40690 each contain a 23 nucleotide T7 promoter sequence from nucleotide positions 1-23 respectively. Nucleotides 24-45 as set forth in SEQ ID NO:40689 correspond to nucleotides 103-124 as set forth in SEQ ID NO:40688. Nucleotides 24-45 as set forth in SEQ ID NO:40690 correspond to the reverse complement of the sequence as set forth in SEQ ID NO:40688 from nucleotides 573-594. Using the primer pair consisting of SEQ ID NO:40689 and SEQ ID NO:40690 in an amplification reaction with CRW genomic DNA as a template, a 538 base pair amplicon comprising the nucleotide sequence as set forth in SEQ ID NO:40691 is produced, corresponding substantially to a part of the CRW genome encoding a protein exhibiting homology to a ubiquitin conjugating enzyme. The nucleotide sequence as set forth in SEQ ID NO:40691 from about nucleotide 24 through about nucleotide 515 corresponds substantially to the nucleotide sequence as set forth at SEQ ID NO:40688 from nucleotides 103-594.

An amplicon exhibiting the sequence corresponding to SEQ ID NO:40691 is cloned into a plasmid vector, and sufficient amounts of plasmid DNA are recovered to allow for in vitro T7 RNA polymerase transcription from the embedded convergent T7 promoters at either end of the cloned amplicon. Double stranded RNA is produced and a sample subjected to bioassay; one RNA segment, the sense strand, consisting of the sequence as set forth in SEQ ID NO:40691 from about nucleotide position 24 at least through about nucleotide position 515 except that a uridine residue is present at each position in which a thymidine residue is shown in SEQ ID NO:40691, and the reverse complement RNA segment, or the anti-sense strand, being substantially the reverse complement of the nucleotide sequence as set forth in SEQ ID NO:40691, from about nucleotide position 515 at least through about nucleotide position 24, uridines appropriately positioned in place of thymidines. A sample of double stranded RNA (dsRNA) is treated with DICER or with RNAse III to produce sufficient quantities of small interfering RNA's (siRNA). Samples containing 0.15 parts per million siRNA or dsRNA are overlayed onto CRW diet bioassay as described above and larvae allowed to feed for 13 days. CRW larvae feeding on diet containing dsRNA corresponding to all or a part of the sequence as set forth at SEQ ID NO:40691 exhibit significant growth inhibition and mortality compared to controls.

A Ubiquitin B Homologous Sequence

As described above, the ubiquitin protein degradation pathway plays an important role in the control of the cell cycle by the specific degradation of a number of regulatory proteins including mitotic cyclins and inhibitors of cyclin-dependent kinases such as p27 of mammalian cells. Thus, genes encoding ubiquitin and associated components may be a preferred target for double stranded RNA mediated inhibition. (Smith et al., Plant Phys. 1997, 113:281-291).

A CRW cDNA library sequence was identified that was predicted to encode an amino acid sequence exhibiting homology to a protein designated herein as ubiquitin B. The consensus sequence for the UNIGENE cluster set forth at SEQ ID NO:40692 was assembled from the overlapping sequences of four singleton EST sequences. An amino acid sequence translation of SEQ ID NO:40692 exhibited homology with a polyubiquitin amino acid sequence from *Amoeba proteus* (GenBank Accession No. AF034789) and with a ubiquitin protein sequence from *Drosophila melanogaster* (GenBank Accession No. M22428). Thus, an amino acid sequence translation of the sequence as set forth at SEQ ID NO:40692 was believed to encode a ubiquitin B. SEQ ID NO:40692 served as the basis for constructing a primer pair for use in a thermal amplification reaction to amplify a nucleotide sequence encoding all or a part of a corn rootworm ubiquitin B amino acid sequence.

SEQ ID NO:40693 and SEQ ID NO:40694 correspond respectively to forward and reverse thermal amplification primers (i.e., a primer pair) for use in producing an amplicon from nucleotide sequences derived from CRW, either genomic DNA, mRNA pools, or cDNA derived from such mRNA pools. The sequence of such an amplicon should correspond to all or a part of a CRW gene encoding a ubiquitin B homologous protein. SEQ ID NO:40693 and SEQ ID NO:40694 each contain a 23 nucleotide T7 promoter sequence from nucleotide positions 1-23 respectively. Nucleotides 24-40 as set forth in SEQ ID NO:40693 correspond to nucleotides 62-78 as set forth in SEQ ID NO:40692. Nucleotides 24-47 as set forth in SEQ ID NO:40694 correspond to the reverse complement of the sequence as set forth in SEQ ID NO:40692 from nucleotides 399-422. Using the primer pair consisting of SEQ ID NO:40693 and SEQ ID NO:40694 in an amplification reaction with CRW genomic DNA as a template, a 407 base pair amplicon comprising the nucleotide sequence as set forth in SEQ ID NO:40695 is produced, corresponding substantially to a part of the CRW genome encoding a protein exhibiting homology to a ubiquitin conjugating enzyme. The nucleotide sequence as set forth in SEQ ID NO:40695 from about nucleotide 24 through about nucleotide 384 corresponds substantially to the nucleotide sequence as set forth at SEQ ID NO:40692 from nucleotides 62-422.

The amplicon exhibiting the sequence corresponding to SEQ ID NO:40695 is cloned into a plasmid vector, and sufficient amounts of plasmid DNA recovered to allow for in vitro T7 RNA polymerase transcription from the embedded convergent T7 promoters at either end of the cloned amplicon. Double stranded RNA is produced and a sample subjected to bioassay; one RNA segment, the sense strand, consisting of the sequence as set forth in SEQ ID NO:40695 from about nucleotide position 24 at least through about nucleotide position 384 except that a uridine residue is present at each position in which a thymidine residue is shown in SEQ ID NO:40695, and the reverse complement RNA segment, or the anti-sense strand, being substantially the reverse complement of the nucleotide sequence as set forth in SEQ ID NO:40695, from about nucleotide position 384 at least through about nucleotide position 24, uridines appropriately positioned in place of thymidines. A sample of double stranded RNA (dsRNA) is treated with DICER or with RNAse III to produce sufficient quantities of small interfering RNA's (siRNA). Samples containing 0.15 parts per million siRNA or dsRNA are overlayed onto CRW diet bioassay as described above and larvae allowed to feed for 13 days. CRW larvae feeding on diet containing dsRNA corresponding to all or a part of the sequence as set forth at SEQ ID NO:40695 exhibit significant growth inhibition and mortality compared to controls.

A Juvenile Hormone Esterase Homolog

As indicated above, insect juvenile hormone controls and regulates a variety of necessary biological processes within the insect life cycle including but not necessarily limited to metamorphosis, reproduction, and diapause. Disruption of JH synthesis or degradation pathways using gene suppression technology could be an effective target for double stranded RNA mediated pest inhibition.

An insect juvenile hormone esterase homologous sequence derived from CRW was identified for use in the present invention. SEQ ID NO:40696 corresponds substantially to a CRW midgut cDNA nucleotide sequence. An amino acid sequence translation of SEQ ID NO:40696 predicted homology to a juvenile hormone esterase (JHE). SEQ ID NO:40697 and SEQ ID NO:40698 correspond respectively to forward and reverse amplification primers (i.e., a primer pair) for use in producing an amplicon from CRW genomic DNA, CRW mRNA pools, or a CRW cDNA derived from such pools. The sequence of such an amplicon should correspond to all or a part of a CRW gene encoding a JHE homologous protein. SEQ ID NO:40697 and SEQ ID NO:40698 each contain a 23 nucleotide T7 promoter sequence from nucleotide positions 1-23 respectively. Nucleotides 24-45 as set forth in SEQ ID NO:40697 correspond to nucleotides 58-79 as set forth in SEQ ID NO:40696. Nucleotides 24-46 as set forth in SEQ ID NO:40698 correspond to the reverse complement of the sequence as set forth in SEQ ID NO:40696 from nucleotides 338-360. Using the primer pair consisting of SEQ ID NO:40697 and SEQ ID NO:40698 in an amplification reaction with CRW genomic DNA as a template, a 348 base pair amplicon was produced comprising the nucleotide sequence as set forth in SEQ ID NO:758 or in SEQ ID NO:40607 through SEQ ID NO:40700. Preferably, an amplicon is produced using a CRW mRNA pool or a cDNA derived from such pool as the template nucleotide sequence in the amplification reaction.

An amplicon exhibiting the sequence corresponding to SEQ ID NO:758 or in SEQ ID NO:40607 through SEQ ID NO:40700 is cloned into a plasmid vector, and sufficient amounts of plasmid DNA are recovered to allow for in vitro T7 RNA polymerase transcription from the embedded convergent T7 promoters at either end of the cloned amplicon. Double stranded RNA is produced and a sample is subjected to bioassay; one RNA segment, the sense strand, consisting of the sequence as set forth in SEQ ID NO:758 or in SEQ ID NO:40607 through SEQ ID NO:40700 from about nucleotide position 45 at least through about nucleotide position 302 except that a uridine residue is present at each position in which a thymidine residue is shown in SEQ ID NO:40699, and the reverse complement RNA segment, or the anti-sense strand, being substantially the reverse complement of the nucleotide sequence as set forth in SEQ ID NO:758 or in SEQ ID NO:40607 through SEQ ID NO:40700 from about nucleotide position 302 at least through about nucleotide position 45, uridines appropriately positioned in place of thymidines. A sample of double stranded RNA (dsRNA) is treated with DICER or with RNAse III to produce sufficient quantities of small interfering RNA's (siRNA). Samples containing 0.15 parts per million siRNA or dsRNA are overlayed onto CRW diet bioassay as described above and larvae are allowed to feed for 13 days. CRW larvae feeding on diet containing dsRNA corresponding to all or a part of the sequence as set forth at SEQ ID NO:758 or in SEQ ID NO:40607 through SEQ ID NO:40700 exhibit significant growth inhibition and mortality compared to controls.

Ten of the double stranded RNA molecules listed above were tested in bioassay in parallel with small interfering RNA's generated from the double stranded RNA molecules. Double stranded RNA sequence samples or small interfering RNA samples prepared from the double stranded RNA sequence samples, each corresponding to amino acid sequences annotated to selected target gene homologs including a 40 kDa V-ATPase homolog, an EF-1-alpha homolog, a 26S proteasome subunit p28 homolog, a juvenile hormone epoxide hydrolase homolog, a CHD3 homolog, a beta-tubulin homolog, two chitinase homologs, a transcription factor IIB homolog, and a juvenile hormone esterase homolog (corresponding respectively to SEQ ID NO:40638, SEQ ID NO:40642, SEQ ID NO:40650, SEQ ID NO:40655, SEQ ID NO:40610, SEQ ID NO:40624, SEQ ID NO:40679, SEQ ID NO:40683, SEQ ID NO:40675, and SEQ ID NO:40699) were applied to the insect diet at a concentration of about ten parts per million (30 microliters of solution containing a double stranded RNA sample adjusted to an appropriate concentration was added to microtiter dish wells containing 200 microliters insect diet per well). A total of eighteen wells were used for each sample. A single first instar larva was added to each well after the RNA samples had diffused into the diet. The bioassays were incubated as indicated above for about 13 days and monitored daily for morbidity and mortality. An amino acid sequence variant Cry3Bb1 insecticidal crystal protein designated as insecticidal protein 11231 in English et al. (U.S. Pat. No. 6,642,030) was used as a positive control for observing insecticidal bioactivity specific for the rootworm pest. Cry3Bb was applied to the diet as set forth in English et al., except that the concentration of Cry3Bb in the diet was adjusted to be about 200-300 parts per million. A separate control sample that was treated only with buffer or water was also included in the assay. A double stranded RNA control sample and a small interfering RNA control sample produced from double stranded RNA control samples were also included as additional negative controls (MEGAscript® RNAi Kit, AMBION, Austin, Tex.).

An initial evaluation using double stranded RNA molecules derived from these ten sequences indicated that larvae which were allowed to feed on diet containing double stranded RNA corresponding to a 40 kDa V-ATPase homolog (SEQ ID NO:40638), a CHD3 homolog (SEQ ID NO:40610), and a beta-tubulin homolog (SEQ ID NO:40634) exhibited significant mortality in comparison to the controls. Based on these results, additional bioassays were conducted to test whether small interfering double stranded RNA particles would be more effective than the full length double stranded RNA molecules.

A Alpha Tubuliln Homologous Sequence

Eukaryotic cells generally utilize cytoskeletal structural elements that are important, no t only as a mechanical scaffold, but also in sustaining the shape of the cell. Semiflexible microfilaments make cells mobile, help them to divide in mitosis (cytokinesis) and, in vertebrate and invertebrate animals, are responsible for muscular contraction. The relatively stiff microtubules which are made up of alpha and beta tubulin proteins play an important role in acting as a sort of highway for transport of vesicles and organelles and in the separation of chromosomes during mitosis (karyokinesis). The flexible intermediate filaments provide at least additional strength to the overall cellular structure. The cytoskeleton is also known to be involved in signaling across the cell cytoplasm. Taking these functions into account, it is believed that any disruption of the cytoskeleton or even subtle changes of its integrity may cause pathological consequences to a cell.

At least one CRW cDNA library sequence was identified that was predicted to encode an amino acid sequence exhibiting homology to a protein designated herein as alpha tubulin, and more specifically referred to herein as SEQ ID NO:692 as set forth in the sequence listing. An amino acid sequence translation of the sequence as set forth at SEQ ID NO: 692 was believed to encode an alpha tubulin protein or fragment thereof. SEQ ID NO: 692 served as the basis for constructing a sequence that is predicted to form a double stranded RNA when expressed in *E. coli* from a T7 promoter or in a plant from a plant functional promoter. A sequence serving as the basis for such double stranded RNA coding sequence is SEQ ID NO:40700 as set forth in the sequence listing from nucleotide position 58 through nucleotide position 1010. This sequence can be expressed as a RNA molecule and purified and tested in vitro feeding assays for determining corn rootworm inhibition.

A T7 RNA polymerase promoter was introduced upstream of a nucleotide sequence as set forth in SEQ ID NO:40700 from nucleotide position 58 through nucleotide position 1010, and RNA was produced from this construct (pIC17527). Such RNA was tested in triplicate in an in vitro feeding assay against corn rootworms against a beta tubulin positive control (described hereinabove), 200 ppm Cry3Bb, and an untreated control, and mean mortality was determined.

Untreated control samples exhibited less than about 3-5% mortality, while all other test samples exhibited from about 20 to about 55% mortality. Cry3Bb samples exhibited from about 20 to about 36% mortality, while the pIC17527 samples (at 15 ppm) exhibited from about 38 to about 45% mortality. The D8 (beta tubulin as set forth herein above) samples, also at about 15 ppm, exhibited from about 38 to about 52% mortality. Based on these results, the alpha tubulin construct was placed under the control of a plant functional promoter, used to transform corn plants, and transformation events arising from the transformation were tested for their ability to resist corn rootworm infestation.

Roots from R0 corn plants transformed with a nucleotide sequence as set forth in SEQ ID NO:40700. Briefly, the sequence encoding a dsRNA construct in SEQ ID NO:40700 as described above was linked at the 5' end to a sequence that consisted of an e35S promoter operably linked to a maize hsp70 intron and at the 3' end to a NOS3' transcription termination and polyadenylation sequence. This expression cassette was placed downstream of a glyphosate selection cassette. These linked cassettes were then placed into an *Agrobacterium tumefaciens* plant transformation functional vector and the new vector was designated as pMON72829 (the alpha tubulin dsRNA construct), used to transform maize tissue to glyphosate tolerance, and events were selected and transferred to soil. R0 plant roots were fed to western corn rootworm larvae (WCR, *Diabrotica virifera*). Transgenic corn roots were handed-off in Petri dishes with MSOD medium containing the antibiotics and glyphosate for in vitro selection. Two WCR larvae were infested per root in each dish with a fine tip paintbrush. The dishes were sealed with Parafilm to prevent the larvae from escaping. The assays were placed into a 27° C., 60% RH Percival incubator in complete darkness. Contamination and larval quality were monitored. After six days of feeding on root tissue, the larvae were transferred to WCR diet in a 96 well plate. The larvae were allowed to feed on the diet for eight days making the full assay fourteen days long. Larval mass and survivorship were recorded for analysis. A one-way analysis was performed on the larval mass data and a Dunnett's test to look for statistical significance compared to LH244, an untransformed negative control. WCR larvae were significantly stunted ($\alpha$=0.05) after feeding on two events, ZM_S125922 and ZM_S125938, and compared to growth of larvae fed on negative control plants ($p<0.02$). Larvae feeding on negative control plants exhibited a mean larval mass of from about 0.6 to about 0.8 mg, while larvae feeding on the transgenic roots exhibited a mean larval mass of from about 0.1 to about 0.2 mg.

Transgenic corn plants (R0) generated using pMON72829 were planted into 10-inch pots containing Metromix soil after reaching an appropriate size. When plants reached the V4 growth stage, approximately 1000 Western corn rootworm (WCR, *Diabrotica virifera*) eggs were infested into the root zone. Non-transgenic corn of the same genotype was infested at a similar growth stage to serve as a negative control. Eggs were pre-incubated so hatch would occur within 24 hours of infestation. Larvae were allowed to feed on the root systems for 3 weeks. Plants were removed from the soil and washed so that the roots could be evaluated for larval feeding. Root damage was rated using a Node Injury Scale (NIS) was used to score the level of damage where a 0 indicates no damage, a 1 indicates that one node of roots was pruned to within 1.5 inches, a 2 indicates that 2 nodes were pruned, while a 3 indicates that 3 nodes were pruned. Because the plants being used for evaluation were directly out of tissue culture after transformation and because transformation events are unique, only a single plant was evaluated per event at this time and no statistics are available. All plants in the assay presented symptoms of larval feeding indicating that a successful infestation was obtained. Negative control plant roots were moderately to severely damaged averaging about 1.9 on the Node Injury Scale. Single plants from eight different transgenic events were tested. Roots of three of these transgenic plants provided excellent control of larval feeding, averaging about 0.2 or less on the Node Injury Scale. Roots from two of the transgenic plants exhibited moderate feeding damage, and three other transgenic plants exhibited no control of larval feeding. This data indicated that the double nucleotide sequence encoding a RNA sequence that can form into a dsRNA is fully capable of providing protection from rootworm pest infestation when expressed in a transgenic plant and that plant is provided in the diet of the rootworm pest.

One explanation for the lack of consistent observable mortality or other effects with the sequences selected for gene suppression including EF1alpha, 26S proteasome subunit, and various other cDNA sequences could be that, for these genes, there are expressed homologues present within the population of genes encoding proteins that have similar functions but exhibit sufficient sequence differences that the RNAi pathway does not act to suppress the homologue using the sequences selected for suppression.

Example 2

This example illustrates significant pest inhibition obtained by feeding to an invertebrate pest a diet containing double stranded RNA sequences derived from that pest.

Artificial diet sufficient for rearing corn rootworm larvae was prepared by applying samples of double stranded RNA sequences derived from six different corn rootworm cDNA library sequences. Corn rootworm larvae were allowed to feed on the diet for several days and mortality, morbidity and stunting monitored in comparison to rootworms allowed to feed only on control diet. The nucleotide sequences that were used in the diet were derived from sequences as set forth in SEQ ID NO:40638, SEQ ID NO:40642, SEQ ID NO:40650, SEQ ID NO:40655, SEQ ID NO:40610, and SEQ ID NO:40634, each corresponding to nucleotide sequences derived from a corn rootworm cDNA library, the deduced amino acid sequence translation of which corresponds respectively to proteins annotated to a 40 kDa V-ATPase homolog, an EF1$\alpha$ homolog, a 26S proteasome subunit homolog, a juvenile hormone epoxide hydroxylase homolog, a CHD3 homolog, and a $\beta$-tubulin homolog.

Double stranded RNA's (dsRNA's) corresponding to these sequences were produced as indicated above. siRNA's were generated by cleavage of the corresponding dsRNA's using RNAse III enzyme, which is known to cleave dsRNA into 12-15 bp dsRNA fragments containing 2 to 3 nucleotide 3' overhangs, and 5' phosphate and 3' hydroxyl termini. The siRNA's produced in this fashion were expected to exhibit the same properties as siRNA's that would be produced by the Dicer enzyme involved in the eukaryotic RNAi pathway.

The dsRNA's and siRNA's were sampled onto the CRW diet as indicated above at about 0.15 ppm. 12 individual corn rootworm larvae were tested separately against each dsRNA or siRNA sample as indicated above and the results were scored after 13 days.

A significant reduction in larval mass ($p<0.05$) was observed for larvae feeding on diet containing 0.15 ppm dsRNA sequences as set forth in SEQ ID NO:40638, SEQ ID NO:40655, SEQ ID NO:40610, and SEQ ID NO:40634 compared to the untreated control (UTC). siRNA corresponding to sequences as set forth in SEQ ID NO:40638, SEQ ID NO:40642, SEQ ID NO:40650, and SEQ ID NO:40610 also provided a significant reduction in larval mass (p<0.05). However, the larval sample size was insufficient to establish with certainty that the dsRNA or siRNA molecules which resulted in the greatest decrease in larval mass compared to the controls was a result of random variation or clearly a result based on double stranded RNA mediated inhibition of some biological function within the rootworm larvae. Therefore, based on these results, RNA sequences corresponding to SEQ ID NO:40638, SEQ ID NO:40642, SEQ ID NO:40610, and SEQ ID NO:40634 were re-evaluated with a larger larval sample size.

dsRNA or siRNA samples were applied to each of 72 wells for each of the four RNA sequences in the evaluation. Each well was loaded with 0.15 ppm dsRNA or siRNA as indicated above by applying a 30 microliter volume containing the RNA to the surface of the diet and allowing the sample to infuse and the surface of the diet to dry. A single larva was added to each well and incubated for thirteen days. Larval mortality and morbidity were evaluated, and mass of surviving larvae was determined. The bioassay results are shown in Table 1.

TABLE 1

Bioassay Results

| RNA | % Mortality | Mass (mg) | STE |
|---|---|---|---|
| dsRNA Bioassay Results | | | |
| SEQ ID NO: 40638 | 62.25 | 0.42 | 0.12 |
| SEQ ID NO: 40642 | 50.5 | 0.39 | 0.05 |
| SEQ ID NO: 40610 | 47.67 | 0.37 | 0.05 |
| SEQ ID NO: 40634 | 92.24 | 0.27 | 0.05 |
| dsRNA Control[1] | 21.08 | 0.58 | 0.08 |
| Cry3Bb[2] | 42.08 | 0.21 | 0.03 |
| UTC | 5.58 | 1.24 | 0.33 |
| siRNA Bioassay Results | | | |
| SEQ ID NO: 40638 | 21.11 | 0.45 | 0.06 |
| SEQ ID NO: 40638 | 21.39 | 1.31 | 0.16 |
| SEQ ID NO: 40610 | 15.83 | 0.73 | 0.09 |
| SEQ ID NO: 40634 | 20.00 | 0.39 | 0.07 |
| siRNA Control[1] | 6.52 | 1.10 | 0.16 |
| Cry3Bb[2] | 27.78 | 0.49 | 0.05 |
| UTC | 9.45 | 1.25 | 0.18 |

All siRNA samples at 0.15 ppm per well
UTC - 10 mM TrisHCl pH 7.5
STE - standard error
[1]phage λ dsRNA, EPICENTER TECHNOLOGIES, Madison, Wisconsin in dsRNA bioassay; MEGAscript ® RNAi Kit, AMBION, Austin, Texas in siRNA bioassay
[2]Cry3Bb variant 11231 at 300 ppm in dsRNA bioassay, 200 ppm in siRNA bioassay All samples were compared to each other using Tukey's HSD method rather than to any single control. Significant larval stunting was observed for each dsRNA or siRNA tested as judged by average mass reduction of surviving larvae compared to the untreated control. More importantly, the double stranded small interfering RNA samples demonstrated an ability to cause mortality and morbidity (based on reduced larval mass) at a level that was at least as effective as the positive control sample Cry3Bb variant 11231. These results suggest that any double stranded RNA molecule derived from a messenger RNA sequence present in the cells of corn rootworm could be effective when provided to rootworms in their diet to inhibit rootworm pest infestation of a plant species.

Example 3

This example illustrates nucleotide sequences for expression in a plant cell, and the effect of providing such nucleotide sequences in the diet of a corn rootworm.

A CHD3 coding sequence derived from a corn rootworm cDNA library was used to construct a nucleotide sequence encoding a stabilized double stranded RNA. A cDNA sequence as set forth in SEQ ID NO:2114 encoding a part of an ortholog or a homolog of a CHD3 amino acid sequence was used to construct a primer pair for use in a thermal amplification reaction using corn rootworm genomic template DNA. The primer pair as set forth at SEQ ID NO:40608 and SEQ ID NO:40609 enabled the amplification of a double stranded genome amplicon, one strand of which exhibited the sequence as set forth in SEQ ID NO:40610. Three nucleotide sequence segments were produced from the nucleotide sequence as set forth in SEQ ID NO:40610. A first nucleotide segment (SEQ ID NO:19251) was produced using a nucleotide sequence as set forth in SEQ ID NO:40610 as template in a thermal amplification reaction along with the thermal amplification primer pair exhibiting the sequences as set forth in SEQ ID NO:40611 and SEQ ID NO:40612. A second nucleotide segment (SEQ ID NO:40616) was produced using a nucleotide sequence as set forth in SEQ ID NO:40610 as template in a thermal amplification reaction along with the thermal amplification primer pair exhibiting the sequences as set forth in SEQ ID NO:40614 and SEQ ID NO:40615. A third nucleotide segment (SEQ ID NO:40619) was produced using a nucleotide sequence as set forth in SEQ ID NO:40610 as template in a thermal amplification reaction along with the thermal amplification primer pair exhibiting the sequences a set forth in SEQ ID NO:40617 and SEQ ID NO:40618. The 3' end of one of the strands the first segment is complementary to the 3' end of one of the strands of the second segment so that in a thermal amplification reaction containing both of these segments, these complementary ends hybridize and allow for the polymerase-mediated extension of both strands from their respective 3' ends. The 3' end of the other strand of the second segment is complementary to the 3' end of one of the strands of the third segment, so that in a thermal amplification reaction containing both of these segments, these complementary ends hybridize and allow for the polymerase-mediated extension of both strands from their respective 3' ends. In a thermal amplification reaction containing all three segments and their complementary sequences, i.e., the first, the second and the third segment, along with thermal amplification primer sequences as set forth in SEQ ID NO:40611 and SEQ ID NO:40618, a new sequence is produced as set forth in SEQ ID NO:40620, that when placed under the control of a promoter that functions in plants, can produce an RNA nucleotide sequence substantially identical to the sequence as set forth in SEQ ID NO:40620 except that uridine residues are present in place of thymidine residues. This RNA nucleotide sequence can form into a stabilized RNA molecule by virtue of the reverse complementarity of the third segment to the first segment, in which the portion of SEQ ID NO:40620 corresponding to the third segment from about nucleotide position 303 to about nucleotide position 473 hybridizes to the portion of SEQ ID NO:40620 corresponding to the first segment from about nucleotide position 1 through about nucleotide position 171, and the first and the third segments are linked by a second nucleotide sequence segment, which in this example is represented by the portion of SEQ ID NO:40620 corresponding to the second segment from about nucleotide position 172 through about nucleotide position 302. Expression of a nucleotide sequence corresponding to SEQ ID NO:40620 in plant cells results in the synthesis of a stabilized RNA molecule.

Plant cells transcribing a nucleotide sequence as set forth in SEQ ID NO:40620 into an RNA sequence can be provided in the diet of a corn rootworm. A corn rootworm feeding upon such plant cells stop feeding, is prevented from developing into an adult beetle, is prevented from breeding, dies, or suffers from any or all of these effects as a result of inhibition of the CHD3 homologous protein synthesis.

A β-tubulin coding sequence derived from a corn rootworm cDNA library was used to construct a nucleotide sequence encoding a stabilized double stranded RNA. A cDNA sequence as set forth in SEQ ID NO:40621 encoding a part of an ortholog or a homolog of a β-tubulin amino acid sequence was used to construct a primer pair for use in a thermal amplification reaction using corn rootworm genomic template DNA. The primer pair as set forth at SEQ ID NO:40622 and SEQ ID NO:40623 enabled the amplification of a double stranded genome amplicon, one strand of which exhibited the sequence as set forth in SEQ ID NO:40624. Three nucleotide sequence segments were produced from the nucleotide sequence as set forth in SEQ ID NO:40624. A first nucleotide segment (SEQ ID NO:3917) was produced using a nucleotide sequence as set forth in SEQ ID NO:40624 as template in a thermal amplification reaction along with the thermal amplification primer pair exhibiting the sequences as set forth in SEQ ID NO:40625 and SEQ ID NO:40626. A second nucleotide segment (SEQ ID NO:40630) was produced using a nucleotide sequence as set forth in SEQ ID NO:40624 as template in a thermal amplification reaction along with the thermal amplification primer pair exhibiting the sequences as set forth in SEQ ID NO:40628 and SEQ ID NO:40629. A third nucleotide segment (SEQ ID NO:40639) was produced using a nucleotide sequence as set forth in SEQ ID NO:40624 as template in a thermal amplification reaction along with the thermal amplification primer pair exhibiting the sequences a set forth in SEQ ID NO:40631 and SEQ ID NO:40632. The 3' end of one of the strands the first segment is complementary to the 3' end of one of the strands of the second segment so that in a thermal amplification reaction containing both of these segments, these complementary ends hybridize and allow for the polymerase-mediated extension of both strands from their respective 3' ends. The 3' end of the other strand of the second segment is complementary to the 3' end of one of the strands of the third segment, so that in a thermal amplification reaction containing both of these segments, these complementary ends hybridize and allow for the polymerase-mediated extension of both strands from their respective 3' ends. In a thermal amplification reaction containing all three segments and their complementary sequences, i.e., the first, the second and the third segment, along with thermal amplification primer sequences as set forth in SEQ ID NO:40625 and SEQ ID NO:40632, a new sequence is produced as set forth in SEQ ID NO:40634, that when placed under the control of a promoter that functions in plants, can produce an RNA nucleotide sequence substantially identical to the sequence as set forth in SEQ ID NO:40634 except that uridine residues are present in place of thymidine residues. This RNA nucleotide sequence can form into a stabilized RNA molecule by virtue of the reverse complementarity of the third segment to the first segment, in which the portion of SEQ ID NO:40634 corresponding to the third segment from about nucleotide position 358 to about nucleotide position 577 hybridizes to the portion of SEQ ID NO:40634 corresponding to the first segment from about nucleotide position 31 through about nucleotide position 250, and the first and third segments are linked by a second nucleotide sequence segment, which in this example is represented a portion of SEQ ID NO:40634 corresponding to the second segment from about nucleotide position 251 through about nucleotide position 357. Expression of a nucleotide sequence corresponding to SEQ ID NO:40634 in plant cells results in the synthesis of a stabilized RNA molecule. Plant cells transcribing a nucleotide sequence as set forth in SEQ ID NO:40634 into an RNA sequence can be provided in the diet of a corn rootworm. A corn rootworm feeding upon such plant cells stop feeding, is prevented from developing into an adult beetle, is prevented from breeding, dies, or suffers from any or all of these effects as a result of inhibition of the 13 tubulin protein synthesis.

Example 4

This example illustrates the synergistic effects of providing in the diet of an invertebrate pest one or more pesticidally effective compositions together with one or more double stranded RNA sequences derived from the invertebrate pest, the one or more dsRNA sequences having previously demonstrated a pesticidal effect when provided in the diet of the pest.

As indicated in example 3, providing in the diet of an invertebrate pest a double stranded RNA molecule derived from that pest results in the inhibition of one or more biological functions in the pest and therefore functions to achieve a pesticidal effect, resulting in the mortality of the pest or some other measurable feature that reduces the ability of the pest to infest a particular environment or host. The addition of one or more other pesticidal agents, each different from each other and each functioning to achieve its pesticidal effect by a means different from the way in which the dsRNA functions to achieve its pesticidal effect, may result in achieving an improvement in the level of pest control and would further decrease the likelihood that the pest would develop resistance to any one or more of the pesticidal agents or dsRNA's when used alone to achieve inhibition of the pest.

To test this, CRW larvae are allowed to feed on diet into which is incorporated varying amounts of a Cry3Bb rootworm inhibitory protein and a fixed amount of a double stranded RNA formulated above as set forth in Example 2 or 3, such as a dsRNA corresponding to SEQ ID NO:40620 or SEQ ID NO:40634. A synergistic pest inhibition effect is observed. As set forth in Example 2 and 3, an LD50 amount of a variant Cry3Bb was used to achieve about 50% insect larvae mortality with a coordinate reduction in fitness of the surviving larvae as judged by the reduced larvae weights in comparison to negative controls. Reducing the amount of the insecticidal protein in the diet results in a coordinate reduction in the mortality rate, and an increase in the mean surviving larval weights. The addition of dsRNA corresponding to either SEQ ID NO:40634 or to SEQ ID NO:40620 results in almost complete mortality at each concentration of Cry3Bb, and a substantial decrease in the mean weight of any survivors. This suggests a synergistic effect. Synergy may be achieved through the disturbance in the larval mid-gut as a result of the introduction of any amount of Cry3Bb, which has been shown to introduce pores into the mid-gut membrane. The pores may allow a greater level of the double stranded RNA species to permeate into cells or even into the haemolymph, resulting in a more efficient delivery of the dsRNA species into the larvae, and thus resulting in a more efficient reduction in the suppression of the target mRNA. Particular combinations of pore forming compositions along with double stranded RNA compositions results in an enhanced and synergistic pesticidal effect because dsRNA is now more able to be distributed throughout the haemolymph and exert effects on cells and tissues remote from the gut of the pest. Particular pore forming compositions include but may not be limited to insecticidal toxin proteins derived from *B. thuringiensis* and related species, whether or not these are demonstrated to be insecticidal to a particular insect, and further may include but not be limited to pore forming domains of such toxins. Such pore forming compositions may also include one or more such pore forming toxins or domains or combinations thereof, each different from the other, each exhibiting a different mode of action as judged by each toxin or domain channel forming properties including kinetics of ion channel formation, sizes of conductance states, total membrane conductance, ion specificity, and ion channel gating properties. Combinations of such pore forming compositions along with dsRNA molecules specific for suppression of one or more genes in a coleopteran species are specifically contemplated herein.

Example 5

This example illustrates that the nucleotide sequence fragments of the V-ATPase, when provided in the double stranded RNA form in the diet of a CRW species, are useful for controlling the insect pest.

The sequence as set forth in SEQ ID NO:40713 is a cDNA clone that represents 1870 nucleotides of a 2400 nucleotide mRNA encoding a protein exhibiting substantial sequence identity to a *Drosophila melanogaster* Vacuolar ATPase (68 kd, subunit 2). This cDNA clone was fully sequenced on both strands using primers designed from the initial sequence data. These sequencing primers are listed as SEQ ID NO:40714 through SEQ ID NO:40729. SEQ ID NO:40730 and SEQ ID NO:40731 are sequences of the primers used to produce a copy of SEQ ID NO:40713 from the cDNA in the cloning vector pSPORT (Invitrogen). Each primer contained a 20-nucleotide T7 promoter sequence from nucleotide positions 1-20. Nucleotides 21-44 set forth in SEQ ID NO:40730 and nucleotides 21-45 of SEQ ID NO:40731 correspond to sequences within the pSPORT vector flanking the inserted cDNA. These primers allow the amplification of a DNA template containing the cDNA fragment flanked at either end with T7 promoters, allowing for the in vitro production of double stranded RNA with a T7 RNA polymerase. When double stranded RNA derived from SEQ ID NO:40713 was included in the CRW diet, about 80% mortality was observed.

Six different regions of SEQ ID NO:40713 were tested by using the following sets of amplification primers: SEQ ID NO:40732 and SEQ ID NO:40733, corresponding to nucleotides 1 to 291 (referred to as section #1, 271 base pairs) of SEQ ID NO: 1; SEQ ID NO:40734 and SEQ ID NO:40735 corresponding to nucleotides 292 to 548 (referred to as section #2, 260 base pairs); SEQ ID NO:40736 and SEQ ID NO:40737 corresponding to 549 to 830 (referred to as section #3, 271 base pairs); SEQ ID NO:40738 and SEQ ID NO:40739 corresponding to nucleotides 840 to 1345 (referred to as section #4, 505 base pairs); SEQ ID NO:40740 and SEQ ID NO:40741 corresponding to nucleotides 1360 to 1621 (referred to as section #5 261 base pairs); SEQ ID NO:40742 and SEQ ID NO:40745 corresponding to nucleotides 1540 to 1870 (referred to as section #6, 278 base pairs). Note that section 5 and 6 overlapped by approximately 80 base pairs. When these 6 sections were separately incorporated into CRW diet, sections #1, #2, #3 and #4 showed CRW mortality ranging from 94% to 100%. Section #5 and #6 showed no CRW mortality above the background seen in the untreated controls. The sequence represented by section #1 was further subdivided into 3 smaller sections, each of these three smaller sections being represented by at least from about 150 to about 180 contiguous nucleotides within section #1, so that the first subsection in section #1 overlapped with the second subsection in section #1, and the third subsection in section #1 overlapped with the second subsection. Each of these subsections were tested separately in the CRW bioassay. Mortality between 80 and 90% was observed using these three shorter sequences.

A second means for testing the bioactivity of dsRNA molecules derived from CRW genes is to construct a self-complementary RNA molecule. By combining the same DNA sequence in the reverse orientation with the T7 RNA polymerase promoter a single RNA molecule can be synthesized which is self complementary. One such RNA molecule was constructed by combining the nucleotides 1 through 345 with the nucleotides 50 through 325, from the nucleotide sequence as set forth in SEQ ID NO:40713. The resulting sequence is as set forth in SEQ ID NO:40746 and was designated as pIC17527. pIC17527 was cloned into pTOPT2.1 (Invitrogen). Using the T7 promoter in the pTOPO 2.1 vector a dsRNA approximately 500 base pair nucleotides was produced and incorporated into CRW diet. The resulting mortality was between 80% to 100%.

Example 6

This example illustrates the oral toxicity of dsRNA's towards larvae of the Colorado Potato Beetle, *Leptinotarsa decemlineata*.

Total RNA was isolated from larvae of the Colorado potato beetle (CPB), *Leptinotarsa decemlineata*, using the Ambion mirVana kit (Catalog #1560) and recommended procedures (Ambion Inc., Austin, Tex.). CPB larvae occupying approximately 200 µL volume in a microfuge tube were used for each preparation. Five micrograms of total RNA were used to prepare cDNA using the Invitrogen Thermoscript™ RT-PCR system (Catalog #11146) and recommended procedures for random primer-mediated cDNA synthesis (Invitrogen, Carlsbad, Calif.). This cDNA was used as a template for amplification of V-ATPase A subunit 2 ortholog sequences using Taq DNA polymerase and the oligonucleotide primers pr 550 (SEQ ID NO:40769) and pr552 (SEQ ID NO:40770). These primers were designed by aligning the nucleotide sequences for the nearest V-ATPase A orthologs from *Manduca sexta* (SEQ ID NO:40760), *Aedes aegypti* (SEQ ID NO:40761), *Drosophila melanogaster* (SEQ ID NO:40762), and *Diabrotica virgifera* (WCR) and selecting regions of minimal degeneracy. Primer pr550 corresponds to nucleotides 230-252 in the *M. sexta* gene sequence while primer pr552 corresponds to nucleotides 1354-1331 in the *M. sexta* gene sequence.

Amplification was achieved using a touchdown amplification procedure with the following cycling parameters:
Step 1. 94 C, 2 min;
Step 2. 94 C, 30 sec;
Step 3. 50 C, 2 min;
Step 4. 72 C, 2 min
(35 cycles for steps 2-4, with a step down of −0.3 C per cycle for step 3);
Step 5. 72 C, 10 min; and
Step 6. 4 C.

The approximately 1.2 kb DNA fragment amplified from the cDNA was cloned into the vector pCR2.1-TOPO (Invitrogen) to yield the recombinant plasmid pIC17105. The nucleotide sequence of the cloned insert (SEQ ID NO:40753) shares only 82% nucleotide sequence identity with the V-ATPase A subunit 2 ortholog sequence from the Western corn rootworm, *Diabrotica virgifera*, however, the deduced amino acid sequences for the encoded V-ATPase A proteins share 97% sequence identity.

The V-ATPase A ortholog sequence in plasmid pIC17105 was amplified using primers pr568 (SEQ ID NO:40771) and pr569 (SEQ ID NO:40772), designed as "universal" primers for generating DNA templates with flanking T7 polymerase promoter sequences from pCR2.1-TOPO clones. The amplified DNA served as the template for dsRNA synthesis using the Ambion MEGAscript™ kit (Catalog #1626) and recommended procedures (Ambion Inc., Austin, Tex.). Purified dsRNA derived from the *L. decemlineata* V-ATPase A ortholog sequence was fed to larvae of *L. decemlineata* in an insect feeding assay.

The CPB diet consists of 13.2 g/L agar (Serva 11393), 140.3 g/L Bio-Serve pre-mix (F9380B), 5 ml/L KOH (18.3% w/w), and 1.25 ml/L formalin (37%). The diet was dispensed in 200 uL aliquots onto 96-well plates and dried briefly prior to sample application. Twenty □L of test sample were applied per well, with sterile water serving as the untreated check (UTC). Plates were allowed to dry before adding insect larvae. One neonate CPB larva was added per well with a fine paintbrush. Plates were sealed with mylar and ventilated using an insect pin. Forty larvae were tested per treatment. The bioassay plates were incubated at 27 C, 60% RH, in complete darkness for 10-12 days. The plates were scored for larval stunting and mortality. Data were analyzed using JMP® 4 statistical software (SAS Institute, Cary, N.C., USA).

TABLE 2

Oral toxicity of dsRNA to CPB larvae

| Treatment | % Mortality | Std Dev | SEM | 95% CI |
|---|---|---|---|---|
| Untreated check | 8.33 | 10.21 | 4.17 | −2.38-19.04 |
| V-ATPase A dsRNA | 87.5 | 10.83 | 3.61 | 79.18-95.82 |

Based on the oral toxicity bioassay data using a CPB specific V-ATPase dsRNA, CPB infestation of plants can be controlled by providing in the diet of the pest a plant cell expressing one or more dsRNA sequences specific for suppression of one or more genes in a CPB pest.

Example 7

This example illustrates the results of bioassays of various lepidopteran larvae on artificial diet using insect specific dsRNA.

Total RNA was isolated from $2^{nd}$-$3^{rd}$ ins tar larvae of *Spodoptera frugiperda, Helicoverpa zea, Agrotis ipsilon*, and *Ostrinia nubilalis* using the Ambion mirVana kit (Catalog #1560) and recommended procedures (Ambion Inc., Austin, Tex.). Larvae occupying approximately 200 μL volume in a microfuge tube were used for each preparation.

Five micrograms of total RNA from each of the above lepidopteran species was used to prepare cDNA using the Invitrogen Thermoscript™ RT-PCR system (Catalog #11146) and recommended procedures for random primer-mediated cDNA synthesis (Invitrogen, Carlsbad, Calif.). This cDNA was used as a template for amplification of one or more V-ATPase A subunit 2 ortholog sequences specific for each of the lepidopteran species using Taq DNA polymerase and the oligonucleotide primers pr 550 (SEQ ID NO:40769) and pr552 (SEQ ID NO:40770).

These primers were designed by aligning the nucleotide sequences for the nearest V-ATPase A orthologs from *Manduca sexta, Aedes aegypti, Drosophila melanogaster*, and *Diabrotica virgifera* (WCR) and selecting regions of minimal degeneracy. Primer pr550 corresponds to nucleotides 230-252 in the *M. sexta* gene sequence while primer pr552 corresponds to nucleotides 1354-1331 in the *M. sexta* gene sequence.

Amplification was achieved using a touchdown PCR procedure with the cycling parameters as described in Example 6. The amplified DNA products were cloned into pCR2.1-TOPO and sequenced to confirm their identity. The recombinant plasmids containing the ortholog gene sequences are listed in Table 3.

TABLE 3

Lepidopteran V-ATPase A subunit 2 ortholog sequences

| Plasmid | Insect species | SEQ ID NO: |
|---|---|---|
| pIC17088 | *Spodoptera frugiperda* | SEQ ID NO: 40754 |
| pIC17101 | *Agrotis ipsilon* | SEQ ID NO: 40755 |
| pIC17102 | *Helicoverpa zea* | SEQ ID NO: 40756 |
| pIC17103 | *Ostrinia nubilalis* | SEQ ID NO: 40757 |

The V-ATPase A ortholog sequences in plasmids pIC17088, pIC17101, pIC17102 were amplified using primers pr555 (SEQ ID NO:40773) and pr556 (SEQ ID NO:40774), designed to generate DNA fragments with flanking and opposing T7 polymerase promoters for in vitro dsRNA synthesis.

Double-stranded RNAs (dsRNAs) for the FAW, BCW, and CEW ortholog sequences were synthesized from these amplified DNA templates using the Ambion MEGAscript™ kit (Catalog #1626) and recommended procedures (Ambion Inc., Austin, Tex.) and submitted for insect bioassays at 10 ppm.

For these assays, artificial lepidopteran diet (165 g/L Southland Multiple Species Diet, 14.48 g/L agar) was prepared and dispensed to 128 well trays, 500 ul per well. Samples were dispensed over the diet and placed in a "dry down" chamber at 27 C and 35% humidity, where excess water is evaporated off. Once dried each well was infested with a single neonate larva and sealed with a perforated mylar seal. The trays were incubated for six to eight days at 27 C. The untreated control insects had depleted all of the diet in their respective wells at six to eight days. Fifty-well trays were prepared with 4 ml artificial diet per well, and all insects that were at or near depletion of diet before the assay concluded, were transferred to the new trays. These trays were sealed and returned to the incubator, and all bioassays were then evaluated after a total of ten to twelve days.

The results from these bioassays for the lepidopteran insect species indicate no significant effect on larval mortality or mass gain as compared to the untreated check (comparisons for all pairs using Tukey-Kramer HSD) and using this assay regimen has been observed. Effects on larval mortality or mass gain were also not observed in bioassays using combinations of dsRNA and sublethal amounts of pore forming BT insecticidal proteins known from previous experiments to be toxic to these lepidopteran pests.

Example 8

This example illustrates a bioassay for determining oral toxicity of dsRNA towards larvae of the cotton boll weevil, *Anthonomus grandis*.

Total RNA was isolated from larvae of the cotton boll weevil (BWV), *Anthonomus grandis*, using the Ambion mir- Vana kit (Catalog #1560) and recommended procedures (Ambion Inc., Austin, Tex.). BWV larvae occupying approximately 200 ul volume in a microfuge tube were used for each preparation. Five micrograms of total RNA were used to prepare cDNA using the Invitrogen Thermoscript™ RT-PCR system (Catalog #11146) and recommended procedures for random primer-mediated cDNA synthesis (Invitrogen, Carlsbad, Calif.). This cDNA was used as a template for amplification of V-ATPase A subunit 2 ortholog sequences using Taq DNA polymerase and the oligonucleotide primers pr 550 (SEQ ID NO:40769) and pr552 (SEQ ID NO:40770).

These primers were designed by aligning the nucleotide sequences for the nearest V-ATPase A orthologs from *Manduca sexta, Aedes aegypti, Drosophila melanogaster*, and *Diabrotica virgifera* (WCR) and selecting regions of minimal degeneracy. Primer pr550 corresponds to nucleotides 230-252 in the *M. sexta* gene sequence while primer pr552 corresponds to nucleotides 1354-1331 in the *M. sexta* gene sequence.

Amplification was achieved using a touchdown amplification procedure with the cycling parameters as described in Example 6. The approximately 1.2 kb DNA fragment amplified from the cDNA was cloned into the vector pCR2.1-TOPO (Invitrogen) and the insert sequenced for confirmation. The V-ATPase A ortholog sequence (SEQ ID NO:40758) was amplified using primers pr568 (SEQ ID NO:40771) and pr569 (SEQ ID NO:40772), designed as "universal" primers for generating DNA templates with flanking T7 polymerase promoter sequences from pCR2.1-TOPO clones.

Double-stranded RNAs (dsRNAs) were synthesized from this amplified DNA template using the Ambion MEGAscript™ kit (Catalog #1626) and recommended procedures (Ambion Inc., Austin, Tex.) and submitted for insect bioassay.

For bioassays of the boll weevil, *Anthonomus grandis* Boheman, an agar-based artificial insect diet was used (Bioserv™—F9247B; Gast and Davich, 1966) per manufacturers instructions. Approximately 200 ul of molten diet was dispensed into 96-well microtiter plates and allowed to cool and solidify. A sample (20 ul) containing about 10 ppm dsRNA corresponding to the V-ATPase A ortholog sequence (SEQ ID NO:40758) was then overlaid onto the diet and allowed to dry. Insect eggs (0-14) in 25 ul of 0.1% agar were then dispensed onto the diet. The plates were then sealed with perforated seals (Zymark #72281). The assay was incubated at 27° C. for ten to twelve days and scored for activity by determination of frass accumulation. No effects on larval mortality or mass gain were observed, but this may be a result of the particular feeding physiology of the boll weevil. Burrowing into the diet may significantly decrease the dose of dsRNA ingested and therefore significantly reduce any effects that would otherwise be observed with a surface feeding physiology. Incorporation of the dsRNA into the diet in a uniform manner would likely achieve significant mortality and reduced mass gain.

Other target gene sequences from the boll weevil may be cloned and used as templates for the in vitro synthesis of dsRNAs that can then be tested in insect bioassay to assess their efficacy. For instance, the ribosomal protein L19 (rpl19) gene may be used as a template for dsRNA synthesis. The nucleotide sequences for the rpl19 orthologs from *Bombyx mori* (SEQ ID NO:40763), *Drosophila melanogaster* (SEQ ID NO:40764), *Anopholes gambiae* (SEQ ID NO:40765), and *Diabrotica virgifera* (SEQ ID NO:40766) were aligned and consensus regions of minimal degeneracy identified for the purpose of designing degenerate oligonucleotide primers. Primers pr574 (SEQ ID NO:40775) and pr577 (SEQ ID NO:40777) or primers pr575 (SEQ ID NO:40776) and pr577 (SEQ ID NO:40777) may be used to amplify putative rpl19 ortholog sequences from many different insect species.

Amplification is achieved using a touchdown amplification procedure with the cycling parameters as described in Example 6. The approximately 0.4 kb DNA fragment amplified from the boll weevil cDNA was cloned into the vector pCR2.1-TOPO (Invitrogen) and the insert sequenced for confirmation. The rpl19 ortholog sequence (SEQ ID NO:40767) was amplified using primers pr568 (SEQ ID NO:40771) and pr569 (SEQ ID NO:40772), designed as "universal" primers for generating DNA templates with flanking T7 polymerase promoter sequences from pCR2.1-TOPO clones.

Example 9

This example illustrates a bioassay for determining oral toxicity of dsRNAs towards larvae of the red flour beetle, *Tribolium castaneum*.

Some insects pests are commercially important because they infest the commodity products and processed materials produced from a particular crop. One particular such pest is the red flour beetle. The presence of one or more dsRNA species specific for inhibition of one or more genes in such pests in the commodity product and processed materials produced from a particular crop would be useful in controlling such pest infestation.

Total RNA was isolated from larvae of the red flour beetle (RFB), *Tribolium castaneum*, using the Ambion mirVana kit (Catalog #1560) and recommended procedures (Ambion Inc., Austin, Tex.). RFB larvae occupying approximately 200 ul volume in a microfuge tube were used for each preparation. Five micrograms of total RNA were used to prepare cDNA using the Invitrogen Thermoscript™ RT-PCR system (Catalog #11146) and recommended procedures for random primer-mediated cDNA synthesis (Invitrogen, Carlsbad, Calif.). This cDNA was used as a template for amplification of V-ATPase A subunit 2 ortholog sequences using Taq DNA polymerase and the oligonucleotide primers pr 550 (SEQ ID NO:40769) and pr552 (SEQ ID NO:40770).

These primers were designed by aligning the nucleotide sequences for the nearest V-ATPase A orthologs from *Manduca sexta, Aedes aegypti, Drosophila melanogaster*, and *Diabrotica virgifera* (WCR) and selecting regions of minimal degeneracy. Primer pr550 corresponds to nucleotides 230-252 in the *M. sexta* gene sequence while primer pr552 corresponds to nucleotides 1354-1331 in the *M. sexta* gene sequence.

Amplification is achieved using a touchdown amplification procedure with the cycling parameters as described in Example 6. The approximately 1.2 kb DNA fragment amplified from the cDNA was cloned into the vector pCR2.1-TOPO (Invitrogen) and the insert sequenced for confirmation. The V-ATPase A ortholog sequence (SEQ ID NO:40759) was amplified using primers pr568 (SEQ ID NO:40771 and pr569 (SEQ ID NO:40772), designed as "universal" primers for generating DNA templates with flanking T7 polymerase promoter sequences from pCR2.1-TOPO clones.

Double-stranded RNAs (dsRNAs) were synthesized from this amplified DNA template using the Ambion MEGAscript™ kit (Catalog #1626) and recommended procedures (Ambion Inc., Austin, Tex.) and submitted for insect bioassay. Wheat flour is uniformly mixed with water and dsRNA corresponding to V-ATPase A ortholog sequence (SEQ ID NO:40759) and allowed to dry. The composition is used as a bioassay substrate along with red flour beetle larvae. Insecticidal effects are observed after several days of incubation by extracting the weevil larvae from the flour/dsRNA mixture.

Other target gene sequences from the red flour beetle may be cloned and used as templates for the in vitro synthesis of dsRNAs that can then be tested in insect bioassay to assess their efficacy. For instance, the ribosomal protein L19 (rpl19) gene may be used as a template for dsRNA synthesis. The nucleotide sequences for the rpl19 orthologs from *Bombyx mori*, *Drosophila melanogaster*, *Anopholes gambiae*, and *Diabrotica virgifera* were aligned and consensus regions of minimal degeneracy identified for the purpose of designing degenerate oligonucleotide primers. Primers pr574 (SEQ ID NO:40775) and pr577 (SEQ ID NO:40777) or primers pr575 (SEQ ID NO:40776) and pr577 (SEQ ID NO:40777) may be used to amplify putative rpl19 ortholog sequences from many different insect species.

Amplification is achieved using a touchdown amplification procedure with the cycling parameters as described in Example 6. The approximately 0.4 kb kb DNA fragment amplified from the red flour beetle cDNA was cloned into the vector pCR2.1-TOPO (Invitrogen) and the insert sequenced for confirmation. The rpl19 ortholog sequence (SEQ ID NO:40768) was amplified using primers pr568 (SEQ ID NO:40771) and pr569 (SEQ ID NO:40772), designed as "universal" primers for generating DNA templates with flanking T7 polymerase promoter sequences from pCR2.1-TOPO clones.

Example 10

This example illustrates a bioassay for determining oral toxicity of dsRNAs to white grubs and wireworms.

Total RNA is isolated from white grub of wireworm larvae using the Ambion mirVana kit (Catalog #1560) and recommended procedures (Ambion Inc., Austin, Tex.). Larvae occupying approximately 200 ul volume in a microfuge tube are used for each preparation. Five micrograms of total RNA are used to prepare cDNA using the Invitrogen Thermoscript™ RT-PCR system (Catalog #11146) and recommended procedures for random primer-mediated cDNA synthesis (Invitrogen, Carlsbad, Calif.). This cDNA is used as a template for amplification of V-ATPase A subunit 2 ortholog sequences using Taq DNA polymerase and the oligonucleotide primers pr 550 (SEQ ID NO:40769) and pr552 (SEQ ID NO:40770).

These primers were designed by aligning the nucleotide sequences for the nearest V-ATPase A orthologs from *Manduca sexta*, *Aedes aegypti*, *Drosophila melanogaster*, and *Diabrotica virgifera* (WCR) and selecting regions of minimal degeneracy. Primer pr550 corresponds to nucleotides 230-252 in the *M. sexta* gene sequence while primer pr552 corresponds to nucleotides 1354-1331 in the *M. sexta* gene sequence.

Amplification is achieved using a touchdown amplification procedure with the cycling parameters as described in Example 7. The approximately 1.2 kb DNA fragment amplified from the cDNA is cloned into the vector pCR2.1-TOPO (Invitrogen) and the insert sequenced for confirmation. The V-ATPase A ortholog sequence is amplified using primers pr568 (SEQ ID NO:40771) and pr569 (SEQ ID NO:40772), designed as "universal" primers for generating DNA templates with flanking T7 polymerase promoter sequences from pCR2.1-TOPO clones.

Double-stranded RNAs (dsRNAs) are synthesized from this amplified DNA template using the Ambion MEGAscript™ kit (Catalog #1626) and recommended procedures (Ambion Inc., Austin, Tex.) and submitted for insect bioassay. Effects of oral toxicity are observed after several days of bioassay.

Other target gene sequences from white grubs or wireworms may be cloned and used as templates for the in vitro synthesis of dsRNAs that can then be tested in insect bioassay to assess their efficacy. For instance, the ribosomal protein L19 (rpl19) gene may be used as a template for dsRNA synthesis. The nucleotide sequences for the rpl19 orthologs from *Bombyx mori*, *Drosophila melanogaster*, *Anopholes gambiae*, and *Diabrotica virgifera* were aligned and consensus regions of minimal degeneracy identified for the purpose of designing degenerate oligonucleotide primers. Primers pr574 and pr577 or primers pr575 and pr577 may be used to amplify putative rpl19 ortholog sequences from many different insect species.

Amplification is achieved using a touchdown amplification procedure with the cycling parameters as described in Example 7. The approximately 0.4 kb DNA fragment amplified from the cDNA is cloned into the vector pCR2.1-TOPO (Invitrogen) and the insert sequenced for confirmation. The rpl19 ortholog sequence is amplified using primers pr568 (SEQ ID NO:40771) and pr569 (SEQ ID NO:40772), designed as "universal" primers for generating DNA templates with flanking T7 polymerase promoter sequences from pCR2.1-TOPO clones.

Example 11

This example illustrates a bioassay for determining oral toxicity of dsRNAs towards larvae of the mosquito, *Aedes aegypti*.

Total RNA is isolated from larvae of *Aedes aegypti* larvae using the Ambion mirVana kit (Catalog #1560) and recommended procedures (Ambion Inc., Austin, Tex.). *Aedes aegypti* larvae occupying approximately 200 ul volume in a microfuge tube are used for each preparation. Five micrograms of total RNA are used to prepare cDNA using the Invitrogen Thermoscript™ RT-PCR system (Catalog #11146) and recommended procedures for random primer-mediated cDNA synthesis (Invitrogen, Carlsbad, Calif.). This cDNA is used as a template for amplification of V-ATPase A subunit 2 ortholog sequences using Taq DNA polymerase and the oligonucleotide primers pr 550 (SEQ ID NO:40769) and pr552 (SEQ ID NO:40770).

These primers were designed by aligning the nucleotide sequences for the nearest V-ATPase A orthologs from *Manduca sexta*, *Aedes aegypti*, *Drosophila melanogaster*, and *Diabrotica virgifera* (WCR) and selecting regions of minimal degeneracy. Primer pr550 corresponds to nucleotides 230-252 in the *M. sexta* gene sequence while primer pr552 corresponds to nucleotides 1354-1331 in the *M. sexta* gene sequence.

Amplification is achieved using a touchdown amplification procedure with the cycling parameters as described in Example 7. The approximately 1.2 kb DNA fragment amplified from the cDNA is cloned into the vector pCR2.1-TOPO (Invitrogen) and the insert sequenced for confirmation. The V-ATPase A ortholog sequence is amplified using primers pr568 (SEQ ID NO:40771) and pr569 (SEQ ID NO:40772), designed as "universal" primers for generating DNA templates with flanking T7 polymerase promoter sequences from pCR2.1-TOPO clones.

Double-stranded RNAs (dsRNAs) are synthesized from this amplified DNA template using the Ambion MEGAscript™ kit (Catalog #1626) and recommended procedures (Ambion Inc., Austin, Tex.) and submitted for insect bioassay.

Effects on insect larvae are observed after several days in bioassay.

Other target gene sequences from mosquitoes may be cloned and used as templates for the in vitro synthesis of dsRNAs that can then be tested in insect bioassay to assess their efficacy. For instance, the ribosomal protein L19 (rpl19) gene may be used as a template for dsRNA synthesis. The nucleotide sequences for the rpl19 orthologs from *Bombyx mori, Drosophila melanogaster, Anopholes gambiae*, and *Diabrotica virgifera* were aligned and consensus regions of minimal degeneracy identified for the purpose of designing degenerate oligonucleotide primers. Primers pr574 and pr577 or primers pr575 and pr577 may be used to amplify putative rpl19 ortholog sequences from many different insect species.

Amplification is achieved using a touchdown amplification procedure with the cycling parameters as described in Example 7. The approximately 0.4 kb DNA fragment amplified from the cDNA is cloned into the vector pCR2.1-TOPO (Invitrogen) and the insert sequenced for confirmation. The rpl19 ortholog sequence is amplified using primers pr568 (SEQ ID NO:40771) and pr569 (SEQ ID NO:40772), designed as "universal" primers for generating DNA templates with flanking T7 polymerase promoter sequences from pCR2.1-TOPO clones.

Double-stranded RNAs (dsRNAs) are synthesized from this amplified DNA template using the Ambion MEGAscript™ kit (Catalog #1626) and recommended procedures (Ambion Inc., Austin, Tex.) and submitted for insect bioassay.

Other mosquito species are contemplated to be within the scope of this invention. Suitable target gene sequences from *Aedes, Culex*, and *Anopholes* species can be amplified using appropriate oligonucleotide primers, cloned into the vector pCR2.1-TOPO (Invitrogen) and the insert sequenced for confirmation. The cloned target sequences are amplified using primers pr568 (SEQ ID NO:40771) and pr569 (SEQ ID NO:40772), designed as "universal" primers for generating DNA templates with flanking T7 polymerase promoter sequences from pCR2.1-TOPO clones.

Double-stranded RNAs (dsRNAs) are synthesized from these amplified DNA templates using the Ambion MEGAscript™ kit (Catalog #1626) and recommended procedures (Ambion Inc., Austin, Tex.) and submitted for insect bioassay Example 12

This example illustrates how dsRNA made from the 3'UTR region of V-ATPase showed the down regulation of the target.

Segments (ca. 300 bp of dsRNA) of the WCR V-ATPase 3' UTR have been put into WCR bio-assay and failed to show stunting and mortality within a 12 day bio-assay period. Comparably sized segments within the coding region of the V-ATPase do show significant stunting and mortality at a range of concentrations. Northern blots examining total RNA extracted from WCR larvae fed for 4 days on a V-ATPase 3' UTR segment (and probed with a coding region probe) showed a significant decline in the V-ATPase target mRNA relative to untreated control larvae (summarized NBP#7497215). However, detectable message remained, indicating less effective knock-down of the target with a 3' UTR dsRNA segment (vs using a coding region segment) and/or contribution from a putative second V-ATPase gene that has a significantly diverged 3' UTR from the primary V-ATPase gene. Southern blot data on WCR is consistent with more than one hybridizing gene sequence within the genome, but examination of ESTs and limited family PCR have not yet demonstrated that a putative second gene is transcribed.

It is important to mention that although it is critical to determine the potential to stunt and kill larvae, simply monitoring expression of a target gene by Northern blot or quantitative PCR could also find targets amenable to RNAi strategies. The results above plus other northern experiments looking at the V-ATPase target have shown that the RNA effect on transcript abundance is discernable in insects within hours of presentation of the dsRNA.

Example 13

This example illustrates one approach to implementing insect pest gene suppression using a ta-siRNA mediated silencing method.

An alternative method to silence genes in a plant pest uses the recently discovered class of trans-acting small interfering RNA (ta-siRNA) (Dalmay et al., Cell 101:543-553, 2000; Mourrain et al., Cell 101:533-542, 2000; Peragine et al., Genes and Development, 18:2368-2379, 2004; Vazquez et al, Mol Cell 16(1):69-79, 2004; Yu et al., Mol Plant Microbe Interact 16:206-216, 2003). ta-siRNA are derived from single strand RNA transcripts that are targeted by naturally occurring miRNA within the cell. Methods for using microRNA to trigger ta-siRNA for gene silencing in plants are described in U.S. Provisional Patent Application Ser. No. 60/643,136 (Carrington et al. 2004), incorporated herein by reference in its entirety. At least one pest specific miRNA expressed in gut epithelial cells of corn rootworm larvae is identified. This pest specific miRNA is then used to identify at least one target RNA transcript sequence complementary to the miRNA that is expressed in the cell. The corresponding target sequence is a short sequence of no more than 21 contiguous nucleotides that, when part of a RNA transcript and contacted by its corresponding miRNA in a cell type with a functional RNAi pathway, leads to slicer-mediated cleavage of said transcript. Once miRNA target sequences are identified, at least one miRNA target sequence is fused to a second sequence that corresponds to part of a pest gene that is to be silenced using this method. For example, the miRNA target sequence(s) is fused to sequences of the corn rootworm vacuolar ATPase (V-ATPase) gene. The miRNA target sequence can be placed at the 5' end, the 3' end, or embedded in the middle of the V-ATPase gene. It may be preferable to use multiple miRNA target sequences corresponding to multiple miRNA genes, or use the same miRNA target sequence multiple times in the chimera of the miRNA target sequence and the V-ATPase sequence. The V-ATPase sequence can be of any length, with a minimum of 21 bp.

The chimera of the miRNA target sequence(s) and the V-ATPase sequence is expressed in plant cells using any of a number of appropriate promoter and other transcription regulatory elements, as long as the transcription occurs in cells types subject to being provided in the diet of the pest, e.g. corn roots for control of corn rootworm.

This method may have the additional advantage of delivering longer RNA molecules to the target pest. Typically, dsRNA's produced in plants are rapidly processed by Dicer into short RNA's that may not be effective when fed exogenously to some pests. In this method, a single strand transcript is produced in the plant cell, taken up by the pest, and converted into a dsRNA in the pest cell where it is then processed into ta-siRNA capable of post-transcriptionally silencing one or more genes in one or more target pests.

Example 14

This example illustrates the comparison of CRW cDNA sequences to sequences from sources other than CRW and the identification of (1) sequences in common with those other source sequences and (2) sequences that are unique to CRW. cDNA sequences that are conserved between two organisms are potential RNAi candidates that can be used to target the gene expression and function of both organisms. Alternatively, it may be desirable to select sequences for CRW gene suppression for which no known homologous sequence is present in (a) other pest organisms, (b) non-target organisms, and (c) the plant genome selected for transformation with the CRW suppression sequence.

Six CRW cDNA sequences were selected for comparison to sequences from other sources. The specific sequences included sequences encoding alpha-tubulin, beta-tubulin, CHD3, vacuolar proton pump E subunit, V-ATPase A subunit, and thread proteins. The nucleotide sequences are as set forth in SEQ ID NO:40701, SEQ ID NO:40702, SEQ ID NO:40703, SEQ ID NO:40704, SEQ ID NO:40705, SEQ ID NO:40706, respectively. The CRW cDNA sequences were compared to all public cDNA of various organisms from GenBank using the NCBI megablast program (Altschul et al., J. Mol. Biol. 215:403-410, 1990), the search parameters set as follows:

−W 21 −b50 −v50 requiring at least a 21-mer perfect match and retaining only the top 50 best matches and alignments. The results were filtered to include only organisms in the Insecta order, and honey bee (Apis mellifera) was excluded. Although the analysis was only done on the six CRW cDNA sequences, the same process may be applied to all cDNA or unigene sequences in CRW or other organism of interest without undue burden or experimentation.

Using the six CRW cDNA sequences, a total of 145 matches were identified from 20 distinct insect organisms. These included several pest species, such as pea aphid (Acyrthosiphon pisum), Asiatic citrus psyllid (Diaphorina citri) and human lice (Pediculus humansus).

The results are presented in Table 4 below with coordinates of match on the query sequence and the hit, percent identity of the match, and the insect species from which the hit sequence was derived. For example, a segment from nucleotide position 844 to 1528 in SEQ ID NO:40701 was identified to be substantially identical to a segment from nucleotide position 812 to 128 from GenBank sequence accession number GI: 47521748 derived from pea aphid (Acyrthosiphon pisum). These two sequences share about 85% identity.

TABLE 4

CRW Unigene sequences and Insect Nucleotide Sequnce Homologs

| SEQ ID NO[1] | Identity Position[2] | Gene ID[3] | Identity Poston[4] | % Identity[5] | Genus species[6] |
|---|---|---|---|---|---|
| 40701 | 171-1529 | GI:14279671 | 89-1447 | 83% | Chironomus tentans |
| 40701 | 175-938 | GI:60297223 | 69-832 | 88% | Diaprepes abbreviatus |
| 40701 | 171-779 | GI:49394745 | 79-687 | 89% | Drosophila melanogaster |
| 40701 | 769-1528 | GI:47537494 | 827-68 | 85% | Acyrthosiphon pisum |
| 40701 | 529-1339 | GI:55814359 | 56-865 | 85% | Acyrthosiphon pisum |
| 40701 | 729-1469 | GI:46995994 | 1-741 | 85% | Acyrthosiphon pisum |
| 40701 | 171-740 | GI:49395093 | 79-652 | 88% | Drosophila melanogaster |
| 40701 | 166-903 | GI:60297353 | 68-804 | 85% | Diaprepes abbreviatus |
| 40701 | 171-875 | GI:37593891 | 66-769 | 85% | Pediculus humanus |
| 40701 | 844-1528 | GI:47521748 | 812-128 | 85% | Acyrthosiphon pisum |
| 40701 | 351-1255 | GI:55798571 | 1-903 | 83% | Acyrthosiphon pisum |
| 40701 | 862-1528 | GI:55815587 | 8-674 | 86% | Acyrthosiphon pisum |
| 40701 | 415-1520 | GI:19773419 | 309-1414 | 81% | Bombyx mori |
| 40701 | 171-296 | GI:19773419 | 65-190 | 88% | Bombyx mori |
| 40701 | 415-1520 | GI:608680 | 309-1414 | 81% | Bombyx mori |
| 40701 | 171-296 | GI:608680 | 65-190 | 88% | Bombyx mori |
| 40701 | 738-1434 | GI:55811699 | 1-697 | 85% | Acyrthosiphon pisum |
| 40701 | 171-899 | GI:37593910 | 70-799 | 85% | Pediculus humanus |
| 40701 | 171-1029 | GI:55799535 | 53-911 | 83% | Acyrthosiphon pisum |
| 40701 | 817-1492 | GI:35508998 | 7-681 | 85% | Acyrthosiphon pisum |
| 40701 | 171-845 | GI:25959177 | 50-724 | 85% | Meladema coriacea |
| 40701 | 862-1528 | GI:55803725 | 726-60 | 85% | Acyrthosiphon pisum |
| 40701 | 171-695 | GI:49394718 | 79-603 | 88% | Drosophila melanogaster |
| 40701 | 838-1528 | GI:55813912 | 827-137 | 85% | Acyrthosiphon pisum |
| 40701 | 171-692 | GI:49395499 | 54-575 | 88% | Drosophila melanogaster |
| 40701 | 171-1025 | GI:46997250 | 92-945 | 83% | Acyrthosiphon pisum |
| 40701 | 171-1022 | GI:47533429 | 4-855 | 83% | Acyrthosiphon pisum |
| 40701 | 171-998 | GI:34788002 | 122-949 | 83% | Callosobruchus maculatus |
| 40701 | 171-839 | GI:25959137 | 50-717 | 85% | Meladema coriacea |
| 40701 | 171-677 | GI:49395221 | 84-590 | 88% | Drosophila melanogaster |
| 40701 | 171-809 | GI:25959136 | 50-688 | 86% | Meladema coriacea |
| 40701 | 171-816 | GI:37593801 | 66-712 | 85% | Pediculus humanus |
| 40701 | 171-816 | GI:37593472 | 67-712 | 85% | Pediculus humanus |
| 40701 | 171-848 | GI:25959229 | 47-724 | 85% | Meladema coriacea |
| 40701 | 171-677 | GI:49395496 | 75-581 | 88% | Drosophila melanogaster |
| 40701 | 171-659 | GI:49395250 | 83-571 | 89% | Drosophila melanogaster |
| 40701 | 171-1029 | GI:46997155 | 98-953 | 83% | Acyrthosiphon pisum |
| 40701 | 904-1528 | GI:47519891 | 752-128 | 86% | Acyrthosiphon pisum |
| 40701 | 199-1061 | GI:55813341 | 8-870 | 83% | Acyrthosiphon pisum |
| 40701 | 760-1430 | GI:60298750 | 9-679 | 85% | Diaphorina citri |
| 40701 | 171-998 | GI:46997667 | 106-933 | 83% | Acyrthosiphon pisum |

TABLE 4-continued

CRW Unigene sequences and Insect Nucleotide Sequnce Homologs

| SEQ ID NO[1] | Identity Position[2] | Gene ID[3] | Identity Poston[4] | % Identity[5] | Genus species[6] |
|---|---|---|---|---|---|
| 40701 | 171-785 | GI:25959104 | 69-684 | 85% | *Meladema coriacea* |
| 40701 | 922-1528 | GI:25959369 | 697-91 | 86% | *Meladema coriacea* |
| 40701 | 922-1528 | GI:25959412 | 698-92 | 86% | *Meladema coriacea* |
| 40701 | 171-772 | GI:25959233 | 68-669 | 86% | *Meladema coriacea* |
| 40701 | 171-677 | GI:49395121 | 74-582 | 88% | *Drosophila melanogaster* |
| 40701 | 199-1029 | GI:47534273 | 1-830 | 83% | *Acyrthosiphon pisum* |
| 40702 | 90-1385 | GI:34787982 | 56-1351 | 83% | *Callosobruchus maculatus* |
| 40702 | 74-797 | GI:25958562 | 14-739 | 88% | *Curculio glandium* |
| 40702 | 572-1374 | GI:60297081 | 25-827 | 86% | *Diaprepes abbreviatus* |
| 40702 | 100-1425 | GI:19773425 | 91-1416 | 81% | *Bombyx mori* |
| 40702 | 100-1425 | GI:2073100 | 111-1436 | 81% | *Bombyx mori* |
| 40702 | 55-738 | GI:60297565 | 7-684 | 87% | *Diaprepes abbreviatus* |
| 40702 | 131-1425 | GI:39842328 | 28-1322 | 81% | *Laodelphax striatellus* |
| 40702 | 688-1449 | GI:60298019 | 9-770 | 85% | *Diaprepes abbreviatus* |
| 40702 | 61-606 | GI:49394901 | 10-557 | 87% | *Drosophila melanogaster* |
| 40702 | 61-605 | GI:49395418 | 12-558 | 87% | *Drosophila melanogaster* |
| 40702 | 100-1008 | GI:2613140 | 68-976 | 81% | *Manduca sexta* |
| 40702 | 1064-1416 | GI:2613140 | 1032-1384 | 83% | *Manduca sexta* |
| 40702 | 61-573 | GI:49395445 | 15-528 | 87% | *Drosophila melanogaster* |
| 40702 | 40-582 | GI:49395189 | 4-551 | 86% | *Drosophila melanogaster* |
| 40702 | 104-918 | GI:47518537 | 27-841 | 82% | *Acyrthosiphon pisum* |
| 40702 | 104-784 | GI:25959017 | 39-719 | 83% | *Meladema coriacea* |
| 40702 | 104-879 | GI:47538212 | 85-860 | 82% | *Acyrthosiphon pisum* |
| 40702 | 104-852 | GI:47520002 | 32-780 | 82% | *Acyrthosiphon pisum* |
| 40702 | 104-789 | GI:47519819 | 118-803 | 83% | *Acyrthosiphon pisum* |
| 40702 | 104-789 | GI:47532797 | 106-791 | 83% | *Acyrthosiphon pisum* |
| 40702 | 100-708 | GI:53910346 | 73-681 | 84% | *Heliconius erato petiverana* |
| 40702 | 100-880 | GI:6902132 | 54-834 | 82% | *Bombyx mori* |
| 40702 | 104-789 | GI:46999310 | 91-777 | 83% | *Acyrthosiphon pisum* |
| 40704 | 113-263 | GI:41578101 | 124-274 | 90% | *Culicoides sonorensis* |
| 40704 | 113-263 | GI:41577171 | 65-215 | 90% | *Culicoides sonorensis* |
| 40704 | 113-308 | GI:15466250 | 140-335 | 86% | *Drosophila melanogaster* |
| 40704 | 113-308 | GI:15530478 | 140-335 | 85% | *Drosophila melanogaster* |
| 40704 | 112-308 | GI:15516090 | 140-336 | 85% | *Drosophila melanogaster* |
| 40704 | 113-308 | GI:49393479 | 52-247 | 85% | *Drosophila melanogaster* |
| 40704 | 113-263 | GI:41577256 | 99-249 | 88% | *Culicoides sonorensis* |
| 40704 | 113-308 | GI:41403307 | 84-279 | 85% | *Drosophila melanogaster* |
| 40704 | 113-308 | GI:41402978 | 79-274 | 85% | *Drosophila melanogaster* |
| 40704 | 113-308 | GI:41401487 | 82-277 | 85% | *Drosophila melanogaster* |
| 40704 | 113-308 | GI:38628155 | 176-371 | 85% | *Drosophila melanogaster* |
| 40704 | 118-293 | GI:16901350 | 70-245 | 87% | *Ctenocephalides felis* |
| 40704 | 118-293 | GI:16900951 | 78-253 | 87% | *Ctenocephalides felis* |
| 40704 | 113-308 | GI:14708726 | 170-365 | 85% | *Drosophila melanogaster* |
| 40704 | 113-308 | GI:14707923 | 171-366 | 85% | *Drosophila melanogaster* |
| 40704 | 113-308 | GI:14708035 | 139-334 | 85% | *Drosophila melanogaster* |
| 40704 | 113-308 | GI:14705944 | 135-330 | 85% | *Drosophila melanogaster* |
| 40704 | 113-308 | GI:14705959 | 95-290 | 85% | *Drosophila melanogaster* |
| 40704 | 113-308 | GI:14705165 | 108-303 | 85% | *Drosophila melanogaster* |
| 40704 | 113-308 | GI:14703451 | 150-345 | 85% | *Drosophila melanogaster* |
| 40704 | 113-308 | GI:14703188 | 95-290 | 85% | *Drosophila melanogaster* |
| 40704 | 113-308 | GI:14700853 | 108-303 | 85% | *Drosophila melanogaster* |
| 40704 | 113-308 | GI:14700635 | 136-331 | 85% | *Drosophila melanogaster* |
| 40704 | 113-308 | GI:14699645 | 95-290 | 85% | *Drosophila melanogaster* |
| 40704 | 113-308 | GI:14697887 | 94-289 | 85% | *Drosophila melanogaster* |
| 40704 | 113-308 | GI:14697103 | 136-331 | 85% | *Drosophila melanogaster* |
| 40704 | 113-308 | GI:14696099 | 137-332 | 85% | *Drosophila melanogaster* |
| 40704 | 113-308 | GI:14696107 | 136-331 | 85% | *Drosophila melanogaster* |
| 40704 | 113-308 | GI:14695238 | 95-290 | 85% | *Drosophila melanogaster* |
| 40704 | 113-308 | GI:14693081 | 133-328 | 85% | *Drosophila melanogaster* |
| 40704 | 113-308 | GI:14691490 | 138-333 | 85% | *Drosophila melanogaster* |
| 40705 | 694-1364 | GI:2454487 | 811-1481 | 84% | *Aedes aegypti* |
| 40705 | 715-1220 | GI:22039978 | 3-507 | 86% | *Ctenocephalides felis* |
| 40705 | 694-1175 | GI:4734043 | 166-647 | 85% | *Aedes aegypti* |
| 40705 | 895-1286 | GI:16899106 | 3-393 | 87% | *Ctenocephalides felis* |
| 40705 | 895-1286 | GI:16899780 | 6-395 | 87% | *Ctenocephalides felis* |
| 40705 | 895-1286 | GI:16899721 | 6-396 | 86% | *Ctenocephalides felis* |
| 40705 | 961-1286 | GI:22039013 | 8-333 | 87% | *Ctenocephalides felis* |
| 40705 | 874-1327 | GI:33376955 | 30-483 | 83% | *Glossina morsitans morsitans* |
| 40705 | 636-1136 | GI:46997165 | 360-859 | 81% | *Acyrthosiphon pisum* |
| 40705 | 874-1220 | GI:33376948 | 25-371 | 84% | *Glossina morsitans morsitans* |
| 40705 | 943-1364 | GI:3514814 | 74-495 | 82% | *Drosophila melanogaster* |
| 40705 | 943-1364 | GI:24583987 | 1055-1476 | 82% | *Drosophila melanogaster* |
| 40705 | 694-884 | GI:24583987 | 806-996 | 82% | *Drosophila melanogaster* |
| 40705 | 943-1364 | GI:24583985 | 967-1388 | 82% | *Drosophila melanogaster* |
| 40705 | 694-884 | GI:24583985 | 718-908 | 82% | *Drosophila melanogaster* |

TABLE 4-continued

CRW Unigene sequences and Insect Nucleotide Sequnce Homologs

| SEQ ID NO[1] | Identity Position[2] | Gene ID[3] | Identity Poston[4] | % Identity[5] | Genus species[6] |
|---|---|---|---|---|---|
| 40705 | 943-1364 | GI:24583983 | 1052-1473 | 82% | Drosophila melanogaster |
| 40705 | 694-884 | GI:24583983 | 803-993 | 82% | Drosophila melanogaster |
| 40705 | 943-1364 | GI:18467973 | 1049-1470 | 82% | Drosophila melanogaster |
| 40705 | 694-884 | GI:18467973 | 800-990 | 82% | Drosophila melanogaster |
| 40705 | 943-1364 | GI:19527546 | 1052-1473 | 82% | Drosophila melanogaster |
| 40705 | 694-884 | GI:19527546 | 803-993 | 82% | Drosophila melanogaster |
| 40705 | 1045-1365 | GI:4734199 | 1-321 | 84% | Aedes aegypti |
| 40705 | 943-1280 | GI:51961912 | 81-418 | 83% | Drosophila simulans |
| 40705 | 734-947 | GI:22039138 | 73-285 | 87% | Ctenocephalides felis |
| 40705 | 959-1364 | GI:24583991 | 1081-1486 | 81% | Drosophila melanogaster |
| 40705 | 959-1364 | GI:18467977 | 1081-1486 | 81% | Drosophila melanogaster |
| 40705 | 943-1340 | GI:21355198 | 994-1391 | 81% | Drosophila melanogaster |
| 40705 | 694-884 | GI:21355198 | 745-935 | 82% | Drosophila melanogaster |
| 40705 | 959-1364 | GI:19528270 | 1021-1426 | 81% | Drosophila melanogaster |
| 40705 | 959-1364 | GI:18859618 | 951-1356 | 81% | Drosophila melanogaster |
| 40705 | 943-1340 | GI:1373432 | 994-1391 | 81% | Drosophila melanogaster |
| 40705 | 694-884 | GI:1373432 | 745-935 | 82% | Drosophila melanogaster |
| 40705 | 959-1364 | GI:5851682 | 1021-1426 | 81% | Drosophila melanogaster |
| 40705 | 142-345 | GI:22039875 | 163-366 | 87% | Ctenocephalides felis |
| 40705 | 142-345 | GI:16901137 | 217-420 | 87% | Ctenocephalides felis |
| 40705 | 82-595 | GI:34787824 | 112-625 | 79% | Callosobruchus maculatus |
| 40705 | 142-345 | GI:16901267 | 156-360 | 87% | Ctenocephalides felis |
| 40705 | 771-1022 | GI:22005558 | 58-309 | 84% | Aedes aegypti |
| 40705 | 96-357 | GI:46996282 | 118-379 | 83% | Acyrthosiphon pisum |
| 40705 | 963-1364 | GI:18898890 | 11-412 | 80% | Anopheles gambiae |
| 40705 | 967-1364 | GI:18936027 | 25-422 | 80% | Anopheles gambiae |
| 40705 | 61-344 | GI:37952369 | 124-407 | 81% | Ips pini |
| 40706 | 1230-1251 | GI:33371240 | 247-268 | 100% | Glossina morsitans morsitans |
| 40706 | 1230-1251 | GI:33374947 | 249-270 | 100% | Glossina morsitans morsitans |

[1]WCR SEQ ID NO as set forth in the sequence listing;
[2]Nucleotide position in the SEQ ID NO in column 1 that exhibits substantial identity with Gene ID in column 3 on same row;
[3]Gene accession number of corresponding matching sequence identified within public database that exhibits substantial identity with column 1 SEQ ID NO;
[4]nucleotide position of sequence identified in column 3 that matches with CRW nucleotids specified on same row;
[5]Percentage identity between the WCR SEQ ID NO and Gene ID (comparison of identity between column 2 and column 4 sequences on any given row); and
[6]Genus and species of organism from which the Gene Accession No. sequence was derived.

Example 15

This example illustrates the identification of predicted protein functional domains and gene families from the translation of the nucleotide sequences disclosed herein using sequence matches to known sequences and existing domain consensus models.

The protein sequences were first produced with a "translator" program, which translated Unigenes into peptide sequences through the following steps: homology to known proteins; model-based ab initio gene structure prediction; and longest open reading frame (ORF). Frame shifts due to sequencing errors were corrected. The protein sequences were then searched against Pfam database, a large collection of multiple sequence alignments and hidden Markov models (HMM) covering many common protein families (The Pfam Protein Families Database, Bateman et al., Nucleic Acids Research 32:D138-D141, 2004). The protein HMM models were searched with program HMMPAM (Durbin et al., Biological Sequence Analysis: Probabilistic Models of Proteins and Nucleic Acids, Cambridge University Press, 1998), with the default stringencies. A further filtering was done to keep only those matches with an expectation value of 0.1 or smaller as significant matches. Of the 20303 Corn rootworm peptide sequences, 4199 (21%) were identified with 1317 distinct protein domains and families.

The analysis results were presented in the feature fields of the sequence listing file with these attributes: Pfam name, Pfam description, and match level with HMMPFAM score, expectation value (E-value) and number of copies of the domain in the peptide sequence.

Example 16

This example illustrates a method for providing a DNA sequence for dsRNA-mediated gene silencing. More specifically, this example describes selection of an improved DNA useful in dsRNA-mediated gene silencing by (a) selecting from a target gene an initial DNA sequence including more than 21 contiguous nucleotides; (b) identifying at least one shorter DNA sequence derived from regions of the initial DNA sequence consisting of regions predicted to not generate undesirable polypeptides; and (c) selecting a DNA sequence for dsRNA-mediated gene silencing that includes the at least one shorter DNA sequence. Undesirable polypeptides include, but are not limited to, polypeptides homologous to allergenic polypeptides and polypeptides homologous to known polypeptide toxins.

WCR V-ATPase has been demonstrated to function in corn rootworm feeding assays to test dsRNA mediated silencing as a means of controlling larval growth. A cDNA sequence from a vacuolar ATPase gene (V-ATPase) from Western corn rootworm (WCR) (Diabrotica virgifera virgifera LeConte) was selected for use as an initial DNA sequence (SEQ ID NO. 40707). This initial DNA sequence was screened for regions within which every contiguous fragment including at least 21 nucleotides matched fewer than 21 out of 21 contiguous nucleotides of known vertebrate sequences. Three sequence segments greater than about 100 contiguous nucleotides that were free of such 21/21 hits were identified; a first sequence segment corresponding to nucleotide position 739-839, a second sequence segment corresponding to nucleotide position 849-987, and a third sequence segment corresponding to nucleotide position 998-1166 as set forth in SEQ ID NO:40707. These three sequence segments were combined to construct a chimeric DNA sequence (SEQ ID NO: 40772) for use in dsRNA-mediated gene silencing of the corresponding CRW V-ATPase coding sequence. The novel chimeric DNA sequence was tested in the CRW bioassay described above.

All publications, patents and published patent applications mentioned in this specification are herein incorporated by reference as if each individual publication or patent was specially and individually stated to be incorporated by reference.

10. The method of claim 1, wherein said plant expresses a dsRNA for suppression of an essential gene in said Western corn rootworm.

11. A method for reducing or eliminating Western corn rootworm infestation on a plant, comprising topically applying to the seed before planting a pesticidally effective amount of a pesticide composition comprising a dsRNA targeting for suppression an essential gene in said Western corn rootworm and at least a second pesticidal agent with a different mode of action for controlling said Western corn rootworm, wherein said second pesticidal agent comprises a *Bacillus thuringiensis* insecticidal protein.

SEQUENCE LISTING (40774 sequences)

SEQ ID NO: 1 - DNA, 570 bp, Diabrotica virgifera
gatcgcgagcggccgccctttttttttttttttgggctttttctgcagcttttgtgacttttccggcgctgggatctttgaaggcaacgctcttgatgactcctactgcaacggtttgcctcatgtcacggacagcaaaacgtccaaggggtgggaattcttggaatgattctacacacatggtgcttggtgggtaccaagttgacaatggcggcatcaccagatttgatattgctttgaggaaattccaaacagctaaatactatgtaaccatcattgatgcccctggacacagagatttcattaagaacatgatcactggtacatcacaagctgactgtgctgtactcattgttgcagctggtactggtgaatttgaagcagggatttcaaacaatggacaaacacgtgaacatgctcttcttgctttcacccttggtgtaaaacaacttattgttggtgtccacaaaatggactcgactgaaccagaatacagtgaatcacgtttcaagcaaatcaagaaggaagtatcctcatacatcaagaaaattggttacaacccacttgccg

SEQ ID NO: 2 - DNA, 843 bp, Diabrotica virgifera
tggttcctctggaagcgccccccctttttttttttttttctttggacatcacaatttatccaaaaacaaataaatatccaaaacaggtacatcacgatttgtattatgtgttaatcattttgacaaaaaataaaaaaattcctccatagttagtttcaatcaacatcttcgggcctcacaggatgtgtcaatggtataacagatttttggttcacatctctagaacaagcttttctcatatcataggcatcttcatctggatcacccgaataatattcaagaactgttcgatacacaatatatcccaaatgattgtacatatttatagctactttgttactaactctaacaaaaagatccacaaaataggccctcttcttttctgaaacatcttccaaaaaattcatcaaacaggctgctaatcctaaacgtcggaagtcaggagatactgttaaggctgtaacatgtccatgccagttctctcctataccttcggcttttcccattatgtagcccattatttctccgcttggtgattctgctacttgaaaatactcgggccaatgagccaaatactgcatgtaaaacgataatccataggtctcagttaaggggtctaaattaacattattaaatttgtacatgtcgttacacgtaaatggtcttaatgtagtcatcgcaatgaattatggagctttttagttctatattttcttcctcttttttcgtacgtgacttctgttttatttatctatcatgctttgtttttaaaccaggaggagtaaactaaaaagtcagattcacacccaagaaaatcattttcgctttcggcttacaactgtc

SEQ ID NO: 3 - DNA, 611 bp, Diabrotica virgifera
gtacccaggtattgccgacagaacagtgttggaaatcaccgcccttgctccatccaccatcaagatcaagatcatcgctcccccagaaaggaaatactccgtctggatcggtggatccatcttggcctccctctccaccttccaacagatgtggatctccaaacaagaatacgacgaatccggcccaggaattgtccaccgcaagtgcttctaagctatttaatcaattcatacctaataagctatttttcatgttgattgtactgtgtttacatctttgcagttcttaaataatatgcgaccgtggttgtaactgccagacagacttttaagatcttataacaccttataattatttattatttgttatatttacttactataactattttgtaactgggcaggtaaatataacaaataataaataattataaggtgttatatttacttactataactattttgtaactgggcaggtaaataaatcctatctagtactaaacctgcctattatttcgattaagaacgagaatatgatgttatgttaatttttttaataaaattttggcatagtttatatacaatatacaataaaattcaaattttatttt

SEQ ID NO: 4 - DNA, 1457 bp, Diabrotica virgifera
aaaaaacaaacaagatgtctcaatcagtggttcaacctcttgaaactgagactagttcaattcttactagtcatttacctctaatattgattcgagttatctcagctctattagcataccattactggtttaaaaaccaacgatatgttcagttgggcaataaattcccagggcccgccactttaccattaattggaaatgctcacttagcctttggaaaatctgctcacggattgtttagagatgcagttcaatattatgaagaattcaaaattgatgtcgttaggttttggcttggatctagattgatcattggcgtcggaaatgccgatgatatagaagtaattttaggtaatagtgtacatttggaaaaatcttctgagtatagtttattcgaaccctggcttggtgacggcctacttatcagcaaaggcgaaaaatggaggtcccacaggaaaatgattgcaccaactttccacacctcaatcttaaaatccttcatgccagtttttaacagaaacgctattgctttggtcgaaacatttagaaaggaaaaaggaaaagtattcgattgtcatgattaccttagcactacaactgtagatactttgctcgaaactgctatgggtgttacgaaagaacacgacagcaatactggatttgattatgccatggctgttatgcgcatgtgtaacatccttcatcttagacatctgaaagcctggttgagacctgacatcatttttaacttcaccaaactgagtaacatccaagtaaatcttttaaaagtcattcacgatctcactaacgggactatcaagagaaagaaggcaaactattttgaaagagaaaagtctggagaaaagagtttgtatgaacaagcagtcaagacgtccaaatttgacgaaaaacaaggaaaccttattgaaactcgcgatctaatgtcaaatttattaagggatgatttggatgaaaacgaggaaaatgatgtcggtgaaaagaaaagattggctttccttgattatcttattgaagccagtcaaaccaaaggaaatgcacttagtgataaagaaataaacgaagaagtgaataccattatgtttgagggtcacgacacgactgctgctgcttccagtttcgtcataagcttattgggtatccatcaagacgttcaagaaagagcttttaatgaattgaaagaaatcttttccgacaatttgcaccgacctgtcacatttaatgacacgcttcacatgaagtacctggaaagggtaattttagaatctttgagaatgtatccaccagttcctatgattgcaagaaaagtgaacgaagatgtaaaactggcttctggtgactacaccattcctgcaggaaccactgtaattgtatcccaatacattctccatcgtaacgagaaatactataagaaccctacggtgttcgaccctgataac

SEQ ID NO: 5 - DNA, 1132 bp, Diabrotica virgifera
aagtggaaagatcgtcattttgcagtaatattaatatcttaactatatgagatataaatataattcttaaaacatgccagtctgatgtgccacctgttggcacgggcgttttcttactattcctacaagaaagactaggtaaagaaaaggtaagactaattagaagtccgaaagaatcccactggagtatcgacggtccctcattgccgttttcgaataatatagacaaaagactaactgcatggctattgatgaaagcgctgcttttccacgtactacctaaaactccaactattcgcaccaaactctcaatgcaatctctttgtctgctggataagtggcccaatagaggtttctgtgcgtctcttaaaagtacttctatagagtgtattgtgtatgctaacgttttccaacacatcggtaccaaacgtttatcatatggatggggattaacgttcagtcctctggtgtaagccacctgtgcaaaaacttgtatcatttcctcatgactactctccaatttcggaaattctacagggaaaagctgtttaaattcttcaggtgtatctggtgtaaaatcatacgagaagaaaacttgatggggttgcaatgtacagtttacttcacattttacattctcctcgtgttcgatattaccgttagaagtatataagcagtccttacaatgtttatttttacattcctccgacgaatcgcaggtgaacaaaccgtggcaagttgtctgtttatttgttaaaacatgattgatggttacatagtatttagctgtttcgaatttccacaaagcaatatcaatggtaataccacgttctctctcggccttaagtttgtcgagtacccaggcatatttgaatgaacctttacccatttcttgggcttctttttcgaacttttcgatggtacgtttgtcgataccaccacatttgtaaattaaatgtccagtagtagtagatttaccagaatctacgtgtccaatgacaacgatgttaatatgaatcttttctttaaccattttgattgtttggaaataaagtaaatgcaactgttcgaaattaaacttagaataaaaggaacactaagagggatgtaacaccaggcgcggactagttct

SEQ ID NO: 6 - DNA, 540 bp, Diabrotica virgifera
attggcccaagtttaatttacaaatcccaaaaaaggcaagggaagaaaaaagccctttattttttaaaaaaactttgaaaccccaatattaatataaaaaaaaaacaaaacttttcaaaattttttaaggaggggggcccaaaaaaactttttttttttttgggttttttcggcagtttttgggatttttccgggggggggatttttgaagggaaccctcttgaggaccccaacggcaacggtttgcctcttgtcccggacagaaaaacgcccaaggggggggaatttttggaatgattttaccccctggggtttggggggaaccaagttgacaaggggggcatccccaaatttgagggttttgggatttttttcgggggttttaccaaaacgacggccaaccttttttttgatttcagcaaatttgcaggaaatgggagctgggggacagtcaaaaacaggggtatttccgtttgaaatttgaccaggggggttgaaaacaatgatttgggcagggaagtctgaagcccctcggggggg

SEQ ID NO: 7 - DNA, 870 bp, Diabrotica virgifera
  misc_feature (841)..(841): n is a, c, g, or t
  misc_feature (855)..(855): n is a, c, g, or t
accaaattgttctatatggtccataaatgttcagaaagaagtcacacctttttgagcgtcgggtttgggggggagagggtggagaagtcggtaaattcgcagttttttaagtttttcgtcaatatttctaaaactatgaggtttagcaagaacaaccttctataaaaaaatgttctacattaaatttgaaataaaaaaggctctatacataatccttctaaaacgaacggttccaaagttacggaggtatagtggagtcaatgaaggttttcacctccgatttcgttgaacctccatcgattttcatgaaaattggtaaatatgtagaggctgtggcacgattaattttatgaaacagccccatgaatggaagccattttaatggtagcgcgactaattggataaacatgaagatatatagatctgacaaaattcgtgctacaaaaatttattaagtacctcggttggctctgtctcagagattttagggagtggattctttaatagatgttatgatatattcttattagcttaaaaaattagaaagatagaaaaatcgaaataaggatgtgaaataaaaaataaagaaaaatacaaaaaataaaatattggggcgccattgggttacctaagggaaaccaaactttatacaaaaaaaatagaaataaaacaaagaaagataaattaaaataaaacaaagaaacatagtcgaataaaatgatatacataatatacaaaatgttataatgtaacttacttcctttactttacactcaaaattatatactcagtcaatgttttatcgttcttacgattcaagagagaaggaaagaaataatanattatagggtgaanatcaaacattattta

SEQ ID NO: 8 - DNA, 808 bp, Diabrotica virgifera
cctcgaagtggagttccattcctgtcctcgacttggagtagaattattgaaaccttcaatggtatgccggtacggatggtttgtcgatgaagatatacttccgttcgtagcatgaggatcttgtcttaagacaactgtgtcgggtacatctggactcgaagttctacttgactgcgaactaatctcgaaatcgtttggatccttcgtaatctcaaaatgctgtaactgattcgccggaggtagtttcgctctgaaggtaattttattgatccaatccatcatgtcgacttctgaattggacgcaaacaaaaattctgatccatctgtaatagacaatcggaaagtatgttttcgtttttggtaatcgtctgctattccgcaggtggcattgtgaatattcaatggtgcagcattagctttgctcgcaacaaagtcatcctttgttttaaagaagcatagtaattggccacagagaacagtgtaggaatgtttccatgcccgatttgtagcacgcttttgtccaggaagcaagagttgttttctttcgaggaatgcttcagcttccacaggaggtagcactaattcattctttgatcgaatagatcctcgccttctggtattgaaagacggcgttctcttcacaggcttgaccaaattgcctactttcatactctcagctcgtttaacagaaacatcagatcctcttctaattctatctctgtcgaacgtgtgggctattgaattagttttacgtatagatatattgttattttcggcaggtgattgggtagattgttgaagggcttcg

SEQ ID NO: 9 - DNA, 437 bp, Diabrotica virgifera
gggtgttcttttttttttctttttttttcgtcttttttatttattatattataatattgttttattctttttcactattccatttttacatcaaaaataggaataatacccacataatataaatctggaactgatatttacaaaattgtaacataaattgtagttgactaaacaattattaacactacatagacttggacttaaattatggatttaaaatgtggactcccttattggctttccatcttgccatttggttactttaatatgggtttcatttcttctcattgcttctgttctaagttcaggtttaagtgcctgcctcagaagtttggcagcaatgttggaatagttaatgtagtttaatccagcagctctccaggcactcatttttgtaaaaattaattttacagatttcgaatcctagaaacgagccg

SEQ ID NO: 10 - DNA, 683 bp, Diabrotica virgifera
aaaatacggatagcaagacctcccaagaatagtccttctatgtgttggtaaaccacagttttatagttcacgacatcagcataaacactaaatgctccttctgcgggtccattttgtaatatttcatcctgtatttatttgacgtcactactaatggagtatgctttagagccaaagtgcaagtcattactgtaattgatcttgtagttactctcgcatgattttgcacactttggcgtgttaccttctgaagcatcgcaggctggacgtgatccgtttgtgtggtgttcacaaggaggaatttcgtatggccggcaaccctgttttgtaccatattgaccaccagagacaagaccttttctgacccaataatgccaagctgcaccaggatatccaccattacatcccattccacatgtccaacagcaagaaaccaaatcatctgatgagaaatggaagttagattcaccgttagaatgaatgcacactctgtctgacatagcttccactgctccaaaagcccattgttttcttcaaaaaaatattggaaccaaaaactcttcacaaccccaaacaaaaaaataaaaacttcctccaacgtaaattaatcttcttataacttatttcaaccaaaaggtaaattcttacaatggccaccggaggacttcttgatcggacaagaa

SEQ ID NO: 11 - DNA, 888 bp, Diabrotica virgifera
taatactgtacaatccagatgttcgaggtttaatttccatccaagaggtagaaattctcagagaaaagatttatggtgtattagaggactatacccgtaccacgcatcctaacgagccaggcagattcgccaaacttttacttcgtttgccagcgctaaggtcgatcggacttaaatgtcttgaacatctattcttctttaggttgattggcgatgcctccgttgacacatttttgacagaaatgttagagaatcctttagattcttaaatattaggaatatatgtaatgttgacgaggctgttatgttgaaaaatgatgctaaattaccacttagttcaggaactgaaattgttattaaattaaattaaatacataccaattcggttaaaataatataatacattaccctttaaaactattccagaaatctttacccaaaaaataattatttaaatcaagaagttatttgcttgtctttcaacgtaactgtttccttgtcataataaatctcctcatcattgttgttcgtgtttccccaagttaatcttacggatctgtgattttataataatttcattttttggatgtattgtattagtaattacattatttttgtattttacagcattaatagtaatagaaaataagacggattttacatattgctctcaatcttgctcatatgaaaatttaattgaatatttaaatcctatattctggtaaaactgcgatacaatagtatatgttcaaaattaatggtgagcctggtgataaaataaatacttggggcccggaaatacacagaacaaaaatgcatataaatgacaagatcaactttcataaaattgaggtggttacttaccaaaacccgcacttactacatcta

SEQ ID NO: 12 - DNA, 410 bp, Diabrotica virgifera
ctgctaatgacgatcgtatgcaaaaggaaatcactgccttggctccatcaaccatcaaaatcaagatcatcgctcccccagaaagaaagtactccgtttggatcggtggctccatcttggcctccctctccaccttccaacagatgtggatctccaaacaagaatacgacgaatccggccctggaattgttcaccgcaaatgcttctaaactactttatatttatcgtatacatattaagtacaatactgagagttggagcatgaatgtatgtttttatttatggttatatatatgatgacttgttgatattgtaacaataaattcattttgtattactctggtaatattttatttatgagaacaaccagattgaagtcgtaaagagccaataacaacctgaagatatca

SEQ ID NO: 13 - DNA, 970 bp, Diabrotica virgifera
  misc_feature (868)..(868): n is a, c, g, or t
  misc_feature (887)..(887): n is a, c, g, or t
  misc_feature (902)..(902): n is a, c, g, or t
  misc_feature (950)..(950): n is a, c, g, or t
gtctcctacaaaattcgtgaagaatcagataggagaatttgtacattacaattctctgatgtttgggaaaaggggcttaagtcagaggtgcacatcgataatgttttgatgatttctggaccagaaaaatcggctctttttattggtacatacagtttacgtctacaacagttttttgctggtccagaaatcatcaaaacattggcaatgtgcagttctgacttacgccctttttgccaaacataaaaaaagcaatctggtcataactgaccaatgagcaattttaatttaacctaaattactaatgtttcttaaaatgaagagcttacccgatagcgtctcttatctaatctaacaagatcgtgcactattctaacatacacagccacatcacgcactatgctctgcttttcactatcacctatcactcaaactagttcaaaaggctttgtcctcttcaatcttctagtttgcccagtagtatcgaggaggatttcctcaatattcttgtacttatttaagttgtttgtcgggattcctgctatcttcttgatgattatatccaggttccattcctaggtattaatatttgtttataaagtaataacttattatgcatggacaatgttgtttcttccaattagccaatacactttttatatctttattttggttatatctggttttttgtagaccactttcagctgattctaaaaaaaattaaaatgaacggtaatttttctattctttacaattaaaaatcaaaatatttacaggtaatacatgcataaatgattcgtttcataaagaaaattgaaaacggattttataatacttacataattgtttaagagatccagccatagcncaaactagcatactaaacnagtacagtgagtatnagcaaaaaagccactaattcccattttcacccccttatcgatgcattnttttccatcaaaattttact

SEQ ID NO: 14 - DNA, 1389 bp, Diabrotica virgifera
aagcggctcaagaatttcacgtttttttggactttgccgacttctttgaacaagattttactcggacacgattatactagtttcattttctctgaaggggcctctaatttacttataatcataaaatgctaacttatctaaatcttgatacttttactaaatatctatataataatctctaaagcaactgactttacattttagttttgggtttaggttagtgattgacctctctcgtttcattactgaatactaaaataaactaaaagttaagttatgtgtgatattagtgcaaaatttttcaacattcgtaaaacagtcactttatcggatttattatcaactttaagtttattattataaacgggatttcatggtactaaaatggcagtagttcaatcaaattacattcaaaatataccttcttttggatgtgtagaccaacctggcaacggctccaaaacaacaagagaatcattagtagaagtgtcttcatcacgtccacgccaagaagactactcagtatatgagaacagactggcatctttcactaactggcccaacacccaagtgtcaagagaatcattagctcgagctggttttatatatacaggtcaagatgacatcgttatctgccctatttgtaagatagagggataccgttgggtatcaggagacaatccaatggatgatcatcgtgtttggaatcccaactgcccctttcttaatagaagagataacatcgagcacgatcactctgtaggttctagagacacttgtggactttttggcatagaattgttaccaaattcagttcctgaagataatacaagtaatttacaaaaattagggatccaacctggaacaggtccaccaaatcaagacaaaattacgttagaaaggccggttagcaacatttccaggggtgggcccaagagcatttaaacagagggcttctgagttaactgaggcgggatttttatttaaacaagaactggggaccaaactgtgtgcttttattgtggtgggggattaaaagactgggattaaggagaagaatcctttgggaagcacacctggcccttttggtttacaaaatgggggtttctccatttgaaaaaaaggggaaagaaatccttcattcaataaaaaaagaaagggttgatcccccattttttattccctgggacctagggggcactccagccaaaaaaagaaccgactggtcacgaatttttcaaaggggaaaaaaaaaagtggaacaaagggaaaaaaaaaatacaaaaagggaaaaattcccccaccgtccccaaactttttgggaaaaaatttttttttataaaaacaaaacctgggggggttgggttttttttcccttgtgggggaaaa

SEQ ID NO: 15 - DNA, 1538 bp, Diabrotica virgifera
  misc_feature (854)..(854): n is a, c, g, or t
  misc_feature (876)..(876): n is a, c, g, or t
ttaaattttttgcatactttagtaattctctgtcttcatttgcttttgcacacctttttttgttaatttcggaaacaacatatcagatttttaacacaaacagataaacataaaatttgatcaaaaatgaagacaaaatatagttttgttctctttcataaagtaatttcatatacagagtgtttatttttgaaagaggtatgtcatgcgactaaatggactcaaatgactacgcaccttctacgtttctaacagttgaaacaaccatagaacagtgccatatatatgattaatttaatactaaaatatactgtaaagttcttataattactacggttaaaaatctgtacaactgttgtttcccagtcgctctgttcagtttaaataagtacctatctattggttttttcgcgaaaatgttattctgagtccaatgctgttttgtttttatacttcgttacattctaaatacttctcctggcagttatcaccgtatcttcctcttcttcccgcttcgtagaagacgtcgaatgaagatcccagtgatttttccataacgtagctaatagcgtaacttccaagatgacagtacaatgagctctgtccgacgttctttgaacactcactgttggcttggcatacatatctctccatacatttggtgtctccagttgacaacgacctcatgtaacctttcatcatggaaagacttgctactgcggcatcactgactgagtctttcttgcctagacttctggcttggagggaacggtgggagaatgaggtcttcaaggcgtccaaaaggttgaccacgatgtttatgaactcaccagcttgtctagcaatcttgttancttgttcaggatctctgtctcncacaacagcttctactacggccgccagaacaccctgcattggagaatttccattatctactttgtcgataccgtctcctccggtgtttcctcctcccaatattgcagtgagcattttgagacctacagacagcaagttggcccatggggatgttgggacgggagcagtgtccagatcgtcagatttgttgggaccttggttaccaccggggttgaagatcatctgcatcaacataccaatatagttctccggtgctaagagatttgaccaagagaatcctcctccactggcaagaccgttatcgctgctctctgcaatggaattactctcgacatcatccagtcgatccaaagccacctttttaattgcatttggtttttctgcgaattttctttccgctctctggaattgtggcacgtctctggggcctttcactggatagaagttacgtggttctgacggtgattcagctgcgtctgaagatactggcctggagttaatttggacatttggataagagaatgttcctactagagaactggagaccaaaagggcggtaaaagcccaacctactgcttctctgtacattttttcgaaatttaaattgaagatgtcactaaaccgttcttaactctgtcactagtactcacggtaaaagaaat

SEQ ID NO: 16 - DNA, 1626 bp, Diabrotica virgifera
  misc_feature (731)..(731): n is a, c, g, or t
  misc_feature (1576)..(1576): n is a, c, g, or t
  misc_feature (1585)..(1585): n is a, c, g, or t
cggacgcgtgggcaatttataagtaatattattgaaattgagcctgttggcattaaaatagcagatggaagagtgatgacggctcgtacaaaaggtaaattaaaagtttattacaatgaaactcctattaacattgatgttctcattttaaatgaactagaatataatttattatcagtcagtaaactaaacagtttaggtttcacagtagtatttaaagaaaataaggctgaaataagaaaaaagaactttaaacttatttgctataaacataagagtaacttatttgctgcaaattttcaattaaataattttcaatctagtttagtagcaaagcatagcgataaagacttatggcatttacgtttaggacacgtaaatagaaggggactacaattgttgggacttccctattcagataaactatgtgactcgtgtcaacaaggaaaagccacaaggcaaccttttaaagaagttatatacaaaaaatcctctagagttggggaacttttacatgttgatacttggggaccatccaaagatcccacattttctggtgaaaagtattacttatcaattattgatgatttctcacattttagtgttgtatatttaatgacaagaaaaagcgaaagcgaatcacatcttattaatcatattgaaaaattagctgcagaaggcaggagagtatctagaataagaatggataaaggtggagagatgtcttctanatattttaaaaactattgtatacaacatggtatagtacaagaatttactgcagggtacacacctcagcagaatagtatagccgaacgacttaatcgtactattttagacaaagtaagagcaatgtttgtagaaacaaatcttccaaagagtttgtggggagaagcagttagaacagctgtttatcagcttaatcgaactccatcacgagcaattgaattacaagtaccagcagaaatatacttaggcagacttgacttgtctaaacttagaatttttggttcaaaagtatggtactacaacctaccaaagcaaagtaaattagaaccaagagcaagtaaaggtgtaatggttggatacagtggtgctggttatagaatttggaatccactgaccaagcaaatcaaaatttcaagagatgttgttttcgatgaaacacagtataaatattctccagaaatatcgtcgaataatcaaaatgttgaggaaattttaccaagccaaaatgaattggaaacatttgaaacaaattatgaagaaagtacagtccaaacattaagaaacactactgaaattaattcacaagatgaagaaccagtaaatttacaaaataccaaaattacttcctccaatagagaaataaaacaaccttcgaagttcaaagactatgaactttattatgcatattgcttagttacatcaacaccagtaacttatgaagaagcagtagaggaggatgaatggaagcaggcaatagaaacagaactagaatgtcttgaaaaaatgaacacgtggagtgaagccacaaaaatacctcatgatcaacaaatcataaatacaaaatggngtatttaanaacaaaaagtgatggcacgaaaaaagctcgcttagtcgcca

SEQ ID NO: 17 - DNA, 971 bp, Diabrotica virgifera
  misc_feature (837)..(837): n is a, c, g, or t
  misc_feature (919)..(919): n is a, c, g, or t
acccacgcgtccgcccacgcgtccgatttagtgcttacttggtacagcagtttcagtgctgtgctttagaataatttattttttaacatttatatagaaatcaaatactaaccaatcaacatgtgtgaagaagaagttgccgctttagtcgtagacaatggatccggtatgtgcaaagctggttttgctggggatgatgcacctcgtgctgtattcccttcaattgttggacgcccaagacatcagggtgtgatggtaggaatgggacaaaaagattcctatgtaggtgatgaagttcaaagtaaaagaggtatccttaccttaaaataccccatcgagcacggaatagtcacaaactgggatgatatggagaaaatttggcatcatacattctacaatgaactcagagtagccccagaagaacaccctgttctgttgacagaagctcctctcaaccccaaggccagggaaaagatgacacaaataatgtttgaaactttcaacaccccagccatgtatgttgccatccaggctgtactctccttgtatgcatcgggtcgtacaactggtattgtgttggattctggtgatggtgtatcccacactgtcccaatctatgaaggttatgctcttcctcatgcaatccttcgtttggacttagctggtagagacttgactgattacctcatgaaaattttgactgaacgtggctactctttcaccaccacagcagaaagagaaattgttagagatattaaagaaaaactctgctatgtagctttggacttcgaacaagaaatggcaacagctgctagttccagttccctttgaaaagangtatgaacttcctgatgggacagtcatcaccattggtaatgaaaagattccgttgcccagaagctctcttccaccatcctcntctggggtatggaagctgctggtattcatgaaacaacctacaattccatcat

SEQ ID NO: 18 - DNA, 910 bp, Diabrotica virgifera
atttcaaaccccaattaagtggtatgggtacatttctccatattccgctgtcaatcatacccgggtgcaaacaattgaccgttactccagtgccttccagtcttcttgcaagttctaaagtgaaacatatattggcgtatttggatacgtagtaccaatattcaggacaccaagtactgctaggattgagattgtctagatttagtgaagcgagtctgtataattctgacgctactacgactattctggaaggtgctgaacgtttaagtagatcaatgaggagatgtgttaacaaaaatggtccaaaatggttggtcgccattgtgagttcaataccatcttctgattttttgagtttattttccgctgtacctgcgttatggatcaacacatccagtttggtttctgtacggttgatatcttcggcgaattctcttattgatttctgagatgagagatcaagtttctttacgatgatattttggtttttggtatcttgtgctaattcgtctcttacttttttggcagactcaacatttctgcaagcaataatgactttagctcctcttttcgccagttctcgtgctgtttcttttccgattcctcccgtcgctccagtaacaattacagtttttctctccattctaactttttcgtggaagaatccgcaggtcacataagcgtagaactttagcagcgaaacagcggtcagaaaaccaagaagtaacaccgctaaaatggctagtacagtggaagtgtccagttcaacgccgagaaaattcatatttacacaaaaaatttatatactaacaatcacagaaagattaatgaacacctaaaaaacggaaaacccgatccaccgtctacgtgttatgtatgatcttgaccgctgttgcggacgcgtgaaggg

SEQ ID NO: 19 - DNA, 879 bp, Diabrotica virgifera
gtacaatgagctctgtccgacgttctttgaacactcactgtggctttggcatacatatctctccatacatttggtgtctccagttgacaacgacctcatgtaacctttcatcatggaaagacttgctactgcggcatcactgactgagtctttcttgcctagacttctggcttggagggaacggtgggagaatgaggtcttcaaggcgtccaaaaggttgaccacgatgtttatgaactgcattggagaatttccattatctactttgtcgataccgtctcctccggtgtttccacctcccaatattgcagtgaggattttaagacctacagagagcaagttggcccatggggatgttgggacgggagcagtgtccagatcgtcagatttgttggggccttggttgccaccggggttgaagatcatctgcatcaacataccaatatagttctccggtgctaagagatttgaccaagagaatcctcctccactggcaagaccgttatcgctgctctctgcaatggaattactctcgacatcatccagtcgatccaaagccacctttttaattgcatttggtttttctgcgaattttctttccgctctctggaattgtggcacgtctctggggcctttcactggatagaagttacgtggttctgacggtgatgcagctgcgtctgaagatactggcctggagttaatttggacatttggataagagaatgttcctactagagaactggagaccaaaagggcggtaaaagcccaacctactgcttctctgtacattttttcgaaatttaaattgaagatgtcactaaaccgttcttaactctctcactagtactcacggtaaaagaaatccggacgcgtggg

SEQ ID NO: 20 - DNA, 1509 bp, Diabrotica virgifera
cacttcgcgtccggtctgtttaccctatcactatcccaacaaaccaattagcataatttggacgtactaatatgacaacaactaagttgcaacgcaatccttgtaacggcatcatttaactacttgtaacgccgacctgaagatgatctgtatattgtagagatcgaaaccggtcgtcaaagtataattaaatgattgtgagggagcaacacattccaatgcaattattcttgattcttcaggaaatatattaggacaagctccaggaccaggaacaaaccaccatctagcagggatgaaagaagctcaaaaaaggatagctcaacttgtagatgctgccaaaagtaaagctaacatatcgctggatactaaattagatgccttgggtttgagtcttagcggctgtgaacaagaagaaactaataatatactaaaaaaaggacttctagaagactatccaaatttagcagaaaaagtattggtagctagtgatactgaaggttcagtagctgccacatcaaagacaggtggtgtagtttgtattgcaggtacaggatcaaatacactcttgataaatcctaatggatccagagttcaatggtggaggttggggaaaccttttaggagacgaaggaagtgcctggaatatatcccacatggccataaaaacatgttttgatgaattagacaattttgaaaaatctccacatccgataggtgcagtttgggatgtcattcgatcacatttcaaaataaaaatacaagcagatatacttgattatttttacgccaattttgataaggcgtttatagcgtctttagctaaaaaaatctcagaattggctacacgcaagaacgatcctctggctcagcacatatttagcaaagcaggaagctctatagcccaaaatattacagctgtagttttaaaagcagatccaaagttgactgacagggaaggtggaatacacataacttgcgttggttccgtgtggcatagttgggagttactaaaaccaggtttcttaaaatatttggctacaactaatgtaaaagagctaaccctaatgcgactagacgttgagagtggcgtaggagcagcttatttagcatcagataaactaggcttatctttggatagagattattctaaaaattacaaaattctcttccactatttgaaggagcaatctgcctgtaatacttctggacataatcatatttgtgacaagtaaataaaatttatttttaggtatgtgtcgaaaacatttaagaaaatataaaatcaagatatacttgtagatttgtttgatatatgttttagacatattattgtattataaatataatattttatatgaatgattatacccaactttataattaaatttttaattttaaatatttaaattcctttttacgttgattaaagttcaataacttatatttgcatggcaaaaatatagtaatatggaaacataagcattaacaatataatttataaatatc

SEQ ID NO: 21 - DNA, 953 bp, Diabrotica virgifera
cgtactagtgtgtgaacgttgttgtatttccattgcatcggtcggcatagttttgttgtttctcacggtactctatcgagggaaaatacatcgtgtgaaccgaaaactgttgggcaggaagtggcctattaacgaaacagatctgtttctgtgtgaaaatttcggaaatttttttaaactggaagaattcatgacacatattgtaaaatggttgtggaccaaattatttcatggtactaaaatggcagtagttcaatcaaattacattcaaaatataccttcttttggatgtgtagaccaacctgacaacggctccaaaacaacaagagaatcattagtagaagtgtcttcatcacgtccacgccaagaagactactcagtatatgagaacagactggcatctttcactaactggcccaacacccaagtgtcaagagaatcattagctcgagctggttttatatatacaggtcaagatgacatcgttatctgccctatttgtaagatagagggataccgttgggtatcaggagacaatccaatggatgatcatcgtgtttggaatcccaactgcccctttcttaatagaagagataacatcgagcacgatcactctgtaggttctagagacacttgtggactttttggcatagaattgttaccaaattcagttcctgaagataatacaagtaatttacaaaaattagggatccaacctggaacaggtccacaaaatcaagacaaaattacgttagaaagccggttagcaacattccagggttggccaaagagcattaaacagaggccttctgagttagctgaggcgggattttattacacaggagctggggaccaaactgtgtgcttttattgtggtgggggattaaaagactgggatgaaggagatgatccttgggagcacatgccctttggtttagcaaatgtgtgtttct

SEQ ID NO: 22 - DNA, 658 bp, Diabrotica virgifera
cagcaacattaatatttattacaatttgtacataagaaaatcatatttctaataagtttaattttaatcataatagcagttatcttggtcatcgtttactaatgcatctacagagagattgttgtcttccagaacttggacaatattatctatatcatctggtgaagcctcttgatatcttgtcgtgaggaaaagactctctagaaaaacaccatttcgttcaaaacaggagaatcctacagaccatcttttatagtctgtaccaagaatccaaaaaggtacagttacatctggattaaggaaatgtactaagaatttggcttctcctgtggttgaatttgatactccttctccttctagaacatggtcttcgtttgtttttgtattagtatatttggtacgacttcttataactccatcagcgcctactgcaatattggtaataacacattctccatgatcttccagtaaagttgggtatcttgcttgttcgatccaatcacccaaatatgcttgtccatcgaaatttgcaactccttttacatcgggacatctttcgacaggaatttgtccctgtatagatattacaagcaaacataaagtaactgctaaaacaatcattttcgtgttttgtaaacggacgcgtgggcggataaag

SEQ ID NO: 23 - DNA, 2461 bp, Diabrotica virgifera
agcggccgcccttttcttttttttttgttataactttcaagttttatatctgttttcatttactaaatttaaatagactaggctaatcaatttatcttactcatctacaattatgcaacaggtgatatgcttgtacgttagattatgcactgcctacttaaacttaactcaacacttcttctctactttaattcttctctacttgaatactaatgtagaataattaatcatgtatttttattattgttacaacagttttttcacaatagtggttacacatatagtttagattttgttattaatgctataaattaacaactatcttttttgtaaaatttgaaaatgctgtatactttatgttactaagagatttaattaaaataggcaactactgtacaacatttgagaagaagtgttttgacatttcagataacctacatctgcctacactgtcaatattccctcttgaaaacacaaaaactagacttcaatttaggaagtaaaaactaagttaaatagtaattggggaaatgtagtgctacctcccttaaaaaaaccttttaccaataattgttatgtctttgtgcttttaaaccctatgtgttatgtgttaatttatttatttagttaaaaactattctcaagtaagtgcctacacccttccattaatatttcgtttctttctttttctttgtacatatcccattatacaatagctcaaacaaaataatctttaattttatcaatttcttacctttttcaatttttcaatttaaagtttcttaaccgatgttttgatattaatattttttcatttaactaactagctttcctttaatttctatacacttcatagtttcacagtgtatggcacttactacttcataatattatgatattattatacttatgacatccctcagttaacttactgagaacaacatatcttaaattagattaatttatgacaacattttcctatttgtcatttcctatgctttgacctctgcccgcatcgtataacatctacgagctaagaccatcacatttgtacaagagcctagaataacatttcatactttgctacaattaatacgcaactcctggagcattgtctttctccattctaacaaaacatcacccgtttcacatacgcatcttccttcaggatccattccaaattcgaaatcttactgtgttttaacctacgtaacatgtctgtttaccctatcactatcccaacaaaccaattagcataatttggacgtactaatatgacaacaactaagttgcaacgcaatccttgtaacggcatgtaagtagattagaacaatattactatctcttttattattactactttgaatttggaagcatatttaagtcagtttatgtttattttgttttttaatggttaaaaattttaatttcaacaaattcaaactgtatgcacccatttgcacatacatgactatgagcatttttactcataggtttgactttgtatataccaatattctgaaatgtcaacagttgcaaacctttatgtcaaaaaaattttataaaaatttttttaaatttggctttctattaacatctcttcaatcagacactggtctaacacaagttttctcttattgtagcatttaactacttgtaacgccgacctgaagatgatctgtatattgtagagatcgaaaccggtcgtcaaagtataattaaatgattgtgagtaagtctgtgtttcattactatatttaatatggactcacatatgcaacccattcaatatttgaataatgcaagactagcaactttgctacaccgttacaaggagctgaacatcaagaaaatgttacaaaaatctaagatcttttataacaacgaatgtttacgtctcaacctgctgcctagttatgctagaggtagactaagagaacttaacttcaatgcaacgaaggctaaacaagtaaaaattctgggtagatccatcattagggatgagattcggaaactataccaacatatctacaccattgacttgcaactgaagacaatctacaacagcttacatagaagaatgacagcgctcgagtttgatgaatgtatgcgtgatttacatgggactattaattttcataggagtagacaatataggaaactgttgtcataaattaatctaatttaagatatgttgttctcagtaagttaactgagggatgtcataagtataataatatcataatattatgaagtagtaagtgccatacactgtgaaactatgaagtgtatagaaattaaaggaaagctagttagttaaatgaaaaaatattaatatcaaaacatcggttaagaaactttaaattgaaaaattgaaaaaaggtaagaaattgataaaattaaagattattttgtttgagctattgtataatgggatatgtacaaagaaaaagaaagaaac

SEQ ID NO: 24 - DNA, 1638 bp, Diabrotica virgifera
tatgtaagtacacatttcgaacaatagcaccccgctgagctgaatgttcctgagtctcttaaatagattgtaggactataatcaaaatcataatgattacgcaaaacaaaaaatcaatggttaggcacgcatatattacaagaatatatgtcaactaaaagtgaaaaataaaattcaggtaaacaataatgtgtacttgaattaaattttttgtatacttaagtaattctctgtcttcatttgcttttgcacacctttttttgttaatttcggaaacaacatatcagatttttaacacaaacagataaacataaaatttgatcaaaaatgaagacaaaatatagttttgttctctttcataaagtaatttcatatacagagtgtttatttttgaaagaggtatgtcatgcgactaaatggactcaaatgactacgcaccttctacgtttctaacagttgaaacaaccatagaacagtgccatatatatgattaatttaatactaaaatatactggaaagttcttataattactacggttaaaaatctgtacaactgttgtttcccagtcgctctgttcagtttaaataagtacctatctattggttttttcgcgaaaatgttattctgagtccaatgctgttttgtttttatacttcgttacattctaaatacttctcctggcagttatcaccgtatcttcctcttcttcccgcttcgtagaagacgtcgaatgaagatcccagtgatttttccataacgtagctaatagcgtaacttccaagatgacagtacaatgagctctgtccgacgttctttgaacactcactgttggcttggcatacatatctctccatacatttggtgtctccagttgacaacgacctcatgtaacctttcatcatggaaagacttgctactgcggcatcactgactgagtctttcttgcctagacttctggcttggagggaacggtgggagaatgaggtcttcaaggcgtccaaaaggttgaccacgatgtttatgaactgcattggagaatttccattatctactttgtcgataccgtctcctccggtgtttccacctcccaatattgcagtgaggattttaagacctacagagagcaagttggcccatggggatgttgggacgggagcagtgtccagatcgtcagatttgttggggccttggttgccaccggggttgaagatcatctgcatcaacatacctaagagatttgaccaagagaatcctcctccactggcaagaccgttatcgctgctctctgcaatggaattactctcgacatcatccagtcgatccaaagccacctttttaattgcatttggtttttctgcgaattttctttccgctctctggaattgtggcacgtctctggggcctttcactggatagaagttacgtggttctgacggtgatgcagctgcgtctgaagatactggcctggagttaatttggacatttggataagagaatgttcctactagagaactggagaccaaaagggcggtaaaagcccaacctactgcttctctgtacattttttcaaaatttaaattgaagatgtcactaaaccgttcttaactctctcactagtactcacggtaaaagaaatc

SEQ ID NO: 25 - DNA, 995 bp, Diabrotica virgifera
atttagtgcttacttggtacagcagtttcagtgctgtgctttagaataatttattttttaacatttatatagaaatcaaagtaagtgttcgaatttgtataaaaatcataatgtgaaacgatttggttttgaaaaagttcgttaaaaaaataggtgtggtcgtgacaacgtggatttcttcttggattttaatactaaccaatcaacatgtgtgaagaagaagttgccgctttagtcgtagacaatggatccggtatgtgcaaagctggttttgctggggatgatgcacctcgtgctgtattcccttcaattgttggacgcccaagacatcagggtgtgatggtaggaatgggacaaaaagattcctatgtaggtgatgaagctcaaagtaaaagaggtatccttaccttaaaataccccatcgagcacggaatagtcacaaactgggatgatatggagaaaatttggcatcatacattctacaatgaactcagagtagccccagaagaacaccctgttctgttgacagaagctcctctcaaccccaaggccaacagggaaaagatgacacaaataatgtttgaaactttcaacaccccagccatgtatgttgccatccaggctgtactctccttgtatgcatctggtcgtacaactggtattgtgttggattctggtgatggtgtatcccacactgtcccaatctatgaaggttatgctcttcctcatgcaatccttcgtttggacttagctggtagagacttgactgattacctcatgaaaattttgactgaacgtggctactctttcaccaccacagcagaaagagaaattgttagagatattaaagaaaaactctgctatgtagctttggacttcgaacaagaaatggcaacagctgctagttccagttcccttgaaaagagttatgaacttcctgatggacaagtcatcaccattggtaatgaaagattccgttgcccagaagctctctt

SEQ ID NO: 26 - DNA, 1422 bp, Diabrotica virgifera
tggtagttatcaacctagaagagggcaatcataagctcctccaagcagtttcaatccccaaataaagcggagtgacaccgagccaagagcaagtcctgtacttcctcagacttatgaccgtgcaagatggcgtcttggtcggcgtctccataagcaacagcttcattcggggttgatcgacttgttcaattctttaccatagaagaaatcttgcaacagtttttgtacctttggaatacgggtagatcctccaaccaacacaatatcgtgaacttgagatttgtccatcttggcatccctgatggccttttctacaggttccatggtagatctgaacaaatcagcgttcagttcttcaaatctatccctggtgattgaggtgtagaagtcaataccctcatatagagaatcgatttcaatgctgacttgggaagatgaggaaagggtacgcttagctctttcacagcttgttctcaaacgacggagggcacgtttgtttgtggtaaggtccttcttgtattacctctagaattctccaacaaagtgattgtccattctgttgtcgaagtcttcacctcatgtaacctttcatcatggaaagacttgctactgcggcatcactgactgagtctttcttgcctagacttctggcttggagggaacggtgggagaatgaggtcttcaaggcgtccaaaaggttgaccacgatgtttatgaactcaccagcttgtctagcaatcttgttaacttgttcaggatctctgtctcccacaacagcttctactacggccgccagaacaccctgcattggagaatttccattatctactttgtcgataccgtctcctccggtgtttccacctcccaatattgcagtgaggattttaagacctacagagagcaagttggcccatggggatgttgggacgggagcagtgtccagatcgtcagatttgttggggccttggttgccaccggggttgaagatcatctgcatcaacatacctaagagatttgaccaagagaatcctcctccactggcaagaccgttatcgctgctctctgcaatggaattactctcgacatcatccagtcgatccaaagccacctttttaattgcatttggtttttctgcgaattttctttccgctctctggaattgtggcacgtctctggggcctttcactggatagaaattacgtggttctgacggtgattcagctgcgtctgaagatactggcctggagttaatttggacatttggataagagaatgttcctactagagaactggagaccaaaagggcggtaaaagcccaacctactgcttctctgtacattttttcgaaatttaaattgaagatgtcactaaaccgttcttaactctctcactagtactcacggtaaaaaaaaacggacgcaa

SEQ ID NO: 27 - DNA, 787 bp, Diabrotica virgifera
cgagcggccgctcgcgatctaacaagtctgaagcaagtctttttgctagttagaatatcaaattgataaacatgaagttcgtattggtcgctctagttttggccgtagtggtgtgccaagtgatatgtgatggtgatgatactggttcctccagcaccaccatcgcggtcaccaccagcgaagctccacctaccaccaccagttcgaatgcggaacaatcatcaacaacctcagcacctgagagcagcaccaagggtggtgcatctacggccattcccgcaataggacttgtattgggaaccgctttactgtgtctccactaaaagcagaaaggacgcttttgtctagtcactgttcactttaatacactcacttaaattattattttcgaaaaaaatatcaatttgctcaaaaaataaacatcagacatacaaccatagaagccatagaatattgatcgaattacttgatgttttaaacgtttgtatctaataaaatatagcttaatttattgtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggaaaaaaaaaaaaaggggggggccccttaaaaggaaccaaatttaaaaagggggggtggggaagcaatattttttttaaaggggccccaaaatttatttccggggcgcgggttttaaaaccgcgggagggggaaaacccgggg

SEQ ID NO: 28 - DNA, 1565 bp, Diabrotica virgifera
acttcgtcgagtgagtaggtctttgctggtctcctcctgactacccaagccaagctaaaatctgcaaagttccttttagcctttttgtataaatagaaatcaaaatgtctgacgaagaagttcaaaccaaaaaaggccgcaaagcagcagctgaagccaccaaacgtaccaaaaaggatgcgaaagctgaagttgaagatgctccagtagccaagagaggcagaggaaggccaaagggaaccgcaaagaaggctgaaaagaaggaaaccaaagccaaatcaaatggagtgagcaagcgtggtaggaggaaaaaggaagagaaggaggaatcagctgaagaagaaaatggagacaaaagcagtgaaaatgaagaagaggaagaagatgatgaataaattgttcgaatacatttcctttgcttttaaactattttttatacttaatgcttaaaatttacgtatttactttcagtatccatacttttaggtttatttaacagtacacacttaaattatttaatttttgactgatttgaatttggtattagtaggaatccaattccaggaaaatgttgcaatagcctctcattatttatttttagttttttaactcatatttatatatcatcagaccatgtaagttactcacactgaagtgtatttccggaattggtgtatttaggtactcgtttagtactttagactgaaataaattttgtatatataaaaaaaaagctcaaggtactccttgctgatgtcatcaggaaattccacatcgagtcagtagataaagaacagactttaggcttcagggagatatcattcttaaaagggaaaaaagatttagggttaaggtgactgaaagggcttgaaataaaattaattgtattatatgggtcgaattatttgtataagcatgtctatatattcatctatacatactgttttacttagaaagtaattttattgtgttactaaaattagcgattctattcttactgttatggatctaataataaattatatttatttttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggggcccttaaaaaaaaaaaaaatttaaaacggggggggggggggctatttttttttttttggggccccaaaaaattttttccggggcgggtttttaaaaaaggggggggggaaaaaaccggggggccccccattataattcctgtggaaaaccccccccttttccgggggggaaaaaaaaaaaaaaagcccccccccccccccccccccccaaataaggcccccctttttagggggaaaggaccccccccttttaacactttttataaagggggggggggggggggttttttccccgggtggggccctttttttttgtgggacccgccaaccccccccc

SEQ ID NO: 29 - DNA, 1030 bp, Diabrotica virgifera
  misc_feature (913)..(913): n is a, c, g, or t
  misc_feature (918)..(919): n is a, c, g, or t
  misc_feature (925)..(925): n is a, c, g, or t
acccacgcgtccgcggacgcgtgggcggacgcgtgggttcgaaaggaaggaagtaacatctaaggtgaggtagcggataacatcttccaccggcccgaacatcatggctgaagcggagcaacaacaaacagcgccagaacaacctaaggcagtcccaaaacagaaggaagtacttgcaactaaggtaactggcacagtaaaatggtttaacgtcaaaagcggttatggatttatcaacagaaatgataccaaagaagacgtttttgtgcaccaatcagccataataaagaataacccgaagaaagccgtccgatcagtgggcgacggtgaagtcgtagaatttagcgtagtcgtaggtgaaaagggtaacgaggcggccaatgtaaccggccctaatggtgacccagtaagaggttcgccttatgctgccgaccgaagaagaggataccgccagtggtattacccgagaggaagacgtggacgtcgtggcggtagccgaggcggcggaccgccaagggaaagtgaaggcgaattaaaggatggggtacaatcaggcggtgaaggcggccaaggtggccaaggacccccacgtcgttatgcaccaagacgcggacgtggaggatattcatattacaggggaccctatcgcggaccgccaggagaattagaacaaaatggagatgctccccgtggtcgtcgacccccacgtggctttttccgtcgtaattatcgtggaggtcgcggcggcgcaagaccacgttcccaggacagccagggccaggctggagagctaaacggtcaagaaggtggaccacgtggacctcgtggaccacgctaccgcagacgtgggccagcccgtccaagagccggtaactctcagtcagagtctgcaggagggaaccaaccaaatacncaggnntccganaaagctgtatctgataagaccgaagaaagtcaaccagtgcagaacacaactacagagagcagtgcttaagcgtaatcgcgctcaagtccatcactctataatcat

SEQ ID NO: 30 - DNA, 1544 bp, Diabrotica virgifera
agcttattagctgtgtttttctcgtctagtgagcagtgatcaaccacaaaagacaacacgtgtgacgacgatgttgcggctcttcgtcgttgacaatggatccggtatcgtgcaaagctcggattcgccggagatgacgcaccccgtgccgtcttcccctcaatcgtcggtcgcccaaggcatcaaggtgtcatcggttggtatcgggacaaaaagactcatacgtaggagatgaagcccaaagcaaaagaggtatcctcacattgaaataccccattgaacacggtatcatcaccaactcgggatgatatggaaaaaatctggcatcacaccttctacaatgaactccgtgtagctccagaagaacacccagtcctcctcactgaagctccactcaaccccaaggcaaacagagaaaagatgacccaaatcatgtttgaaaccttcaacacacccgccatgtatgtagccatccaagccgtactctccttgtacgcttccggtcgtaccactggtattgtattggactccggagatggtgtcacccacaccgtcccaatctacgaaggttacgctcttccccacgccatcctccgtttggacttggccggtcgtgacttgaccgactacctcatgaagattcttactgaaagaggttactcattcaccaccaccgctgaaagggaaattgtccgtgacatcaaagaaaaactctgctatgtcgccctcgacttcgaacaggaaatggccaccgctgctgcttccacctccctcgaaaagagctacgaattgcctgatggacaagtcatcaccattggtaacgaaagattccgttgcccagaagccctcttccaaccttccttcttgggtatggaatcttgcggtatccacgaaaccgtatacaactccatcatgaagtgcgacgttgatatccgtaaggacttgtacgccaacactgttctctccggaggtaccaccatgtacccaggtattgccgacagaatgcaaaaggaaatcaccgcccttgctccatccaccatcaagatcaagatcatcgctcccccagaaaggaaatactccgtctggatcggtggatccatcttggcctccctctccaccttccaacagatgtggatctccaaacaagaatacgacgaatccggcccaggaattgtccaccgcaagtgcttctaagctatttaatcaattcatacctaataagctatttttcatgttgtttgtactgtgtttacatctttgcagttcttaaataatatgcgaccgtggttgtaactgccagacagacttttaagatcttataacaccttataattatttattatttgttatatttacttactataactattttgtaactgggcaggtaaataaatcctatctgttactaaacctgcctattatttcgattaagaacgagaatatgatgttatgttaatttttttaataaaattttggcatagtttatatacaatatacaataaaattcaaattttattttaaaaaaaaaaaaaaaaaaaaaaatg

SEQ ID NO: 31 - DNA, 675 bp, Diabrotica virgifera
gactagttctagttgagttgccttgacattgccttctacactttcaaaatgaacaaatacttcgttttcgttgccattgccttcttggctatccaggctgttgaatccaaaccaagggcttcccaacaacaacgcccagctgcccaaaatgtagcagaagacgacctcgccaagaaagctcaagatttgatcaaaaaagccgatgaagtcgttactggaaacctccccagcaccgaacagatcatcaacaatgtagaggaaaccggcaaaaaattggttagcaacattaaagatttcaacgactaccttaagacccaactcactgcaaacaaaggtgatgtagacaaaatattgagacaagtatctgacaatttgcacgctgccagtgaaaaaatccaaaaagatgttttgggaccacaaggacaaaagaaagcttctgaaatcagagaaaacttacacgcacagatcaaatccgctgccactcaaattgaaaaacttactgcagctgtcaaacccgaagcagagaaagtgaagaatgacttgttggctgctgctaacctcttcttggacaaagccatcaatgttgccgatgacttgaaaaaagtagtcgctgaacacaaaaactaaatgatctagtattttatatttatgatgttttaaatttttatgtaatat

SEQ ID NO: 32 - DNA, 1130 bp, Diabrotica virgifera
aaccatgttcatcaatggagtatttttacacacgctcttcaagaggcatccctttcacggggtatatggaaccggacataattactttttcagtatcaggcaattcaaaagtccggtctcttcagtctgtttcagtccagaaaattgatcggaaatgtggatataatctatgtattcgggatacttattaattacagtggacaccttgtgatccaatatggcagaagcggcttccccgatttcgctcatcacgttgaaactggatggcaaattgaatttgtcgcccgatttacgctcgggacaatacacgctcaaatcggccatgtctttgactagactcgttgctgtttttttggtggccaggcagaacacaaagttgtccatgtcttctttgttcatacgtatggtgaagtggatttggtccatggtgggccgcatcatgccggataatgtggctagcaaatcctgtcttttaataagttttaattccactaacatcccctcgcagcaagttcttccactgcaccacaaagtaaagatattctcactctccttggttaaactggtattttcatttctatctaaagtcccgtcgtctcccaccaacgaaaagttatcttcgaacaattgcctgtgagtattgaaccatgtgttggctatcttactgtttttgcttttgcctgtggcaaagttgatgaaatatacaaccaatccggccatcatgagtatttctagatagtagctgtcccagttttggcggaagttgagtggaactttggcaattgttatttttggttctgattcgacattttcttctttcaattcgtagccttcgaactcttctccatcttggaaatgttcgaattctgaatcgtcatcatcgactaccatatccggatcgtcctcattctctggcacttgttctggaggcccctctgtgtcactttgtacttcttcagaaataacctgttcatcttcaacttcgaaatcctcgaattcagcaaactcgttgtctgcctgatcgtgaaaatcattagttaaaccactctgaattagcagaataaaaagaataaaatatcggagcaacatcgtatcactaatttggaatttacttgtatattgtgattgtg

SEQ ID NO: 33 - DNA, 1455 bp, Diabrotica virgifera
  misc_feature (1309)..(1309): n is a, c, g, or t
  misc_feature (1368)..(1368): n is a, c, g, or t
gagtgttcaaaatataaggaaaagtgagactgtcatcagttaaatatcccagaaaaaactaaaaatacactcaaataaaaacatttaaaggcgtgctgtttaccttttaggggttagaaatggcattaagttcagtagatgtggaaactacagctttcgaggggcaaaagcccggcacaagcggtttaaggaagaaagtcaaagtatttatggaaaaacattatactgagaactttgtacagtctataattaatgctttgggagacaaggctaaaggctctacacttattgttggtggagatggaagatatttctctaaacaggccatcaacattattattagaatcgcttcggctaatggggtttcaaagttgctcattggtcaactaggaatactctcaacacctgctgtttccagccttataagacaccataaagtattaggtggtattgtcctgacagcttctcacaatcctggtggtatccgtaacgacttcggcatcaaatacaacatcgaaaatggtggccctgctcctgatcaagtctccgatgctatatatgaacacactaagaaaataaaatcgtacaaatatacgcctaaactagaaactgatagacttattgatatattaggaactaccgcagtcaaagtggacggacgtgattttatcgttgaagttatcgattccacggcaaactatgtagcattgatgaaggacatcttcgacttcaaaaagttgagaactttgattcgtggaactgagcagcgtccccccttcaatgtacttatcgattccatgaacggagtgactggcgtttatgtacgacgtatttttgttgaggaactcggtgcaagtcctgacaataatgtatgccgaatcgttccattggacaacttcggcgaaatccatcccgatcctaacctcacttacgctaaagacctcgtggacaaagtcaaagccaaccccagctatgatttgggagctgcttttgatggagatggagatcgtaacatgatcattggtaaaaacgcatttttcgtgactccaagtgacagtttagctgttttggccaacaacttggaatgcattccatatttccagaaacatggcgtacaaggtttcgctaggtctatgcctaccgccgctgcggtcgacagggtcgctgagaaattgggtaaggaaatgtttgaagttccaactggttggaagtactttggcaatttaatggatgctggaaggttatccctttgtggagaagaagttttggaactggttctgaccatattcgtgaaaaggatggcatttgngctgttttggcttgggtatcagtgattgaacacaaaaatatgagcgtagaagaaatccnttaagaacactggagtatatacggaagaaactattttactaggtacgattatgaagaaatgcgaagtgacgcagcgaatgacatgat

SEQ ID NO: 34 - DNA, 2252 bp, Diabrotica virgifera
ggcatttgagctcattctgttaatatctcatagttgcctgaccgtttgaacatttaatacggagtctgatcagtgcaatattcttaaacattaaacacgtgtttctcaatataaaaatgtcaccctaaattatttgtaattcactaagactacacattttatattatagctttataaatttaataagttccgatatggaagtgcatgatcattttgtacaagttatcaaaaccttttaatctattaaataccttaaatttataacttaccatttatggcgcatgaggaagttggttggcaccaatacttaaatacaaataggatttaaacaaactttaggttctcttttaaattaacacccccccctacctccctctacacacctgtcattaaacattccgcttcctttgacctcgttgacgtggcattgccacgactgcaatattaacaatactaccaaccaactttcttttatttttctttttctttgtctttgttataactttcacgttttatatctgttttcatttactaaatttaaatagactaggctaatcaatttatcttactcatctacaattatgcaacaggtgatatgcttgtacgttagattatgcactgcctacttacacttaaactcaacacttcttctctactttaattcttctctacttgaatactaatgtagaataatacatctgttatcttttaatcatgtacttttattattgttacaacattttttcacaatagtggttacacatatagtttagattttgttattaatgctataaattaacaactatcttttttgtaaaatttgaaaatgctgtatactttatgttactaagagatttaattaaaatagacaattactgtacaacatttgagaagaagtgttttgacatttcagataacctacatctgtctacactgtcaatattccctcttgaaaacacaaaaactagacttcaatttaggaagtaaaaactaagttaaatagtaattggggaaatgtagtgctacctcccttaaaaaaccttttaccaataattgttatgtctttgtgcttttaaaccctatgtgttatgtgttaatttatttatttagttaataactattctcaagtaagtgcctacacccttccattaatatttcgtttctttctttttctttgtacatatcccattatacaatagctcaaacaaaatattctttaattttatcaatttcttacctttttgaaattttttaatttacagtttcttaaccgatgttttgataataattttttcatttaactaactagtttccctttatttctatacacttcatagtttcatagtgtatggcacttactacttcataatattatgatattattatacttatgacatccctcagttaatttactgagaacaacatatcttaaattgtattaatttatgacaacaatttcctatttgtcatgtcctatactttgacctctgcccgcatcgtataacatctacgagcttagaccatcacattcgtacaagatcctagaataacatttcatactttgctacaattaatacgcaactcctggagcattgtctttctccattcgaacaaaacatcacccgtttcacatacgcatcttccttcaggatcaattccaaatttgaaatcttactgtgttttaacctacgtaacatgtctgtttaccctatcactatcccaacaaaccaattagcataatttggacgtactaatatgacaacaactaagttgcaacgcaatccttgtaacggcatgtaagtagattagaacaatattactatctcttttattattactactttgaatttggaagcatatttaagtcagtttatgtttattttgttttttaatggttaaaaattttaatctcaacaaattcaaactgtatgcacccatttgcacatacatgcctatgagcatttttactcataggtttgactttgtatataccaatattctgaaatgtcaacagttgcaaacctttatttcaaaaaattttataaaaaatttttaaatttggctttctattaacatctcttcaatcagacactggtctaacacaagttttctcttattgtagcatttaactacttgtaacgccgacctgaagatgatctgtatattgtagagatcgaaaccggtcgtcaaagtataattaaatgattgtgagtaagtctgtgtttcattactatatttaatatggactcaca

SEQ ID NO: 35 - DNA, 522 bp, Diabrotica virgifera
actagttctagatcgcgagcggccgccctttttttttttttttgaaaacttcagtaggaagccaaacaaccaaaatgtctgataacgaagttgatgatgcacccccagccccacaagtacaatctggtgggcccatggacgtaaatcaagcactccaagaggtcttgaaaacagcccttattcacgatggagtcgttcatggtttgcatgaggctgctaaagctttggataaaagacaagccgtactttgtgtgctcgctgaaaactgtgacgagcctatgtataagaaactagtctcagctttatgctcagaacatcaaattcctcttattaaggtagacaataacaaaaaattaggcgagtggtcagggttatgcaaaattgataacactggtaaagcacgaaaggtcgttggctgttcctgtgtagtcattagggactatggagaagaatccccagccctagatgttcttagggattatcttaagaatgctaagtaatgttacacattttttatttaat

SEQ ID NO: 36 - DNA, 2176 bp, Diabrotica virgifera
  misc_feature (2124)..(2124): n is a, c, g, or t
gatgatactggttcctccagcaccaccatcgctggtcaccaccagcgaagctccacctaccaccaccagttcgaatgcggaacaatcatcaacaacctcagcacctgagagcagcaccaagggtggtgcatctacggccattcccgcaataggacttgtattgggaaccgctttactgtgtctccactaaaagcagaaaggacgcttttgtctagtcactgtttactttaatacactcacttaaattattattttcgaaaaaaatatcaatttgctcaaaaaataaacatcagacatacaaccatagaagccatagaatattgatcgaattacttgatgttttaaacgtttgtatctaataaaatatagcttaatttattgcaaaaaaaaaaaccaagcagaagggtgataaaaaaggcaaatctgccataaatgaagtagtaactagagaatatacagtaaatcttcacaagaggttacatggtattagtttcaaaaaacgtgcccctcgtgctattaaggctattcgtcaatttgctttaaaacagatgggtaccccagatgtcagagttgatacgagacttaacaaacaactatggtccaaaggaattaggaatgttcctttcagagtacgtgtacgtctttccagaaggagaaatgatgatgaagattctgtgaacaaattgtacactcttgtaacatatgttccagtagcaacattcaagggtttacagacagaaaatgttgacgcaagtcaagaataactaataaatattttttaagtccaatagtctcactaagtacattaaaaaaacaaaatgtctcaatcagtggttcaacctcttgagactgagactagctctattcttactagtaatataccactaattttgattggaattatctcagttttattaggataccaatactggtttaaaaaccaacgatatgttcagatgggcaataaattcccgggacctgccactttaccatttataggaaatgctcacttagcctttggaaaatctgctcatggattgtttgaactggccatggcatattataaagaattacaaattgacgttggtaggatttggcttgggcctagattgatcattggcgttgcaaatgccgatgatatagaaattattttaggcaatagtgttcatttggaaaaatctcctgactacggtttattcgaaccctggcttggtgatggcctactcattagcaaaggggaaaaatggaggtcccacaggaaaatgattgcaccaactttccacacctcaatcttaaaatctttcatgccagtatttaacagaaatgctactgctttggtcgaaacatttagaaaggaacagggaaaagtattcgattgccatgattacctcagcagtacaactgtagatactttgctagaaactgctatgggtgttacaaaagaacacgacagcaaagctggattcgattatgccatggctgttatgcgaatgtgtaacatccttcatcttagacatatgaaattctggttgagacctgacaccatttttaacttcaccaaactgagtaacatccaagtaaatcttttaaaagtcattcacgatctcactaacgggactatcaagagaaagaaggcaaactattttgaaagagaaaagtctggagaaaagagtttgtatgaacaagcagtcaagacgtccaaatttgacgaaaaacaaggaaaccttattgaaactcgtgatataatgtcaaatttattaagggatgatttggatgaaaacgaggaaaatgatgtcggtgaaaagaaaagattggctttccttgattatcttattgaagccagtcaaaccaaaggaaatgcacttagtgataaagaaataaacgaagaagtgaataccattatgtttgagggtcacgacacgactgctgctgcttccagtttcgtcataagcttattgggtatccatcaagacgttcaagaaagagcttttaatgaattgaaagaaatcttttccgacaatttgcaccgacctgtcacatttaatgacacgcttcacatgaagtaccctggaagggtaattttagaatctttgagaatgtatccaccagttcctatgattgcangaaaagtgaacgaagatgtaaaactggcttctggtgactacaccattcctgc

SEQ ID NO: 37 - DNA, 3578 bp, Diabrotica virgifera
agtcagtagtcagtcttgcggcattcagctcgagactccctggctaactaacgtaccgagttaataagccaactgggctgcaacggattgattcgaagcccgccggatcggagcaagatcatacaaataaaaaaatcaagtgacaccaaaactatgttagaagaaatttgtttctagttaaatgattataaacctaagataagaatgcgctaggcttaagtaaatatagtatgtttgcttttcaataaacagctgtaacgtatgtatttacacttatgttatatgcgttatccagttagtaacaaaaataaagtttgcatccacagactggtttgaaaaaaatatttaaaaatccattcctggtggggaaggcactcttatcactgcaaactcggctcgatttgtcttcatgacgagctatttacattcggcacattttttggggtacgtctgtgatttttctggcaacgaacttcagcgtttcgtcaagtaatactactggaattgagaacttcatcaccgtcatccattcttctaagtcaatgggcacacttggaatacaacagataaaacttcaacgtaaatgataacgaagtgaagggtgaatgaaagagccattgaaccaatcaaccaccagttggaccatggaggcatggcaatcaaggactgattttctgataagctgttcatagcgtttaacatttcaattgttaccaatacagacaaagccatagtcataggatgaggatcgctgaatactttgcagttgactcccttgaattcaggtccaccaccaatgcattgcaaatgatgtgtcaattgatagtagttcatttgaggtccttcggggctgtacatgaaccaccaagcagcagcgcctacagttgcagcacctacatatcctccaatagccaagtatctgaagaacaaccatccggagatcaaggattcatcagctttacgtgggggtttgctcatgatgtccaagtcaggtgggttgaaaccgagagcagtagctggaagaccgtcagttaccaagttgacccacaatagttgtactggaataagggcttcaggaagaccaagagcggctgtcaagaaaatggatacgacttcaccaatgtttgaggaaataaggtaacggatgaattgtttcatgttgttgtagatggcacgaccttcttcaacagcggctacaatggatgagaagttatcatcagccaacaccatctcagacgcagatttagcgacagcagttcctgaacccatagcaataccaatttcggccttcttcaaagcgggagcgtcgtttacaccatcacctgtcatagcagaaatttcattcatgctttgcaaatactcaacaatcttggatttgtgagctggttcgactctggagaataatctagctctagcgcatgcagctttttgttcagaagtaggcaaatcgtcgaactcacgaccagaatatgactttccagtagtatcttcatcttcagtgaatacaccaatacgtctgcaaatggcttcagcagtagctttgttgtcaccagtgataacaataactctgataccagcagcgcggcattgaacaatggagtcaaatacttctttacgtgggggatccaacataccaacaacaccaacgaatgtaagattgacttcatatgtgtagaatttggttgaatcgccaaggtccatttcgtctggtttcatggggttatcagcagttgctagggcaagacaacgcaacgtgtcgcgtccacaaccatattgagcggtaagatcagtgattctctttttaagggtgctggtaagtggtactttttgagatccaacacgagcgtgtgtacacctttccaaaacaccttctggagctcctttaacgaagagtttaggtccattaccaatacgagatggtttgaggggtgtgcagtaggaagacatagatttacgatcacgtgagaattccaaagtgaattccttcttccatttagtttcaatgtcttgtctaacacagatggcaacctgtctacgatctccagttttactgacagagaagggattcattttttctgctaatacaatgagagcagtttcagtagcttcaccaactttttcgaaagcttgtttgaattcattgaaatcaatggcggagtcattgcacataatacaaatggtaccaatttcatgtaatgcgtcaaattctgcacatttaactttttgtcctttaaggaatacttcaccaataggttcataagtggagccagtgatttcaaattcatggaaagagctgtcgctgccttcaactttatcgaaaataaacatacgtgagactgacatttggttggtggttaaagtaccagttttatcggagcagatgacagatgtgcaaccaagagtttctacagatggaagggaccttacaatagcgtttttcttagccatacgacgagtaccaagagcaagacatgtagtaatgacagctggtagaccttcaggaatggcagcgacagccaaagctacagcgattttgaagtagtagacagcacctttaatccatgaaccaccatgggctgggtcattgaaatgtccaatgttaatagcccatacagcaacacagatgactgaaatgactttggagagttgttcaccgaattcgtccaatttttgttgaaggggagtcttaatttcttccgtttctgacatttcagttctgattttaccaatggcggtgttaagaccagttccaataacaataccacgtgctttaccagcagcaacattggtacctgagaaaagaatgtttttcttgtcttggttgacagctcttgggtcgggaatggcatcggtgtgtttgatcacagaaacggattcaccagtcaggatagactgatcgatacggagtgttgttgagaaaattttaactaaacgaatatcagcgggaattttgtcacccactgacacttctactatatctccgggtacgatttctttcgcccggattttctgaataccggatttgtcttgtcggacaactttgcccatttctggttcatattctttaagagcttcaatggcggattcagcatttctttcctgccatacacctactactgcgtttgcaataagaattaaaagaattacaaaaggttctacgaacgcggtgaatgcgccatcgtgttcttcaaataaagctaatacaaaggaaattatagcggctaataataaaatcttgactagaagatcatcaaactgttctaaaactaattgccatatggattttccttcttccgcaggaagttcattgggtccatatttagcttgattctttttgacttgatcaagtgaaagacctcgttcttgatcagcgtcgaagtacctaagtacttcgtccactgtttttgcgtgaccatcctccattctgcccagttgtcacttcgcttgttatcacaaaaatggtcccagtagttatcacttgacgaaaactttggtggattatcaaaggttaacaacgacacggtattgtttaggcccccatttaagagtagcacaaaattgtcacagaagtttagagc

SEQ ID NO: 38 - DNA, 1091 bp, Diabrotica virgifera
cacacgcgtccgcccacgcgtccgcctgttcccatatatgggcggccggcgtgttatttttaagtgcactcgacaatccctataaaaacgacgcttcgcgtcattagcgcactcgttgttaacgtcgctgagcgtcgagtccatacacttactcagagtcgctgtaccaccaaaccaaaaaaccataaatcatgtgtgacgacgatgtagcggctcttgtcgtcgacaatggctccggaatgtgcaaagccggtttcgccggtgatgacgcccctcgtgctgtctttccatccatcgtaggtcgtcccagacaccaaggtgtcatggtgggtatgggtcaaaaagactcctacgtaggagacgaagcccaaagcaaaagaggtatcctcaccttaaaataccccattgaacacggaattatcactaactgggacgatatggaaaagatctggcatcacaccttctacaatgaacttagagtagcccccgaagaacatcccattcttttgactgaagctccacttaacccaaaagccaacagagaaaagatgactcaaatcatgtttgaaactttcaatacccctgccatgtatgttgccattcaagctgtattgtctctgtacgcttccggtcgtaccactggtattgtacttgattctggagatggtgtatcccacacagtacccatctatgaaggttacgctctcccacacgccatcttgcgtttggacttggccggtagagacttgactgactaccttatgaagatcttaaccgaaagaggttactctttcaccaccacagctgaaagagagatcgttcgtgacatcaaggaaaaattgtgctatgtagctttggacttcgaacaggaaatggccacagcagcgagctccacctccttagaaaagagttatgaacttcctgacggtcaagtcatcaccattggtaatgaaaggttccgttgccctgaagctctcttccaccttccttcttgggtatggaatcttgcggtatccacgaaactgtctacaactccatcatgaaagtgcgatgtcgacatccgtaaagacttgtacgccacactgtccttt

SEQ ID NO: 39 - DNA, 1911 bp, Diabrotica virgifera
  misc_feature (391)..(391): n is a, c, g, or t
  misc_feature (418)..(418): n is a, c, g, or t
agtcgtactagtgtgtgaacgttgttgtatttccattgcatcggtcggcatagtttagttgtttctcacggtactctatcgagggaaaatacatcgtgtgaaccgaaaactgttgggcaggaagtggcctattaacgaaacagatctgtttctgtgtgaaaatttcggaaatttttttaaactggaagaattcatgacacatattgtaaaatggttgtggaccaaattgaaagagaacatatttgtcctctctgttaactgaacagaagagcatggaaatggaaaccaaataggaggaaaagaggatgtcctaaattatagtggaactgacaaataaaaacagcaatgaaaaaggagacgtgaagaagaaatggcgaccagcatgtggtanacagcaaacagaatatgctgtgtatanagatgaaatttcatggtactaaaatggcagtagttcaatcaaattacattcaaaatataccttcttttggatgtgtagaccaacctgacaacggctccaaaacaacaagagaatcattagtagaagtgtcttcatcacgtccacgccaagaagactactcagtatatgagaacagactggcatctttcactaactggcccaacacccaagtgtcaagagaatcattagctcgagctggttttatatatacaggtcaagatgacatcgttatctgccctatttgtaagatagagggataccgttgggtatcaggagacaatccaatggatgatcatcgtgtttggaatcccaactgcccctttcttaatagaagagataacatcgagcacgatcactctgtaggttctagagacacttgtggactttttggcatagaattgttaccaaattcagttcctgaagataatacaagtaatttacaaaaattagggatccaacctggaacaggtccacaaaatcaagacaaaattacgttagaaagccggttagcaacattccagggttggccaaagagcattaaacagaggccttctgagttagctgaggcgggattttattacacaggagctggggaccaaactgtgtgcttttattgtggtgggggattaaaagactgggatgaaggagatgatccttgggagcaacatgccctttggtttagcaaatgtgtgtttctcaatttgaaaaagggcaaagaattcatcgatcaagtaaagaggaaggctgatccacaattttcaattcctggacctagcggtactcaagccaaagaggaaacgactgctactgaatcttcaagtgataaacaaagtgaaacagtgaaaacaaaatcagatagggaaagtttcgcaactgacacaactttgtgcaaaatttgctttaaaaacgaacttggtgttgttttcttgccttgtggacatattgttgcttgtgtagattgtgctgctgcactaaaaacatgtgctgtatgccgaaaacctttagaggccacagtcagagcgttcctatcataaatttttattctgttaatagtttttcacatttcatgtttcacacatacttagatctagtcaagattgttagagttttggcaaagaaattaaataaaaattcttttcataaaaatcatttctttaatattacattagagaaaaattatatttttatactgagtacaaatttgaacaagttattaattttaagttacaaaatacgcttttataggttaacaattatcaaagcgcttaaatctaatagatactacacaacattaaggactgcaaaccatatctttcacgaagtaatccctactagtgaccaattgctcgctaggagcagatgcaaattacacaaatttactataaatctgacattaaaacttaggtgtatgtttgtgtgtatgttatgtattgatcataataatatagtaattt

SEQ ID NO: 40 - DNA, 1375 bp, Diabrotica virgifera
cccccacataatttttttttttttgtttttttcttttttttttttaaaaataaaatatgtattataaaaacggctttttttattatttttattttttttgtgtaaagaaaaaaaaccaccccaaaaacaaccacaacataaaaaaaaaaaatattttttattttttttttatttttttttttatttcctttttttttttttgggccaaaccccagtttttttttcccctttcaaagccgccaaatggtcccttcctttaaaagatttttaaaggttccaaaagtcccccccgtcgggtttccaggaattacaaacaacccaaaatgggggttttttttttcccccccaccgaaaaaatcggaaaccagacctccccaagaattgcctttttaagtgttggaaaccccccagtttttatagttcacgaaatcagcataaacgctaaatgctccttctacgggtccattttgtaatatttcagcctgtatttgtttgacgtcactactaatggagtatgctttagagccaaagtgcaagtcattactgtaattgattttgtagttactttcgcatgattttgcacactttggcgtgttaccttctgaagcatcgcaggctggacgtgatccgtttgtgtggtgttcacaaggaggaatttcgtatggccggcaaccctgttttgtaccatattgaccaccagagacaagaccttttctgacccaataatgccaagctgcaccaggatatccaccattacatcccattccacatgtccaacagcaagaaaccaaatcatctgatgagaaatggaagttagattcaccgttagaatgaatgcacactctgtctgacatagcttccactgctccaaaagcccaacatgacccgcatgatccctgatctcttatctcccgaattgttgggcaatgtggccattgctgacgagcatcgaaatcggctggaatttctagagcttctagtttatgtgtcaatacaggaggcatatagttcttatggtcaggtaatacccccatcaatttaatgatatagtccattgatttgtcctgagcaaaatttcttcctgcagtccatgtggattttgctgcattgatggagttaatgaattcatcagatagtggatgaagctctttagagttagtgacttcatcagatgaatgtgtaactatatccattcttagaccagaacaatacggtatcaacagaagtaacagcggaatcatttttctctctattctgaagcaacaatttaaactgtcacaattctattaatcactcgtaacaacaaaaacaatatgaaacatgaaaccaaagaaaccaaacaaaaacaacagccggctttgaaacgtcaatcagt

SEQ ID NO: 41 - DNA, 1926 bp, Diabrotica virgifera
gaaggggggttcggggggggccttttcccttttcacccaccgtggaaaaaggggtgttctctcaagggaattaaaatggggaaccccaggggtttctccaccccgccgccttttaaaacggcggccccggaattgatttttggggcccctttaaaaaaatttttcctcccccatcccccgaaggtaaacatggatccttttaagcggccccccctttttttttttttgggtttttttttttttttttttttttttttttttttttttttttttttttttttttttttttttttttttttttttttttttttttttgtacaaatactttgtatttattttaaatgtcaattacattataaaaaaaattaagaacgtctgttgaatgtgtttgtagctggttgcgttaactgcaatccactgatgttgttgaaatcgagcattttcaacatttctttggtctctggatcaacctcaatgatatcatgttcaagagcagagacttctggtacgtagttatcacgtctttcacgttcttcttcttgcaatttgatggagattccacgcacttgtgagtgcctgagacgtttcatcaaatgtgtgacaaatccggcaattttgttgcgtagaggttttgttggaataattgcgatttcttcgcagatacgcttgtttgtgtggaaatctaaagttaaacgtgtgtagtacttttcaatgatgactttggaggctttcttcacagtcttggtacgtacgcgacccatgttttcaaaagcgaaaaacttggttcagaaaaacgtggtcaaagaagttttttttgacttcaacgtccttaattcgtcctttacttacgttagttccactcgttttccaaaggagtgaagaaggttggtttgaacatttccaaaaagtctacctgcaaccgtcgaaatgactacctcttggaactatcctgatgctgcactcagagctgaactcaagaagatcgctgatgctatcaccgctcctggaaaaggtatcttagctgccgacgaatctaccgctaccgtaggcaagcgtttcgctgacatcggagttgaaaacaacgaagaaaaccgtcgtaaatacagacaacttcttttcaccaccgatccagccattggacaatacatttctggtgtaattttgttccacgaaagtttataccaaaaagccgatgatggtactccattcccagaacttcttaaacagagaggaatcattcccggcattaaagtcgactctggtgtagtacctctcttcggcagcaatgacgaatgcaccacacaaggtttggacgatttggccaagcgttgcgcccaatacaaaaaagatggttgccacttcgctaaatggcgttgtgtgttgaagatcagtgcacagacaccttccatccaatcactcattgaaaatgccaacgtactggctcgttatgcgtccatctgccaggccaacagaatcgtacccatcgtggaacctgaaatcttacctgacggtggacacgaccttctcacctgtcagaagacaacagaaacagtattggcatacgtctacaaagctcttgctgatcacaacgtctacctcgaaggaactctcttgaaacccaacatggttacagcaggtcaatcctctgcaaacaaagccacaccagcacaagtagcagaagccacagtaaccgctttacaacgcagattgccccctgcagttcccggtgtcacctttcttgtctggaagacaatcccaaaaaaaaagctaccgtcaacttaaacgcccatcaaccaaattcccaggaaaagaaaccgggggggcgctaaacttttcaatttatgggacggtgcccctttcaagctttcccgttcctcccccgcccggggggaggaaaaaaacgaaaaacggtcaaaaagttggccc

SEQ ID NO: 42 - DNA, 695 bp, Diabrotica virgifera
aaagtcgtctctctaattttttcagattaaaaatacatcaatcatggccattaaaatgtattacaatttgtacataataaaataatatataatatattttattttaatcataatcgcagcccatttgatcagtcattattatttcctttcgagaaatattgttagcttctagaacgtcgacaattgcatctatatcatctggtgatccatattgatgtcttgttgtaaggaaaagactctctagaaaaacaccatctcgttcaaaacaggagaaacctacagaccatcttttatagtctgtaccaagaatccaaaaaggtacagttacgtctggattaagaaaatgtactaaaaatttggcttctcctgtggttgaatttgatattccttccccttcgagaacatgtgtctcatttgtttcggaattgatgtattgcgtacgactctttacagatccatttgagtttactgcaatattggtaacaacacatcttccgtgatcttccagtaaagttgggtatcttgcttgttcgaaccagtcacccaaatatgcttttccatcgaaatttgcaactccttttacatctgggcatctttcaacaggaatttgtccctgtacagatattacaagcaaagaaatagttactgcaaaaccaatcattttcgtggttttataaacacagcggacgcgtggg

SEQ ID NO: 43 - DNA, 2143 bp, Diabrotica virgifera
gacctcccaatgacattggagtgttcaaaatataaggaaaagtgagactgtcatcagttaaatatcccagaaaaaactaaaaatacactcaaataaaaacattaaaggcgtgctgtttaccttttaggggttagaaatggcattaagttcagtagatgtggaaactacagctttcgaggggcaaaagcccggcacaagcggtttaaggaagaaagtcaaagtgtttatggaaaaacattatactgagaactttgtacagtctataattaatgctttgggagacaaggctaaaggctctacacttattgttggtggagatggaagatacttctctaaacaggccatcaacattattatcagaatcgcttccgctaatggggtttcaaagttgctcattggtcaactaggaatactctcaacacctgctgtttccagccttataagacaccataaagtattaggtggtattgtcctgacagcttctcacaatcctggtggtatccgtaacgacttcggcatcaaatacaacatcgaaaatggtggccctgctcctgatcaagtctccgatgctatttatgaacacactaagaaaataaaatcgtacaaatatacgcctaaactagaaactgatagacttattgatatattaggaactaccgcagtcaaagtggacggacgtgattttatcgttgaagttatcgattccacggcaaactatgtagcattgatgaaggacatcttcgacttcaaaaagttaagaactttgattcgtggaactgagcagcgtccccccttcaatgtacttatcgattccatgaacggagtgactggcgtttatgtacgacgtatttttgttgaggaactcggtgcaagtcctgacaataatgtatgccgaatcgttccattggacaacttcggcgaaatccatcccgatcctaaccttacttacgctaaagacctcgtggacaaagtcaaagccaaccccagctatgatttgggagctgcttttgatggagatggagatcgtaacatgatcattggtaaaaacgcatttttcgtgactccaagtgacagtttagctgttttggccaacaacttggaatgcattccatatttccagaaacatggggtacaaggtttcgctaggtctatgcctaccgccgctgctgtggacagggtcgctgagaaattgggtaaggaaatgtttgaagttccaactggttggaagtactttggcaatttaatggatgctggaaggatatccctttgtggagaagaaagttttggaactggttctgaccatattcgtgaaaaggatggcatttgggctgttttggcttggttatcagtgattgaacagaaaaatatgagcgtagaagaaatccttaaagaacactggagtatatacggaagaaactattttactaggtacgattatgaagaatgcgaaagtgacgcagcgaatgacatgatgaaacatttagaaaacttaatagcaacaaatgccttggttggtaaagcatttacagctggcggtaaatcctacaaagtcagcaaggccgacaacttttcttatgtagatcctatcgacaacagcgtaactaaaaatcaaggtatccggatacttttcgacgatggttcaagattaatcttcaggttgtcaggtacaggaagcagcggcgccaccataagagtatacattgatagctacgaaaagaagaacgtactatcagatgcacaagaaatgctaaaacccttggtggacgtcggtttggaaatctcccaactgaagaaattcacgggtcgtgacgctccaaccgtcattacataatcatgttactacttaagagaaaaagaataataagtttaggtgaaattttacaaaaatattgtttgtactagattttattagttttttgtcactttttttcaaatatacattattatattttgttacaattttgatgaaattatattgaaatgtttttattcgttgttattttttatgttgagagatttttcaaagtgtatcattccggtgtagcttgaacattttgcatcttgatactgccaatatctcgcttaaagatagtttattacacttgttgaagttggcatccaataaaacatatttaagtaattt

SEQ ID NO: 44 - DNA, 1371 bp, Diabrotica virgifera
ttttttttttttttatattataatattgttttattctttttcactattccatttttacatcaaaaataggaataatacccacataatataaatctggaactgatatttacaaaattgtaacataaattgtagttgactaaacaattattaacactacatagacttggacttaaattatggatttaaaatgtggactccctagtatttattctctagcacttattggctttccatcttgccatttggttactttaatatgggtttcatttcttctcattgcttctgttctaagttcaggtttaagtgcctgcctcagaagtttggcagcaatgttggaatagttaatgtagtttaatccagcagctctccaggcactcatttttgtaaaaatttattttacagatttcgaatcctagaaacgagccgagttatgtaaaagatggactgctgtgtttagttttttgaaatatttatttttttaatatactaatcaatcaacatgtgtgaagaagaagttgctgctttagtcgtagacaatggatccggtatgtgcaaagctggttttgccggggatgatgcacccagagctgtattcccttcaattgttggacgtccaagacatcagggtgtgatggtaggaatgggccaaaaagattcctatgttggcgatgaagctcaaagcaaaagaggtatccttacattaaagtaccccatcgagcatggaatagtcacaaactgggatgatatggagaaaatttggcatcatacattctacaatgaactcagagtagccccagaagaacaccccgttctgttgacggaagctcctctcaaccccaaggccaacagggaaaagatgacacaaataatgtttgaaactttcaacaccccagccatgtatgttgccatccaggctgtactctccttgtatgcatctggtcgtactactggtatcgtattggattctggtgatggtgtatcccacactgtcccaatctatgaaggttatgcacttccccatgcaatccttcgtttggacttggctggcagagatttaactgattacctcatgaaaatcttgactgaacgtggctactctttcaccaccacagcagaaagagaaattgttagggatattaaagaaaaactctgctatgtagctttggacttcgaacaagaaatggcaacggctgctagttccagttcccttgaaaagagttacgaacttcctgatggacaagtcatcaccattggtaatgaaagattccgttgtccagaagccctcttccaaccatcctttttttgggaatggaagccaatgggatacatgagactacctacaattccatcatgaagtgtgatgttgatatc

SEQ ID NO: 45 - DNA, 980 bp, Diabrotica virgifera
tgggtcccttttagaagatcttttccgttacattcttcatttttgtaaccctttatcttttatatcgttccgtccttttttttttttttttttttttttttttttttttttttttttttttttttttttttttttttttttttttttttttttttttttcaggtaatatactcgtattttattttaatctaataagtacattcattttggtctgtgaagattagtggctttatagcaaaattgttgtcgtcaagaacttggagaatcgaatccaccagatcttttggtggaaatggagttcttgttgaaatgaaaaggctcgctagaggagcaccatctcgttcaaaacaggacaaacctacagaataactttcatagtctgtaccaagaacccagaaaggtacagttacgtctggatttaagaaatgtactataaatttgccttccccagttgttgaaccttgtgtttctccttctaggacgtgtctctcatttgtctctgaattgatatattgggtacgactccttatagttctatcgtcacctactgcaatattggtaacaacacatcttccgtgatcttccagtaaagttgggtatctggcttgttcgtaccagtcacccaaatatgcacttccattgaaatttgtaactacttctacatctggacacctttcaacaggaatttgtccctgtgcagatattaccagcaaacaaaaagttactgcagacgtggcccagcccgtccaagagccggtaactctcagtcagagtctgcaggagggaaccaaccaaataccaaggttcccgaaaaagctgtatctgataagaccgaagaaagtcaaccagtgcagaacacaactacagagagcagtgcttaagcgtaatcgcgctcaagtccatcactctataatcataaaatatttaacaacgttagcgcgtgagtttgtaaaagtaaagcagacaaaaggcatttcatg

SEQ ID NO: 46 - DNA, 1615 bp, Diabrotica virgifera
gtttagcgcagatacagcgctctcaagcggctcttaacaaggaggggcaaataattatacctgcaaaaacttcgactagacattagaagacattcaaatattgtgatatcagtactgctgtgtttagttttttgaaatatttatttttttaatatactaatcaatcaacatgtgtgaagaagaagttgctgctttagtcgtagacaatggatccggtatgtgcaaagctggttttgccggggatgatgcacccagagctgtattcccttcaattgttggacgtccaagacatcagggtgtgatggtaggaatgggccaaaaagattcctatgttggcgatgaagctcaaagcaaaagaggtatccttacattaaagtaccccatcgagcatggaatagtcacaaactgggatgatatggagaaaatttggcatcatacattctacaatgaactcagagtagccccagaagaacaccccgttctgttgacggaagctcctctcaaccccaaggccaacagggaaaagatgacacaaataatgtttgaaactttcaacaccccagccatgtatgttgccatccaggctgtactctccttgtatgcatctggtcgtactactggtatcgtattggattctggtgatggtgtatcccacactgtcccaatctatgaaggttatgcacttccccatgcaatccttcgtttggacttggctggcagagatttaactgattacctcatgaaaatcttgactgaacgtggctactctttcaccaccacagcagaaagagaaattgttagggatattaaagaaaaactctgctatgtagctttggacttcgaacaagaaatggcaacggctgctagttccagttcccttgaaaagagttacgaacttcctgatggacaagtcatcaccattggtaatgaaagattccgttgtccagaagccctcttccaaccatcctttttgggaatggaagccaatggtatacatgagactacctacaattccatcatgaagtgtgatgttgatatccgtaaagacttatatgccaatactgtactctctggaggtaccaccatgtaccctggtattgctgacagaatgcagaaagaaataacctccttggcacccagcacaatgaaaatcaaaattattgctccaccagaaaggaaatactctgtttggattggtggttcaattttagcttctctttctactttccaacagatgtggatttccaaacaggaatatgatgaatctggaccatccattgttcacaggaagtgcttttaatttttatctatgtttaagtatattctttatatatcttgttttttatatcccccatcttggggcaagaactgcctatgttatatgagtgatcttgtgatttattacacgttcagcataagacttaatgagctttaattttaagaagtgtaagttgaatactctgtttcatatttattttacctttgtaatataataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaattgggg

SEQ ID NO: 47 - DNA, 1761 bp, Diabrotica virgifera
agataatatactcgtattttattttaatctaataacgttctaataagtacaatcatcttggtctgtatcgattatttgctcacgatcaatattgttgtcgtcaagaacttggataatcgcatctatctcatctcgtgttggaactggagttcttgttgtaaggaaaagactctctagaaaaacaccattacgttcaaaacagacgaaacctacagaataattttcatagtctgtaccaagaacatagaaaggtacagttacgtctggatttaagaaatgtactagaaatcgaccttccccagttgttgaaccttgttgtgcttctccttctagaacgtgtgtctcatttgtctctgaattgatatattgcgtacgactccttatagttctacttatagggcctactgcaatattggtaacaacacatcttccgtgatcttccagtaaagttggatatctaccttgttcgtaccagttacccaaatatgcatatccgtcgaaatttgcaactccttttacatctggacatctttcaacaggaatttgtccctgtgcagatattaccagcaaacaaaaagttactgcaaaagcaatcattcattaattaccgcatgcttttgattaaaattacttttgcttgatttaaatattagataactatggcccaaaacaaattgaatgatttagcaggtaaatttggcaagggaggtcctcccggtcttggaattggtttaaaattgttagctgttggtggagccgctgcctatgggatttctcaatcaatgtacacagttgagggaggtcacagagcaattatgttcaacagaataggtggtgttcaaaaagaaatatatacagaaggtttgcatttcagaattccatggttccagtatcctatcatttatgatattagatcaaggccaaggaaaatctcttcccccacaggatccaaagatctgcaaatggtaaacatttcccttcgtgttttatctcggcccatggccgcttccttgccagtaatttacaggcaacttggattagattatgatgaaaaagtccttccgtcaatttgtaatgaagtcttaaagtctgtagtggccaaattcaatgctgcccagttgatcacacaaagacaacaggtttctttgttggttagaagagaattagtagaacgagctcaagacttcaacatcattctcgatgatgtatccatcacagatttatcattcggaaaagactacacagcagctgtagagtccaagcaggtagctcagcaagaggcacagagggctgcttttgtagtggaaaaggccaaacaggagagacaacagaagatagtgcaagctgagggagaagctgaagctgctaagatgttaggagaagccattggaagaaatccaggatttttaaaactaaggaaaatcagagcagcacaaaatatttctagaaccattgccaattcccaaaacaaggtatacctcagcggaaacagtttgatgttgaatatctcagataaggagttcgatgatatgtcagagaagttgcaaagtaagaagtgaataaaaccgttataaatatcaaatcaatcgcagaggaactacatactgatactaccataagtgtagactccgaatttttgttaataaacttttatacttagtatattttactttacattgttgaaaaatcggcattttgggccccaatacaattgttactatgtgtaaatattcatctgtttaataaacgctcagaatagat

SEQ ID NO: 48 - DNA, 871 bp, Diabrotica virgifera
ggcccttttaaaaaaatttaaggtttccaacccccggtaggtaaatttggtttttttaaaggggccccccctttttttttttttaaaattttttttttttttttttttttttttttttttttttatttttttttttttttttttttttttttttttttttttttttaacattaaaatttattacaatttttacataagaaaatcatatttctaatatatttattttatttataatagcagtaatcttggctatctactactaaatcatctacagagagattgttgtctattagaactttgacaagattatctatatcgtcttctgtaacatattggtgtcttgttgtgaggaagagactctctaggaaaacaccatctcgttcaaaacaagagaatcccacagagtatgttgtatagtctgtaccaagaacccaaaaaggtacagttacatctggattaaggaaatgtactaaaaatttggcttctcctgtggttgaatttgatactccttctccttcgagaacatgtacttcgcgtgtttcgctattagtatatgtggtacgactttttacaactccattaaggtctagtgcaatattggtaacaacgcattctccgtggtcttccagtaaagttgggtatcttgctttgaacgagatggtgttttcctagagagtctcttcctcacaacaagacaccaatatgttacagaagacgatatagataatcttgtcaaagttctaatagacaacaatctctctgtagatgatttagtagtagatagccaagattactgctattataaataaaataaatatattagaaatatgattttcttatgtaaaaattgtaataaattttaatgttaatg

SEQ ID NO: 49 - DNA, 3848 bp, Diabrotica virgifera
cacaaaccaattagcatatttgaaaatgctgtatactttatgttactaagagattaaataaaataggcaactactgtacaacatttgagaagaagtgttttgacatttcagataacctacatctgtctacactgtcaatattccctcttgaaaacacaaaaactagacttcaatttaggaagtaaaaactaagttaaatagtaattggggaaatgtagtgctacctcccttaaaaaaaccttttaccaataattgttatgtctttgtgcttttaaaccctatgtgttatgtgttaatttatttatttagttaaaaactattctcaagtaagtgcctacacccttccattaatatttcgtttctttctttttctttgtacatatcccattatacaatagctcaaacaaaataatctttaattttatcaatttcttacctttttcaatttaaagtttcttaaccgatgttttgataataatatttttttcatttaactaactagctttcctttaatttctatacacttcatagtttcacagtgtatggcacttactacttcataatattatgatattattatacttatgacatccctcagttaatttactgagaacaacatatcttaaattagattaatttatgacaacaatttcctatttgtcatttcctatgctttgacctctgcccgcatcgtataacatctacgagctaagaccatcacatttgtacaagagcctagaataacatttcatactttgctacaattaatacgcaactcctggagcattgtctttctccattcgaacaaaacatcacccgtttcacatacgcatcttccttcaggatccattccaaattcgaaatcttactgtgttttaacctacgtaacatgtctgtttaccctatcactatcccaacaaaccaattagcacaatttggacgcaccaatatgacaacaaccaagttgcaacgcaatccttgcaacggcatgcaagcagattagaacaacaccactatctcccccactattactactctgaacctggaagcacattcaagccagttcatgcccattttgctctctaatggttaaaaatcccaatctcaacaaatccaaactgcatgcacccacctgcacatacacgcctatgagcattctcactcataggtttgactttgtatataccaatattctgaaatgtcaacagttgcaaacctttatgtcaaaaaaattttataaaaatttttttaaatttggctttctattaacatctcttcaatcagacactggtctaacacaagttttctcttattgtagcatttaactacttgtaacgccgacctgaagatgatctgtatattgtagagatcgaaaccggtcgtcaaagtataattaaatgattgtgagtaagtctgtgtttcattactatatttaatatggactcacatatgcaacccattcaatatttgaataatgcaagaccagcaactttgctacaccgttacaaggagctgaacatcaagaaaatgttacaaaaatctaagatcttttataacaacgaatgtttacgtctcaacctgctgcctagttatgctagaggtagactaagagaacttaacttcaatgcaacgaaggctaaacaagtaaaaattctgggtagatccatcattagggatgagattcggaaactataccaacatatctacaccattgacttgcaactgaagacaatctacaacagcttacatagaagaatgacagcgctcgagtttgatgaatgtatgcgtgatttacatgggactattaattttcataggagtagacaatataggaaacttcatgacaagatcaagaaacttaaatttataacacatagagtaaataacaatattattttgtcaaatcaatctgtgttttcacaacttaacaatgaccaacttgtggtggatagtaacagtaatggctcttatattgtaacaccttctaattttacaaattctgatttgtatacttctgaacgattattaaacgttactaccaatactagtcttagtgatcttcctgatcaaactcatagtattaatacatctatatcttctgacccagacaacattttcgatggctctgagcaacatacattctatacccctttcataaattactctaacgtagtattttcaaataatgaactgtctctactccaaaaaggtttcaaattcaatcccccccaatcttctaaaaaacaacaacttagaaatctagaactactcggagttgagagtgaaagtatcttacaatcaataccactggaaaacacagaagaaattaggagcagtttgaaagtattactgaaaaaagaaaaggaggctatttgtaacaacagaaagggctatcacagaaaccctctcaatgaatataaggacaccattaaatcaattgataagaaaattagtgaaaataaccttacaatcactaaagcagataaaggcagcactgtagttgtcttacacacccaagactaccatcaaaaagtcactaattttatactagataaccaatttctaacaaaatctgtcaatattaatactttcactactaaagttagaacagccatcaataaaatcactgaagtttttgataatactactaaaaagaaacttttaccatctaaagcaaacgttcccagactctatggtctcatgaaaatacacaagactgatgtctttgaaaacataccaatcagaccagtggtatcctttactgattctcccactcatgcattagcttctcacttaaacaaattccttaaaaccttttacaacaataaattcgattatgtagtctctaacaacttaagtttgacaaataaaattacagaagttaatcttagtaatgaagatttattgatttccttagacataactaatctctttactaacattccaacacaagaagttatcagtattgttgctttagacttgtggaataataattaccatcctaatcaaattattgagtatacagagcttttgaatttgtgtctgagtcagaatttctttaatttcaacaacaccacatatgtgcaaccggacggactagctatgggatctcctctttcaccgatattagctgatatttttctaaatgacttggaatctaataaaatagtgaaaaataatccatttacagattatattaaattttacgctaggtatgttgacgatactttaataatatggaatggcacaattgacattcttcacgatttcttagatttcctcaatactttacatgacactattaaatttactttagagattcagaatgactcaaagagtttgaactttttagatcttacattgacactcagaaatggaacgattgactttggtatttatagaaaaccaacccatacaggtacagttatccctgccgattcacaccaccccatacaacataaactggctgctttttatagttacatcaacaggcttgtctctatcccattgactacaacttcatttaacaaagaattaaaaattatccaacaaatagcagttaataatggttatactgtggacttagtaaataaaattttacacaaaaaaacaaatagaattttagaacatcgagtatatacacagcctattctagtcgaacaggagccaaaaccatatagatcattaacatttacaggtcaattctcttacaaattagctcatatttttaaatattactgtaatatttcttttagaactaattcaaatttaggtttggttttcttgaataacaaggacagtcgtgatagatctgagtgttgtggagtttatgagctcggacgcgtggg

SEQ ID NO: 50 - DNA, 2185 bp, Diabrotica virgifera
  misc_feature (2023)..(2023): n is a, c, g, or t
  misc_feature (2080)..(2080): n is a, c, g, or t
cccacgcgtccgaatcttccttggtagacaaaagtattcggcttcagttcgtcgtgcggcaactgctctaattgcaccaattttattagtgagtagaaccgtgtgtgcagtgattttttaaatttacaacaatatgagctggcaggattacgtagacaaacagctcttggcttcaaaatgcgttacgaaagcggcaatcgctggccacgacggaaacgtttgggctaaatcagaaaatttcgatgtatcaaaagaagaactagcaaaattagttcagggcttcgaaaaacaagacattctcacatcctcaggcgtaacattagccggtaacagatacatatacctctctggcacagaccgtgtaattagggcgaaattgggcaaagttggtgtacattgcatgaaaacgacacaagctgttgtagtatccctttatgaagatccaatccaacctcagcaagcagcgtcagtggtagaaaagctaggtgattacttaattacctgcggttactagagatagtgtgtgccgctgtaagcagccatgccgtgcggcgaaaaattaattattattaaatttgtatttttttcaaaataacagcgaaccggcaatgcgtataccgagtgcatcatcattaaaaaatacatggaaaaaagtcatagaatcggacaatattgtattttcctttttttaccaaacaaacaacataaaatatatattatatatcggtcaaaatcattaattttttcatcgttgtccatcgtgtggttccagttatgttacgagggtcataatattaaatttataacaaaaaaatttgtcttttaaaaccttttatacaatacgtgacctcctaacacgactgcgccaatttgccaatcataatttatgactgtggtctcaattatcattgttttttaagagtatttaggatattttaagtttttttttgagagtgtttcgcaaacttaactgagataagtttccggaacatgatgtgatttttttaattataataaagcgcatttttcttgttaagcttttctcataccattgctatctctaaaaacatttgatactgaagaacttacagtttaggattttttaataaaaaaatctctagtcctgctgtctctattttattttcgacccttctcctttctcctgggctcctgtgctttttgtaatagtgccgatgtgggatctaaaaacggaatttatcagaaaaagggttagagtaagcactaaatatttatacggtttaacagtgtaaagtgaaatttgtttattggctttttaagttttcaaaaaaaaaccttttgctttaggttataaaacattttttttgttaaaaatgagacagtgtaagtgaacttttagttgattgcattttactaagctttttctgtagaaagtcaaatggaaaaacctactaacattgtgatattttttctcttatagtaattgtccaactatggtgtttttactacaaaaattaacttacatcattcaagttttctgacgtcagaaccacaaaattttgtatttccccacattcacaaagagcgtcgttatctgtcttgatgccacatttaatgaggttctgttttagagggacaaaaccggtgcgtatgcggttaagtgtccgccagtttctccagtccaggttcattccattaggtcgttctggctgtagagggaacaggtcgggtagtttgacgctgacatttctcataaactatttccctgatttaagtcggctggttcctgacgggtcgtcaaactcgtataattaatgcctttcattcaacttccccacattgtgaggcgcatctacggtcatctggtgatgcgaatccagctgcccgatacaataggggtagaagggtaggcttcatacaactggtagttattctacatgttttatttaacgccgtggtgacttgttgggcgtgcatagatttaccccaggcgggacaagcatattcccctgttgagaaacataaggcctcagctattgacttntaacacctgggggtttgcacccacttgctccctacaagttctccggagaagtctttntctctcagaaaccttttgtcttgttctcggacagtggaattttatatgtagtgaccagtctagtatcactccaagatatttggggctatcagtatggtccaagcg

SEQ ID NO: 51 - DNA, 2038 bp, Diabrotica virgifera
gatagactgatcgatccggagtgttgttgagaaaattttaactaaacgtatatcagcgggagttttgtcgcccgctgacacttctcctatatctccgggttcgatttccttcggtcgaatcctctgaataccggatttgtcttgtcgcacatctttgcccgtttctggttcatattctttaagagcttcgatggcggattcagcatttctctcctaacgtactcatactactgcgttttctataagaatttaaagaattacaaaaggttctacgaacgcggtgaattcgccgtcgtgttcttcaaataaagctaatacagaggaaattatagcggataataataaaatcttgtctcgaatatcgtcaatctgttctaaaactaatttccatatgcatattccttcttacgcaggaaaatcatcggccactaagtcatctggcatcaaaaattcgtgttactggggttcatgcttgtttggtttcaggcagcatgtccgatgagacgttctgcgtctgtgaatcccacatatgatggtgtggttctgttaccttggtcattggcaataatttcaactttgccatgttggaaaactcctacacaggagtatgtggttcctaaatcaatacctacagctggggctttagccatcttataattaattatttgcagacaattcttaaataaatacttaaattacgtgtgactagttctagatcgcgagcggccgccctttttttttttttttagcttccttataactttattaaaagtctcatattttagaatacataaaaatttataaaatctcaaaatttagagtaaaaaacatcgtcacaaacaaatatacaaactaacagtttacagtccttctaaaactgcttcagggatcaactccatgtgcatcaatgatcttctgactcttctaacacagttgttgcttcctttgcgttcctttacgtagccagggttacaaatacagaaattgggggctgtacaagagccgttagggcaacctcctgggcaatgggctacgcaggtctggcttctaatggagtttggagcttcaatgtaaccttctttacatttgcactgattaggggcaacacagtcaccattcaggcatggattattgcagtgaggagtacaaacggttccagtaccatccaaagcccatccagctttacaagaacatctgtttggtgctacacagtctccattgtggcatcctcttgggcaatctgctacacaagagtgtccagcttgtctatatcctggtttgcaggaacattggttcggtccaatgcagcttccttctccacagcctccttcgcaatggtagttgcatttgcgggttcttgcatccaaagagaaacctttgtcacaagcacaggtctcaggacctacgcagtttcctccaacaccacagcctccgctacagtgaggaaggcagtattttccgctagagctgagtgtgtttccggcattgcaggagcattggccagtgatggtgcagacaccattgagacacctttctgggcaagtaggaatgcagtctttatggtagggatcatggatccatcctcgcttgcattcgcaatgaccaggagacgtgcagttaccattttcgcagtgatcacagacaggctcacattgcaagtgggttcttggaactctttcgtatccactacagcacacatctattttactgtatccgtttctggatccatttcctctaggtataacgccatgtctgtcttctgcaggaattaggtcaatagtaggaacttccaaggtacagatacctcttctggagttatttcttgctactccctgcagctgagcggcttctacgctctggctcagaagagaaaaaggccatcaaggccgtggcgcccaccaccagcttgaaagccatattattatctatctattttttttaaaccactttcaatatcaccggatgccggtatcttctgcgtccgtagcttctgttaattgtcgtgtatctgctgatggtttaaaataaacgtggaatg

SEQ ID NO: 52 - DNA, 1385 bp, Diabrotica virgifera
attacaaaataaatatcttattaaaaaatatcgtacatataacatccttacattcccgaaatagagcagtcttaaatatctaaacaaatttacaattagaaaagacaaacatcacaattccgaattatatttattttacacaaattaataacatcactttgatccatgttgcgcttggaattctttcataaatttaactaacaatttaacatcatctaaagtaactgcattatataaactagctctgattcctcctacagatctgtgcccttttagttgatacatcttaactttctctgcttctactaagaaaagttcttcgagtttttcgttgcctccacccactctgaatggtacgttcattctacttctgacgtcttcatcaattgggcaagtgtagaaacctttagattcaaccatggcgttgtacaataaactgctcttttctatggcttggttttccatggcttcgagacctccgttctttttaatccactgaagtaccttttccatgacgtagacagagaatgttgctggagtgttatgtacagagttttctttggctatgtgagtgaagtccattacagatggacagcatttcatgggatttcctagaagatcttcacggacaataaccactactactcccgcaggtccaatattcttttgggcaccagcaatgatgcagccgaattttgagatgtctagtttcttggtcattatgctggatgacatgtcagtgactagtggaacaccattggtttcgggaatgtaatggaatgcaacaccatcgacagtttcattatcacagtagtatacgtaggaagcatttggattcatcttccacgtgttttgaggaggaacactgcctggtttgctggcttttgggaatactagattgacgtttccatatttggatgcctctttagctgctttgtcggaccatgtaccagtcacggcgtaatcagcggttccggttctattcaagagattcatggcaactgcggcaaaagctccacatccaccgccttgcataagcagaatcttgtagttgtccggaacattaagaagctccctgataaccgcttgtgaatctttattgattttggtatattccttgcctctgtggctcatttcaatcaagctcattcctgaatcttggtaggaaaggaattctttttggacctcttctagcacctctctaggtaacttggcgggcccggcaccaaaatttaaagctgactgtgcacttcccattttaaataaactactgagtaaacctgtcacttaaactacaactaatattctacaacagtgaactaagtcactttccacactgatttctcgtattaacgaacgaactttttaaacaccggacgcgtggg

SEQ ID NO: 53 - DNA, 1209 bp, Diabrotica virgifera
aacgtaaactgatagcacctccgtggttcgtaagtcgtaacgttcaactttagtcgctccgagaccgtgtgtagtgtcaacgggtaactcgtactttctttgagttctttcgttttgtccgtaagcgcgaaaacaacacccatccaccatggacgcgatcaagaagaaaatgcaagcgatgaagcttgaaaaagacaacgcattagaccgcgcagcacacaatgaacaactcgccaaagatgccaacctccgcgctgaaaaggctgaagaagaagctcgctccctacaaaagaagatccaagccattgaaaacgatcttgaccaaactcaggaacaactcacacaagtcaatggcaaacttgaagaaaaagaaaaggccctccaaaacgctgaatccgaagttgccgccctcaaccgtcgtatccaattgttagaagaagacttggaacgttcagaagaacgtttagccactgccaccgccaaattggctgaagcctcacaggcagccgatgaaagcgaaaggcagcgcaaagtactcgagaatcgttccctggccgatgaggaacgtatggacgccctcgagaaccaacttaaagaggcccgtttcctagctgaagaagccgacaaaaaatacgatgaggtagcccgtaaattggccatggttgaagctgacttggaacgtgctgaagaacgtgccgaagccggtgaatccaaaattgtagaacttgaggaagaacttcgcgtagtaggcaataacttaaaatcccttgaagtatcagaagaaaaggccaaccaacgcgaagaagaatacaaaaaccaaattaagaacctcaccacccgtctaaaggaggctgaagcaagagctgaattcgcagaacgttcagtacagaaactccagaaggaggtcgacagactagaagacgaattggtagccgagaaggagcgttacaaagaaattggagacgatttggacaccgctttcgtcgagcttatcctttaattttctttatgttgttttaataaaccctgtattcgaggtatagtcttgcacggcttgttcagcgactcaaattcacaaggaagaaccattacggattaagttcagaatgaatacaggggaaaatattgtgttttgacattgtgtattagactttattaccagaaaatttttatgtaaatattattttcattaatacatgattgtgaatg

SEQ ID NO: 54 - DNA, 1467 bp, Diabrotica virgifera
gaaacacattgatatccgatatcattttgtcaaagaagctgtaaacaaaggtttgataaagctggaatatttggacacagctaacatgccagctgatctcttgacaaaaagcttgagttctgtgaaacataataagtttttgaaagagattggtttagttaagatagtgtaataaacatttgataaatgttattttcttaatttgtttatctagtgggagtgttggatatagataaataaattaaatatttttatagcagtgccatctactggccgctttactatttactgtatagtgtgttgctttcaacgtttgtttaacatgtagtccttaaaatacagccattgggtaaaaaaaacccacgcgtccgagcttattagctgtgtttttctgtctagtgagcagtgatcaaccacaaaagacaacatgtgtgacgacgatgttgcggctcttgtcgttgacaatggatccggtatgtgcaaagctggattcgccggagatgacgcaccccgtgccgtcttcccctcaatcgtcggtcgcccaaggcatcaaggtgtcatggttggtatgggacaaaaagactcatacgtaggagatgaagcccaaagcaaaagaggtatcctcacattgaaataccccattgaacacggtatcatcaccaactgggatgacatggaaaaaatctggcatcacaccttctacaatgaactccgtgtagctccagaagaacacccagtcctcctcactgaagctccactcaaccccaaggcaaacagagaaaagatgacccaaatcatgtttgaaaccttcaacacacccgccatgtatgtagccatccaagccgtactctccttgtacgcttccggtcgtaccactggtattgtattggactccggagatggtgtcacccacaccgtcccaatctacgaaggttacgctcttccccacgccatcctccgtttggacttggccggtcgtgacttgaccgactacctcatgaagattcttactgaaagaggttactcattcaccaccaccgctgaaagggaaattgtccgtgacatcaaagaaaaactctgctatgtcgccctcgacttcgaacaggaaatggccaccgctgctgcttccacctccctcgaaaagagctacgaattgcctgatggacaagtcatcaccattggtaacgaaagattccgttgcccagaagccctcttccaaccttccttcttgggtatggaatcttgcggtatccacgaaaccgtatacaactccatcatgaagtgcgacgttgatatccgtaaggacttgtacgccaacactgttctctccggaggtaccaccatgtacccaggtattgccgacagaatgcaaaaggaaatcaccgcccttgctccatccacccatcagatcaagatcatcgctcccccagaaaggaatactccgtctggatcggtggatccatcttg

SEQ ID NO: 55 - DNA, 2486 bp, Diabrotica virgifera
  misc_feature (2407)..(2407): n is a, c, g, or t
  misc_feature (2465)..(2465): n is a, c, g, or t
  misc_feature (2469)..(2469): n is a, c, g, or t
ttatcttatttttgatttacaagaccaatattttatttaaattattaaaactttaatgataatatattttttattattagtaatatttttatctgggattattagttttattttaaatcgtaagcatttattgttaatattattaagtttagaatttattgtaattgctttatatattcaatttttttttttatttaagaaatataaattatgaatattttttttctataatttttttaacaataagagtttgtgaaggttctttaggtttagcaattttaattataatagtttcgtgtttatggtaatgattatattttaactttttcttctttatgataagatttttatttagattaatttttttgattcctttatgttttaaaaaaaatttttgattaattcaatgattaatattttttttttacatttttattttttttttaattatggtagaggtttaaattatttctctatttcaaatattttaggtattgatttttgatcttatagtttaattttactaagattttgagtttgtactttaataattttagctagaggaaaattatataaatatggaatttattcaaatttatttttattagtattaatttttttaatattaagtttatatttagtattttcttcattaaatattttcattttttatttatttttttgaaattagattagtaccagttttattattaattattggttgaggttatcaaccagaacgtttagaggctggaatttatttattattttatactttattaatatcattacctataataattattattttttatttaaatgaaaaattttattgtatttcttttttattaatagatttaagtttaaatagaatatttatatatttatgtataaatatagtttttttttgttaaaattcctatattttttttacatttatggttacctaaggctcatgttgaagctccggtttctggctcgataattttagctggtattatattaaaattagggggttatggtttattacgttttatagtattttttaaatattttttatcattaaatatattttttatatcattatctttattagggggatttattgtttcaatgatttgcattcgtcaaagagatataaaatcattaattgcttactcttcagtttctcatataaggttagtattagggggtattttagctataaatatatgaggattttatggtgctttatttataatattagctcatggtttatgttcttcgggtttattttgtttagcaaatattttttatgaacgtattcatagtcgaagaatttatttaaataagggtttattaaatattatacctaatttaagattatgaatatttttattattatcttctaatatagctgctcctccatctttaaatttaatgagagaaattattttaattaattcaatagttggttttaattttttaacaatattattcttatcattaatatcatttttcagagctgtttattctttatttttatatagatattctcaacatggcatatttttttctggtgcttattctttttataatggattaattcgtgagtatatattattattattacattgattacctttaaatattatatttttaaaaatagaaatttttatataaaaaaaaaaaaaaagggcggccgccctttttttttttgacttgttagctgtatgtgtgccaaatttcatgtaaatccaagtggttctttaaaatgtagaggttgtgcaatattttacagcttgtgttaaagttatcattaatgaggatcatgttgtatatttttctattggtgatacctcagtagaactggatgacaactgtattggacttaactctttatttgctagaactttaaatctagacaataatatattagtaagagtatctgaagtcccttccttcccttcagtgtctagtcttaccgtttttccagttaatcgaaatgaatatgaagtgatggagatgttagctgataacattcaggatacgttacttagtcaaattagggtggtttatacaggacagaaaatagtaatatggataggaaataatattaatgtgactatatgtgttggtaatgtgaatccagtgtctcctggtgcaatagactttttgacggaagtacatatagaagaatcctttcacaagcctttggaagataatactgtaacagctggttccaaccagatcgctgatatatccgatttgaaactattttccaattttattaaagcttctaatgcgacaaatccttttgaaaaatacatcactttaccaactgaattactttttagggttgttcccttaaacaaagtgcctttttctgataaatctttactctcagatcttccatttactatatatntatttcaagatgagacatcagaagtcatatcgccgtgtaaaatatttcgactgagttnattnactaatgatgtttttgc

SEQ ID NO: 56 - DNA, 1819 bp, Diabrotica virgifera
ctagatcgcgagcggccgccctttttttttttttttgtggtttaaattatattggcaaacattacatcattataactaaaaaaaaaaaatctaatatgttctaatgatttatgacttcttagttatcgggttcacaggagtcaaataaacccttgtttcggatttggttgaaggacttctcaatatcatatgtcctgtaaaatgcagcataatccttctttctctgatcattgacaaacactttctgggctatggcagctgcagcagccatagtggcagcaatgataatattccatttaatttgtccagctaggagacctcttagttggggttttgttgttttacttacttcaccacccgttttccaaacgagtgaagaaggttggtttgaacatttccaaaaagtttacctgcaaccgtcgaaatgactacctcttggaactatcctgatgctgcactcagagctgaactcaagaaaatcgctgatgctatcaccgctcctggaaaaggtattttggctgccgacgaatctaccgctaccgtaggcaagcgttttgctgacatcggagtcgaaaacaacgaagagaaccgtcgtaaatacagacaacttcttttcaccaccgatccagccattggacaatacatttctggtgtaattttgttccacgaaagttttataccaaaaagccgatgatggtactccattcccagaacttcttaaacagagaggaatcattcccggcattaaagtcgactctggtgtagtacctctcttcggcagcaatgacgaatgcaccacacaaggtttggacgatttggccaagcgttgcgcccaatacaaaaaagatggttgccacttcgctaaatggcgttgtgtgttgaagatcagtgcacagacaccttccatccaatcactcattgaaaatgccaacgtactggctcgttatgcgtccatctgccaggccaacagaatcgtacccatcgtggaacctgaaatcttacctgacggtggacacgaccttctcacctgtcagaagacaacagaaacagtattggcatacgtctacaaagctcttgctgatcacaacgtctacctcgaaggaactctcttgaaacccaacatggttacagcaggtcaatcctctgcaaacaaagccacaccagcacaagtagcagaagccacagtaaccgctttacaacgcagattgccccctgcagttcccggtgtcaccttcttgtctggaggacaatccgaagaagaagctaccgtcaacttaaacgccatcaaccaattcccaggaaagagaccgtgggcgctaactttcagttatggacgtgcccttcaagcttccgttctccgcgcctggggaggaaaagacgaaaacgtcaaagctggacaagaagaattgatgaaacgtgcgaaggctaacagcgaagcttcccttggaaaatacgtagctggtagtgtgtcaggaaaagctggagatgcaggtctcttcatcaaagatcacgcctattaagcaaatcctcacaaatttgttgtgaatgtaacgttattagtgaaaaacatgttttagatctacattgaacaaacccaaattcataaagtctgttatatatattttatctgttatcgtgtatatacaattttgtttagaaatttatacaatatttattgtggactattatttataggtacacgtcgtggttgtactttattttatgaatcaattgttaatttcttagaacatctatttgtggaagtgaaattgaaaaataataaataataaatgtcttatgaaaaaaaaaagaagaatag

SEQ ID NO: 57 - DNA, 1403 bp, Diabrotica virgifera
aacacaatatcgtgaacttgagatttgtccatcttggcatccctgatggccttttctacaggttccatggtagatctgaacaaatcagcgttcagttcttcaaatctagccctggtgattgaggtgtagaagtcaattttttttttttaaaacaacaggtttttattcaatttttttatataatataatttgtttttaaataattacaaagcccaaactcttacgtaatcaaccttaagatgtgagtcatctgagttcaaattccaggttggtttccatttttgattagcttgccagaattttgtcataccctgacggtaaggttcagtgctagtccagggtttcttataagctttattgtcaaattcatcgttgaaataagctcctccaatagccaaattaattataagatggaactctttgtcaaatggagccattctagttcctccagaccatgggtttggcaatccagatggtccaagatcaccgtattcccagaagcctccagatgggggtgtaattgtaccaagttcttgatcatcgcaggaaaatttaatatgttcaggcgtccattccacttgatatctatggaaagcgttatcccaaccaccgttataattgatcttttcccagtgagtcttcagttgtttgttgaattgtggagtaggtccccaatgtagagtagatgattctgttgcagttccaacgttttgtccattgggggcataatactgacggtttcctctactttccatgatgtcgatttctccagatgctggccaatttccatactcccagttagttggtaacatccagacagctggccataaccaatctccagatggtattttagcattaacttcaaccctgccgtatttaaatgagaatgagtgcaatgtcctcatacgagcacttacgatgggattgactatggcattgggtgaaccagttcttctgcaaccttcgttgtcgccacctgtgcaggcagctcctatatcaatagtaccagaatataagaaatcttctccatattcatctgcgacaaaagtgggtttgatgtgtaattggccgttggaggtatagctgttacgtctatcatccgtataccattcaaattcgttgtttccaccaccagataaggtttgctcatggtgccatttggatgtgtccaaaaaattgaagttatcttcaaagatcagttgaccagaacagagactcttgttcttgggtgcgtgtaaaccacttgcagttgttatcgaatttttaagacatacggaatgtacaccgttaaaaagtatcgcggaaaacgcgaacagtataagaatcatcgtatctgccgattttttttttggtggactatgttaagacaatctcctagctaacgcttatatacaatcgagatc

SEQ ID NO: 58 - DNA, 1811 bp, Diabrotica virgifera
cccacgcgtccgctgaattcgaaaggaaggaagtaacatctaaggtgaggtagcggataacatcttccaccggcccgaacatcatggctgaagcggagcaacaacaaacagcgccagaacaaccttctgttttgggactgccttaggcagtcccaaaacagaaggaagtacttgcaactaaggtaactggcacagtaaaatggtttaacgtcaaaagcggttatggatttatcaacagaaatgataccaaagaagacgtttttgtgcaccaatcagccataataaagaataacccgaagaaagccgtccgatcagtgggcgacggtgaagtcgtagaatttagcgtagtcgtaggtgaaaagggtaacgaggcggccaatgtaaccggccctaatggtgacccagtaagaggttcgccttatgctgccgaccgaagaagaggataccgccagtggtattacccgagaggaagacgtggacgtcgtggcggtagccgaggcggcggaccgccaagggaaagccaaagtgaaggcgaattaaaggatggggtacaatcaggcggtgaaggcggccaaggtggccaaggacccccacgtcgttatgcaccaagacgcggacgtggaggatattcatattacaggggaccctatcgcggaccgccaggagaattagaacaaaatggagatgctccccgtggtcgtcgacccccacgtggctttttccgtcgtaattatcgtggaggtcgcggcggcgcaagaccacgttcccaggacagccagggccaggctggagagctaaacggtcaagaaggtggaccacgtggacctcgtggaccacgctaccgcagacgtggcccagcccgtccaagagccggtaactctcagtcagagtctgcaggagggaaccaaccaaataccaaggttcccgaaaaagctgtatctgataagaccgaagaaagtcaaccagtgcagaacacaactacagagagcagtgcttaagcgtaatcgcgctcaagtccatcactctataatcataaaatatttaacaacgttagcgcgtgagtttgtaaaagtaaaagcagacaaaaggcatttcatggcgaatgtttgtaccactaataatttttgtcaattcatctgtaagaaaaaaaaaataccagcaaaaagaatttgctacagtttgacgccgcaattttcaactggggtttcgaaaacatttttgatactttttatattcccattgatgtttttatacagagatttgtaaattgtagataagcaaattgcaactcgtttgaaaatggcgacaaactgctttttgtatttttttgtaacgtgcatgaaatgtcttgagaccttatgtcatgctgcaaaatttttccttcataacaataaaataaaaaaaacattgtaaaaattcgacgccttgtcttgtcaacattgacgagcgtcgtaccaaaaaaatatgattgcaacatctaactttgaaaagtcttttccatcttgtgagcaaaaggaaaagaaccaaaaaagttttaaaaatacaaaaaaaaatccgtaaaagtataaacacaggacagtttattttcgacttacattatgggtaacatgattttctcgacatttgtaaacagtaatctcatgtcaaaatctttgggtgctagtcattaagtattggtgtcttttctttattgcgttactgtagtgtttgttttagataactacaaatatacagtaattgggagttctttttatttatttatttttttcgctattttgttcaatataagtggaaaataaaaactgttctag

SEQ ID NO: 59 - DNA, 1976 bp, Diabrotica virgifera
ccttctcgtccggttatccaatagtctcactaagtacattaaaaaaaaaaacaaaatgtctcaaccagtggttcaacctcttgagactgagactagctctattcttactagtaatataccactaattttgattggaattatctcagttttattaggataccaatactggtttaaaaaccaacgatatgttcagatgggcaataaattcccgggacctgccactttaccattcataggaaatgctcacttagcctttggaaaatctgctcatggattgtttgaactggccatggcatattataaagaattacaaattgacgttggtaggatttggcttgggcctagattgatcattggcgttgcaaatgccgatgatatagaaattattttaggcaatagtgttcatttggaaaaatctcctgactacggtttattcgaaccctggcttggtgatggcctactcattagcaaaggggaaaaatggaggtcccacaggaaaatgattgcaccaactttccacacctcaatcttaaaatctttcatgccagtatttaacagaaatgctactgctttggtcgaaacatttagaaaggaacagggaaaagtattcgattgccatgattacctcagcagtacaactgtagatactttgctagaaactgctatgggtgttacaaaagaacacgacagcaaagctggattcgattatgccatggctgttatgcggtacgtatcaagagtggacatactatacagatataaaaaattaacttaatcttctttacagaatgtgtaacatccttcatcttagacatatgaaattctggttgagacctgacaccatttttaacttcaccaaactgagtaacatccaagtaaatcttttaaaagtcattcacgatctcactaacgggactatcaagagaaagaaggcaaactattttgaaagagaaaagtctggagaaaagagtttgtatgaacaagcagtcaagacgtccaaatttgacgaaaaacaaggaaaccttattgaaactcgcgatctaatgtcaaatttattaagggatgatttggatgaaaacgaggaaaatgatgtcggtgaaaagaaaagattggctttccttgattatcttattgaagccagtcaaaccaaaggaaatgcacttagtgataaagaaataaacgaagaagtgaataccattatgtttgagggtcacgacacgactgctgctgcttccagtttcgtcataagcttattgggtatccatcaagacgttcaagaaagagcttttaatgaattgaaagaaatcttttccgacaatttgcaccgacctgtcacatttaatgacacgcttcacatgaagtacctggaaagggtaattttagaatctttgagaatgtatccaccagttcctatgattgcaagaaaagtgaacgaagatgtaaaactggcttctggtgactacaccattcctgcaggaaccactgtaattgtatcccaatacattctccatcgtaacgagaaatactataagaaccctacggtgttcgaccctgataacttcttgccagaaaaatgccaagaacgaccatactatgcttttattccattcagtgctggtcccagaagttgcgtaggaaggaaatacgccatgctcaagctcaaggtactccttgctgatgtcatcaggaaattccacatcgagtcagtagataaagaaacagactttaggcttcagggagatatcattcttaaaagggaagaaggatttagggttaaggtgactgaaagggcttgaaatataaattaattgtaaaatatgggtcgaattatttgtataagcatgtctatatattcatctatacatactgttttacttagaaagtaattttattgtgttactaaaattagcgattctattcttactcttatggatctaataataaattatatttatttttaaaaacccacgcgtccg

SEQ ID NO: 60 - DNA, 2121 bp, Diabrotica virgifera
aaaaataaatgcagatttaaagaaatttaaattttaaacgcggcctactgcgaatcaacaaacagggtaaattttcgatattttgcttcacataagagatatcggaaaagctatttgaaaaagttgttctaaatattattctgccctacatagcaggtttcatgacaaaattcgcacctttagtttcttcattatttgtaatcagggccctaaatggtccgtcaggacaggtcctgactaaaaataatgaagaaactaaaagtgcgaattttgttatgaaatttggtatgtggggttgaatgatattttgaacaactttttctgataagtatttaaaatttaaattttagttgagtgtattaaaaaatgtttacttactgacaaacctcaaatctgtatttattttgatagccgaaatgtagggcgtcttcatctttcatgcgacacactgtataatctcttgaccatagctctgaagatggctttgtaagctgccagcgctcagctggcaattaaatatttttacacacttcaaaaatactttgcttttcccattcattcatatttatttttatcactttctccccgagttaaattagccagaaaatttagcctattgagtaggtgatgaagcatattttctttgtggcattttaagttaaaatattatgttattcaactgtatattatggagatattaacagttttcccttttgttccagtactaaccaatcaacatgtgtgaagaagaagttgccgctttagtcgtagacaatggatccggtatgtgcaaagctggttttgctggggatgatgcacctcgtgctgtattcccttcaattgttggacgcccaagacatcagggtgtgatggtaggaatgggacaaaaagattcctatgtaggtgatgaagctcaaagtaaaagaggtatccttaccttaaaataccccatcgagcacggaatagtcacaaactgggatgatatggagaaaatttggcatcatacattctacaatgaactcagagtagccccagaagaacaccctgttctgttgacagaagctcctctcaaccccaaggccaacagggaaaagatgacacaaataatgtttgaaactttcaacaccccagccatgtatgttgccatccaggctgtactctccttgtatgcatctggtcgtacaactggtattgtgttggattctggtgatggtgtatcccacactgtcccaatctatgaaggttatgctcttcctcatgcaatccttcgtttggacttagctggtagagacttgactgattacctcatgaaaattttgactgaacgtggctactctttcaccaccacagcagaaagagaaattgttagagatattaaagaaaaactctgctatgtagctttggacttcgaacaagaaatggcaacagctgctagttccagttcccttgaaaagagttatgaacttcctgatggacaagtcatcaccattggtaatgaaagattccgttgcccagaagctctcttccaaccatccttcttgggtatggaagctgctggtattcatgaaacaacctacaattccatcatgaagtgtgatgttgatatccgtaaggacctatatgccaacactgtactctctggaggtaccaccatgtaccctggtattgctgatagaatgcagaaagaaatcactgccttggctcctagcacaatgaagattaagatcatcgccccaccagaaagaaaatactctgtatggatcggtggttccattttggcctctctatccaccttccaacaaatgtggatttccaaacaagaatatgatgaatctggtccatccatcgtccacagaaaatgcttctaatttgtttttgtccgcatttatattctttatttctatttacataagcccgcccattttccgggcgcgaactgccgtgtttatcgtatgggatcgagaccataaaatatccacactaggccaaagtattactatcttaatttttgtaatttattacctgtgcaaagtaagactattatattattaggctaatactatgggaaaaaaaaaaaaaaagggcggccgctcgcgatctagaactagtcggacgcgtggg

SEQ ID NO: 61 - DNA, 2178 bp, Diabrotica virgifera
attaaactcttttttctgccccccttttttttttttaaattttttttttatttttttttgggggggaacctttttttatcatttggggaaggggggtttctctgttttttttttggttgggggtgtaatatttaaaatatatttttaaaacattctaaaatatcccctagggaatcaaattttttaggggttattttttttttgggggccccccccgggggggggcgggagggaatgcccattaagttcgacatttttcccaaggaggtttgttgtacttttgttccaggccacatttcccctttcactttccccggactaagttctcccgggttgggttgttcagagtaatgtagggaaaggtctgggtttgcttggtgggaatggtagtgttacgtttgatgagggcagtcataacacctccggcagtttcaatacccaatgaaagtggagtgacatcgagcaagagcaagtcctgtacttcctcagacttatctccgtgcaagatggcggcttggacggctgcaccataagcaacagcttcatcggggttgatcgacttgttcaattctttaccattgaagaaatcttgcaacagtttttgtacctttggaatacgggtagatccaccaaccaacacaatatcgtgaacttgagatttgtccatcttggcatccctgatggccttttctacaggttccatggtagatctgaacaaatcagcgttgagttcttcaaatctagccctggtgattgaggtgtagaagtcaataccctcaaatagagaatcgatttcaatgctggcttgggttgatgaggaaagggtacgcttagctctttcacagcttgttctcaaacgacggagggcacgtttgtttgtggtaaggtccttcttgtattacctcttgaattctccaacaaagtgattgaccattctgttgtcgaagtcttcacctcccaagtgagtgtctccagcagttgatttgacttcaaagataccatcttcaattgttaagattgatacatcaaaagtaccaccacccagatcgaaaatgaggacgtttctttcaccttggccctttttgtctaaaccataggcgatggcagcagcggtgggttcgttaataatacgtaatacctggagtccagcaatggttccagcatctttggtagcttgacgttgtgagtcattgaaatatgcaggtactgtgatgacagcgttggtgacattctttcctaagtatgcttctgctgtttccttcatttttgtaaggaccatggaactgacttcttctgggtagaaggatttgtcttcgcccttgtatgcaactttaatctttggtttacctgcatcatttactacttcaaatggccaatgtttcatgtcagactgtacagcactgtcatcaaagcgacgcccaataagacgtttggcatcaaaaattgtgttattggggttcatggctacctggttcttggcagcatctccgatgagacgttctgtgtctgtgaaggccacatatgatggtgtggttctgttaccttggtcgttggcaataatttcaactttgccatgttggaaaactcctacacaggagtatgtggttcctaaatcaatacctacagctggggctttagccatcttataattaattatttgcagacaattcttaaataaatacttaaattacgtgtgcactacagcaatgacgttacgtgaaaataaatttggattaaataacatggctggagctgcaaaacttgcaactggattaactggccttactgtggccaaaaatcctcaccatacattaggtattttatacagtaaaattttgaggaccttacaaaaaatgccagaggatgccgcctacagaaaatacacagcagacataataaatgagagatcaaagattttgaagtcaactactgatgtcattgctatcgaaaaacaaataggatgtggacaaattgaagaggtaattgtacaagctgaaaatgaattaatacttgccagaaaaatgttgaactggaagccttgggaacctctattaaaagaagctcctccaacccaatggacttggccaccagctcaaccaaggagttaatttgttaaatgtgtaaaaaatagaaatttagcacctttgtaaatatttagaataaatacctaaaatttaa

SEQ ID NO: 62 - DNA, 2527 bp, Diabrotica virgifera
gacgtgaaaccaacattgtcaccaggtactgcttcctggagggcttcgtgatgcatttcaacggatttacttcagtcgtcaaattggctggagcgaatactacacccatacccaggttcaatacaccagtttcaacacgacctaccaggtactgttccaataccacccaattttgtagacatcctggagtggaagacggaggggtttctcagttggacgagatgggggaaggatagcatccaaagcctcaatcaagcactttccttcagcttttccttctttacgttcgatttgccatcccttgaaccatggcatcttgtcagatccttctaaccatgttgtctacgtgccatcctgaaattggtacgaaagcaacggcagctgggttgtaaccaattttcttgatgtatgaggatacttccttcttgatttcctcgaaacgtgattcactgtatgctggttcagtcgagtccattttgttgacaccaacaataagttgttttacaccaagggtgaaagcaagaagagcatgttcacgtgtttggactagttctagatcgcgagcggccgccctttttttttttttttactttattaatacaatttattagaaaacaatatatagttacagtcacaatatattcattagtttaatgttgcttgcgcctgaaactgcaaccttctgtaagtctcgctttgcctccagtggaagtgcaaaggattgtagaacaacctttgcatgggactgcggactgggcgtgcgagaatattgttgaaattgcataacagccgggacacttaacatccataaagtaactgttaggatgctgaaccaaccttttcaatttgtgggatctcctctgtttttcggcagaaggatgcaataagtcgactgctaaaggcatcttttttacttattttaggactaaaattcacaaaaattcggacgcgtgggttttctgtctagtgagcagtgatcaaccacaaaagacaacatgtgtgacgacgatgttgcggctcttgtcgttgacaatggatccggtatgtgcaaagctggattcgccggagatgacgcaccccgtgccgtcttcccctcaatcgtcggtcgcccaaggcatcaaggtgtcatggttggtatgggacaaaaagactcatacgtaggagatgaagcccaaagcaaaagaggtatcctcacattgaaataccccattgaacacggtatcatcaccaactgggatgatatggaaaaaaatctggcatcacaccttctacaatgaactccgtgtagctccagaagaacacccagtcctcctcactgaagctccactcaaccccaaggcaaacagagaaaagatgacccaaatcatgtttgaaaccttcaacacacccgccatgtatgtagccatccaagccgtactctccttgtacgcttctggtcgtaccactggtattgtattggactccggagatggtgtcacccacaccgtcccaatctacgaaggttacgctcttccccacgccatcctccgtttggacttggccggtcgtgacttgaccgactacctcatgaagattcttactgaaagaggttactcattcaccaccaccgctgaaagggaaattgtccgtgacatcaaagaaaaactctgctatgtcgccctcgacttcgaacaggaaatggccaccgctgctgcttccacctccctcgaaaagagctacgaattgcctgatggacaagtcatcaccattggtaacgaaagattccgttgcccagaagccctcttccaaccttccttcttgggtatggaatcttgcggtatccacgaaaccgtatacaactccatcatgaagtgcgacgttgatatccgtaaggacttgtacgccaacactgttctctccggaggtaccaccatgtacccaggtattgccgacagaatgcaaaaggaaatcaccgcccttgctccatccaccatcaagatcaagatcatcgctcccccagaaaggaaatactccgtctggatcggtggatccatcttggcctccctctccaccttccaacagatgtggatctccaaacaagaatacgacgaatccggcccaggaattgtccaccgcaagtgcttctaagctatttaatcaattcatacctaataagctatttttcatgttgtttgtactgtgtttacatctttgcagttcttaaataatatgcgaccgtggttgtaactgccagacagacttttaagatcttataacaccttataattatttattatttgttatatttacttactataactattttgtaactgggcaggtaaataaatcctatctagtactaaacctgcctattatttcgattaagaacgagaatatgatgttatgttaatttttttaataaaattttggcatagtttatatacaatatacaataaaattcaaattttattttaaaaaaaaaaaaaaaaaaaaaaaaaaaaaaataaaaaaaaaaaaaaagggcggccgctcgcgatctagaactagt

SEQ ID NO: 63 - DNA, 2411 bp, Diabrotica virgifera
gtggtatgggtacatttctccatattccgctgtcaatcatacccgggtgcaaacaattgaccgttactccagtgccttccagtcttcttgcaagttctaaggtgaaaaatatattggcgtatttggatacatagtaccaatattcaggacaccaagtactgctgggattgaggttgtctagatttagtgaagcgagtctgtataattctgaggctactacgactattctggaaggtgctgaacgtttaagtagatcaatgaggagatgtgttaacaaaaatggtccaaaatggttggtcgccattgtgagttcaataccatcttctgattttttgagtttattttccgctgtacctgcgttatggatcaacacatccagtttggtttctgtacggttgatatcttcggcgaattctcttattgatttctgagaagggagatcaagtttctttacgatgatattttggtttttggtatcttgtgctaattcgtctcctacttttttggcagactcaacatttctgcaagcaataatgactttagctcctcttttcgccagttctcgtgctgtttcttttccgattcctcccgtcgctccagtaacaattacagtttttctctccattctaactttttcgtggaagaatccgcaggtcacataagcgtagaactttagcagcgtagttctagatcgcgagcggccgccctttgtttttttttttatttgtccaagtttaatttacagatcacaaataatgcaatgcaagtaataagtccattagttattaaaaatacattgatactccaatattaatatataaaagaaacaaaacatatcaaaattatttaagtagtggagtccaaatagactatttcttcttttgggctttttctgcagcttttgtgacttttccggcgctgggatctttgaaggcaacgctcttgatgactcctactgcaacggtttgcctcatgtcacggacagcaaaacgtccaaggggtgggaattcttggaatgattctacacacatgggcttggtgggtaccaagttgacaatggcggcatcaccagatttgatggctttgggattttcttcagtggtcttaccagaacgacggtcaaccttttctttgatttcagcgaatttgcaggcaatgtgagctgtgtgacagtcgagtacaggggtatatccgtttgagatttgaccagggtggttgagaacaatgacttgggcagtgaagtctgaagctcctctgggtgggttgttcttggtgtctccagctacgtaaccacgacgcaattctttaacagagacattcttgacgttgaaaccaacattgtcaccaggtactgcttcctggagggcttcgtgatgcatttcaacggattttacttcagtcgtcaaattggctggagcgaatactacaaccataccaggtttcaatacaccagtttcaacacgacctacaggtactgttccaataccaccaattttgtagacatcctggagtggaagacggaggggtttctcagttggacgagatgggggaaggatagcatccaaagcctcaatcaagcactttccttcagcttttccttctttacgttcgatttgccatcccttgaaccatggcatcttgtcagatccttctaacatgttgtctccgtgccatcctgaaattggtacgaaagcaacggcagctgggttgtaaccaattttcttgatgtatgaggatacttccttcttgatttcctcgaaacgtgattcactgtatgctggttcagtcgagtccattttgttgacaccaacaataagttgttttacaccaagggtgaaagcaagaagagcatgttcacgtgtttgtccattctttgaaatacctgcttcaaattcaccagtaccagctgcaacaatgagtacagcacagtcagcttgtgatgtaccagtgatcatgttcttaatgaaatctctgtgtccaggggcatcaatgatggttacatagtatttagctgtttcgaatttccacaaagcaatatcaatggtaataccacgttctctctcggccttaagtttgtcgagtacccaggcatatttgaatgaacctttacccatttcttgggcttctttttcgaacttttcgatggtacgtttgtcgataccaccacatttgtaaattaaatgtccagtagtagtagatttaccagaatctacgtgtccaatgacaacgatgttaatatgaatcttttctttacccattttgattgtttggaaataaagtaaatgcaactgttcgaaattaaaacttagaataaaaggaaacactacttgggatgtaacaccaggcgcgaggtccacaccccacgacgagcaaacccacgcgtgggcggacgcgtgggcggacgcgtgggc

SEQ ID NO: 64 - DNA, 1758 bp, Diabrotica virgifera
actcgcgggctgtctttcttagtaagtaaatgtcacctctagggtcgaggtgaaaaaagtaaattataataaaattacgaaaaatttgaataataacaattttttaacgaagtccgtgcttcttattaataccttcaccaaaagcaacaatgcagtgttcagtttttaaagtattatcgtccacaataaagccaactttaaggcacaaccaaagaatattaggaaacttacaaagtcgtttatattcaaacgatggagatgctgacattgtagtgattggttcaggaccaggaggttatgtagctgctatcaaagctgcccaattgggcatgaagaccgtttgtatcgaaaaaaatccaacattgggaggtacgtgtcttaatgttggctgtataccatccaaggctctattgaacaattcacatttctatcatatggcccattctggtgaccttactgagagaggcattgaaactagcggtgttaacttaaatttagatgcaatgatgggtcagaaagtcaaagctgtcacaagtttgacgggaggtatcgcccaattattcaagaaaaacaaagtgacgctcatcaaaggacacggtaaaatcaccggaccaaatcaggtaacagctgcgaaagaagacggttccaccgaagtagtcaatacgaaaaacattctgatcgctacaggatcggaagttacaccttttccaggaattgagactgacgaagaaaccattgttacttctacaggagcattgtcactcggcaaagttccacaaaggcttatagtcatcggtgctggtgtcatcggtttggaattgggttcagtttggtcccgtttgggatccgaagtaaccgccatagaattcttgcccagcatcggcggtgccggtatcgacgcggaggtggcgaaatctttgcagaagattctttcgaagcaaggtctcaagttcaagctcggtaccaaagtgactggagcctcaagagaaggaggtgttattaaagttaatatcgaagacggaaaagattcgagcaaaacggaagtgctcgactgtgatgtactattggtgtgtgtaggaagaaggcctttcactgaaggattaggtttagaagaaatgggaattgctaaagaccagaaaggaagaattccggtaaactcacacttccagactgttattccaagtatttatgccattggtgattgcatacacggtcctatgttggcacacaaggctgaagatgaaggtgtcgcctgtgtggaaggtttacagggtggtccagtacacatcgactacaattgcgtgccgtctgtaatctacactcatccagaagtcggttgggttggaaagaccgaagaagatcttaaaaacgaaggtattgcctacaaagtaggcaaatttccgttcatggctaattccagagcaaaaacaaataacgacacagatggatttgttaaggtactagctgacaaagctaccgataggatcctaggaacacacatcatcggccccggagctggcgaactcatcaatgaagccgtacttggtcaagaatacggagcatcaagtgaagatatcgccagggtgtgccacgctcatcctacctgctctgaggctttgagggaagctaatttggcggcttattgcggaaaacctatcaaattttctaattcgtaaatgcaatatcatctcatcacacctttttttttaattttaacttttatgtacctaccttcttttgttaagcggtcattaatct

SEQ ID NO: 65 - DNA, 1213 bp, Diabrotica virgifera
cttgtccggaaaagagtacatttttttgttcaaaacactttatttaaacatataacttgatttttaaaaaatataaggtccacacacaaacatgattttcaggtttctaatgtttttcttttcagaatatttgaggctatgcgtgcaaaaagggcgaacttaacttttggcgttttttctttttttaacattcttttctatgtttgtcctttaacatgacaaagtgattcattaattcataatcataatgattgtcttcaattattattgaattaaatcttttcgaacgaattaaattaataaaaatgaggtttttcagttcacctttctttcaagcatagccgcatttgtatgttctagatatatttgacaattccacatctccaaaggtaaaggtaattatcgtccaaaccaacctatttcctactttgtttaattgcttatttctgtctgtcatatagcgcaatgaaaattttgctagcgaaactaccaaggccgtggatagtagacgagaagaaggatgatgggtacactgctctccacttagctgccttaaacaaccatgttgaagtagctgaacagttggtgttaaacggaaaagccaatatggacctacagaatgttaacttgcagactgcgcttcatcttgctgtggaaagacaacacactcaaattgtcaggctgttggtgagggagggagctaatttgaatgtagcagacaaagacggggacactccactacatgaagccttacgtcaccacactctttcgcaactacgtcaactacaagatgtccaggacgtggggaaactgcttatgggactgggaacacaaggatcagacaaaaagtcatcagcgagcatagcttgctttttggcaggtaatggagctgacctaacccatcaagaacaagaaagacaacaccctttggacttatgtcagaccctaacctctgcaaaattctgaccaaatgccaaaaagaaaaacaaaagggggaaatgggaattgggttcccacccaaaacctcaaaaactccaacaaaaacctcaaaattaaaaaaagggtttgggcttgttcgcaatgccaaaaaaggaaaaatttcccttccccccctttttaaatctttgtttatttgtttttttccaggggggggcccccaaaaaagtataaaaaaaggccctttttttttccaaaaaaatacttgtcccccccc

SEQ ID NO: 66 - DNA, 776 bp, Diabrotica virgifera
cccacgcgtccggtcagacataatgtttagtgtttacttttttgtaggactaacgattttagcggctactcaagccagtagtcctgcaaatccctcggctgtggagcttctacaagatgtgtattatgattgcttgcaggatttttcttttgggtgcgttaaacccaaaactttgcactggttgagcgaggttactagcaaccaaaatattagaatcaccgacaatttgatgattgtaaagaagggtggtgcagaaagtgtccaggaacgaggattttcagatgatatatttgagaaatttgaagatttccttcaatcccacgagttggtaatgtctgcaccagaattcctgcctagatctttagacaccaaagaaattagagttcctttagcagtaacaggtcgttcgtcaaaaatcgtgaagaaagttatcgtaccattcttgttgggacttaagtttaaaacggccatattggtacctcttgccttagctttaattgctttaaaaacctggaaagccctaaccttgggattactgtcgcttgttctgacaggagctttagttatttttaagttcaccaaaccaaaggtggttaactacgaagtggttcacgtaccccatcatgttgaacatcatgtggatcatcctccttcatctggatgggagcatccaggttacggaaggcaactgactgcaaatgaaatggcttacaacgctcatctcgactagaaattctgttttattaatttattaaataaatttatttattttctta

SEQ ID NO: 67 - DNA, 1821 bp, Diabrotica virgifera
agctaacttcacgtttgttcctttcctcatggcaaattattaaaaggtgacgtttgccgtcttcatttctgtttaaaggaaaaaaacaggacagattttagcaaaatgtccaaacgaaaaggaatggaagagtctgacaaactcacccgtatagccattgtcaatgcagataaatgcaaacccaaaagatgtaggcaggaatgcaagaaatcttgtccagtggtccggcttggaaaactgtgcattgaagttgtaccaaacagtaaaattgctaccatatctgaggaattgtgcattggttgtggtatctgtgttaagaaatgcccctttgaagccattgctattattaatttaccaagtaatttgcaaaaagaaactactcatagatatggtaagaactcattcaagctccataggttacctatacctcgtcctggtgaggtacttggactcgtaggcactaacggtattggtaaatctactgccctgaagattcttgcaggaaaacaaaagcccaatctaggaagatatatggatcctccagattggacagaaattctaagccatttcagaggtagcgaattgcaaaattacttcactaagattctagaggatgatttgaaggctcttataaagccccagtatgttgatcaaattcccaaagcagttaaaggcactgtgggacaacttctagacagaaaaaatgaactagacaatatgaatcaaatttgtgggatgttggatctgctgcacataaaagaacgtgaaatcgccgcattatctggaggagaactccaaagatttgcctgtgccatggtatgtattcagaatggagacatattcatgttcgatgagccttcatcatatctagatgtcaaacagcgcttaaatgctgccagaactatcagatccctgatagatcccagcaattctaggtttattattgtggtggaacacgacttgagtgttcttgactacctgtcagacttcatttgctgtctttatggagtgcctggtgcctatggtgtagtaactatgcctttctctgtccgtgaaggtatcaacattttcctggacggttttgtcccaaccgaaaatctccgtttccgagatgaatctttagtttttaaagtagcagagtcggctacagaagaagaaattaaacgtatgaaccactacgagtacccaactatgactaaaacgatgggtagttttgagttgaaggttgcccagggtcagttttctgattctgaaattttggtgctgttgggagagaatggtaccggaaagactacttttattagaatgttggctggaaatttggagcctgatagtggatcaggtgaattaccccagttgcatataagttataagccccaaaagatcagtcctaaatccacaggattggtaagacagttgcttcatgagaaaattagggatgcctatattcatccacaatttatagcagatgtaatgaagcctttgaagatagaagacatcatcgatcaagaagtacagaatttatctggaggagaattgcagagagtggcaatgacgctttgtcttggaaaacccgctgatgtataccttgttgatgaacctagtgcctatttggattctgaacagcgtttggtagcagctaaggtcataaaacggtttatacttcacgcgaagaagaccggtttcgtagtagagcacgatttcataatggcgacctacttggccgatcgtgtcatcgtattcgaagggtctccctcagtgaagacgacagcccacgcccctcaaaacttattggccgggatgaaccggttcctggaactc

SEQ ID NO: 68 - DNA, 1101 bp, Diabrotica virgifera
cgcattttctttcctatttgaactatctacgtgtggatgaatactgtggatcagttgatagtttattccattgcttcgatagaaacgttgatccagatgttaaatgctataatgatgaaaaaagcaagagacatcggtttgctgcactaaatttagcaattttgcactaccattttggacacattgaagaagctctagcagcacttagggaatctatcaagatatcccaagaagcgaacgacaatgtttgccttcaacatgctttatcctggctgtaccgacttactacagtgaacgaagacaaactgatcatccattgtatactgaagagttccgaattgaagttgagttacactgcttcactaggattgcaaacgtttggacagtacgaatgcttaaatacggggaaaacctacgccatatttgagactttaggccgaagtgatatgttaaactgccaacacaactacaaggacctcacatcaaacaattatgcaatgaaagcatccctgtggcagctctatggtaaaaacgagatgtgctctctttggagccagctcctactctaccaaaacatggactctcttacgcctagtaaaggttactatggagaaggattctgccttgcagtgtgtaatattgccaataatctaatggttgaaggcgagtatacattgggtcattgtgtcttgaattttgctaaatcaagatttcccaatgaaccgcactccgtcatttggaaactctgcgagaacatgttcctctaccaaatgtctctgtatcatgagcaatttgaagaagccgaagctgctgctcaaaagatcatggtgtttgataagtgggaggggtatctgagactgggagaggtacatttctatcaaaggaactacgtacaagctgatacttacgttgaaactttacttaaccagtacgagaatgataatacgtacaaatttagtgacagatattactacgtccgagccaaagttctcaagatggaaatccagtttgctaccacgtatccagacagtatctctgcgggcattatgacggtgcttaacattttgctaatgagtcacagcttctcatttgactaccatc

SEQ ID NO: 69 - DNA, 1763 bp, Diabrotica virgifera
  misc_feature (813)..(813): n is a, c, g, or t
attgaccatttgaaattgactagtatgttcagtgacttcattaacaaaaggtgcaatacaactttcataaaaataatatcatcataattatataattgttggcttccttttactgtatagggtccagaattattttttattacaaaaagaataatttgttagcaggaacagcttaagactttcgataggccatcagaaacgactcaccctgtaaacagccataacatgtgagcagtctttcaaaaacatccacactcaagcatgatagttaaagtatctggttggtaattccattgtaaagaatgatgaaaaaccactaaaaaaccaatcacactatctcaacgtaagtattggtgttacatcagatctactccgaatattaacatcaaactcatcataattccaaaaaaatgataaagttaaaaataagaattagtggtactaatggaccagtacattataaaattctttcgtaaaaatcggctcctttgtaataggaaacttgcataaaattttaaattcgaagaaaatgttataaatcacaacagaacataatttaaaacatgtatcaaagataaaaaattttgtttgtctttcgtttggcccgtaaagacgatcagaaaatcaaattataccagccaacccaaaacgcgtcgtgacgtcgccaggttatatgtttacattctgaaccaacaaagtaaacaaaattgtatataattttaaattagacattatatacgtcagtagaaaatacagttatgtgacgttacaagtgtttttgctcgtttgactattcatagaaaatttgtattntacaaagtggttttattttccacagtaaaccttcttttcttttccttcaataactatatcaaactccaaatctcacaaactggtatatattattacaatgacatacgataaatgttaatagaatataaatatttttcctttattccgcgacgaggtatactcaagtaggtggaggccaataaactaaagaagaagaatataacctaattataaccataaacggaaccatatagttaaactgtgtgacgtcatccgtttatatgtttacattcttccaacaaagtaaacataatttgaaattagacgttataaacgtcagtagaaaatacagttatgtgacgttacaagtgttttgatcgtttgaactattcatagaaaacttgtacttttacaaaatggttttattttccgtagtaaaccttctttcctttccttcaataactatatcaaactccaatgtcaacaaactggtatatattattacaatgacatacgataaatgttaatagaatataaatatttttcctctattccgcgacgaggtatacccaagtaggtggaggccaataaactaaagaagaagaatataacctaattataaccataaacggaaccatatagttaaactgtgtgacgtcacgggtcgtttgaactattttaaaatacagaatactttaaatttgtacttccaagttattatgaggttttgaagcgtaaaattttagatatctcatttttataaaaaaactgaacattattatgtaataaaaaaatgtgcaagttccctattggtgtaacaattgaatatgtgccttaaatgttaataaagttgtaattatttgtagttatgtttgtcgataaattttttctggatcaaagatacgttttaattgaacaatcctagtatattggcactcataaattaaacagatccttttcggacgcgtggg

SEQ ID NO: 70 - DNA, 1867 bp, Diabrotica virgifera
  misc_feature (1835)..(1835): n is a, c, g, or t
  misc_feature (1851)..(1851): n is a, c, g, or t
tggaaaagtgaaaattggttttttttcaattttttgaaaacttttaggagattttttatggaaaagggccatgtatcatttttatggcaggaacaacttaaaccaaatttatagtcaaatttgtccaccccataaaaaatttatgggattttgttccccttagcccccacttttgggtcggtccaaattattgattattgtggtaccattagttaaacacaacgtttctaaaacttttttgccttctaatattttttcgataagccagtttttatcgagatgcggcttcttttttaatatggaaatttttttttgtgtttaaactgacaaacaacgaaacatgttttactaaaaaagtgattctttttattaagttttttcttcgccatagcaaaatccctgtcacatggcatgtagaaatgtccctttatggggaaatttctactggttcacactttgaaatcgtcggaggtctgtaagtgctaaactgtatagttcttattctgaccaccacatatatcaaaaaaaatatggaaatagtaatccttgatggagttatagggcagtcaatgagggtatgtggctccgaattctatcctactatatcgatttacgtgatattttcacagtaagtagggaatagcccaagaaacaaagtccaccctatgccgatgtgtgcccctgtcctggggaacttgcataaaattttaaattcgaaaaaaatggtataaatcacaacagaacataatttagaacctgtatcaaagataaaaaagttttgtttgtctttcgtttggcccctaaagacgactacaaattcaacttataccagccaccccaaaacgcgtcgtgacgtcacgccgttgtatgtttacattctacgttgtatatacaattttaaattagacattataaacgtcagtaaaaaatacagttatgtgacgttaaagtgttctgatcgtttgaatattcatagaaaactgtacttttacaaaatggttttattttccgtagtaaaccttctttcctttccttcaataactatatcaaactccaatgtcaacaaactgggtatatattattacaatgacatacgatacatgttaatagaatataaatatttttcctttatttcgcgacgaggtataccaaaataggtggaggccaataaactaaagaagaagaagaacaatatacctaattataaccataaacggaaccatatagttaaattgagtgacgtcacgggccgtttgacctattttaagataccgaagactttaaatttgtacttctaagttctaagttattatgagtttgaagcgtgaaattttggaaatctcatttttatacaaaactgaacattatgtaataaaaaaaatgtgcaagttccctattattattgtggtaccattagttaaacacagtattttaaaacttttttgcctcttagtattttttcgataagccagtttttaacgagatacggcattttttttaatatgtttacatacaaattttatgggggtttcgttcctttaaaccccccaaatttttgtgtacgttccaagtaaactattattgcggtaccattagaacacattgtttttaaaactttttgtttcttagtattttttcgataaggcaccttttatcgagatgtggcttcttgtttaatatggttcaaaatatacctaaaaatgtaaattataaataaattttcatattattaccaggtctctataatcgtacttaaccatgtggtggatttgacaaatattcaaatatctcaaataaaactggcttttcgagaaagtactgggaggcaagaagtnttaaaacattgtgttnggctaatagtacctac

SEQ ID NO: 71 - DNA, 1237 bp, Diabrotica virgifera
tttcgacgttttgagtccccctgagtctaaaaagcaaataaaaaaaacatgtcggaagtatgtacgtacgtacgtatgtacgtacgtatgtcgccaccgcccagcaaaaactactggaccgattttgatgaaattcggtatgagtaagtttaagagaattttgtcgagaaactaagcttttaaaaaaaatctctcaaaggggggccgaaataggggggttatttagggcccatttttgcaaattttgacagaaataaatgaaattcaactcaaattaagctcatcgataggtaaataaaagtacggaatttgacatttccaaattcaaaatggcggccaacatggccgaccgcccccccgacacatttccctatctatctaaaaagtttttgaagataagtttaatttgaaaaagccgttatatagcctaaagatggggctataagaaagatgttatcgtttttcagaaaaagttacgggttgcctatatttaaggggtcaaattttgacataaatttgaactagattttctcaaaaatggctccaaggaatttttttattttttgacatattcttgatatcctatcagtaaattgaatgacattagtcatacgcctccccataggaggggagttatgaattttttatgaaaaaatattcgagtgcccgtaacttccttcttaatagaaaccaaaatttgaaattttgcagacatatatggtactttattatctattatcacaataaattttaccaaaaatatggcttccggttgaaccggaaatgaataaaaaatcttaatttttttagatacgccctgtatattttaacatattttgaaagaatgcaaaattacctttccaatgacataaaattcattgctatagctcaaaaactcgaaaagttacggtaaatagaaattttgctataatcttatgtgtgtcatcctctctcacgcgttcatagcagagcattattgtagggcagtcaatgaggttatttggctccgaattccatcctactacattgatatacttgatattttcacagtaagtagggaatagctcaagaaacaaaatctaccctatatactatggcgctttttatcttggggcggttcccacctcttcaagggggtggaaaatttgttggtcaaaataagcacggaagtggctaaagaacctatttctaagcaaaaactggtctatacttttttttgagaactcaatactttttg

SEQ ID NO: 72 - DNA, 1625 bp, Diabrotica virgifera
gcagaaggcaacatactatgggcagtcaatgagggtatgtggctccgaattccatcctactatatcgatttacgtgatactttcacagtaagtagggaatagcccaagaaacaaagtctaccctatggatataaaacttggaaagtgacaaaaaccaaagacaaattgcagctctttgttaacaaatacctacgaagaattgttcgcattatttgtcctagcatcatcagaagtaaagatctactccagctgaccgaacaaaagagggtatacaatgggcacttcacaaaagtaactccagtattgcaaagactgccatagaatggaatccccaaggaaaaagaaacaggggtcgcccagtacaaacttggagaagatcaatcatggacgagataagatgtcaaggaaagtgaggaaggatatggtgaagctctatgctccacctaggggttcaagaaccttatgtatgtaggtacctatatcctcagtttgctacattcacatacagttgatctcttgtgtccagaggacgatttacagtttccatattctcactctaataaaaaaaactgcgaaatagagtctctggtggacaaactctgtgaaaaactgaaggaaatcaattgcgaaatcatgtttcccactttcattcgtcggaagttatagcagaaactatctacaaatctaagaagatcacacctcaagaagatactaaaaagattacgttgctttctccccctctttgtccgcaataatcctccaaagaatcgaaatcacctcctcctcgtctccattggatacttctccaatcaagaactagaaagaattgtaaagtcggcaacggaaacaaatcccatgccaaagaaagtaacgatacaatgaaagcgctcacaaccaaagtaaacaacgtctcaactgttttgctcgcagtaagaacaacttgcataacaacgtcattttccatagctgggacctgagtttttaccctgccaacaaaaggttcgctgacaataatggaaagaggatcagttcgacaatgaggaatatttcgatcagtgcgtagaaattaatagaaacatttgggacaatgaagatgaacttgatatgtatgaggatttgcctgttgtcatcatagatttgctggattctccgactccaagtgatgatacaatggagatgatgaatatcacaaacaggaaagatactgagaagcgaatatttatctcttacgagacgaacattatgagctccatatggtcaactgatcaagatgtaacgattgacaataatttcaactcaaccatcgatgcctcacagaatgtcgccaataatacaaaactaactgtagacttccaattcagcgaaatatctatttacaatccatctgttaagtcctcgtttgatgattggccgccagctaattctatagttgaaaacgataccaacgctctattagaaaccaacaaggttttagacataaatatttttctccaatgatttccatagccttcatggtaactgaaccgtttggaaatggaagaaagatggacgcagaaaaggaaatatacgaaagagaaaaattgttggctttcaggttaatgaagttaaatcacaataaggagaac

SEQ ID NO: 73 - DNA, 1528 bp, Diabrotica virgifera
atttttgggtgtggaatattttcccaaaatttggggagaattaagagtttgggccgaatccaatccaaaataattggggttttttccccaatggttttaaattaaaaattaatattaaaaaataattattcccaaacaaattccaataaaatgtgaattcaagggaccaaaaactcaaattcatctccaaagtttataaaaatatctttttcttttaccattaatgcacaagttttttttattgaacatgttctttattaaattttattctgaataaatataatatgtgccatccattttagaaggcaagctataaaacttccgtctgtgtggcattgcaagggaaaataggtgccgtccttaaatggtcaactgtaccaagtgctacttagccaataaaaaatattaataatgatttgaaccaaattaaacttgtttttattacattgccactcaatccaaacaagttatgacaaacaaatattgagttatataggtattattaaatgcttaatatattttctacgtctattaactaaaaagatcccctccacgttccttacgtcaacacctaaccatttaaatcacaaaaataagagtaaagatatgtacaaattaatttttctatggtgctatgcactattatatacataagccttaggggtacatacagttgtttatatacaattataaaattccaaatgctggtaatgattgttttttatgagatatcaaagctgatttcttcatcatcatgtatatgtagtattttaccttaactctttagctcataaatcattatacgatacctatatcgcaggtcgggaacaagaattacgtaactgcaaaaagccaaatttctcacgagagcaaaaaaacgatttttaaatatttaaaatagggattaaatgaggagtgatcgtccaggagcatcggtatggggtttattcttccaatgatggcttttatttttatctctattggttcgaatttccttatcttaatttaattcccacattttcaaccctatctacagttgcgtcattattcatctaaaattttttaaacatttaaaatagtgattaaataaagagtaaccgtcaaggagcaacggtatggcgtttattcttacaatgatggcttttagtttcatccttattggtctgaatttcattatctcccagcaatttaatccccccattttcaaccatatctacagtggcgacatcttaaactttttctgtacaaaaaaaaagatttttaaatatttagtatgccgtttattcttacagcgatggcttttattttcatccctattggtccgaatttgaagaaacaaggtctgaaatggtgcatatttcaataacgacgcaactacccttagggcagtcaatagggtatgtggctccgaattctatcctactatatcgatttacgtgacagtaagtagggcgcagagggtggggcggcgcgggtagtccgcgcgccgtgcacggcggggcctaccatgcttccctatgaggggggg

SEQ ID NO: 74 - DNA, 927 bp, Diabrotica virgifera
  misc_feature (835)..(836): n is a, c, g, or t
aaataataaaatataaaatagtttattccaagttaaataaaatgaccaatactcctactttaagcaattccaatggagttgaagatgaggaaatgcctgatactaataatgtttttaaaactagagaatttttgtacaaacttattataagtcaattattgtacgatggatatcaaaatgtggctacatcattacaacaagctgttcaagccgatccgattaatgcccctagtgatagattgtatcatttaacagtaacaggacttgaacatgaacccagtattaaagacagaccaaaaacgtctgcaattgggaacaatctaattggcccaggattagatttggaattcgaaatggaatccaatgtcccagcaccagaaccagccctttatgaaacagcctacgtaacttcccataaaggaaactgcagggcaggttgtttttcagcagatggtcaactaatcgctacaggtagtgtagacgctagtataaaaatattagatgtagacagaatgttggccaaatctgcaccagatgaaatggatccttcaagaggggaacagcaaggacatcctgtcattagaactctttatgaccacatggaagaagttacttgtttggaatttcaccctaaagaaccatttttatgttctggaagtagggatatgtcaataaagctgtttgatatttctaaacctagtgtgaaaaaggctttcaaaactattactgaatcggaatcggtgaaagaaatatcattccatcctttaggcgaccacctaattgtagcaaccaagcacccagtcatacgtctttacgatatgaacaccctgcactnngctttgtgtgtcgttccccaaacaccaacatactgcacctgtaaacagtttaaaatggtctcgagatgccaaactgtttgcttcagcagca

SEQ ID NO: 75 - DNA, 938 bp, Diabrotica virgifera
  misc_feature (18)..(18): n is a, c, g, or t
cctatttacaaatgggcncgggtggactaggacttttaacaattaaattaaactttcttaactattttgtttataaaaaatttataatggaaacagaaaatattcataaatttgccccagaactgcacaaaaagtatttattattcatattaaatggtaaattgccatcttctaacagctcaatggacacaaatagatcagtgcttatgtactttgctgtatcaggcttggatatattaggagaaattgagaatattccaaaagaaagaagacagtcaattatagagtggatatattccttgcagattattaataaagaagaaccaataagtggttttcaaggatcaacaactctaaatacagataacaataaggaaagatatggtatttataaatgctcccatatagcccatacttatgtatgtttaacaactttattaatacttggagatgatttgaaaagagtcaataggcaggctattttaaatagtcttaaaacattacagttaccagatggatcatttaaaggtgctatagatggagtagaaagtgatatgaggttttcatactgtgcagcctgcatttgttacatattggatgattggagttgtatagacatagatgctatggtagattttatattgaacagtatttcatatgatggaggaattggtcagggaccagaactggaatcacattgtggctcaacattctgcgcagtcgcagccttagctttaagcaacaacctagataaactatccagagcacaatttaatgcattaagacgttggcttctgttcagatttgacggaggcttcagtggtagacccaacaaacctatcgacacatgttattccttctggactgggggagccttgaaattttaaacgctacgattttattcacatagcaataacatcaatttgttttatgaccca

SEQ ID NO: 76 - DNA, 1077 bp, Diabrotica virgifera
caatggagaaccagtgacatcagttctcagtccattcattagcaaattaaaaagtgttgaaaggttagtatttggaaatattgggtcattattaactggaaaagttgttctgtatgatattctaaaccatattacacttatttaatagaataaacaaaaaataccttcgtttcagcttatggaagcatactaaaatatcaaaatgaaatggttgtatttgtgttgtttgctactgattcttcaagtctgcactgcacctccagtggagaaaaagaaggaagaacctgaggattcagaagtaaatggtttagaagattatatggaatatcacagatatctaaaggaggttgtgcacgccttggaatcagacccggatttcagagcaaaactagaaaaggccgaagaatctgacatcaaatctggaaaaatagcggaagaattagaattcgtctcgcatcacgtcagaaaccgtctagacgagatcaaaagagtggagttggaaagactgaggcatttagtagaacaaaagaggaaattggaagacaccaatgccatagacaccgaagaccccacacacaatcatctggaccactcgaatccacatacgttcgaaatcgaagatttgaagaagctgattgctaaaactgcacaggatctggatgaggctgataagaaaagaaaggagcaatttaaacagtatgaattggaaaaagagtataagaagatggataagttgaatcatactaatggagacgaaaggcagaaattagaaaaagaatatgaagaaatggaaaacaagcataagcgtcatgaaaaactccacgaacccggacacaaagctcagttggaggaagtgtgggaagagcaggatcagatgcaacaggacttcgatcccaaaacctttttcatgcttcacgatatcgacggtaatggcttgtgggatcaagacgaagtgaaagctttgttcattaaagaattggacaaaatgtaccagcacacccgctcctgccctcaattccaaggggaggaatggaagaaaatggaaagaatgagggaaagcgtttttagggaaatgga

SEQ ID NO: 77 - DNA, 1705 bp, Diabrotica virgifera
gtgtcaaaatacgtttgtgaaattaattatgaactaacaatgattttgcccgtaaccagatatttggaattaacgaaaatagaaaaaaggttattgaattcttgacgagggaagaacaaaagcatgagttgaaatgaagaaaagctacacctcaacagatattaaccaaaatcagggccaggagctctcaaaaaaattatatcggtccataagtgaacaagctaaacgtttagatgacactaggagttgtgccagaatagtgggagacctcttttcaccaaatttacaagtgcagcgcaaaaagttctgtgaatactgcgaaagattgatattttcagatccttcactatatggtcgtaaaggagaggagttactgtggaggaaggggttttatgatgtagtttcaacagcaaagaaactgaagaaaaaggagtaccttcctgaggaaatcagtttcattgcttcgcacataaatgctggaataggtttttacagccatatgttatctaagttgcaatatcattttaatttagatatcaaaacattcattgattttccaatgatacactctgagaagaaggatactggtgatgtaaagatagaagcgatagagtgggccaaacaatctgtgcatcaatgccttatttatttgggcgatttaagtagatacaaactggaaatatatcctaattgggagtctactctagcttgtcgttattacctgcaagctatttcttacaagcctgagtatggcatgccccataatcaaatgggaaccttagccatgaaccaaaatagctttttagatgctgtttaccactacatgagatgtttatcatgtaaaatttcctttgaaggtacttctaataatcttatagcactttttgagagaaattctaagtttttggagcagctcccaaaggaggataaaaatgctgacctcattatagagcctgaccaaagtgagaagatcaaaagatttgtagctaggtttcttttgcttatagacatttggtatttcaacaaaaaagttcctaaagtgtatgatctttgtcatcagacctataaaaacttggaagaatgtttaacatttgttaaattgacaaacagtgagtcaggagatggacctacagatggagattctgtagaaactgattctgtagcttcccatataagtggagacatgattttcaaaattgtagtcatttctttactatgcatatccagattgaagtcttcaaattcatctcagactatcgacagcagtggctttcctgataggcatctattcccagaaagataaggaatgataccaatcattgacactaatgtattttaaatatttccccaatgtgagtgttaaggtttgtcgtttgaagggttagtttaaaataattgttaactgatcaggaagcaagtatgagatgacgaattatctttacaaaccctgtatagaatccaaggagtgagtaaaatgaaccttggtggagaagattagtacgatggctcatttaacaacctttacatttgatgaactatgaccttcagacagaagattcaacagttgctagaatttgcacctttgagagcagcttccgttcttgtaaacagcctatttggccgtactccagaacgatgtatataggagatgtgtcaactgcttattgtctcttctagtgacgaagtatgcatattcattgaccac

SEQ ID NO: 78 - DNA, 931 bp, Diabrotica virgifera
tctttaatgacagcaatcttacgtgtagattttataaaagttagtaaataataatgattataatatggtttgcaaatagttaaatgcagtatgtgattttctgaagaagtgaagaggttatatcacattccagttgtttagagcacttagtagagatatacacctttaaacatgtcgtgttcagcgatatatattttagatgtaaaaggaaaagtcttaatctctaggaactatagaggcgatatagacctaggtgtaatagagaagtttatgcctttattaatggaaaaagaagaagaagggcttctaactccaattttgcaaatccctgaatgcaccttctcatatattaaaaccaacaatctatatatagtaagcactacgaagaaaaatggtaatatcgctcttgtatttgtatttttacataaaatcgttcaagtaatgactgaatattttaaagaattagaagaagaaagtatcagagataattttgtcgttatttatgagttgttggacgaacttttagactttggctatcctcaaacaactgatagcaaaattcttcaagaatacatcactcaagaaggtcataaactagagatacaaccaagaattcctgtagctgtgacaaatgcagtttcatggcgttctgagggaatcaaatacaggaaaaatgaagtattcttagatgtaatcgagtcagtaaatcttttagcaagtgcaaatggcaatgtactaagaagcgaaatagtgggagcaataaaaatgagagtgtatctttctggtatgcctgaactgagattaggtctcaatgataaagtattattcgagagtacaggacgtggtaaatctaaatcggtagagttagatgatgttaagttccatcaatgtgtaagatatcaagattcgagatagatagaacaatctcttt

SEQ ID NO: 79 - DNA, 1055 bp, Diabrotica virgifera
gccacgtcacttaaaagaagtcagaattccaaaataatattgtcccaaaatgaatattttcagacttacaggagatttatcccatttagtggctataattattcttctgcaaaagatttggcatacgagatcatgtgcaggtatatcaggaaaaagtcagatcctctttgctatagtctacactacaagataccttgacttagtgacgtcatatgtatctatgtacaatactgttatgaaatttgtatttttggccacatcgtatgcaactatttatttaatctacatgaaatttaaagccacttatgaccataaccatgacacgttcagaatagagtttctcattttaccatcgtttggtttggctatgcttatcaatcacgagttttcatttatggaggtcttgtggactttcagtatttatttggaatcagtggctatattgccgcaattgttcatggtcagtaaaacaggagaagcagaaagtattacttcgcactacttattcgcattgggatcttatagggccctatacattttgaactggatctaccgctatgcaactgaaactcattacgatctcatcgctatagtagctggtgttgtgcagactatattatattgtgacttcttttatctttacattactaaagtactcaagggaaagaaactacaattgcccgcttaaacccctcttatataagacttaactgtacaaacattttactttcagctaaacggtattaacacaatgatgcctaatgatcatgtgtttggatagcaatcaatatccacattttattttttgtataaacgtttaccatttcgtcagaaatttcaattatataggattagaattaaatagtttttgtacaaatttcgttcataataaccagaaaatatatatttttgtctttacttttaagtatttgtaattacttttttcggggttgttttaccctaaaggaatctgggccctttggtttttaaattttaaaaaaccccaaaaaaaaatttaaaaaaaaaaaaaaaaacaaaaggggtttttccctttt

SEQ ID NO: 80 - DNA, 1988 bp, Diabrotica virgifera
  misc_feature (1950)..(1950): n is a, c, g, or t
cttcacgcgtccgcccacgcgtccgcttcttcgtagttagtggactgtcaccagaggttaacgtcatcaagaacgctcagcgatggtgttcgataggaagtggtttattatattgatatgtttacttgttgaagtctgcagtagaccgcaactgaacgataatgcagctccaccatcagtagattttaggtcaagtgacaaaatcacactaattccattctacggaggaggaaaaggacaatctcttcaaattatagaaaagtcagatggctcggttcatacatccataattaagacgccaacaaaagatgaagaagatgaaagcacgggtatagacaacataattgacacatctgagctagaaaatccaccccttccatcaaaattcgatttagaagatttcggaaggaatataaaaaatatacaaagctatgctcagaggataatatcgttacaagaaattctcaaacagaaaggaaaattaagtccagctcaagaagcagcgtataaagaaaatatggacagcttaagttcctctgccttaaaattggctgaaatacaagaaaaaagcaatcccatcggactagaaaacagagaaggtataagtgcttggttagaaaacaagaaaaattcaaacaacaaaaataaaaacaagaagaaggaagaagataggaaaaaagacgaagagaaaaaacgaaaagttgatgaagaaaaaagaaaagaggagcaaaaacgaaaacaagaaaaattagaagcagaaaaggaaaaagaaaaggaaggtgaaaaggaagaaggcaaccaaggagaaaaagaagagggagaaaaagagcaagaaggtgacggcgataccattggaatcggtttacccacagatgatgcttctgtggctgaagccagacccgttggactagcggtagcaggtgaaggtggcgtagctgccagtaaaccaatagctaccgccgtagtaggtccaggaggattagcaatagccagaccagtaggaactgcaatagcaggagtagatccagcgcaagcattgataccaattcatgcggagaactatgttttaggttcgaaaccaaaagggggtcacactgaaacggctaatgaatatctaagcaaactgatcactaaatttcatcaaaactagtagatatagaatttgtgataaacatattttaaagacttgtgatgaaaatactttcagtactcaatattgatacagtttttaataggtttactacaacgttttaggtatgtaaattacctttaaaaaacttccttaaaaactaccatatccttctattagtgtcgatttgtcatcaagtgttagcgaccgttacaattatccttactttattggcagcaacgagaaaaatccataaaaaacatttaccctaacaatatttacattccaataatatatacaatataggtatcttctttctttttcttccctgcttggctgtctttagcaaccgccaaccatttggctggaccctggttatgtggtcaatcagtttaagtgtgtcacgatgtattttcttcactctgtttccctggtttaacccttaactacagacatcccaatattagcacgtaattgcagatccccggtattttttaccggtcattataaaatagagtcaaaatataaagttaataataaaaaacaaaaaaaattgcattatgagtttttctggagtctctatatatgggaaaaaatggtaaaatgagtgattttaataatataatacaagatttttgaagaataatctattaaaccagaattttggtaacatttttggtctattgaaacaaacggccataaatgctatgaacaaaaatttagactttttttaacaaataaacgtaacatagaatcacaaaaggaacataaaatagtatttacaaaaatttttacatccatgagaaaaaatctgcaagggngaaaaattatcacagaaattaaatggcaattccctttt

SEQ ID NO: 81 - DNA, 1023 bp, Diabrotica virgifera
ttttcgtccgtgtaatgcaacgttgtattttttggaaaataatacattaaattcgaaaataaaaagattatacagtatgaatctattcaaaacaactgtacgttaattcagctacgaaagcaatggtcgattacagatatgatttaggacttgacgtgtctctggattcctctactgataaaaaacggaaattacgttttcgaaggtggtggaatcggttgtcaaaatgccagaaaagctttatagttaccgtctctattttaatattattgagttgtacatatttattaaatttacaaaaagatagcagagtgataacagttgaagaagttgaagacaagaggtatactataaagagccatgttgaagaacctaaacaaatagaagaagttaatgttgaggcccaagaaattaaaagtaataataataataatgatgtaaataaaaatgttctagccgtccccaaagttgaacatagattctctggtcctacaacaccaaggcaagcagccgtagttgaagccttcaaacatgcttggaagggctacaaaaagtttgcctggggacatgataatcttaaacctatttcagaaggctttactgaatggtttggattaggtttaactattgtggattccttagatactattttcattatgggtcttgatgaagagtatgatgaagcaagaaattgggtcgataaacatttaaatttcgatgtgaatagggatgtcaatttatttgaagttacgatccgagttttgggagggttacttagtatatatcactttagtaaagatgatatgttcttaaaaaaaagcgactgaattagcagataggttacttccatgttttgattccgaatctggaattccatattctgacataaacttaattttactagaaaaccacatgcaccccaagtgggcaccaaaataagaacgcctttccgaaatttattaccataacaattaaaattttaaaagaaccctggaataggggtccaagggggaattccccaaa

SEQ ID NO: 82 - DNA, 1246 bp, Diabrotica virgifera
aagctttatcaactaccgttataaagcgataaactaaactatctaaatatactaaactgataatgccaaattggtgtacaacaatcaatttgattttgaccaacattgacattgaacgttgaactaagcttaagagtaagagtctcacaaactagtaaaatctcctattcggcatttgaagtgcctgtttaaccacttcatcattgcaattggtaaatagtcaataaagtggaccaggtgataacagaattcctatattagatcgaagaaaaacgatttttatttgtagtcacccttttgcacttattggaacaagtctacacgtgcctccaaatataaatttggacattttttaaattcacactttgccatgagtccgggatcaagaaatcgagatccagaatacacttttagatcgcctctagaggatcatcctacacttcctaatagagcacctaaatgtccatggaccaaggatctccataaaactgtacgatctccacatggtgaaagagtttggaagccctgtgacaggaaaattcttcccagtatacttaatgctgtaggaaatacacctttggtaaaaataaataaaattccaaaagaagagaacatagattgcgaaatttatggaaaatgtgaattcatgaacccaactggatcaataaaagaacgtatgcttcttcgatgtattgaagatgcggaaaaattgggcacccttaaacctggtatgacgatcattgaaactacttctggtaataccggcattgcattggcttgggtatgtgctattaaagattacaaatgcattctcgtattaccagataaggcgtccaaggagaaggaagatatcatgaaagcatttggtgcaacagtcgtaagagtcccaatggatgaaccagatattagtgagcatggaaagtacggaaaaacccactatattcataaacaaacaccaaattccattattctagatcatttttctaacccatctaatgcggtagcccattaattgaataaagctgaaaaaagaaatacacagtaaaaaggaaaaatggatcagatcgtttttgctgcttttttggaaggcccgaaaacaaaaaggaaaataaaaaaatggaatcaaagtaaaaaaaattaaaaaaacatttttctccccaacccaaaggaaaaaaaaaaaggaaaaaaaaaaaagggaaaaaattttttttttttaaaaaaaaaacatcctgccggccgggccgcg

SEQ ID NO: 83 - DNA, 840 bp, Diabrotica virgifera
  misc_feature (819)..(819): n is a, c, g, or t
attatataagccatttaatgggccacgaaggtccaggtagtattttgtccgtacttaaggctcgaggatggtccaacaatttagtagccggaagtaaacctgctcctagaggtataggatttttcgccgtagctgtcgatttaacagaagaaggcatggaccacattgatgaaatcatcgaattagtgttccagtatttgaacatgttgaaaaaagaaggcccacagcaatgggtgcaggatgaaaataaaaatattggacatatgatatttagatttaaagacaaagaatctcctagaacttatatctcgtctttagttcatagtatacaagaatatccaatggaagacatcctgagtgcaaactacatgttacgtgaatggcgtcctgatcttgttgaaagtgtatggaatagttttgttccagataatgttagaatatctgtgatagctaagaaattcgaaaatgaacttaatgagacagaaccctggtatggaactaagtataagaaagttgatatccccaaagaaactatagaggcgtggaaacaaactggactgtgtccagatttgaagatgctcgaaaagaacgaatttattcctacagattttagtttgtatacgctggacgaggatgttactgaatttcctgtaataattgaagatactgcgctgaccagagtatggtttaaacaagatgatcaatttttactgcccaaatcgcatctcatgtgcgatttcgtgagccctctggcttatttagatccatcaaattgtaatttaacccatatgttggtacaacttttcaaagatgccttanacgagtatgcgtatgcagctg

SEQ ID NO: 84 - DNA, 1736 bp, Diabrotica virgifera
  misc_feature (1560)..(1560): n is a, c, g, or t
  misc_feature (1696)..(1696): n is a, c, g, or t
agaagtcgtcagcttgaaggaaatccctggtattataaaattttgaatgaaagataagtcataccttcatttttgagcgaaccggcgcaacgtgtaacaatttgaacataagttagaagatacaatggcaaaacgagtgcaacccacttggaacgtttctaatactgagccccaaccagtattaaaagtttataatagtttaacaagacaaaaggaagtgtttgttccccgttctggaaagaaggtgaattggtacagctgtggccccactgtgtatgatgcttcgcatatgggacatgcaaggtcgtacattacttttgatattttacgaagagtattgtcagactactttggatatgatattttctacgtgatgaatataaccgatattgatgataaaattattaagagagctcgacaaaactatctttttaagaaatacgttgatgaaaatcattctttagaaagtgtgcttgcagatgccaagttagtattacaagatgtacaatctagggttaaaactactacagatcttgacaagaagaatatgttagagaagatgttaacaaggctagcagcttcagtagaggagttagaaaaatcagtaaaaagtggagattcacttagagtagaaaatagtaaacaacaatttattttagacggtaaagatcctatttcagaatggttagatcagaaacagggagatactgtacgagataatgcaatatttagttctcttcctcgacattgggaacaacaattctatcaagatatggacgcattaatatactgagacctagtgtagtaacaagagtaagcgaatacattcccgaaattattacatttattcaaaagattattgagaatggttttgcttatgaagccagtggatcagtttattttgatgttgcagcttttgataaaagcgaaaaacattattatgctaagttagttccagaagcgtatggtgatacaaatagcttacaggagggcgaaggagatttaactactgcagaacaaagaagtgaaaaacactcaccaaatgactttgctttatggaaaaaaagcaaaccgggagaaccgttctgggattccccttggggtaccggtagacccggctggcatatagaatgctctgctatggcatctgatatctttggagcgacgatggatatccatactggaggagtagatctcaaatttccccatcatgacaatgaaattgcacaaagtgaggcatactttggcaactcagaatgggtaagttacttcctccattctggtcacttaacaatagccgggtgcaaaatgtccaagtccttaaagaatttcgtatcaatccaagatgctctctcaaaatacacctctagacaattaaggtttgcgtttctgttacacagttggaaggatacgttggactacagccaaaattccatggattctgcaattcagtatgaaaaactcttcaacgaattctttctaaatgtaaaggatgcgtcgatttcaatttgcttgaaaaacacaacagtagatactttcaccaaatggtctgagcacganaaaaccctgagtaacaagcttatagcagctaaaactgcagttcataatgcactatgtgataatattgatacaaaatccgcaattaatgctttaagggatatcgtaacagcaagtaacatctatatgagggaacggnaacctcccgacgcattacttttacacgacgtaggacttta

SEQ ID NO: 85 - DNA, 1206 bp, Diabrotica virgifera
ccctccgcgtccggattctccaatagatactgataaggatggtgttccagacaatcatgacaattgcagacttataccaaatccaaatcaacttgacactgatagagatggaaaaggagacgcttgcgatacggatattgatgatgatgctattccaaataaccgtgacaactgtgtctttgtctacaatcctgatcaattggactcaaatagaaacggatatggagataaatgtgataacgacacagacgacgatcacgtaactaacgataaggatgtatgtcccaccaactcattaatctaccaaaccgacttcagcaaataccaaaccatagtccttgatccatacggtgaaactcaaatcgatccaatttgggaaatttacaaccacggagcagaaattgtccagactgttaacagtgatcccggtttggctgttggacatgacaaatttactggagtagattttgaaggaacgttctttgtggactctgacgaagatgatgactatgttggttttattttcagctaccaaagcaacagaaagttctatgccgttatgtggaagaaacacgcccaggtctattgggaagcggaaccattcagagccttcgctgaaccaggaatccaaattaaggtaatcgactccgaaactggacccggagaagtgcttagaaactctctatggcacacaggagatactcctaatcaagtaagacttctttggaaagatcccaaaaacgtaggatggaaagagaagacttcgtacagatggttcttaatccacagacctgctattggtctcattaggttgaagatatttgatggagagagtatggtagctgattcaggaaatcttttcgatacgacacataaggggggaagattgggagttctttgtttctcacaacagatgatcatatggtccgatttggcatacagatgtaatgaaaatctcagagaagaaatttggagggctctgtcaccaagataccaaaagaaagtaaaaattgacaatattggatcttataacgtaaaatcaccagatgttcaatagaaaataatataagttaaatcttgttttgttaatgttgggtattatgctaattaaccaatgagttcaattaacacataatgaaactttgttatgattcatattgtaaataaattttttaatacaatgcaaaactttgtttatttaattgc

SEQ ID NO: 86 - DNA, 890 bp, Diabrotica virgifera
cttccgccctttttttaattttttgacagtttaatccatacttttattgtcaacaaattttttaatacagtactgataagctaaaataaagaatatcttttatctgctcctttccatttatattctgtcaaaataacaactaaaatatcagtaattacaaattattaacaacaattggaaaattttgaaaaatgaccttccaacagtctcttctttcagcttcggggatgcttcccactgtaacttcttttcctatatctataaacccacaatccttatcagtagccttccaagttaattgtaaatcatttgcaggtggtgttgggtttcctgttttagcaaaatttgtccatagtttaacaaaccgacgaacaactttatctgctcctttccatttatcaagaaactgagctgctacgtggtttttaaaaaggtaacccaattcatcgccatgacacgtacctggatcagtaacctttgtaatttttttaagaaggtttaagccggcgtctattgaaattctgtacaaataaactggacacttggatgttcttgcgtggacgtttcctgctgcaataatcccagatacaaagtaaaaatctgtaggtaatagatatttgtctttttcactttctgttgccctttttttgtaagtttctacaagggtttttaaaatacgtttattctgaggatcatcttcagataaaccaggtacaaggaatttcttaacgtcaacatcttcttcctgtccctcttttttagatccagctttgtatccgaaacgtttatacacttccagaaaaattccttccctatcacagtacccaagtattaaagtaactttatcgtacctgcccacatgctaacagctcagtatgttaacatgaaac

SEQ ID NO: 87 - DNA, 1090 bp, Diabrotica virgifera
ccctctccttcgtccgacttttaaaatgacggtcaagaaaaaagtcgtcaaaaaacacacttatacgaagaaaaatggctatttaccgcacaaaaatcgatcgcatccattatatttcgtatggctgccgttaagagtaagcatattttttatattcttctggatagtgcttgttccagttttgtatatcatcctgatggcccacgttcctggatttgcagcagttaccctctacttctttgtgggaatgtttgttgtgtttttaatagccctgtcaatttttgtgtgccagtggagatgcaagaacagcaggcaaagcgacatttactacatagaatatcaagcatctgaaattccacctcaagaaatggtggaacttaagaagaagccgatagtgtttgaaatagaaaaagaaaagatagaaattaaaaaagaaacaccgaagaaaacagaaattagaaaagaaacaccgaagaaaacagaaatcgaaaaagaagatgttaataatggggttcatcgtgaatttaaagaaaaaactgtcattttccgagaggagaccaaagtcatacaacgtcctgttacgctggcaatagaaaaagaaaaagaaccagcgagaccttcgtctcaaaatttgagttcacctttgagtcccagagagttgttctttttagatatgtacgaatatgccaatgtcgcgatgagaaacgctaccgacaattttctccagaaggaaaagttactctataatcccagtggacctgttcaaagagaatattcggatacctcaagtgatatcgcggaaagtcaacacgaagaatcaatcaatcgtactcagcagcctatagttgagcagtctcctgcaagagtaccatacctcctacatgaaacatctcccgtcagtgagttggctcctcttcactcgagattgtcggaaataataaagatcgagctgagattgaagaaccaaatattgttcctattatcaaaagaaccaagtcgaagagactgaaggaaattagaagactctccggctgaggtagaatttcacaatatggtatcaaagtatcgtcacccgtctgcgagtcagctc

SEQ ID NO: 88 - DNA, 797 bp, Diabrotica virgifera
gaaactataaaacagtttggcagtgaaaaacatttcttcagactagtgtggtttgtgcagtttgaaaagtgacatttttagaaaaaagaatgagactacttctagccatactggcactttctgtgttacatcatacaacagcagaagaagcctcatggtcttggggctcaaacgacaaagatgaaaccccacagaaatcgtccaatgagccacttcaagaaactgtgcccagatctttaaaaccttcgtttttacaagatgaggaaattctaattgctgaaccttccgaatattcagaagacatcagagcaaacagcactgaagcagaacttgtaatagacgaaatccttagctctacgaagaaaggtagagccatagatggtttccatgaagtctacagcgaccctaacgtacaagaagctttgcaaaagggggatgattccgaagcgagaaatgttatcaaggataggttatgtgctttaggacttatgcagtgtgacggtgtggaggaaaagagaccattctacgctcctgaagaacttatatacgcccaaccagtctccataaaccctgtaggtaaacccattccaaccattcctatcaaaggacaccgtggtgtaggatatggtcctccaaaacctcttcactatccaagtcgtcccttacctcctcccggaaaattccctcctttaagcataccaccaaataaattcggtccaccatctacctatatccaaccagggaaaccacctcgtcggcaattcgcaggtcccccaacaaaacccttctatggtaag

SEQ ID NO: 89 - DNA, 1327 bp, Diabrotica virgifera
  misc_feature (1131)..(1131): n is a, c, g, or t
  misc_feature (1218)..(1218): n is a, c, g, or t
gacaaactggataaaacacaaaaatggataatccatttgaatgaaaaatgtaatttgtattaaaataataaattatgaaatatcgtatcacaccgttgcgatttctacaaaagaattggcttttagtaggtattttgtgctgtatttttgtagccggtatttacccaaaattaggatctaaacaagggcctttacgaacggagtacacagtaaaatatggtgcagtattcattatatttttagtaagtggtctgtctttgaaaacagatagcatttttaaaacattccaacaatacaagttacattgctttattcaatgtttcacatttatttttatacccctttttggggtagtattaatccagtttttatatatttttggagttcatccatgggtattaaaaggaatcactacagtagcaagtatgccccctcctgtttctagtgccgtaattttgaccagggctgcacaagggaatgaaagtgcagcaatatttaattctattttgggcagttttataggtattatagtaactcctattttattgcttcttcagttgggttcaacaacaatagttccccttttagatactgtatttcagcttgcagtaacagtgcttttacctttgacgattggtcaagttttaaagaaacacactaaattgaaaatccaaacgttgcctttgaatacaatcagccagtgtgctctattgttcgttatttatactacattttgtgatacattcctagtaccagaaacgggactttccgctttggacgtactttttacagtattttcagttctcttaatgcaactgagtttgatgatgatcagctttcatttggcaaacatgtttataaaatatttcaatccgcaagatattatagctataatattttgttcgacgcacaaatctttaacgctaggcattcctattcttcgaataatgtttcacggatactcacacctaagtcaaataagcttaccacttttggtgtaccatccaactcagataatttgggtggcttagtcgttcctcagttgaaagattggatgcattcgcagagagcaaaacgaccaccagtgtagatgtacatattgattcgtagagagcgctaatagattatganacaaattcattgcaaattcaaatattttgcaaacaatttattttagacaaaaatccttaaatatgtccatttgtaattttaatgccnattttttataatctgcgaaattatgacgtcattagttttacacagtgacgtaatcggtgatttttttaattttgactaatgcttataaggggccataaataatttccac

SEQ ID NO: 90 - DNA, 686 bp, Diabrotica virgifera
ctcaaaggtggcagccggcttaactttcgcttcgatctagtttttctagttacaagctttgtttaaatttaattttactgtctattattcgatctattcaaaatgcctaaaaataagccaaagagagatacttccgattcagattccggaccagacgatgatgttccagcaaagaagaccaaaaagcctgagtcaaagtcttcgaagtcatcaggcgaagaagagaattcctggagtctgggtaaaaataagttcgttaaattgagcgagttcaaaaatacctggtatgttaatattagagagtactacaatgctgacggtgaacttaaacctggtaaaaaaggaatcatgctaaccatggaacagtggcagaaattcaagggtttcgttgacgaagttgatgaagctattaagaaaaatgtttagatgtacctatatgttttcgaggaatttgcagttacaaaaaagtgcatttgattttatacttaatgtttgtttagttatattttgataaattggttgttgcgttttatgtaaaagggtttatgttaggtttcctatgtttttataaaacattggtttgtaagttttgtggcaatgttcctctgacttgtttaaaatgatttgttttgtataagctgtgcttttgaataagtttaagtttaaataaatttggttacacatgt

SEQ ID NO: 91 - DNA, 1473 bp, Diabrotica virgifera
actagagtgcgcggggcatggtctgtcacacattatgatcattatattttatatgattaacttataaaattaagaataatgccatcattaaaatggcaaattgcttttggtctcggagcagccggtgctttgggtttagcttattggtatttaagagccagcaagaaagaaacgttgcagacacttaatgctgcaattgaaaatgataaggaaaataccccatttcaagaagcacaaaagtataagacacaaggcaacgaatttttcaaaaggggcaagtatgatgaggctatcgcctgttataatagtgcaatagagacaataccggaagaacacaaattagatcttgctacatactatcaaaatcgtgctgctgcatatgaacagctaaaaaaatggagttcagtcatatcggattgcacaaaagcgattgaacttaataatagatatgaaaaagcacttttcagaagagccaaggctgaggaaatgctgaaagattgggtaaatgcattggatgacattaccacagtatgcttattacagaattttcaaaatcaagctaccatgcttatggctgatagggtattaaaggaattgggtaaacaaaatgcagcagaagctataaaaaatagaatacctgtaataccctctcgtagttttattaagacatatttttcttcgttctctgaagatccagtatttaaaaagttacaagaaatatctgaaccactaggactaggtgacttaaaaggttttttgaaagcaaaattagcttttgctactgaaaggtatgatgaagttatatcagcatgcacagaagagctgaatcttagtgagtcagaatcacagtacaaatttgaagccttatctcttagagcatcgtttatttcctcactggtcagttcaaagaggctttggaagaccttacatttataatagactcgaaagaagcagatcttctcatcaaggtaaattctcttataaagaggtcttcaatttacatgcagacagaaaaaatccaggattgtcttgctgattttgaagcagctgctgaattaggtcctgaagtatcagatgtattccatcacaggggccaagtaaaactgttaatggagcaaatagaagacgccagaaaagactttgaaaaggcggtggccttgaatccagactttgcagtcgcagtcgtacaaaaatgctacgcagactatcgttacgcaatgcaagtcaaagatgtaacgctcctcatgcaaacaatgcacgatttccgtatggcaattgatcgtttcccgaattgtgcggaaacctacggtttattcgcacaagtgaaaactgaaaaacaagagtttcacgaagccgagaaactttatcacaccgccatggaaatccaatcacataacgctactatttatggacatagggggggcttttgttggtgcacggggaaaggaaaaaattgaaaaggggtgggggaac

SEQ ID NO: 92 - DNA, 1050 bp, Diabrotica virgifera
gtgttgaaaaagaaagttcatggctcttagcgccaaatttgatagagttttacgaatatcttcaagtattgcgtcccatgtgtggaacggattttcgaccatggccacagacgctaaaactcctcgtattcttaaaagaataggtacccatagtggcgtttttcattgtgatgaagccttagcatgttatatgttaagacagttacctgaatatgcggatgcagagattataagaaccagggatccgaagattttagatgaatgtgacattgtagtagatgtaggtggagaatataatcccaaaaaacatagatacgatcatcatcaaagaggttttgaagaaacgataagtactgtacgtccagatcttataaaaaacaaatctataaagttaagttctgctggtttagtttatgctcattttggttttgaagtattagacgcaattttaaaaaaggaaaaaatacctacaaatactgaatgcttaagatctatttttgtttttatttatgagggatttgtggaagaattagatgctatagacaatggagttccaatgtttactgaaggtaaaccaaaatatagaataaacacccatttaagtgcaagaatacacagattaaatccagaatggaattctccaaatccagttcctagcaatgaaactttctttaaagctatggagttagtagggacacgcgtccgtgaaagagttatagatagcgcaactgtttggtggccagctagagaaattgtaaaaaaatctatagaaagcagaaatcaagtacatgaaaacggacagatagttttactaaacgaaagatgtccatggaaagatcatcttctggctttagaagaagatttggggatttccggacaaattaaatttgttatttttcatgatgctggcgattcatggagagtacaagctagacctatccaacctgatagttttatatgccgagtttttctacataaagattggcgaggcgttcgtgatgaccaactcagcactatatcgggcataaaagattgcatattttgtcatgc

SEQ ID NO: 93 - DNA, 930 bp, Diabrotica virgifera
  misc_feature (910)..(910): n is a, c, g, or t
gttgtacgtcattctaggtgatggtaaagttgagaattttagaaaattaataaaaatctgtaatattttgtaaatttatagttctccgttagaatcgagagttgtaaatactgtacacgcttttgttatgttataattacatggagatctggatcttgtgaggcatgtaatatatgtgtatgaatagtaatttttatgtaatgtgtgcccgttgtccagtttgaacatttttattttgactgtggttaaagttatgcacctcgcgtaattctattgtaaggcttaaagttacagactgtgacgatatatcctcgaattcaaaggaaatgtctagtaagagctccctaagtaacaatacatctgttttaaagcagttcgatctggatcaaatatggggagatctacatgctggcatccagcaagtctacaatcgagaaacgatgcataaatcacgttacatacagctctatacacacgtctataattattgcacttccgttcatcaacagaacaatggacgagcttcggcaaatgcaaatacaaagggtaaaaagaatcagatcggaggaggtgcccaactagttggattagaactttataagagactgagagactttcttaggaactatcttgtgactttactcagtgatggactacatcgtatggatgaagacgttctcaaattttatacaaaccagtgggaggattatcagttctgtagtaaagtgctcgatggtgtatgtgcatatcttaatagacattgggtgaaaagggaatgtgaagaaggtaggaaaggtatatatgaaatatatcaactcgcactggttacatggagggatcatctcttcaacaattaaataaggcagttaccaatgcagttctcaaactgatagaaaaagaaagaaatggncgaacaattaacacgcgttt

SEQ ID NO: 94 - DNA, 895 bp, Diabrotica virgifera
  misc_feature (820)..(820): n is a, c, g, or t
  misc_feature (865)..(865): n is a, c, g, or t
cctcttgacgtccggttagtgtaactatataaaccacttcgaaacgtattgataaaaaacgaaaatacgaaaatggaaagtgtccgatttatcctgttgtgtatgttttttgtggcatgcaaagttgatggggaaaatgcggtaaactttgcagtgaatttcgtaaacaaaacattactcgaaagtaaatgccagttacatatgttaacgatgaaactctctccacatactcatttttccggtactaatccttgtgacgaattacacggtcaggtaggggaactcccaaaaggatttgatcctcatgttgaattggctagtatcaaacctccagatatattgacaaatggaaatgttccagtaaataaagtaacacttagccccaataattcaggtaaagacaagaacaagactggtcagctttttccaaacaatcctttccttaataatggacaagtacaaaataccaacggcgtaggaagtaatatcggatctggtatcccaaatactcaaaatcccaatggacaggtacaaccttttaatccctatataaatggttggaattttccaaataatggttttaatcctagtgggcaatggaatccaaatactggatatcccaattatcagttcaatcctgctggacaatatccttatccaggtccatataatccaaatccaaatcaattttatcctaatggtcaacctgtatggggcaataacggtaattttcctaatcaaggtacatttcccaatgcgaaccaacccaatactggacagagttctaattggccttataaaccccatccatatccaggancaataaataaatggcaatacccgaatgtaaatggagtacctattnggatgccaaatcaaaatacaaatcaaaatc

SEQ ID NO: 95 - DNA, 1355 bp, Diabrotica virgifera
  misc_feature (1302)..(1302): n is a, c, g, or t
taacacttctgtgggatgaccccagttctaatcaccatccgtctgaacttgtacctcaaatactgcacaaaaataaagatatattaaaaaaatgtgggcgagaagtgtatgtgctgtactttatctattttttgtactgtacgaagtaaattccttaacgcagcaagaagtggttcagcagatcaataaatggaagaaggaggtcgatgaatttaattgcaatatgtacaaatggcaaaagaaaatgtttccgaatggtcaacatactggtcctgatccatgttcttcattacaaggtcaggtaggggaactcccaaaaggatttgatcctcatgttgaaatggctagtatcaaacctccagatatattgacaaatggaaatgttccagtaaataaagtaacacttagccccaataattcagacaagaacaagactggtcagctttttccaaacaatccttttcttaataatggacaagtacaaaataccaacggcgtaggaagtaatatcggatctggtatcccaaatactcaaaatcccagtggacaggtacaaccttttaatccctatataaatggttggaattttccaaataatggttttaatcctagtgggcaatggaatccaaatactggatatcccaattatcagttcaatcctgctggacaatatccttatccaggtccatataatccaaatctcaattttatcctaatggtcaacctgtatggggcaataacggtaattttcctaatcaaggtacatttcccaatgcgaaccaacccaatactggacagagttctaattggccttataaccccaatccatatccaggacaaataaataatggccaatacccgaatgtaaatggagtacctaattggatgccaaatcaaaatacaaatcaaaatccaggacacaaccaaggccaatttcctaacccctggggattcaatccaaatccaaatcaagatcaaaacggtcaaaaacccaatcaaggtactaatataaatttgaacactaaccaaggatctggacaaactaatcagctgcctaataataatccaaaacaaggacaatatcctaatcaaaatggtcaaccaatttggggtaaccaaaatccaaatcagggaaccggacaaaatggtcaagttccaaacataaataaccagccagtacgtggaaatgtctctccaaatgaaaatgactcacagaatacaggtattgtttttccaggacctgatagtcagggtcaggaggtagaagtattttaacagcaacatagtacacatgtaactccnactttgctttctaccacatctaccactactcctactcctagcaccactattac

SEQ ID NO: 96 - DNA, 1633 bp, Diabrotica virgifera
  misc_feature (49)..(49): n is a, c, g, or t
gttgagtctttacattgagttttgatttcaatctttagttttttgtttnacattataaataatgtattttaaaacataatataaataaaaaagttcattcttaatttaaaaacatgctgctacttggcaccatctactggagcttctgattcttccttatgcttattaggatcgtctggtttcatagcggggaagagcaacacctccttaatattgttattgtctgtcaaaaacattgtgactctatcaatgcccataccccagccagcggtaggaggtagaccaaattccaaagccttgcaaaaatcttcatctaacaagggtacttcatcatcaccttcggctttaagagctgcttgctgttcgaacctttctctttgcacaacaggatcgtttaattcggtgtaagcattgcatatttcttttttcattacaaaaagttcgaatctttctgtcaatcccggaatagatctatgccacttggccaatggactcattacttgaggatgttcgataatgaaagtgggattaattgatttttcttcaatgaaatctccaatcagcttgtccagcaacctgttggcagttctagggggcgtgcaatcaacattgtgcttaatacaaaggtcattcaagaacttttgagcttcggcactggtgagatctgctggaaatttaacattcaattctttttctaaagtagatatgatcgaaactctcttaaacggaggagtaaaatctatttcgaccacttggtcgtcgtcaggaccattgggatggtactgtattttatatgagccatgtatactcttcaccattcctgaaaccatctcttcggtaattgtcatgagatcattgtagtcagcataagccatataaaactcacatgttgtaataattctggatttgagtaagatctatacctttcgttcctaaactgtctgcctatttcatacactctatccaaccctccaacaactagagtcttgtgatacaattctggtgctattctcatgtacaaatccatatcaagttcattatgatgagtgatgaaaggtttagcgacagcgcctcccgcttgcatgttcatcataggcgtttcaatttccaaaaaacccatctcatctaaataccttcttacataggcaataatcttagctctgacttcgaagattttgcggaccctgttgtttaagataagatcaagatacctctgcctgaatctggtttctttgtctttaagaccaaagtgcaaatgaggaagcatgtgtaaacaaggtgccaaaagtttgattttctttggtaggattgacagctcgcctttctttgtcttggttggaactccttctataccaataatatctcctctccttattttagcggtatcatctacaaatttcgattcatcttcataatatctagcattagccatgacttgtatcttaactccctcacccctcaagtcgtagaaaactaatttaggacctgactctctaatagcatgaattcttcctgccacactaaggtggtcattctctagaatatcaccatctttcagatatgaatacttctcaataaaactctcgagtgatgacgaaacatggaatttatgaggataaggcgactgttcacc

SEQ ID NO: 97 - DNA, 1863 bp, Diabrotica virgifera
gaaacgccaccatttactgtaacattttaaagaacacaatggtaatttatatattacagtgattcacaacacgtggtatttattgaaaaaatgaatagtcattactacaaatagaaaacttaagtacataaaacgtaccatgaaaccttggcacccacatcaacacctaaggaaatttttagccattctacaaagcatagttcatgttgcaaaagccaggtgactctttcggaatgaattagtgacatttcgaacaggagtaactttattttgaatgtcagtttcttgatcgttatgttcagttaaaactgggtctactattttatgtagtaaatctgcacattaaactgtcttaggaaaattttaacataatggaaaatcaaaacgccaattttgtctagcgattgagaagtggaagattgtcactaatttattctgagaatgtcttggcttttaataaggaccttgtgtgttttaaaaaacgttgtaatataaaaatatatttctatacaggatttgtttctgtgtgggtttcaacgtatttatttgccacaatcggtaggtataactttaaaaattctatttatctacatatgcacaaataaatacttttattaattataataaaaacaatataaaacttattgaattgccgtttgtactactattattgtacatattgattacaacaggtataggtcaatgtatattacactaaaattgatttgagaatatgggacactttctagaaaaggtacaaaccttgtggcccccaaaacaaatactaaaagtaggcagtgttaaattatcaacagataatacacttaacgcgaatagtttagattcggtgaaatcaaaacgaaagtacgttatttgcaatatccgaagaatgatatgtttggcaagattgattattgttaccgtttaaaatcaaccaaactttgtagaatgaccaacagacactttatttttcactacttttaagtgcaacattaactaaaaattaaatgcgatttttctaaaattatttgtgttatgttataaaatatgtcgaatgttagggctagatcaaaatattcacacaggtttgcccctacattttacattatttaattacatacatatataaaaacataagaaacttctgaacacgaatatattttcaagagaaacctaggcttctacttctgtatctgctttcgcttccgctgattctttttcatggtacgttttatgtacataagttttctatttgtagtaatgactattatcttaactccctcacccctcaagtcgtagaaaactaatttaggacctgactctctaatagcatgaattcttcctgccacactaaggtggtcattctctagaatatcaccgtctttcagatatgaatacttctcaataaaactctcgagtgatgacgaaacatggaatttatgaggataaggcgactgttcaccccctataccctttagtttatctacagctgttgatctaagtttaaaatattcatttggactaatttcttcttcactgggttttgtttctttagtcttctgggcttgagcaggctgttgggcagctttttcagccttttctttggctttctgttcagccttaagtcgtcttttaagctcacttttacttttttgtattagtcctgaatcgattgaaaataattgttttctcataagcctaagagtttgcatcatggtataggttaaggaaggaaaattatatttctcaattcagatgaacttacttttttgacaaaggttctccagctgcatcagccatcgttttttatgtctctgactaaaactaaatggtctaaaacacttatcaaaagataccgtatgc

SEQ ID NO: 98 - DNA, 2751 bp, Diabrotica virgifera
atcccgggtcaaggtttcatggtacccacatcaacacctaaggaaatttttagccattctacaaagcatagttcatgttgcaaaagccaggtgactctttcggaacgaattagtgacatttcgaacaggagtaactttattttgaatgtcagtttcttgattcttatgttcagtcaatactgggtcttttttttattttacataataaatctgcaccatttatggtcttaatgaacaaagataatattaataaaaacgttcattcttaatttaaaaacctacttgccatctactggagcttgattcttccttatgcttattatagaacacctccttattttcgaaaaaacaaggatacttcatcatcaacttaggaccccagatcattttttttttttccggggccaaaaaagggctgatgaagtataaatccactttagttacatatgaatgaatgtttttttgagttatttaaaaaaacgaggcatatgggaaataaaaaaaataatttttttaaaaaaaaaaatattattttttatttgggggcattaatttttttttggtgggtttcaaaatatttatttcccccaatcggtaggtataactttaaaaattttatttatctacatatgcacaaataaatacttttattaattataataaaaacaatataaaacttattgaattgccgtttgtactactattattgtacatattgattacaacaggtataggtcaatgtatattacactaaaattgatttgagaatatgggacactttctagaaaaggtacaaaccttgtggcccccaaaacaaatactaaaagtaggcagtgttaaattatcaacagataatacacttaacgcgaatagtttagattcggtgaaatcaaaacgaaagtacgttatttgcaatatccgaagaatgatatgtttggcaagattgattattgttaccgtttaaaatcaaccaaactttgtagaatgaccaacagacactttatttttcactacttttaagtgcaacattaactaaaaattaaatgcgatttttctaaaattatttgtgttatgttataaaatatgtcgaatgttagggctagatcaaaatattcacacaggtttgcccctacattttacattatttaattacatacatatataaaaacataagaaacttctgaacacgaatatattttcaagagaaacctaggcttctacttctgtatctgctttcgcttccgctgattctttttcatccagcttggcttttttctctggtgtggcgctctcaacgtccacactgtctgttgcatctccaccgcctgtagatttcctctttacggcaggtttttcttcagattctgaacttccattttcttctgttttttcagcaccattctcggatgatttttctttctcctcatcttcatttgctttggcatccccattttctaccttttctgcgggtttcactggggaggctttgtcatccttgatttttggttcttcttcagtgacttcaacactgggttgttctaccttatccgtcatgtttggggttgattttctttcggttaataaaaaaaaacgagagatttgtgtagcgtaccgcgtgttgctgtggacgatttggcgaggtctttgaatcggagcggacgcgtgtcggtgaaatcaaaacgaaacgtatgttattttcaatatacgaagaatgatatgtttggcaagatcgattattagttaccgtttaaaatcaatcaaactcgataggaatgacctacagacactcaattattcattatacaattctggtgctatcctcatgtacaaatccatatcaagttcattatgatgagtgatgaaaggtttagcgacagcgcctccggcttgcatgttcatcataggcgtttcaatttccaaaaaacccatctcatctaaataccttcgtacataggcaataatcttagctctgacttcgaagattttgcggaccctgttgtttaagataagatcaagatacctctgcctgaatctggtttctttatctttaagaccgaagtgcaaatgaggaagcatgtgtaaacaaggtgccaaaagtttgattttctgtggtaggattgacagctcgcctttctttgtcttggttggaactccttctataccaatgatatcccctctcctgattttagctgtatcatctacaaatttcgattcatcttcataatatctagcattagccatgacttgtatcttaactccctcacccctcaagtcgtagaaaactaatttaggacctgactctctaatagcatgaattcttcctgccacactaaggtggtcattctctagaatatcaccgtctttcagatatgaatacttctcaataaaactctcgagtgatgacgaaacatggaatttatgaggataaggcgactgttcaccccctataccctttagtttatctacagctgttgatctaagtttaaaatattcatttggactaatttcttcttcactgggttttgtttctttagtcttctgggcttgagcaggctgttgggcagctttttcagccttttctttggctttctgttcagccttaagtcgtcttttaagctcattttttgacaaaggttctccagctgcatcagccatcgttttttatgtctctgactctgtaaaactaaatggtctaaaacacttatcaaaagataccgtatgcaatcttgcaatcggcaacttaaaagattt

SEQ ID NO: 99 - DNA, 1380 bp, Diabrotica virgifera
gacggcttcgtggcagaattatcgctacttgttaacatgtgcgctgcaccatatgaaactaatctcaatattgcgaagagtaacactactaaaccgtgacattttgcaaaataccataaaaaaggagtgtaaagaggttgcaacagtcaggacattttacatcagcccttctgcagatcagtggggaaagaataaaaaacataggaatattaaattgaatctgtacttcgacacaatggcagatcctcaaattgaagaagttttagctcctctaagagccagtgtgaaagaacaaggagacctggtacgtaaactaaaagccgatggtgctccagtttttgatgtcaaaaaagccgtagttgagttacaagctaggaaaaagcttctagaagataaagagctcagcttagcacctaaccagacgtttgatagagcaaaaatggaagatctgcttaaaagaagattcttttttgatcagagtttcgccatatatggaggtattactggacagtttgatttcggaccaatgggttgtgcatttaaggcaaacttattacagacctggcgacaattttttgtcttggaggaacagatgttggaagtagattgttctattttgacaccagaacctgttctcaaagcctctggacatgtagatagatttgctgacctcatggttaaggatacaaaaaccggagaatgctttaggctagatcatttaatcaaagcccatttagaaaagatttcagcggataagaaaacttctgctgcaacaagggaggaatgtcaagatattgtcatcaagttggatggaatgaataaagatgaaatgggagctgtaatgaaaaaattcgatatgaaaagccctcttactggaaatgccctaaccgaacctatggagttcaatctaatgttcgcaactcagataggcccatctggtttaattaaaggatttttgcggcctgaaacagcccagggcatctttgtcaattttaaacgtcttctagagttcaaccaagggaaattgccatttgctgcagctcaaataggtaatgcatttagaaatgaaatatctccacgatctggcctcataagagttagggaatttacaatggctgaaattgaacatttttgcgaccctagtgataaatctcatcccaagttcgataatgtgcgagacacacaactgttattgtactcagcttgtaatcagatggatggaaaagcagctgaaaggaaaactattggtgttgctgttgattcgggtctggtggcaaatcaaactttgggatactttatggcccgaatccaacagtttttagtaaaatctggagttgatccagcaagattaagattcaggcaacatatggcaaatgaaat

SEQ ID NO: 100 - DNA, 1007 bp, Diabrotica virgifera
cttaaaggttcaattattgtgtgtgaattatatttaagtttattatacatagttatattttcggtcgtaacatgtctaaagaagaagatgtacaggtgatacccgatataatttatgatgttcacacaaagacttattacaagaaaggaaagttttatggaaagggtggatttgcaaaatgttacgagctgacaaactcccagaacaaccaatcctatgcaggcaagatagtttccaaaacgttgatgcaaaagcaaaatcaaaaagaaaagatgacccaagaaatacagattcaccaatcacttcgacacaaaaatgttgtcggcttccataatttttttgatgacaatcacaacatttatattatattagaattatgtagaaaaaagtcaatgatggaacttcacaagagaagaaaagccctaacagaaccagaaactaggttttatatgaaacagatattatctggagtgcaatacctccatcaggcaagaataatccacagggatttaaaattaggcaatttatttttaaatgataatctgatagtaaaaataggcgatttcgggttggcagccaaaattgaatatgaaggggagagaaaaaagactctgtgtggaactcctaattatatcgcccctgaaattttaacaaagaagggtcattcctttgaagttgatatttggtctattggctgtattatgtataccttgctaatcggaaagccgccttttgaaactaccactttaaaggaaacttactctaagattaagaaatgtgaatataaattatctccaaacatttcttcatcggcacagcaaatgataatattaatgctacaatcagatccgaagaaccgtccaaaagtagacgcgctaataagacacgattttatacaaaatggttattgtcctcccagtctgcctgttagagcactcacaatggctcctagatttgaaaatttgggatgaggctcctcgtagggctcttgatgcaaataaataatt

SEQ ID NO: 101 - DNA, 1329 bp, Diabrotica virgifera
aacaaatcggaggtatgtcacatcagtgactatatgcagggtgtaacaggggtgcgggtcataaatttggtcacatatcctgggaccgggaatagtttgattggacctaacttgccttagtgcgagtgtgcacaggggaaaagttacagccctttgaagttatatattaatagcaccaagggccttagaggcccatggcttgaaaagtttgttttttcttcattttcacgtttctttatgtactgagatcttctctggcttgatatgtgatttttctccattccttcctcttattcatttttcttttctgaccctgtaacaccattctttccaaatctttttcgacctcttgcttccatctattttccggtcttcctcttctctttcttgaagctatagtgtagtttagtacccttttcggagtcctcgtttttggcatcctttcaatgtgacctcgtgatctaagtctctgtgcctttatcactcatttgaagttacaaaatgaaaagtgattttttccaatgtatcgaaaacaatgtgcttttgtgcacgtttcagtttaattattattgtagtacctaccatttaaacaacgttttgaaaacttttttgcctcttattgctttttcgagaagtcaatttttatcgaaatattgtgaatatttgtcaaatccaccacatatttgtatatggttaagtacgattatggagacttggtaataatatgcaaacttatttatgctttacatttttaggtatattttgaaccatattaaaaaagaagccagactcgataaaacgtgccttatcgaaaaagtacaagaggcagaaaagttttgaaaacactctgtttaactaatgttacctcagtaatagttttattggacatacacatttggggggggttaaaggaacaaacccccataaaatttttttcggatgtgatgacgttccacgtcgcgccacgtgtataaaagattgatagaaatggtcggaaccgaagtctatcaagtttcttgacccatctgagaagtcactatacccctattctgcgagaggtactgcggcatttgtctgatgtatgacaaggaaagatggtataaaaggatcaaccggaaatcgccttagggagagaaacctgcgaaatgtaaaggtgatatccaagtctgaatgaaacctgatgcgatcaatccaatgagtgagattcttgacggaacgatcatcaagaagcacgacgccgaaaggagatagaattacccctacagagtgaattactactccaagagaaacatcacgagagttatcaagtccagccctctattttgatgg

SEQ ID NO: 102 - DNA, 1150 bp, Diabrotica virgifera
  misc_feature (1072)..(1072): n is a, c, g, or t
agcgaaatggtttgaagagtttgtaaatgacttgaactgtttgttatctgtttgcgttccatcgaacaatgaaacaaagtaaacaatgataaaggacgcatttgtgcactgctgggaatgactaaaacttcgggcgtggctaaccagataaacattactcatcaccggtaaaattgacagttggagaaagaagaaaccagccatcgagtcgacgagactgcttcgatagtgcgcgaccaagtgtttactaataatgctagcttgaaggacgtagtttagtgttttctcgcaacatgagtgccaataatgtgaatgctcaagtccctaccactcaagcgaccgccacaatcaaatctagaccaaacataatgcctagcagttacatgtacacatccagtagtgctcttttgaaccgcagttccgaaaacaaaccgactcctccacctacgcttccgaaatacacctcgagttttaatgcaggcagtagtttaaatagagacagagacaaggacagtgttggtggttcctacaggctttctagtctcgatcgtgtcgccatgagacaaaagtttatggaccagcagaacaacacaacagtcaccaccactacaaccaatggctcaccccaaaccaacggaaatggtgacgctgtatcagctgctacccttcaaactaaacgtgaaatgttcttcacttcaactgaaaacaactctcattccattacaagctctctaacaaaagattcaaatagactgaacaagactccttcattggaaaagcctatagacacatctttaaaaacattatcacctgattccaatagagatgataccagcaaagaatccaccccagaaattatcaaagaacgtccaaagcctaaggaattagatgggtacgtaggatttgctaatcttcctaatcaagtatatcgaaaagccgtcaaaaaaggatttgagtttactttgatggtcgttggtgaatcaggtctcggaaaatcaacattaatcaactcaatgtttttaaccgacatctataattcatcagattatccaggacctactcaaagacttanaaaaacagtggctgtcgaacaacaaaagtgctattaaaagaaaatggtgtaaatctgttgcttacggtagtggacact

SEQ ID NO: 103 - DNA, 1060 bp, Diabrotica virgifera
taaagagtgaggttatttttgtttttttccttctaaatttgtttttaattcaaaataagttttgaaatgattgctgaaataatttaaatttactattcgaaatatgatcattgtagaatggaaagtgaacaccaggagaaatcttctttttggaagaagaatgtaaaatcagtagctggaagaccaagtccgaagcgtgatgtaaaggacattaggaaaactccaggttcaacctcatttcaagactttcaagcatcagttagtgatgcttgggatttagatgatgatgagttttgtattatatcaggattagaaaatacaaaaatatcaaagaaagtagcacactctgcagctttaaatgtactgaatagtcatagaagtacgactgaatctgaagcatccactgaaaagaaacatagtaagcggatgaatatttctgaaaccgaatcaattaaaattagtcgaatacctggtcggccaaaaccaattcgtagattgccttgcgaacaagaaggtgttgaaaaaaaattagaaagatttgaaaatatcctagaaacttcattaacattacaagaattgtgtcagctcagttggtctggtataccagcaaaagttaggggtatcacatggagactgctttccgggtcttccaatgaatatagaaagaagaaatgaagtattagaaagaaagagacacgattattggtctctagtagaaaaatattattatacagaacatgatgaaacaaatcgtgatattcaacaccaaattaatattgatgtgccaagaatgaacccttcaataccattatttcacaaaagacagttcagataatgtttgaaaggatattatttatttggtcaatacgtcatccagcctctggatatgttcagggtataaatgatttagttacgccgctttatatagtgttcttgctagaatatttaaaagaagaatcaaccatttgagaaagtgtttcgttgatgaattgactgaggatcaacgcacaggggtggggggaagcaaaattcatttccggggggttttttccaaaatttt

SEQ ID NO: 104 - DNA, 1853 bp, Diabrotica virgifera
actagttctagatcgcgagcggccgccctttttttttttttttcaatatttatctaattataaaaattattttatatatttggtcctttcgtactaaaatatattaataaattaaagatataaaccaccctggctcacaccgatttaaactcaaatcctgtaaaattttaaaagtctaacagacttaataatatagctgctacgccaattatagactttactccaacatcgaggcccgctatcttatatctatcgttttgaacgctccaagtaaaatcacgctgtaatccttagggtaatttattctaatattttgaatccagcggcggtgagaggttcattttcatcagtaaaaatggcactaaacaaactcgcaatcgatgcaattgatctcgcaaacaaaagagttctgatgagagtggacttcaatgtccccttaaaagatggtgccataactaacaaccaaagaatcgtagcagctttagataccatcaagtatgccctggataaacaagcgaaaagtgtagttcttatgtctcacttgggaagaccagatggcagtcccaatccaaaatacaccttaaagcctgttgctggagaactggaaaaattactgagcaggccaatccagttcttacctgattgtgttggttccgaagttgaaaaggagtgtgctgatcccaagcctggttctgttattttgttagaaaacttgagataccacattgaagaagaagggaagggtgtagatgccagtggtaacaaagttaaagcagatcctgccaaagtcaaagcttttagagaaagtcttcgtaaattgggagatgtatacgttaatgatgcattcggtactgcacacagagcccattcgtcaatgatgggagaaggatttgacaagagagcttcaggatttttgcttaaaaaggaactgcagtatttcgctaaggctttggataaccccgaaaggcccttcttggcaattttggggggtgctaaagtagcagataaaatccagctgattgaaaatctgttagacaaagtaaacgagatgattattggtggtggtatggcatacacattccttaaagagagccaaggcatgaagattggagattccttgtatgacaaagaaggagcaaaaatcgtgaacaaactgttggaaaaagctaaagccaacaacgttcagatacatttacccgtagattttgttgttgctgatggattttctgaaaatgccaagactgattccgctaccgctgcagcgggtatttctgatggatggatgggactcgacattggaccaaaaactatcgaacaattcagagaacctgtcaggcgtgccaaagttatcgtttggaacggacctgctggtgtattcgagtgggataaatttgctacaggaactaaagccattatggatgaagttgtgaatgtcactggcaaaggagccatcactattattggtggaggcgatacagcaacctgcgcagccaaatggaagaccgaagacaaagtatctcacgtttcaaccggaggtggtgccagtctcgaactgttggagggaaaagttcttccaggagtcgccgcgttatctgatgcctaagaaccatcgttttcttcagacgtttctagaagaactcagaccaaacgttactcatacatattccaaagtctgcataaatctgtgttcaacatgggaagacgcgttatcaaatttgtggtctgaggataaattcctgcaaaattttgagtgtctgttactgtatgttcatataatgttccacaatttatttatgtagatatatttcatttgtttttgtcctcgttagacaataaaaatatttatcgattac

SEQ ID NO: 105 - DNA, 1096 bp, Diabrotica virgifera
tagtaggtttctttcagagtgctgtttgctgtatcatatattttaaaactttaattttaataactatttctgtagtaattattatttagataatatatctctattcaaataatcgaaattatgcctgctgggggagccttatttggtagctcagctgctggcccaggttctaccgggggaaataaacatcttattgaagtgagagctggaaaaatgaatttaaaagggcggacggttaatgcagacaaacgcaaaggtttactgtatgtgtatcaaagtgatgactctttaatgcacttttgttggcaagacagaactacaggcattgttgaggatgatctgattatttttccagatgactgtgaatatgtaaaggttcctcaatgcacaacaggtcgtgcttacttgctaaaattcaagtcatcaaataagaaattctttttctggttacaggaacctaaaactgataaggatgaagataactgtaaaagaattaatgaactactaaataatccatcgagtgctgttcaaaatacaccaaatcctgatcaagatttgcagtctcttctaaataatatgtcccagtcccagctgatgcagctgtttggcagtggagttggccagatcggaggattgtcgagtcttctgggaaccattagaggtccaaatagtggaagcgctcgaactagcacaacacctgctattacacacagaactactgtacctactacccccacaccaacaccagcgaccaactctcaaactagtactacacccgcaccaggaactacaacccctcagaatccaattccaacagttactcctgatgctccaagggtaagaggaagtacgactagaccccaagatgagagttctccttcatcatttccttcttcaagtcctattcagttagcagatttgcagaactttctttcaggtcttactccaccacctggagcaggagcacctgctggaggggctcagcaggctcaatcagttgatttatctactgctttaaccagtgagagtctagcaggagttttgagtaatccagagactcttcagcaattacagaatcatttgccagcagttgatg

SEQ ID NO: 106 - DNA, 212 bp, Diabrotica virgifera
caacgatttacaatggaaaatttccaatacattcttgtagtcttcttatttttgggtttcattggccaaattgaaaacgcagctttgggtttgggcgatgcttctggagcatttggattaggcgtacttagtaaaattgctgctgcactcgctggcagtggcagcaccaccatataaaatgtaacatcagaagtttgtaatatattaccagc

SEQ ID NO: 107 - DNA, 449 bp, Diabrotica virgifera
gcgtaggacaatgcaacaccctaaaaatatattctacccatgaagatcagcatacaaggtctcaattttctactactgcaggaatgcaggagactaatcaacaaacagctgctacaagaagacacagtttaacacaaaatgcaacaaataatataagtagttcacaagaaaatggaaaatctgcaccctcagttatttcaacgacacagcaccaggaagatcagatatcctcatcaaaaactcaaaacgcagaaattttgaccaaaactaaatctgaggaggatatatattcatcaaggctgcaacacgctgaaatcgtaacaataactcagcctcaggaacaaatctactcgtcaggagatcaaaacttcaatacagaaaaagcaagaattattgaaaaaggaaaaactagtgatcgtagttccggaaatgcagctgtattgattaat

SEQ ID NO: 108 - DNA, 1122 bp, Diabrotica virgifera
ccgcaccgaccaaacgtcaacatgatgagatgaggtggaatttatccatatttatcaataattatgtattgcaacttttgaaaaaatttgcgtatgataaataagttgaaggcaattatcttgattgtaatttatacaagctttgtaaaattaatcattgctcaatacaatatgtctaaggaaaaacaagcagttaattccaaaaacaaatactcaatactcttaccaacttacaatgaggtggaaaatcttccaattattctttatcttatagtaaaatacatgaatcgaagcaactgtgattacgagataatagtaatagatgacggaagtccagatggcacacttgaagcagcaaagcagctccaaaaaatatatggtgaagataaaatttttttaagacctagagaaaaaaagctaggcttgggaacagcttatattcatggtatcaatcatgctacaggcaactttatcattataatggatgctgacttaagtcaccatccaaaatttatatcccagtttatcgaaaaacaacagtcacaagattatgacgtagtttctggtactcgctacataggagatggaggagtatccggatgggattttaaaagaaaactagtgtctcgtggagcaaacttcctaactcagcttttattaagacccggtgcgtctgatctaacaggatcattccgtctctacaaaaaagatgttcttgaaaaacttatcaacagttgtgtgtctaaaggttatgtctttcagatggaaatgatagttagagccagggagttaaactactcagtgggtgaagtgccaattactttcgtagatagagtctatggggaatcgaagttaggagggtcagaaattgttcagtttgttagagcattgttgtatctttttgctactacatagaaattattctcttgtgcattccccccccatacatactctctacgttcttctacccctgatgttcttctccctgcccccagtattcccccctttttatttgcaccactataaacccgccccctttttttttcccccccccttttcacccatcacttttctgccatcctccccccccctccccccccaatttagattttcttcccaccc

SEQ ID NO: 109 - DNA, 1131 bp, Diabrotica virgifera
tgacaatgaagtaacgttgcaaggaacaattggttttggcatagattttacagtaagtgactgccagaaccactatactcaatgcgcttttaacggatcctcactatcaataaatgaggtcgatagtggttaccaaatcgtctggaattctgtttatacagatggtgagtttgtggataaatttcaactgaattcaggaaacagttactggtttggcggtccagaaaggtacctacagaacccgttggagaagttagtattaaatggaaatgatccgtatgtaatcaaaaaggcagacaattttgctgtagctgaaagatactggttaaatagtaagggtacctttatttttattgatgataaagtaccgctattcattgaccaaaataataacgaaaacggagcactacttctgatagctaagtgtataaatccctatgtgaatcgtcagaggaacattctaaagtacgatcttgttacgaagaaaaacgccaaagaagctcacctccatgccgtcaacaactacctaggaaaaccaacaggatacccaaatgaaaatatgataagaaaaccaatatggaccacttggcctaaatataaacagcctgtcgatcaaaacaaagtaaatgagtttgtgaaaagtattgtcgaccataactttttgggaggacagatagaaatcgatgagaactgggaagtatgctttgggtcccacgtatttaacaaggacaaatttccagatccaaatggtttaatagattccataaaatcccaaggctttaaaactgccctgtggattaatccgtttgttaacaatgattgtcagaattattctaacgagggactttgacaaatgatactttgttaaagatgtcaatggtgatactagagctatttggtgggaaagtgataatgctcatcacgtagattttacaaatccagatgccgccaaatggttttccgacaaaatcaaagcactatctgacgatcctggcctacatggtttcaagtttgatgcacgataaacagattacgcaatgccgccacaccagtttgatcatgtcgaagatcaagaagaagttcccaatatattcaccaaacaatatgttgaaacttgtgcgcaatttggag

SEQ ID NO: 110 - DNA, 1009 bp, Diabrotica virgifera
caagaaattaatcaacagagccagtatgtcgagaaactgaaggagcaaatgttagaacaggacgaactcatcgccagtacgagaagggactatgaggccttgcaggctgaaatgaacaggatacaacaagaaaacgaaagcgccaaagaagaagtcaaagaagttttgcaagcgctcgaagaattggccgtcaactacgaccagaagagtcaagaagtcgaagctaaaaacaaagaaatggaatctctctctgaagaactcatgcaaaaacagactaaccttaactccactaccaccgaattgcaacaattgcgtgacatgaataaccaccagaagaagagaatcactgagatgctgagtaatctactgaaggagttaggagagataggcagttcgctgggaggaggggacggtcaagatattaagatatctaacgatgtggctaaattagaagaagaatttacggttgcacgattgtacatttcccgtatgaaaagtgaagtcacaagccttacacagcgattgcaagagatcgaaaacaaagaacaggacagcaacaaaaaagttactgaatacgagaaggaattggctgagtgtcgattgttgatttcccaacatgaagctaggatgaagagcttgcaggagtccatgagggaagctgagaacaagaagagattgttagaagagaatatcgacgcgctgagggaggaatgtgctaaattgaaagcagcagaacaggtgcaaagtgcgagtgagagtgaaaagaaggaagccaatgaacttcgtgtagctttggaacagcaaatggaccagttgagagatgtccaccagaaacaagttgcggcattgagggatgagatagcggaaaagcagagcttgataaacgatatcaaagattcaaaccaaaagctcactctggcccagcaacaactccaagcagattatgagaaagatcagtccgacgagaccgagaaagtcagcaaactgcaggaacttatcgctacgaacg

SEQ ID NO: 111 - DNA, 1136 bp, Diabrotica virgifera
acttgactaaagtgatacatgtatttggcgaacgtccgaaataaagaaaaaacggcgtgcaaagattgtgtttgtggtgtcttagtttgtttactgatggtgcaaggatagtggtttaataaaaatatactgataataagaaatttaactccaaaatgaacaatatgaatatatcgatgctatgcatattattttttggactgttggtatcctttgtccattgtcagatatgtcaagtaagtggaagtgacactataacagcaattgactgtaacacagtgagattggtaggaagagatctgcatctggattcaaatatccctgccactagtaaacttgtggttctaaatcttaacaattgttctggaaggatcgacgatcattcattttcgaatatcaaacatctaagatccataaatatagataactgtgtactggaaaaatttaaagtaccaaacctaccagacctaaaagatttggacatacggaactcatttcttccaaggatcaccagagcttcgctgaagaatggaaaaaatctgaaacgagtagccttgtccgaaaataaagtagatataaccagcgggtcatttcaggatttaactgcccttactgccttagatatagaacaccagaacatcactttggataaacattttttgagaggactcagaaatttgatcttactcagtataacagattccacagttacacaaatttcaagcgatagctttacggaagtaccagagcttcttgatctcagcctggagagaaatccaatacagcacatagaaaacggagcattcgatcctttaaaaaactgaaaaacctaaatctcctcgataaccaactggacaactcgacgtaaccaacttcaaagaaaccagaaacttagaatctatacgagttcctgcgagacttgtcaaaaactttcgatctcagaaatttctggagtactgcccacggttactaactttgatttcagttatctgattgtgtgaaccgaaggtaagagtttgggaaccaaagcgataattgaatgcttatgttttattttattatgatggtatgatagacctgatcgttgtgatttatagttttatttttggggaaaaaattttttaatatttcttttt

SEQ ID NO: 112 - DNA, 899 bp, Diabrotica virgifera
ctatcatgaaaaattatctaataaaaatattagatgtaaaacacaagatttactctgaaatttaccatgataattttcaatataaaaatttagaacctgttctatattctagaaagttttcagagtaaactgcgtgagtttctgtgcagaacgttaaataacgtggtggtgtttacgataacaacctttataattacaacacgtgctgatttgtttattcagtgaagtatctttgagagagagaaagacatactttattgatacaatgtaccaaaaggccatcgaccgaagtctttcagccaatttatacaattaatatacattaatacagtatgttttttgttaatattaatacaatgcaataattaaaaaaaatatatttgtatgtggcggtaatcacaacatcactgacaattagttacaatacagatgatgatttaaatagagttgtttattgtcttgatgagtagcagatttcttcaaaaagagttcttcctggatatctacgggcactgtcctctggtatcttcacaatgtggggctcaatcaaatttttgttattgtcattaatagagagatatttaaacagcttattgagtctctcattaataggttcaattccagttttctcgtacagcattctgtttgatggattatgaagtggattatcaggatgacgcattctagtaatttgtcgaaggctagttgtttcagccacttttatattatttttggcaggaccttcagcattatagaaaattgcagaaccatactccagcatgggcctgcaaatcattttataaatattggctgctgtttcaattgtaattccctcattcttgtttttttaacttctgaagtgttttgctctagttataattttcctttttataactgct

SEQ ID NO: 113 - DNA, 1580 bp, Diabrotica virgifera
  misc_feature (16)..(16): n is a, c, g, or t
  misc_feature (98)..(98): n is a, c, g, or t
  misc_feature (1499)..(1499): n is a, c, g, or t
  misc_feature (1538)..(1538): n is a, c, g, or t
cattaggagctttacntcatctaatgagaatgatctttggtactgcgtatgggtcgattggagattacttaaagaagaataaagtaatgtctccaaangctataagaaaatcatttattctagcgtctcatattatacctgggatattgatgatatgtgtcatttttatgggttgcaattgggtgccgttaataattttactaacattcagcatggctattaatggagcagctgtgttaactaatttacagaatcctcaagatctagcacccaactttgcaggttctattttcggaattattagttgtataggaggtaccactggattcttagtacctgcgattacaggggcatttattcagaaacataacggtttgaaggaatggtcttatacgtttatattcggcggatgcgtttacattggaactggtataatctttatcttgtttggtagtgttgaggagcaaccgtggaataggattgcagatacagaaaatcattagaaaatctaaaatcagtagtacaaaatgttgatgtcgactggttttctttaattgtgtagacctctttatacggttaaaattatagctagcattaaatcaaaactatttttggtaaatttaaacagtttcagctgattgctctgttgtttgacaacgtatttgtcaaatacctattttataaaaatttacattgtaactaaatgcatgctagtgtgaccaactccaagtcagtccaattcgggacaaagctgaaaaaaaacctaaaatccgggacttttcaatgaaaatcgggccatttttttaaacatacaactttaatatcattttattgattatttaacatttatatgttgacaaacatttttttgatgggatgggttggaatgataattacatttttattagtttttgatgtttcgacttccaatctataaatcgttctcaaaaagggaaaaattagaaaatttaactgatgttggatttccatgtaaatagaaccttaagttaataacaaaatataattatcattatttgatattcatgtttttgaatcgtctttcagaagacgataattaaaatacagaaacgggaaaaagtccagggtttgactttttgtagaactgtaataccacgatataaaatgcaagcgttttggatgtgatattattattacactctagaacagtggtgcccagacttaaactgcatgggatctaccacataaattgcaagcatccagcgatcgactgctaataaaaaatcaatttagaaaataaaaattttgattgcaaatttctattttataaaaagttgtaaagttgcgcgtgaggtaagttagcgcagttcccatcttttccattttttgtatatttttcgtgaatcgcgatcgacttcaaaaacttttgcgatcgaccggtcgatcgcgatcgaccatttgagcaccgctgctctagaaattgtcgactttttttcgtcccaccaatttaatttcatgtnaattcttagaagaataatgtattcaaaatttcacaatangatttttacccaaacgttgaaaattcggatggcccggaagcc

SEQ ID NO: 114 - DNA, 1343 bp, Diabrotica virgifera
  misc_feature (1249)..(1249): n is a, c, g, or t
cccacccgggcgaggatatattagttgaaatggttaaattaaaagtagtaattttattgttggcaatatccaatgttttttgtaaaaacactactttggatgctattggaaattttataagaaactataggaaatcttttaatgttagcgatgccgtcttcgaaccatattctgatctaggacttgatatttataaatttttggccaaatataactatcccgtagaaactcattgggtaaaaactgaagatggctatatccttcgaatgcaacggctagtaggaggccaaaatggaacgcacgttaacacaaaagataaaccagctgttcttcttatgcatggtcttctaagtagtgccatggattttgtaaattatggcccaaatagatcaattgcattgatgttagcagatgaaggatatgacgtttggttaggaaataacagaggaactacttggtcgagaatgcatgagacattggatcctgataatgatgcaaaatattatgattacagttttgacgaatgtggttactacgatttgcccgcaaaaattgactatatcgtcaataagactggacaggaaaagatattttatataggacattcccagggaacatctcagttttttgctatggcagctttaagaccagaatataatgaaaaaatcgctttaatgtcagccttagctccggttgcctatatgaatcacatgagttctacgagtttgaggattgtgagccaatatcttgatatcttgaaattaatattggtggacattttaaatattcatagtctgctgtcgcattcttggatttatacagaactggccaaattgtatattgtcataaccgacgttgtaccacaagcaaaagaaatcggagcaatagtagcatttttctctagtgggtttaataatagagaatttgacaggtcatttgtaccaataatattgtctaatgcacctgctggaatatcttcaaaaatggctatacattatggacaagaaattatttcagggaaattcagaagatacgattatcaattaggtaattatgaaaaatataattcacttttcccaccggactacaatttgtctgccattactgcaccaattgtactttattactcaaaaaatgactatatggtaggagttaaggaccgtagaaaggttgtccaaggagtacccaacggttgtgaagttacaattagtccaagatagacggtttaatcatctggattacctttggngcgaagatgtgcacacaatctcaatgatgatgtgattgcactcagaataatacatacccagtgacccacaccaagggctcgcaatacatttatg

SEQ ID NO: 115 - DNA, 1770 bp, Diabrotica virgifera
ggaacgtacaattcctttaaaccttctctacctatcagtccctcaaccacagcaggcctaggtaattttggatctagcaatggtttcctagcatctaatacttttggctctacaaatggattcagtcaagcttcctatggaggtcagcctattgcaaattatggagttaaacctataaccgaaaattatcaagatcaaggatatgaaagtttcggggcctctgtaggttcatatggttcaacaggattatacaaaaaagagttaaacctcaattcagttaacaacaactatcttcaagccaattacgctgataagtaccaaggagttgaatcagcaagagctgagaattatgattgtatctgcgtaccttacgaccaatgtccttcacatgacgttattggaaggaaagatgacttatatttacctcttgaccccagaaatctgaaatccgacatcgaggcacttagcgatgaagaaagagttatcacagatggaaatggtacgatgaccgtagtaacagttaacaaggatacaggattaactggaacaaatgtaactgaagttatgaaggagggtaagaggatcagcaaacgagatacctctgaagtagatgccaaagtaaaccagaatggaggagacggtaaaccagaagcgaggcagttctacggaggcaataacttaataggtcgtccacaaacctgcggtccaagacacgtctgctgcaaacgtccattacgtccacaagtacctcatccaaacaggcagtgtggtaccaggcattctcaaggtattaacggccgcatcaagaaccccgtctatgtatatggcgacagcgaatttggagaatatccctggcaagttgctattctgaagaaagattcaaaagaaagcgtatacgtatgtggaggaacattgatagatcctttgcatattcttactgctgcccattgtgttaaaacatacactggatttgatttacgtgcacgtcttggagaatgggatgtcaaccacgacgtagaattctacccctacatagaacgagacgtagtatctgtccatgttcatcctgaattctacgctggtactctctacaacgatatcgctattttgaggatggacaaacccgtagattggtccaagagcccacacattagtcctgcctgtttgcctcatccccaagacgattacacgggcgccagatgttggacaacaggatggggaaaagatgcttttggagatttcggaaaatatcagaacatacttaaagaagtggatgtaccgatagttgatagcggcatttgtcagagacagttgcagcaaactagattaggctacgacttcaagctccatcctggattcatatgcgctggtggagaagaaggaaaagacgcttgcaaaggtgacggaggtggtccaatggtatgcgaaaggggtggcacttggcaagtagttggtctagtaagttggggtatcggatgtggtcagaccggagttcctggagtttacgttaaagttggctactatctggactggatcaggcaaataacgcaaagatattaggtcgactttaaagaagtcaatgttttacagttagatttaaattaattccaatactttaagattatttattataagttatttatggaatacctagtataatataacttattacttgtatatagttaactttatattcgtttatgttcgtttgttgtgatatattgattttgtactgctactgatcctctttttttttaaataaaatcatct

SEQ ID NO: 116 - DNA, 1463 bp, Diabrotica virgifera
  misc_feature (1290)..(1290): n is a, c, g, or t
ctatactataaaaatacacagtgtgtcctagttcttcgtgataacatgaaactagttgcgatagttgctatttttatgtgtagcgtagccttaactcggggttacagaatactgggtgtttttagttattgtggccatagtcactttagtttggggtatcgaattgcatcggaattagctgcacgagggcatgacgtgactatgataacgtgtaaccctcagaataagggagtgaagaatttaaaggaagtgtcagtagaaggatttaaaagacatcttgaaagttttaacgccgatttagcagattttggacagatgagcttttggggccaattagaatggataaaaggtctaggtattgcctatacagagtatgtgctaactgctcctgaagtaaaacaattatggaactctaatcaggaatttgatcttgttgtgatggagcattttattaatgatgcagcgacgatatttcatcacaggttcaactgtcccttagtgattttagctcccggaccaatgagcatgatgaacaactacctggtaggaaatctagctccgccttcgtatgtaccaagcattttgggaaactacgacgctgaaatgagctattgggaaagactgtcgaacacttacaaatttataatgggagaaattttcatgcatacgaagtttattcctgcgcacaacgagttactgaaacgagtttttccagatgctcctgacctaaacacaattttgtataatgccagcctcattctcatcacttcccatgtcagtttaatagacgccatgcctctacaacaaaacatcaaggaaatcggaggttaccatgtcaccgatccagaacctctgccaaagaatcttaaagactttttagacagcgccaaagacggagcaatcattttctctatgggatccaatctaaaaagctccgattttgaaccagagaaaaaacgagccatcttgaaggctttttcgaaaatcaagcaaaaggttctttggaaatttgagacggaccttccagagaagagtgataatgtgatgatttctagctggctacctcaaaaagatgccttggctcatccaaatgtgataggatttattggacatggaggtttactcggcactattgaagccatatatcatggtgtgcccatattgggtatgccaatcttttgggaccagatgaagaatatcgaggaagctgttagaaaaggttacggtgtaaaactcaactttgctgacttaactgaggagacatttgaaaagtccttaaatgaattgatncacaatccgaaatacagagaatgtgccaagacaagatccaagatcatgcatgaccaaccaacgaagcaaatcgatgaagcaatgttctggatagagtacgtggtcaggcataaaggagccccacatttgagatctcaatctgtcaaattacggtggtaccaactgtatttatt

SEQ ID NO: 117 - DNA, 1141 bp, Diabrotica virgifera
  misc_feature (996)..(996): n is a, c, g, or t
  misc_feature (1063)..(1063): n is a, c, g, or t
  misc_feature (1071)..(1072): n is a, c, g, or t
  misc_feature (1076)..(1076): n is a, c, g, or t
  misc_feature (1079)..(1079): n is a, c, g, or t
  misc_feature (1088)..(1088): n is a, c, g, or t
  misc_feature (1101)..(1101): n is a, c, g, or t
cctttcgcgtccgcaactacattgaaggtggccttaattccagtatgggatatgaaaatgttacggaattaatttatcaaataatcgtatacacgacttaaaatggataccaatgggaattgagaaactcaacttacaacacaatagcctgactcacattgactctgaacttttcaaaattattaatagcacaaagagtctaaataaattggaattggcgtataatccttggtcatgtggatgctctgcttttgatctacaacagtttctacaaaatcgccacacaattgtaaattcaacagacgttttttgtcagaaggaaaagcagtatctagttaaaaaagctgacctgtgtaaaacatcttcagctctcattctgtcagtagtattcccgattgtagccctcctgattttaacaatagtaacgcttgtattatacatctattacaggcaggaagttaaagtttggttatatgccaagaatatctgtttatgcttggttactgaagaagagcttgacgaagataaagaatatgatgtgtttttaagttatgcgcaccaagacgaagtatttgtcctccagaatttacttccagctcttgaaccactcagaacttgcattcacatcagagattggaaacccggtgagacgatactgacaaatgttaatgattccgttatgaattctagaagaaccttggttgttctttcgaataacttcttagacagcgtttggggcatacaagaatttaaaactgctcatactcaagctattaaggaaggtcgtgctagagtgatcgtagtgaaatatggcgaacttgataaaagcaggttggatgtagatatagagacatatctaaagaccaacacttacgtagaatgggggagaaccttggttctggaataagtttaattatgctttaccccatcgccgagaaaaaggatgttgtaatcctttctgtaagtcaaatcaaaaacacgatagtatcatgttanaaattgatgacaaatttgaacttactaatcctcctgtgaaccacgcagaaagactccctccagttgntactctgnnaccnggncgtacttanaaatcatcctttngactttcaaaaaactagtgactcgcacatttcttcgtctg

SEQ ID NO: 118 - DNA, 1202 bp, Diabrotica virgifera
agcctatcgtcaacataaaaacatggctccaaaattatacaaaatgaatcttagtccgccagtaagggctgtattattgtgttcaaagattgcaaatatagatctggagttaattgatgtgaatttaatggcaggagaacaaatgacacaggattatttaaagttaaaccctcaacataccgtaccacttttagatgatgacggattcattttagccgatagtcatgctattatgcagtaccttattgaaacatatgctgaagattcgcctttacttccaaaagatataaaatcgagagctactctcaaccatagactacattttgacactggcattctcttcgcaagggggctcgcaataacaaaattaataatatttgaatcagtcaaagaagtccccgaaaaatatatagctttattagatgaggctattggaatagtagaaaaatttctaacccaaaacgaatggatagctggcgaccaaatgaccatcgctgatcttagctgtgttaccaacgttacaactttttcatactttattccaatcacagaagaaaggtttccaaaaatatcagcatggatcaaaagatttgaggatgtgccccattttaaagaaattaacgaaggagttaacgattatattaatgttattgaagcagccatgaatcgtgattagtgatattaaaaacgataacattctttttctaaatgtgtatctgcaccaaagcaacttacttcaacttttgtgttttacaatgttgaagtaggttgaattaagtttcacatttttgtaacaaagtatctatacccaagcaactttgttgttccaatgttggagtttgttgcacgtatttgcggctagatgtatcatcatgtatccactgaaacaacagttgattataatgagcgacgaaagaggcacctgctccggatttcttcatacacttgtattttttcctttctccgaaaaactgagttcacaaatttgatattttatggaatgcctcttctataatttcacagtttaaactgctacgaatattgaacctggcatcatatttaccttctctacatttataatttttcgtaagtgtgcatctatgagatatagatatgctgtttataattatatcttatgatcatcgatccatctacagtgtcatttaccaccaaattattaactggattgaaaagaggaaact

SEQ ID NO: 119 - DNA, 1677 bp, Diabrotica virgifera
  misc_feature (1660)..(1660): n is a, c, g, or t
cgtagcgttcgtaaacgtcattagtgtcaaagtcaatgttaagttaaaaactataatcacgattcacgatcgtattttattctgcgttgtgagttgaaatgtaatctataactcgaattaaacaaaattagcttagttattgtttaaccagtgaattaatcgttaagagtttaacttaaaatatgtacaacattttttaaacatggattacaaaagaagaggatatgtgatatgtaccatagtgttttttgttttatttgtaaatattgcgtcgcttcaaaatgtgaatcaaacaatcgtttcatcagaggccccactcactaaagaaactgttaccgaagcaaacacaaagaatcaagttgacaaagcaactgcagtgccaagcaaagattcacaaaatgttactgttacaactgcgactacaccaaataatgtcacgaatactactacagaagcccctgctactgtagacaaaccagacaatgcttcgacggtggtaaagcagaccaatacaacatcagaaaatgttactactgcacaaacagcggacccagtaccagtactgcctgccaaagaggctgctgaagatgaacataacagttctatggcgatattttttgtactctgcgttttagctttgggaattttgttgatacatttaatgcttcaaactcacttccagtatgtccccgaaagcattgttatagttttcttaggagctttaattggattgatcatgaatgctctgtctagtagaaatataagtaattggagaaaggaagaagctttttctcctacggctttcttcttaatacttttgcctccgattatattcgaatcaggatacaacttgcataaaggtaacttctttcagaacataggctcgatactggtttttgccatatttggaacaaccatttctgcttttattatcggctttggaatatatttcctgggtttagcagacgttgtctatagattaggttttgtagaatcttttgcatttggttccttgatttctgctgttgaccctgtggccactattgcaatattccatgctcttaatgtagatcccattttgaacatgttggtgtttggggagagtattcttaatgatgccattgccattgtgcttaccaatgctgctttggaatctaataatcccgatatgaatactggtgaagctattgttttgggaatagagagattttgtttgatgttctttgcttctgctcttcttggtgtggtttttgcacttgttagtgcacttttattaaaacatgttgacctgagaaagaatccttccctagaatttggcatgatgttagtctttacgtatgccccatatgtcctggctgaaggcattcatctttcgggaataatggcaattttgttctgtggaattgtcatgtcacattatactcacttcaatctgtctactgttactcagatcactatgcagcagactctcagaactctcgctttcattgcagaaacctgcgtttttgcttatttaggtttagcattgtttagttttaagcatagagtagaaccagcgttgattgtctggagtattgttttatgtctattaggacgagcatgtaatatattcccgctagcaattctagtcaacaaatttagagaacatcagataactaanaaaatgatgtttataat

SEQ ID NO: 120 - DNA, 2862 bp, Diabrotica virgifera
aagaaaacgtgtctatgtttcagaaaaatgaaatcaaaattagtttttttagttatagtagttattctagtgacaaacttaagtgacgctaagccaagagtgaaaagggatattgaaataaatcccgaagatataaaacttagtgaatcttttcctcctagtgataaaaagtggtcttggtatcttagtagaagaggtaaaaattcccaacgaagtgaggactctgaagaattgtataaagacttgactgtggatattgaacctagaagtaccaaatgtgatgaagcacatatcgaacatcaatcaaagaaagaaaagcctgagtctgaagaagtttcagagaaaaatcaaaaagaagaatggagatggtacgtaaaagccaaacctaatgacatattagatacagatacaagcttggagattgtaacctggtatcttaaacaaagaggtcgtacaatatcaccacaaagattaagagcatcagagcatagaacttctattacaaactcacatagaaaaacatctgaatctagcacaggttttactaaatcaaatataattaataattccactgagactcacaatcctactactattggttccaagtcccatacaactaataatattttagaaatagaagaagatgtaacagttaatccttgtttaaatagctctgtaaccgtccaaacaccagacatcgtcaataaaactgaaactttgatttcaaggttgactacaactggtattcaagaatctacccaagttaaaacatcggaagctaacaatataaatacacaagtctcaatcaacgaaaccacaacagacattaacataaataaattaaaaacggtaaaagaagcccagacaacttcaaagcctgctacaaaagatccacatcaacaacagttcttgtaacagaagctaagactataaaaccttctataagacaatccagaccaacaacagttgtccaaaccaaaattacagatgtaaagccttcttacgaaagcagaagcagcagaaactacgacaacaacagctgtaacaactgaagctgcaactactacaacaacagaggcttcagaaataacaacaagagctaaaacaacacaagatacaacaacaacagcagctttttcaacagaagctaaaacaacagctgctgtaacaactgaagctgcaaccactacaacaacagaagctgcagaaaaaacaagaacagttaaaacagcagaagatacaacaagaacaacaactggtacaacagaagctaaatcaacagcagctgtaacaactgaagctgcaactactacaacaactgaagctgccgaaataacgacaacagttaaaacaactgaagatacaacaacaacagatgttacaacagaagctaaaacaacagctgttgtaacaactgaagctgcaactactgaaacaacagaagatgcagaaataacagctacagctgaaacaacagaagatacaacaacagcagatacaacaacaacagctgtaacaacagaagctacaacgacaacattggcaacaacaccatcaacaacaaatatgagaaaacgcgaggtaatcgatttatataagcgaagttacgatgaagtttcaaagaataactccgtagtggatttagaaagaagaaaccgccaggaagttggtacgaaggtaacaacttcatcatcaaacattgatgaagatattaaagatttaggtttaccgtctgcagctgaagaaacaagtttcaatagaagaaaaaaagtgaaatcatatatttatgacacagacacattactacttgtgactgcgttattcagacatggaaatcgaacagtggaaaggacacaatacgagagatatccaaacgatccctataaagatttagattattttcccactggaattggtcagcttactaagaatggtaggaaaagggccttccaaattggtcgccgattaagaaaacgttacagacaatttttgggagatgtattttatccagaaatagtagcagctcaaagtacaaatttggatcgaacaaagatgactttagagttggtattagctggtctatttcctcctagcaaagatgacgaaattagtaaggaacttcagggttggcaaccaatttcgttcaattatttgcccttagcacaggatccggcactaatgccatatttctgtccaaaattcaaaacagaatataaaaaagcagtacaatcaccaaacaacaagttggtattcggcagaaacaacaagatatttaaatatatttcagataacactggagtaaacgtaaccgattttgagatttagacctaaatcttcttaggtttccaagcaaaagaagatttaggcctaaatctcccagattggttaaagagtatatatcctgatcccatggacaagatgtcagccaagtattactaccaactgacgggaaccaacgaattgaagaagatgtttgccggaaatttcctacagcaagtgctcgaaaatataaaaaggaaaatggctgccaacgatggtaagtttggaaagaagatctacctgtactcagctcatgaattcaatgtagccgccttgttggcatctcttggagtttataacaatcatacgcccaattatgggtcttatattataattgaactccatgttaaaggaggagtgcctggaataaaactcttctgggagaactgggatggtagaggacccacactcttgaaattgtcaggatgtcaaactttatgtccattgacgaagtttgtagaattgatttctaacatagtaccagaagaaggtgaaactgcatgtcagtaattttaaatattatattgacaattaggtatattt

SEQ ID NO: 121 - DNA, 1046 bp, Diabrotica virgifera
  misc_feature (933)..(933): n is a, c, g, or t
  misc_feature (1030)..(1030): n is a, c, g, or t
gttatcagcgcgctcatcactgtataaacaacaatggtggctaaatatttgtgtgcgtaaattggtgtacgcgagtgatgtgccataaagtataagtttggattataataccatcaagcaaactgccttaagaaaacgaaacgaaataagaggcatttatctaaaaatacctttccctctaaacttcaagatatatttctttaatgtgacaaacccaatggaagtacacaatggtgcaaccccaatacttcaacaagtagggccatactattatgatgaatacaaagagaaaataaacgtcgtagataatgatgctgaagatagtttgcagtacgacgcttttgatacataccaattcaataaaacgttatctggctctttatcggatgaggattatgtgaccatcatacatccgctacttgtaggtatggttaatacagtaacagcgacgtctcctgcgttattgtcgatagtaaaccaagccattacgcatatttttaatgaaccaaagacgatatatttgacagataaagtaaaaaatattatgtttaacggtatggaattaaattgccagggatcagattttgcttcaaaagcagtatgcacgcaaataaaatctcagatgaaaggagtaaaagaatcaccaacacaaaaaaatgtattgttgttttctttaataggacccaggaacgccactattgctgacacaattaaaatcatgaggggtattaaaaattacagagatctgggaagagtactagaagttaatggtaaaaaggatattggattgtggggaactgaagaatgcaacaggtttaaaggcacagatggttggattatacctccacttctaaacccgaagaaggaattaaatgttatactactcacttatgcaggaatattgccctcgactatgttcgagacgatgtagtntaagggattaacgtacgaagatatgaaaggaatttaggcgaccagcaaacaatccagctgacaagtggtactgtccagaaaatcagacatgccttanaacaggaacatttgaa

SEQ ID NO: 122 - DNA, 857 bp, Diabrotica virgifera
cccacgcgtccggtgcaagcagcaaataacaaactgatgcgatggtccgcggtgaggccgccggaagaagaaagttcaagtgaaatgtgaaaaccggacagacgtcaattccacaccgcacagtagtaacgcatctctttcttcgatttggatctcttgtgaaacccgccacaattgtatctcccgcggtcgtagaaactattgttgtcgttttttatttgtaaaacattttctagtaattgttgtagttatgtcagtgtcgtgtgaattctgtatagtattttgttgggacaaattcttcacgattagtttggcagatgtggaacgctgaagatactggttggattctgttattgattcgtgaaaaaagaagaaaatgacgacgaaaaacgactcatctcagctgatcgtacttaaagatgttaatgattccaggatggaccaaccgacgaatattacggagaacctattaatgataccggagaagaagctgcatcaattaaactcaccagaaatacggtgttcgccctctccgtgcgtttttgactttgatggtaatataattcgaaggtgtggagaaaatactctataccccaaccaatccccttcgaggacgccatctccagcttctgactgttctccgcggctgggtcgaagaggcagcaattttaggagaagcaacagcccttctagccccatattggggtctagaaggggatccactactggttacgaaacatatcagaaaagtttattagaagtgcccatttgtgttgactacggagatccctccagcgatgattttagttcccaatgggattctgatgtaccgcaaacgaaaagggatgtgacgacta

SEQ ID NO: 123 - DNA, 1427 bp, Diabrotica virgifera
  misc_feature (910)..(910): n is a, c, g, or t
atcgtgacgaaaataactgtttgttgaatttctccaattatttgtgtaattttgccattaatcgcgttaaaatggcaacccgagtgtttgtgggtggtcttacttacaaaattcgcgaacgtgacttagaaaagttcttcagaaagtatggaagaatcaaggaggtttccatgaagaatggttatgcatttgtggaattcgacgatcacagagacgccgacgacgcttgctatgagctaaacgtatgtgtatcattaagaggtcaatagttggtttcctatcctggaccaaagattgagtattccttgagggtcattacagatgttcagtcagttacctatcccataccaaatattaaacagagagaaattatttcttgttagacagtggcatcctatcctagaccgagttgaggttacaatagtttatcccagccaaacagcatctagaaaggaattacctttcgtcagaccatgatgtgccatcccaggcccaaagtccaatattcagtgggagccaacaaatgttaacagctgttacctatccagattaaaacaggaaatattccagtcaaagttcagtttcaaaactggtgataatggatgttaacagttgttacccagttcagaccaaacagcatctagagagatattcccatccagtcaaagagggtcatagttgatgttcttgcttttcctcaaccacacagctatagaaactcaaataccaaatattcagtattcattgagatggatgccaagagttgttccctaatccagaaaaaaacccatagtaccatctacagaaccatgcagaaccattacgcatttttactttattatttatcacttaactttcaatattggccaaaaaagatgttaacaacgtattgaaagagtacaaaacaaanagatttaatattctgtatggatcataacagtcctttggtttactccattccaaataacatgaagaactttcctatatgatggtttgcaatcagttattgggccatggatgtaaacagttaaaatgagacaaagttcaaacacaatcacatgtgaagaacagttaagagattggctaatatccattcactgtgaatacttcactatgagggccagagaaagtattagcaaaaccaagtcaatttgattccaacttatccagaaaattatactgaagttacaaaaatttggaaaatgataatatatgctaatggtagtaatcactgtcacaagaaattttcaaacttaccagatgttgtctaaggaacatttctcattttttttttctgaaatgttttaatttccataccctttggttcgttttattctgtagtatttttttctgtgcatgaaataatatccattttttaacatttcaaaaaaaaaaaaaaagggcggccgctcgcgatctaaaactag

SEQ ID NO: 124 - DNA, 1174 bp, Diabrotica virgifera
  misc_feature (1143)..(1143): n is a, c, g, or t
ccttttccccaagagatcgtgacgaaaataactgtttgttgaatttctccaattatttgtgtaattttgccattaatcgcgttaaaatggcaacccgagtgtttgtgggtggtcttacttacaaaattcgcgaacgtgacttagaaaagttcttcagaaagtatggaagaatcaaggaggtttccatgaagaatggttatgcatttgtggaattcgacgatcacagagacgccgacgacgcttgctatgagctaaacggtaaggacttaatgggggaaagaattactgtagaaagagcccgtggtacgccccgcggaagtgatcaatggcggggaagcggtcgagatagaggttattcaggttatagcggtccacgcggtagaaacgataattctagagctcgtgacaaatatgggcccccgacgcgtacagaatacagagttattgttgaaaacttgtctagccgttgtagctggcaagatttgaaggattacatgcgtaaagccggtgaggtaacctttgctgatgctcataaactagttccaaacgagggagtcgtcgaatttgtttcatacagcgatatgaaaaatgctattgaaaagcttgatgatactgaaattaacggacgcagaattagagttttcgaagacagaagaggtggacgaaaaaacaacagatctgtaagtcgcagccgatcacgatcaaggcgtcgttccaagtcaagaagtgccagccgtaataagagccattctaagtcaagatctagatcacattccaaagataataagaggaggtcaaattctagatctgaagacagaatttaaagaagtcgttccattgattttcacaatgtatgttgtgtaaacagtacctttaagtttaataacataatctaacttgtatcatggtttatcataatatgtttgatattgtgtgaacattctcttattttcctaaacttttgttatctttgtaggtgtctttattaaactggaataattaactttgcctttatttaaatgtacagggaatatagtaccacgattagatctcattctcaatttgattattttaatcataattaaaattggttatttttggtatttccatactattcaaaactacattattttggtaaagttnatcccaaatagaaaatcatttcaaaacattt

SEQ ID NO: 125 - DNA, 1264 bp, Diabrotica virgifera
cctcgttgataaaactctacagcagcgtagagattaagtaaatataaacaaatacacaggcataattattataacaaaactgcctaaacaagtttgaggtcaagacaacaagatttatcagctacaggccaccaatcattgtaaaccgttttagtattcctatcattagtgtagcaaaatgttgttgggattttttatattgggaacatgcctgttgcatgtaggacactgcaattcatccccaaccacaaatactgttgaagacatagatgtttattatccaaatataaattggtcaaatatttttgattggaggatattaaaagaatattctcctacatataaaaacttgttggtgtccccaattagtttaagaataattttggctctgctttatcaaggctccagcggcctaactaaaagagaatttgaatctgtgatgcattttacagaccaacaatctgcgagagaggaatttaggaatatccttaacaaattacaggttgccgaatctccagaatatactcttaatttaggaacacgagtttttctagatatcccagtcgcaccacagcagaaatttgcgagtattgccaaagacttctttaaaaccgagctcgtattaacaaattttactaataaagaagaagcgggaaataccattaactcgtgggcagaacaacaaacaaatggaaggatacacaaactaatcgatccagctgatcttgcagacgctttaatggtaatagccaacgctgtgtattttaaagggacttggaaatatcaatttcccttccagactgtagataaattttacgttccagatggaaacaatttcttttccattcaagctcggtttatggctgtagaagataaattttattttcatgaatctcccctattggacgctaaaattttaagactgccttataagggagggcgctactccatgtttatattattaccgaactcgaagggaggtttaccaagtttaattaagcaaataaacataaataacttaaaaagtttgttgtatttgatggatcaacgtcttgttaatgtcacgatccccaagtttcgcttcgattttcaagcgaggtttagtagaactttacaagagtttggtttacttcaaatgtttcaaaacacggccagtttcccgggaattgccagaggagatagcaccattttgagaaaattagtcgtttcggacattgtacagaaatctggcattgaagttaatgagtatggaagtgttgtctat

SEQ ID NO: 126 - DNA, 1017 bp, Diabrotica virgifera
  misc_feature (950)..(950): n is a, c, g, or t
acgtcataacaaactctaaaatacacttgttgcttgcttttaaatattcgaaatttgttggtgccccaacaatttccattaaaaatgatggattccaaataacacgtaagacattcatgtacgaaatttgatacatggcacagttcataatttaatataaccaaatcttgttatctcttttgtactgtactacatagttgcatatttatttttattctttaaaattaatagcaattaacaaatagtgatagccgagtttaacaatatgaaaatgaaaccagactatgcagaaatggtggcagctgttgcatttggtgtactttcagccatttttgtcagtgcatttgtaattttaatagtaatttgcagaagacataaaatgttttacaaaacaattttgtttgaggatgttgctgtcaggcctgaaaaacatctaattgattctgagcctccagaactagagttgggtgaagtaagtgcagatgttgaagatctaactgatgagcaatggattgatgatgctacaggactgataccacattgccttgcaattttaaaaacttgtagatctctcacagaaagattgactgctctagctatgagttctactcctgcttctggagattttagacagatcgttgagagtgcaaggagaatttcgagcagggttgatgatatggtaagaagtatgtatcctcctttagatcccagacttctagaagcccgagccgcagcgttaacgttggcagtaactcacttggcacttttggctaaatacgaatgcggttcaaaagaaagaacgctaatgtggattgatcagtctttgcgcgatatggacagccacttaatgtttttaagagatgcatctatccaacaaaagaacatgaacaaatcccgaatactatgaatctgagtactcctttcgtagtgtaagaaatctttatatactncttatatatcttttatacatatatatacactcttttgaaaatatatatacataaataaatatatttt

SEQ ID NO: 127 - DNA, 1590 bp, Diabrotica virgifera
  misc_feature (1490)..(1490): n is a, c, g, or t
  misc_feature (1549)..(1549): n is a, c, g, or t
  misc_feature (1552)..(1553): n is a, c, g, or t
  misc_feature (1559)..(1559): n is a, c, g, or t
  misc_feature (1574)..(1574): n is a, c, g, or t
tagataccagtgtagatgagttgttagttttctatatttgagcctgtatatacatgtgtagggagcattttcgaacaaaaagtttatttacataaccaattagatggaactcacaactattccaacttttcttgataacgtggcgaatggcctctctacttcaacagcctcctatacttcttccatacataaatcagcaggcataagattttcatggtatgactacttaattttctgcttcttaatattaattagtttgggaataggaatttattttggatgttttgggaagaagcaaaatgtgaaagattatttattagcaggaggaaacatgaaagtttttcctgtggttgtatcattagttgcaagtcatacttcaggaataacgttactagcacttccagcagaagtctacagctttggagcaaattattggctctgtgtcatatgtctttacatagtacctgtaataactgtgtacgttttccttccagtattttacaaactgcagctaacaagtacgtacgaatatttaggaatacgattcgataagaaaacaagaaagctggcatctgtattattcactatttctgtcttttgcttagtacctattgccacatatattccagctatggcgttttcatctgcgactggcttgaatctgcataaagtagtcccagttatttgtggcacttgtattttctacactgcaatcggaggactcaaggctttggtatggtccgacactctacagttctcagcaactcttggagcacttttaacaatattgagtcttggtttgtataaagtaggcggtataggaaaagtaatgacgctagcatattcaactgaccggttggacctttttgattttgctttggactttacaaaaagagattccttttggactatagtaatggcttcacgtttcattggatagcggtaatgtccatcaatcagggttgtatgcagaagttcttggcagttggcacttttagggaatctaaatgggttgcctttttatattgctccgttggaatgactgcagtaaaatctatcagcattgtgagtggattaaccatgtatacccactatgcagattgcgatcctttaaagtctcataaaatacgacataacaacgaaatatttccttactttgttctggatgtggctggtaaaattcctggattatctggattatttattgctggcgtcttttgtgcgtctttaagtgctctctcatgtaatttgaacagcttagctggaaccatatatgaagattttatcaaaccgaaacttagtcccaaaaatcaagaaaatgctggatattttctaaaagggctagttgttataattggtatcatcggaaccgctcttgtttacatcgttgaacagttaggaggtctcctatcgttatccgttggcctgggaggtattgcccaagggccattgctggggctttttacattagggatgctatttccaagagncaatgcaaaaggtgctttctggtggagctttggccagtgtagtatcagttactggcttnagnnttttgncgcttattatctaanatcacaacatattatt

SEQ ID NO: 128 - DNA, 489 bp, Diabrotica virgifera
gatcaataaaatcagagtaataacaaaatagttgtagactattcgttgacaagatgaattcaagtattttggtagttttaatgtgtttgtgcgctgcacaatttgctttcggctcacagcatgagattaaagatggaaaatgttccaacgcatctcaggatgatctagtatttcgtgatcatataaacaaagcttcaattcctttcattaaaagagatgagaaggttgaatggcatggagacacaaccatttactgcctacaggtcaccaccgatcaagatgaatcaaaaggtgctacagctactgtaaaggaaggaggtgttggtcattcttttgtgaccgtcaaagtagagtctggtagaggacatagtttggattattacgtaaaagtttacgctaagtaataaatgtattattttttatattataaaataaaatacatgaaaatcaaaaaaaaaaaaaaaaaaaactggagactagcggcacgag

SEQ ID NO: 129 - DNA, 944 bp, Diabrotica virgifera
  misc_feature (898)..(898): n is a, c, g, or t
  misc_feature (910)..(911): n is a, c, g, or t
aaataaaatacattaggtaataaaatttcatttcacccagaagatatctaagttttaacatagttttccgtggatttgtagtgacaatgtcaagggaaagggcgaacagaagattctacagggtagaatccacctcaaatttattatcatgcttggacagagggttggccgctgaacaggaaaaccgttggactttcgaaatagcatgggaggcagccaacaaagttggtggcatttacactgtcatcagatcgaaggcatatgtttcgacagaagaattgggcgaccaatactgcctcatgggcccctacaaggaacattgcgcccgcacagaagtagaggaaggtccattggggtgtgaagctcttaataaggccatagaggctgttaggaacaaaggatttagggtaatcaccggaagatggttggtcgatggtaatccacagattattttatttgatattggatctgccgcatggaaattggatgaatataaacaagagctgtgggaaaaaactaacgtaggagttcctcatttagatatagaagctaacgatgcgatcattttgggttgtatggttgctgaatttttaggagaattcagaagaacctcagaagattatggtggaggcacccctccgcggatagttgctcattttcacgaatggcaagctggagttggtctcattatgatcagaatcagacatatcaacgttgctactgtcttcaccacgcatgctacacttttaggaagatacctgtgtgctggtaacacagatttctataataatctcagtacatttagtgttgacgaagaggctggaaaaagacaaatctatcacagatattgtatagaaagggcagcatctcatctggctcacagtttcacaaccgtatncgaaattacagnngtatgagccgaacatttattaaagagaaaactg

SEQ ID NO: 130 - DNA, 2931 bp, Diabrotica virgifera
tccttcttcaaaacgtgttagatttttaagttcaaggcccgtagtttaaatatttcttgttttattttcgaaaaaaaaagttgagtgtaaacgtcagtgacaatgtcaagggaaagggcgaacagaagattctacagggtagaatccacctcaaatttattatcatgcttggacagagggttggccgctgaacaggaaaaccgttggactttcgaaatagcatgggaggcagccaacaaagttggtggcatttacactgtcatcagatcgaaggcatatgtttcgacagaagaattgggcgaccaatactgcctcatgggcccctacaaggaacattgcgcccgcacagaagtagaggaaggtccattggggtgtgaagctcttaataaggccatagaggctgttaggaacaaaggatttagggtaatcaccggaagatggttggtcgatggtaatccacagattattttatttgatattggatctgccgcatggaaattggatgaatataaacaagagctgtgggaaaaaactaacgtaggagttcctcatttagatatagaagctaacgatgcgatcattttgggttgtatggttgctgaatttttaggagaattcagaagaacctcagaagattatggtggaggcacccctccgcggatagttgctcattttcacgaatggcaagctggagttggtctcattatgatcagaatcagacatatcaacgttgctactgtcttcaccacgcatgctacacttttaggaagatacctgtgtgctggtaacacagatttctataataatctcagtacatttagtgttgacgaagaggctggaaaaagacaaatctatcacagatattgtatagaaagggcagcatctcatctggctcacagtttcacaaccgtatcggaaattacaggttatgaagccgaacatttattaaagagaaaacctgacgttataactccgaatggtctcaatgttaaaaagttctcagctcttcacgaatttcaaaatctccacgcactttccaaagataaaatacacgaatttgttcgaggccacttctacggacactacgactttgacttggacaaaacgttatactttttcattgctggccgttacgaattcggtaataaaggagctgatattttcatcgaggctttagccagactgaaccactacttaaagagcacccatccggacgtcactgtggtagctttcatgatattcccggcaaaaactaataatttcaacgtcgaatcacttagaggacacgcagttactaaagctttgagagatactatcaatgatattcagaataaaatcggaaaacgaatgtatgaatgttgtttgaatggccgattaccaaatggtaacgacatgttagaaaaagaagaactggtcagactgaagagatgtatttattctttacaacgggacggtctgccaccagttactacacacaacgtgcaagacgactggaacgatcctgtcctaaattcagtcagaaggtgtagtttattcaatactacacacgacagagtcaaaattgtctttcatcctgagttccttagttctacaaatccactattcggtctcgattatgaagagttcgtaagggggtgtcacttgggagtttttcccagttattatgaaccgtggggatacactcctgcagagtgtaccgtaatgggtattccaagcatcactacaaatttatcaggttttggatgtttcatgcaagaacatatcatggaccccatgtcctacggaatctacatagtggaccgtagatacatcggcctcgaagattccgtcaaacagttagctcaatttatgtacgacttcgctaggctcagtagaagacagaggataattcaaaggaaccgtactgaaagactcagcgatcttttggactggaggaacttgggagtgtactatcgtcaagcgcggatgaaagccttgcacaaagtatttccggactacaaagaagaaatggaatacggtctcgaattcaaatatcccagacccatttctgaacctccatctcctagttccagtaaagtaacgactccagctgcttcggtgcacggatctgatgatgaaggagattcggtggactcggaagcagagctggaagaacttagaagagctctatagaaataatgccatatgttacaaaatacccttaaataagtaaagaagctatatgcagtggcataggacctacaattgtacagggttattcataacgaattggtattattttatctatagattttataggagaaaatattaatttcttatcaataactgggtggagttgccactattacacaatttttcgattcttctgtatgacaattttagaccgaactcttattctcgaattatttatgtttgacgttatttgtgcttgacgagttttgtggggtccagtattagatacaatggggttagagttacccaaataattcactaacattgttaatttttttcaattatcccagctttcacacttcctgtgtgaagtttcggatattacataatcgttcgttgtgaaaccttttttaagtttagagaccagtcacacggtattaattctggcgaataagtcggagcaatttataccttatgtcataattttgtctgcgtaaaaaagtctaatagactgcacagcacgcgcaaattatggttatatctttttcccaaatgattgtgtgaatagcacaaaaagactctcttttcataaaagaaagccgccattgccttttccagctatcaggggggttagacctttccagggttttttcccccgtcctccgataaaccccatgaataacaaaaaacttttcctaaaataaaggtttggattccaaaaaactgaaaaataaaaaaaaccaatggaacaattttttt

SEQ ID NO: 131 - DNA, 1272 bp, Diabrotica virgifera
gcttcaaaaatgttggtgccatcattcatagacttatttttaccaattttttagccaaaactggcactaagaagattgttattgttaatttcctttcaattcctttgcacattttgaagacatttgcccaatagtacgaaaaacgcgcttagctaccaaaaacatcaatgaaaataataaaatactatttttattctgtccccgcaggtaccacaccatattaccaagtgcttcttaagagtcagaccgggttttacaagttggagaagacatgaggcaatttcgctccaatcatgaaccactgccttgaggtcatcttttttctgattttcttctattttaatacactacaattctctttactttcaccccaacagaagttttttattttgttacatcggcagcccaacgcggtgccaaccttataaattctaagacagtagttcttttagtccatttctttttcttttatctaaattttctgtaaattttgtaacatacatataagaggactgttgttatattgtatatcctgttaaagcgtttcgttctctttactttcactccaacagaagttttctttattgttacatagctgacacatgcagatgtctagtagtagtagtatctgaactgttggacgtacgacccttttaaagaaactgttgccgtacatacagctaccgacatctatgagaagctcctgacactcaattttaatgctggcacttataacctttcttaggacgacaagctgggccttagaacattcctccgtcaataactgaatggcaccttgattctttataatttccactgaattctaaaatattttctatctatcaacagtcattaatggcatgcaaaggacttaaaaggaaagaatctaaatattatttattgtatttgttacttattgtataggttcaaaattttaatgatatagatactttataattttctatacaatccaaattcatgaagcgttcaatggatggataatttagacaaacttgaaaatatagttcaaggattgatgtcagaagaataatatactaaataaaacacaaatagtttgaaaattatttgaacctctccaatacgctatgttccatttaaaatgtgtataaaacaatctcgtatatatacaggttgtaactgtctttaagccacgaaaattttgtagaaaacatcatttttctttttttaaaccatctatttttcacagatcatacaaaaaagtactcattacaaaactaataagtacttttt

SEQ ID NO: 132 - DNA, 2248 bp, Diabrotica virgifera
cagccacatacaggtactcaggacactccatgtccgatccaggtacaagttacagaaccagggatgaaattcaggaagtaagacaaaccagggatcctattacctctttcaaggagaaaatcatctcatcaaacttggtcacacctgatgaaatcaagaaaatcgacggtgaaatccgaacccaagtcgatgaagcgaccaaacaagccaaatccgatgcagaacttggtctcgacgaactcccagctgacatctatgccgtcaacttggaaggccagatcagaaatatcgacccctggactactctcacccacaaaagaatagggccagctgttaatttgaagtaaagcgttatcgaaatctgccaattagggaaaaataagaaattttaacggaatgtagctcaatgattatcatagccggaaaaatggtcgttttgttaaaaaattggtaatgttcaactaagtcaagaacctgcaggtcactgtgataatacaatttctatgatctatatttttctgtaaaacgggttatttcatacacaattcatcataaaatattcgtaagataaacacatattttttattttagtatattcagtgaacttacatatttattattcaccttcaatcattatttggttttatcttttttattttttttatcttcaatcattaaaatgcttttatataatcatatatttaaaatgaatattttatttgtatttcttattgatttaaatatgttttaatatgaaaaatatctacaagtaccaaaaaagtattgtttgatttttttggtagatttaaaaaatatttacatagtgaagtacttcaatcgtttttaattgtattgcaaaatgtgataacatctttagtcttttgacctttgtttttaaataatttctgttcgttcttggcgcaaaaatttaggcatttttgaagtacattgaactcgacattaatttggcaattattaataattatataatctaagagacatgcctctacaaattattaggagcttttcttctaattatattgaaaataggcttcaaaaatgttggtgccatcattcatagacttatttttaccaattttttagccaaaactgacattaagaagattgttattgttaatttcctttcaattcctttgcacattttgaagacatttgcccaatagtacgaaaaacgcgcttagctaccaaaaacatcaatgtgaatagtaaaatcctatttttattctgtccccgcagttaccacaccatattaccaagtgctttttaagagtcagaccgggttttacaagttggaaaagacatgaggcaatttcgctccaaccatgaaccactgccttgaggtcatcctttttctgattttcttctattttaatacactacaattctctttactttcactccaacagaagttttttattttgttacatcggcagcccaatgcggtgccaagcttataagttctaagacagtagttcttttagtctttttagtagctatatctgaactgttgggcgtacgacccttttaaagaaactgttgccgtacatacagccaccgacatctatgagaagctcctgacactcaattttaatgctggcccttataacctttcttaggacgacaagctgggaccttagaacattcctccgtcaataactgaatgacaccttgattatttctaatttccacttaattctaaagtatcttctatctatcaaaagtcattaatggcatgcaaaggacttaaaaggaaagaatctaaatattatttattgtatttgttacttattgtataggttcaaaattttaatgatatagatactttataatttataattttctatccaatccaaattcatgaagcgttcaatggatggataatttagacaaacttgaaaatatagttcaaggattgatgtcagaaaaataatatactaaataaaacacaaatagtttgaaaagtatttgaacctctccaatacgctatgttccatttaaaatgttgtataaaacaatctcgtatatatacagtttgtaactgtctttaggccacgaaaattttgtagaaaacatcatttttcattttttaaaccatctatttttcaacagatcatacaaaaaagtactcattacaaaactaataagtacttttttaatcacaatatattacaatcatcaattttcattgatatataatgtacataatataaataaattattatttacg

SEQ ID NO: 133 - DNA, 1875 bp, Diabrotica virgifera
gagatccgcctggtgattctcggaacttacccacgcaggcggcctaccattggcagaacctgatggcgccaccgattttatctgcaagaaaaagtctggctgctagggacggagacctataaaacctccttctaaataaaagacacctacaatcttcacatttatctatcagaatgcttccaaattgtgttagaactgtttgcacaaaaaccgttttgcccaaaaaaacgttgggcgccttttcaaagaacttcgctacagaagcttcttttgaaacaaaaccttacagactacataaattagatgaatctcctgctacatcagtaactttaaataaagaagatgccatcaattactacacacaaatgcacaccattagaaggatggaaaccgcagctggtaacctctacaaagacaaaatcattagaggattctgtcatctttactctggacaggaagctgtagctgtaggtatcaaggctgctcttcgcccatacgatggtgtcatcactgcctacagagcccatggttggacctaccttatgggagtcccaccagtaggagttctttccgaactctgtggaaggcaaaagggctgcgccaagggtaaaggaggctctatgcacatgtacactgaaaacttttatggaggaaacggtatcgttggagctcaggttcctttgggagtcggaattgctcttgccgcccaatacaaaggcacagatggagtgtgcatagcactgtacggtgatggtgctgccaatcaaggccaagtatttgaggtgtacaacatggccaaactttggaacattccttgcattttcgtatgtgaaaacaatggttatggtatgggtaccagtgctgaaagagcttcagcaagtactacctactattcaaggggagactatgttcctggaatctgggtagatggtatggatgtattggctgtaagggaatgtttcaggtacgcagtcaattatgcaggcagtggaaagggaccattggtcattgaagcagccacatacaggtactcaggacactccatgtccgatccaggtacaagttacagaaccagggatgaaattcaggaagtaagacaaaccagggatcctattacctctttcaaggagaaaatcatctcatcaaacttggtcacacctgatgaaatcaagaaaatcgacggtgaaatccgaacccaagtcgatgaagcgaccaaacaagccaaatccgatgcagaacttggtctcgacgaactcccagctgacatctatgccgtcaacttggaaggccagatcagaaatatcgacccctggactactctcacccacaaaagaatagggccagctgttaatttgaagtaaagcgttatcgaaatctgccaattagggaaaaataagaaattttaacggaatgtagctcaatgattatcatagccggaaaaatggtcgttttgttaaaaaattggtaatgttcaactacgtcaagaacctgcaggtcactgtgataatacaatttctatgatctatatttttctgtaaaacgggttatttcatacacaattcatcataaaatattcgtaagattaacacatattttttattttagtatattccgcgaacttacatatttattattcaccttccatcattattttggttttatctttttttattctttttttctccacttatttaaacccctttattatattcttacatttaaaaatgactactttcactccgcctttctttttgtcttcttcaataggttttaaccatgaaacaacccttcgccccgtcccccccacacactctcgcttagaactttcttccgcccgattattcaaaattatttttccccccccccccccccccc

SEQ ID NO: 134 - DNA, 1355 bp, Diabrotica virgifera
gtcacttttcgtccataaccataacctaagtaatctaaaaattatttttaggtttttaaatagctgtaaaaacaatctcaattaaaagatatcgtaatatcttgaataagaaaactctctaacgaaaatcacatttaaataattgtacaaataatgtctttataattagaaaagaagcaaaatcaataccatccttgtaaacatgtcattggcaaataataacgtcgttgcagaaaacggcgaacaatatataccagcaacgcaaagacctgatggcacttggcggaaagcaagaagagtcaaagaaggctatgtaccccaagaagaagtacctctgtacgaaagtaagggaaaacaaattttgaacagaaaaaatgaacctgttgtgctcgcttcagggcaagttgccaagaaggccactattcccgggctttacattgttgaagatgaggtggagaaaaagaaaaaaccaaaaaaaaaaatggaagaagttgaaaaacttataagcaatatcaagatctcagaacctcctaagcaaaagtctgccaagccagctaaaaaagatcctaaacctgctcaagataccaatgctcaggaagctaccactgatcctcaaaagaaacttaagaacctcaagaagagactcagggaagttgagtcactggaggaaaaaattaaaaatggtacacttgccaaacctgaaccggagcaacttgttaaagtcaaaagaaagaatgatctcatcgttttaatacatgaacttgagaagatgttacagtagaatgtgtgttgtcatgtgtatagtgtaattcatagtgatttttcactttttgacagttggaacttctaaaaaattcgtcacttttttatagattaacgtattgtaaataaaaacttaatatgggttttttttcttctatttctaatgtattataataaaaaaaacttagtagtaatagttttaaatgtaaatactaagtacatcttttgtaaaagagaaaacccaaaacaaattgactggccagttggttgttaaaaccagtgccaatattatcctgcattacggaaccgctctttaaaatcaaattttctctctattcgtttgttagaacctcaaggaactcatatttctgcacgaactctaagaaaagtcctacatgaaagtggtttacgttctcatacgccagtagcatgcactaaattaacagcatctcatcgagctaaccggatgagatttttaatgatggactgttcagcaatggtatggtcagtaatgttttctgacgagtcccgttttttgcttacgatctccaggcagacgccgacgtatatggaggatacccagagactgattt

SEQ ID NO: 135 - DNA, 650 bp, Diabrotica virgifera
agcgtgtttagttttgtattttattcggcgttgagctttgcagtgttcttaaatcaaaatatcccggttcaggagaaacaccatgtctagacatcgagaatgggagctttcttgtaaagtttatgtaggcaatctgggttcgtcggccagcaaacacgaaattgaagccgcgtttggcaaatatggaccgttaagaaacgtttgggtagcccgaagtcccccgggatttgcatttgtggagttcgaagacaccagagacgcggaagatgcggttcgaggtttggacggaacgcgctgttgtggcacaagagtaagggtagagatgtcaaatggacgttctagaagaggtggtggcggtggaaggagaggaccttcccgatattcaaggtctagatctcccagacgttccagaagtccaagatctcgttctcgcagccgagattccagaggacgatctgattcaagagacagacgttaaattttaagatttatcatttaatttataagttcaagaaggaaagattttctggataataagtataatcttgatattttacagtttttacaatgatttttatttctaagtttgtattttgtctatatttagtctcgtattttgacttcataatcaaataaagaaattacacgtg

SEQ ID NO: 136 - DNA, 1011 bp, Diabrotica virgifera
ttcccacccggcgtccgattttctaaacatttctgtatttctcatctgattattcatcaaattaattgattctttgttagttgttttaaatatttctaaatagataaattaaacaaccaattatagttatcaggtaatcaaaatgggggccgtcctgggtctttgttcagcagcacaacttgcctgttgctgtagtagcgcagcatgttctctatgctgttcagcatgtccatcatgcaggaattctacatcttctcgtataatgtatgcattgatgctgttggttgctactgtggcggcttgtattactctgtctccaggactggaaagcgctttacaaaaggtaccgttttgcaaaaacagttcggctctggttcctgactcggttgtttttgattgtaaacaagctgtgggatatttagctgtatatagaatttgctttattttaacatgtttctttgctttgatgtctcttatgatgatcggtgtaaaaacttccaaagatgcaagagcagggattcaaaacgggttctgggggataaagtatttgttagtaatcggaggcattataggcgctttctttatccccgagggctcatttggatcagtttggatggtgttcggcatgataggtggtttcttgtttatactgatccagttgattctaattatagacttcgcccattcatgggctgaagcttgggttggtaattttgaagaaactggatcaaaaggatggtatgtcgcactgattgggatgacgatgcttaactatatcttgagcattactggaatagtattactatatgtattttacactaaggctaacgattgcggattaaataaattcttcatttcaatcaacctgatcatttgtctaatcgtaagtgtgctgtctattttgcctgctgttcaagataagttgcctcgatctggactgctgcaatcatctgtagtgactgtatacgttgtctatcttactttgtcagctgtatcaattcaagcaaagat

SEQ ID NO: 137 - DNA, 1242 bp, Diabrotica virgifera
  misc_feature (1152)..(1152): n is a, c, g, or t
ctcttacgccgcccgcgaaggctctagggctgcattacgtgtctctttagccccgactaagtccgtacaccatgcctaaaccacaaaaacaagagggggatgacccagatcccaccccatacttgttcgtatctctcgaacagaaacgtatcgaccaaactaagccctatgatgccaaaaaatcttgctgggtaccggacgacaaggagggtttcttgcttggtgaaatcaaaggaaccaagggtgatcttgtcaccgttggtcttcctggaggagaggaaaagaacttcaagaaggaccaagtaactcaggtcaatcctccaaagtacgaaaaggccgaggatatgtcaaatttgacatacctcaacgacgcttcagtattgcacaatttaaaacaacgttattaccataagcttatctacacatactcaggtttgttctgtgtcgccattaacccctacaaacgtttccctgtatataccaaccgttgtgccaagttgtaccgtggtaagaggcgtaatgaagtaccaccccacattttcgccatttctgacggtgcctacgtcaacatgttgaccaatcacgaaaatcaatctatgttgattactggtgaatctggtgccggtaaaactgaaaacacgaagaaggtaattgcctacttcgccaccgtcggtgcctcaactaagaaagatgctgatcccaaccaaaagaaaggtaacttggaagatcaagttgtacaaactaaccctgtacttgaagccttcggtaacgccaagaccgtgcgtaacgataactcttcccgtttcggtaaattcatccgtatccacttcggcccaactggtaaacttgctggtgctgatattgaaacttatctgctagaaaaggcccgtgtcatttcccaacagccattggaaagatcttaccacatcttctaccagatcatgtctggatctgtacctggagttaaagaaaagtgtttgttgtctaacaatatcaacgagtacaacttcgtcgcccaaggaaaaactacaattcctggcgtagatgatgctgaggaatgtagacttacagatgaagccttcgatatccttggtttcacacaagaagaaaaggacaacgtatacaagatcaccgccgctgtaatgcacatgngttgcatgaagttcaaacaaagaggtcgtgaagaacaggcctgaacagacggtaccgaagaaggtgaacgtgttagtaaactcttgggtg

SEQ ID NO: 138 - DNA, 1315 bp, Diabrotica virgifera
  misc_feature (1290)..(1290): n is a, c, g, or t
gcttcaagtacagggttagtttgtaccgaaggcttcaagtacagggttagtttgtaccgaaggcttcaagtacagggttagtttgtacaacttgaagccttcggtaacgccaagaccgtgcgtaacgataactcttcccgtttcggtaaattcatccgtatccacttcggcccaactggtaaacttgctggtgctgatattgaaacttatctgctagaaaaggcccgtgtcatttcccaacagccattggaaagatcttaccacatcttctaccagatcatgtctggatctgtacctggagttaaagaaaagtgtttgttgtctaacaatatcaacgagtacaacttcgtcgcccaaggaaaaactacaattcctggcgtagatgatgctgaggaatgtagacttacagatgaagccttcgatatccttggtttcacacaagaagaaaaggacaacgtatacaagatcaccgccgctgtaatgcacatgggttgcatgaagttcaaacaaagaggtcgtgaagaacaggctgaaccagacggtaccgaagaaggtgaacgtgttagtaaactcttgggtgttgaagccccagctctctaccaagctcttgtcaaaccaagaattaaggtcggtaacgaattcgtcacccaaggtcgtaatgtcaaccaagtatcctactccgtcggtgccatgtcaaaggccatgtttgacagggtcttcaagttcttggtcaaaaagtgtaacgaaactttggacaccaaacaaaagagacagcacttcattggtgtactggatattgctggttttgaaatcttcgacttcaacggctttgagcagctttgtatcaactttaccaatgaaaagttgcaacagttctttaaccaccacatgtttgtacttgaacaagaagaataccaaagagagggtattgaatgggcttttattgatttcggtatggacttagctgcctgtatcgaacttatcgaaaagcctatgggtatcttgtccatccttgaagaagaatctatgttccccaaagctaccgacaagacctttgaggaaaaattgaacaccaaccacttgggcaaatcacccaacttccaaaaaccaaaaccaccaaaaccaggtcagcaagctgctcacttcaccttgggccattatgccggtaatgtaccatacaatataaccggttggttggaaaagaacaaggatcccttgaacgacaccgttgttgacttgtacaagaagggttccaatgccctcgttgtcgaatcttcgccgaccatccanggtcatctggtggtgctgccgaaaa

SEQ ID NO: 139 - DNA, 1032 bp, Diabrotica virgifera
gcacattttttagccattaaaagccagtttatctcctatctcccaatttaccggctacattcctaaatttgttatcaaacatgaacaatattttaaaagtggcacaaagactgaatggcgtcagatcgttgttgaatccaatcaaaaatgggatatcctcttcaataaaccagcaaagacaaattgcccgatctatttggtatatgagtaactctcaaagaaatggaatcatcaaagaagtcgagcacactcaattgtgcagctgtggatgtggtagtaaaagagccagtcataccaaagctgagaaagaacttgttgaatttttgacagaagaaatcgtagcagagaggaaagcacaaaaaattaaaaccattccaacagagttaggtggctttaaagcaaatttaaatggagcggaaataacattaacaaagactgcaggagacgaaaccatcaaactaagtttcaatgtaaatcacagtgtggatagtgatgttgagccagaggtaaacgaaaatatggataagcctgatattggagaactgaaatccaaaccttcattcaaagtagaaatagtaagaggaaatacaacaattagtttgctctgttcatacatgaatgcaaatgaacaagatgatggatacaatgacatatttggcattgatgaaatcagcatttatgaaggagaatggaatgaaaatgtatactcagtttcaggagaagttttagatacatacttgtatgatttattattgaactacttggaagaaaaaggaatctccaatgattttgtagaaaaactctcgaaatatagtacaacatatgaacactcagcatatattggtcttctttacggattgtcttaatttgtgtcaggaaaataaaaaatgtgctaagaataaaaataagaataaagtgttatatttcatttaaatatttgtggtttttattaaataatttaaaatttggaaaaaaaaaaaccaaaaatcataagcaaataaaaaaaatttttttgaacaccattttttattt

SEQ ID NO: 140 - DNA, 1138 bp, Diabrotica virgifera
aaaatcataatatatactaaaaaaaaaaaaaacgggcggccgctcccacgcgtccgttggtgttaagattttgtagcttgcttattaccttattaatcattaaatcttcttatcagataataaaatccacacatgaatgtttgcacaatcaaacattgttctgctctcgcgtcgttatcactttagaccatcgcgagaaagtaaaaaagttcgttctagtgaaaaagttcaggccttttcgacgttatgtagtttgtaaacgtacaaatttcaaattgacaaatggccctaaacgactttgttaacacgactataaaatgtctcactctgccggctgctatcatcactgggattcaagcagcaatatggttcacgttatcattattagcaatattttgctataataatatcattggaagatcggattcattagaaaaaacaagctatggatatatcatttatacgtattatctacaacccactgatgaaatacaagaacagtatattgtacatcctaaagcacttaacatatttatgtacgtctatttggtgctcagcttcatatggttggtgatatctatatctttggcatgggtgacgataaaaaagaaatggaaggctgtatcgaaagtattgatatgttgggctataactaccataattatagcaattctggacataactcttatgagtttactggcgtcggatatacagaaagcaagaagtaataatcaatctttaataagaggacagtcctatgaaatgagacagactgaatatacagcgttaggaatcgtcatgtctatagttgcaagaggatacatattatggatattgaatgtagtttttgccatcgttttaatggtttctgtttgtcgacagagacggaagccccgtcgatcgttactttcacctataaatgcctatcaatcagggccagcgccatttagtctgtacgacaacgtacaaatagacaacaccttcgaaaacagaggcttcgactcagaggaaagcctatttagccctccatcaagtgaactccgaagaccttcaaatggtctaaatccactgagcaacagcgcaatgaatccattacacccctacgaatacggaagacctccgtcagacgaaagcaggc

SEQ ID NO: 141 - DNA, 1961 bp, Diabrotica virgifera
  misc_feature (1852)..(1852): n is a, c, g, or t
aaaaacaagcagaaagagtagatgttggtctacgagagtacgcaaaaaacctcaaagtaaacgaaatcaaacaagaattacaaaactcggaattcatggaatctcttaacacacttgacagtattctcaatgactcagctaaagacccaactactactattggggaaacattacctccccagaaatttgaaacagattacatacagtttatggacaacaatcaaatgcttctcacatgtcgtgaatgtgcaaaaatgttcactacattagagggtttacgttgtcacaaacgcatacacactggaggtatgtacaaatgcaaacaatgcgacaaagaatatacaagacttaatcacctgcaacgccatgaacaatctcacaatagaagaaaagtccatgtttgtagaatttgcagtaaaactttgacaagaatggaacatctgaaaagacacttggtgacacatttaagagaaaaaccattttcttgcaaaacgtgtaacagaggattcaacagaattgaacatttacataatcatgctcctagatgtaaaggtgatacggtctacccatgcgatatttgcaataaagccttcaaccgcgaagacagtctcgaagttcatagaaaaatgcatgactcaactactccgaaattaccgacaattgaaaacttggataatattgaagatcattattaccagatcgatcaagacccatctatggacttttctgatcatgagcatctttctgatgttgatgattactttgaacctcaagttgaagtgacagaaacaattgaagatgatgacaaactgaaggttgctgaagaaatttcaactcaacaagaagaagaaaaccaggatgataaaagtatccacagtgatggttctattggtggtggtgatatcggcgttgacatagataatgataatgagtccgatgaggaggaagacttcgacgaggataaagaagataatgatgctgacactagtatggaaaaaggaccaaaagatttaacaggtatcgatgatgaagaaaacgaagatcagaaatcagttaaacttgaagatgaaaaaccggaaattgatatagatgagcagatgcttaaaaatgttattgctgaagtggaaggtgaagtttcagacgacgatgactcagataaagaaagtaacgactcagattatatgccagtaaagaaatcaccaccagtgaaacgtggtcgaggcagacctcgtaaaaatgcggatgcgccccccaaaccaccgaagaaaccgggaaccggcaagagaggccgtaagccgggctctaaaaataaaaacaaaattgatagagagatcaaaaaagaaaaggatgatgattatggagattatccttgtcctgtttgcaacgagatgtttaatacgatgagtaaactggatagacacgcgaaatacaaacatgaaggagccaagattcacaaatgtaatgtgtgcagcaaagccttctcacgcgtaaatcacttgaagagacatattacatcacattcgactattaaacctttccgttgtacagtatgtaccaaaagctttaacagacgcgatcatctcaatcaacatcaaaagttgcatgagagaactaatgattacgaatgtgaaatatgtcaaaaaccattttcaagggccgatcacctcgctaaacacaaggcttcgaaacatggcataggagagagaatatgtgtaatgggcgagaagaaatttgaatgtcctctatgtcacaaattcttcacaacagagaaataccgagatgttcatgtggcaggtcacaacggcactaaagaatactcatgtagagtatgtgaaaagacattcttatctanatctcacctgacagaacatatgaaattccacaatgaacattccaagaagttcctttgttctgagtgcggacagcgctttattagaaatgactatttggttattcatatg

SEQ ID NO: 142 - DNA, 898 bp, Diabrotica virgifera
attgaacaagaatttgtaagaaaaaataataaacacaatatctggagcaacttcaccgaaagctttaggtctcggaatattacaaataattgacttctttccttcttctctctattgttcaagtaaaggcggtattgtcagatcttgtaagtctaatatctttattttagaaatgctaaaatatttacgttattatatttgaagtatatcttcaggcacattcaatttatttttgtagaatggtcgcccttttgtttttttttttttccaaaattatttgatttttaatagttattgtatgtggtcgattttgtagtaaggtaaatgagaagtgaacgcaacagtgtaaaattatattcttactttaagatgtttacagagcaattatcgtgtttccaatgactagatgtgtacggtcatcagtttaccccaaaatttattgttcaatgaagaacctattgaaatataatctgagattgctctgtgcgatatcttttattattccattttgtgattaagtttatatttgcttaagtatgtgaacgagaagaattattgaaaataaaattttgttcataatttttcgattgtcttaactatttacaaaaattagggtaaaaattctgtcaaaatgttggaaatagaaccaaaatcaacacgtacttttcacaacaaaaaacatctaaatattgatcatttttcttgctctgctgggactagttttattataggttctatctctaccacaacctttattatgtcaactgcaccgtaacatcaaatatatgtagaatacataaaataagccatgatatactggattttgatctctaactttgttggtagaatttgtacatagtgtccaaaaacggtgaatcaggtgagaaatatgatatga

SEQ ID NO: 143 - DNA, 1546 bp, Diabrotica virgifera
  misc_feature (1443)..(1443): n is a, c, g, or t
cccacgctaccggtcactgtcattacaaatccccaaaaaatccaaagttcttaaaaatattctactgaactaatttcattaagttttttactgactcacgtgttattatacttttaaaagtctaaaccgtcatatattatcattgtgacatgatattagcgtaaagtttactttaatataattacaatgagtgcagctcagaaagaggttaatggggctcctcctggtgagataacagcaagcaatgaagaacctggtgttgcacaaaatgatgctgcccaacaaagagctccaacaaaaatggaatcatttctggctgtagttaaatctctcataataagagcaatgatcatgtattttatattctcattctttagaagtccacaaccccaaaagccaacaaatgatcaaggagtaaaattgccacaaaccgcagccagaaacatattcccagatggcacaataatgaatctatatatttatttatcagaaaatgaaacaatggataattatagtccttccaatgtgttctggtacaaagaagggcttaaatacggagactggacatcaggaaaagataaagatgggtcttatacaatagaaaaagatgtcccaatcactgcacatatgaagaataatggttccttatttatacatgcatatctagtcaggtccggatacagtcctgatcctgaagctaagaactttgcaaaaaatcaaatgtcatcagtcatgaagcaattaaatagatataagaagctcaaagcaagtggtacaaaaaatctcttgaccggcgaaactgaaaaggaaatagtcgaagatggaaaaataatatcccactggcatccaaactttacattgaatctggtgactgatcaaactttgtggaattacggtggagtgccagtccctctagatcagtttattcgattcacagatgatggaaagcaatataaaccagtgttatttgcaaacgacttttggaacatggctcgtgattataaacctttaaacgagacttattcacttcaaattacattccagccactgagcttgttcaaatggcagctgtacgccgcacaacacatgagacagagttggaatgtctggggcgatgaacagacacagtccgacgaagaacaagatacgcttaaagaaaccttgatggatactaacccttatcttttgggtatcactatcgcggtatcaatagttcactctgttttcgaacttcttgcttttaagaatgatattcaattttggaacaacagaaattctctggaaggtttgtctgttaggtccgttttctttggagtatttcaatctctagttgttttgttgtacgttttagacaacgagacaaacacgttgatacgagtttcttgtttagtaggtttgggtatagaaatttggaagatatggaaagtagtagatataaaattncgaaaatggtagattaacgtttaaagataagagttcttatgttcagtctagtacaaaagtatatgataagctagcattaaatactaatccgtgggtttgtttc

SEQ ID NO: 144 - DNA, 934 bp, Diabrotica virgifera
  misc_feature (762)..(762): n is a, c, g, or t
  misc_feature (879)..(879): n is a, c, g, or t
gtcggcagcacaatcatggataaagttgattttgaagtgttttatttagtcagttattttttcgtagaaggaggttcagaatggcaaatgataattactcgatttttaccagtcggaatatgcttagtagccgttatgcagtggagagcattaaggaaaagacaaaaggaaggaattgcaagtaaatgggagatcaactgttattgtttacttcctttaagaacagtatctagatgttgggggtatatagccgatgtaacactacccgaagtactgaggcctcccgtttacaaaatgtactccaacgcattcggtgttaacatcgcagaagctgaaaacgaggatttaacgtcttaccccagtctggcagatttttttgccagatctcttaaaagtggtgtaagacaagtcgacgagagtagctgtcttgtatcgccatgtgacgggacggtcctccatttcgggactgttgatactgaacaagttgaacaggtaaaaggagtaacatattcactaaaagacttttttggtgagaatacaggaaaaggtcaaaaatacaatggagactttaagacctctttattgcacaaaccacatgagggaaatgtattgtatcaatgcgttatctacttggcacctggagactatcacagatttcattcaccatcagaatggaaaccaacgcaccgcagacatttttcgggacaattactttctgtgaaccccagcattgccagttggttaccaggtttatttactctncatgagagagccgtttatcttggacaatggaaatatggatttttctcatatactgcagtaggtgctacaaacgttggtactgtaaaagtatactttgacaaaacttttgcaacgaancaacccttttagaaacaaacaaaggaagaaagtgtgctcggtaattcatcgaact

SEQ ID NO: 145 - DNA, 839 bp, Diabrotica virgifera
tatggacgcgtggcaaatccacaagtcatcaacacgaagacaaaagttaaaaattttgtttgtaattgcaagtaatcatggcttcagagagatatagcttttctttaactactttcagcccctctggaaagttggttcagattgaatatgcattagccgctgtagcggcgggtgctccatcagtaggaattaaagcatcaaatggtgtggttattgcaacagagaacaagcacaaatcaattctgtatgatgaacacagtgtccataaagtagaaatgatcacaaaacacattggtatggtttattctggtatgggtcctgactatcgccttcttgtgagacaagcacgcaagatggctcagcagtattacctagtataccatgaacccattcctacagtacagttggtgcaaagagtagcgactgtaatgcaagaatacacccaatcaggaggagttagaccatttggagtgtcactactgatttgtggttgggataacaacagaccttacttgttccaatgcgatccttctggagcttactttgcttggaaagctactgcaatgggaaagaattatgtcaatggaaaaacgttcttagaaaaaaggtacagtgaagagctagaactcgacgatgctgtgcacactgctatccttaccctgaaagaaagttttgaaggccagatgacagctgacaacatagaagttggtatttgcgatgctaatggattcagaaggtttgatccatctactgttaaggatttcttagctaatattccttaaatttttttatagtttcgattttttaatattacttggattattaaatttactataagt

SEQ ID NO: 146 - DNA, 1714 bp, Diabrotica virgifera
  misc_feature (700)..(700): n is a, c, g, or t
  misc_feature (772)..(772): n is a, c, g, or t
  misc_feature (774)..(774): n is a, c, g, or t
  misc_feature (1674)..(1674): n is a, c, g, or t
aatacttaagtgtattagaaattatcagttacatttaccttagtaaaagttgttatacagtgagatgtttgtattataaaatttgtaataagatacagtgtttaacgttgttacactccataccatttcaaaatgcgtctgaaattaaatgttgaaataatagtactgctagctcttcctgtggttattcagtgccagttaaacgcagtcaagtctgaagtcttagcaatttgttacaatgaatccgccattcctgggattaccattgctaataataggccaccagccactttgaatgttttcctggaaatattacgaagaatagaagatgctaacccagcgatgggaatcaataacttggcagctttattgatacaaaagcttagacaaaatgggatagaagaaacacgaagagcagttaacataaatattgctttaccttatgcaccaactggacaagacgctcttaaaggaacaatcatttttgacgaatatctacctacttcacaaatcagattatcttatggagatctttctatggctgacgtgtgcgcatttcactacatgatctcaaattcaattaataaaacaattagaggtgatgaagaccagacttgtattaggtctgctcggtatcaaatgagaagaaccagggctactagtagaaaagatgtagaaacaattgagaagcaatcccgcncaatcgttcggttctactggagaacccagtctatgcccgattgaaaaaaggtgtagtctacaacgattatgngncatttaaggctggacaagtgatttcagggattggctgctggattgaaccctcctatttatttgtctatatatggaaattctacacagtatcgctgtactggagatttatgccaagcagcgttgattcaaatgagtccaccttttcagcttggcggttcaggtggctggaatagcacaacaaatccaaaatattattttctccagcagaacgataatttggatttgactgatcaagacattagaggatcattagatggactctacatggcactaaaaataaatgacatcaaaggaaaaactgacgttaaaatttcgcaagtcctagatatgtattactctcctcaacaaaaaggagtttttaatacatcttttagggcatgtaacagaaatattctttattctgaattggtcgattctaaaactctacaaaaaaatatcaacaatcttatgtcagtaatggacgataagggccaatatcctggatatattgttcctgaaaaatatccaacactggccgaagcagcatttaacaactttgcatcatatctaccacgactgaatgtcgatctccaatgtcctcaattggattctgggatagaacgggtccgtactgatctactaatttttatagatccaaattgggaatacagaacaattcaacctatattatcgtatattttggataacatcgatgttaacaagtttgcttcaagatattcactatttagtggagcagatgcttcgaatatcactaatagtacatcatatttgttggaatttcataacagttataatttaagtgttcatcaacgtttgccaagatcatttgactattcaaaagtatatgaaaaactggagtctgttgcaaagtcgaaacttaaaacacacacttacaatggntggagagtcaaccatcatactccctgataacaagaatgca

SEQ ID NO: 147 - DNA, 1652 bp, Diabrotica virgifera
  misc_feature (1619)..(1619): n is a, c, g, or t
  misc_feature (1625)..(1625): n is a, c, g, or t
  misc_feature (1635)..(1635): n is a, c, g, or t
aacatgtcaggtgcctagataaattatttctgattgatatttttcagatacagtgtttaacgttgttacactccataccatttcaaaatgcgtctgaaattaaatgttgaaataatagtactgctagctcttcctgtggttattcagtgccagttaaacgcagtcaagtctgaagtcttagcaatttgttacaatgaatccgccattcctgggattaccattgctaataataggccaccagccactttgaatgttttcctggaaatattacgaagaatagaagatgctaacccagcgatgggaatcaataacttggcagctttattgatacaaaagcttagacaaaatgggatagaagaaacacgaagagcagttaacataaatattgctttaccttatgcaccaactggacaagacgctcttaaaggaacaatcatttttgacgaatatctacctacttcacaaatcagattatcttatggagatctttctatggctgacgtgtgcgcatttcactacatgatctcaaattcaattaataaaacaattagaggtgatgaagaccagacttgtattaggtctgctcggtatcaaatgagaagaaccagggctactagtagaaaagatgtagaaacaattgagaagcaatcccgccaatcgttcggttctactggagaacccagtctatgcccgattgaaaaaggtgtagtctacaacgattatgggccatttaaggctggacaagtgattcagggattggctgctggattgaaccaagaagttgatcctaacaacgtggacaatagatatgcagctacgttagcaggagatttatgccaagcagcgttgattcaaatgagtccaccttttcagcttggcggttcaggtggctggaatagcacaacaaatccaaaatattattttctccagcagaacgataatttggatttgactgatcaagacattagaggatcattagatggactctacatggcactaaaaataaatgacatcaaaggaaaaactgacgttaaaatttcgcaagtcctagatatgtattactctcctcaacaaaaaggagtttttaatacatcttttagggcatgtaacagaaatattctttattctgaattggtcgattctaaaactctacaaaaaaatatcaacaatcttatgtcagtaatggacgataagggccaatatcctggatatattgttcctgaaaaatatccaacactggccgaagcagcatttaacaactttgcatcatatctaccacgactgaatgtcgatctccaatgtcctcaattggattctgggatagaacgggtccgtactgatctactaatttttatagatccaaattgggaatacagaacaattcaacctatattatcgtatattttggataacatcgatgttaacaagtttgcttcaagatattcactatttagtggagcagatgcttcgaatatcactaatagtacatcatatttgttggaatttcataacagttataatttaagtgttcatcaacgtttgccaagatcatttgactattcaaaagtatatgaaaaactggagtctgttgcaaagtcgaaacttaacaacaacacttnacatgngtggagagtncaccatcatactcctga

SEQ ID NO: 148 - DNA, 1183 bp, Diabrotica virgifera
ctttctcgcgtccgaaaatattaatattaaaaaaataatttttttttttagcagcaaattgaattaaatatatgatttatagtaaatagaactgggcaaaaaaatatcaacaatcttatgtcagtaatggacgataagggccaatatcctggatatattgttcctgaaaaatatccaacactggccgaagcagccgtccgcaactttgcatcatatctaccacgactgaatgtcgatctccaatgtcctcaattggattctgggatagaacgggtccgtactgatctactaatttttatagatccaaattgggaatacagaacaattcaacctatattatcgtatattttggataacatcgatgttaacaagtttgcttcaagatattcactatttagtggagcagatgcttcgaatatcactaatagtacatcatatttgttggaatttcataacagttataatttaagtgttcatcaacgtttgccaagatcatttgactattcaaaagtatatgaaaaactggagtctgttgcaaagtcgaaacttaacaacaacacttacaatggtggagagtcaaccatcatactcctgataacaaagaatgcaccaaccggaaatcaagaaacgtttgtgaaacagaggaaagaaattataaagcagtatctaccagatctctcccttcttgttcttggagaaggatcatctaccgactattcttccatgctccttaatccttcaaaagattttatatctttatcaagtacaactaacgatgataatcttaagaacattggacaaaacgttgtggatgcaattaaaagaattcctcgagcaattgtcaatcctgcctgtggttcaagctttgtaggcagtgccagcgcaacaagttactccgattcagtagacttgtatggtacgaactactataaaatatctccttattactttgccactggaagcaatggaaggagtttaagaattactgaaccaagtactggtagcatcactgtctgtatatcgcgggacaacgacagaccaacaagtttaaatggcaattgtcaaactctacagtccagtgtcaagtcatacgacctctcaaactatttgtggcactacgcgagagactggtctcctatttatttgtctatatatgggaaattctacacagtatcgctgtact

SEQ ID NO: 149 - DNA, 312 bp, Diabrotica virgifera
tgttcttcgagaaatcatcaatgtgactctacatgtctgcttcggcgtcaacagcgtgaacaccagtgattcgacacgcaatcaccattgggaacactttaaaggtaaccatggcaaagcctaaaaacacccattcgaagaaacatcccgcctctcagttctccaatccactcaaaaactcatcagtgcacacagcgcaatatacgagcagagaattgttggataaactatgggaatacatcatctcgcagacatcaatcgataagatctcagctccattctacgtacacaagcatataacatccctaacat

SEQ ID NO: 150 - DNA, 1086 bp, Diabrotica virgifera
  misc_feature (1084)..(1084): n is a, c, g, or t
gagctgcaaggttgattactaaaaatcgtttaattgattcattcagaacaggaagaaaagtctcgaaataaaacttttattgtttgacgtcacgagctggattccatttgttgtatgggtggtaccggtttggtaaaatcgtataaaaagaacaaaaatcaagaaacctatatcagttttcgtcagtcagtctcaagacaacgacacagacctacttgtcaaaatgttcaaattggtggtgttgtttgctctcgtagcccttaccgttgctaaacccagtggtgtgtacctagaaagcccattagtcgagacgtacagtttaccagtagtttcttccggcgtcagtcacacatacaggaaagatgtcattagtgaacctgccgtagtagcctactctgctcctgctgtagtctccgctcccgtcgttcaagaagttgtagctccagtagtaaccaaagtagcttccccagttctagcagttccttcagctgtcagccacacctacagaaaggatgtcatcagtgaacccgtcgttgctgtccactctgctccagctgtagtagcttccccagttgttgaacaggtagtagctaaagtagctgtaccatctgcagttagccacacctacagaaaggatgtcatcagcgaacccgtcgttgccgttcactctgctcccgctgtagttgcctctccagttgttgaacaagtagtagctaaagtagctgtaccatctgcagttagccacagctacagaaaagatgtcatcagtgaacccgttgtggctgtacactccgctccagtagtggctgaagttgcttcccctgtggttgctgcccattactcagctcccgttgccctatcttccgctgtaagccacagttacagaagtgatctccaccagcccattgttgcctcttactctctcccagctgtagaatattcccatgttggacatgttgccccagttgcttattctgctcacgtacctgctgttcaagcttggtaaagagaggactgacgaaaaagatccattaatgttaaaattgtgtatatttatttgaacaaataaaagatatataaattncg

SEQ ID NO: 151 - DNA, 1218 bp, Diabrotica virgifera
ttgcggccgggactaacctactaacacgtaacacctaacctaagttctaacttaacattttaatttaaaatataacagaaacatggaaaacattataaattaattattagttctcgttttcagttcattaaaatgccacaaaaaattcagatacgtctcgctactcacagagtaaatccatcagttgccccaaataaaaggtatccaaagatatttactccaggagaagttatcactgctcaagatgaattcatgagaggtcatggaacatatgaagagaatggagaactgaaagcttcagtagcaggtgtaagagaacaagttaataatctgatatcagtaagacctctaaaaagtagatataatggagaaataggtgatgttgtagtaggacggattacagaggttcagcaaaaaaggtggaaagtagataccaattcaagactggactcggcactgctcttatcttcagtaaatttgccaggtggtgaattgaggagaagatcagtggaggatgaacacatgatgaggcagtttttacaagaaggtgatcttataagcgcagaagtacaaaatgtattttcagatggagctttgtctttacatacaagaagtttgagatatggaaagcttggacaaggtgttttggtaaaggtatttccatctttgatcaagagaagcaaaacacattttcacactctacccataggagcaagcatcatattgggaaacaatgggttcatctggatatctccaattattgttaattctgaagatagcgtcggaggcttcatacaaaatttggaagaggtaattccaaggcaagagagagaaataataggacgtttaagaaactgtgtcttggcgttaacacaaagcaaaatgatgttgtatgataccagcattttatatgcttacgaagaatccttgaaatattctgtagccgaactactcatcccagaagcgatggtagatgtcgcttttttaacacaacataggctgtcgatgctgggaattgaatagtggagttttaatgaggatggatacaactctattttttttatttttccgccacgcacacttttttttacaattataataaattgttttttttttgttgcggaatgaatgcatattgtaaaaaattgaataaactgaaaaaaaaggggttattagcccataataattttttggattattcaattggttaggggaatt

SEQ ID NO: 152 - DNA, 1276 bp, Diabrotica virgifera
atttggagaagactgttttatcagatctcttcttgatttggaagtttcaatgtccaacaatttattattctaatattctaagttgtcaaaataattaagtggttgaatataattatacttgaactgaaggccaaaaagtggaaatgaatattgatattatattaactgatccagatggtacctacaaaccagatgatataataagaggaacagtaacccttgatctcacatccactcaaaatatccaaaatatactttgcaaatttgttggtaatgaagaaactagttgggctacttcagaaagtttatatgatgaaagaacgaacaccatgagatcaggaatagtacactataaaggagaacacaatataatatcatgtgaagaacaattagctaaagatctaattttgcctatcggacgtcacgactttccttttgccatcacagtgcctaagagaattcccagctcctattcatcaaacaatggatggatcaaatttggtcttgcagttactatacagaatgaccttgtcttgtatgaaaaagagataccaatccatgtaaaagcacccataaattttaatgatatacgaggagaaattcaactggaaccaattgtttatcaaaacgaagaaatcatatggcattgttgttacgctggtgacccagttacgatggatctgatattggaaagagaagcctacacagttaatgaacctattacatttaaattggaggtgaacaataaatcagatcgagaaatatccgaaatagatgtaactctgacattggtagttgaaactactgctgcagctcctagaagaagtcggaagtattatgaaaaactcttaacgggagctaaagccaggggattggctcatgggcagcaggaattatactcattcagattccaagtaccagatgttatagacattccaaattttattggaagtaccttatttcgacagaagtgtgtgttgaaggctgaatgtaaaatacaagattctgatacaaagttagatgttcagactgaacttaaacttggtcacattccagttgaaagatctagaagaataacacatcctcatggacctgttagacgggtccatagttctggagccataaatagacctttaggttttaatttctttaacacgtccgataatgctagtgcacctccggcagattatcagccaactgcccctagaacgacagatgatatcgataatcttcctccatctttatgaagagctataagagcgacttttgatgcccg

SEQ ID NO: 153 - DNA, 1067 bp, Diabrotica virgifera
  misc_feature (936)..(936): n is a, c, g, or t
  misc_feature (969)..(969): n is a, c, g, or t
gggcttacaatctaccaaacagtgcacaaagaagtatacatttgtcgaagtgtgtaaataatgggaaaaggtggattattatcaacggaatggaatataccgaaggcaaccaacatcaagccagaatcacaccatgtaacaagagaaaaacgaagtcaaatactaggcagtactaacgagaaaaagtttagaggatgtactatctggttcactggtttatcaggtgctggtaagacgagcatttcctttgcacttgaggagcgcctagtgtccagtggagtaccatcttacagcttggacggggacaatattagatatggtctgaatagaaacttgggattttctgaggaggataggaaggaaaatatacgaagagttgcagaggtagcgagattgttcgctgacgcaggacatatctgcctctgcagtttcatttcccctcaaacagcggacagaaacatcgctaggcaaatccacgaaaataacaatttaccattttttgaggtattcgtagacacaccactggaaatttgcgaacaaagagatgtgaaaggtctttacaaaaaggctcgggcaggaaaaatcaaaggattcactgggattgatcaggcttacgaaaaaccggaaaatcctgagttggttctgaagacagtcaatgcgtcagttgaaacagctgtagatattgtctgggaactgttacaaaaacacggcattttacctaaactggtaccagactcacatctacattgcaacggaaacgagaatatatcaacagctcaaagtgtcactgttccagaactgttcgtacctaagaataagctacaagcaactttggccgaagcaaaaaatttaccacggttggacataggggtagtagatctacagtggttgcaagttttaagcgaaggttgggcctatccccttaaaggttttatngaagaggatgaacttttgcaagttttacatttncacacgattgaattaaacggagacaagatcagtcaaagtattccaatagtactagcaatatcttcagaagacaaaaacaggctaccatctcataaagc

SEQ ID NO: 154 - DNA, 998 bp, Diabrotica virgifera
cacagccacacccgtcgcccgtcgcccgttacccgtccggtcaagtcaagtcaaaagctcaaaagctgtgcgtgcgctcaactcctgggttgaaaaatttgaaaaccagaaaacatttgaccagatttgacagacacagaccatatacttaatttagaacaatacaaattaggtaaaataagctaactccttctagtattttaactgtttaccttttttaacttgttactttaaaataattgatttaataaaatttgatcagtgtaaagcaaaatgaagcccatcttgtaccacttacctcccagtggaaattccagaggagcattattagcagccaaagtagcaggtgttgatgtagatatacagattgtagatataatgaaaagggaacaattcacagaggcctttttaaagattaatcctcaacatactttacctactttggttgatggagatttaactctctgggacagtcatgctattgcaggatatctggcaacacaatactcaaaggatgataatttatatcccaaagatccaaaaaagagagctcttgtggatcagagattatactttgactgtggaactttatatccaagactccgagctatatgttttccaattatacataaaggtgaaaccaaaatttatgatgaacatagagcatctttagaagaagctttaggatttttggatgggtttctcgaaggcaatgattttgtaacaggaaaacatctaacaattgctgattgctctttagtaggttcagtatccagtatagtggctataggatgggacgttagtgctcactctaacattgccaattggataacaagatgtgccttggcaattccagattatgaagaagcaaatcaaaagggcgcagatgcatttggccaattagtaggaagtaaattggcccccggacactgtaaacattgcggtattctgtacttttagataatcctttaaaaaaaaatttaaaaacaaaatcaaaa

SEQ ID NO: 155 - DNA, 1610 bp, Diabrotica virgifera
  misc_feature (1414)..(1414): n is a, c, g, or t
  misc_feature (1436)..(1436): n is a, c, g, or t
  misc_feature (1480)..(1480): n is a, c, g, or t
  misc_feature (1545)..(1545): n is a, c, g, or t
  misc_feature (1577)..(1577): n is a, c, g, or t
aactaacttgtatgtgtatgtattcgtagctaagccgcgatcgcgaacgaatcttgcaaagttcagtcgcgtgaagtaccgagtgatcagttatctttgcgaatacctctttcccgcggtgaatgacagtgaatatcactttggaactaccaattatttttcttattgaccagacggatcaaggatatacctgacaacccaaagtgaaatgtacaaaatatggttcgtcttagcggtagtggtgttttacttaggaattgatgttactcccctagaaaatggtctcgccagaactccaccaatgggatggttggcttgggagcggttccgatgcaatacagattgtaaaaatgatcctgaaaactgtattagcgagaatctcttcagaacaatggccgacatcctcgttaacgagggttacgccagcgttggctacgaatacattaacgtcgatgactgctggttggagaaagataggagcgtctatggggagttggttcccgacagagtgaggttcccgagaggaatgaaatctttagctgattatgttcattccaaaggtcttaagttcggtatctacgaggattacggtaattacacttgcgctggttatcccggtgttttaggtagtcttcaaagagatgcagaaacatttgcgtcatgggatgtagactacgtgaaactagatggatgttacgcccatccaagagatatggacaggggatatccagaattcggttttcacctaaatagaactggccgggcaatgatctactcatgcagttggccagtataccaaatatatgcgggtatgtctccaaacttctctgcaatcattgagcactgcaacatgtggcgaaatttcgacgacatacaagactcgtggactagtgttgaaagcatcatcgactactacggcaataaccaagacgtccttattgccaacgctggtccaggacactggaatgatcccgatatgctcatcatcggtaatttcgggcttagttatgaacagagcaagactcagatggccatctgggccatcttggcagctccgcttctaatgtcagtagatttaaggactataaggccagagtacaaagccatattacaaaataggaaaattatagcagtagatcaagatccactagggatacaaggaagaagaatatataaacacaagggaatagaaatttggtcaagaccaataactccactataccaaagttatttctcctatgccatagcttttgttaacagaaggactgacggtacgccttcagatgtagctgtaactcttaaagagttgggattgacgtctcctaccggttatagagtagaagatttatacgaagacgtagactacggtgtattgtcaccccaaaccaaaataaaagtgaaagtcatccatcangtgttgtgatattaagagctgnatgtcaagcagacttcaaccgaagaataccattctttacgactncacgacccgtcagcagtagtctctaaaccagtggtcagggtacgcggaaatgggtttaaataganttgttacacgttcgtgcttaagtaaattattnattttagttaggaatgattgtaatatatttttt

SEQ ID NO: 156 - DNA, 982 bp, Diabrotica virgifera
agtctcgctcgcaggcgtcactaaactttgaaaaacagaatgaagctacaatatttgtcgttactagtattagtgactcttactggaacgaaatgtgattcgggagatgatctcacaacaccagtaaatttcaatgatgccaatttaaacacaagtgaagttgtgttcgagacatacaaagtattagaccgcggaatgaagagtaccgaccgaaagggctcccattttgacttataccccactagaatcctcatacacgggcacggcgaaaacggtcaaagttcttgggtactaacggcaaggaatgcttacttaggtctcagagaacctcacaatgttgttattgtagattgggcaacaggagctgccccatacgagacagctgcggcgaatacaaaacctcttggagaacttattggaaagtatattctcgataatgaacttgagctagaaaagttgcaacttattggtgttggtatgggcgcccacgctgccggacaggcaggaaaatatattactagagtaagtcttcaccatataggtagaataactggtcttgacgtagctggtcctaaatttgaattggattctgtgccagcagaaggcaaattacagaaaactgatgcttttttcgtagatactgttcatacgaacgttcaaaagtttggatataaatgtcctattgggcacgtagattggtacgttaatggtggaaatgttcaaccgggatgtcctgttttagattctccagatttggatgtgtgcagtgagttacgcgcccccgacctgtatgttgaatcaatcacttatcaggcaccttcctatgaatgtacggtaaccatccagaatggatcatctgtagtgaccaaagttccgtttggaagacaagtggtatttggagaaaacgtcaatttatccgctagaggaaattactccatagataccaatagcgttcctaaatatttgccacattataatctaa

SEQ ID NO: 157 - DNA, 943 bp, Diabrotica virgifera
agattgtagaactatatattttattttatcctttgagatggagttgttacctacttattttatttgattagaggtcttttgccaaagatatttattttttctcctcacttgtcgtacattgatgtccacaatgaaatccatatacgtttgcacttttacaaaatttagactcaaaatttcattacatttagtcaaagaatttctcgaacgttataatatgttaaaatataataaaaaactcatgggatgagctggttctccaatccgtagtctaaaattactttattctttgcctattacatatgcctaatatctcttttattatctatattagagattttttatttagtttgtgacatggtacattcttgaaccaatcccattaacactttgtacagattttgtgttaatctaaataataatgaatgtataaaataataatagtcgtactgtgttaaatttttttttaaatttgatttaactacacctttttggcaagtttaaatcaaagaaaaagcctcatgataatctagtaccgagttattttttagttcagtacttgacatatagagcatgctccattttggagccgagaatgtttttttatacctttttgttatgtatttaatagtattttttagttttttaacttacgtagatcttgaagaaatgtgcttatatattcgagactgattttactaagttagtagttgacgagttctgattttcaggtagtaaaaaatgatttttaatattgtacagttattgtaaataaacatgaaaatctgaacgcatcgactatgatgtctggattataattgcatttttatacatgttttaaatgtattaattttgtaaaaatgatcctatttataatttattttcaaaataaggcttcggaaaaaaaaaaaaaaactagttctagaacgcgagcggccgctct

SEQ ID NO: 158 - DNA, 1093 bp, Diabrotica virgifera
tgtagattggcgtgtagctaacctaacaataaactttttcactttttcttttttcatcttatcatcgagatgtttggctttcatgaaatataatataaaaaaaggtttatttgttattataattgtagcagcgaatatttgttgttgtaaacgcgtgtatcgtcaaaattagatttacttataaatgaaaactaaaccaatgttatgacctatttttgaacataatagacttaattgaccatggtcaaacgcaagactgtaagtgatagcgaagatgagcagaagccatcaaaaaaatccaaagcctccacaagtgaagccctaaacccaaacacgccctttaaaccccttataataaaaaaagaaatccaggaagatgagactacaattcagcctaaagctacaccaaaagtgaaaaagaaaaaaaaagaacatgtttcatcaagtgattctgatcaggaaaaagagaaacagtccaccattgaatccatcctgaatgaaacaaaacgtttggtgttatctactaagaaaccaaaaaaacctaaaaagtctcaaaaacaaaatgatgctagcaaattaaatgagtcgtttacaaccaaaaatcttaaaacagaagccttagactcatttgaaaattcaaatgtgcaagatgaagaggaatctggtgataacctcagcaatgaagtagaacctgtaaataatgtgctaaatggtgaaaagtctcctagaattagcataagcgacaaaaacgaggatgacaatttgatggaaaaaattgagaacaaagtccaaattcttcaaaacattcacgtatctccaaccaaaacaaaatcatcacaagagtcccttaaggatttatatcccaatattaaaacgagtcctattaaaacaaacttaagttgaagagttcttgtgacgtttacatgttaagaatccctaaagtgtagatgctaatggtcttttgaatgtcagcattgatcttgaaggaaaaagcaaagtaacgatagggggtcaaaaattgttatacaacatacatcgaaaatacctgatccccacatttgttttaagtacaaaaccccattttgattgaatt

SEQ ID NO: 159 - DNA, 1718 bp, Diabrotica virgifera
  misc_feature (1501)..(1501): n is a, c, g, or t
  misc_feature (1530)..(1530): n is a, c, g, or t
  misc_feature (1565)..(1565): n is a, c, g, or t
gctatgtacgttgagttatcggtttatcagtttgttgtgaacaaccagtggtgtagctgaagattggccccccgcgacaatttttgtgggtcctcgtattgtaaacataacgacaactataacgacaatattgtatgttccgaaagaattttttgtacctttttgaaagtatcctcagttgttaagaatacataatgtacaagttcagtcgtctgactgtcatacgtaatgtacaatacacaggttcagtcgtctgacaacttttgaattgagtagtgctacgcttttaaatttctcaaacgaaaagtgatttcttgagtgtgcattacaacaaactgtgttttttaaagattgtcaacgaggcgagagagttattgacgaatatcagcacagcagccgtatgaatgcagttttagtctactctgaaccaaaatgggaataatattcagtgcgaaatgtacatctaccaataggctcgatggaaaaacagctattataacaggagctaatactggaataggtaaagaaactgccaaggatttttacgagagaggtgccaaagtgatactagcatgtcgaaatttggaaaaagccaaagcagcagtagctgatatccaaaaacaatgtacagttaaatcaaatctaggcgaactcaaagttgtagaattagatttatgtagtttagaatctgttcgtaagtgtgcaaaggagttattagaatcagaagaacgaattaacttattaatcaataatgcgggggtgatgatgtgtccgtatagcaaaactaaggatggttttgagacgcaatttggtaccaaccatttggcacattttctttttactttactattattaccaaaaatatgcaaaagcatgccagctagaatagttaatgtatcgtctatagcacatacagcaccttttggacctatggacttcacggatttaaactttgagaaaagaaaatataaccctgttcatgcttatcaacaaagtaaactagcaaatattctttttaccaaggaattagccaggagactgacagaaaaggacataactgatgtccatgtctactccttacatcccggagttatacgtaccgaacttggccgacactatgattccatgtttccaggactaacctgggtgtacgacaatatcttcggactttttattaaaactccaactcagggtgcgcaaacacaaatatactgcgcagtagacgacaattgcgcgagtgaaacaggactgtactatgcggagtgcgctgtaacgtcgtgttcaagggaagcggagaatgccgaaactgctcgaaaactgtgggacattagcatggaacttgtaggacttgataaaatgacgacatatttaaaaattgtttaattgtaaacaaacactttttttttttaattgtatttgtaatttaaaccattttgtgatcatcatcattttcatcatcatcaacagctcttgctttcctaggtgtgtccatttatttctngttgctggttttttgcatccatccgtggncagacattcgcttgatgtcatcagtccatcttttnttgagtctgtctctactttctttgcttgcacttggtcgccatttcagaattcgctttctacaacggctgtcttccattcttcctgtgtcctgcccattccatttaaacatcgcaggcttttggacacatctggtacttttaatcatcttctat

SEQ ID NO: 160 - DNA, 998 bp, Diabrotica virgifera
  misc_feature (953)..(955): n is a, c, g, or t
gtgtttttctccaaaggattattttttctggtagaagatcagacactagtttaaataaatgcacagtcgaaaaatataattctacatccgactttcaaacaaaaactatggttacagaagaacaggtgtcggcatttcttgccgaaaactccaaatttctggaagattatattatgaataaaatcgaaatagaacagattgaacggtggattattcgaaaatctaaaatatctgataaaacaccaggcacaacagtacaaactcgaaagacaagtttatctaaatggaaattttgtgtacatgctgataagcgtcaaatgttaaaaaacttaactcaaagtcttcaagctaagcctacccaaggtcacgtattatgggagttagccacttgtatatcttccgcagtcaaggcagatggatttagattatacgttatcgataaggaaaacccttcacagttacttctgtacctagccaccgaagaagatgcaaatcattctccaaaactaagagttattaaaaacaatgtatctattccggcctatgtggcaaaaacccacgaagccgtaagattttctagaggaaaatctgattccagatttccagacacggttgtcaaagagttacagaataatatagcacatattcaatgtcagccaataacgcaatcggatggaaaaatggtaggagttattgaaatgtggcgaatcgattccaataaccccttctatgaagaagatgaagagatcgctaatagttatttagtttggggaggaattgctcttcattacgctcaactgtacttgaatatgaatcaacaaaaaaaattaaatgagtttcttctggctgttgtcaaatcgatttttcaagatatggtaagcatagatagtttagtaatcaaaataatgaattttgcccatcgactggtagatgcagatcgagcttccttattnnnctgtgactcaaaacgtaaagaattatacgctaccatctttgat

SEQ ID NO: 161 - DNA, 989 bp, Diabrotica virgifera
gttttatcagaccaataacggcaattgtgacgatttttcgttcaacgaaatcggaggtaatagctcatatccatctccagtaattgcactagttccatttttcatgcgtccggtgtattcaccgcagaaaaaatattaaagcgcaactgtggatcactcactgctcgctcactaattatttcacaaaactgtaaacgtcggtcataatcattctcattaagtttctgtactaggtgtacattttatatgaatggaatttgttcttcaaaatggcttaaacgctaattatgttgattccaggtacagcttctacttgcctcgtagttaccatacagtgcgctggaatgattgttaccccccccccctattaacttatttatttttagcacataagcaaaacgctcggacaggtcgatttttaaaatgatcaaagtgtattataacatcaatgtttcgaacttcatgcgatccctcttcaggtgacaggcacaactttaatttttttaaaatggaaaagtacatcatatgacagctgatttaaaagcaattgaaatactgattacaaaaatgtataatactttaaccttttttgagagcgtaggcgcaaaatttcgatcgaattatttttaaacgcattcatgtttttcgaatcacctgaagagggatcgtgcaaaattcgaaacattgatgctataatatactaacaccgagcattttgtttgtgtgctaaaataaatgtgtgaaaaaggggggggggggggggggggggggggaacacttattccaggggtactgtataatctagggggaacatctcataatactgcaacttaatatgttcattaatctcagcttcctgaattttttttaccgaatccaaaacatactttctactgttgtgtttatcttgtcattcaataaattgctgagccgtcatattggcacattattgttcatagaatacaactaaaagatatctaccctttccg

SEQ ID NO: 162 - DNA, 1035 bp, Diabrotica virgifera
attttggatgcatttggatttcgtttcctgtttttgtcaactttataaactttaccacaatgcaaactgattatttaaggaaattattattggaaactccagatgttgcgagaaaggtagaagatatttattgaagctgaaaataattggggatttagatccatacgcaattcagtcagaattggattttacagtaaagtgcagaccatcaagttactattatagatattttatacatatctggtggaatctcgcagttgctactctaagcagcagatgaaagcatacaaaagccttcaggcacataaatattttacagctggatttgttttgaatggagtaaaaattgttaatgatttcctgatttccatattattgttggaaaggtatgcctttattttatttattcaccattaagaaatatatggataacagtattagtgtcttttggataaattggttctaaatattagatttatttacgtttatatatctgtatgaaaccagacatatcgtcgtcctaatctgtaaactgcgaactccataattctctgaaaatgatttattactgccatctatttgaattactgtcatgattgttctaaaattatattatatgaatgtctgattttaaataaaatattctcaatcattgtaaagaacgcaaatactctaataaaaataaatttttgtagttgaagaatttccaaaaaaaataaaatattttttttaggtgaagcatttccaaaaagctaatgctaaacgactaaatggcttgggtggggtgatagccagttctgatgacatagcaaatgcacattgtatgcgtatggccggtaatagtgaagtctgcagccatattgcagcaatcctatttttagctgagtatgcccagagcaagacagacgaagaagaaccccatgcatgtacatatgttacagctacatggtttggagatagcaacatatgcattctctgatgaaaaactaatgagttttgaaactggttccggcagagtgctttgtgcgctcacta

SEQ ID NO: 163 - DNA, 1017 bp, Diabrotica virgifera
  misc_feature (928)..(928): n is a, c, g, or t
caacgataccgctacaaaatgagaaattctgcagcagtcacttttcgaggttaaaagattaaggcacggatttatattatactcgactttttaggcttctacttccagtgtacctaacaacttttcttccagtagaaaatttagtgaaaagtgtgaaaagcgcgtgtggttaggttttcccgcttgaaggttcccggaaacctcgtgagtgtatttttagaatttcgatcgatatttaggcagatatgagctagaacctcgggaaagatttttttcggataagatacgcattcgcaaaatgggcgatcaaggagataatctttaccttggtttggatcttagcacacaacagcttaaggctgctgtagttaacgaaaaactagaaattgtagcggaacaaatcgtaatatatgactctgacttacctgaatttcgtacccaaggaggcgcgattatagataaaattaacaatgcctacatcacttctcccactttaatgtgggtaaaggcccttgatatagtgctggacaagctaacagtggcaggaatcaatttttcaaaaatagcagcaatctcaggaagtggacagcaacatggttcagtttattggcaaagaggggctagtcaaacgttagcaaatttaaatcctggtgaatttcttcatcaacagttagcccattcttttgctgtagctaacagtccgatatggatggactcaagtacgaccaaacagtgccagttactggaacaagctgtaggcggaccaatgaaattagcagaaattacaggttctcgagcttatgaaagattcacaggatctcaaatatgtaaaataaatcaaacaagaccagatgcttataaaagttcagagagaatatctctcgttagcagtttcgtgtgttctctcttcgctgggaaaattgctccnatagacatatccgacggatcgggaatgaacctgatgacatcaaaaacgaaaaatgggatgaagaacgtgcttgcagtatgcggatcaaa

SEQ ID NO: 164 - DNA, 989 bp, Diabrotica virgifera
cggacgcgtgggcatgggtagtggcctccttttccctactctcgtagacatgttacgtgctgtgtggcaggttattccatattggtttgccatgtcttcttggattgccttctcggtggtattcgtgggcaatcctcgtaacactaattttggtttcctgtcttcgtcgagtggaaaggctatccattgtagcctctttttctctttggcggcgtatgcttctgcatattcctccactatccttgtcatctttctgtagtcatccgggcttttagcctggatgagcgtctctctgccacttctggagattttgtttgtggtgatgatgcctttgccctgggctatggtaagaatagcccctgtctcgctgacactctgtaacttaattacaggcggttttctgtatggtgttacctggttttcaggtaacacggcttcttcggcgtcttcttcgttttggtttgtttccattgacactgtatcagtttgactggaagcggcaagcgcgtccctatctgtgctcgtggatggcactggttcctcggggaggggtagctgtacctggggagctagtttcatggctttttcttggtcggacgtccatgcggcgtcttcctcgtcggttagtggaaggtgtgtcaccaggggtggaaactcttcctttctctttttcctctgttgggtggacgcctccttcgtcgaggtggtagccttctggctgggtggtcgagtctgctcggtggtcatctttttggtggcaggctgctctactggtggctttttgtccgtcttttcggggtttttcttctccggtttctttgcgagttgtttctggagagctatcaactcgtcgaatctggcatccatcttttcgctcattcgtcgaatctccgtattcagctctttgatctctgccttctgttgtgcgatcacctcttcgtattttttgttgtttgcatcaacgtttgctgcaaattctttcatcaggg

SEQ ID NO: 165 - DNA, 1024 bp, Diabrotica virgifera
  misc_feature (959)..(959): n is a, c, g, or t
  misc_feature (965)..(965): n is a, c, g, or t
  misc_feature (981)..(982): n is a, c, g, or t
cttctactattaactaattggtcttactaaaaatctatttcaataccagaataatataaaacaatataatcctatcgaaacgtattatttgataaatcgattaatttagttttccctatctttagtcacgtgatggtatttaaaggataagaaaggcttcgcagtaggtacgtcttcaccgcgcgcgatttgaaaattagactcaacatcattttagctcctgtgatatttttaaagaaaaaaaaaagcaaaaatagctccaaatcaaggttggattgaaacagttatgctacatgttcttaaaagcgaaatcataaactttttgtttaaatattggtagatattacttacattccttttacgtgaaatacatctaatttttcgacgtccataaaatacagtgagtaaaattcaagcgatacgtatttaaccaacaccgtcgtaaaattttgttttccaaaatatttctcaaaattgaaccaaaggaagttacttctgtttcgtgattattacgtgaaataaacgtacctttgcgatgtaaccgacattcacaactattataaaaaccatgtgtactatattcgtcattattattttatattattctaatgtccaacatgtataaaggaagcactaatatataggtggatgatttggcactgaaatacgtttttttcccgtcataaatcaccgagttacgtattcgttgaaatttgccgtaaatttaacgtaattatcacgtaactgggctcaagtctgtttgctgggatgtattattctctatgatctatgtctgagacacgtcttgatagataaaaacgtcaacgtcaaacgtcagcctgttgacatttgtcgctgtcaataatcttagtttcttgaatcacataacttaacaaatgtgtaccattgcgcacatcccaaatctagacccgagaataaatagatatacaatatataanatagancaattaaaggaatttnngatcattagtgatttctactatatcgtcttcttcttttcatc

SEQ ID NO: 166 - DNA, 988 bp, Diabrotica virgifera
gatccatatcaaaacaaaaagtggaaataacactaaacaaaccaaaagaaaagcagacatggaagcttgtcaagcagtggaaagagaaattgataaagtttgttcgaagtttggaaatataaatgaacacgccaaaagggttctatcggatctcgtaaaccagattcagaacttaaaagaagagtatgataatagtggaagcgaacatgttttaactgagcttcaagtcgatattttgaagcagaacatggtgaagataaaagaaacaatatctaaattggcaaccgatcaccgagatttacatagtacagtttcgaaagtaggaaaagcaatcgatcgcaatttcacagcagatttcgctgctactagtcgcgaagagatgttcaacaatcccgataaaattaaccttattaataaagttatttgtcaacatttttacagacaaggcatgcacgatgtagctgaccaactcgcccaggaaagctccattacgccagagacgcacgagaaagaacccttcaccgaaatcaatcacatcttggaaagattaaagatgaaagatttggagccggctctggcgtgggcgacggtacaccacgaaaatttggaggctcaaaattcctctttagagttcatgctgcacagattgaagtatattgaaattctacgtaaaggtccggtataccagacagatgcgatttgctatgctaggttacatttcagtaaattcatgtatcgacatgaaaaagaaatccaaacgttgatggggatgcttctgtatgtccccaacggaataaatagttcaccatatagttgccttttagaccaagaactgtggatagaaatctgcgagttgtttctgcgcgaagcttgccagcttctcggcgtatgcgtcaacagtcctctgaccacttgcatcaacgccggctgcactgccattcccgctttgctcaatattaaacagggtatgatgcagcgacaggttact

SEQ ID NO: 167 - DNA, 936 bp, Diabrotica virgifera
cggacgcgtgggtaatgatcttaacgtttatagtactatatagagaattgaataacctttcaaatgagccggcacacgacatccgttctcatttataaagaaaaaatcgattacgtcatcacgcccagatggatcgccgtcaccggtgcgatatatgtgtcaagggtcataattggaaagtcgaacttttgtattttacattttttttctagttctgtaaataaggcagtttgcaggggggtcaaaatatggtgaatagccctgtacattcattggggccgaccgatcggctctgtcccgtcatgcagctgaccgactgtaataacttttatttatattcaatttggaatgtgtgtactgattttcaaccttagtaaatggatttaattaccttcgtaggaaagcaactttgataccctcttagtaaccactgttctacgtttcgtttgaccgaccgcagtatgtttctctacctacacaatcacagtgatcaattatgaaaagtttagcttttgtgaattcacagattttttagcgctttatattggaaaattaacatttttcaatataaaccgtccactatattaatagatacaaaattaggagctgtagcagaaaagtatctcaactgactcaatttattttattaataagtcctggtatttattacgtttgaaaacggacattttggatgctttctatcttcgatctttgtaaagaaaccgtggaataaagtaaaacaatgttaaatattacctaggtattttaatgcataaaattatatactcaatgcttgaaggataatataaagaagcatttgttttttttttaatattttttctcttcgaacttttttgtgtgcggcacatttttgtaggtatctttcgtttggtggaaaaataaagggtggaaattaataataggtctataacgcaa

SEQ ID NO: 168 - DNA, 1079 bp, Diabrotica virgifera
cggacgcgtggggggaagattacatttacgaccgatgtgttgatatcttcactgagggttacctataatggatatcatagagaaaaccttatcgtataataacaaactaatagaacccccacctgataacattgtggtccaaaatgaagataacgaagaagttcactatgtaaatattcatgaggtgcacgtcaacaaagtcatcgagaaaaaactgggcaccaatcatttcgttctacttaattatgagcttaaacctataactgaccgtcttggtcttcttggagaccacagtattttgttcgtaacattcctcaataatattggatccaaagaacatttgcaatttttcgttaagtattttccttttactgaatctcaagcacaattcgctgatggcatcggagcatttgaaaaagaagcactggtttataaattgttcaaagagttttataagcaaggtatcactcaagccagtaatgttgtcccctactgctatgtagtagctcccaaaaaatattttatattaaatgatcttactctcgagagttatcaaattttaaataaacatatttgcttagaatacgatgtcgttgtagttgttttacaagctttagcccagttacattccggtagtatagcgtacgaagaaaaattaaagaagaatctattagacttatatggtaaagatttagatgagactttctttaatgatagaaaaggttttccaaatgtagaaggagtagagtcttgtataaagtgtattgtggacgaaatcaagctttttaattttccaaataaactggcttctggaaaagtttttactgaagtagcagacacagtttgtcgtaaaatataccaagcagttaaaccatcaaaaactgttagaaacgtcctaacacatggagacatatggacaaataatatattaataaaatatgacaaaaagtctaacaaaccaattggttgtaagttgggtggattttcaagctggaaggtatgctccaccagctcaagatgtactttggctttttttgtacctaaatactcgaagagatttcagaaaaaaatatctgtat

SEQ ID NO: 169 - DNA, 911 bp, Diabrotica virgifera
  misc_feature (820)..(820): n is a, c, g, or t
gttattagtgaaattgttttttatcgtgttcgttttctaccaaacagtggaaacgaaggcatctctactagatgttagtaacctggatgaagatgaattgattgtaacgttgttaaagccctcaagcaagattcgcggacacagattaatgactcgattgggacaagactactatgctttccaagatattccttatgctcaagcaccaattggtaaaaatcgctttaagccagcaattgcgtcagagggatggccagatatacttgacgcaactagtaataaaaagaaatgttttcagcccggatcaccagttccatttgatacactaatagaaactgaagattgtttacttgtgaatgtatatacacctgtgaaacctggcactcgcccttatttgcctgtttatttttggattcatggaggaggttttaatacaggtaacggagcaattggcacattggatcccagaaattttatggactatgacgtaatagttgtaacaattaattacaggttgggagtgctaggttttctatcaaccgatgacgaaagtattcctggaaatttggggttaaaagatcaacaatttgctctaaaatggacttacgataatataaaagcttttggtggtgatccgaaaaaaatcactatagggggtgaaagtgcaggagcttcatcagttagctatcatctattgcatactggaaataaggatttgattaaaggcattatacaagaaagcggttccgctcttaacacatttgcataccagattaattgtacagagaatgcctttacatatgctaggcttcttgaccanacttttacctcaaatagctctcaagatttgctagaacttctacaaaaaactccagcagaaactttaaatagaactcagtctaatatgcatt

SEQ ID NO: 170 - DNA, 945 bp, Diabrotica virgifera
accaaaatgtcaatttcggtattttaatagtgtttgtaaacatatagttttaaggtaaattaagcagcaaaaatgtcttacagtgtaaatatatcagtcgaagctccaatcgaaaatcaaatacaagaaattacttatgatggaacagagatatatcaaccacctttaactctttctgagagtctcgctaagtatgctcaaaagatagacttcagtaaaacgtcagaattagaaattaagaaggaagaaactaacgaagatgctaaatcagacactgacagtaaagatgcgtttcagtcttcattatggccctgggattcggtgagaaataaacttaggaatgcccttacggaagtatgtgtattagccgacgtattggcgattgctaaagacaaaagatacttagttcttgaccctgtacaacaagaatctcttgatacgaaaccgatggttcaaatctatgctaggaagaaagcgttagcaggtgctgctagtgtattgttagctggtgcagaaaagatgaaaaattctcaaaatgaagcagcacgaagtagaacaaccttagattttcatatagaacttcttaggttaagacaaaactggagactgaaaaaggtctctaatacgatcataggagatctcagctataggaccacaggatccaagtacttacagactggcacatttgaggtaaccaaagcagaagacgaggaaaaaactaacagtcctccaagcagtccattaccaggaggtccagcccctgtaaaacctacaagtgctttaagagtatcaattccctctgagctacaaggtgttgcttatattgaagttttgtgccaaaaagatcaagaagatctttgcactgccatttgacgctcctcggctccggtcccccaccgtccaatcctgatatgcattgggcacagaaacttgaagctgcgcaaa

SEQ ID NO: 171 - DNA, 1012 bp, Diabrotica virgifera
gacagaacttctgtcgtgtactatgatgaacatctctcaaagaatttatcaacaaattatgttctcagtaaacagatttcttaaagtaattgtagttaatacaagtatgttagacactaactcaatatgaaactcatatcgcaagacgtcgataaaaatggtgagggcactgttgctctcatcccagaagagccagaagatatgtggcatgcttacaatcttatttctgaaggagattccgtaaaaagcactacaatcagaaaagttcaatctgagtcttcaactggttcctccacatctagtagagttcgaacaacattaacaatatcagtggaaaatatagattttgatactcaggcatgtatgttaagattaaaaggaagaaacatcgaagaaaatcaatatgttaagatgggagcataccacaccttagatctggaacttaataggaaattttcactcagaaaaccagaatgggattctgtttcactagagcgtatagatatggcatgcgatccaacaaaaagtgcagatgttgctgctgtgatcatgcaagagggacttgctcatgtatgtctgataacatccagtatgactcttgtacgagctaaaattgatgttaatattcctagaaaaaggaaaggatttgtgcagcaacatgaaaagggtttggctaaattttatgacactgtgatgcaagccattctaagacacattaacttcgatattgttaaatgtatactagttgcatctcctggatttgttaaagatcagttttatgaatacatgtttcaaactgcagttaaaacagacaataaaattttgctagaaaataagtcaaaatttatgctaattcattctttcttcgggttttaaacattctctacaagaaatactacaagatccatctgtataaacaaaatatctgacacaaaagctgctggtgaggtaaaatcttgggaaacttttacacgatgcttcatttgaccagccaaggcgttttatggtaaaa

SEQ ID NO: 172 - DNA, 980 bp, Diabrotica virgifera
  misc_feature (899)..(899): n is a, c, g, or t
  misc_feature (913)..(913): n is a, c, g, or t
ggaatagtcaactctaactgagaatcaacttgaactgtaacatatacatttgaactctcaatcctatttttctatataatctcccaacaaattcaggcacttatcataacggtgaactagctttgagataccattgtcataagattctgccgcctgagactttaaccaggtgttttacgccgtcccatagcttcgcatcgttatcaaagcactgcgttacaagcaaggtcttcatcgctcgaaacaggtggtaggtaggaaaccaaggttcactttgttcttcatagtgcacattggttcggctatttttgaatttaatgcaccattgacgcactccaccttcagtgatcacattgttcctataagcagcacaaatttcgcgataaatttcaattgatttgctatttttagtcaacaagaaccgtagtaccgttcgcacctcacaactggcgaggttttcgatcgcggcacacatttcaaacagctgttgtaaaataaagagaagagacagtaacttcgcgctagcacggctggacagttactgaacggaggcacgccacgatgctaagacggcagcgcagtcccctcccctagcggctacagatcaaaacgtaacgaaaattctggtatatacggtatattcgtatatacggtaactcacactattcgatgaaatatgttcattcgcgatttttaaagtaaaaaaatttgttttttcttagatcgatagtctttgacatttcatctggtactttttccagtttttaataataaacatttttaggtgattttttttctttataatgaatgtgtattaaatctctgacttatcgttccaaacttgcccctcaaatcttcttaagacattaattcgcgtgttattcccctctcattccaanatattgtttgatanttatgtaagtagttagagtatattatctaaatacttgcttcataagctgtcatgtggtaaaaatttt

SEQ ID NO: 173 - DNA, 1103 bp, Diabrotica virgifera
gtgattattaatttatcgtttttattaaaagtatctattttaatctagaaattctcattattaatacaatattttctaaataattgtcacttaaattacaatttttacagaaataaagtattgccgttgaaaaatatctacaaaaccactttggggggtgttcaaaatggacgtcattcttcatattcgctaattgccggtgaaaaatattgtctagagttaaaatggaaacagtaaattcacagttgttgaccaaagccataaactttcatggtcaacagctgcagaagttgtgggaaggagaatttggagaaaatgatttgacaagaaaaaatgtcaaagatttgaattacaatgtgtatagtcaacgccagaagaacctatcttttcaagatagaggtaaacggttgaaactccaacagtttttgataaagaaggctaattttatctatagtttggaacccacgaagcaaaagaacaatgagaaagcgattactgaagatatgtatgctgttatgcctccttttgaaacttacaccagtgtagacaaacaaaaaagagtggcattcttcatggagaatgtgaaagtaggtaatctaatcctgggcaccattgtgagcagacaacaatcaggaatgatgttgaaagtgttgtgtactactggaaatggtaacacttgtttatatgctgctgatatcaacgtcaaggcattctgtccagttgcaaatgtcattaatgcagtggacaaaaagggggtatcacgcaactacatgatgaatgactatgtgtgttgtgaagtgctggaaatcatgcctgatacagataagctaatatgtggtatgatgggtgtgactaggaaatcatcagatccagaacatcgaccacctctagggcttattagtactgaagattttcctcttatatacaaacattttgtcttgccaaaaatacaaaaaaatacaataaaggctatgagcaaatattgcgtaaaagtagtaaaacttggtatgtttagcactgtggcaatatgcatctagaaaaaatttgcactttatgaaacatcacaaaaagtacaagcttgaaaatgctccccagacaaaaat

SEQ ID NO: 174 - DNA, 1227 bp, Diabrotica virgifera
tttcgtccgcaagacgcgacaattgcgtacatacatacatacttacatacatacatacatacactaatcctgtggcgacttccaaagtgtctcgtgcgctgtttgaaaaaccggcggcacacgtttctatcgtagcctttttgccaaaatgaaatataccggatttattttattggttgcattattaatcgtatgtgagtgccgaaatgatagtacaaaggaggaatggaaacgttttaagttacagtttaataaaacatacgcaactaataaagaagatttaaaacgatataaagtatttaaagaaaatcttaagaatattcataaacataacaaacgatttgagaaagggaaggagacgtatttgcaggaaatgaatagatttggggatttgacagataaagaatttggtgaaatttatggtctcgccgaaaacgaaaatgttataaaatatgacgatgatacaaaggcgaaggaaaagaaatctggaaacacatccacttctcaaagtaaagatgaatttttggattggagtaaaactggggctgtaactccagcaaaagatcaaggcacatgtggatcttgctggatatttagtgcagtgggtgccttggagagttacaattttagaaaaacaggaaagttgatttctttcagtgaacaaaacattgtggattgtttctcaaacgatacttgcgaaggaggagtaccagagtatgctgctaagtatatatacaatcacggaatacatctggaatctgattatccctacacagcaggacaagacgcttgcaaaatccttataaaaccaactattagaataccttttaacgatacttctttcacgaaaggtactgatgaggaccttaaacaaggggttaaggagcatggtcccctttctgtttgtttgtacgttactgccaattggaggttttatggtagaggagtttggtaccataacaaatgttcatacgagtcaaatcactgcgtgctgttggtcggatacggaaaaaaaaaggcaacaataattgaaatttaaaaaattcgggggggccccaaatgggggccaaaatggggtttatttaaaggggccacgaaaaaaaaactgggaaactaactgggggaaaaaaaggttagggaatagttttttaaaaaaaactaaaaaaaacaaaaagagatattcccaaaattcctgtcgcccccagaaaaatttaaaataaataaaaa

SEQ ID NO: 175 - DNA, 1204 bp, Diabrotica virgifera
  misc_feature (1128)..(1128): n is a, c, g, or t
  misc_feature (1143)..(1143): n is a, c, g, or t
  misc_feature (1169)..(1169): n is a, c, g, or t
atggaggattatttcgatacgaagtttcctttacccaagttagattactcgcaattcctaatttcggtaaaaccgctacggagaaccggggcatcatatcttttagaaaatcttcagtcttatttcgatcctaattccactagtattaagaccagaagctatatattagcgaaaattcgcgcatcgagttggtccatcaatggtttggaaacttcggttacgatggaatggtggtctgacctctcggttaaatgaagggcttcgccacgttcatatcggaaatagcaattacaacgctaagacctaaatggcatgcttacagtagcataaaagttagggatacctataatacactaaatgacgatagtctcaaatcagcaagaagtatgcagagggaaattataacaaattccgaaattgaagaagtgttcaatcctataatctacagaaaaggaagtagcattctgaaaatgttaaatgctacattatcacacgaacatttcaagaaaggtttgcaagatttcatcaagaaattcgcttacaaatctgtcactcaggatgatctctggtcaatttacacaaacacggcccaaaaccaaagccttattcccgatacagtaacggtcaaagatctaatgaactcttggtctatgcaaagcggatatccatgtgtaaccattaatagagattactttactggtgtagccaccattaatcaaactaagatgacggaggatgcgaatctcacttctgatgctctctggtacattcctatcacatatatcacgaaaggtcatagtgaaattaaggaaatatggctggagaatgtgcgagagaccagtttaaatatgagtggtattggaaatggatcttggatacttttaaatattgacgaaacaggattttatagagtgaactacgatacacacaattggaagctgttaatttaccaactaagaacaggttccaatcagatccccgtaacaacaagaggtcaacttatcgacgattcttttgttttagcagaagtaggattaattaattacaccatagctttcgatttagtcaagtatctctacataaccgagcctaattatataccatgggtacagtgctttaagaaatatnggaagaactgagagnaatcattagcaactatgaatactctnggatatacgacaatttcctactcaaacttgtaacg

SEQ ID NO: 176 - DNA, 272 bp, Diabrotica virgifera
gacactacgaactggtggtttttattggagactaccccattaaatgtgtactttatttatttagcttataaattttacaaagagtcgtcaagtgctacctcaaggaaactgttccggttttctttaattcatttgccgttaataatggtcctatttttaataaataaaaagaagtggtttttgtttgacgatcagaaaaccgaaacaaataggacagagttagtgagtgcgtagttaaagtgatattttatttcaaataaagtattaggtac

SEQ ID NO: 177 - DNA, 1595 bp, Diabrotica virgifera
  misc_feature (12)..(12): n is a, c, g, or t
  misc_feature (1534)..(1534): n is a, c, g, or t
cccgcaattatntgggaatgccacaactcacaacgttgaaggagatttgttaaacctggaaagaaccgttgatgatgaactgatcttagaacgcaaagcaaaattagttggtactgatatcattgctaccaacggtgttattcatttgatcgatgctgtaattgtaccagatgcaggtctctatattggtaacgtacttaaacaccaaaactacacaaaattccaggaactcatccagaaagctgagctggaagaacaaattaacgagctccaaaatgctacagtattcgttccaagtaatcaagcttttgaaagtccagaaggaaagaagttattgagcgagattgaaaacgacaaagagaagctaaaagaaatagtcaggtatcacacacttcagggtcagctacaatcaggagatatgaataataacgaaaagttggtcacgtatgataatggaagagagcttagattgaatctctattcaactttacctctattcaccaacatcgtaaatcgtgccacagtaaactgcgcaaggctaataggtttcgacgaaaaagcatgcggttccaccattcacgaagtcaaccaaatcttggtaccacccaccagaaatatcttggaagttatcgaaaacgacgcgagatattctaccctcaaaactttactgaaagacacagaattggagaaaattctgcaggaaaataatagatcattgacattgttagcacctacagatgaaacatttgcagctttggacgagaaggatcgtgaggcgttactgaacgataagaaaaaagcagaacagattttgaagcatcatgtattaactgaggttctgtgctgctcaggcgtcggtccacattcctggggttttagcagttttatttcaactctggccaacacgcagatagaagtagcccgcaccggaagcaggatccgcgttaacagagcagtagtcactagctgtgataatttagcaacgaacggagtcgtacacaccgtcaacaaagtattattgcccaggcaaccacccgtttcgtctatcggtggtttcttcctcttcgatctttagagtttttaaagtgatttagaatcatcgtgtaatgcagattttggctttccatccattacgtttgtatacttcgttcattttcaaactaagctcagacgctagtttcagacacgtgatcggtgggtgtgccatgtcttctcagattgtcattggttacaaattactttctaaccaatgacaaaacgaggacacgatacatctttaaagtgtctaaaactgtcttctaagcttatcatgagaatgaacgtggtacagtgtgtaacttgcaagcacatgagacctccatttataataattttttagttgagaaatcatgtgatccttctggtaaagactatgatttaggattggtccagtcaaataatcgtcttaatcaaaaaagagatcagcaatgtatcgatcaagagaaaggcaattctctcagaaatcatttagtaagtcggaaagatactatatggnatatgtgtgtctataccaagtctatggtctatgtctataccaagcagtagcgtatctaggc

SEQ ID NO: 178 - DNA, 1643 bp, Diabrotica virgifera
  misc_feature (1604)..(1604): n is a, c, g, or t
  misc_feature (1609)..(1609): n is a, c, g, or t
agatttttaccaaattctaaacagttttgttctaaaatatcaagaaaagtgaagttttaaatttgtagaaggctagttcagtacattaaacagtggaggatcaagatgctgctaacttcatcatgggtaatagatagtataatattcctaattttttttgtcgtcctgatatataaatatcttacacggaatgcagacttttggaaaaaaagaaacatcccattcgcaaaacctactctattttttggtaacttctatgaagtattcactttaaaaacaacaattcatgagcagataaaaaagctatatgacaaaatagacgcaccatactttggaatattcatcttcgatgaaccattgttagttttaaaagatcctaaacttattaaagatgttctaataaaagacgctgttattttcgccaatagaagacctgcaactcctacccatcctctcatggagcactcagtatttttcctgaagtttccgttctggaaaaaaatgagaacgaaacttaccccactgtttactactgtgatgttaaagaccatgcacaatgacttaagtgaagtctgtaaatcaatgactggatttttacagaatcataaagatgtaatagatggaggacatattggcgaacttttcacgactgagttcatttttaaatggttctttggagctaatcttgattgttttgcagaaaatccccctctattgggaaaactggtgaaacaaaccaatgagtttagtttcagaaattccattattcaaaatcttttctttattaaaccagcgtgggtcactaatttaaagcttaatttcatatctgataatacacttagattttttggagatatctttaaaaaaggaatggcagctagacaggaatatgatggcaaaccacagaattatgttgactttgccaatagagctgtgagagacaaacaaaatggaaaggaagatgccatggatttggaaatgtccacctcaagtgcaatattttttttaatagctggtaaagatgctttgaatacgctacttgcttttactctgtacgaactttctttaaatgaaaatatacaaaataggttaagagaagaaattagagaaaatgttcaaaagttcaatggcattacgtatgacggactacaagaaaacaaatacctagaatggtgtgtaaatgaaataatcagaaaatatccacctataccgttcatcgacagaatgcctctctccgattacacatttgagggtaccgacttgaaagtacaaaaagacatgaccgtaatagtaccattttatgcgcttcatagagatgagaagcattttcctaatcctgacgtattcaatccagacaggttcgcagaagaacttgaagaaggagtttatattccgtttggaggaggacctagaaattgtataggtaaacgcctggggatgttgggcttatcagtagcagtgtcgtatgtagtactgaattttgaaatagaaaaatgtgccaacactccaatcaaccttgagtttgatccaaaaagttttgcactgaattcgaaaacaggtcttccgatgaaaattacgccgataaaaacaaaaaatatttgtanaatanaaaaaaataaaaaaaacataaaatcctttactac

SEQ ID NO: 179 - DNA, 475 bp, Diabrotica virgifera
aggaactaaataacacagtaacaaaatgaagtatttagttgttcttgcttgtgttgttgttgcggctgtggctagccacctgcccaacttacccgaaaacgaaagacttaaactagctcaagttcacagagactgccaagccgacccaaaaacttacgtcgacgaagacaaacttaggaagcttccaaacttcgttgaagacaaacaagtgggcattcatatgcgatgcatggcagtaaagtcaggattaatgaagcaaaatggagacctcgacattcctagcattacccaaaaatttggtttggtgatcaaagatcattctaaggttaacggattcgtccaacagtgtgctaagaaagcagacacaccagaaaagacagctattcttcttaccttatgctgtgtcaaaaacgacattcagtattaccataaattgtaaaaaaatatccatattatattagcaaatatataagtc

SEQ ID NO: 180 - DNA, 1370 bp, Diabrotica virgifera
  misc_feature (1321)..(1321): n is a, c, g, or t
  misc_feature (1345)..(1345): n is a, c, g, or t
gctatctactagagcggagtggatgagattcggttgcagaaatcgattgattgattggatgcagaaatgattccttctcgacacgccccacgacttttggaaaatgccaaaagctgcattaacttgtccaagaaggctttgagtaccgaaaaggttatccataaggaagagaagtatgcagcccataactaccatcctctaccagttgctctagcgaaaggacaaggtgtttttgtatgggacgtcgaaggaaaaagatattttgattacttaagtggttattccgccaacaattttggtcactgtcatccgaaaatcgtcaaagctttacaagaccaaagtgcagtacttcaccacacatccagagcatttttttccgatcaacttggagaatatgcagaggttctaaccaagctttttgggtacgacaaggttttgccgatgaatacaggtgttgaagccgacgatactgcctgtaaattagccaggaaatggggatacagaaagaaagggatacccaaaaatcaggccaaaattatttttgcacaagacaacttttggggaagatctttggcagcagtgtcagcgtctacagatcccactagctatgaggactatggaccgttcatgcctggctttaaaattataccttacgacgatctgaaggcattagaggaggaattaaaagatcccaacgtatgtgcctatatggttgaaccaatccaaggagaagccggtattagagtaccatctccaggttatttaaaaggcgtcagagaactctgcaccaaatacaacgtcctttggattgccgatgaaatccaaactggtttaggaagaactggaaaaagactggctgtagattacgaaatgtcaagcctgatattctggtccttggaaaggcgctgggaggtggggtttatccagtgtcagcttgcttagctaacgatgatgttatgttggtgattgaaccaggtactcacggatccaccttcggaggtaaccctctaggttctagagtagcaattgtttccctaggagttttagaagacgagaacatcgcagaaaacgctttcaacatgggagagatcttcagaagagagcttcaaagcaaattaaataaagatattgtaacggaagttagaggaaaaggtcttttgaacgctgtagtcatcaacagaggtgtagctgatgcgtgggatgtatgtttgaagatgaaagacaacggtcttattgccaaacatactcacgaagacatcattagatttgcccctcctcttgttattaacaaggaacactcgaagatctattaacattattngtaacactattaatggcttacaanaataaagtgtatattttgtatcata

SEQ ID NO: 181 - DNA, 851 bp, Diabrotica virgifera
gttcagtctttgaaattccgcgtgtattaaaatatcttttaatgttaataaacatccagtgttcactgtggggcatctgagacaaaaaactgagaagaatgtcgcactacagtgatgctgaagaatctatcaaagatatacaagatttagacttaggattaagaaaaagaagggtgataggatgggacccagaaacagagtctattgcttctgaaataaaggatttattggaagaggatgtcaactcattggaggaggaggactgcatcggctgtccccttccttccactccagaagatgaaggtcttctggattcggagatgagtgatgttctaaaagcagcagttctaggggatgacttggacatcacagctttggcccacaatgctgcgacccaagccgagcatgtcgtcagaaagatgatccaagccggatggtccgtctgtcattttaggaacctaccggcttggttgcaagataatgattttctccaccactgtcatcggccaccactacctagtttccgggcatgtttcaagagcatctttagacttcatacagaaacagcgaatatttggacacacttgttgggatgtgtggcttttataggaattgcaatctactttttaatgcgaccaaatactgaaattgaaattcaagagaaggtggtcttcggagcattctttgcaggagctatcatctgtttaggaatgtcgtttatgttccacactgtcaactgtcattcacaatttatagggaaattattttcaaagctggattattgtggtatagcgcttctaattatgggttccttcgttccatggctgtactacgggttctactgccatttc

SEQ ID NO: 182 - DNA, 937 bp, Diabrotica virgifera
  misc_feature (827)..(827): n is a, c, g, or t
tttgtccgaaatagaaagctttcgcacggtttagagacgcatcaccgactcttttctatcaagttgactgaatatatctatctgtaattatctgttttcgtacgtatatcccttaatgaatccatagtcgatttattgcggaggtttttgtttgaggagatgacgtgacaatatttttgaaccctaatgcaaagaaggatctgagtcgaccgaatattcggcgttactatgtttaaaaatgtttgtttggctgaagatccattttataattaaactaagaatgttttttacgttttacaacgttttcttatctacagatataactcaatatatataattgagaaatatatatctacatacacttacagtagtgtattgtgttgaagcatcagtatgttggaaaataacaaatcttaattatctgcaacacagtcaaccaaaggggctaccatcttgaaccgtaaattactgttttttgacagattgcgcgcgcattgacaactgaagattgttacctatcatctaaagtctgttctcgttactaataagcaatatagaaacaaatatttgtggtgttacagttaaaaatgtctagaataccgcacgtaatggcaatagagcaccacactgttggaaaacaacaaactttggcatctacagcacaatcttgccctcagattcgttgcgggagcataaatctgtgcgacactagttgtctttctcttctggtagtgcatatccgtttcggatctgtactttacacaacactgctctgttttgacagtttgcgctttcattgaaatttgtaaaattggctacctaccatncagtgacatttttcattcaacctgggcacacatataagaaaattttgtggtgtttgattttatggaaagtttaattacctcacttctttatgagtacatgatttcttttg

SEQ ID NO: 183 - DNA, 1304 bp, Diabrotica virgifera
attagtgacaaaatattttcatttttaattatgcaagaataatttataatgatttgattccctttcataaaaattaaaatgaatagcattagatgttttttatttagtaaacaatttttttctactacaaatcagagtaaagtatttataaattataagaacctttccacaagttctacctttcataaaatcgaaacaggttttgttcatatttttgatcgaaaaacaaaaagtcttcagagaaaaagagctgccatagctgacgatgtaaatgtgtataattaccttaaggatgaaattggttacaggcttgcagatagactttttgatatcaaaagaaagtttaagttagcagcagatataggatgtagccgtggttatgtatctagacatatctccccagattctgtagaagaactgatactatgtgacattagtgaatcaaatttgaatgctgcagttgtacaagatggcataaaaactacaaaacaaattctggatgaggaacacattgagtttaaaccaaattcattggatatagttatatcttgtcttagtttacattgggtaaatgatttaccaaaagcctttaaaaggatcctgctgagccttaaagaggatggtgtctttttagcttcagtgtttggaggtgacacgttatacgagttacgatcttcccttcaattagcagaactagaaagaagaggcggaatatccccacacatttctccgtttactgaagtaagagatataggaagcttattgacaagagctggctttacaatgttaacaatagatacagatgaaatcattgtaagatatccatccatgtttgaactgatgattgatttaaaagggatggcagaaagtaatgctgcccttaatagatcgttgcatttgcatagagatacacaatttgcagcggcagctctataccaacagctttatggagcacctgatcctgaatctggggaaatgcctgttccagcaaccctttccaataaataaaaatgctttggctggaaacccccatccaaaaaaaaccaaaaccaaaaaaaaaaaagggaaaggggggggagggtttccccctggaaggaccctcccccaaaattaaaatgaaaatccatttaaaaaaaagaaaaaatccaatataaaaaaaaaagagggggaggaaaaaaggggggtggaagagttaatttttttataaatttttttaaaaaaaatattttcttttttttttaaaaaaaaaattttttttatttcccccaaaaaaaaaaaaaaacaaagaaagggggggggggggg

SEQ ID NO: 184 - DNA, 1277 bp, Diabrotica virgifera
  misc_feature (1248)..(1249): n is a, c, g, or t
  misc_feature (1261)..(1261): n is a, c, g, or t
atctaacaagtttggttgtaccaactcgcacatttggttgtacattttaaatctaaactacataatatattttgactgtattttttaaaaagtaactcaatctaaatggctcctttagagtcaactaataacaacaacaatgaggaacctggcccaataaatccaattgtgggaattatttatccaccaccagaggtgagaaatattgtcgacaaaactgcaagttttgttgctagaaatggtccagaatttgaagctcgtattagacaaaatgagttaggaaaccctaagtttaattttttaaacagtggggatccttaccattcctactatcaacataaagttaaagactttagggaaggaaaaggacaagatcctacccctggattaactcaagccgtctcaaaactttctgtcactgcatcagctcaacagaaacagcaagaaattttaaagcaagtagaacagccctttatacccaaggaaacaccttcagaatttgaatttatagctgatcccccatcaatttcagctctagatttagatattgttaagcttacagctcagttcgtagctagaaatggtagagcttttctgacacaattgatgaatagagaacagagaaatctgcagtttgattttttgagacctcaacactctttatttcaatacttcaccaaattactggagcaatatacaaaggttcttattcccccaaaaagtatgcatgaaagcctgcgaaacgaggctaatagtccgaagaatgtgttagagcaagtcaaatatcgtgcagaatggttgaagtatcaagagcaacaaaaagctaaggaagaggagcttttagaacgagaaagggttgcgtatgcacaaattgactggcatgagtttgtagtcgtcgaaactgttgactaccaacccttcgaaattggaaattttccggctccaactacccctgaagaagtcggagcccgtattttaattcaagagaggatagaagaaggggaagatatcgaaatgcaattagagagtgatgaggaagaaccaccagttatggaagctggtttaagcagcatgcaggacaaaaccaatcggaagacacgcgacgataccagaattcaagatatggaagaagaaagctccgatgaagaaaaagaagaagaagaggaattagctttacctccaccaccaccatctattcaaccaccgttacctcctattccctgataagttgtcgtgaaaaatatgatnnccaacagctgtncatgttagtcggccac

SEQ ID NO: 185 - DNA, 1651 bp, Diabrotica virgifera
  misc_feature (1600)..(1601): n is a, c, g, or t
tcatgtccgtgcagagttttcgagagtgtgcgtaactgtgataaaaaatcttgagagagtcaaccggtcaataatgggtaaggtagcagcaattggcattgaccttggtaccacctactcctgtgtcggtgtttggcagcatggtaaagtcgaaataatagcaaatgaccaaggaaacaggactacccccagctatgtcgccttcaccgacagcgaaaggcttataggggatgccgccaagaaccaagtagcaatgaaccccaaaaacacagtattcgacgccaaacgactgattggcagaaaatttgatgaccccaaaattcaagcagacatgaaacattggacttttaatgtagtcaatgactgtggtaaacccaaaatccaagttgagtacaagggggaagtcaaaacattcgcaccagaggaagttagctcaatggttctcaccaaaatgaaggaaattgctgaaacatacctagggggaaaagtaacagatgccgtcgtcacagtaccagcgtactttaacgactcgcaaagacaagccacaaaagacgcaggtgccatagctggacttaacgtattaagaataatcaacgaaccaacagctgctgccttagcttatggtctagacaaaaacctcaaaggcgaaaagaatgttcttatttttgatcttggaggtggcaccttcgacgtctctatcttggctattgatgaaggatctctctttgaagttaaatccactgccggagatacgcatttaggtggggaggactttgataacagattagttaaccactttgttgaagaatttaaaagaaaacacaagaaagacttaagtaataatactcgagctctaagacgtttaagaacagcttgcgagagggctaagagaacactttcgtccagtactgaagctagcattgaaattgatgctctacacgaaggagtagacttttactctaaagttacaagagcaagattcgaagagctttgtatggacttattcaggtctactcttcaaccagtggagaaatctttaacggatgccaaattagacaaaggagcaatccatgatgttgttttggttggtggttctactagaattcccaagattcagaaaatgctgcaggactttttctgtggaaaagctctaaatcttagcatcaatcctgatgaagctgtagcttacggtgctgctgtacaagcagctatcctaagtggagatactagctcccaaattcaggatgtacttctcgtagatgtcgctcctctgtctcttgggatagaaactgctggaggtgtcatgaccaaaattgtcgaacgcaattctagaattccttgcaaacaacagcaaacattcactacttatgccgataatcaaaacgctgtcaccattcaagtctttgaaggagaaagagctatgacaaaagacaataatcttttgggaacattcaacctagcgggtatcccaccagctccaagaggtattccaaaaatagaggtcacttttgatttagatgctaatggtatcttgaacgtatctgctagagacagtagtactgggaaacaagagaagataactatttaccatgacaaaggnnagattgtctaaagctgagatcgataagatgctttctgatgcagaaaatat

SEQ ID NO: 186 - DNA, 945 bp, Diabrotica virgifera
tgattttgtactgaaaagtaattatgtaattttcttttctcggtctgtatttatggaatgaattattgaaataaacgaaaaatatggcagataaagttccaataaaattagggggaacagattacacccaagtgttcattgcagtttttgtcatagttataactttggttctaattgctctttacaaaagaaggaagagttctcgccagggaatacttttaactggtatctgtgacagtggaaaaactttaatattttcccaactaattcacaataagcatattcaaacgcacacgtcaattaaagaaaatgttgcaaactatataagtaacaatgaagttctgaggatcatcgatatccctgggcatgaacgtttaagagacaaattttttgaacaatacaaagaaatcactaaaggtattgtgtatgtagtggactctaataccattacccaagatataagggatgctgcagaatttttgtacaatatgctagtcgatcctgttgttattaaaaataaacccaaattgttgattttatgcaataaacaagactacacttttgctaagggaggatctgcggtgaaggctatttttgaaaaagaattaaatacccttcgtattacaaaatccaatcaacttgaatcagtggatcctaagatgaaaaagacagccttactaggagatcctgaagaagactttgattttgcggccttgccattgaaagttgacattgctgaaagttatgcatatcacaaaaacggcactgttgatattgatggattgaaaaagtggcttgctcatcatgtctaatttactgattgattgaatttagagatcagttttttttgtaatttaattttttgtttagcaaagattttgtactttttttaatatatttattgtatgggccccaaataaaaagatatgaggtaaattattatat

SEQ ID NO: 187 - DNA, 1165 bp, Diabrotica virgifera
  misc_feature (1025)..(1025): n is a, c, g, or t
ggaacaagttgttatttctctatggtcctagttgggtgagtccagtgagtctgagtacttgagcgaacggaatttttagttttggttttgagttttgagcttggcaataaaaaaagtcttggttgtgtagaaagcttacctactttacttacataaatttgtttattaactatggaagaaagtgttaactatggaagttaaagttgaaaaggaagagtttgcagactatgaccaaaaagatctagagaatcaattatccacatcaatagatcttcaagattttaaggaagagccaaaggaaaatcaaccaggttgcctgcagaaaaacaacattcattcatctcgcaatgaagaagatgtgggtagacatgatcaagaaacaattaaaaataaaaatataaaagttaagattggaaaaggatctcacaaatgtgaaatttgtttcaagcaattttctcaaacaaatcatttgagaaatcatatgatgagtcacaatagaaaaaaatcttacaagtgcgaactttgttttaagcagtttactctagccggtagtttgaaagtacacatgatgattcacactggtgaaaagccttacaagtgtgatatttgtttgaagcagtttattgcacgaagtaatctgaaatcacatattatgacccacactagagagaagccttataagtgcgagatatgtcttaagcagtttaagcaagcaagtaatttaaaaacacatttgatggctcacactggagtatatcctcacaaatgtgaaatttgtttgaaaaagtttacttcagctgctactctaaaacaacatacgatgattcacactggagaaaaacctcacaagtgtgaaatttgtttgcaacagttcgctgcatcaaatactctgaaattacatatgaggactcacactggatacaagccttacaaatgtgaattttgtttcaagcagtttactcaatcaagtgtattcaaataccatttgagaagacacactagagaaaatctgtacaagtgtgaangttgttttaaggagtttactcaagccgggttgttgaaatcacacatgatgactcacacttgtgaaaaactaaataatgtgaaaaattgttcaacagtttgctaaaacatttcaggtgaaaaggcatatggtgactcacac

SEQ ID NO: 188 - DNA, 1485 bp, Diabrotica virgifera
agctttgaaaaccattattgtttggtggcaatgaccagttattctgacaaaggaccagtgcccactaatggaaaatttttgaatttccaccatttaacattttacgttggaaacgcaaaacaggcggcttcctattatatatcacgattaggatttcaacctgtatgttataaaggtcttgaaactggagatagaaactacgttcaacatgttgtacgccaaaataacatatttctgttgctaacttccccctacaatccaggtgagcaagttttaaatggccacctgataagacatggagatggagtaaaggatatcgcatttgaagttgaaaacttggagggaattgtagaaagagcaaaatcccaaggcgctaaaatcttgagagatatttgggaggaagctgattttgaagggattgttcgttatgctttaatccaaacttatggcgatacaacccacactttaatagataaaagtttataccgaggtcagtttctacctggatattcgccatgtcaaccagatcctctaggaaaagtacttccagccacaaatttggatttcatcgatcatatcgtaggaaaccaggatgacaaagaaatggaatccgttgccaaatggtacgaagatgttttacaattccacagattttggtctgtagatgacagccagattcacactgagtattctgcactaagatctattgtaatggctaactgggaagaaaatataaagatgccaataaacgagcctgctcctggaaagaagaagagtcaaattcaagaatatgttgaatattacggtggagctggagtacaacatattgctcttaacacacaagatattataaccagtgttaagaatttgaaagcccgcggtgtagagtttatggaaattcctgactcttactacaccattttaaaagaacaacttaagtcaagcagaactaaaattgctgaagacctcgacgtactacagaaacttaaaattctgattgactacgatgagaatggatatttgctacagatattcacgaaatgtcttgaagacagaccaactgtcttcttggaaattattcaaagaagaaaccataacggatttggtgcaggaaacttcaaatctcttttcgaagcaatagaaatggaacaagacaaaagaggaaatctataaaatctgtttccaaaagcaagttgtttatggaattgaatatatcacattcccagataaataactagaaattatgggttatatgacaatgcatttcttgcatgtagttctttttattatttttacaatatagattttattcagtaaataagaagggaacacatttagactgagacgctgctgtgcttataatatataagatcattagttaggtatgttaaagatttgtccaaataagaaaatattatgttgtataggatataattgaaaataaatacataatctaaaaaaaaaaaaaaagggcggccgctcgcg

SEQ ID NO: 189 - DNA, 901 bp, Diabrotica virgifera
  misc_feature (794)..(794): n is a, c, g, or t
  misc_feature (862)..(862): n is a, c, g, or t
aatcgtgtcctcgcgactatgagccccgcgtccgcaggcaatttggaagtagaacgctacatcggggcctgtttgatttcgcaaaaccgcgctaaaagcaaaccgcaaagacaagaacactattcctcagcgcatagagatgtagtgccggatatctaccatcagaaacacgttaactttcgcttgcagagatgtcactcgggcgacggatgggccggtgggatgcccttgatatcgttcgcccagcaccagcggaagatccaccaccaagaagattcttcttcgttggctaagttggcggtgcacacccaaggcgcgcccttgattcttaccaagagttacaaccacagaaagaataaggtgcacagacacaatggagcgacgaagatcttcgaaaactctaataataagaagaatgttaagtgtcagaacagtgtggacactgtgagcgttaccagtgatgagagttccgggtccgctaattctgaaacgtgtttaccgcggattattaagcctagaaagagacggaaaaaggataggaaacctcctctactcggcaggccgctgagccaggatggtttttcgacagatagcgccagtccggacatagacaacactcaacctaactatttatcaataagcccatttaatttatttaattttaatccatatggtgcgttaatcttcccagaaacttcaaaactagtagatcacctccacatattaaacgatattagtgagactcccaaactccaccacgcgttcgaagatatagaagaaccggaagatatcanagacatcaatggtaaccaaccaccagtatctgtcagtgcggaatattgtgaatctagtgggcaaattntggggacgtgacagggaatgctactcaccatttctaact

SEQ ID NO: 190 - DNA, 1552 bp, Diabrotica virgifera
tctgtccgccgcacgcgatcgcgcgagaactcttgatccgtttatctttgtgatacaaatagaaagctcgattcttgccgagtatgttccatccttgtagacacgctattagccacaccttaacgttcactatctcaaatgtcgttacacagaattctgatttgttacaacctaatcataatccgaaactcgccggtgtaggaaatagctatcatgacaaggacagcatagtattgtagtatcatgtgatacgtaactgtaaacgataaaaatggagtagccacagtggaaatgcagagaccaccggtaaatagtttaaattatgaactactcagccagttgtcttctactttaacagacctagagaaaaacaaatcaagaggtcttattctgacctcaaaaaatgatggtgtcttcagtgcaggattagacatcttggaaatgtataaacctgaccaagacaggatgaaagcattttggacagctcttcaggatacatggattaaactatatggttcttcttatccaacagtagccctaataaatggtcatgcacccgcagggggctgtcttttatcattgtgttgtgagtaccgagtgatgtttaagaaccgtaccataggattgaacgaaacacagcttggtatcgtagctcccaaatggttcatagctagtatgacaaatgtgattggaaatagaaaaacagaattggcgttaactggtggtgtaatgtatacaaccgacgaagctcttaacatggggatgattgacgaaataattgaaactaaagcagaaggaatggctagagcagaagcgtttataaccagatttgccaaaatttcccccgttgctagagggcttactaagaaatatattcgaggtaatactatcgaagatatggtcaaaaataggaaagaagatttagacaattttgtaatgttttctaatcagcctgcagttcaagaaggattgggactttatatacaaagtttgaagaagaagtcaaaggcataacgttattaatttatattcttttatatagactgaattatgtaatattcaaatattttatgcaacatattgaaatattttaatgtcattttgcttttctgtgcatttgcattttttcataattgcattttttcttctttttagtttaaatcataatcattctccattttgtttaaaagtatcatatggttttccatatttctctaatgtatgtttttgatgtaactaactaactgatacttgcctatggaattggactttgttataaatgatatcgaattttttttttgttctttcggtactgtattctttgaaatatacccttatgagaattttattatttttgtccaatttttttgtaaaaggtttttgtatatgttataagcctgtaattctgtagatttgttaattatattctgctctgtatgtaaatcatttttgatttgtgttttctacagttgtaaaaaatgtttttgttttttttattatattttgcaataaattacaccgaataaaaaaaaaaaaaaaaaaaaaaagaata

SEQ ID NO: 191 - DNA, 392 bp, Diabrotica virgifera
acgcgtccgattaactggattgccaaatgggatcccaaagaagttattctatcgaacaattacatatcggacttaacacattttattctattgagcaaaggtgtgacatctttagacttagacaataatttgatacgcgatgtagaatccttaaaagtattaggtttcttcaaaaaattaacagctttagacttacgtggcaatcctgtatgtgacaattttgactatgcttggcagtataagcttgaaatacggaaaatttgtccaaacttaactgtgttggatggtgcggatgtttacgaaaatgtaaattttgactacaaaaaaaattttgtgtgttgcgatgatgctggggagctaacgtctgtattcctcgaacatttctttacttt

SEQ ID NO: 192 - DNA, 972 bp, Diabrotica virgifera
aatttaaacccaaccattgtttggttttgcggttattagcgcaagtaattgcaaagtttactgatgatggactgataactccgaaaacgttcattctgaacaataattaactgttgtaatccatttgcatttttggttacacatttataccaattacaacagaagtgttcactttaagttgtggcgacacgcttcaattgctattttgctaattttaatttttaataaaattcacaaaccatatgcgtaaagggcctgttaaattttaagaaacgaaatatatcagtattcagataaaacgccttctcagcttataaagcaccagatgatgatggcctgttcagtttatgtatgggaaacgcaaattccataatagattacgggacgataaagggccagcctccttatgtcaataaatcagtcttcaacttctttaaaaaccacagaaatgtaaaactaatgtttttagttcatccacaggcagtctgacacaaaccctcgtcccgcgaagaataacaaaccctcttacgagatataagcacgcctttttaaccaaaaataaataaaatattttattgttcgttgtcttacacttattttaatttcatttaatcgattccgtaaacggccaacggaacaaagtagttttaactaaatggtatacagccaattcccggcaactatctcaatttagattttaattttgatcagttgtacaattattgttgacactcctttgtgataattttcgccaaatactaaacgaaattacagtaaaaaagactgtctcactattatcaaagatcttagggaacaccctctatattgttacaattttgggctcttctcgatcaacaccttgtgcgctatgagggtgagatggtagtaatgccagagacaaatttttattaatttcgtacaaagattagctaggagaattcgcataactagtggggaatctggtaatcttga

SEQ ID NO: 193 - DNA, 1857 bp, Diabrotica virgifera
  misc_feature (1769)..(1769): n is a, c, g, or t
  misc_feature (1811)..(1811): n is a, c, g, or t
cgcgccagcggtacctataaaaaaactggaaactattattataactgattaaacaaaacatggctgtgattagctttgtagcttaagttttttcaaagatacctacttaactttactttcttattctgtatatatatgtatatgtgtatatatgtatatatatatgtgtatatatatgtatacatatgttatatatgatgtgaggaatatgtatggaacttcagagacttcgacttcaccagaggaaacttgtccggaaattcggttttagaaacgtcaaagaaacatacaagcacgtaatacacagagtaaaagagaagaactaccctacacaaagtaaaaataaccgaagaaaccaacaaatttattgatgaaaagaaaattatatatataaaaaatcccccaaacacccaatccccagaagagatacagaagtacaaagagtacaatagataagtaaaacaaagaagaagagcaaaaacagaccgctccgttcctctttgggtcagtctgagtttaattgctgtggcctagtgtaaggaaagtgttttggtgtggtaagttatgactggaagcacacattggtggaacgtcttctttttcaaataatttgacaagttgctcttgaagatgtctgatagagctccatattcgcaacatacttaagtgattcttctttacagttcaacaatttgactgtccctgaaaatttgatacaagatttgtcatgtattgtgtctttccaaaattatatttggaaattattattgtaacttataggcggcatctaactcagtaagtataggtagttccaatctcttttaagttatctgttatcagaactgtgtcgtccgcgaatcgtgttttattttttgaacaacgtttattaatacaaacctttagtgtttaatgttaccagatttttgaggtgtctttgttataggttgtacatttttaactgttgcaagaaactagatgagtttttaagagattactgtttatgtttcaacatttatatatttgttgtttcttgtgacaggacctctatccctccatatattcctatgatgtaaaactaaaatctataaattcagatgcaaagacttataaaaagaaataaactaataaatctatttaactcaagaatatattttgtcaaatgaaaaaatgtttatttgtatatagatatcgtgacagtataataataaagcacgtggaattaagaaaaacattttaatgtatactacgaatacttctacataaagataaagatgtatttgtttaataatttaatatggcaaaattcttacttttgttcagacaagaggtaaaagaccttcgtgttaccaatgcttgtttaccgttagtagcaaatatcaagaaagaacaacagctccagctcatctcacgaaaaaagtcgtcaagatgctccaaacacggtttgccgaaggtccataaggctgggttgccattacaaccaatagtcagctgtatcagaccccctttacaaccactgacaaaatttctggctaaacagctacaacgatacatatgcagaggaggctgactcttcaaaggaagttactctcgagtcggacacttgttagttagctttgaagtagtccaatgttccaatatacgaagatacgcagaggaagctgtctcttcagaacaagttactctcgagtctggaaacttgttagttaactttgaagtagtccaatgttccaatagaagaatcaagaatcgttagaaattatacgcagaanatatcaaataccaccagttatactacagctctaagaactacnaccagacgccaataaagtaaaagaataaagtccaagatactttcat

SEQ ID NO: 194 - DNA, 954 bp, Diabrotica virgifera
  misc_feature (896)..(896): n is a, c, g, or t
tgtaaggagaatatttgagttgtgcggttgatttgataagttgtttttagtgtcattacatattagctatttttaaaatgtctgcatcacccatggcaagacaagcggtggaaagtaaggcgattcctattaggagagtgttaattaatgatcattccgagttacctgcacattattcctctacccccggtggaactttgttttcaactacacctggaggtacaaaaatagtatacgaaaaatcggttcttctgaacctaaggaactccccaatttccaaaacaccccctcagttcgagattccagacaccatcttaggcggctccgctaagaacgtagttagaaaacaaaaccattccaggccattacctccaagtccaagaaagtcacagccagaaatcaacaaccacaatacctccgaggaccaatttgacatggaactttagtattatcgactagtcaggaagtggaatatgttaaaattataagattgctgcgcaggaagtggttacttgcaggttccgtcaccaaaaacaaccagattcctacagtggcgtaaccaggggggttttggggattataacccccccattgggatttactttgagctctatgcttgacaccattaacatggtgttaagcatagagtaccagataccctccagtagttgtaaccccccttaggatcatcctggttacgccattgagataccctccagtagttgtaaccacccttaggatcatcctggttacgccattgaatttatagctttttccatatccaaaaaataaatcattgataaaagaaaacgacatagcaagcaattgttggattcggtgatttaaacaggtccacgttttattaattattacttaaacatagtgagaaggagtanaatacgaagaataattcacattcaaagaagtattcctgtgggacagcaaatatattat

SEQ ID NO: 195 - DNA, 941 bp, Diabrotica virgifera
cgttttgatgtaaaataaaatcgggtaaattataaattcaaaattgaacagtgatcagtgttgaaatctacagctaacaatcttttattttaatcaatacaatggaagtaaaacaagaacaagatattttgccggtagaaggatgcgagatgaaaacagaatttatcgatttccccaatgtttcttttcactcttctgttaaaacggagattaaagaggaccactatgtggcggtggcggattcgcttaacaacgatacaaaaacctattttgttaatgactcaaaccgattaaacatggacatttctgttggtggtatcaaagtagaagaggaggaggaagaggataaggctgaactagtacaaattgagaatgttatggaactcaaacgtgaaattaagcaagaagaaattaccgttgaagacgttaaggatgaatcaccagaaggagaagattcttcaggttttcaggagaagaataaaatggaaataataaaaactttgccaggatttacacgtaatagcgaacgatgtctaagtcagcccagcgaaaaactattatgtggaatttgtaacaaacaattttctcggaaagaagctttaaaaaaacatcttcagaagcatagtaaacccatttcttgccatatttgtttcaagtcattttctcatgattgtagtttgaaagtacatatgagagtgcatactggtgagaaaccttatcaatgtgaaatttgttttaagtcgtttactcaacatagttctataaataaacatagaagattgcacactggagaaaaaactcatcaatgtgaaatttgtcataaatcattttccgaactatatagtttaaatgaacatatgagagtgcacactggtgagaaaccgcatcagtgtgaaatttgttttaagtcgtttctgccaaagggattttttgaagtacat

SEQ ID NO: 196 - DNA, 1033 bp, Diabrotica virgifera
gtttttaaaatatcacgtgtaaacgtgaaaatctaagtcttcgcctgaagtattgtaattaaagttaaaaatgcaacacgacgacgttgtttggagtattataaacaaaacacattgttcatacaagactcaaaccaagacacaaaagttttgccgtaacgaatataaccttacaggtctgtgcaacagatcggcttgtcccttagcaaacagtcaatatgcaacgatcagggaagaaaatggtataatctatctgtttatgaagactgccgagcggtcagcgtttccaaataagacctgggaaaaggtaaaactatccagaaactttgaaaaggccatacatcaaatcaatgaaaatttactctattggtctggttttattaagtcaaaatgtaagcagaggttcgtaaaaataacacaatacttaattcgaatgagaaagttgaaattacgaagacagaaattgctggttccgattcaaagtaaggtagaacgaagagaaagacgcagagaagacaaagctctcatagctgctcgaattgaaaagggagttgagaaaacgttgttagaccgtttgaaacaaggcgtgtaccaagatttgtacaatatatctccacaaacatttgatgaagcagagcaagagagagaattggaatctgaggaagaggtagaacaagaaatggaaatggaaaatgaaatggaggaagaattagatacaccggaatttgttgcggcagattcagatgatgacagtgatgttgaaagtgaaagtggtaatcctgaggaagtggatttagacagtagttttgaatcttcagacggttcagatattgaagatataagacctagtacttcaaagaagagccagacacctgtaaataagaaaggtacacccaaacctggatccagtaagaagaagcgtaggtctagggttgaaattgaatatgaacatgaaccagctcaaagactgtctgttagttaaatttttttaattgtgattgttacactttctttaataaaaatatattaaggc

SEQ ID NO: 197 - DNA, 1735 bp, Diabrotica virgifera
atagaaattcacaatttgggaaatcagctgagtggtgaggcaagcgttgtatgaacttgtaactttgtaaacacatttttccgaacaaaatgaacttaaagggtccacctgaaaccaaacttgtcgtagaaacatcgatagaatcgccggaatatgacgggatcttgttagtggctgcaccggatcaaaaagtgaagaattcgaagttgaattctcttgttcaagatgctctaagtttcgaccaatccctcaagacagaaatcggcgttttacagacagatttaccggcgagacgagtggtttattctcctactggtccaatcgatacggactacgatgatgtgagaattttcaaaaacagtgctgcggcgggtgttaagagggcgctaaaggctggtgttaaaaagttgttggtggtccttgaggaatatcccgcatttgaaagtaccgagttggttacgcttttgggagtattggatgccttatatacgcctattcaagtcagagaacatgatccttcaaaaacgaacaaagtcgatctcgtcggagtatacaccgaaaatccagacaaaaccaaagcaattgttgggcaggcccaagtactggaaattagcagacgtgtggcatgcgacattggtgattccgatccggaacgaatgactccagccagagcagaagagtatgtaaggaatctattccagggaaccagcatcaaattaagcgtagtaagtgatgaagaagaattcaataaaggatatccattgtttgcagctgttaacagagcagctagccttaatgccaggcataggggaagaattatttatttggaatacaatccaccacaggctgttaaggaaacgttatttattgtaggaaaaggggtaacaatggatactggtggtatagacgtcaaaatcggcggagctatgatgggaatgtcacgtgataagtgtggagcagctgcagcagctggttttatgacagtcgtgaatcttcttcagcccaaacatcttaaagtggttgctgcaatgagtatggtacggaatagtataggatctaatggatataccagtgacgaagttatcactgccagatcgggggccagagtccgaatcataaacacagatgctgaaggtagaatgataatggctgacgtattgtgcaagttgaaggaagatgcagtcaatgcagtaaatcctcatctatacaccatagccaccttgactggacacgctcatagaactgttggcgaaggttactcaattgctatggacaatgggccagcgaaaaaaacacagaatgcagaaaagttgcaagctgctggagacaagatcggagacatgtttgaaatttccagaattcgtcgagatgattttaagcatcacaaaggagaatgcgaaggagacgatttgatccaaagtgctgcaaaaccatcgacgctggtttcgagaggacatcaaggtcctggagcatttctcatggtggcttcgggtttggacaagcatggctcagcaagtgatgtgcctctaaggtacactcatctggatatagcaggttccgccggtacctttcctcttcctggaacaggtgctccagtactcgcattggcacaagcttatctgttataaatatcacaaaattctttatattataatacatgtttttttttcttttgtaatgtaatttgcgataattgccgattggtataattcctaataaatattctgatttaaaa

SEQ ID NO: 198 - DNA, 830 bp, Diabrotica virgifera
caaaaagataggtacctattagtgaaaattttgctcaaaatggtggcgatagacaaaaattcgagtgtttttatgcaaacgctgttttaccttatgaaccagagtaatattgtacaggatacctcgtacaattattatttcatgcagataggacaagaccatgttatagaatcaaaagcatccaagtgctatgggatatatggttgtttcgaattaggatctccatggacttcagaaaatcggccaatagcttactatcccgaagagttagaaaaaatagaaccacaatatctacttctaactagagacaatccggttacacctattactatggaactgaacgactttgattacgaagattcactagattttgatcccgaaaaaaatatttatattgtaacgcatgggtatatggaaggaggtacaataaaatggattcatgaaatcgcagatgcattattagcccaagaagattgtaacatcattattatagattggcaacgaggctctggaccgccatacactcaagctgttgcaaatataagggttggttggagctatgactgcatatctgctggcggatatttcaaaatttaccggtgatctcaagctaaatcatgttcatgcgataggtcactctttaggagcacatctgtgtggatacataggttatactttacaaaaggaattccaacttacgctaggaaggatcactggtatggaccctgcagaacctcatttttcgaaagctaaacctccagtacgacttgatagatctgctgctcattacgtcgatattatacataccgatggcactcagttcattagag

SEQ ID NO: 199 - DNA, 1073 bp, Diabrotica virgifera
ctacaacaagacaatttatttcccatatgattagtgtacttaattcaactttatattgaccttgtacatatacaaacaacaaatactacaacagcgtccaagatgcgactttcaatattgtgtatatcactaattatcggtgtgttcggtcaaaatgaagaaattattgatgaagacactaggaagaaaatagatgagatatttcctatgagcaacaataactttcctacagacttggaagaggttacagaatcgactaacggaagttatactgccatcgagcaatgcggtgaggggtctactagggggttaaaaagatgtgtagtctattctaaatgtgatccgaagactaatactatagtagaagaagatgttacttatgggtttggacagatcgatatcaggtttggaaaaaagccgtgcgaagataccttggacgtgtgttgtaaaattaatccaaatacacccacccccgatcctgtgtctcccactccagtaaccccagaaccagtcaccactcctccgatcgtaaaacccagcttctgtggcattagaaaccccaagggaatcgactttaccatcactggaaatcatgacaatgaagccgaatacggagagtttccttggatggttgcaattttgaacaaaaactatctattacaaggacttgataaacctcttgcttgtggaggttccttgatcacacctaatgttgttttaactggcgcccattgtgtttacaggaacaaaacctttgacctgactgtccgcgctggagaatgggacacccaaacaacgaaagaaaggctaccatatcaagaaagaaacgtcaaccaaattatcttccatgaggaattcgttcctggaattttgcataacgacgtcgcccttttaattctcgacgaagcagtaaacaaagcagatcatattggtaccatttgtttaccgccccaaaacctcaaaataaattcgaaaaactgtttcgttactggatggggtcaaaaggatttcggtagaaaaggaaaattccaagctatattgaaaaaatagaactacctacaattgataaacgc

SEQ ID NO: 200 - DNA, 935 bp, Diabrotica virgifera
accgaaaatgtgcaaggatcttcacaaagaagtcaggttagaggtagatgggaaactggttgaactacctcaagtagagggcataattattctcaatattttaagttggggatcaggagcaaatccatggggtcctgagaaggatgatcaattctcaaaaccaaaccattgggatggtatgttggaagttgtcggggttacaggagtggtacacctgggacaaattcaatctggtttacgctcagctatgaggatcgctcagggaggacatattaaaattcatttaaattcggacattcccgttcaggtcggcggagaaccatgggtacagagcccatgtgatgtggttgtactaaaatctgctctaaaggcaacaatgctgaagaaaaataagttcaagcgtcgtcctaccgaaccaaacatactaccggccaatggggaggggggaaagagcacagacgaataattccaaatatcaactcgtttcataagacacaacattttctcacaaaactttttttcatttttataagactttttcatttctcttttatcatataggcatgagtattttgcttggtttttttaggtaatcgtaaagttgcttttataacttacttaaagtagagaatatattcaattatttgtaacaagtatacgtttgtgtaccttcccccctcaggccaccatgttgaagaagatgaagggtaaaatgaaacgacgtaacacggaacctacaatgttggtatctcccggagttcaactggcgcccttaccttccaatgatgggggaatctcccacggatccaaacaccaatttttagtttaactttcatttattaattgggttttagactttcttccttttcacgatgtattattttttttattggcgactctggtaattgtattttttaaacagtaaaaagtaatag

SEQ ID NO: 201 - DNA, 838 bp, Diabrotica virgifera
atacacgatcgtgcggatgcaagtcagtgttccacacattttcggcctctaaatattcgcttcgcgcgctgctaaatattaccgaatcgataattttaaaataccctgtgactggaatataaaaattataccgtcatcatgactgacaaagatctcgagaaaccaactacggacctaaacgcattaaaaattgacgaatcaccggccgcttcccctacaccgggaagcaattcatccctactcacattcgaaacaaacttcaagaacttcgcaaagttcggagacccaaaatcggatggcaaacagataactctatcgaacagcgacaaatggatgaagcaagcgaagatcatcgatggaaagaagattacgacaacggataccggtattcattttaaaaagcttaaatcgctaaaagtgggaattgtacagtataaacaattccttgaagatttggctaaagctaaaggtatgggggtggatgaaattaaagacaagttggtcagttgtggaccaccagcaactcctggtggttcatctacaactgccaaagcagcagcggcagtcgatcgactaacagacacgtcaaaatacaccggcacacataaacaaagattcgacgacactggcaaaggcaagggcatttccggaaggaaagacatgggtgattcatctggatatgttaccgggtttcaacataaataaaatataaaaaaatcctgtcctttctatcactaaaaattttccaaatgtattcgggaaaaaaaatatgaaggggagaaagtggttaagctggatttttaagggatgataattattattttttgtagccacatgg

SEQ ID NO: 202 - DNA, 892 bp, Diabrotica virgifera
  misc_feature (832)..(832): n is a, c, g, or t
agctgttagcaggaatgcaacatcccaacatcattagatcattggctttgttcgacaatgctccattacctggcatcgatacgatcatattggaattagtcaaaggacctttattatttaagtatattagtgataaagaaacttacagtgagtcagatgtaagaaactacacgtgtcagttaatatctgccttaaaatggctgcaccaaaaaagtattgcgcatctagatgttaagcccgaaaacgtaatgatcgatataaccgttcccatccccctattaaaattagtagacttcggtgactcagtcaacacctccaagaatgtcatcttgccaccagcttgcctcgaattcgcctcgcccgaaccggttctcggtcaaccagttggcgtccacactgactgttgggctgtaggagtgttcctctacgtcatgctcagcggagtgtcccccttcctcgacgactcagtggaagaaaccactgcgaatattctcaaatgcgatttttgtttccccgatgagtattttggagacgtatcgcaagaagccaaggatttgacgaagagtttgttggtgctagttccagcgcaaaggttgaatatggagaagagtcttcaatggtgtttggataaaagaggctagtggttcagcatctatcccgtcagcacgtctaaaaatggtcatgcagcgaagacaccccatgaatcttgcaccctcgaactcgaattattataaagaagatgctctttagtcccaatcgtagatattgttctttgtaaatatattttaatttgtgaccaatttgattaattttccgttttagcttgttaatncatcgtatatattttataattatatttttactatacataaataaacggaacttttggttt

SEQ ID NO: 203 - DNA, 876 bp, Diabrotica virgifera
agagattaagtaaattttcagttaagccgatttatataatcgatgttgaaacgatatataatgtatagaaagtacaaaacttatgtatttgtacgaaaaatcgatatgagatggaacacaatctgatatatagtttttgtaattttaaaattaatcgtaaaagaattatattgtactaattaaagaactgggcatactcataaaaatcttagtaacggttttagctcgctgtacactggaagcgtagactttgaattgagtttatgagatcaaaccgttatcatctagccgttatcatccactgctgaacatgggtctcctccaagtttctccatgtctccctgtcttgagctaccatcatccagttcccagtctctttacatcgtcacgccagcgcgttggtggtcgctctgcttcgttggtccgcccgaggccgccatttcaataatcttctagtccacctatcattcggtgttcttgccacatgatctgcccatctctatttctttttagctacatgttctactgtgtctttgatttttgcgctgtatatacgggcgcacatatttagcatgtttttaatgggcaaaggtattgtgagctacacgtgtgtcttatgcagtatgattcaaaagtatggaataaattcattatttcagaaacagacgacttaaaaaaatcttaaaacacgtcaatttcaatttttgaatggaatccggctcgaaggaccatgtctaattcttcgggctcagtggaggatgaacttcagttattgaaacaccaatagcacttatatagtttattgatagtggtagacaccagggtagttaccccgagagaacgttgtggtactggtatgtggcttgtacgcgaatt

SEQ ID NO: 204 - DNA, 2064 bp, Diabrotica virgifera
gcttagtttatatgcagattattgcaggtgcatgattcgataaactaagcattaggaaaaatgccaaaaatgtgtaattttaatatttgttagttcgtctttccagttttatagtaaaagtaacgtcgagttttaattttgtgttttttatttgttattgtattaataaacaatgttaaaatatatcaaatggaaaaaaaaacaaaatattgtttacgagtataccatatcgtacttagttccgaccaatggtatagtagagatagtaatatcaaagtaaatagactcacaatcacatttattttaccatggacgaccggtttcgctttctataacttagcttcatcaggtctcgggtacagcaaaattaaatgctaaaattactaatactggttgttgtaataaaatttaaagtaaaacgattcgcgattacaatatttacagtcgataattgatatatttggaatcttgtttgtgcattaatctagcattagaaacagttcccaattcaaatagaaaaaatgaaaatatttgttttttatatttataaccataacaatattttgtttttttttcttccattttagtcatattgcgacttaactcaatcgaattgtcacatacaaaagtattataattaaaaaacaattagttaccactagaaaatgttaacttaattatcatgatagtttatcattaatgaggttcgaagtttcattgctaattacacttttactgccaaaatattcaaaaatttatgtgatttaattatttttgacaaaacaacaaacttatttacttgaaatagttgtcacatattttgatatttttcgtggatacattaataatctctaatagtattatattaataattaacataagtacaatgcatattctcccaccaccgtttatcgaatcatgcacctgcaataatctgcatataaactaagcattaggaaaaatgccaaaaatgtgtaattttaatatttgttagttcgtctttccagttttatagtaaaagtaacgtcgagttttaattttgtgttttttatttgttattgtattaataaacaatgttaaaatatatcaaatggaaaaaaaaaacaaaatattgtttacgagtataccatatcgtacttagttccgaccaatggtatagtagagatagtaatatcaaagtaaatagactcacaatcacatttattttaccatggacgaccggtttcgctttctataacttagcttcatcaggtctcgggtacagcaaaattaaatgctaaaattactaatactggttgttgtaataaaatttaaagtaaaacgattcgcgattacaatatttacagtcgataattgatatatttggaatcttgtttgtgcattaatctagcattagaaacagttcccaattcaaatagaaaaaatgaaaatatttgttttttatatttataaccataacaatattttgtttttttttcttccattttagtcatattgcgacttaactcaatcgaattgtcacatacaaaagtattataattaaaaaacaattagttaccactagaaaatgttaacttaattatcatgatagtttatcattaatgaggttcgaagtttcattgctaattacacttttactgccaaaatattcaaaaatttatgtgatttaattatttttgacaaaacaacaaacttatttacttgaaatagttgttttattagatttatattcagtattgtgtcattgtattgttttagtcagtcaaagattaggttaacaaaatcttttttcccttttattttattcccttgtgactttttggttttaccctactcttcctatctcacatatcattaaaatttaatattaaacgggatttacaacaattttccacaaccaatttctgttacagtcctacaatatatctaagagactcaataatatttgttcgaggtgtgaaattccctaaacaagggatcttcctgttttatgggaatatcccctgctcatgtaagtacacatttcaaacaataagggccccgctgagcttaatattaatgcct

SEQ ID NO: 205 - DNA, 1157 bp, Diabrotica virgifera
gatgaagtttgcgacacgagccgtaggcgagtgtcgtaattcatcagcataaaataaaatcaaaatgtttatctagaagaaacctacatttttgtatggcatcttttttttggcatctcttatcattttcgagttacatggagaaataggaaggtttacaggaaacggttgtagaatacattgagaagaaacaattaacgtggtacggacatgttcagagaatgggggaggaaagactgccaaagaaaattatgaaatggatacctacagaaaacagaaaaagaggaaggccacgaacgacatggatacaaggagtaagacgatcaatgagtgtacgaggattagatgatgaaaactgcaatgatagaagatattggtaacaaggcatcggacaacgtcggaggacgttttgaacccgaatttatatatataaaaatgcgctcaataatttgatcttatttttttcaaaaaccatttattttaaacccctcccaactttttgaatataaacagaacactatagtaaaatgtattgtagaaggaaaacgatgcatttaaattcttgtggatgaggggttaaatatacttctcattttttgcttaaaatacgttagtcatcaaattttttacagtttatctcacacagtttgaatgtaatcgacatttaatattgcttaatttataggtcttttcaagcacaacaaaagttatcggtagcattatacacctaaaatcgaccgtttctctgttattttcaagttaaatacactgatttgaacatggcaccaagaaaaacaagtttttttcacttaccatatctctttttgtgttataactagaagattcataaaggaaagaatctctttgttattttataagctacaaaaatgttttatatagttttttagttagatgcatagtttaaaaggtattcgcaaaaaaccgtttgaaaagggtcgtattggttccaaggaaaatggccaattttcaaccaggaataactcaaaaggtatttgagttttcgaaaaaaatatagaaacagtttttgccttaaattaggtgctctagcacttaactcccgaaaaattggtttaaaacaaaaccacccttcccccccccccgggaaccgccggcgggggtaacccacacaccccccc

SEQ ID NO: 206 - DNA, 1093 bp, Diabrotica virgifera
aaacatacaaatgtatatttattaaattgtttttaaaattgattatatattattataatatatagataaaatgaaaatagcagtagaacccacgcgtccgggagatttagagaatatatatgatactatatatgttttggaacagaaagaaggcattaaagtggacttgttgatatgttgtggtgattttcaatcttcaagaaataatgatgatcttacctgtatggctgtacctccgaaatatagaaatatttgtactttctacaaatactattcaggcgaaaaagtagccccaattttgaccatttttataggaggtaaccatgaggcatccaattacttgcaggaacttccatatggaggatgggtagctccaaatatttattatatgggatacgctggagtaatcaatgtgggaggtttgagaatagcaggcatatcaggtatttataaaggacaagattactggaaaggtcattatgaaaagccaccttacacagatgaatctaaaagatctgtgtaccatgtgaggaatttagaaatatttagacttaaacaactatctggtaaaattgatgtgatgatttcccatgattggccaaatgaaattactaaatatggaaatgttaagcagttgataaagaagaagccccattttaaggaagatattgaaaagaatcagctggggagccaacccaactccgacctcttatttcatctaaaaccagcctactggtttgccgctcaccttcattgtaaattctcagctgtagtgatgcacaaagacgactccatgaccagatttttggctttggataaatgtcttccaaaaaggaagttcctgcaagttttggaagttccacacaatgaggattctaaaatagaaattgcttatgatttggaatggttaagcatattatatttaacgaatcatttgttgtctgtgaaaagtactaagaactatatgccgggaccaggaagtactgagaggtatgaatttacccctactgaccaggaaaaaatcattgtgatgaatcgcttcaaagacaacttggtagttccgaggatatttctaaacagctgtagatatagt

SEQ ID NO: 207 - DNA, 1535 bp, Diabrotica virgifera
  misc_feature (1460)..(1461): n is a, c, g, or t
caaacttgcaaaaaatcccaatgtaatgggctttaagataaatacagaagaaacaacaggcaataaactaaaattaaaataaatcggaagacaaatagacgaagtagataacgtttcataaatctggaatcaatcatcggaaaaaaggcagtagtagatcagatatagaaaaaagaatagtaaaggcacagcatgtatataattccttaaagacaatctgggacactggaaatctggaaaaaaaaaacaaaataagacaaaataacagtgacgattaaaagaaaaatggattggcatacactaaggaaagaccaaaataatataaccagacaggcactggaataccaagcaggcgaaagaagaaaaggaagattgaataatagctggagaattgtaacaagagataatgaaagaattgggctgatatgcaaagaggtcaaacagagagcaagaaatagagagaaatggaaaacactgaggaaatttcgaaggaataaaacaacacgatgcagaagaaagaaagagagagagagagagagagagagagcgagagagagagaatgtcacaaactagagagagagatagagggaggatattatgagatattatgaaaaataaaaacactggaaatgatgttttgggtgcagattaacacgggctttgtgacaaaagttgatcaccctgtatacaagttagcttacttaatatttatttacatgtataatgaattttctgtatgggagtgactaatcatccgaaagacggaaggcttattccaaggcttacttaattacctttttttcgatagctctacagtattttattattattattattacgaagctattagactggcagatactatgataatgtttcgttagtcgcttatttaactcgtaaacttattttaatctcactgaatcaattccaaattcaactattttctaatctgatattattctgtactatagcgcgtgtcacgttaagaatagaacattgcggagatagccccgtgtatttcttacggaccatagaagcgcgccgatgccacgccatactgactagaatgaatcgtatatcggcagtcgagtatccacctgtgcgccataggtttggcaacactgatccactccgtaatcgttacgttctattcttcacgtgaaacaaagtataggtaaatacagagatgttttttacttaataaattaagtgattttaatgataaattgttggtgtatatattctagaggagaaaatgtccaactttgtttactttttttatacctaattggtttattattagagatggcaaaattagttatttttggggattcctttaaggattatttatttaagggaatttggtaaggggaggaagaggatcaattatttatctttatttacagttttgaggggtgttattttgaaataactagatacatcgattgtatttgtatannaagtataattctatgagattttttacacctcgattttttgatctgcactttttaaattataccagtctacagaa

SEQ ID NO: 208 - DNA, 1430 bp, Diabrotica virgifera
gataaatcggcaatatatacttgaaaatgtgaaattttataacaaattttgaactaaatgtaccaattaatattacgtcaaaatggttagtaaaagaaggccagtccacgcaacgaatctaaattttcggcctaatatcaataactcaaataatatagaacaaaaagggacgaaacccacaagtgagcctacctcagtcaaggaaattttaactttaatggtcctgtacttatgcaagaaatcactatttttcgacacaaatttaaaggtgggaatatatttagcttgtttgttccttatatcattaatagccgatgtattaatgataccaaaaacatatttggcaagatcagataatatatttaataaggtgtttgttaaattcgcctggggatggaatttgaccctcatcgtgccttttctcattttgacgtcagtggtgtattgctgtggaaataaacaaaagattcttaaacaacacttcccaagaatcctaatagcaacgtttttctggtggctatggacaacagttttcaatgtaatcgaagcatcccttggtagatgtgcaactccaggtttcaatagcaaagtggtatgtttacatgaaggacatgtttggaatggttttgatctgtctggccattcatttattttaatttatggtagtttgttactcatagaagagacaaggtgtatcgtgaactgggacacaataaaagactacatacgactagaggagcatcaacgtttagcgagagatgcaaacgaaaaaccgaatcctttacgtaatctatcggacctggagttaaaagaaatgaagacaaactatgagaagtttacaccgtatataagactgttgtttatagtaattgctgttattcaaattttgtgggatattatgttgatcagcaccatgttgtattaccatatcatgatagaaaaatccctggggaggggttggtgctattgttacgggggttttttatttataaaggggggactctcacccttctctcttgccaaggcttcctggtgaaagggaatttaaaaaaacttaaaaaaaaaaaccggcttctccacccccccccatattaaaaaaaccaaaaagttaacaactgaacaaatccaaagggtttaccccggggtttttttggggggggcccattacaaaaaaacttctccaaaattcgcaaaaaaaaaaaaaatcacttttggttttttttaaaaatttttttttttttttttttttttttttttgggaaaaggagtgggggtttgttgttaaaaaaaaaaacggaaaaaaagggaatataggggattgttttattttaaaataaaattatttttttttttttatcaaaaaaaaaaaaaaaaaaaaaagggggggggggcgggccgccctcttcaaaaaaaagagaaaaaaaacaaaa

SEQ ID NO: 209 - DNA, 1231 bp, Diabrotica virgifera
  misc_feature (26)..(26): n is a, c, g, or t
cttcgggcgcgacaattgagtgtggntaaccgtgtttagttttttggtttacttgtgttaatcaagttaaattaatatggctggttacggatttaaacaagaatatccaacacataattgtgaacaatgtcagaggaacgttaccaactatccgtcacaacctgccacttgcccgcatcattcccataatagaccaccatcaggttacccttcttatccagcacctcctgcatataatccctattacaatggaaactcagcgccaatgtatccacaaccaccaacatatccacagccgccaacatatccacaaccgccaacaaattcaaattggccaccaactcaccatggaccatctcattcaagttatgcaatctgggtggactgctatcttcacagtccgatgcctaactctgcagtcaggggtggtaccgatatagatgggcaaccaatttatgttggtagagcctttcatgaaggtgattggttgccggccaaagttattccgggacgacgctgctgttatatttcctatgatggaaaggaatacgctaaaactaattttcaggttttatctcatacatctgcacattgggttccaggatttggtgggcaagtgccgcataatgcaattgaaggtggtagaactgttaatggcgaaaagctttacatcggacgagttatgcatcaacattcccaaactgtgggcaagatacatccaagtcacagaaattgttatataccattcgacggaagagaaatagcatatgccgcttatgatgtattagtttctaggaactagtttttctctatttacaaagactttccaattattttagtatatgggatacaaaaattgatacaaaatattgtcataaaataaatacagttatttcatataatatgggggtaaaaatattaaatgatttgtataaaaaattattttacaccaaaaaaaaaaaaaaggggggccgcctctaaagggatcaagctttacgaacccgtggcatggaacgtcattagctttttctataagggtcccctaaaattttaatttcacctgggcccgcccgtttttaaaaacggcccgggactgggggaaaaaaccccggggggggttaccccaaactttaaattcccctttggcaccccaatctcccccccttttccccccagcttgggcggaaaaaaaacgcaaaaaaagaggcccccccccccgcaactccccccc

SEQ ID NO: 210 - DNA, 2029 bp, Diabrotica virgifera
gtaatattgcaacttgcgtatggcggatcaaattactattataaatatataaattagtatacttttcattaagttcatagtgtgcctaaatggcagccgatatgagtgtcttcgataatcttaaggcacaactgcctgattatgataactacactcacaccaatcagtatactgctgccagtattacgttcagtcctggaggaatgaaagggctgtatgatatgaccaggagttttgtagacagcttgctaccggccaattttttaagtgaagatttgtttagctgggacgacgataacaatccatctctaaatactagctacgcagatttggcaatgcaatatgcaggtttgatagcattcttcggttttattcttttactacttgtattaataccggtatgtggtttaatttttgcctgttgtcgatgctgtggattgtgtggagccaaagctagagtcagcgagaagaaacaggatctttgcttgaagattattttcggtattttgctagtaatttgctgtgcagtgctgttatttggaattgctagtgctttcgccactactcacagaatgaagacgggcgtcaatcagttaagagaaaatggcagaaaagtctacaacgatagcgtagggtatattgaggatgtcaaggatcatgttcactttttacttgaagcggactatgataagtttagtggcacctttaaacaaacgttgaaagattctacacaggatatattaaataatttgcctctatggaacgatgttacgataataacgactatttctacatttgctgataaattaacatatctgaaaaccgacctagataatttgcaaaggaagaccgatcaactgaaaacaacaggaagcaacttaacgagtgaaatggcggacattcaaaaaggtttaaaagatacattagagaagtgtggtccatcttgtgctgatgcagagaaaatggtcaatgatttaaaaatcatagatgtaaaagatataccggcaattccagacatatttaatggcgtacccattggagatatacaaaaagcagcgacctctgctaatgatctggtacaaaaagttccagatacaatcaattctcaaatccaaactgttacggctcaagttgatacagagatagataaggctggagcaaccataaaggacaacacaaaaaccatggatgatctcgtagataaagtaaaggagcatatgaaaagtgtttattcttctttcggcgacaggaatgattatctggaaaagtactatccatatttttactatgtgggaatagtagtttcgtgcgttttgcttttaatccttgtgtttctattttttggattagtttttggtttgtttggcaatagacccgataagtacaagagttattgctgcagtaaaggtacaggaagtgtattcttaatgactgctgttgccctgatattcatcataaccgtcattatatgtattatgacgttagtaatgtcggttggtggtatagcagcagatcggatcatttgctatccattaaggaatcctgacaaatcatctattattactgtaatcgataagtacattgataaacatattaaagatgacaatgagttttcttttaatatcacaaccattttggataaatgttataacaataaaagtatttatgaggtgcttgatctgaaaacgaaatcacaattcgacatcgataaaacgataggccagtttaacattacacaaaaatatagatgacatggtggataaagtaggcgatgcaatagataaaataaattttaactttttggaggctgacaccgaagaaaagttgaacgaattgactaaaatcgatgttaaagacttactcgccgacttcaaaaaaatgcaagatatacttaagacacatatgtcgatgctgattttgaaagagttagtagatacgttaaataatatcgctgctaactaaacaatgtggaccaagaattagctgctaatcttacaacccagataaaggatttggaagactcaatact

SEQ ID NO: 211 - DNA, 291 bp, Diabrotica virgifera
acccgccagcatgccacccagtgaggtggtgtagcccgccgtgtcgctgcggctgtcggtcttgccccaactgccgagcgccttgacccacacattgctttcaccggtaaccggcgtatggcgcaggcgctcgccgacggcatcacgtagttggcgactatcgttgatcagcatggtgtcgatggccggatagatttcccccgacagttgctggaagccttgttgcgcggcggccacggagtccgaacgcaggatgctttcgtacaccgggttgcccgcgcccaattgctc

SEQ ID NO: 212 - DNA, 2048 bp, Diabrotica virgifera
  misc_feature (1324)..(1324): n is a, c, g, or t
gcgagcggccgctcgcgcccacgcgtccgcgacagtcatctttagtaacgtgcctttatcaaagaagttgctatttttgtatcggagtaatattttttcagataatccaattatgggtttgcataattaacttgttttagatattgtagccataatatgttaaaaaaggtatttggaagtatgtactgaaaagtcaaaagagattgcagagttgactgttaatctcagtctttagtcattactctggaatatctctaaaaatcatatgcatgatgagcttgcactatcttgtcaattaaattgtcaaattatttattaaaatcctttataaggtatatttatattaaaaaggccctttcgggcagaccctacagattgttttcgacataaaaatttcatcatcagcgctgctaacctgaaataagtacatataatcacttataaatgcaaacatgaatattaaattttgactaaggttaaaaatacataggggttatgcttacaggtgtacctacatgcttgagccaccaaaatatatgggtaaaaatcctttgaatgttatgaacttgtagaaaagttacatgttcacataaaataatatgtgatgtttaaaatactcaggggcgtcaattcaaattttgattgaggggggcaagcacaaaaagcaaaattcgttgttaccgaatttttctttttttttttttcgaagctgctatattgtcagcgatacgtatgatttcattcagagatgggtatttatacaaaaaaaaagttaccgctcaccggaatatcaaaatgatttaattgatgtgtattcttcaagactgctgaaaaatattatcacaaaaggtaatcaagtcgaattctttgctataatggctgatgaaaccaaagatacagctgaaaccaaatcggaacagcttgcaattttaatccgttatgttgatgctgagggcacaaaaatttatgaacgtgctatcgggctgcaccatcttaaggactgtggtgccgaaagtatagccaacgccatacaatcgatgttatcggataaaagactagacatagaaaactgcgttggtcagtgttacgacggagcgaatgtcatcagcggggtccaggcgagaattaaaaatttagcccctcatgctacgtacttccactgtgaggctgatcgactaaatctagttgtagtggatgtgttgggtaacattgacaaagttagacttttttctacagttcaaactctatcgattcatttccaacactgctactcgccatcagctttttgtaaaaatacaacagaggatgaataaaccactactanattttggaaaggactgtaacgtaacaagatactggttgaatgcagtatcgaaaattcgaaagacatgccagaccagtttagctgttctagatgaaagaaaaaggccagtgtagagagtatcgggataaaagcgcaggtaatgcaggtaatgcattgttctatggagagaatataagcgttacttattgtcacagcagttacaagccgaaagaacttgacttaagcacctgccatgcatcttaatcaaaaggaacccaagaagaaacttaaaaaaacccagaaattgacgacacatacccggcgaggttttaaaaaagagctaaatcctttggacagacaagaagggggtgtttttattttgaccaagcaaaaaaaaagaacgaatgacctgtttcctcccttagaactccgcttattaaaccggaattaatggttcaacacaactggggaaaaaaaatattacccggaaacaaaaagggaatataactttccaaaattaaaaaaaaaaacatttcctctggggaaccccaatccctcgccttctctcaaaaaaagaaagggtccggttcccccccaccccgggaggccctttttaaaaaaaaaaaaaaaacacaacaatttttctggggggggaaaaaagaaaaataaaaagaccccctaaaaaaaaaaaaaaaaaaaaaaaaaaaatttttttttaaaaaaatatttaaatctttctcctccc

SEQ ID NO: 213 - DNA, 2333 bp, Diabrotica virgifera
caaattattgtacacaaaaatttgtgaaatcaattagtttttgtcgaccttcataaccttatatttactgtttataagaactaagaataagaatataaataaggataagtagtaatctaaaatattcgaaatacataattctatttcgactttcgacagtactcagctgatcacgaggtactctacagttaattaaagacaagacacctttacatacatttgttgattaattttcagtgtcaacattccgtagcttaaaacaatttaattagtaggctaataaatttcaggaacaaatgcaatcattacttaatccaaatttacaagatccaatatttacatatttgccttttgtttagcacctagattcttttgtcatgagattaatgtacagattctagttagacctgggagagagatcatagtaagtgattcaaaatgaaatttgcagaacatctttctgctcatattacaccagaatggaggaaacaatatataagttacgaggaaatgaaaagcatgctctacctgaccgtagaagaagcaccttccgcagaaagtgtagaaccagaaatagttacccgacatctggcaaacttcgaagaacaattttttctctactgcgataaagaactgaagaaaatcaacacattctattcggaaaaaatggccgaggccactagaaaattcgcaagtcttcatagtgaactaaaagattctttaaacaatatgaatctcggcaagaagaaaagcggaaaccgaaggatggttccgaccagaaaactacaggaacttaaacttgcttttagcgaattctatttgagtttaattttacttcagaactaccaaactttgaatcatacagggttcagaaaaattctgaaaaaacatgacaagctattatcaacagatgtaggtgcaaaatggagacaggaacatgtagagacttcacactttttcacgaataaggacatagacaaattgataaacgacacagaaaattcagttaccaatgaactagaaggaggcgacagacaaaaggcgatgaagaggttgagagttcctcctctaggagaacaacagtcaccatggactacatttaaagtgggcctcttctctggttcatttatagtactgctgattgctgcggtactatcagccgtattccatgaaggcaccactgaaaacttaaaaatagctttccgtctctacagaggcccccttttagtccgagaattactttttttaatcggcgttaacatttatggatggagatcatcgggagtgaatcatgtacttatcttcgagctagatccaagaaatcacgtatccgaacaacatcttatggagctagctgccatatttggagttgtttgggcagttagtttactaaattttttgtacagcgcaactttaagtattcctccatatgtcaatccacttgttttgactgtgataatgatagtgttcctggttaatcctctgaaaatatttagacacgacgctagattttggtttcttcgtatttgtggccgcatgtttggagctccttttttccgtgttgaatttgcggatttctggcttgcagatcaacttaacagcttagcagcagcatttttggatttccagttcttaacatgtttctattttactaacggagattggcttgtagcaggagatacggctcaatgtatggaaagaaattttaccataaggccgatagttaattgtattccagcatggttacgttttgcacaatgtttaagaagatactatgactccaaagatgccttcccacatttagttaatgcaggaaaatattcaactactttcctcgttgtaatttttggaacgttaaaatcagtttacaaagacgattatgcaacgccttcagataatccgtatatgtttctttggatagcagcacagatactcagttccacatatgcatacacatgggatattaagatggattggggattattcgacaaatcagctggtgaaaatacattcttgcgggaggaaacagtttattcttcaaaggttttctattacttcgccataatagaggatctgattttacgttttgcatgggcagtttcactttatttgactgagaatggttatgttagtggagacttaatgacttccattttagccccccttgaggtatttagaaggttcgtgtggaactttttccgtttagagaacgagcatatcaataattgtggtcagttcagagccgttcgtgatatatctgtggctccaattgattcatctgatcaaattcaaattataagaatgatggataaagaagatggagtgacgaatag

SEQ ID NO: 214 - DNA, 943 bp, Diabrotica virgifera
cactccggttagaatattctgtatgtgaatgtcaatgaaaaagtattgtgttcttgaatgacaatgtgtttttgcgattagcactcgattatttattgtttgcggtgtttggtgtgatcctgactaacctcgttatctggtgataaattggacaattattattaaaacaatagcagaaatatggcaagattaactcctgcaattatcttactttctctatcaacattagttgctgctcaattggattcatcaattcattttccgggagactctagttttcctgcttccagtttacaacaggctgtaggaagtccatatgaaaattatgtagatctggtaattgcaaggggcattaataaattatgcttagaaatcaaccagaaatatcaggaaacaaatgggttgataaaggttgataatactgtgttttctcctataaacattgcaggagctttagcactcctcttactaggatcaaatggtcaaacatttaaagaattagctacggtattgggactggctacaggactggacattgaaaacaactctgaacgagtacacgaacatctagggcagatattgcgaagaatagaggaacgtccttactctgtaggagaagacgaacagcaaatcaacttcgctaatgcaatttttgtgcaagaaagctttcccattagaaaaatatacaaggagaccgccgatagtctatataaattcgaaatttttaatcttaattttgaacgagaaccagtaaaagcacagaagtatgtgaatgcttgggtctccgatagaactgtgggaaagatcaaggacattctgagtgagcctccactaccaagcactaaaataattctagctagtgctatgtacttcaaagctaaatgggaaattcctttctttggtgagggggtgacacaaaggagacgtttttacccaaatgggt

SEQ ID NO: 215 - DNA, 1210 bp, Diabrotica virgifera
cccacgcgtccgcacaatgatcgctgttgtaacgtttttgttgtttttcgtacactttagtgaaaatgcggtgtatgttggaaatatacacgaactgcacaatgatgtaaataatttaaaattcacaaaattattaaatgcaaaattggaaaatagaccggatccatggaaaacagatataaatagtttaattcaaccagaaaacgaggagaataatattggtaaaacggacaactacgttgaaattcctattaagttttcgttcgctgttgacaaggagaaagacagaaatgacggtaataaaaattttatcttgaacatgtttagaggatgtgacgccttggttggtacaagcaaaatacaattatgtcgccttgacaaggcccaggagagtttagatatcaaaaaaacttatccaagaagctgcagagaaattctagaaagtggtatcaacaaatctggaatatatgaaattaaacccaggactagcagtaaaccgttttctgttctttgtgatatggaaaccaaaggaggaggttggactcatatccaaaagagatttgacggttctcaagatttctatttaggttggagagattacaagtttggttttggtgatttaaatggagagttctggatgggacttgaaaatatatatcatatgactgcttttgagacaaatgaattgttaatagaattgactgatagagataagaaaaatgcatatgcacaatatacgtcgttttcaattggtcctgaaaaagatgggtatcctttaatgtgcttaaaggattttctggtgatgctggagatgctttaacacctcatctgaatgccaaatttactactcatgatgtcgaccaggacaccaatccaccaaaatgtgcacaaatgtaccacggggggtttgggggatacaagttgccacgcaagtaacttaaatggaaaataaatgaaaaattgccctttcggaacccaataaaacccaccggccttatttggtctgaattccggggcccccaataacattttggttgggtttttgggatactaaaaacggccccaagggagacataaaaaattgttgaacgaaggggaaccaacaaaaataaacaaataaaaaaacaaattttaaaatatttttaaaatggggttttttattaaaatttttatattataaaaaaaaaataaaacctccctccccccccac

SEQ ID NO: 216 - DNA, 878 bp, Diabrotica virgifera
ggttgcggacataccagctgcggtttctctttcaaacgttggaaaatgaacagtttgcacagtgtacaatatcaagttggttttaaaatttcccgtttttgctttgaagtccaatagactttgtgttaaagattgccttcctgtgttattaagcctctgaagataacaaacaattgataaaatttgacagattaagaaaccatgggaaaatcggaagtccagtctctaccaatacatcgtcctgaaccaaaccttatttgtgtaccggccccttgtaaaatcttacaaaataactgtgtgaacggtttagaaaaactagacttaggagaagaactcgaaaacgtcgttgaagaggaagacaaaaccgtggcaataccagagggttacgaaatatataaacatcaaatggctggacatatggataaaggggataatattgggatattgaaggaagatggaatgatattaaaaccagtgataaaaccagaaaacggcgagagggagatcactttttatcaaaacctttccaacacattagataaaaccattttagagctacgaaacttcgtaccaaaatattatggaactaggtgtttagctgtaaatggaaaaacatacgaatttattgttctcgaagatctgatcagagactttaaagaaccttgtgtaatggatattaaaataggcagaaggacttgggatccaacctccacatatgaaaaaatttgttcggaagagagaaaatatcaagactgtaaacgagatctagggttctgtatcccctggtttcaagtgtataaattagcaaatagcccattaattaagtacgataaggaatttggaaaaggtctaaacaaagaacgagctgaagatgcaat

SEQ ID NO: 217 - DNA, 1334 bp, Diabrotica virgifera
  misc_feature (1242)..(1242): n is a, c, g, or t
  misc_feature (1254)..(1254): n is a, c, g, or t
  misc_feature (1260)..(1260): n is a, c, g, or t
  misc_feature (1265)..(1265): n is a, c, g, or t
ggctcatgtggtgcaactagcggagggaaaaatttctggaggcactaggacagatctcaatggggataagtttcattcgtttttatgtatcccatacggaaaagctccagtaggcgacctacggtttaaggcgccattacctactgaaccatgggaaggggtaaaacaagttatcacagaagacaaaacgccattccagaagaacattgttctgaaggaatatactggagaagaagattgcttgtctcttcatgtatttacaaagaaacttccccatgaagaatccaaactgaaacctgtgatggtgtacattcatggaggaggttttataataggatctcacgaaactacgatgtatggtccagaataccttatgactgaagacatagttctcgtaagcatcacttaccgaattggtctactgggttttcttagtatagaagacgaatcactggacgttcctggaaatgcaggtctaaaagatcaagtactggctttaaagtgggtccagcgaaacataagaaatttcaatggagatcccaataacattaccatatttggagaaagtgcgggaggggcatctgttgaatttttgctgttatctccttcagccaaaggtttatttcataaagccatacttcagagcgggtcgactttaaatccatggactcttaaaaactccccagcaactgagtttgctgagtttaccaaactacataacttgtctgatattgaccttttgaaaagcttgaggcgtatgactgttagggagctgtacgatcaacaaaatcaatatattaagtctaagaagctatttgtagatttcggtctaataaccccagtgatagaaaaacccaacccaacagcatttttgacagagaaacctatcgacatcatccagtcagggaaatacaacaatgtgccagtgataatgggttacaccgacagtgaaggtcttcttctagacttcttgtcggcacttggaatgaacggggcaaaagagggagaagatatacctattgagcagatactaccatacgagacaaatttaacagatgcacaacaagtcaaacgattagttgaaaagttaagaaatttttatcgtccagaagctgatccggttggacgaattaatttatctacggatgccttgttttgcgctggaataatcacttctgcaaaaaatcagcgaaagtgtcaaagaaccctgtatatttttatagattttcattggacgcaggncttaacatgctngagaanatggntgaatgatacacgtccaggagcttgtcacggggatgaactgggatacctatttaaaaaccttttgacac

SEQ ID NO: 218 - DNA, 809 bp, Diabrotica virgifera
gattttctgattttcatcgagcttattgtattctttataataattaccaatgtatctgaaattattttatctctttagatccttttagtaccataaatgctgctaaatcttaattagatagtgaataagacaatgacgcttctatgtatgttctagaaagaatagtattccctcttactgactcccccaccaagcgattcaactgtatagctaatacgagaatactcgtaaatggtggataatatttgggatttgatagaagggatggttctttcgctgctcataacgtacccgccggatcttatattgaggaaggattacatccagagtttgcattctagcctgctatagagaaaagatattccaagggcaaatttaggggtacgaaaggaacacgcgtccggatttctgaagttatcatagtgccatatccattacgtatgaaagcattagggaaaacacggtatttccaattgagagaacaatggagaataacagatctcttatttaacccaatgatcatgatgatggtcctacctcttctcttagtcatggttctgccaaagatgatgaatgacccagaaacaaagaaggaaatggagcaaattcaaaacatggccaaatttgaaatgtctgataggttctcaaattacttggctggatcgactacaccagcgcagactgacaaggataaaaaccaagctgttaataaaaagagtcaaaagactaggaaacgaatagaaaaataaattatagtttattatttttacatagcaaattgcattagatatacaatttaagtttgtaag

SEQ ID NO: 219 - DNA, 480 bp, Diabrotica virgifera
tccgaaaattaaaactttcagctctgggccaatagcagatattggtctcatgtgccagttttagacagtcattggaaaacccacgcaacgcgaacacggtagtcgtgtcggcggtacctgattaaaaacagtgaacacgcgagtcgtgtcgccggacttgaaagtgttaagacctgaaataattttgcttttccatttaacagtttttctatcagtgttagatgtcaatacatttacaatttgggacatactcgtatcatatttttttactacgactgaatagttttgtattcatctaaatgtgtcgagaacactagtaacactacgggattttcatgtgtggtaattttaagttacaattgattatatattgttgtaaaaaccttcaattcaaaacaacattttcgagtagttaaacgtgtatgatacacacatttcttcaataaaatgttttgttgtaacaaaaaaaaacaaaacaaa

SEQ ID NO: 220 - DNA, 1193 bp, Diabrotica virgifera
cctcttttttgtcacctaaaaatatttatctctgtcatgatttcacgtttatcaacaaaagttccaagtaaggacttaaacaattattaacactaaagaaaatgcattgttaagtattaacagaaataatatttaatcactaatgaccttctcggaatagataattacattctattgataaaaatgccttcagtccaacaaattttggcctgcatgtttatgggcaaactcaaaaaaatatatggaggtccagtagagaagctgtacgaaccaaactctcttgaacatattagtgacaagtgcttaaattctctatatgtaatttggaaattaggcatctacacatcaccaattgtggtgggactcttgtatcagaggggatactttgaacctgatggattgttactcctaacaaaatttataacaactgcaggtgtcattgttgttatgtcattttgtttgagggggtatggtagagccaccaatccaacatatgtaaagtattttaaggctgttaagactgcagaaagagatatgacgccaggtgcaaaacaggaattaatgaaatatgattttgactttaaatcttggccagttgagtacaaatgtaccagtgatgcaagggaaatggtacaacaaattcctaaacaaccaaaatactctggattgataaattggctgtggcagttacctttcaaaataatcgcttattttgctattcacacttttggcattagacttatttatccaggaaccattggattccttcaaattatattagatcaaagtcttatgcaaggtagatctaagctagtagaactatacagaggggaaagatataaacttcagacagctgacggcaatcatattgatactatgttcgtcgatagaagaaaaacaacctcaattggtaacacactggtagtctgctgtgaaggaaatgccggtttctacgaaattggcgtaatgagtacccccatcgaagcaggatattcagtattgggctggaaccatcctggctttgccaatagtacgggcaagccatatccttcgcaggaacaaaacgctattcatgcggttatgcagtttgcggaacagaaattgaacttcaaaagggaggatataatattgtttcgttgggagaacggtggatacgcccccccatgcgcgggggggggggggaatattattac

SEQ ID NO: 221 - DNA, 1307 bp, Diabrotica virgifera
aaaatggtcagaacatagtattagtagatggagtaaggaccccctttttgttatctggaactgattatgcaaaacttatgccacatgaactggctaaacaggctctaagtggcattcttaagaagactggtgttccaaaggaaattatcgattatgttatttatggtactgtgatgcaagaagtcagaacttctaatattgctagggaagctgccctggttgctggatatagtgacaaaactcctgctcatactgtcacaatggcttgcatttcttcaaatgttgccatgacaacagctattggtcttattaacagtggcatttacgagacaatagtatgtggtggagtagaatttatgtcagatatccctattagacatagcagaaaaatgagaaacctactactaaaagcaaataaagcgaagaacctccaacagagactgtctttgttggcttcgatcagacctgattactttgtaccagatctcccatcaattgccgaattttcttctggagagactatgggccattcagccgacaggctcgctgctgcctttggagcaaaccgcaaggagcaagacgaatttgccttaaggtcacataccagagcacaagaagctgctgataaaggttacttaaccgacatcgtgccattccaagtaccaggagttgcaaagcaagtcgaaaaagataatggtatccgtgtatcaagtcctgaaaaattggcgtcactcaaaccagcttttattaaacctcatggaacggtcactgcagcaaatgcttcatttttgactgatggtgcttctgcttgcctcatcactacagaagctaagtgcaaacaactggggctaaaaccaaaagcgtacctcagaaacttcctttacgtatcccaagatcctatcgatcaacttcttctgggacctgcatacggaacacctcaagtattagaaagggctggactcacacccaaggagatcgatgtttgggaattccatgaagcctttgcaggtcaaattttggcgaacttaaaagcgcttgacagtgactggttcgctcagaaatacatgaatagacagaatagagttggagctcccgatctcaacaagttcaatgcctggggaggatcactttcaatcggacatccatttgctgctacaggtgtaagattggctatgcacacagctaatagattagttagagaagatggtcaatttggattggttgctgcatgtgctgctggtggtcaaggaggagccatgattttggagagacatcctgatgactacccccaattagaatgtaaactg

SEQ ID NO: 222 - DNA, 1064 bp, Diabrotica virgifera
gaggggtcaaagtctaaaacggacgcgtgggattttgtggactccgtttatattattaatttattttgttctttcatttaagtaaaagtaaaacaaaaaataaaatacgaaaatggctttaagttcagcgagaaatattgtaaaaaatcaggttacattaggcctaataaagcaacaaggcaatgctttgagaactttttcccttggaattcataacaatcagaagaaatctttggctcctaaaaatggtcagaacatagtattagtagatggagtaaggaccccctttttgttatctggaactgattatgcaaaacttatgccacatgaactggctaaacaggctctaagtggcattcttaagaagactggtgttccaaaggaaattatcgattatgttatttatggtactgtgatgcaagaagtcagaacttctaatattgctagggaagctgccctggttgctggatatagtgacaaaactcctgctcatactgtcacaatggcttgcatttcttcaaatgttgccatgacaacagctattggtcttattaacagtggcatttacgagacaatagtatgtggtggagtagaatttatgtcagatatccctattagacatagcagaaaaatgagaaacctactactaaaagcaaataaagcgaagaacctccaacagagactgtctttgttggcttcgatcagacctgattactttgtaccagatctcccatcaattgccgaattttcttctggagagactatgggccattcagccgacaggctcgctgctgcctttggagcaaaccgcaaggagcaagacgaatttgccttaaggtcacataccagagcacaagaagctgctgataaaggttacttaaccgacatcgtgccattccaagtaccaggagttgcaaagcaagtcgaaaaagataatggtatccgtgtatcaagtcctgaaaaattggcgtcactcaaaccagcttttattaaacctcattggaaacgcccctggtccaaaaagtttttatttttttgggaggggggcctcttgttttttccct

SEQ ID NO: 223 - DNA, 1496 bp, Diabrotica virgifera
actagttctagatcgcgagcggccgcccttttttttattttttgtgatttatgggatacagccagtacaggaatttttccttgtgatattttttctttaaatattgtgcagttgtagaaaatttagatgtttatataaaattaattgtgatgtttaaaataatcctagattttatatcaggcaacacagaactggctcacaatacgcgggttgcaagtctagagggcagaaccgcacattatggactgtaaagagcaactgacagcactgatgatgaactctatttcgaaaacgttttgtgatgtagccctttaagagactttttgaattaaatatacgttttataaaggattttaactaattttttgtgattaatggtatacagccgactacagtggattttattagttgtgttaaaagttgatattgctctataattacagcatttttctttatcgctcttttggtttcattatttctattttcaacttatctggtgtaacaaagttactagttgtgagccactaattgccgtaaacataagctttaaaaacaaagtgggagagcacacgaagaagacttataccagataaattattagtttgatcttcaggctcaacatttttcgatacgatctggttgctattctatttctttcgctaaactatgtttatcttgtcatcagcaatatagttaatttttagtgtacaactaactgtagaacttactttaaataattgtggaaatatttaacttttatggttttgtaataagaaataaaattgtaatccactttaaaaaaaataatccgatatatattttttatatgatcaggtgatgaatatgccttgtcttaacattttaatgtacatattacttaggatagaagtgaaataactaaattttgtctgactggtgttggaaaatagcttattattgttattatttggcctgatgaatattgatatcatgtaatttaaaagagttcgtggctccgctttcataattttaacagattttaaaaagtgttaaaacatggtttaattcgtttacatgcattaataatactatatgagggtcatccgtggaaaagggttacctgtgccgctgagaaagtgtcatacatcaactctccttctctcttacctcaccagtttcgactcactgcttttctcagtgtcgacttagcagtcttcgaagatggaggtcccggtgggtgttacctccaatgtgaaattcatgctgtgatacgttttttaaatgctgttttttaaaatggatttcacctattgacattcatcgtcagagtatatctgttcaacatgttcgcaaataggggtagagaactcagtgatgaaggccttcactgaattctctacaacatttgcggatatgttgaacagatatgcagtcatacccataaacttttgattgactgacgatgaatgcaaataggtgaaatctattttgcatgtagaaaatgtatttggatgcaa

SEQ ID NO: 224 - DNA, 1020 bp, Diabrotica virgifera
  misc_feature (808)..(808): n is a, c, g, or t
  misc_feature (817)..(817): n is a, c, g, or t
  misc_feature (875)..(875): n is a, c, g, or t
atcgcgagcgccgccctttttttttttttttatgttattaaggtttatttattcatggaacgtacaatatcaacactagtgataaccaactgttgtgtgaccaggacagtccgaatcctcaatcttgacacaccctcttttagatgcgctccagtagagttctactggacattggataggtccctcccactggttactttcacaaatatagaaataatgacagctattaacatcagctttcatatcaccgtttgtgcaggaagcaggtgttgttgatgtttcaatttgcgagcagtcagagctctcggtacatccaggtaaatgaacattccacaaaagaggatcagggcagatcatatgctgttttacgttgttaatacattcgtaaaatgcttgacaattcgttgtatctggaaaatattcgccgtttacgtcacatcgaagccatggaggtattgttgttccagttgggtttgcagtagttggagcaggtgttggaggtgcagtggactccgtaggaccaacagtccatgaacagtcaacgttttctgggcgatcacaagtcagaagcagggggttccagtaaagacctgatgggcaactcatttcaaccttctcaccctgagtattacattcgtagtattttgtacagtcgtagacatcaggccaatattgttgtttttcacaatcaggatcctgtgcgatggtaccgccaacaaacaggacggcgacaaatattatacttgaacaatgcatactgtgtatcacttggtcactttcaaaactaaagtgagactttcaaaactanagtgagaanactatatggaaacgacctatttatatgctgaacaattacacactgattttttctatangtaatctataagttttattgtaaactgtagtgatttcgagatgccagggatcatgaagggcttcatcgtactatccatcttttgcgtcgccgcttggcctcccagacagctgtattaatgacgcagttaccgcatgtgatcagct

SEQ ID NO: 225 - DNA, 1676 bp, Diabrotica virgifera
catctcgcgtccgccgcgggatgttgcatgtggccccaaacctttgacggggtgacaatcttccaaatttttgacacttgcgtccggccggttgacagacgtctgggtggtgcgattttatatccagaaaatatcaaatagctgctcttcaaagatgcccatcaaaagcatcctcgctcgccaaatcttcgactctcgtggtaaccccaccgtcgaagtcgatctcgtcaccgaattgggattgttccgtgctgctgtaccatctggagccagtactggtatctacgaagctcttgaactccgtgacaatgtcaagggagaataccacgccaaaggtgtcaaaactgccatcaacaacatcaattccataatcgcacctgaactgatcaaatcaggcctagaagttaccgcacaaacagacgtcgacaatttcatgttgaaactcgatggaaccgaaaacaaatccaaattgggggccaacgctatcttgggtgtgtcactagccgttgccaaagccggagccgccaagaagggagtaccattgtacagacatttggctgatttgtctggaaacaaagacatcattttgcccgttcctgccttcaacgtcatcaatggtggatctcacgctggtaacaagctagctatgcaggaattcatgatccttccaactggagctgccaacttcacagaagccatgcgcatgggaagcgaagtctaccatcacctcaagaaagtcatcaaggatagattcggcttggacgctactgctgtaggtgatgaaggtggttttgctcccaacatcctcaacaacaaagacggtctcgaactcatcaaggttgctatcgcaaatgctggatacacaggcaagatcgaaattggtatggatgttgctgcatctgaattctacaaagaaggcaaatacgacttagacttcaaaaaccccaactccgacaaaagcaaatggatcactcctgaccaacttcttgacctctaccaagaattcatcaaagaataccccatcgtttccattgaagatcccttcgaccaagatgactggccagcatggtccaaaatcactgctgcaacctccatccaaattgtcggtgacgatttaacagtcacaaacccaaaacgtatccaaaccgcagtagagaagaaagcttgtaactgcttgcttttgaaagtcaaccaaattggtaccgtgacagagtccatccaagcccacaatctggccaaggccaacggttggggcaccatggtttcccacaggtctggtgaaaccgaagacactttcatcgccgatcttgtcgtaggtctttccactggtcaaatcaagactggagctccttgcagatcagaacgtttggctaaatacaaccaaattctccgtatcgaagaagagttaggatccgcagctaaatatgctggaaaatcattccgtaaacctcagtaagtgacaataaggatatgtaaaaaaaaactcgtagtttgagggtattgtcaagagaatgttgttttctctctaatatgttaagagcaaagtaaacgctatgttgtcaaaactgtactattgtcatcaaatagttgtactgtatgagatatttatctttttgtggttattataaatctaaaatatattgttatttatttccaaaaaaaacggacgcgtaatg

SEQ ID NO: 226 - DNA, 845 bp, Diabrotica virgifera
gtacatcagaagactactagctaaacgcctggccgaaaaacgcaaaaaggcagcatttgcaattagaaggtttatcaagggcttcattacacgaaatggtccacctacagacgaaaacaaatcattcttgagcatggccaaagtgcaatggttgaaaagattagccaaaacacttcctaaacaaatattgtacagacgttggccaccttgtccttttgtgtgccgagaagcgtccaagcatttagaaaaaatgcacggagcacacttgtcaagggtgtatagactggctttaacacctgagatgaaacgacagttcgagttgaaagtgttggcggaatcgttatttaaagacaaaaagaaatcgtacaaagatagtgtcccccacctcttcgaaccagatagagttcaagaaataaatattccaatgaaagaactttatgcatcacaactaaatggagacaaagaaatttattctacgaacgtcatcaagtttgataggcatggatataaaccaagggagagactgatggttattggtagtaaaaatcttcaccttttagaatgtaaaggatcactgaaacccaagcactgccttcctttaaataggttaacttttacgataacgccagaaaatgacaagatgcttttggtgcaaattcccgaggatttgatcaaaaaggataagggtgacttaattttggaagtgcccaacttgatagaagctttgacctacgttatggacacattaaaagacaaatccgtcttgaaaataatttcccaatcacacattgaacataatatgaaaggaaaacacggcacaattgacattcacatggagatgcccc

SEQ ID NO: 227 - DNA, 1240 bp, Diabrotica virgifera
caacatggcatcaggaaaaaaagggaagaaaaccaaagggaagacgttcgctcttaccgatttcttacaggaaactaccggctccattcctgttcaacctattcgcaaatcaaatatcaattgggccgacgaggtagaagattatgatgatacaagaaaggctgtcaatgtagtgttacccacggctccaaaagcttcaagagattatgatgatattagcaatacggttcctatggaaccaccattttgggcttatctttcgaatttgccttacgacgtggatgaagatgaactttcagcattttttaataacatgaggatagccaatatgagaattccaaaagatgacagaggaggagaatcaaaatcgaaaggttatggatatattgaatttgaagacagagacagtttattggaagcacttttccttcgtgacaccacattaaaatctagaagaatgaggatagaagtagcatcaaatatggataatgataggcgaagaggtagaatggacatgaatcgtgacaggcaaccagatcgcagcgattcttttggtgattggcggtctggaccaagggcatcttctgacagtatggataaccgccgaaccggttttaatagggatcgagacggcggtggaggtggcggaggatttaccagagaaggaatgcgtgatagagatgacaaaagttttactcgtgaaggaatgagagatcgtgactatggtagagatagggacaatcgagattttggacgtgacagagatagtaacagagacttcaatagagatagggatagtaatagggatagaaaagatattgatgatcggcccggtggatggagagatggagatagacaaaataaagatggggaccgcgacagagataggggtttcaaccgtgatagaggcaatttccgtgactctgacagaggcaaccgatacgacgatgatcgaagaggtgggggttttggcggaagaaggtttgatgacaaaagggagggataaagacaaagatagacgggatggattttcaagaagaaatgaccgggaaacagaatcgtcggaaccccgagaaagggccacaatttatgttttaaaccggaaaagaaaaaaaaaaattgtccactggtaataacataataatatctgcccgcacctcagaggttttgcggccggaaaacctttttcggggaagggggggaaaaaccgggggaaaataacaggcgggcgcccgggggg

SEQ ID NO: 228 - DNA, 1235 bp, Diabrotica virgifera
cccacgcgtccgaacatggcatcaggaaaaaaagggaagaaaaccaaagggaagacgttcgctcttaccgatttcttacaggaatgcgtgactatggtagagatagggacaatcgagattttggacgtgacagagatagtaacagagacttcaatagagatagggatagtaatagggatagaaaagatattgatgatcggcccggtggatggagagatggagatagacaaaataaagatggggaccgcgacagagataggggtttcaaccgtgatagaggcaatttccgtgactctgacagaggcaaccgatacgacgatgatcgaagaggtggaggctttggtggaagaaggtttgatgacagaagggatgataaagacagagatagacgggatggattttcaagaagagatgaccgggatacagagtcgtcggaaccacgtgaaaggccaaaattaatgttagcaccaaggacaaaaccagtagaagttgtacctgtaaatactacagaatcagtgccttcagcttctatattcggtagtgcgaaacctgtagatacagcgcagcgagaaagagaaatagaagagaaaattgccagagaggctgataaaccaagagaaagtagcaaagatagagatgagaatagaaagcatgaaaatagtgaacgaaaaaatgtagataggattgaaagaagtaggccaccaccacgcagaatagatgatagcccacaaagagataaggaccacagagatggacctaaaaagaactatgatgacagaaaattacctcctaaaaatgatcacaaatcgccagacagacttgataataggcacaaacacgataagtctgaaaagcccaagcgagaggagaaaagagacaggtacgagaaggatatgccaaaattgactgagccagaacccccgaacttcgcagccaacaataagttcgcttttctgccgacagattccgattagcaatacgtgattattaaatggtgtaaatattttgaataaactgtgtttaataaaatatgaactttttaaaacgaatgtgaagcggttttacatatttattgttttagtcatagaatatattttttgttaaatacaaaaaaaaccagcaaaaaaaaaaaaaaagggcggccgctcgttattgttattttttttaatttgggggtgggggaatttccttatttttttttccccctggaaaaaaaaaaaaaaaaaagggggggc

SEQ ID NO: 229 - DNA, 2264 bp, Diabrotica virgifera
  misc_feature (674)..(674): n is a, c, g, or t
  misc_feature (725)..(725): n is a, c, g, or t
gaaaataaataaataatcgatcgagatcgaagataatctatttccgtgctattctagtttatcattacaagtaacgtggaatccaacaagtttgaggccacatcgggacacattaaaccaaaagctagtgcagcagtccaaacacaagcagttaaggatttaattttaaggttactcgatactaaagctagcaaattttctcgtaaatcgtggatccaacatttatacaaaataacaaagacacgtttgaggtgtcgaaagaaaagggagtaattaacatcgtcggaactagtggagtcgcagccgcgacaggattccaccattacttaaagtatttttgtaacgctcatatttcctgggaggcctcacagctgaatctaccggaagacttacccgacgttaatgttaccattacgttgaacgacaggtttagatattaccaaaatacatgtaccactagctacagtttcgtgtggtggaattggcaggaatgggaaaaacatatagattggatggcactgaattcttttaatctagttttagcctttaatgggcaagaggctatttgggaacgagtatacaaaaaattaaatttcacaaaacaggacattgatgaacactttacaggaccagcctttttatcttggttacgtatgggaaatatgagaggatgnggtggaccactgtctgcatcatggcacgagaggtcaatattgttgcagaanaaaatcttggaacgaatgagaagtttgggaatcattccagtattgccagcttttgctggacatttaccaagagccgttacaagaatttaccccaatgtgaatgtcactaaaatggagacatggaacagtttcaatgactcctactgctgtccatatttcctcgatcctactgaagaacttttcaaagtaataggaaagctttttatagaggagcaaacaaaagaatttggtacggaccacatctataactgtgatagtttcaacgaaaatgatcctacaacaactaatacaacgtacataggaaatgtcgggaaaagtatttatgcagctatgactgcagcagatcctgatgctatttgggttatgcaagggtggctattttacaacaacgagtattggcataatttggatcgagccaaagctttgattaccagtgtaccaacgggcaaaatgattatattagatcttcaatcagaggaatttcctcagtatgacgcgttagatcaatatttcggccaaccttatatttggtgtatgctgcacgattttggtggaactttgggcatgtttggatcagctaacattataaacatgagagttatccaagcaagacacagcattaacagcacgatgataggaactgggcttaccccggaaggtattaaccaaaattatgttatatatgacttaatgactgaacaagcatggagaaaagaatcagcaaatttaacaacctggttcgaaaattatgcactaaggaggtatggaaaatccaacgcaaagatcaatgaagcatggcagttattaaagaacacagtttatgatttttctggattacacaaactaagaggaaaatatgccattacatggacaccaacattaaaattggacgtctggacgtggtacaattatagtgaggtatttgacgcttgggacatttttgtacgaaatgctgatgatcttaaaaacagcccaggttttcttcacgacttagtcgacttaacaagacaagtattacaaatttacggtgacatttactatcccaagattgttactgcatttagggacgacgattatacgaattttagtcaacatgcgacagtttttatggaaatattcgatgatctggaactcatattatctacaaacaaagcatttttgttaggaccttggattgaagcagcaaaaagttgtggaaacaactcacaggaaagtaatctttttgaatataacgctagaaaccaaattactttatggggaccagaaggagagattattaattacgctaacaagcaatggtcagggatcgtcgctaattattacaagcctcgttgggaaatctttattaatagaatgaattacagtttgcttcacaatacatggttttcagaaacagctgcgaggagggaaatgtttagaaaagcagaagaaccatttacttttgaccgtacagtatttccagttgagccaacaggaaacactatttgaagctgctaaggctattcataaaagatggaatgtgcgacgtgaagtccctaa

SEQ ID NO: 230 - DNA, 2108 bp, Diabrotica virgifera
gcgagcggccgctcgcgatctagaactagtctaatattgagtgtgattgttgctgtgtttgttgttattgtagtaacacttgtggtaacttggcttcgtgctctaagaaagtatgacagtttaaaaaatgtgccaggaccaacaccaattccaattattggaaatgcacttcttatgggaactaccaccgtagctctgttacaaacctttctggatctgcagaaaaaatatggaaatttctataaattatggatgggacccaggttacacttggtgatatacaaaccagaatatttagagaaaatcatgacttcacacgttcatttagataaaaccagcggatatgatctatttgaaccatggttgggggacggattattaataagcactggaaaaaagtggaagcttagaaggaaaatgataactccaacttttcatttcaaaatcctcgaagagtttgtaaatgtctttattactacgtttaatctattctgaaaattagtacaatgtttgaaaccagaggtgtaaccaggatgatcctaaggggagggggttacaactacttgattgtctctgggggatatggattagtgatggtgttaagcgtatagagctcaaagtacatccaaatggaggggttataacccccgaagccccccctggttacgcctatgtttgaaactgatataattttaacttaaagatcaaatacatacaatataacgtatatcgctaaaagtgcagctgattgacagatcaataaattgaatagatattgttttaatctctgagtcttagcttaactttaagtccatttttagatttgagaactgaagtcaagccatgttgaggtatagagttaggatcttgtattaggtcaaacttcaacaggaatttgattacgctgagtttagcttcactggatgctatttgtgaaactgcctttggtacatgcctgaatgttcaacgtaacggaaaccgagaatacgtgcaagctctgggaagattttttagaaatattcgtagtcagatttttttccgcgtggttgcgtaacccggtattattcatactctcgaaatattataaagaatactcagaaaatttgaaaattcttcatacgtttactgacaacataagtaaagcccgataggaagaatgctaaactcacaaagtctctgggggacagaactcagtggactcgataagcgtgtagcgatcaaagttcatagatatgggaggggttataccccccgaagccccccctggttacgcctatgtttgaaactgatataatttaacttaaagatcaaatacatacaatataacgtatatcgctaaaagtgcagctgattgacagatcaataaattgaatagatattgttttaatctctgagtcttagcttaactttaagtccatttttagatttgagaactgaagtcaagccatgttgaggtataaagttaggatcttgtattagttcaaacttcaacaccgaatttgattacgctgagtttaacttcataaacagcaaatttttgacctatacaatttcttgggccagcactaaacggcagataagcaaatgtgtggcgacttgagatactttctggaagaaatcgttcgggttcaaatttgtctgggtttgggaaaacctttggatcgtgattcattccatataagaatattgacacgtcagtaccttttggaactgtagttgcatctaaatccatatcctctacaatctttctttctatcattggcacaggtgggtattttctgaatgcttcttttaccacaatatctaagtattttaaatcatttagattagatatggtcaaatccatatttttgtcacttcctaatgtatcaacaatttcgttatacagcttcttttgcacatcgggattttcagccagggcatataaagtataggcaattccggaacttgttgtatcatgaccctcaaacatgaacgtatcaacttctgctctgatatcttcgtcaggaatatcttctccattttcttttgcttgtaataacatatctagcaaacctactcggttcttgattcctgagtcatctgagttctgtttttgatcgagtttg

SEQ ID NO: 231 - DNA, 1498 bp, Diabrotica virgifera
  misc_feature (1424)..(1424): n is a, c, g, or t
  misc_feature (1473)..(1473): n is a, c, g, or t
  misc_feature (1484)..(1484): n is a, c, g, or t
cggacgcgtgggtgttaccacagaagagaatatttctagtagcacaacaggtgatgtggaagaaacaagcgctgataatagaaccacggacgaaggcactactgaaaactacacagatgtccctagtacttcggacagtcgaaccgagactacaactggtgacaatgtaactgataatgttaccacagaagaaaatatttctagtagcacaacaggtgatatggaagaaacaagcactgataatagaaccactgacgaaggtactactgaaaacaacacagatgtccccagtactacggacagtcaaaccgagactacaactggtgacaacgtaactgataatgttaccacagaagagaacatttctagtagcacaacaggtgatgtggaagaaacaagcactgataataaaaccaccgacgaaggtactactgaaaacaaaccagatgtatccagtactacggagagtcaaaccgagactgcaactgatgacaatgtaactgataatgttaccacagaaaagaacatttctagtagcacaacaggtgatttggaagaaacaagcgctgataatagaaccacggacgaaggtactactgaaaacaacacagatgtccccagtactacggacagtcaaacccagacctccactgatgacaatgtaactgataatgttaccacagaagaaaatatttctagtagtacaacaggtgatgtggaagaaacaagcgctgataatagaaccacggacgaagatactactgaaaacaacacagacgtccccagtacttcggacagtcaaactcagactaccactgatgacaatgtaactgataatgttaccacagaagagaatatttctagtagcacaacaagtgatgtggaagaaacaagcgctgatagtagaaccacggacgaagacacaactgaaaacaacacagatgtccccagtactacggacactcaaaccgagatctcaactgatgacaatgtaacggataatgtcaccacagaagataatatttctagtagcacaacaggtgatgtggaagaaacaagcgctgataataaaaccacagacgaaagtactactgaaaacaacacagatgtccccagtactacgaacagtcaaaccgagatttcaactgatgacaatgtaactgataatgttaccacagaagagaatatttctagtagcacaagaggtgatgtggaagaaacaagcgctgataacagaaccacggacgaaggcactactgaaaactacacagatgtccccaatactacggacagccaaaccgagactacaactggtgacaatgtaactgataatgttaccacagaagagaatatttctagtagcacaacagttgatgtggaagaaacaagcgcagataacagaaccacggacggaggcactactngaaactacacagatgtccccagtactacgaacagtcaaaccgagactancactggtgacnatgaaactgatagt

SEQ ID NO: 232 - DNA, 2957 bp, Diabrotica virgifera
acacgacgttgtttgccctgaagtcgacggaccagtttcagtttatgcccgcttaccagactgtaccaaattctgtcaatgttctaatggggtaccgtatctgcatcattgtccactaggtctacatttcaatccttcactaaatgtttgtgattggccagaagatgcaggttgtaataatgtaatagatgtaactgaaagtacttcaaaagaaggcagcacttctactgccacaacagaatataatgaggtcactactaaaaataatactaccaacgaaagtaccgattccacagatgtccccaatactacggagagtcaaaccaaaactactactggcgaaaatgtaactgacaatgttacaacagaagataatatttctagtagcacaacaggtgatgtagatgaaacaagcgctgataatagaaccacggacgaaggtactactgaaaacaacacagatgtccccagtactatggaaagtgaaaccgagactgcaactggtgacaatgtaactgataatgttaccacagaagagaacatttctagtagcacaacaggtgatgtggaagaaacaagcgctgataataaaaccacagacgaaggtactaccgaaaacgacacagatgtcaccagtactacggacagtcaaaccgagacctcaactggtgacaatgtaactgataatgttaccacagaagataatatttctagtagcacaacaggtgatgtggaagaaacaagcgctgataatagaaccacggacgaaggtactactgaaaacaacacagatgtctccagtactacggagagtcaaaccgaaactgcaactggtggaaatgtaactgatacggttaccacagaagagaatatttctagtagcacaacaagtgatatggaagaaacaagcgctgataatagaaccacggacgaaggcataactgaaaaaaacacagatgtccccagtactacggacagtcaaaccgagacctcaactggtaacaatgaaactgataatgttaccacagaagaaaatatttctagtagtacaacaggtgatgtggaagaaacaagcgctgataataggaccacgcacgaaggtactactgaaaacaacacagacgtccccagtacttcggacagtcaaactcagactaccactgatgacaatgtaactgataatgttaccacagaagagaatatttctagtagcacaacaagtgatgtggaagaaacaagcgctgatagtagaaccacggacgaaggcacaactgaaaacaacacagatgtccccagtactacggatagtcaaaccgagacctcaactggtgacaataaaactgataatgttaccacagaagaaaatatttctagtagtacaacaggtgatgtggaagaaacaagcgctgataatagaaccacggacgaaggtactactgaaaacaacacagacgtccccagtacttcggacagtcaaactcagactaccactgatgacaatgtaactgataatgttaccacagaagagaatatttctagtagcacaacaagtgatgtggaagaaacaagcgctgataatagaaccacggacgaggacacaactgaaaacaacacagatgtccccagtactacggacactcaaaccgagatctcaactgatgacaatgtaactgataatccacgcgtccgagataatatttctagtagcacaacaggtgatgtggaagaaacaagcgctgataataaaactacagacgaaagtactactgaaaacaacacagatgtccccagtactacgaacagtcaaaccgagatttcaactgatgacaatgtaactgataatgttaccacagaagataatatttctagtagcacaacaggtgatgtggaagaaacaagcgctgataacagaaccaccgacgaaggcacaactgaaaactacgcagatgtccccagtactacggagagtcaaaccgagactacaactggtgacaatgtaactgataatgttaccacagaagagaatatttctagtagcacaagaggtgatgtggaagaaacaagcgctgataacagaaccacggacgaaggcactactgaaaactacacagatgtccccaatactacggacagccaaaccgagactacaactggtgacaatgtaactgataatgttaccacagaagagaatatttctagtagcacaacagttgatgtggaagaaacaagcgcagataacagaaccacggacggaggcactactgaaaactacacagatgtccccagtactacgaacagtcaaaccgagactacaactggtgacaatgaaactgatagtgttaccacagaagagaatatttctagtagcactacagctgatgtggaagatacaagcgctgataatagaaccatggacgaaggcactactgaaaactacacagatgtccccagtactacggacagtcaaaccgagactacaactggtgacaatgtaactgataatgttaccacacaagagaatatttctagtagcacaacaggtgatgtggaagaaacaagcgctgataatagaaccacggacgaaggcactactgaaaactacacagatgtccccagcactgcaaaaactactactgaaaataatattgatgaaaagactacatctgcagccaatagtaccgaggaaagtagtaacacagacgtgactactacagaagctatcggtacaagcacagataacacaaatgatgacgctaacaatactacaactcttgctccagaaaatggaacagccatatgtcttcgaaacaatgttgtattgccctgcaatcgatggaccagattcatggttcgcgtgctgtatactgattgtaccaaattttgactatgttcaaatgtagctcctgatctatacaactgtccagcaggtctacacttccatccttcactagacgtat

SEQ ID NO: 233 - DNA, 453 bp, Diabrotica virgifera
acgagatccgagtgcgtgatttggggagaacttggaattcttttactgtcgacgtagctttgaagcacagttatagtactgtattctaacataaatcaaaacaactatggaccaaattgcaaaattcgttgagcctggaaaacagtttgccaaagactcaattagattagttaaaaggtgtacaaaaccagacagacgagagttccaaaagattgcaattgccactgccatcggtttttgtatcatgggcttcataggatttttcgtaaaactaatccacatccccatcaacaacattatagtgggatcataaatatattttcatatttatgtcagttcatacaatcatcattttccattttcttagttaaataggaataccataaattatatttttacttttcatatatttatcattcaatgttttttgcatagaataaaacgttgttttgt

SEQ ID NO: 234 - DNA, 559 bp, Diabrotica virgifera
atattgtttgcttaagtaataataataatacaaaagagtcatcatgaagttcttggttttcagcttggtctttgctgtttactatgcaaatgcagctattactcccgaacaagctgagaagatcaaaagtttccacaaagaatgtcttccagaatccggagttaatcccgaattggttcaaaaggcaagacaaggagatttcgccaatgacgacaagctaaaagcacatatcttctgcgtctccaagaagatcggtttccaaaacgatgccggtgaaattcaagtggaagttctcaaagccaaagtgggtgctgccttagaagatccagctcttgctgcccaattgatcggcacctgtgctaagcaacaagcaaatggacccgaaacagcctttgaaaccataaaatgctatcacgaaaagacaccaattcatcttagtattatttaaatattttgattttgttataatataaaaaacttcttttttgaagagttgttataaaataaattttttatcattaaaaaaaaaaaaaaagggcggactagttctagatcgcga

SEQ ID NO: 235 - DNA, 999 bp, Diabrotica virgifera
aaagcatccattttgtgaaaatagccaatctgtcaaaatataatttatatatcgccaaaataattaattattgtgattttttggtgtaaaaagtctttaatctagtaaaaagcaagtttagtaccggaaaaatgggagaagaaaaagattctaaagagagagatcgtagcagggaaagaaatgaaaaggatagaaggaaaagatcacgttctagagagcataggcgtagatccagatcaagaagccgtggaagaaggaggtctcgttctccatctccaagaaataataaacattcttctggttattccagaagacgtaaaccatctctatattgggatgtgcctcctccaggttttgagcacattacacctcttcagtacaaagctatgcaggcagcaggtcagattccagccaatatagttgctgatactcctcaggcagctgtacctgtagtaggatcaaccataacaaggcaggctagacgtctgtatgttggtaatattccatttggggtgactgaagaagaaatgatggaatacttcaaccaacaaatgcacttgagtggtttagcccaagccgctggtaacccagttctggcgtgtcaaataaatctcgacaaaaactttgcatttttggaattcagatctattgatgagacaacacaagctatggcattcgatggtataaactttaaaggtcaaagtttgaaaatcagaagacctcacgattatcagccaatgccaggaatgtctgaaaactccataagtgttccagctggagttattagcactgtagtaccggattccccacacaaaatatttatcggaggtcttcctaattacctcaatgaagaccaggtaaaggaactgcttatgtcttttggacaattgagggcttttcatctcgtgaaggacactgcatttggattaagcaaaggatatgcatttgctgaatacatcgatattacaatgacggaccaggctatagctggtctaaatg

SEQ ID NO: 236 - DNA, 1195 bp, Diabrotica virgifera
cccacgcgtccggacaccacacacgacatcgcggttggcgttgtccagaaatggaaaacatttgcagattcaaaaagagaatggtgtaccctgaacagttaaatttggaccaggtagtccacaaatctgctcaaaaagcctcttcatggtgcagtgaaccattggaagagactagcaataatgttaatgttcaagaaacacaaactaacggatctgtgaatgaaaaggtcgataacaattcctacaaaaatggaggaattcaccaaacgacagcaaacaagcagttcattcaagatcgcatacggcacttagtagacgctttttctaccagagctcaggccgctagagaacgcatcgaaacccccgccactccttcgtcagtcagcagtagagaaacgatcgaccaacaacctcctataccgatgaagcaaaaattgagtatttccttttctgataaacatatcgaagaaagttttgaagaaaaagatgaatccatgggtttgaaacaacgctttgaacgaaaaataattgatcctaatggtcgtttctacgtaatctggatgtcgattgccgctatgtcagtattctataacgcttgggtgattcccatgagaagtacttttccttatcaaacaaaagaaaaccgagtcgtttggatggtgttcgattatatagcagactttatttatataacagacgttttttgtattcagcccagagtgaagtatttacatgagggtttctgggtgacggatataaagttgttaagaagcaattatatgaaaagtaaaaggtttaagctagatttgttatctctgctacccttagactttctgtacataatctggggtccagaatttgtaattctacgtctaccaaagttctttaaagttcacactttttgggaattcttcagcttagtcgacaaactgttgtcgaatccttacgttatcaggatctccagaactttaatgtatatgatgtatcttattcatctgaatgcatgtgcatactattcgttttctgcctgagagggaattgggagcaataattttgtttttaatggaaaaggaaatgcttacattatgtgtttctattttgtcacccacacagtcacttctatatgacacaatcccaaagcgacacaagaactaaaatatatggtcatgaccttctacatggctgatgctgatcc

SEQ ID NO: 237 - DNA, 2040 bp, Diabrotica virgifera
  misc_feature (1821)..(1821): n is a, c, g, or t
gagatatagacggaaaggtactgatggacccctataggaatagaaatgcagataacgatcattatgaagttggttctccaatggcagtatatggatctgttcctgttgtatatggacattctgagaaccaaacgtctggcatctttttgcacaacgcagctgaacaatgggtggacatttggtacgacgaagaatctacatcaggctggagttactttatggtagaaagcggtaccttagatctgttcgttttgctcggaaatcaacccaaaaacgtcgtcaggcagttcacgaagctcacaggagtagcccatatgcctcaactatggactctggggtaccaccaatgcagatggtcctacaaaacccaagaagacaccaaattcgtcgtagccgagatgaacgccaacaatttcccgatggatgccatttggttggacatcgactacaccgacggcaagagatactttacgtgggatcctgagacttattctgatccagaagaattgcagaggaatttgtccagtactaacaaaaaactggtagtcattttggaccctcacatcaaagttgatgaggactacccagtgtatactggagcgaaaggaaaatacttcgttaaaaagcccaacggagaagattttaaaggtgattgttggccaggtttatccagctatattgatttcctggacccagaagctcgagactactacgccagttggtacagctacgagaaatttaaaaaatcaactcccgttcttgctggagtatggaacgacatgaacgagccatcagtattcgacgatgagctggaaaaaacgttgccttttgatgttttacaccatggaaatgttccccatagagatattcacaatatttacggttttcttcagaccatggctacacaccaaggactgatgcagagggacaatggtaccaaacgtccatttatcttgaccagatctcacttcgctggaagtcaaagatatacagcaatgtggactggagacaatacggccgattggcctttcttgcaagtcagttattcagaatgtatcttatctaatattatgggcttggtattttgcggagctgacgtcggtggatttttccacaatcctgagacggagctagtccaaagatggtatcaggcaggtgtctggttgcctttctatagaggtcacgcagaaaataacacggatagaagggaaccctacatatactccacagaagtccaggatgttatcagaaatgccctcagactgagatacaagcatataccggtgtggtataccctgttttacgagcacaccagaacaggagatccagtggtgagaccaattttctacgactatcccggcagcgtcgaccaggactatcatatattattgggttccaatatattagcaaggcctgtgatggaaaaaggagcaagatcggtgactgtaaatttccctggctcagaagataatcagtggtatcgagtagatgatggttcgtttaaaatctacaatgggcaatcttctgcgatcttacccgtaactattttaacatctccatatttctataaagcaggaagtattattacaaggagagacgaagaacgatcatcaactgctgaaatgcaagacgatcctttcgttttgtatgtgaacgtagacaaggaaaatacagccagtggtaatctttatgttgacgattacaccagttttgaataccaaaataatcaaagatacttctatgcaaacctggcatatcaatcaaaccaaattgatattagtatagtcgatggtaatttcagcggcatgacagtcacattgngtcaagttattgtacatcaacagtctgataaagatgagaagagatacacccgtaccgtctacacacatttagcagatggtacacccctgaagaagtataatatagtggaaaagttgaaacggaacaatatggtttctttaaaatataagattatgaaattcgtgtgataaattattgaatattataagatattattttaaataaatgtttaattttact

SEQ ID NO: 238 - DNA, 1165 bp, Diabrotica virgifera
accaagcgtccgaatgattgtcataaaagctaaataactcgttcagtgtcaacgtatggaaaggtcagacaagatgttaagacctttactacttttggctttgatagccagctatgtttcgtgtgcgaatcacaccatatacaaagattgttccagaataccattttgcaaaaaattgagaaccattgaaaatcactcgaagtttacagctcaattagacaaattaagtcaaactggcaatgtgatctcgattcctctaacaaattccgatagtcaggaactaatcctgcaaatatctttactggtccatgaaactgcaaggataaaaattgccgaaaagggtagtaaacgataccaactggctgatgttttggcggaagaaccacaaactttagaaatatcagcaaaaacatcagaaagggaagtatctatagcaccaacaaacgcatcatattcgtacaaagttgtagtaactacaggaactagtttcaaagtggagttctattacgacgacaacaccaaagagattgcactaaacggggaacaactggtgtttgataaggaagacaactccttcgcatttgcaacggaattcatcaatgccaagagactctatggtttgcatcaccatccagtcaagctagaacttccatcgacaagagatgtagacggaaaggtactgatggacccctataggaatagaaatgcagataatgatcattatgaagttggttctccaatggcggtatatggatctgttcctgttgtatatggacattctgagaaccaaacgtctggcatctttttgcacaacgcagctgaacaatgggtggacatttggtacgacgaagaatctacatcaggctggagttattttatggtagaaagcggtaccttagatctgttcattttgcttggaaatcaacccaaaaacgtcgtcaggcagttcacgaagctcacaggtgtagcccatatgcctcactatggactctggggtaccccccaatgcagatggtcccacaaaaaaccccaaaaaaaaaccccaaatttcctcccaaggccgaaaattaaggcccccccattttcccgcagggggtgctcttttgggtgtgggaaccttgtaaataaaccccacgggcgaaaaagaaaaatttttatcttgggg

SEQ ID NO: 239 - DNA, 1603 bp, Diabrotica virgifera
gaagaaaatagccaagaatttattgatgataaatataataaattataaacaaataaaacgtaaaagaaaagattacgttcaaaagttaattcaaattaaatgaaacattaaatcacgatgactgatagtggaccttctgtaaagagatatcgacgagaagagaatagtaactctgattctgatgataattacgtcccctatgtaccagttaaagaaaggaaaaaacaacaattgttaaaattgggtcgacttggacagttaaaagaaacagagcagaataagccaaagtcttcaagtgaaaatgaaacaaacgaggatgaagaagaagatgaaatttggggaagaaagaataacattccattacttgaccaacatactgaattgcgaaagttagctgaagctaagaaggtaagtgctgtagagaagcaattaaaaaaggaagaagagattttagaaatagttgctgaaaagaaagctcttatgggtgtatctgaattggctaaaggtatacagtatagagatcctataaaaacaagttggcatcctcccagatacattttacagaaacctccccaagcgcacgaaaagttaagaatgagtcttcgtattttagttgaaggagatgaaataccacctcccttgaaaacattcaaagaaatgaagttgcatgaaggtattattgctggattgaaagagaaacatataaagaaacctacacccattcagatacaaggaatacccacagtgttatctggcagagatatgattggtatcgcatttacaggattaggaaaaaccttggtctttgtcttacctttaataatgttctgtctagagcaagaagtaaagctcccttttataaaaaacgaaggtccctatggattaatcatttgcccatccagagaattagcaaaacagacctacgacatcattcagcattattccaacagtttaaataaacatggtatgccattaataagaagctgtttggctattggtggagttcctgtaacagaagctttagaagtcattcaaaaaggtgttcatataatggtggctacacctggtcgtctaatggatatgctagaaaagaaaatcgtcaaattaacagtgtgtagatatctttgtatggacgaagcagacagaatgatagatttgggatttgaagaggatgttcgaacaattttttcttattttaatggtcaaagacaaacactgctcttttctgcaactatgccgaagaaaattcagaactttgcaagatcggcgttggtaaagcctattactataaacgtgggacgagctggagccgcttctatgaatgtagtgcaagaagttgagtatgttaaacaagaagcaaaaatagtatatctcttggaatgtttacaaaaaacaccacctcctgtattgattttcgcagagaaaaaacaagatgtcgacgccatacacgaatatcttcttctgaagggagtagaggctgtagcgatatcacggtggaaaagatcaggaggagcgatccaggtctgtggaggcctttagaaaacgataaaagatgtactcgtagcgacagatgttgcttccaaaggtttagattttcctgata

SEQ ID NO: 240 - DNA, 1138 bp, Diabrotica virgifera
aaagaagaaaataaattacagaatttataaattaagaatttttttgcagttttattttatgttggtttgaagtttgaatcatgtttgtatttgttattaaaatttctacacctttggagtagcaacgaattcatatattgatattagcctacaaaatacaaacatattttgttctatttttgaaaaataattttctcatatatacattataatataatgtattatctcctattctgttagaaataattaagtattcctcttatttttttaacattcagaaattaaatatggaagaagattacgatgataggccttgggatggtggtgatagacatgatgattctgatgctggagatgaaccagaaaatccagaacaagttctagcagaatgtgctgagaaattctcaaccccagattatataatggaaccaggcattttttcacagttaaagcgttattttcagtctggaggaaatccattacaggttattgaagaattatcacaaaactatacggctgtggcacaaatggcaaatttgatagcagaatggcttataattgggggtgtgaaagtaacagatgttcaagctatggtagaaaaccacttgaaagaaatgattttaaaaacttttgacccaaagaaggctgacactatatttacagaagaaggagaaacacctgcttggttaacacaattaatagaacatcctacatggagatctttgatttatagattggcagaagaatatccagattgtcttatgttgaattttacaatcaaacttatttccgatgctggctttcaaggggaaataaccagcatttctacagctgctcaacaacttgaagtattttcaagagttcttaaaacatccatcacaagttttcttagcaatccagaagaatggcaaaatactagtaaagaatgtgctaaaatggtgtgccacgggcaacatacatatgtatatagtcaagtgattattcatatattggcccgtgagtcaaaaggaggaagtagcatgaagagattgtcacaagagattactaaatgtgcccaaaagaatgggaatgatgttactcctattacaatggcattaaatggagcatctggttacccctactgcttgtcaagcattga

SEQ ID NO: 241 - DNA, 1029 bp, Diabrotica virgifera
gtttaaatgttgatagtttataaaagtgtaatttaaaataaaaacttattgaattagattcagtgttgtttggtttaattattttgtagaaatatttactattaaacagtatgacaactaaaaacgcgaacagtgaacctatagtgggtccacctaagaagaaatttaaaaaagatgggacaacagacaagtctaaaaagataaagaaatcagtcgaaggtagtacaaagcatagtaaaaccgacaagccagcaccaaaaaaagattttacaaaaccgaactctaaatttgtctccaataataattttagagataaaaagacaggaaagtttgataaggataaaaataaaccagaaatatttgaaaactggaatgagtttaaaaagaaaaagaaggaactgaaactcaaaagaaggcaaaacaaagatggatttgatgtaatagtaaaagcgaaaagaattggtgaggaattaaggaaaaaatctctgaatggaggagaacaaaaaagggttcaactgataaatgagctgcacagtcttttaaaaggtggaggtcattatccgaaatttgttcttgcacatgatactgcaagaattgtgcagtggcttttgaaatatgcatcagatttggtcattaatcaaatatcaaaagaactcattccagtcagtgtaaatatgttacaatcaaagtatggtatccattgtgtaaaacgacttctaaaatatggcaagaacgaaataagatctcaagttatagatgctatggttggccatgctgtgaaactgtcaacacgcaatattagtgctccggttgttgaatatgctttttccacgtgggccactcctctacaaagcaggaatttggttgcagaattttatggagacctttacagatctaaccaggataacaatgtcaaacatttaagggatacagaaccagtttatccataatccaaagatgcaaatttagccattttagggggtcccaaaagctaaaataattgaacatatcccttttgggatttttttg

SEQ ID NO: 242 - DNA, 1800 bp, Diabrotica virgifera
tgcaaacctagcgcagcgcacaaaccagaatttaatttcaaagttcaataaaattttaaatcaaccgcgcctgttctttgctctagttggttgtttctgacgtaacccagaaatatcaaccaatagcaaatcaccacatatacagctggtgactggtgccatgtcaacaaaagtacaaaggtcgataatttccataaatattttattcagtatagagaaaagagtgaaactgtagagattaaattaaatggtgatagttgtctaagtaaaacaaagtaaatgagtaaatattgaataataataataatacagtgaaataacaagtgtttactttaaaaataaaaagttgaaatttaaagaaatattaacaattttaatcaagcaacaatgacgacgacagtgtcatcaatattgaaatttttggaaaacgcagataaaaattttgccatggatacagatgcagacattccaaaaagcaaaaagagaaaattggaccatttgacatgggaagaaaaattacaaaggaagaaattaaagaatcgtgtagcagcccaaacttcccgagataggaaaaaagccaagatggaacagatggagcaggctctccagcagctctttgtgaaaaacgagtccctattagtcgaatgtaaaaacctcaagctcgccaaccagaagctccaacaagaaaacacagaactgtacaatcgtctgcaggccccttgtctgtcatgtgcccaagctcaaaaccgttctgtcgggtgtgagtccctaaatggatccacagcgtccctccttctgccgaaaggaagagtcacacacccagcagcggctttgagcaaacagcagacaatggtcttgttgaaaatcgtactgacctgccttctttaccggacctccttgatgaactcgaggcagacgtcgaccttaactcgttggaacaactcactcagagcctccttgaagatatcgccagagacttggaagctactgctcagaaaacaagtaatgaagaatcaggaagtaatggaagtagctatggagaaatggtggggacgacatcaacagagttggaatccagtgggtgcacaaccaatacgaagtcgctagaaagcgacatctcggagtatttgctgcttcaccacaactatgctgctaaacccccattagacgacacattaaaaaccaagagcccaattaatagaaacagaaaattgaaaaccatcaaaccaaaacgcaagattgtcactacaaaacctgttgtacctgaaagtgatgtggtttatggaacacttgatgaagttagcaatgttgtcacgataatagtggacagtaatggagtaccaatgacagaagaagcgttacaaaggttagaaaacagagaggaggaaacccaactcactgttcccttacctcctgtaacacaaggtgaattggttactccgttaccagttgcagaatcaaacagatctacttcatcatctgttgcagaatcacacctcactgttccaacagccatgctagaatgtttgtctccaatgtcctgcagtgactctgatcgaggatatgaatcattagattctccgattagtttacctgaagatctttgggaccaaagtatatcagagctatttccatctttactctaggtttaaacctctaacatcgtgtacagtttaatttaaattaggttacttaatttattttttacttaaagagtgatttttatatatatttgttatattgtgtatattttgtaaatttaggtaataaagttgtggatgtagcagatctaaaaaaaaa

SEQ ID NO: 243 - DNA, 1443 bp, Diabrotica virgifera
agccaaagcgttgatataagaaatgttattgaataaccaagttacaaaatgtgttaaggcatatagacatgtttttttgaatataatactactactaaagtaaaacatgtgttcacaaagagaatacaaaattttataaggaagaatagtggactctcagaaaacaaacacaataaatctttgttataattcatgtgtgacgatttatggtgggtctctagcatcaaaaatttgaattttgatattgacgatatgtctatctattaaatatgttgaaggagtaaatggaacgtattttcagacattcttaacgaaaaggatgtacctacctcactaggtaaaacaattttaaagttaaacgttaaaaggttacgctgaagttgtcaaaatcattctaaaacaatattgattttattttacattattgtttaccaaggatctttattaatattgcgacacttaccaacatagaaccaactaaaccaacaacacctagaagcagatcattgataaaattttgtactttaacatcaatactgtttgcatcaataatcacaactagcgatgtcaacatattagttaagaacgtttagcgcttttaatagattatgatatttgacatttgctggaacagttccagtgataacgattatatgcaaaatatgctgaaatatatcgatgatgggagagctattagatagaaaggtaggacattatcttctattgcttgaactaaaaacagtaaaaacttgctcaggatgtcctattctttgcttaaattatcaatgaatatatttttatcaaatcgactgtcatttgctcactcgttgactggacggaatggtaggaagtcaatgtttcaatacaataaatgttttatgagatataaaccaaggagtactgacagcatacacacatacagcatacatgctttgaaaagcagtacttggaaattctggaagtgagcttgtacatatgtttatgaacatcccaaagacaataccaatatttttaattatgctgcgcgtcactagaccatctttctataaaatcttcttcaatagctttgtaagcgcaattctgacattcgaagtctaagaaaaaatctctcaataatatataaatgtaataatcacttgcaaggtataatacgttatgagtctactaaaaagaaacaatctcaaccacacagaagctgcaaaggcagcacagcaaatgttacgatggaagcagatatgaagacgaagaaaggaaaggctcagaacgagatgactgaatgacgtagaagacgacctgacaaccatgaacatatagcgatgcatgacaaggccacaagagagatctgaatgtgaagacatatctagacagacaaagaccgatccagggtttatgatgccacaagatgcagaatctcagacacatacggtcacagactatacttat

SEQ ID NO: 244 - DNA, 1246 bp, Diabrotica virgifera
attatttatctaaatataaaaattattttatatatttggacctttcgtactaaaatatattaataaattaaagatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctagttatccctaaggtaatttattcttataatcaaaaaaattggatgaaaaaaaaaactgtctttatttaatttataaagaattttatttttaagtgaaaaagcttaaatttttttaaaagacgagaagaccctatagagttttataattttataaatacccacgcgtcctcttattcaagcgatgatttttattatattctctttgctagcctttgttggcctagctccttctatagatgctttagaactaactccagttgaagggggtctaagtggtaatggttccacaagccggtattgggactgttgtaagccagcatgtgcttggccctcaaatgttccgcatagtccaaggccagttactagttgtaaagctgacggaataacaccaataaatccagacgctatgtcaggttgtgaaaatggtactgcatatacgtgcacaaatcaacaaccatttattgttaatcaaacgtatggatatggatttgcagctgcttatttaattggtggaccgagcacaaacaacttttgctgtgcttgtttcttgcttaactttacagatcaaataaaatataaacacatggttgtacaggtaacaaacagtggtaccaactttgataaaaacgagttcgtcattgctctacctggaagcggtgtcggggatcacccagaaggttgccacgatcagtggaacgctccatggacaggatggggtgaccaatacgggggagttcacatgagatcagaatgtgtgacgctccttccagaagaactacaagagggatgtaaatttagatttgattttatggaaaccgcggcaaatccactggtttcattccaacaagtagtttgtcctgatgaacttgtaaaaattagtggttgtagaattcccgaataaaattatgatcatcaataatttttgaatgttttatatgtaaaaatatactaaaatattttatacaatacgtgtttcttatattttatataaatgaattttctggttttaa

SEQ ID NO: 245 - DNA, 957 bp, Diabrotica virgifera
gtcaaaacaaaatatttactttctctgattaatgttaagaagtgttattcggtaatatccagtaatatttaaacatttaagtaatttaactatggacgacgactttttctacgaaaacgaaaatgattatgattacgaatattctgaagaaagtacatcagagcctgatgtggatttagaaaatcagtactatttggccaaaaatttgaaggaagaacacatagaacagtcagttaatgcctttcaaaaagtactagaattgcaaggtgaacataaaggagaatgggggttcaaatctttaaagcaactagtaaaggtacatttcaggctgaagaattatgatgccatgattaagatgtacaaggacctattaggatatataaataatgctgtgactaaaaaccaaggtgaaaaagctataaattccattttggattacacatcggctttaaaagatgtacaattgctacaagatttgtatgaaattaccctatcaactttaaaacacgccagaaacgacagattatggtttaaaacaaataccaaattgggtaaagtgtatttggagaggggagattttgggaaaatggctagtactctaagacaacttaaagccactcttactcctgacagtcatgaatatgatccccacaaaggtactcaacttctcgaaatatatgcgttggaaattcagatgtatacacagcagaaaaattacaagcaacttaaagaattgtacgaacgtagccttaaagtacgttcggccattccacatcctcttatcatgagtatcatcagagaatgtggcggaaagatgcatctgagatcgggagattatgagaaggcgtacacagatttcttcgaagcttttaaaaattacgatgaagctggcaatcctcgtcgaatcaactgcctgaagtatcttatacttaccagtatgctgttggtttctgctat

SEQ ID NO: 246 - DNA, 1542 bp, Diabrotica virgifera
  misc_feature (1495)..(1496): n is a, c, g, or t
cccacgcgtccgcccacgcgtccgatttattgtaaacaaaatatttaggtttttttaaaaatataataaatagtgctatagtactgatagataataaagtcaatataaatgtacatgtgcaataatcagttttataattagtgtagtgatagtgataatgtcatccgccgtgaaccaggaggtgtataagaagtttaaaaatgctagaaaattgttaagtactgatagtactgattctactgttcaggtcgatgttagagaagatgaagaacaactcattaaactacaggagattattgacattcttgtagctgctggatactttagggccagaattaaaggcctttctgcatttgataaggttgttggtggaatggtatggtgtatagaatcgtgcaatgttgaattagatgttgatctgctgtttagagaaaacttaagcattggtcaaaaaatagctttaacagaaaaaatcgttgcagttttaccaaaaattaaatgtccacgtagcatagaaccacatcaaatccaaggcttggactttattcacatctttccagtaatacagtggttagtgaaaagatctttggaatgtcgcgaagaagtcgctgcatttgtaagagcttgtgccatcgagcagttcaacaaaaagtttcacagtccagaccaaaatcaggaaaatgtaaatttactgaaaaatatgaagttactgtccgaagtttataggcctcggcggtattataagaagaaaaattcagccccaacttcaactttatcccaaatacagtcgactctgttggaatatggacatagtgatggtgggataggagattattcgatgtttactgctaaagataaagaaggaagtgatgatcaggaatttgtagacttggatgatgaacataaggagcagcttatgaaacattacacgtctctgcagtttgaactaacatcgggcgcaggcgtccagtccagggaccagttgctgattgcttctctggaagagaaaaagcaattgtttaccgaaaaatgcaaagagtttaagataaataaagcatctttagatagtgacattaaaagcaaagccaaagttttacaagaattagaaagtaaacaaaaagaagctgaagtagctttaaaagaactatctcaagaagaactggagagttccaaagtgaaagaaatagaagagctcattatgctgaacgacgatttgaaaacacaagagactcaattcaaggagcagtgcaagaaagaactgtcaaatttaaacaatcaaatacaaaacgtcaaaaatgccaaagttaacattccagtagaaaacccttcagtggtaatgtcagaattgaatgagttgtccgaaaaaaatgcttccatgaggatgaagttagccaaagtgaatagagatgtggctatattgcatcgacaaattgatgatattccgaagagagccgaattggcacagtatcaaaagagatttgtggaatatactatnncagtgccgtcaaacacaggaatcaagcagtatacactctatacaac

SEQ ID NO: 247 - DNA, 1098 bp, Diabrotica virgifera
ccccttgccttacaccaaggttacaaacaatggctctttgacatcgatggaaacagatacttagatatgtatggaggagtttgtactgtttctgttggacattgtcatccgaaaataactagtgccatgaaggatcagatggatacattaggacattccacaaatatttattaccaaactaagatccacgaatatgctaagaagttagcagataagttaccaggcaacttagaatgtatatattttgtaaatagtggcagtgaagctaacgatttagcactgctgatggccagatcttacacagaaaagttcgatgtcatgtctctaaaaaactgctaccatggattaacttatcaggtcatgggaatgacgtcaaataacttctataaataccctgtacccggagctgctggaatgtttaagaccatgaatcccgatatctatcaaggaatatggggaggaaacaaatgtcgcgacagtctagtacaaacagacaggcattgtgactgtactggagaatgtgaagcaggtttgaaatatttagaacaatttgaatatgagttaaatcacgatattccaaaaactgggttagcagctttttgggccgaatccattcaaggacttggaggtgtcgtgcaatatccgaagaattttataaaaggtgtttacgatcgggttagaagccaaggaggattgtatgtagctgatgaggtacaaagtggattcggtagaacaggcgaccatttctggggatttgagagtcacggtatagttccagatattgttactatggcaaagggtattggcaatggctatccccttgcagcagtagccactaccaaagaaattgcaactgctttaaccaaagctgtacacttcaacacatttggaggcaatccagttgcctgcgcaggggggaatatcagtatttttagagattataaaaaaaaaaaagactacccaaaaattgtaaaatagttgggacccccccctaatattgggactaaaaaaaatggaaaatcaaatttttttcccgtgattggaaaatgtcccccgggaaaaggggttgaataaaaagggggggtgaaaatttattgg

SEQ ID NO: 248 - DNA, 985 bp, Diabrotica virgifera
gtgacggatacggatatttaacctaacctaagagttcttggagaaaactttttttttatttgaaataaaattatattttggatttctgtttatagtaaatatataaatggctatcaatcaagttaatatactttttaaaaacttgttacttcaaagccacaaagctgtacatgctagatctctatttacatccacactgaatctgagagatgttgtggatagaaaagaaatgctaagatctatgcctgcaatagatgaaggaacacatggagaaaaatctattgatattgattctgctattaccaagagagacctttttcccaccatagataccccaaacaaattatttaatggaattccttttaaagacctacctatttttaatattagagttacaaggaataatactattctttgtttgactgatgcaaaaggaacacctaaactaacaaggtcttgtggagtagaaggatttaaaaatactaaaaaaggaacaaatattgcagctcaagccacagccatttcagcaggaacaaaagcgctagatcaaggccacaagatagtcagagtaagagtaagaggactgggacctggtagaatggcttcaataaaaggactacagatgtcaggcttagacatagtttcaattacagatagtacaaaagtgtcatggaatggacctagaccacggaagcagagaaagctttaaaacattttacaattaggtatttcgtttaaaggttcggcgcaagttcccatgttcttcatagttaccagagaccttgatcgacagttttcaatatccaagaaacatgtgttgctgtatgtcatgttgtctgtacacatacagggtcgtagtatgttgggcaatcttttgacatccttgaattgaatccggcgatgcagcgtttcatgggactacctataatgtgtttcctataataaaaataaaaaaatatatattttggatatccaattcttactt

SEQ ID NO: 249 - DNA, 1208 bp, Diabrotica virgifera
gcacccaagtcctcagttaatggagaagctcaaacaagccttaggtgtaactagccaacaaattaaatcggagtcaattaaaaaagaaaaactgcaagggcactctcaagaacaacatcacccgcaacctacctcttctcattcacatagtcccagaaaattgaccaaacaggttgctctagagagccccaacaattccgaatttgaggataatggacacttcaaatctcttaagatggacaatcaaagggacttgatggttaaccacagacaacgtatacgtaaagcaggtccattcgcaatgaattcctactctttgcatgatcctagaaaacctggtgcctggatgagcccacaactctccctcaaacttgaaggaattgatttaaaacagagttcgtttagaactggggaagaatgtgtagcagagaggtgtacagaatgtggtttagtgaaagaagaatatagcgatgaggaaatcggactctgtattgtaactttaggaacttttatacaccgagaacctgcacttgctgctcctatgctacccgatatacttagcattgtagcaaaagtagcaacaaatgcaatgtatccgtggcaaactgaaagcaatattcacctacctgggggagctataagtgtagcccatcaatttttaagatgcgttttacaccaattagccccaaacggaatttttacgcaaatgtttcaaacaaatgctccagaaaatattcgaattcaattttttaagagtgttatacaagcgttaattgactttaacgaattaaatcctgtagcgcctattcaacttcttttagaaacattgaattcgaagaaaacgttacctgttgatattttgccgacaattttacaaaatatggcgtgttatttgaactgtctgcctcttgaagttgccttaggtgcaagtacacccatgtggggtacagttttacaacaagtagaaattttatatcgaaaattattgtttttgttaaatactatggatgatattattccgctgttaaaaataatgtcttcactttttaaaatccccttgatttcacaatttaaggggtattttggagcctttttccaaagttctcagttatgcaatacaaacacaaactatgaatttatggtgccttatagaattttgttactttgtgtacaaagcatttacaaaggaaagagataaattaatactt

SEQ ID NO: 250 - DNA, 929 bp, Diabrotica virgifera
cttcacgcgtccggttactacgaggacagatttctcacgcgaggaaatactcgaaagtaaaatataataaaacatccgctgcaaagtaaagcttaaactttaataagagaaacctacatttgttgtgtctaagtatttataaaaaatggcacagtggattggatacatggtttctattaagtgttctaatgacagtacttatcagggagaaattcttacagcaactacaacaaatattaccttaacaaaagcattttgcaacggatttccttgtgaacggaatgaagttaaaatcagggcagacagtatattagatctaaaattaattgaaaaacaaaaggataatttggatgaacgcagcacaattactatagcaaaacctattgccaaaagagctggaaggacacacagtacctcagaacctcatagttctgcgaataaatttgcagcaagcagtagtttacataataggtcaaaaccgatagatattgagataaaacaaactcaagaagcagtgaataattcttttaaaaacagtactcctaataaaaaagaaaagaacaatagaaagtggacaaagggatggagggatgaagagtgctttggctctcctatggagcagagcaacatcggcaaagactttgattttgagaaaaatttggcactgttcaataaacaagctatttgggatgaaattaacgcccaaaaaccagatgtggtaaaacatattgatgctagaaaacctactaagtacaggcatgatgaaaatataatctcaacgattccaacttcgtatcggcaaataaccgttccaaaacaagatttttgtgaatatgtaacagatgaccgcctaataatacccagcatttctagagcattgaggaaaagattgtgggaagtggccgaaagagttggtcttacgtgggaaa

SEQ ID NO: 251 - DNA, 1674 bp, Diabrotica virgifera
cgtgtgagacagttttgtgagcgagtttgaaaaaagctttatatgaagacatggtgatgcaagttgattcaaatagtaccttagtgttttacgtgaatggaaaaaagattgtagaagaaaatgtggatcctgaatggacattattgtattacttaagaaaccaattaagattgtgtggaaccaaactaggatgtggagaaggaggatgtggggcttgtacggtgatggtatccaaatttgatagagaaaagaacaaagtagttcacctaccagtaaatgcctgtttagccccaatatgttcaatgcacggtctagcagtaactacagtcgaaggaatcggctctaccaaaaccaagctacatccagtccaggaaagaatagctaaatctcatggttcacaatgtggtttttgtacacccggtatagttatgtcaatgtacacgttacttaggaactctccgaaaccatctatgaaagatctggaagtagcgtttcaaggaaatctttgcagatgtactggatacaggcccatcatagaaggttataaaacatttactgaagaatgggaattgatacagactggcaataaacttaatggagtcaatggtactaatggatgcggaatgggagataagtgttgtaaactacaaaaaggtattaacgggaaacatgaagacgacgaagttcttttcaatcccagtgaatttaccccctaccatccttcacaagagcctatttttccgccagaactaaaactgaacgacacttacgataaacaaaatttagtttttaaaggcgcaaacactacttggtacaggcctacaaaattaagtgaacttctcgacttaaagcaaaaatttccgaatgccaagctagtagtgggcaatacagaagttggtgttgaagtaaaattcaaacatatggtttacccagatataatccaaccagtacaaataccagaactgacatcgatagaacaaactcctaaaggtgtaaaaatcggagcgtctgcgactttagttgatatcgaaaattatcttcagaagcagataaacgagcaacaagaacacaaaacaaagatatttaaagctgtaatccaaatgatgaattggtttgctggcaaacaaattcgtagtgtgggtgctttgggcagcaacataatgacaggaagtccaatatcggatatgattcctattttgatggcagccaaagcaaagttggaactgtttagcaatgatggatcaagaacagttactttagataataacttctttgtaggttatagaaaaagtatcgtaaaaccggaagaaatattattaagtatattaataccatacacacaagaaaatcagtattttgaagcttacaagcaagctagacgacgagaggatgatatagcgatagttaatgaagcagtgaatgttacttttaaaccacagactgatattattaaagatataagttttggcataggtggtatgtcattcaagacagtatcggcacctaagactgaagcaaaactcataggattatcttgagataagacgatgttggatacagcgttcaacagcttattagaagatcttccgttagatgcaggtgcacctgctggaatgatctcctacagaaaagcgctgccgatgagctcgttctttaagcgtacttgagcatttc

SEQ ID NO: 252 - DNA, 1389 bp, Diabrotica virgifera
aaaaaagtcaaactaaccagaaatcattccaacaaatttcaataaaaacttataaattcattaatattttaattggtttgatagaatagtcgatagctcactgtatcgttcataaaaatgggaaactttagaagggacctagaagaactaaagcagtttagagatagcaatgatagaaaaagcagagaagtagttaacatttggaacagctctattcattccaatgtagacaagctgggaaaagagaaacatgtagtcctggaacaagtttgcatggcagcactagattcgttcaacctgaaaatagcagagatctgcattaaagagctgtatgaagaattcccaaatagttgcagagtacagatattggaatcaatgttacatgaagcagatgagaattttgatagagccttactcatattaaaaaatatcatcaaactggatgctacaaatagttctgccaggaagaggaaaatcgccatacttaagtcacttggcaggaattctgaggctattaaggaattaactgagtatttaaaagtgtttatggctgatatagaagcatggcaagaattgagtgaattgtatttaactgaatttgattacaacaaggcagctttttgtgttgaagaacttatattgcacaatcctcacaatcatctactgcatcaaagatatgccgatattaagtatacccagggtggattagagaatattgaggttgccaggacctactattatcaagcattaaagctaaatcccaacaatatgagggctatgtatgggatttacttaactacttcagcactgttaaacacccaaaaagcagtaactggaaagaagaaagatgcagtaaacaaactgttagagtggattttaaaagaaatcaagcagagatatgttgagaaacaacaaatagatgcattaaaggaagcagtatctgcgttagaaatctgattcagtatttatttggtttcgttttgggtgtttaaatgtttctcgtgaatggtgattacagaattgtttaattgttatttttattgcactttcttttcaaatgttctaaataactagatattcaaggactactccataaatttttagaaaaatgcacgccacaaattaaactattgtttcattttttattcattaatttatttttttactattcattccatttgtgtcataatcaatcatttcatctttgatattacgtgtataccggtaagaaatctcatttttttggaatgaaatacaaaaacatattatgtgagcgatttgaagggactttgtttcaattttatgtaagagacttttaatggaaattggttagttttaattttatttaagaatttgttatatttgaaacttaaatatatattacaatat

SEQ ID NO: 253 - DNA, 1223 bp, Diabrotica virgifera
gttttatattcctcagaggccttatatcggtaataggtaatttaagagaccaagtaatataccccgacacttacacggatacggtaaagaaaggtattaccgaagaaaatttactcgaaaataatcgactatcggtacatctagatcatcatcgtcgagagggacggattctatcgaaatcgaaagatcggactcgacatcttatccggtggtgaaaaacaaaggatcggctatcgcgcgattgttttatcacaaaccgaaatacgctctcttcggacgaatgcacttctcgcagtctccattcgatgttgaaagcttcatataccaaagtgctatagacatgggaattactctactcaccatcacacatagacctacactatggaaattccatacgcacatccttcaattcgacggtacaggatcatgggaatttagtcagttgaaccacaccagcagacttaccttgaagaaagaaaaggaggaccttctaaaagcagaaaacaacgaagaatgatcgaaaagactggacgaactaaacaaattacttggagaggattcataactacttagagattagctaactgacaagcatttactgtagatttcaaatattcaggagaagagttcatagtattcatctacgtcctatcgaatcatttaaaactacaaatcttgcctttactctttcagtttcatcctggtgatagtgctgtgataattccaaacaatttttcggactatacaataccggtaaatgaaggactctgagcattttaaaaaaagttttattttcattttttttttctatttttaatgtcaactttaaaattcttacgtgttcagtcaaggatttggcaacatctatacggcaatctagtgaattttggtaattattatgtatttgttcaagaacttggcaacaccgtacgtcactctagtcaacgtggttcggcaggtttgccgagtttaaaaagacatattgcaatgagtttaagagcaatttgaacaaaaaacacatcacaattgtctaaagaacacaaagtgtttttgtaatatatatatatatacatcaattttgattggatttttaaaaagtggcataccgttataatgcctgattagtcagaaatgaattcatctttatatcagtgtaatatgatttctctataatgaaaaaatcaaacaaaagttaaaaggacactaattttatgaacattttt

SEQ ID NO: 254 - DNA, 1312 bp, Diabrotica virgifera
  misc_feature (1139)..(1139): n is a, c, g, or t
agctgagcttgcaggtttgaaatgggagttgattaatacaaaatatggtttgattcttggtattggcggatacaataataaacaacatatattattgaaaaaaatcatggagaaattaactaatttcaagattgatcctaagaggtttaatatacttaaagaaacttacatacgaaatttgaaaaactttgctgctgagcaaccctatcaacatgccgtatattacttaactgttctgttgacggaacattcatggacaaaacaagaacttttagcagcaactgatcaattgacaatcgaaagattagaagcttttattccacaaatgttgtcgaagatgcacattgagtgtctcattcatggtaatgttaataaagaaaaagcacttgaactagttcacatagtagaagatggtctcacaacggcgatgagcatgtcccctctacttcccagacaacttcttcttaacagagagttaaaacttgaagatggttctgattattcttacgaagtcagtaacgacgttcacaaatcttcttgtatagaactctattaccaatgtgggctacagtcgaaggaaaacaacgtaaaacttgaactggtggcccaaattgtacaggaaccttgtttcaacattttacgtactaaggagcaattaggatatatagtatttagcggcgttaggagatcgaacggagtgcaagggctaaggataattgtgcaatctgacaggcatccaaactatctggactcaagagtggaaaagtttttggagagtatgctggaacacatcactgaaatgagcgaagaagactttttaaaacatcgcgaagctttagcagctcaaaggctggaaaagccgaaacagctcaacgctttaaccaacaagttttggcaggaaattacttcacaacaatatcactatgatagagcgaacgtagaggtagcctatttgaggactcttacgaaagaggatattattgatttctataaagaggtgctgagcaaaaacgcggagaagcgcaaaaaattgacagtccaagtactttcaatggcagaaggtggagccggaagaaatgccgccgaggaaaccaatgaggtcggtgatggaacttgcagcgcttccgttattaatgacngtactgtatttaagagctgtcacgagatgtatccactagtgcaaccttacattaacattacgcgaaagggcaacaaatgcaaactgtgatgccgtgattaagattaaggactaatatttttttttactttccctgattgtgcagttttactgttaataaaacacttaactttt

SEQ ID NO: 255 - DNA, 1900 bp, Diabrotica virgifera
  misc_feature (1888)..(1888): n is a, c, g, or t
cggacgcgtgggcagaaaaactcttgattgaaaataaaaaaattgtgaatattcttatcaattatagttttcctgcggtagtttccactcgtgattattttactcagtataaatgtaacgatagtttgatttaaacaaaaaaaagttggttgctcagtgattataacttaattaaattttagcaaacaatatttactgcggttgactggtaagcgcgtccattgcacattgtttaacgaaatctgaaaaagtacatcaattttagtgaggagaacgtgttatttgaaatataattataaaaaccgatccagaaaaggtttattagttaaatacaatggcaaacgaattggaaaccgaatccttggagacaagtgtagaagaaaaatcatccggaaaacgatcccaagaagatgattaccttaaccctcaaaagaaaagaaaaagcgaacccaaaaatataaatttgcaggagaaaaatccgatttcgctactaaatgagctccggctgggattgaaatacgatataattgaacacatgggtccatctcacaatccaaccttcaagatatgtgttgaagttgatggacaaaagtatttcggtgttgggaactccaaaaaagctgccaaatttgaagccgcaactgaagcgttgaagtcgtttattcagtttccgactaatggtacatttctctccaagaaaacggttccaggtacaagattggattttacatcagatcaagtcatcaacaagaagcacgacaataccttgtcaaataagaacaaaggagttaaaggacccttgatgatattaaatgaactatacccagatgctgagttcacatgcatttccaatgagagtgatccttacggtagatttaagatctctataaatatcaacaatgaaacctattacggaactggctctaacaagagactagctaaaaacgcggcagcgtcacgagcactaagcaagttaaccaattacaccagtcctagttctgctaattctgccatggaagatcttccgtttgccacgaaggaagaacaggatttggctgatactgtcggaagacttgtcaatgagaaattcagtagtttgatggctgatgattgcgtgcatatcaagcggaaagttttggcaggtattgtgaaaactaccaacaatgatctctctacagcagaagtaatatgtgtcactaccggaacaaaatgcgttgccggagattatatcagtatcaacggagcttcactgaatgatatgcatgccgaaattctatcgagaagatgcttaatcaattatttctacgatcagttagaactcttgctatcaaactcaaccaaagataattccatatttacacttaaagccgacaagaaagggtatcaattgaagccagagatcgattttcatctttatataaacacagcaccgtgtggagatgctcgtattttcagtccacatgaagaaattgctgtcgataaacatcccaacagaatatcccgtggacaacttaggtcaaagatcgaatcaggagaaggcacaatacctgtcaaaaacgctgctgccattcagacttgggacggtatcgtccagggtgaaagactcctaactatgtcgtgttcggataaaatatgcaggtggaacgtcttgggtctccaaggagctctcttgtctcattttatcgaacctatatatttaaagtctttgacactggggagcttgatgaaggagagtcatttgtacagagccatctgtggaagaatagagacactttgcaaggtctgcctccaccgttcctattgaacagaccgactatgttgagagtaacatccgttgaggtacgacagccccagaaagctcccaatttttcagtcatatggacgatgngtatgcaaaaac

SEQ ID NO: 256 - DNA, 955 bp, Diabrotica virgifera
cgaaaagatatatttatgaagcaatggatgtttttaaatacgtatattccgtgttagtagcagtggttgttatttatattgtttacaaatttttaaaattacgtagtgttttaaaaaaagtttataagttaccaggtcctccaaaactgccgatttttgggaacttctttgatttgttctactgtgattcagtgcaactatttaaccaatttcgagaatggggtcagaaatactcaccagtttatgcatttcttgtgtttggacaaccaatagtatgtatatctggagctgaagagttcgaaaaaatcgccgctggatcaaaacatcttagcaaaggatttagctacaaacttgtggaaccatggcttggaaaaggccttttaacaaattcaggttctctgtggcagcaaagaagaaagattttgacacctgcatttcactttagtattttacaggagttcgttaaagtgtttaacaaagaaactgctaggttagtcgagacaatcaaaaaagaaaataagaaatcggcaacaaatatagttccactaatttctcaaaccgctttaaacactattgcagaaacatcttttggaacaacgctcgatttgaccaaaacagacgacaaaaattacgtatctgcaattcatgaaatgggtgaaatcttgatatatagaataataaggccttggttccattctttacttatatttagtattgtatcttctgttggcgttagactcaaacaagtattatcaacgctgcatagctttacagaacgtattttactagaaagatcaagagatttcaaaccatttgaagtaaatacagatggcgaataaagaggaaaaaactagcttttctagatttattgttgaaatgcaaaatttccaaaaggatcatcgatgaccaaggtattaaggatgaagtgaatacatttatgtttgaaggacacgat

SEQ ID NO: 257 - DNA, 1651 bp, Diabrotica virgifera
aaatatatacatgaacagaataaataatattagtgaagcaatggatgtttttaaaaacttatctgccgtgttagcagcagtgtttgttatttatattgtttacaaatttttaaaaatacgtagtgttttaaaaaaagtttacaagttgccaggtcctccgaaacttccgattttggggaacttcaatgatttattctactctgattcagtgcaactatttaaaaattttcgagaatggagtcgaaaatattcaccactttattcagtcgttgtacttgacatacccgtagtagttgtcactggacctgatgagtttgaaaaaatcgcatctggatcaaaacatattaccaaaggaatgatttacggtcttgtagaaccatggcttggaaaaggtcttctgacaaattcaggttccctgtggcaacaaagaaggaagattttgacacctgcatttcacttcagtattctacaggagttcgttaaagtgtttaataaagaaactgctaggttggtcgagaccatcaaacaagaaaataagaaatcggcaacaaatataattccactaatttctcaaaccgctttaaacactattgcagaaacatctttcggaacaacgctcgatttgaccaaaaaagacgacaaaaattatgtctctgcaattcatgaaatgggaaaaatcttgatatatagaatggtaagaccttggttctattctttatctgtattttatatattatcttctgttggcgctaaactcaaacaagtcttatcaacgctgcatagctttacagaacgtattatactagaacgatcaaaagattttaaacctttcgaagttaatacagatggcgaaacaaagagaaagaaactagcttttctagatttattgttgaatgcaaaactctccaagggcatcatcgatgaccaaggtattaaggatgaagtgaatacatttatgtttgaaggacacgatacaactgccactggaatatcatggattttacgtcaattggcaacacatagcgaatatcaggatcaaatttatgaagaaatcataactgtattaggagatgcacaaaaacagccagacctgaacgacctaaatgaactaaaggtaatggaaagatttatcaaagaaactttacgtcttttccctcctgtaccatatatagcaaggacgttggacgaagacattgagctgaatggatatttgattcctaaggaggccttaaatcataacatcatatatcgcctccttaggaacccgaaatattggccagaacctgagaaatttgatcccgataggtttttgcctgaaaattgtgtaaatagacatccattcgcttatgtacctttcagtgctggacccagaaattgcattggtcaaagatttgcaatgtttgagatgaaggccattatttgtggaattatgcagaatttctcagtgaaacttgctgataaaaatgaaaaagttgaaataataactgatttggtactaaggagtgcacatgaaattaatttgaactttctacctcgtaactaatattttcgttgtgtgaactgaaacgatcaaataatttgttattatataattttttattggctgtgttattgtattttgttggcgtaattaaaataaaatattttacat

SEQ ID NO: 258 - DNA, 1260 bp, Diabrotica virgifera
gtagaagtgggctttgaatcattgactgaaagtaagttcttctgtggtcctcagtaacgcgtgagtccgcgtttgttcaatacacaaaggtagtgttagtggtattcccctctacggggataagaggacgaaatgatcggccatggactggggttcctggtcgtggcgatagggatattggggagcgtgactgggcaatttttgagtaattaccccgctgagaatcgaaccggtgtctttggaagacattctagaattggttatggggggagaggatatgaggcagaaaatctagaagaaaagtctgaggatgcttttccattagatgaagatgatgaatatgatgataatttaaggggagaccttagtgatgacggtgataacggtgacaacggtgaggacgatgactacataagtccggatgattttgcacgtggatacgacactaccggttcgtacaatccaggccgcgccgacgactatacaacaactgctcctgaaggcggagaaagcagagctgggtcgtatcctgatccaaggtctaatcccgcagaccctcgctacgatcccagatacgatcgtagacatccaaactacgacgagagactagatccaagcagtgacaggtatgatgcccgttttgatcccagtagtcccagctatgatccaaggactgcacagtacggcccacaatatcggacaaattcaggatcatctggatcacaatataatacgataactggatcagtttcaacttcaggaacagcaggtggaggacaatacggtccaggtgggcaaccatctggctcttcttatccaggcaattcacaatctggcagttcttacggttctggttctcagtcgggaggttcttacagttctggttcacaatcaggagggtcaagtccaaatgccggagctccttatgccccaagtccgcaaggaggaagctattacaatgccggttctagttctcaatcaggcagttcttacagttctggttcacaatcgggaggttcctcaagcccaaattctggagcaccttatcctccaagttcgcaaggatcaagctattacaattctggttctagttctcaatcaggtagttcgtatggatcaaatccttatggaactagtactggatcagcttccgcatcaggatctatttcaggatcaagtcaaaggttcaggttatttcaccaatttatggttctagttcacattcaggagggaagttactcttcaggaggatcgtttcgg

SEQ ID NO: 259 - DNA, 2017 bp, Diabrotica virgifera
ctcagattacaaaagaaattagtgacaccagacgaccagaccagctgaagccggacatcatcgtacaacagtttgatatagtattatccaccaagtaacacaggaaacatgaattcactaaccagacagttatttaggaccgcgaaaaaggcaggagcgcgcaacttgagcgtttcaggagtaaggagacaggaaccacagcccgctgaattgggtgcgcaatttggcagggcaccattgacacatttgactgaagatgaacaggtcatgaaagacacagttgcccgcctggcacaggatcaaatcgcccctttggtccgagaaatggaaaatgaaggaaaagtgaaagactccgtgttgaaaatgttgttcgaaaatgggcttatgggtatagaaattgattcggactatggcggtgcaggatgcaatttcatgaccacggtactcacagtcgaagaaatttcaaaagtcgatcctgccgtagctgcccttgtagacatccacaacaccctcgtgaacactgtgataataaaattaggtaacaaacagcaaaaggaacaatatctaccaaggctagccacagatatggttgcaagttttgccctctcagaaccatcctcaggatcggacgccttcgccctcaaaacaacagccaaaaaagacggatctgattatattttgaacggctccaaaatgtggatctcgaattcagacatagcgggagtgttcctgatcatggctaacgctaatccttctgcgggatacaaaggaatcacatgctttatcgtagacagagacacccccggcttcagcgtagccaaaccagagaacaaacttggaatcgtagcttcagggacctgcatgttaaacatggacaacgtccgagtaccagaaacagcaattttgggtgaattagggcaaggttacaatagcggcttccattttgaatgaaggaagggttggaatcgctgctcagatgatcggattggcacaaggatgttacgatcacacgataccgtatactttggagagacaacagtttggaaagcccattttcagcttccagggtatgcagtaccaaatagccgaagtagctacccaaatcgaagcggctcgtcttctcacctacaacgcagctcgtatggtggaagctaaagtaccattcatgaaagaagccgccatggctaagttctatgctgctgacattgcccagaacgtcaccgtcaagtgcatagactggatgggcggagttggcttcaccaaggacttcatccaagaaaaatactacagggacgtcaaaatcggcagcatctacgaaggtactgctaatatgcaactgagcaccatcgctaagtgcatcgagagggagttcaagcaataaattcgacgatactgaactgaccatttcatcttgacaataaattgaatataattgagctaacataattgagtaaacattaaaaataaacacaaacatggcaaataggtgtccaaatcccatattggcaacccaactctactgccaatgcattttggatattttatcaagcactgtcctaacgaaacaatccataaaatcacattttcaaacgaccacgctaattacagacatattgtaggagagctatttcctatatagtaggaaaaaatagtatacttggcaacaatgatgcgtggtagcaaaagtacgacaaaacttttaggcctgctaacaggtggcgctagtactaactaggattgaattttattaatattataaatgtaaaggatttctggactcaaatactcaattatagtatttttagacacatctttatatagacatgtgccaaaataaagcatttcataacttttgtaaatataaattcatcgttcacgcggtattttcggtatatgtattttaattttttagtaattttaatataagcgtctactgtaattcgttaaatgattatctttgtatatattgatatatttttatattatacaagtatttgtcaataaataattgttctcc

SEQ ID NO: 260 - DNA, 1442 bp, Diabrotica virgifera
cccttaacgcgtccgatttgaacttaaacataacgttaacacttctataagtatttgaattgaacttttattcagttaaacagaatgtatttatacagtttttcacttatagttttgaacgtacttgtgctcattattagtgcacaaaaggtgcctccaggagtaccgccacagcgttatcagcaacctccccctccacaataccaaccgcaagtgcctcaacaacaataccaacaacaccaagtgcctcaacaacaatatcaacagcccccaccacaacaacaacaatatcaacaacctcctccacaacagtatcagcaacaacaacaatatcaacaggtgccccaacaggtccctgtaccccaacaaaatgtaccagtacagcaacagcaacatcacgatcatcaccataaccatgatcaacctcaacaacttttaaatgctgctaatgttgtccaagaaaaggaccatatagctgaacatatggacgtaccaattgatacaagtaaaatgagcgaacaagaattacaattccactacttcaagatgcatgatgctgacaataataacaaattggatggttgcgaattaatcaaatcccttatacattggcacgagcaaggcaacaaagaaaaaactaacgaagagatgagaatcttccctgacgacgaactgactaatctcatcgatcctattctaaacgtggacgatgctaacaaagatggttatattgactatccagaattcattagagctcagcaaaaagcgacaggaaaaccccaggtttaatatggtgacgactcggcgaaaagtctatctgacgaggctatatctgattatgtcgatgaattcctaactcgcatagatcccgacaatgacggatacatcagttatgtagaatatcgaaagtatgtagacactgttaaaacacagtaatggaaatttaaattgttatgggtttgaactgaaatttcatggaattttatttagggcaggttggggtagatttggacattatttttcagtataggaatatttttaagacataatattttatgagaaaatgcacaaatcaatagttgtatctggtgtttttggatacacatcgacaaaactatgaataacctacgcaaacatagaaaaaagcagataatacgaaggaacgggacctatgttgtctttataaaatgaataaacaaacaagagattccagccctagatatcaaggtctactggagttggcacagatcttcactaaagcagggacacctattggacctatagaattgattatctgggaaatctatactaaacgctagagaatattctgcattttctaataaatggtttttctccactgttgcaggatgccattgtgtgacgttattttaacacacttattgcagaacattgtttatatttacactcactgatgatgatga

SEQ ID NO: 261 - DNA, 972 bp, Diabrotica virgifera
cgtgttcttcaacagaggctagatttgaacttaaacataacgttaacatttctataagtatttgaattgaacttttattcagttaaacagaatgtatttatacagtttttcacttatagttttgaacgtacttgtgctcattattagtgcacaaaaggtgcctccaggagtaccgccacagcgttatcagcaacctccccctccacaataccaaccgcaagtgcctcaacaacaataccaacaacaccaagtgcctcaacaacaatatcaacagcccccaccacaacaacaacaatatcaacaacctcctccacaacagtatcagcaacaacaacaatatcaacaggtgccccaacaggtccctgtaccccaacaaaatgtaccagtacagcaacagcaacatcacgatcatcaccataaccatgatcaacctcaacaacttttaaatgctgctaatgttgtccaagaaaaggaccatatagctgaacatatggacgtaccaattgatacaagtaaaatgagcgaacaagaattacaattccactacttcaagatgcatgatgctgacaataataacaaattggatggttgcgaattaatcaaatcccttatacattggcacgatggtgacgactcggcgaaaagtctatctgacgaggctatatctgattatgtcgatgaattcctaactcgcatagatcccgacaatgacggatacatcagttatgtagaatatcgaaagtatgtagacactgttaaaacacagtaatgaaaatttaaattgttatgggtttgaactgaaatttcatggaattttatttagggcaggttggggtagatttggacattatttttcagtataggaatatttttaagacataatattttatgacaaaatgcacaaatcaaagagtgtatctggttgtttttgaatagtcatcgacaaaactatgaataacctacgcaaccatg

SEQ ID NO: 262 - DNA, 942 bp, Diabrotica virgifera
ctgatatggctgcatgtcaatgaagatacactccgtagtgttgttttcacatttttatcaacaattcacttaaagttagttgatccaacgagaatttagaatttcccatgatcggcgtgaggtcagaaggtagtaccaggcgtaccgcaatttgaagaacatactataaaaataatagtgatcgtggtggacatttttacagtttgacgtcaataaccaagaatgcgtaaggcggagcagagtgttttatttgtttttgtagtattcttttgttttaatgtgaaaggacaagaccaggaagtggatgatgaatgcttcacagaacaagggtcgctaggagtatgcaaatatctcacgaactgccaaagcgccaaagataacattaagaagggcatatatccaacggatatttgtggatatgacgtaacacaagttatagtgtgttgtgtaccaccgagacaaccaacacctatcattagagaaccgccaattataacccgacctcctccacaagttataactccgacaccaaaccgagttggtaatcagccaggtgataaggccaatgcaatgtgtcaagtatattctcaatatgcatatgagaagattgagagtcctacattgtcagtaataacaacattttcaaaaatattggactgtccaatttctacgcaacctctgattgtaggtggaactaaagcaggacgaaaagaattcccgcatatgatccaaattggttatggctctcctgatacaagttgggactgtggaggtacattaattagtgagaatttcattttaactgctgctcattgcttgcgcggtggcaaaggagacgctaagtttggcagaggtggtcttgcaaatcaatcagacacacaccacccttcaagtcagaaatatcattaagctaataaaaacaccccaggtacaccttcgcaa

SEQ ID NO: 263 - DNA, 1331 bp, Diabrotica virgifera
attacttttagcttttagtatcagttaataacattatgaattaaagaaacatgagtgttatccgcctaagtccctctgtttgccaacggctgttaggctgtagatatgcatcaacaataattcgtcatgaggaagaatacacgtccagtccgaattacccccctattctcgatctctcatacataaagaaaagggagcggaaacatgatagtgtgtatgacgaaattaaagcagtaaaaactatagaagaaaagcaaattaagctgaatatgccgaggtattacggattcaaaagttatatgttgcttgaagatcgttgtcattataacaacctgcctcttacacaacacgttacaagaacacatcttgtcgtaaataacgacttaccacagttctacaaagagttaaatgtggacgaagcgactttacagaagttaaaatctgaaatagaagatgtgatttctgtagaaatagatggctaccaaagaacacatgatcttaaaagtgaagatattaatgaggctaaagttgaagatttgattagtagttccgttactaaacagatcaatagaataatattaaatgaactttcggcaagtttaccccatcttaaaaatgcaaagatcgatattgatccccgaatcgaatcctcttggtattgtggtggaatcgatcctccagaatatgcaaaaaaatccagagaaggaatgaaatggatgaaggaccttgtagatgaaccatttgataggcttatggtatacatcggaaaccctaatttatcattaaggtcagaattaccactgaaaccaatagtatctcatgcggaatcagaaaatcctgagctagccgtacctgaatttaattatgatccaagggtggttgggattacttcagaacacaggcacatagctaatttaccagggttttggcctgatgatgataccaaattcggtctcatgtctttccacaaacgtagctatatgcatcaccgacaaaggtacggagatgcacaggatgataaagaagcaattcatcgtaatggagttttagcctcgtttgggtggttgcaagcgcaagccaacttcttgggtttcaatacgttcaacgatttgacgtatcctcttgttacccagactgttgtaactgatggcaaacactggtcattttatgcttatcagttaaatacgattgttttctgtgagaggttttacaaagaaaaccagaaaagaaacatttggctggggtacccccgaaatgcagctattcgattcgattcaggatggtaaggtgatcggttttaacgacgaagtcctcaaaactttgcttaaatt

SEQ ID NO: 264 - DNA, 1408 bp, Diabrotica virgifera
gtaacaactgcaggattcctacaaatgatgaccggttctggatctcaaaataaagaaaacgctaacttagatcaactgacagagcctttaactccaagtccagggaaaaattctacaagtaatatggaaaacctatcagattcagatttacagacgcttttgcagaatttcaaagatctatcaactgaagaacaacacaatttaataaattatttaaaaaagctggagcttcaagaacctgaccgagtggaaaaattaaggaaatttgtcagtttagattcaaattctaaagataaagatgatcaaaaagaaacagaaaacgacgatgatgaagataagccgaactcgaaacacggccaaaagagtccctcttcaatcagtaatagtaatctgattgacattgattccgaggaagaaaatgaagatgaggaaaaaaaagaaacaggatcagataaacaagatatacagatagaaagaatagattctgatgaagaagaatatacatttgacgatgttgttaaatcagtcaaagataaggaaattgaacgtacaaaaactgtattagaagataccctcaagtatgatagcgcaaaacccaacttaaagagtgctaaagatttaatatcagatcttatgagtaatattaccaaaaagaatgcttctacatcgaaaagtgttgatttattaggattggggaaacctcctgcatctaatcctcctatgccgaatgttgatttaagtaaactattaggtattaatattgcaaatctcgctagtatagtaaataacgttaaaagtatgagttcaaatgacaccactatctcaaatattacccctggatcaccaaagagaagtcaacacaaattaaattttgatctttcgcaacttacatcgcaacttacatcgcatcttacatcagacgatactaaggtttcgttagatgtagacaatcctttagcattcggtggaccaaataaatttggtgctactcggcttggtccaggtaatttggatagatttccacttgatcaaaatagattaccagttggcggtccaggcatgatgggagccagagttcctgaacgattgggacctggacctggaggaccaaatatgtttggacatggaggtcaagatagatttggacgtggaggaccagatcgttttggtcctggaggaccagatcagtttggaattggagtaccaaatcagtttggacctggaggaccagatcggttcggacccggaggaccacctgataggtttggacctggaggaccagatcgatttggtcccggaccagatcggcttggtcctggaccggatcggcttgatcctggaccagatcggcttggacccggaccagatcggcttggacgcggaccgcaccagattgtccccgctaaca

SEQ ID NO: 265 - DNA, 1522 bp, Diabrotica virgifera
caatacatcaagcggtattctcttaaacaaattttcatgtctctcgtaaacgacagccttaactatctgttcaataacaggtgtaaattcttctatgatcagtttatagtgttcattaagaatctggttcgttttttggctaagttcattgtcgccaccgaaaagtccatccaacactgctacgtatttaccaattattatttttagatcggtctttttaattgtcaaatattctactccttttcggtatactcggtcaagatctagtgaacctgatgccttaatatttgttaaattgccttcggcatggccacccgcatccaaattcaaattcagtagtatccccttcattgtcgcatcagcttctacccctatcgaatcccattcaaagcttaaatccaaatgcattttcttcgcatcatatttaatgtcgaccaaagtaaaattctcgatatggtacaaattgatattgcgcatgctaattttgatatgtttattgggttcaagttctgctttttctattatcaatggagcgaattggggtatgtagagttcgggaacaccttttgctagccttggttggagattctttatatttctagccagacactcgtccattttcggatcatttcgattacatggttccacgaatggtgctaaaattgtgtaaaataattataaattgtaacaattttaatttctactctcatgaaaatggaatggccaaaaatagatctgtccatctagtttttgtagatcctaagatacactatgattcgaaacctagaaccaagctattacgccagtcaatgggagcaagaatatgatattacctccgaattctatcctactgcatggattttaattaaattttgggactagcctctacttatctcctaattcaaagtctaccctatgccaatgtgtgcttttatcttgggggtgtttcccaccccttgttaggggtggaaaaatttttgattaaaattgccacggaattcgctagagaacctaattctaagcaaaaactgttttataattttttttgaaaactcaatacttttgagatattagccattttcattgaaacataataccttttcgaacggttttttgcgaataccttaaaagctatgcatctaactaaaaaaaactatattaaacatttttgtaggttataaaaaaacaaagagacacttgccttgataaatcttctagttataatacacatagagatatggtaggtgaaagtagtttgttttttggtacattctcaaattgctgtattcaacttgaaataacagagaaacggtcgattttaggtgtataatgctaccaataccttttgtagtgcttgaaaattcctttaaaatgagctatattaaaggcccattacattaaaactaagcgagatatgctgcaaataaaattgataagtaatgtattttaagaaaaatgagaaataattttaacccccatccaccaaaatgtaaatgcatctttttcttccacaatacctttt

SEQ ID NO: 266 - DNA, 831 bp, Diabrotica virgifera
attttaagtataaatttagacatgtctaagacttcagaaggtgtccaatacacgaagacgaagtacaaccaatcagtgtgaacgacataagaccaaccttataagaaatgaaaaatgggaaaagactactggacctgtaaacattgttattgaattgataaaactcagaccatcagcccatcagtactaaatagaattgttagcagagatctttaataaatgtctaatcaaataagaaaatagttcagaagattggtgcttggcgtatacagggagtccagaaactctaccgacaaacgaagacaggacgttcctcagataattttaagagaatttaatccaattcacctagtccgaaaatgcttcctaagggagctagagctctttgaagatggcgtcttttaattagtttttcttaaatgcctccagaacagttctagttagaaaaacgaaaattggtacacatatttgtcttccagagttatttaagacctcataattaaagatgtctaaagtaggatgttcttcaacatcaagccaacaattcgagggcgaagcaccctcctttgtggcccaaaagatgtgggaaatgtctaatgctgtggaagttgtaagttcagtatatgaaatatatcgttacgataaaaaacagcaacaagatatcctagtcgctaaaccatgggagaaagatccacatttttttaaagatatcaaaatttccgcattagctcttttaaaaatggtcatgcatgcaaggtctggaggaaccctccagttaatgggattaatattatgtaatgtagatggaaatacaatgtttgtcatggactc

SEQ ID NO: 267 - DNA, 1168 bp, Diabrotica virgifera
  misc_feature (1014)..(1014): n is a, c, g, or t
  misc_feature (1020)..(1020): n is a, c, g, or t
  misc_feature (1047)..(1047): n is a, c, g, or t
  misc_feature (1049)..(1050): n is a, c, g, or t
  misc_feature (1121)..(1121): n is a, c, g, or t
gatcactgcaataataattattattatcaattttatttctttaaaataacttattggatattacaaaccggtgaatttacctttctcttcttagttatttaagacctcataattaaagatgtctaaagtaggatgttcttcaacatcaagccaacaattcgagggcgaagcaccctcctctgtggcccaaaagatgtgggaaatgtctaatgctgtggaagttgttagttcagtagatgaaatatatcgttacgataaaaaacagcaacaagatatcctagtcgctaaaccatgggaaaaagatccacattttttcaaagatatcaaaatttccgcattagctcttttaaaaatggtcatgcatgcaaggtctggaggaaccctcgaggtaatgggattaatattaggtaaagtagatggaaatacaatgtttgtcatggactcttttgctttgccagtagaaggtacagaaactcgtgttaatgctcaagcccaagcttatgagtatatgagttcctacatcgaagcagcaaagttggtaggtagacaagaaaatgcaataggctggtaccacagccatcctggctatggttgctggttatctggaatagatgtaagcactcaaatgttgaaccaaaacttccaggaaccttttgttgcaatagttatcgatcctgttcgcaccatctcagctggaaaagtatgtctaggagcttttagaacttatccaaagggctacaaacctgcaaatgaggaaccttctgaataccagactattcctctaaataaaatagaagattttggtgtgcactgcaagcaatactactcattagaggtatcgtactttaagtcagcttaggataggaaggtaattggattctctttggaacaaatactgggttaatactcttagttcttctagtttactaactaatgcggattatactactgggcaaatatttgacttgtcggaaaaattggaacagtcagaagcagaattgggcgggtgcgggntgtatncgtacaggagaaaaacgaccgaagacnanngtgttaaagcaacaagggatagctgtaaaaccaccatagaaatcatacatgggactgatggctcaaatggntaaaagatagattggttaatagtgtgactcccagtaatcgtatacag

SEQ ID NO: 268 - DNA, 1739 bp, Diabrotica virgifera
gtgttaatggaatatgtgagaaaaatgacaatggaattaggatccagctaccacaacctggagttataagcgtgggaatagtatctgacaataaacctgtcaattttaaccctcccgaacacgttcccgaagtatatcctactccaggaagcattaattttgatataaatcaacgtgtcccagaatatccaggaacactttgctctggattacaatgtattcttccccctgtgcctggaagtaaacatgtcccaggtaataccccaacttctggatgttctggagcctactgtattagtatcattccagataaccaagaaaaactaaattgccaaaatggaaaatgtgaaaatagagataaacctgtaagtaatgaaaatccaaatcaagaaaatcgtaacatatattccggttcagaaagtaacgctaatgcgcagagtaccaaaaatcaagaaaatataaatttggaccttaataagcaacaaccaactcatatcgatcttccaattgaagtagaaattcctgtcaatacagaagatgagaaagagaataaacttaaagaacctgttccttcaattgtaccagtgcaagataacaaaccaggatctagcatggactttttactacctggaaataagccaacccaacactaccatccacatattaacaaaccgaatggaccagatagcaacggaggctactatagctgcacaggttcgtcatgcccgttaccaaagcatcctggacaagtgactccaagtccaactgtgcaacattctactacagtagcttatcctaaacaaccttaccaacccaataataaacctaattgcggtaataaaccttgtgattttcctgaatcgtatccgcaatattctcaacatcaaccaaattgtaatgggaaagattgtaccaacctcgaaccaaatactaatcccatctgtataggaggagcctgtgtctataataatcaacctcaaatacctgatgcatataagggtgctggaggcaaagacagactttttgttcctaattataatcaagaattgccaccaatagtaacaccagtcatagtaaaagatcagccccaagatggcccacaaacaaattttaatgctggaagtcaagctaatgctcaagccaattcacaaaatggtttcgtctccggaagtgttattgtagaaaaaccagatggtcttttaatacctgtaattgatgttcaacctccaagcatcaatagacctggatattcttgttctggtacagagtgcggtagcttaaaacctatacacggtggaataataaattctggtagtcacttaggttcatccgatgtcaattttgaaggaagcaatcagggaaatgcatatcctgattaccctgaaagaaacgttcctggttccggctgttccactggaaaatgtggtgctaatggcggatctcaagcaagttattccagttcttctaatggactcctggaaaggaaacgtacatggggggggttggagtacaggaaaattgtggacaaggttttatcggggggcagtccgggaagctattccggaaactggaagctttggaggagaaaaaaggggttggcaaaacagggtcccgcgggtttcccaaccttccgggaaaggggtccaaaaaaaggggttcttttctccaaagaaatccccccgtctccggcggcccccggaaaagggaatctatagggggggggggggcaaaaaagaggg

SEQ ID NO: 269 - DNA, 1058 bp, Diabrotica virgifera
ggtgtgggaaaatcaacaaacctcgcgaaaatctgtttttggttgattgaaaacaacatgcgggtacttatagcagcttgcgatacgttcagggctggagctgtagagcaacttcgaactcatatgagacatctcaatgcccttcatccagccgatcggcacggaggacgcgaaatggtccaattgtacgaaaaaggatacggcaaggatgctgcgggtatagccatggaagcaattaagtttgccagggattctagaatcgatgttgtgttaattgataccgctggaagaatgcaagataacgagcctttgatgagagccttaaccaagctgattaaagttaatgaacctgatctggtactcttcgtaggagaagctcttgttggtaacgaagccgtcgatcagttggtaaaattcaatcaagctcttgcagattattcatctagtactaatccacacatcatagatggcattgtattaaccaaattcgacacaattgatgataaggttggagctgcaatatcaatgacgtatataactggtcaacctatagtttttgttggaactggtcaaacctatacagacttgaaagccttaaatgcgaaaacggtggtgcattcgctcatgaagtaatttattcttaaaaagatgccttaattattatcattctaaacgcgtaaacgcacgcgtccggtcgaaagatgagacattagataattgtgattttattttcatttcagagttttaacgtattttatttgcctctttatgaagtcggctcatgtgtttcaaattgtaagaagacatatttgatatttttcaatcccattagcaatttatatgaactttgcataatgtgcaatgcttataaataatgaaacaatagataagctataaaattgaaaataaatttttgtgaaaaatctctttgaggatcactcaagtttgaacatttttcatatcgtattttattatacatttctttgtaaacaatacagactagactaaggaatataagataatgaatttcaataatatgaatagttataagttgttat

SEQ ID NO: 270 - DNA, 1074 bp, Diabrotica virgifera
atagtccaagtcttaaggggagttaattgtttataacaagttttattaaaaaaagatacgtgcaaattaataattaattgaataaataacattaactataatgcttgttttagtactaggtgatcttcacataccacatagatgtagtagtttacctgcaaaattcaaaaagttgctggtgcccggtcgaatacagcacattttatgtactggcaatctgtgtacgaaagaatcatacgattatttaaaaaccttagctagtgatgtccatgtagtacgaggtgattttgatgataatttgaattacccagaacaaaaagtagtcacagtaggccagtttaggataggactatcccatggtcatcaagtagtaccttggggagacccagaatcaattgcgttaatccaaagacagttggatgttgatatattaatatctggtcatacacataagtttgaagcgtatgaacatgaaaacaagttttatatcaacccaggatcagcaacaggagcttacaattcattagaaacatcaataactccatcgtttgtattaatggacattcagaatacaacagttgtcacatatgtataccaattagttggcgaagatgttaaagttgaaaggattgaatataagaaaaattaaattaaatttttgtatcatattttatttaaatttttaaaaacatggatttaatatcacttattgataattttgttaaagcattaccaaaaaatgattattatgacttcagttgattcagtttcatcatcaggtttgctaaatctttaatatctagaaatagatatatttgaataaagaagattatcaatttgtgatttattattcctgcatattatttgtatgaaattttgtaatattgctgaattagtccgacatgcatgtattgtttaattctttttataatgattttaggatctgtcttctttttcagcttataagttggattaagtatttatacaactaagatataaaatatattgtggaccctaaattgattttattttaattggtaattttataataaaaaaaaaaaaaataacattccc

SEQ ID NO: 271 - DNA, 1369 bp, Diabrotica virgifera
  misc_feature (1308)..(1308): n is a, c, g, or t
  misc_feature (1311)..(1311): n is a, c, g, or t
cacgtgcacaatcgtaaacaaaaaaaagtgacaaaaattttggcgccaatcgattagtttctaataaaaaatgcggctggacataattgattgcgacgactgtagtggttcagatagtgaaaatgagacaaatctggacgatgaagcgggtaacaccgatgaaaattctacagataagagcgatgattcttctgaaagttgtacatctctaaacgtgattgagactggatctggagatgcagtcaactggccaattagacaaagtttatttccaaacattccaccctacattaggtttaagttgcacgatgtcgaagcggaagtacaaattcccaacgccaagaaatatttcaagtggaagctcagtaccatcactccgcttatagttagaaaaaccttaaccaacaccggttttgttcttattagaaagtctaatcaatggttgggtacgtggggtaagcatatgaaatccccaatgtttaagactttaaaggaaacacaaaaacttaatcattttcctgggacgtttcaattgggaaggaaagatcggctttggagaaatttccaaagaatgatgacaaagtttggcgctaaagagtttggatttttacctcatacgtatattctacctcaggaacttaaattattaaagcaatgttgggaatataaaaatggcaatggtggtgaaatgtggattataaaaccgcctgcttctgcgcgaggagtcggcataaaagtgataaataagtggtctcaacttccaaagaaatcatcccttatagttcaaaaatacatttccaatccttatttaataaatggtagcaaatttgatctaagactgtatgttttagtaactagtttcaatccattaataatttatatgtacaaagagggattagccaggtttgccagtgcaaaatatagtagtgataccaaagatctaaaggataggtatatgcatttgacaaattatagtataaataaattttccagtcaatatactgccaatgaagatgcaaatgcctgccaaggacataaatggacaatctctaaattaatggaatatcttcaaggttacaatgtcgatactaaagccttgtggagaaatttacaacaattagttataaaaacaattatagcctgtgaatcacctgtggtacagttatgtgaagaaaatataaacagtagatacaactgttacgaattatttggaattgatatacttttggatgataaattaaggccatggttattagaggttaatatttcgccaagtcttcacagcgcctctcccctggatgctcacgntanaggtccctttagttcatcatttttcgatttagcacaatttcatttaccgtccagaatt

SEQ ID NO: 272 - DNA, 874 bp, Diabrotica virgifera
taaaacaaattcaacaaataccctcaattctttaccgggaatccaggcgcagaaacactcgctgaagtgactttaagccatttatctaagggccaaattgcttctttttatcggtgacgagtttggttatctcgttctttccagctgccagttcctcttcgttatatatgaaatcacgaacgatgaacttcttttctctagcgtgtaacttgaattcttcgacgacctttttgaatagggatacagtatatagaccgtattcgttatcctgtttaatcagttgtgaagaacgagggactatcatgtcggtaatcttttcgtatgtcgcattccattcgttgaattgggcttttggaacaataaccaacaatgtctgcaaatattcagaatccaaaataaaatgttcctttttcaccaaatctgccaagtttcttgttgataatacaaaagagaccatattattagaaattgcattcgaaaaattaaaaaaatgatagatattatgacgcgtagatgagctgacaagtgacgtgttaagatgtattgatatctaagcatgaaatttcaacaaaccatctatgttatagatgtacatatgtttcgtaaaattgacgaaaagctggaaatagattacatataatttgtcataaaatatttgcgtcagagacttgaggttgtgatacaatatatatttactcctacagaatatttgttgaatgttaccgacaccattaaaataccttatccgttatgattgtagataaataatttactctgaatttaatacaaaacgatgtcataatttcaattgtacttgttctaataatataactacttatcgaaaaaaaaaaaaaaagggcggccgctcgcgatc

SEQ ID NO: 273 - DNA, 3136 bp, Diabrotica virgifera
tatctatcatttctttaatttttcgaatgcaatttctaacaacatggtctcttttgtgttatcaacaagaaataatattaataacgatttatatgttcaatcggagtattacatgatacattaaagcaattataccatcgttaaacgaattttaaatgcattttaaaataaaaaaaagttctacattttttgttgcgcatttttaattaatttacatacaatgacggggtactaaatggacattgagtaaggacaaaacttaaaaataccgacattaaaacagcccctcgaaagagtgagtaatcaaaaatatactatttgtatctgtagtacgtttttttaaaattgtttggaacctattaataacaaactcttggattgatgcgtgagtttagatcttcgattctaacatgtcgacgttcagcttgtagtaaacgtatgggtaatactctgattggccgaatccgaggcctggaatgtcaacgctatcaacgttaggtcctgaaagggcagcactactatcgaggtggccgtaaagttggttcaagacatctcttaaacgttttaattgtttcttattggggtggattaaaatagcttggaaattgacggggaggccatatcttaaaacagattcaacaaataccctcaacgctttaacgtgaatccaggcgcagaaacactcgctgaagttgactttaagccatctaactaatggaccaaattgcttctttttatcggtgacgagtttggttatctcgttctttccagctgccagttcctcttcgttatatatgaaatcacgaacgatgaacttcttttctctagcgtgtaacttgaattcttcgacgacctttttgaatagggatacagtatatagaccgtattcgttatcctgtttaatcagttgtgaagaacgagggactatcatgtcggtaatcttttcgtatgtcgcattccattcgttgaattgggcttttggaacaataaccaacaatgtctgcaaatattcagaatccaaaataaaatgttcctttttcaccaaatctgccaagtttcttgttagtaaacttcctgtctgtttcttctccaaattctgaagacttcctttcaagttattgtacgcagacgatttggtcttcagatcagcgtcaatttggccaacttgtttgctgattatatcggcgatgttacggagcgattgcttgatgggatatttggcgatgtcccaagtaaatcgggttaaataagtgggcaaatcgctgttattggcctgcaggttttctgaccacttgtccctctgttcttcaagtacttctccaaggtactgagctacctttctggtgacctgctccacgaacccatcaagcttgcccagatcatcagaaagtcctactaactgatccagagtaccaactttcaagtccgggatttgaaacttgtagttggttgacaaattattctgtttacttgtcatattattcatcgtgtcccatgtctgttgacaggttttatcccctggggcagatatcaaccaatactcagtcatttcttcttggtgatcagaaagtatgctggctctatgtgaattaagtctatggtggcttccaagatcttctttatcactccttcaaataatggaataactccaaaaaacacccctttcaaccactccccaatgaacagagtcagcccagcctgatcgtttttgtattttaaaatgcattttaaaattcgtttaacgatgatttaattgctttaatgtatcatgtaatactccggattgaacatattaaatcgttattaaatattatttcttggttgataattccaaaagaggaccaatatttttttgaaacccccattttgaaaaaaaaaataaaaatgatagatattatgacgcgtagatgagctgacaagtgacgtgttaagatgtattgatatctaaacatgaaatttcaacaaaccatctatgttatagatgtacatatgtttcgtaaaattgacgaaaagctggaaatagattacatataatttgtcataaaatatttgcgtcagagacttgaggttgtgatacaatatatatttactcctacagaatatttgttgaatattaccgacaccattaaaataccttatccgttatgattgtagataaataatttactctgaatttaatacaaaacgatgtcataatttcaattgtacttgttctaataatataactacttatcgaaaaagaatagaaatttattataaaattgtgtgaaatgactgggtattataggattgccccaacaaaatattttagatgtagtatgatgcttcatcagtgacaatatatttgacgtgttttattatgggccactctttaatgtaaaccagtattgatttattgtaaataaatattgtatatatactacaaaccaataaaatattttgccttttgaatctatttataaaagatgattccatattgtaatatagttcaattagttgactactttttttgaatttatttcagaaataattttaagtggttatttgttcaatgtaattgttagaaaataaaaactattccaattgtgtggtcagattgtaggtacctcattcgtcaaaactgtagtcataatattttgcatcattatcaggatgcagtgtctcatgcattctcgaccaagtagttcctcggatatttcctaggcaagcgtcatgtccttcatctgctagcagcagtgcaattgatttatttgggccatgattaacataatccatggcgtatactaagaagtacatgcataagaagatcatgtggtgtatcttgtatgatatcgtgcgttacatattggcctcttgataaccgtcacattagaaggatataaccatattcagtcatgaaccagtgagtttttaagggatagttatatattttcgaataatttatatattacacgtcgtatatacatgtttgttgtcaggtcgtatatccctggggcagatatcaaccaatactcagtcatttcttcttggtgatcagaaagtatgctggttctatgtgaattaagtctatggtggcttccaagatcaagaggatcactccttcaaataatggaataactcggacgcggggagggag

SEQ ID NO: 274 - DNA, 934 bp, Diabrotica virgifera
cggacgcgtgggcggacgcgtgggtttttttgattatttatagtcaaatacaaaaaatggcagcggaaattaaaccagcaactcaatcaaatgaaagattttgtacaacgaaaaagccaatactgttatcaaagttagacggttgtagcgatgagattaatgctgcagttattataccaggcgaagaaggaattatcagtgtttccgatgataaaactgttcgagtgtggttaaaaagagattcgggccagtactggcccagtatttgtcaatatatgcctagcgggaccacatctatatattacacagtggaaaccagacaacttttcatcggccaagaaaatggaaccgtctcagaattcaccctcgcctcggatttcaataggatgatgcccgaaaaggaatatttagcccaccaagctcgagtaaccgatataatttttgcaattaattgtgagtgggttctgagtgttggtagggataaagtgttttcgtttaattgtacacagactggaagaaatatcggaacttttaatgcagaagcgtggtgtacggcattacaatttgacgtccaaacaaaacacgcctttgttggcgactactcaggacaaataactatgttaaaactagataataacggagcctcagtgatcacaacgttaaaaggacattcaggttctattcggtcactatcttgggacagtgataggaatatgttgtttagtggatccttcgatcatactgtgatcgtgtgggatataggaggccaacaaggccatgcttatgaactacagggacatcataataaggtttctagtctctactattcaacgagtaccaaacaattaattagtgccggagaagataacgtaatagtgttctgggacatgaaccaaccacgacaggaaactcccgagtgggtggaatcggatct

SEQ ID NO: 275 - DNA, 1334 bp, Diabrotica virgifera
atggaagctgccagagaggcttatgacgctttcctatctcattatccgtattgctacggttattggcgaaaatacgctgattacgaaaaaagaaagggaaataaaaagaaatgcgaagaggtatttgaacggggggcgaaggcgtggccgttatctgttgacttgtggattcattatttgacgtacgttaaagtaacccgaaccgacgatgaagaatttattcgatctcaatttgaaagggctgtaacatcatgtggcttggaatttagatctgatagattgtgggattcatatatcaaatgggaaagtgaagcaaaacgattgcaaaaagtgacggcgatatatgacaggttgttgggtactccaacgcaaggatacacaacccattttgaaaatttccaagaacatatatctaataacgcaccaaacaaggtagtagacgtagatgagttttttgctttgcggaaggaggttaggcagcaactcaagcacgaaataactgataccccaccagcagacaatgacgcgccacctggtgatgaggatcagaccaaagtgattagttccgacgaagaaacaaaaattcttagagaaagaataatttcaattcgaagaaaactccataaaaatacggtgaccgcagtgactgctagatggaattatgaagaagcgataaaacgtccatattttcatgtaaaacctttagaacgatgtcagcttaaaaactggcaagattacttagattatgagactgagcagggagacagagtgagaataatagtattgtttgaaaggtgtctcatagcatgtgctctatacgaagagttctggttaaagtttgtgcattatcttgaaaatcttagagaccatgagctacagcctaaaataagagatgtgtatgagcgagcttgtactattcaccatctaaaaaaaccaaatctccatttgcaatgggccatttttgaggagggtgttgacaatatgtctagagcagcagagatattagtaaatttggaaaagtctgttccaaatgttttacagattgcttatcggcggataaatttagaaagacgacggggcgatcacgaaaaatgttgccaacttttcgaacactatataaatagtacaaaaaacaaaatcattgccagcagcatatcaataaaatattccagatttgcttgctttatgatgaaggacgttgaaaaagcacaaacaattttaaaaaccgctattgctaaagatccaaataatcctagactgtatttgcagcttgttgatgtcactttacagaagggagatccaactgaaaaaaatatcactgaaatcctaaatat

SEQ ID NO: 276 - DNA, 1507 bp, Diabrotica virgifera
attttctgctgtggtgtatttgtgtacgacgacaacgacctatatttcaaagaacacagagtaactacaaaaacaaaaacaaaaatggactattgaactactgccactactgcagaactactgtaactcttctggttataacttataaatttgctcaatttgctggttttttaatagatgaatgtttttagttccaacaattccaaaaagatacaatgaatatatcatcaccagtacatagaattttgccttgtaacaattcatcaattttggaaagaagtatagtcataaataaaacgaaacattcagtcaaacaagacttcttgtggttcactattaacattgcatttctgtctgctattttatatgatttatcctaattacagagtagtaaaaacaccaagtaagagtccaactcctcaagatagtagcacatcaacacctataaatattacctttaagaaatcaagtatatctcaatttgagcctgacagtttaaactactctacgtcctctccttcgtggatttattttaaaggaacaccagaccgaagctctggtcatttctcacctacgtcttctcctatttttcaggcatccctaaataaatcttctttccgtgatatttctccggtagaatttatcggggacgaagatgctctaagaaaatatttgaaagagcataaggaaatcgaaaaagttaataaactagccagtaaaaaacagaattcttcaaatttattaagttctttttggagccatcctgtcacacaaacagctaaagatgtatcagaataccttaaaaagtgtcaataccaactttcgtcacaattcattgggaaaacaccaagcagtcccaatttaaaaggtgacgacaagtctgcgagtcctgctcaaacttcagcactggaaatatggacaagaattaatgatgacagcgtaactttgacccaatggaacgaaaatctaagaatgtggatatctcaaactattttggaacgtttagtaacagaatttgacagaatcaatgcttccttgaataaacatggattgtcagacgtaaaaattggtgcagtaggactcgatagattaagaaagacagctcagacagctctagtgtctcaattcattccttcattaccggctttgataccattcctggaggttacaaccaaccaagaatacttggaaatgagaatcagaaacctggacaaaggtgggtgcatgagcgagtttaagaggaatggtggcggtaaatataatggaaaagagtgggacgaatcactaccgacggattgtgcagtcgtaatgcatcttcttgcttcttatttggacactcaattgatacctttacctagtatgcctgacactaaagcgatcagcgataatcgttttattagagttgctgataaagcacctactacgttgacttcaagcagtttttatatacaagaagtttctgagaagccaccacataatagagtttttgtatgacatctaatatatg

SEQ ID NO: 277 - DNA, 1186 bp, Diabrotica virgifera
  misc_feature (995)..(995): n is a, c, g, or t
  misc_feature (1044)..(1044): n is a, c, g, or t
atgaaacattccatgaaagttaatcattggggagatctgagagcaagactggaaatggctattgcaagggtaaaagaacttgctgagcagagtgagttcagaaaagagcaagaaggtgactacagcagtgattctgaatctcttagtgtattatgtaacgtccaattgaccactgctgtaagaaagtatttagccacatgtataagagacttaatgcaacatggagcttatatgcctcaaagcactagcctagttcctttgattggttgctttccaagaaggaattctttaagtagtaatcaaattcatgcctgggagatcattctagagtattataggatgaaaaatggtgaaaaatataactctacacctgcaaggaagctgtcacaaagttttaatttggatattgctggagcttcaccctcatcaaataagcagaacatgttgtgttgtattggtagcattatttcaacacatacgccatataaaaggagcaatgattctcattttaaagcctttatctgtgccgctcttaatgccaacaagctagtcccttggttaacgttgatatttacttgtaatcatcttatcaaaacttactatcaaccatggagctatctagccaaaacagggttccaagacagtttaagaagtttagacacattgtccgggatcaaattccagttaccagtggatctcgccattagacaattccaaaatattaaggacgtatttacataatattctcttgttttttctagtcgttctgtacttaattatatacgtacatattactgtgattcatttaacaataatatcaaagaagcgcgggattattgtaaatgcaatgaaacgtcaattgaagtttgttttgtcatttttattatttatttaacgtgattttggtagaaacttcacgttgtagtctatttctccaaggttctatgcctgactggactacgtatacatttgcaataacctctgtgttttcgcanatctcgcagttaaatacgtatccgttttgcctgatatttttgtccttanaagtttatctagtcgttaggtttttgtttttctattgactgataaaagtctgaaaaatgggtggtacttaatggtctctaatcgttttgatttgaataaataatgggttttgaggttaaaataaaaaaataatgggttgtgg

SEQ ID NO: 278 - DNA, 1574 bp, Diabrotica virgifera
cggacgcgtgggcagacgagtggggtcctaatcattgtacaccaacttgaccacacaagccacctcgaaagaagaagagaaatagtcctcagttcctgtccaacatgttgccgctaaaaaaactcatatgcagtaagtccgtctggatcctttttatttgtttgacttccaccacttttggattcttggagaatttaagcaggaatgatatcagccgcaggaatgtccgaggaagccgttcgtcggtggagagcgtcgtcgaggaaatgccctttaggaaagacaccaggaggcaggtcaacgagaaagacagactttatgagaacttgtatgacaggcgaagttttagaactggaaccgacagattcagaaaccgaaacatcgacatccgacttgatcgccggaaccaaaactggaacgacgaaagaagagctctgaacgaccgagtcttcctcacaccagttcctgacataactattcccatcaggggcgtccccaatgaacgaagaagccgggatgtaagactaaacagagaacaacgcgtcagaagcccggataaccgatcagaaagactattccgtgatgatcgccgatcaagagatacaagagaaaatgaagtacaacgagaaagacgcgaagaaacctttaccgataacagaatgaggaatataagagaaactcaaccaaggtcccttaacattcgtgcagagagaatggttcgagagactttatccagagaaaacaggcaacaagaccaacatataagacaattaagaaccaggaataatagacaaagagaactccgcacaaatgatgacagtcgtctacaaaacagggaccagcgcgttgaaaggaatataaggaccaaccaagaacgtataaacgaacgaagacaacttcaagaacgtcgagaggaatcccaagacgaacgaagacaacttcaagaacgtcgagaggagccccaagttaggaatcacagagaacaaagtcgtgaacgaatgctaaaatcacgtaacgaatatctcagtccatcacgttatgaacaaaacttacgaaacagtgagaggaggattgataatagggaaaggaatgtagaaattcgtgaacgtaggcaggaaaaccaagaaagaattcgagaagagactttcaggtacaatcgagacaacactttggaaaaaaataggcaaatacgttcattaaacggtcgtcaagaaagacgaacagcttttgaagcgacaatggatgcacgagaatcacgaaatctctcaacaagacgtttccgtgacacccaagaaagaaatatagaacgcaggatggccaatagttatagagactccaacgaacgtagcttggaaagaagagatgttcgctcagtaagatctagcagaattcgcaacaatagaagcaacggtttagatgccaacatgaatgaaatcaggcaaaatcgtgaaagaaacattaacattcgttctgaggacagatcagaactctatagggaacgcgaagaaagggaatcaacgcgaaagacaattctccagagaacacaggtatatggaccgtagcacatatgctta

SEQ ID NO: 279 - DNA, 2484 bp, Diabrotica virgifera
  misc_feature (1547)..(1547): n is a, c, g, or t
  misc_feature (1629)..(1629): n is a, c, g, or t
  misc_feature (1649)..(1649): n is a, c, g, or t
  misc_feature (1695)..(1695): n is a, c, g, or t
  misc_feature (1716)..(1716): n is a, c, g, or t
  misc_feature (2371)..(2371): n is a, c, g, or t
ccttgtaccgacaaaataaaaatataacgatatgtataacgttatatccaatataatctaacctttgctcaaattcacgtttaaattttattctccctgttttggtccctgatgtcagcattggtaatgttgttccatttttatctttgccaatacgtcacgattcatttaaaaaaaattgaatcaaaacataaagtgaaacgtacgcggatgtgtatagtatatagtatacagtatacaaaatgtatgtacacgtcgacgttcgtttcactttatgttttgacttaaattgtttgaaaatgagtcgtgacgcatgggaaaagttgaatggaagaactatatattggtcccctttattgtaccttatagtgttagggaaaacaaaagaaaacatatcaattattataaaactatattataatgattttcctattatccaactcctatttcgttttaaaaatttatgttcagttggtatttttttgaaccatttagatgtggcatttttcgttgactcttaaagaataatacctcgcagtgcaagtaaaatctttaaataaatcattgaaaactttcataggccccatacgcctgcgatcaaattacgcaaatttacaatgcacagtaaactgttactaaaactggtctcccatacactaggcatttttacgcaatcacacgtcaagcaacacatactgtaacaattgtttgtaaaaccgtttctgttgagcaaatttgttcacaggtgtaaaacattgatagcatccaactgttatttaaagtggtcacccatacattatgcatttttacgcattcacacgtcaagcaacacaataaactgtaacatttgtttgtaaaacagtttctgttgagcaaatttgttcacagacgtgaaacattgaaaactttcataacatcaacaactgttgcttaaagtggtcacccatacattatgcatttttacgcaatcacacgtcaagcaacccaataaactgtaacacttgtttgtaaaatatattctgttgcgcaaatttgttcacaggtacaaaacattgaaaacattcatagcatcaacaactgttgcttaaagtggtcacccatacattatgcatttttacacaatcacacgtcaagcaacacaataaactgtaacaattgtttgtaaaacagtttctgttgaacaaatttgttcacagatgtaaaacattgaaaactttcataacatcaacaactgttgcttaaagcggtcactcatacattatgcatttttaagcaatcacacgtcaagcaacacaataaactgtaacacttgtttgtaaaacagtttctgttgcgcaaatttgttcacaggtgtaaaacattgaaaccattcatagcatcaacaactgttgcttaaactgatcacccatatactaagcatgtttacgcaatcacacgtcaagcaatacatactgtaacaattgtttgtaaaaccgtttctgttgcgcaaatttgtttacaggtgtaaaccattgaaaacattgatagcatcaacatctactgcttanatgggtcacccatacattgcgcaaatttgtttacaggtgtaaaccattgaaaacattgatagcatcaacaactgctgcttanattggtcacccatacattgncgcaatttgtttacaggtgtaaaccattgaaaatattgatagcatncacaactgctgctttaattgntcacccatccattatgcatttttacgcaatcacacgtcaagcaacacaataaactggaacaattgtttgtaaaacagtttctgttgagctttgttcacagatgtaaaacattgaaaactttcataacatcaacaactgttgcttaaagtggtcaccaatacattatgcatttttacgcaatcacacgtcaagcaacacattaaattgtaacaattgtttgtaaaacagtttctgttgagcaaatttgttcacaggtgtaaaacattgaaaacattcatagcatcaacaactgttgcttaacttgtcagccatacaccatacactacgcatttttacgcaatcacacgtcaagcaacacaactgtaacaattatttataaaacagtttctattgcgcaaatttgttcacaggtgtaaaacatgcgatcaaattgcgcaaatttacattgcacaacaaatggttacttaaattggtcacacgtacgctacgcatttttacgcgatcaaacgtcaagcaactaaataaattaacaattattatttgtaaagtagctgctgttgcgcaaatgtgttcacaggtatgaagggcccattattaataaactgtttcgctgtcagcggcataaaaaatgcaccctctgtttcgtttcatttgnttaaatgaagaatctattttcttctgtgttatatcgttgattgatgtattgggggtttattaatatttcaatcaacggttatatccataagagacaacgaaaattgttatata

SEQ ID NO: 280 - DNA, 1577 bp, Diabrotica virgifera
cccctaatacagttcacaatgaattttggtattagtatactgttttttacaatatgtgtcaaccaaggatttttggcggcttctcagcgaaaaccttcaaaaccagaaaaattgccttggtcaaacgacagactttctaccaaggagccagaaactagctcatatcgtccatggtccacaacagaatcttatccttcgcgaacatcgtctcgatcagacagcagcactcgtagaatctggtatagcacctctgactcttggcgaacatcaggacgatgggatggcaccactggtagaccctcatattccaccaatgacccttggcgaacaacaggacgatgggatagcaccactggtagaccctcgtattccaccaatgacccttggcgaacatcaggtcgatgggatagcaccactggtagaccctcatattccaccaatgacccttggcggacaacagggcgatgggatagcaccactggtagaccctcgtattccaccaatgacccttggcgaacatcaggtcgatgggatagcaccactggtagaccctcatattccaccaatgacccttggcgaacaacaggacgatgggatagcaccactggtagaccttcgtattccaccaatgacccttggcgaacaacaggacgatgggatagcaccactggtagaccttcgtattccaccaatgacccttggcgaacaacaggacgatgggatagcaccactggtagaccctcatataccaccaatgacccttggcgaacatcgacacgatcggatagcagtacttataggacctggtccactactcgccgtcccacatactggccaacgggcacaacttggtggccaacagaaagatcgacacgatccgatagcagcacttatacgccttggtccactactcgccgtcccacctactggccaacgggcacaacttggtggccaacagaaagatcgacacgatccgatagcagcacttataggccttggtccactactcgccgtcccacatactggccaacgggcacaacttggtggccaacagaaagatcgacacgatccgatagcagcacttataggccttggtccactactcgccgtcccacctactggccaacgggcaccacttggtggccaacagaaagatcgacacgatccgatagcagcacttataggccttggtccactactcgccgtcccacctactggccaacgggcaccacttggtggccaacagaaagatcgacacgatccgatagcagcacttataggccttggtccactactcgccgtcccacatactggccaacgggcaccacttggtggccaacagatacaacttggcagtcaacaacaaatcgacctttcacaaccactcaatctccaataccaccgccaactcctagacctgcaccaagtattgataactactgttttaaatgcttgtttttagaaattgatttcaggttaagaaaataatattttaagtttttgaaacaatatacataaataattttattgtaacaaaaaattgtgtgttttaataaaattatctaaaattttagagt

SEQ ID NO: 281 - DNA, 1006 bp, Diabrotica virgifera
  misc_feature (910)..(910): n is a, c, g, or t
  misc_feature (917)..(917): n is a, c, g, or t
cgaaactacgtatacttctttcttgtaagtaaacagagattctgttaaggaacaaaatgaggttatgttttggtgttattattattttattattattttattaataactttaaaaagaaaatgattagacgtgtatttggtgtcatagaaaccacattaacctctgagcaagcctcgtatccgaaatgtttcttcaaatcggagaatgcttcatttggatggctccccacagctgcaccatgttttcctataaacgctaaaaacatcaaaatattaacagaaccaaaggaattttatgatacgcttttaagcaattgctgcaatgctaaagaacgaataactttagctagtctttatttaggatatggaaccttagaaaagaagttgcttgaatccataagaagtaatgggaactacaagaataacagcttaaatattaatatattgttagattatactagaggtagtagaggggtagcgaattctagaacaatgttgcttcctttattgcaagaaaatagtaaaaatttaagagtgtcgttatatcacacacctgaacttcgaggagtattaaaacagtatatacctgacagatacaatgaactgttagggctacaacatatgaaactatacatattcgacaacacgcttattattagtggagcaaacttatctaatgattatttcactaatcgccaagataggtatgttgttattaaagataaaagccttagtgacttttactgcagtttggtaaacaaagttcaagattttagccttaatatagaccaacatgacaaggctggtttatccaaaaattgggaaatgctgccttatgagagtagtaaagctcaatttgttcaaaaggcttcacgtaagataaaaatttcattctggattctatgaatcncacacancagtattgtgcacaagaacaaatgacacatggatattccctttagtacagatgggaccactcaatgtgaatcatgacgctccattacta

SEQ ID NO: 282 - DNA, 1235 bp, Diabrotica virgifera
  misc_feature (1113)..(1113): n is a, c, g, or t
  misc_feature (1136)..(1136): n is a, c, g, or t
ctaaccaaggttttaacaataaatgactatccattctcatttataaatacggaaatccacaaaatagaagaaagaaaacaacaccacaagcaatccagtaatactcacaagaaaggataacaactataccatatgttatgggctgaccaggaaaattaaaaaggataggaaacaacatcgcaacaacatttaaaacaaccaatacactcagatatatcctgttcaaacccaaaccagataacacacacggaaagtcaaagaactgcatctgcaaaatacactgtgaatgcaacaatttctatgtgtgagaaactacaaaacccctaagcgtcagaataaacgagcatgaaacatacataaaaaacagggaaattcgacaaataacagatatacaaacattcctgggacaatgagtacacagagtacaatggaaagatgcatcaaaaatcatgaaggaaacagacatgaaagagaaaaatcaaagaagcagctcttattctaccaaatgaagaaaaatgtgtagcaaactcatcagcagaatgtaacaggcttttgttgccaatactagaagtgaacaacaagaatttacaaacaatagcagatgagaaaatgggagacgcaagtcttctattatacataatacatatgcaacacacaatacataacacaagactaactctcttacacagagaaccgcatgaagcatatagaaataatgcagaaagacaccgaataaataatcagaatttaatttaccatggggtataaaacatccaccctcacatattttcagctaagcctggctattgaatacaacacgatagccaagtatgtcaacctcgattttttgataatacataacctctttaacaacttggcggttatagtcaaatctttttaggtaaaaatgtaattgccgttacaatcaactgtaactaatcccatataaatacaatatttaacaattaaatatatataaaaaaaatgtaaaacaacaaatctaccgaacacaaaggaacagaaacaaaagctgccattacaaaatacctttcaacggtaattttttttttgtaaaaatggcggtattaataatatggtcctatacagtattanatcttctgataatgaatattggntggcatattaaatatgttaagtctgtggttctaataacaaatttactaaatcgaaaaactctcatttcaattgttaaatagaattataattttataaaa

SEQ ID NO: 283 - DNA, 1146 bp, Diabrotica virgifera
agttttattacccagtaggatgcgtttatttatttcatacgttctatcatttctgccactcaccatcactcccaagtatttgaaacggtgtactctttcaaaggtatatgcaccaaacttaatttctttctcgatgtttgaacacttgagctatttcgttttgctctggtttattactagccctctcttctttgattctttatctagtattaatactaactaaactatactatcgaattatgtggagtgacccattcttctctactagtcgcaaatttcttcgaatatctcatgaggttctggacgaaattcagatcaatttctgtttttcgcaaatttgccatcttaattgttcttcatcttgggattcccagcctccatgataaactgttgacagtattggagggcctgcggcaagtttgtggaattgtcgtttttgggtatagagagtatgtggtgttgtcgaagcctattactgacagtagacaaagtaaagaaacttttgtttccataggcaacttgatattattttgtttttgttaaaataaagccaatgcatttggtcccaaaacttttaggacatacgttattatgaaccattttgagtatatttacgggttacatacaataacaaagcattatgtaatgtgaaaggatcaaaaaaatatagttttgatacactaaacaaaactttaagagtcacattttatatttttgtattgtaagtcataattacatttgcttggttttggtgtattcagaacactttttgcttatgtggtactaaaaagttttagaagtaaatgttagaaataagtatcttatggcatttcctatgttatctactatattgataattttaattgaaaatacgttacttccctagttcgatttccacctcagacatcattctgtatgaatttgcattttgagaaagatcaaaagaaaacttagtttcagttaaaattatgatttatttccatcgaatgtagtagttaagtatattgtttaatacaggacttgaatggttacctcatatgaagagaatacttcatttacaataattacatttaagtttgttgattccattatgtatatattacttttaatttagaataaaatattttaaacagtcttatacattcc

SEQ ID NO: 284 - DNA, 2061 bp, Diabrotica virgifera
gaacatgtgttaatggcgcttttgagatggcttcctaattcagtgaagacggaaaatattttgcccatttatccacggatggaaaattaaaaatatgggacacattgtccaataccttcgaacaggaatttactcccgactttcatttgacttcaccatgtacatgtttacatttcattcaaaacgattctgtaaaatacaagggtggttcgccaaaaaagaaaaaacgaagagattccgagtcagttgttagtccaaaaatagtcttaggaacaacttctggtgttttgctgttatattcaatcacaaatgctggcttagaaaattcattcgatagtgacacaaatcaagcaattaactgcttatccaccgttgaccataacatcatatattcaggtttagaacagaatgttgttatctggaatttagaaaaacaaaaagttatcaacaaatggaaggttggaaatgaaaaagtaacagcaatattggcaataccagaaagcagtcaattattaacagcttcaagaaacattaaattgtgggacctagaagtaaaagaagtacttaggacatttactggtcataagtcagaagtgatgtttctctatcgtgggcacgagtagccgccctttgttttttattttatgtcaggctctaagggagacagaacccttagttgttggagtttgaacaccaatgtctcagagaaaaatgcagttgctaatttccttatggaggatattgttcttaatgtttctataaatgttgaggatgatggaactacacaaatggctgctactgttagaagtggagtggtgcacttttataggcatacattaaatggcaaatctggtaagccaataaagcccaaaacaacaattcaagtagtttcagatactggtcaatctgaagaagaagtagttaatcctattagaattgttggtgcctttcatagagatagtgaaacattatgtataggacatggtacagatgtgctacttactttcgagaatattgtaccaaatacgtcgaggaaactccattgcctcatacggcaggatcctcagaagctcaagtcacagaaaaacctacaaagcaccaaaacgataacaccagttgtaaatgattctgtccaatacctaacaccagaaacctctgtaatatcctccacgaaaaggaaaaatgatggcactttagaagtacccatggaaaaacggttagaaaaccttagtttgggtaaagctgagggaggaaaagtgcccaaagctgataatgttgcgcaactgctgatacaggggctacatagtaaagataagaagatattgaggactgttttgtatcaaaaaaatgaagaggtggtaaggaatactgtcaagaggctacctgtaacggcgtttgtgccgttattgcaggagctcgccagttacatccaaggaaaaactttatcgagtcaaatgggttcaatgtggatgaaatacatacttcaaatgcatgccggaatcctaatgtcgaaccctcaacttcctgatctattaagtgctacattgggaagtatacaaagccgactgggtctcctcactcctctgaacaggttaaaagggagattagatttgctaatacctcaagttagtagcagttttcaacaggatagtactgaaaatgaacaagctttacttgtatataatgatagggataccagtgattcggaggacgaagaacttcaagttgacgcccagtcagaaagtgggagtgaatgggaggaagagagtaaccctgaacttattacagaaaacaacataggttcggatgtagaagaaaacggtgacggaaaggaggaagaagatgatggtggtgaggaggaagaggatagtggcgaggaggaaaatgatgatgaaccgatgtcgtcgtaactttattttttcgtctttgttatgtatattacgaaaaatgatgcattatcattaattttaatgtttgacaatattttgttaaatagttaagaagagaaatatatttactttttatacaaaacccataaaaaaaaaaaaaaaaaaagggggg

SEQ ID NO: 285 - DNA, 871 bp, Diabrotica virgifera
agagtgagtgcgttttttgtgtacaataaaataataataattattattaaatattataaaatataaatattcaattattctgtgtctatgctgtgattgcttgagcgttaattgctatctattgtatgtattttctcgataatctttaatttgttgccgtttgctgtgccgttgtctaaacctgtgccttaattaaccactgccctagaatcaagttatcaagtgtaatcaaatgcaaaatggaagtaaaacaagaaaggtatgaaatagagcatatagacctggataatgttcttttgcatggcttcaaatgtgaagttaaagaggaatccaataaccaaagtacacatgaagcttatgattacttagactcaaaggaacaggaaatcaagtgtaaccaaatggagataaaacaagaaattggtgatgaaaaatataaatcagtagaagagtataatgaaatggatttaaatgactctaaatgtgaaataaaggaggaatctattagtcaaagtgcaaatgacccctatgattatttagacttaaaggaatatcctataattactgaagaattagaacaacatgggaataaacttgaaggaaaccaaaaaactgagaaagattatctcgaagataacgaaatggaaattttggaagcattaactgaaccttcatctcatgaagaaaattatacgaatccacaatttactcaaggaagtaatttaaaagtgcacactgaagaaaaactttacaactgtgcaacttgtttgaagcagtttactgtgagagattctttggtaaacatttgagagttcactctggagagaaaccttataagtgcaaaatttgttctaagctttttagtaaaacg

SEQ ID NO: 286 - DNA, 1913 bp, Diabrotica virgifera
  misc_feature (1456)..(1456): n is a, c, g, or t
  misc_feature (1594)..(1594): n is a, c, g, or t
tgaagtccggcgcgtgggtttttttagtttacaatttagcattaggtgctgccgacacagaattagataatctatataatgaggtacaaagtgtactagcaggggtacagtcttatcaagtccctgttgataattcagcattgtttactataacaaatgatacaattgtggaatatgaagattacgactttgttatcattggagcaggtgccgcaggtgcagttttggctaacagactatcagaaatttactcatggaggatcttactcttagaagctggaggaaactctaacaaatttagcgagattccacaattaatagctaatttgcgacgaacagacatgaactggggttacttttcaacaccacagaagacttgctgtcaaggcatgattaacaaacaatgcatctaccccagaggaaaagtacttggaggtacaacgacaataaacggaggagtttattccaggggaccccgatcagactacaacctttgggcagctatgggcaatactggctggtcttacgatgaggtgcttccatatttcaagaaatccgaattcaatgctttaacagaatacgacgaaggttatcatggatcatctggttatttgtacgtcaacagaacaacgccaccttccgtagttgcagaagctttctgtaaagctaacttagagaaaggtctaaaagacatagactataacggacgacaacaaataggagtgtcaagaatggaatttaatataaaatataatatcaaacaaaacagcgagcgcgcatttttagatactatcaaggaaaggaacaatctagatattgttctaaatgcagcagtcaataaaattgtgattgttaaagatgaagctaagcttgtaactttcgttaaaaatggaacattacacaaagtaaaggcccgcaaagaagttatattatcagcaggcgccataaactccccccaacttttgatggtttctggagttggccccaaaaaagagagaaattgcccaggacttccaataaaagttgacttaccacaagtaggtaaaaatctacaagaccatccgatgtttgttaatttatattttagaaccaaccaaacagcaccaagcactactttaaaagagaaattggcgctatatttgcaaaaacagacccctcttacaaacggtgctggattggagcaactggccttccttaactccaaaacaatattatttggtgatccagatatcgagctcatgaccttcgcaccaccttctagtgttcctccaaatcccaaatttgcctttaacttcgacgaatcaaatagtgctgtttacaaaaattataacccacttacagatgtctcgattttggtgtcattactaaaagttaaatctagaggtcaggtaacactcaaatcaagcaatattgtagattttcctctcatagacttaaatttcttctctgatgcganaggagaagatattgcaactatgtacaaaggtattcagtatgcattaagtcttcttaacactaaggcttttaaaagtgtaaatgctaccttagttagcacccaaccaaactgtgaacaatacaaagataagggtgatanagaatattggtactgcgctttaaggcagatgacctctacagaataccacactgcaggaacaaccagaatgggattgcgcccgactgattctgtggtaaataaagattgcatcgttcacaatattcgcaacctccgagtagttgatgcgggagttatgccagaaataacacaagctcacgttaatgctgctgtttacatgatagcggaaaagatatctgatgtgattaagtgcaaacatggtaaactcaattcacccaaatgcaactataaacccgaaaatactttttttaaatatctcaataattttaaataactagcc

SEQ ID NO: 287 - DNA, 1727 bp, Diabrotica virgifera
gaatctcccgcggctttcccacgcgtacgggagtcctaggatgcggaacatcccgtaacaacaaaattatagttattattaatataatataatagttttgttattaattaatctatctaaaaatggccatcatcacaggaaatatctgttacgatcttacgggagtagtttttgcattcatagccatatttgttgtatactgtcaatgggcattccgttactggaaggtcagaggtgtaccatttgtggagcctaggattccatggggcagtctcaaaccacaaatcaactccacaatatcaatgggagaagaatttgctcagatgtatgtaaacgctaagcgagatggacacaaacacatcggactttatgccgctatatctccaatttatatgccagtagataatgatcttataaagcgggttttagccaaggattttaattactttaatgcccgaggaatatatatcaatgaaaaagatgaacctataggcgctcacttatttgcacttggtgggacaaaatggaagagccttagaagtaaatttacgccaaatttttcatcgggaaagttaaaatcgatgtttcacactgtcatttcatgtggaaaaatgttggagaattgcttaagcacaaagattaatggagaggagcccgttgatcttaaacaatttatgggtagtttcaccatcagcgtaataggttcatgcgcatttggaatagactgcaacagtttcgaagatgacaatccgttcaagcagatggccaatagaatcgtaaacagaacactttcggatgacgtcaaatttgctgttgcaatcaactttccaaaattagctagtgctatcagattgacttggataccgaagactattaaggaatttttcacgaaagttgttgttgatactgttacgtatagggaaaatagtaaaattgatcgtaatgatttcttacaaggactgatcaatattaagaacgatccagaaacaagaggaaaattaaacgacgagacagctatcacaatggacgaaatagtggctcaaagtttcgtgtttttcgtagcaggctacgaaaccagcgcaaccactatgtcatgggttttatacgagatggctgccaatcccgacatccaagaaagagttagagaagaaatagaagaagtactaaacaatcacaacggcgaaatcacctacgagtccctctgcgatcttaaatatatgggtcaatgcatcgatgaaacattaaggaaatatccaccaattccttttctcaccagagaatgttctcaagattaccagatacctgagacaaacatagtagttgaaaaaggcacaagagtcgtcatacctaccataggtattcactatgatgaagaatattatgataatccagatgtattcgatccagaacgattttcagaagagaacagaaagaacattattccatacacatatgttccttttggagaaggccctaggttatgtttaggtatgaggtttggcatcattcaagtaaaagtaggtatcatgacagttttaaggaactataggctaagtataagcaagaaaatgcaaatgccactcaaattaacgcctgcattcatacctacgcctgagggtggcctatggttagacatggaaaaagtttgttaataggaggattattatctactgacatatttattttaagagtttttatttttataaataaagttgaaaatcaacagc

SEQ ID NO: 288 - DNA, 1082 bp, Diabrotica virgifera
gttaaaaagcggtattggatttggatattggattttacgacttgtgtaaaataaagtaatacgtttacccatttcctaaataatggaagttctaaattcaaatttcagttcactttttagtgaaatagaaaaggctattaatgctagtttatttgtgagtatcgattgtgaattatcaggactcaatattgttaggaatataaaggcttttgacaccccacaggaatattactcaaaaatgagaatcaacagtaaagactttttggtcttacaatatggaataagtacttttagatatgatgaagttgacaataattttaaacatcaaacatataatttttatacatttagacgacctgtgaacagaaatgtacctgatataagatttttatgccaatcttcgagtatagattttctaattggtcatggattcgattttaataagctcttcaaggaaggtatttcttatttaactgaagaagagtatgacaattacaaagctaacatagatcaatcgtatcagaccgttttggaaggaatctgttctagaaaaagtgaagacagctgtgacactatacaagtaccagaaaatgcagtggcatttattgatgatattaaatcgaaaatcgaaaatttcctcacaagtgacgaaacggaactacagcttcccaaatgcaacgcattctttaggaaactaatataccaaactaaggaggaaaagtattcaaatcaaatttacttagaaacaagacaggtagataaagacagggtattatttgtaacgaggttaaaaagcccagaagaagaaaagcaactggcaaagaagagatatgaagaaaatttgaaagaactagataattttcatggtttcagcaaacttctgaaagtgctgataaagtcagggaaactaataattggccataacttatgcttagactttttgcatacaattgacaagtttttgatgccattacccgaatcatatactgaatttaaaagagtgagccacacattattttctagagttctggataccaaatacatggcgagcagtgggctattcaaagacctgatccattcac

SEQ ID NO: 289 - DNA, 1047 bp, Diabrotica virgifera
ggaaaataattattttttattaaaatatacaatctagctctactttttaatattgacaacattcgttaagtattttagtttgttagcggaaaaatacaaaaaaaattatgtaaaaaagttagaaatcatatccattagtcatgtatgttgggttgtcatgaactgtagagtgtttgatcgatagatggcagtgagatcgtgaataagaactaaactcaaggcggtattagaatcataaattaaggttaatatttttgcaatgaaactgccatttaataaagattctattcgaattgtacctataatagtggagattagtgattggagtacctgaaaatggctaaagtagttaacctacacatttaaattctacaatacctcacgaatatgagtagtttactggtttgccacatttactctaagctaggtacacctagggtatgtcatgattgacagtaatgacagatctgtgtaacaccctctagtaatcattgataaaaccttaaaagaccgcctaaatagtaaataaccgaaaaataatttttgcaaatttttagcgtcgaaactaatgagaatcattttgaattggctgtaaagtagttaaattttaatagaaatgaagaatggatagttatttaaaaagttatggtgtcgatcaaattccttttgttgaaaaaattctacagtataggatgacccacatctatattaataaactaaggtgtttagaattgattatgacttacataattatacgtggcataaaataaacggtatttttttaaatatttttaaaaaattataataagatgttataaaacaaaaaaaaggctgataaaatttgaaaatgctagaaaattgtaaacctggcttcgctgtaaatgaaattaataattgtctatttatataggaataattgtcatggtgaaaatcggtggcttttcaagcaaaaaagcatgtgatattttcggagaaataacttttcctctgagacgagccctgatttttttttttatacgaattgaagattttaaaactgcaaatata

SEQ ID NO: 290 - DNA, 2151 bp, Diabrotica virgifera
  misc_feature (2108)..(2108): n is a, c, g, or t
gtacttcgaatggcagagatgattaggtacgccatattactggttgttttggcaaccacagccgcagccattgacaaaacagtcttcaaaagctgttccgaacgaccattttgcaatcgtctccgtaactatgtggtcgatgataaatccaaatactcagccgatgtatattccgcatctatcaaagacaacattctgactgtacctttgaagaacgaaaacggcaacaacttgaacctactggtctctatgtttgaaggcaacaaaataagggttaaagttgaagacccagatagcaaaaggtttgaactcggagatatcgtcatcatcgaagaactgaaagagttaccattggtgagtgacacattggatggtacagatggtagcctattagtgacccctcaagatgagtctcttccttataaagtggttattgatgcaggaccaccactacttataactttctactacggcggattgaaacaagttgttatagatggtgaaagattagtgtagaaagcactgatgaaagtaaagcatttactttcaaagcagacttccctgaagcgaacagactatacgggctattggatcacgcttggagtttggctttgggagataccaataatggtactgctgaatctggagatccgctccgtcttagaaattctgattcttggggctacgaagccaattctccaatggccctgtatggagccagaccagtagtctacggtcattctgcaaacaaaacctctggtattttcctacataacgcagctgaacaatggatagatgcttcttctggatcagacggcaaggacccatcagtttatttcatcgtagagagagcagcgtttgatctattcatacttctagggcctactcccaaagaaatcgttaggcagtttacaggactaacaggcaaagctcatttacctcagatctgggcactcggttaccaccagtgcagatcttcctacaaatcccaagacgacgtaaaagacgtagtagctcgtttggatgaaaacgattttccctgggacgccatttggttagacggtgaccacacagatgactacaaatggttccactggaaccacaccacttacactgatcccgttgagctacaacaaaacatttctgctaccggaagggtctgcgtttcaatttctgatccccacatcaaagtcgacgatgattacgacgtctatgccggagctaagggcaaatacttcaccaaatgggcaaacggaagtgaatatgttgctgattgttggcccggagcatccagctggatcgactatttgaaccctgaagccgctgactattactcgacttggttttcttttgaaaaattcaacggtagtactccaacgttggctggaatctggaacgacatgaatgaacctgctgtatttgatgatagtacagaaaagaccatgccttgggaggtacagcattatggaggtgtcgaacacggagatattcataatatctacggtcttcttcatgtcaaatccacccacaaaggtctaatggctagagaccaaaatgcaaaacgtcctttcgttctaaccagatccaacttcgcaggatcacaaagatacgctgctatgtggaccggtgataacagcgccacttgggaacactttgccaactccatttctgaatgcatgaatgccaatatgctgggaatggtattctgtggagctgatatcggaggcttcatcggcgatccgtccgacgaacttttacaaagatggtatcagggagcagtttggactcctttctttagaggacactccagcagagagagcaaacgacgtgagccatatctattttccaaagatgttcaagatgtcatccgaaatgctttaagactgcgttatcaacacattccagctatctacaccctcttctacgaacatacagttacaggagaccctattatcagcccactctactatcaatacccacgagttaacgacagagatactcaaacaatgattggtgctgatataatgtcagttgctgtcaccaaacctggtgtaaaatctgtcgaagtctattcccctggtggctactctgacactgatcccttcgancaacagaccgacttctggtatagaggtgatcagaagcaattct

SEQ ID NO: 291 - DNA, 1169 bp, Diabrotica virgifera
acccacgcgtccgcccacgcgtccggcagcagccagcgattagatttaatatagtctaattagtgttgctctattcaacaatgcggtgggagattgtttgctttgtcggcgttttagccattgtacttgcagaagataattatttgttcgaaacaaagtatattgatgtgcctttagatcactttagcttcgcacaggacacgaagtttcaattaagatacttaatcaatgacacctatcacgaagatagaggcccaattttcttttatacgggaaatgaaggtgatattaaaaattttgcgaagaacacagggttcatgtacgacatagccccgacattcagtgctttactggtatttgttgaacacagatattatggcgagtcattgccatttggcgatcaatcttactcatccattgacaagttggggtatctttcctctcaacaagcactagcagacttcgtatatgtaatagaagcattgcaggaacaatatgctcataatcaaaagaatcttcctgtcatagcgtttgggggttcctacggagggatgttatccagttggatcagaatgaagtatcccagctctgtgttgggagcaatagcaagttctgctcccatttggcagttgggaggactgacttcgtgcgagatatttaataggattactactagtgtatatgcaagttttggaacagataaatgtacaaatggtattacaaatgtttggaaaacaataaggtcttttactaaaactgccgagggtaaagcaaacttaacttctacgtggaatctgtgctccccaattaaaactgatgacgatattaatcaattgatcgattgggcagcagaacttattgttaacatggcaatggttaattatccgtaccctaccaactttttagcagacttgcctgcttatcctgttagagaattttgcaatagacttaatagtcacaaattgaattggagattatgatctactgggtgcagttgttgatggatttgggggtctaatcccattatacccaaaacagctaaatgccaataatattaatggggccgtcacctacccttaactgaataccggctgggatttcccgtcctgccctgaactgcccccgccaatgggccccccaccccccccccgcctcaactcccccccccc

SEQ ID NO: 292 - DNA, 938 bp, Diabrotica virgifera
gcagcagcgtgcgctcggtgaatggaacgagatccggtctggcgatgccgttaacgtagaggggaactcggtgcacgatcgtaacgacggtgttcacccaggtgcgatagtttgcggcgaaggtttagcgcggcatgctgcccgatacacgagtctagtgatgataacgcaagagcccgcccccgattatcaacaagtgagtgtcgtcacctcggataccaccaccctggtgcctggaaacgacgttgttgtgaggcacaccaactggcaagaggccgatcacaaaagacaccaaaaaatatgcgatgaagttggagtttctgaggctcattcgtcgccgatgctcgcgtctcccagaaacggtacgaagagtgccacccccagtccagtgacgtccgtcgccaaacgaaacggagccagactgaacccggactggcatgacgaagatctcgataggataggaagtttgcagaatagaggaagtctatctactcttggggctcgctcggactcgatggcgagcgtgtactcaggagcaggagagggcaggtacggaactgttgcagtaagaggacaagtagagtttggactgcaatataactacaaagcaggagcgttggagatccaaatcaaacagtgtaaagatctagcacctgtcgatacgaaaagaaataggtcggatccttacgttaaagtgtatctgttacctgataaatccaaaagcggcaaacgaaagacgaaagtgaaaaagcacacgctcaatccagtattcgacgaatgtctcaagttccacatttctttaaacggtttagaatcaagaactttgtggttaacggtatggcattcggatatgttcggacggaacgatttcctaagggaggtcatgatgactttagagaataaagttttcgatgatcctacgcccaagtggtataacc

SEQ ID NO: 293 - DNA, 891 bp, Diabrotica virgifera
cgacgagtgaggtaaaatttgattacgacgctcagagaaacgacgacggttctgtggagtttgtgaagtgtggaaagtggaaaatagtgattagtgcagctataatctgttatataaagaatcctatccaagttaagacatttcataaacaatacgccttcagctaatcctatttaaacaaagaattcgataaaaacaaaacaatgacatcgtctgatccgttaatagtatcaaaagaaccaaaaggaggaatttaccaagcgctagacgaagtagaccgcgtcctcgacaaactcgaagaaggcgaaaactctaacgattggtgttggttctgctctttcgacagatgtcgctggtgttgttggtggtgttctaaggaaactgacgcaaaggaagaaaacgacgatgtgcattgtgctctagttagctacgtacaggaggtacaatcaaagcctgaaggtcgaactgtgaaaaatataatagtatctaagaaggacttactgctgtacaaagatcgccaagaatcaaaccgatcaagcgtagtgcaatcggaagcctcagatgttgaaacggaaccagaggaacctccaaataaattaagtgcgcagatcagtatatcggaaccaataataaatacaactaactcagaagagaagacagaagtacataaagatgaagttggagtttctgaggctcattcgtcgccgatgctcgcgtctcccagaaacggtacgaagagtgccacccccagtccagtgacgtccgtcgccccccgaaacggagccagactgaacccggactggcatgacgaagatctcgataggataggaagtttgcagaatagaagaagtctatctactcttgggggctcgctcggactcgatggggagc

SEQ ID NO: 294 - DNA, 974 bp, Diabrotica virgifera
  misc_feature (880)..(880): n is a, c, g, or t
  misc_feature (931)..(931): n is a, c, g, or t
  misc_feature (938)..(938): n is a, c, g, or t
gtacgatcaaaccgcgagttcgttaaatattgtcttaccctaccggtcgtgtagttctcacgtattttacgcaaaagttatatttccttcatcacaatgaacacagaagaattcaaagttcgcggcaaagaaatggtcgactacatttgtcaatacacgtcaaatctggataaaaacaaggccactccagatgtagaaccgggatatttgaggaagttgctgcccagtgaagctcctcaggagcctgaaaactgggatagtatcatgagggatgtggtctccaagatcatgccgggtgttactcattggcagcatcctaggttccatgcctattttcccagtgggaattcgtatccttcgatgttgggtgaaatgttgtcgaatgccatatcgtgcatcggattttcatgggcttccagtcccgcctgcacagaattggaaatcatcgtcttggattggtttggcaaagctattggtcttccagacgattttattacttcagctaaaaacagtaaaggtggaggagctttcgaaaccagtgctagtgagtgtgtcctagtgtgcatgctggcagcaagaaaccaagccatccagtatctcaaaagagacagtccaaacagcattcacgatagcgagtttttgccaaagttgatctgttatgcttcaaaagatgctcattcttgcgtcgaaaaagctgcgaagatactgctggtaaagattagaacactggaccctgacgaaaatggtagtttgagaggcgagaccgtccgtgcagccatggaagaagatatagctaaaggtctttttcctttcctcgttactgctacccttggtactacagggagcgcttcttttgataatttaaagagattggcccggntttgtaaattacagcatgtacatggcttcatgttgatgctgcttatgctgntagcggnttttatttaccagaactgaaatatctgctaaaaggg

SEQ ID NO: 295 - DNA, 999 bp, Diabrotica virgifera
cggacgcgtgggaaacgatctcactgcgacccaaagccttttttgtgtataccatataaccttaatctgttttacgtcgaaaagctctttctgtattttcacagaatcaacgccataacaaattttaaaaccagcaaacttttttctacaagcaaaagtcaagagaagtatatgtgacacaatacatattacagttttgctgattttgttttgaatacagtggaacttcgataactcggattaatcgggaccgcggccgatccgggttagccggagaatatggtaaaaattaataaaatacggtatgtttacagataaactccgttataattgaaataacatgaaatatatatgcacagtacacatctaaattacgtatagttgtatagagtatagttcatttcttggtaaaaaactcatgcgtagtcaaaaaaacacgcaaacacaaacctatctgaagcacgattacagaacggaagtcaaaaatacgactatactacacacaatacggtcacaatcggaacaatgttatgctatttaaggacagtggagacttgtttaaaaaataattttttaaatagtcttttgtgaacaatgccaagacagttggaaataaataaaggaaatgaaaaaggagacatgctggaaataaataaaggaatacaggtgcctattgtttccgataatccgagaaaatgaacgtcgctctgccgccgtgtgccatgagtcatttttactatcgtatagttgaaattacacaaatgcacattatctctcaaatattatattacatacatttttattgttgaaatgtttgtctgatgaaaatcggtccgggttagccggactttcgggttatcggggttccactgtactgttttggggactcgtcattttggtacattttgggatgaggaccatgtagatttcatagggggttatttagccacttacacttttccctactgcgaaatggaattttttttgatggacaatagt

SEQ ID NO: 296 - DNA, 1400 bp, Diabrotica virgifera
  misc_feature (968)..(968): n is a, c, g, or t
  misc_feature (1028)..(1028): n is a, c, g, or t
tcctaatcatatactcgtggtcttcttgtaaatctctgattgtgaatttctgtacgcccttttggacccttccgatctccatccacatggtctttttggtgtctctgatggcaatgttgtaacctagaagcggtgagcctccgtctgattctgggattccccattccacaacgattgcgttgggtcctatggttcttatttctagtggtggtgttggtggagaaggtacagtggcatgtgttcgcatttgcacaatctcagaagtagctggcggactgagtccaacgctattttctgcgaacaccctgaacagataatcgctcttctctttcaagttctcgaaggtgtattccaaggagaaggcttccaatgtgaacactttttcccatttaggcatgtattcaagtttcttttcgactatgtagcccgtaatttcggttccaccatcgttttctggtggttcccaagttagcgttgcgcttctgctggtcaaatctttgaccttgaggttgattggaggtgatggtggtgtcattctggatcctgcaatgatcgtttctgatggaagataaggatcgctcacaccaatagcattcctggcagtaattctgtagttgtagccatgtcccttttccaagtagttgatggcgaagttggttatgctgcctttagtagcacctagtttcttaaagaccttcttggtcttggcttctttcatctcgactatatactcgatgatttcagaaccaccgtcactttccgatggctgccattgaattgtaaatgatgtatctgacattcccgatatttccagaggacctcttggaggagaaggtttatcgccaattttaagtttggatgaagtcttcagttggtacttttcaactgtacaagaatactcgtattcatcttctatagtagttttatgtacaaccaatcttcttaccctacgatcttcaaagatagangtacctggaagatttttctatgcgttcattctttctgtaccacgtaacttcaacgtcttnccttggaaagttcaacttcaaattcagcgtcggtattaattggaacgatggtgtattctggtaaagatctgatgaaggtacaactgggtacttccaccgtaagtctagctttggatgattgagttccaacttcacaagaatatacaccttcatcttccagggttcggtttttatagattttcagtttttgcctctttccatcaatagacaattgaacgtgttctgagaattgtatctctttgccgtctttgtaccatctggccaaagcatcgccccttggagagttctatttcgaagacagtcttgtcgcctttgtaaccacttgatctttttagtggtgttatattttctgggagggtaattctatcactg

SEQ ID NO: 297 - DNA, 1434 bp, Diabrotica virgifera
catttctaccaatctgaatctatacagcgaaacagcgacaagcgacaacagtgtacagtagcgagtcacgtttagggcagctgaataaggttaggagttgaggtaaattttattgtgaattttatttttgtatttgtaaacgcttccttataaaaagtgaaatctgcacagaaatggcttccacattaacaactattgttgcagttcttttggtaataaatggagcttatgcattggaatgctacaaatgcaattcacaagataagactctatgtaaatggggtctcacgtcattcctgcaggatacagaacaatgtagctcagttttaggcgctgttttctcgccaaaatgctataaaataactgccaaaagtaaaggcggaagtgagtacatcgctagaggttgtatggcaactggccttggtggtggctgcagcgctatggctaaaacactaagttggttctcctctgcggtttcaagtgacgatccagatagcctccaagtcttaggctgtgaaacttgtgaaacagataaatgcaattcggccacaaaactcactggatttgctttcatcggcctcgtattgtctgcaatggctttcttaatgtaaatgtaaatctcgctggagttattttatgtaactcaaataaatttaggctacgatgcttgttcaatcgaaacacatctttggtcagaagaaaaaattattggtctagaaatatatatgtatctagaaataattgaaacaaagctaaaatcaatatcaataaacgaattaatattaaaattaaactcgccagtcttccaggttacactgcgtcgttggttcctaagccgagctttccacgtcctctctgacgttatcttcggcgcttccggggtctcggtctcctgaggctccagacactacactcgctacaatactgaccaaaaatgcgtttcgatggaacaagcataatatttgtaaggaagatgggcagctaagtatgttcgatgtctcagtaagttacgcaatataataatttataggtagttatgactgtaatgtttatatattttttaaagcatttatgaaagttcgacgctagtaataatataaagatactattatttgaaactttctaaaaacaaaaaatacgaagcacatatatttaacttttttttaaaatattgcgcacagcagaaatataacgcatgccctaacccaaaagttctggcacacaatagctatcgccttataactataatgaagaagtttatttaaacactacactccattatgcatttataaattggttatcataaattacaaaagcatctatatgaattactaactcctaacgcagagaacaacgctacgtacccctgaaaatagatagcttgtctatgtatccgaattcatgttgtctccatctggttgcgcgatcagcacc

SEQ ID NO: 298 - DNA, 1556 bp, Diabrotica virgifera
tgcaattattattactatagtgtgaatacaaacatttccataaaatatctcgttagtttgttttatcttatctcaaaattttataatggcattgagtgcattagagatcagctgctagtaatataaagtgattagacggctgatgtattgttatttatttaattaagattgttctcacgagatcaacatgttgtcattaatactatttggggtagccttggccctcttttattatgttgctataaaacctttgagctactggaaggaaagaggagtaattttccaggagggagctctatggttgctcggaaatcaatggaagttctttttaaatcgtcaagatatgtttgaagtatttgaagatgcttacaatgttgcaccaaatgctagatatgtaggtttctatcaatttacggtaccttctttgatgataagagacccacaactgttaaaacagataactgttaaggattttgaccatttcgtcaatcatcgaacgtttataccacaaggtgctgacccactttggtcaaagaatctactttcattaagagatcaaagatggagagatatgagatcagtactaagcccatcattcaccagcagcaaaatgaagatgatgtttcatctcatggcgggctgctctgagaatatggtaaaacatttcttgactaaaaaccaagaaatcatcgatgtgacgtttaaagatgttgcaacgcgttttgctaacgacattatagcttccactgcttttggaataagtacgaattcttttcagaagcctaaaaatgaattttacttaatgggaaaagaaattacgagtttttccagtttctggaagaatttaaagatcatgggttttataacaattcccaaaatttttaagcttctaaagatcaatctctttgatgggccctcaagggagttcttcattcgtctcattgaagacactttaaaaatgagggaagaaaaaaacattgtcaggcctgatatgttgaatcttctaattgaagcaaagaagggtatacagcataaagatgagcaaaatggagtcgatgatgggttttacacagttcaagaacatctaccaggaaaacacatgcaagattctaaggaaatcacaaacgaagatattaccgctcacgccttgatattcttctttggtggttttgactcagtttccagtactatgtgcttcgcagcacacgaattagcaacccatcctcgactccattttgctaacgacattatagcttccactgcttttggaataagtacgaattcttttcagaagcctaaaaatgaattttacttaatgggaaaagaaattacgagtttttccagtttctggaagaatttaaagatcatgggttttataacaattcccaaaatttttaagcttctaaagatcaatctctttgatgggccctcaagggagttcttcattcgtctcattgaagacactttaaaaatgaggggagaaaaaaacattgtcaggcctgatatgttgaatcttctaattgaagcaaagaagggtatacagcaataaagatgag

SEQ ID NO: 299 - DNA, 1195 bp, Diabrotica virgifera
gggacagatttccgtctttacaagtgcaacaaagatctgtacatgtacatcactccaatttatactggtccaatccaatcttccgaaatagacagacgatccaaggatagtgcactctttaaagtctgcatttttatcaaaaactaaagtatctggcgtgagataagattttttgtataaatatttaactggtttaaataccattgttacaaaaactgtttgaaatctttaattagcgaagtgttggtaacaattatcgactcaccatctaatttttaagctaatagtgttcgtacttttttgatgcagtcatccacaagtctcaaaatctcaaagttacttggttgtatttttagaaataattttttgtcaagatgttaccagcagaaagcaacgatttattcgaaaaacatccgccagctcccgttatcaaagtgtataaaaggagatgggtgatattagccatattcattctctattcttgcgccaacgctttccagtggattgagtactctatcatcaccaacattgtggtaaaattttatagagtgagcacgattgccgtggattggacctctattatatatatggtcatttatccttttattgttgtaccagcttcctatattattgatactcaggggttaagggtgaccgcattgattggtgggctaggaactgccttagccgctgtcgttaaagttttttctatcaggcaagacttatttcggttggtacttttaggccaagcgattggatctacggcgcaagtcttcgtcatgtgtctacctgcaaaaattgctgcggtttggtttagccccagtgaggcatcgctagcttgttcattggctgtatttggtacccaactagggtttgcacttggttttgtcctccctccaactctagtcaagaactctgaagatctaagtgtgatcggtagtggacttcagcaactgtgctgggttttagccatttatatgataccagtcagcgtggctataatattttactttcctgcccagccgcctctaccaccaagcatagcccaatttgacgaaaggaaacttagaaaatcttcattcagagatttctggaataaatttacaaatagtttgaagcattacggcttcgttttgcatctggcggcttacggaataaatgtaggagtctatgccggcctttggcacctttttaa

SEQ ID NO: 300 - DNA, 733 bp, Diabrotica virgifera
ttaaaaagggaattttttttttttttttcacaaaactcctggtccaaatagaataccattaattcatgttttaaaatatcaaatttttcagatatttaaggcaaatttacaaattactataaatttatttttaatgttttctaaactcataaaaatatacggagtttaatttgttttaaaccccattgttttgaacaattaatttcagatgcaaatatttttgcatatatattttgaatttttcaatatattgtcgatctagtatcacttcgatattatgcttataaaattttttgtagacgaaatttatgaacatcctaaaaatacttccagaggagatagtacagtatagctccaagaaaaactgacttactggaaaagttctagttacttgtagaaatattcccgaaaagacattctactgctctacaggattgtcaatactgttaagttatatatatttgaataggtataataaaattgttctgtataaagaaatatgtgcagctgcacatttcagttttggataatcaaatttcttggttatatagaatgtttatttatgtgaaggtgaagataattttggtatgatctgaaactgttttgagcgactgttggctagtcagaaaatgatcgtgtacgaaatattgtatatatttttttgaaacatatacagtatttttctgactgatgatttgtatatagacttcctccaaaataaatgcgtttaaac

SEQ ID NO: 301 - DNA, 1263 bp, Diabrotica virgifera
ccaatcagagccaactatccgctgtcctgcgcgtggcaccaataattaatggttgtttaaaagagttcctgacaccgtggtggttggtcgattttaatgttgcagattgctaatgaagggtagagttcacttctatacgcaaataaaggttcagcttgctgtctgctttattttcagtcctgcaacgtttaaaaaaatgaatttttttttgcgaaagctggattgcagagtttattttgcgaaatctgttaaaccgatcttaatgatatttgcagtactgttttgctgtatcataatgtttttacgggtgaaatacgaagatcctgtgtgtagcataaatggttgaaagatgtaagatgcgaatgcttgtttttgtatggttttttcgcaattgttgctgttttgcaacgggggtgactattttttgaatttttaactaattttgtattgtagaaagtttaattacgcaacttttatgttagtgcggcttttctcgagaatgagcagttttacagttatgatcaagaaacgaagaaaaagtcgaatttttccttcattttttgacattttgattatttaaacagtgttccggacctttttgagagtgaggattgctcaaatattattgtttgagttgttttcgggcaatttctgcaaaaaaatttgagtcacctctcaacgtccaaatgtactaatatttttacagatgtttgtcgccgtccttactactctatttgttgtcattcggcatatgtggtcattccattctactcttctgtttcctacttatcttatatctgtacttcttaccatttgtaccatcttacctgtcttaccatcgatttttttgaacggttttcatttccaccgtttcaagcaatattttggtcttgtctgtttctgccgcgtatgtcattattggtccgatgacggttttataaaattctgcttttcatttctttacctatatttttatttttccatattgtgtcatgtctatcttttacttttaattttattgtggggtcctgggaagacggtttttcgatcattttaattattcctagaggtacctctctttagtataaaaaaaatggattaacggtcctttaatttcacccctctccaattgcttacttaaatggccccccaaaccaaaaaaatgccgctttgtaaattcttaataatttccggtgaatttgcttcctttaaaatataaatgccggccccggacttctctaccccaaaaccccattttgcctt

SEQ ID NO: 302 - DNA, 1398 bp, Diabrotica virgifera
atcatcgaatttcaaaaagaaaaaagctgccaagcagaaagcacaagctggttcttcgcacaattggaatgccctgtttttgggccacgatgctgtagctgaagtaatagccgacagttttggaactactaaagaagctgtgataggtcctgatggaaaaggtagtgccgctgtcaggttagctttgggagaaacgcaaattgttgcacaaactaggaaatatttggaacaagagggtgttgtgttggatgcctttgctaactcaccaggaaaaagatctaaaactctaatattagttaagaatttaccatccaagactgaggctaaagaaattcgtgaaatatttgagaaaaatggagaagttggtagagttattttacctcctagtggaattacagccattattgaatttctggaaccttccgaagcaagaaaagcatttacaagattagcttacaccaagtttaaaaacatgcccctatatcttgaatgggctcccgaaaacagtttaaaagaatcaagcaaatataataccggaaagattgtaaatactgatgataaaaaaatacaaccagaagaagaaacaaatacagaacaaaataacgaagaaaatagcaacgaaaacaatgtcgaggaagctgaagaagaagaagaagaacctgagcctgatactacattgttcgtgaaaaatttgaattttaaaacaactgatgaaggtttaaaaaaacattttgtaagttgtggtaaaatccactatgccaatgtggctaccaaaagagatcccaaagataacaacaatgttttatccatgggttatggttttattcggttcacgtacaaagccggagctgataaggctttaaaactatgcagcaaagtgtcttagatggaaaatcgttggaactgaagagatcagaaagaacattcaaaaatgacgtacaatctgctagaaaagttaataaagctactaaacagactggttccaaaatattagtgagaaacgtacctttccaagcgaataaaaaagaaattcaagaactatttagtacgtttggagaaattcgagcattaaggttgcccaaaaaaatgggagctggtacagacagccacagaggatttgctttcattgactacacaacagcgtctgatgctaaggccgcgtttgaagcactttctcaaagtacacatttgtacggtagacgtctagtgttagaatgggcagctcaagaggaaggagttgacgatatcagaaaacgaaccgccagccatttcagaccagaggaagaaggaaaaaagaaatcgaagaaaagtgtttttaccatgtaaagcttgtaaatatacatctttttaatgttcaaaaaaaaaaaaaaagggcggccgctcgcgatctagaactag

SEQ ID NO: 303 - DNA, 536 bp, Diabrotica virgifera
tctttgtccggcgcagtggtagttcgtgcattcagtaaattttattgatctgctgtaggcctttcgactttatatttaaaatctactcgatctactcaatatactaatacagtaaagatgctgttcacaaaagttttgggaactgtaaggaattccgtaaagaacgaggtctgcagtcgaaatattggaattctagctccttgtcttcaaaaggcttcagatcccattcaacaattatttgttgataaaattagagaatacagacaaaaaagtaacagtggaaaaagccttgtagaacctactgccgaattagaaaaagaactaaaaactgaactcgataaagtcgcaaaacaatatggaggtggccaaggagtagatatgaccaaattcccatctttcaaatttcaagatcctgtcattgaccctattaacttagaaaagtaaattattccttatattttgttattgtgaaatagtcattaataaaacatttctgttcatgaaataaatactagataattaaaaaaaaaaataaa

SEQ ID NO: 304 - DNA, 961 bp, Diabrotica virgifera
ggcagaatataccccgtgtactttattgtgcaattctcctggcaatccaatcaactggagtgttagagaatctcaagttgtagtagatagaattcaacatgaatactttgttcatttgttagtagacaatctaccagcagcaattgatgttttcaatccagaaaccaatgaacttcaagtagaacatggataccgacttggcaacactgttggagatagaagtttcatcaataaccaccttaaacttaggtttttgtaccataatccacagcccgatgtgtacagaatagtaggttttcaaataagtgcaaaatccatacatatggatgagttgaagtttaatggaaatacttgcgacttgaccagtaaacataaatcccaagtggtcgatccagtatctggtacgaagttgtattttacatacgaggtggaatggaaagaatcgtcagtgagttgggcttcaagatgggatacttacttggccatgacagatgcacaaatacattggttttcgattatcaattctatcgtcgtcattttcttcttatccggcattctcaccatgataatggttcgaacacttcgacgagatattgcgaaatataatgcagacgaaagttacgacgaaacaatcgaagaaactggttggaagttggtacacggagatgttttcagacctccacgtaactccagattgtttgctgctcttgttggatctggaattcaaatatttttgatgtctcttataacgatattttttgctatgttaggaatgctatccccagcgtctcgaggagctctaaccacagcagccatcaccttctacatgatccatggagctgtggcaggttatctatctgctcgcctctataaaacaatgaagggaaaagagtgtaaaagacccgcctttctccagctggggtgaatcctgctttcgaaggcgggaactttgtttgttttt

SEQ ID NO: 305 - DNA, 927 bp, Diabrotica virgifera
cccacgcgtccggtcggtgacgaaattacataatttggttcccgctatggcaagtaaagtaccctcggtaaaacttaacaatggacgagaaattccagcttttggtttaggaacgtggaagtctaaaccaggtgaagtaacacaggcagtaaaagatgccattgacgctggatacagacacattgattgtgcatatttctacgaaaacgaagctgaagtaggagctgctttaaaggataaaattgacagcggagcagtaaaaagggaagatcttttcattaccagcaaactctgggtcacgtttatgaaacccgaactggtggaaccaacattccagaagactctccaaaacttaggtctcgattatctagatttatatctagtccactggccagctgctcttaaggaaggaggtgctttgttgcctaagcgtccagaccatgaaactcttggtatcttcagcgacgttgattatctagacacgtggaaagaagttgaaaaactcgccaaaaaaggtttagccaaatccataggtgtctcaaatttcaataaaagacaactagagagaattcttgaaaacgctaccattaaaccagtcaataatcagatcgaatgtcacccataccttaaccagaagaaacttatcgccttctgcaaatcaaaaggtatttccgtaactgcctacagtcctttgggttccccagacagaccatgggctaaacctggtgatccaattctcactgaagatcctaaaataaagaagattgcagagaaatacaagaaatctagtgcacaagtaattctaagatatcttttacaatctggagtaattccattccaaaatcagtcaacaagaataggttacgagaaacataaatatttttgacttcgactctctgcagatgatgtagctgttatggatacctt

SEQ ID NO: 306 - DNA, 1885 bp, Diabrotica virgifera
agttctctgtagtacctgttcttatttattaatttgatagtatttagtgatatttgatatttttactttctagtcacaagtaactgaagcaaacatgtctaaccagcagtattatcctttcaaatgtacacccactgtctaccccgccgatcccttcgaccccgtggcagatgccgccaccttgaagaaggccatgaaaggtttcggcacggacgagaaagccatcatcgacgtcctggcccgtagaggcatcgtccaacgtctcgagatcgccgaaaccttcaagacctcctacggcaaagacctcgtctcagagttgaagagcgaattggggggcaagttcgaggatgttatggtagccctcatgactccactgccacaattgtatgccaaagaactgcacgatgccgtagccggaatgggtaccgatgaggaagctatcatcgagatcttgtgcacattgtccaactacggaatccgtaccatcgcacaattttatgaacaaatgtacggcaaacctttagaaaaagacttgaaaggagatacttcaggacatttcaaaaggctctgtgtttctttagtgcaagctaacagagacgaaaaccaaggcgtcaatgaacaacaagccctcgccgacgccgaagctttgatcgaagccggcgaaggaaaatggggcaccgaagaatccatcttcaacaccgtcctcatcaccaggagttaccaacaattaagagccacattctctgaatacgagaggctaacgggcaaagacatcgaacaatccatcaagaaagaattcagcggagatatcgaaaagggattgttaggaatcgtcaagtgcgtgaagagcaaagttggatacttcgcggaacgtcttcactggtccatgtccggtttgggcaccaacgacaagactttaatccgtatcatcgtctcgagatctgaaatcgatttggccgatatcaaacaagctttcttggacaaatatggcaagactttggaaagctgggtgcagggcgatacatctggagattacaagagagtccttttggccatactcgactaattccacaattaaaccaaaaagcactgtaatcttagataaatctgtacgcctttacactaaaacaaacaaattactagctttcgtcatactgccattagaataaactcaatttttgatgtttgctgtcgaaagtcacctacatacactgagacgctacttgtttttcttttgagtgtagcctaacttatgtttctttcgcggttacattactatacagaacctgttgccttcggaaactctcaaaggtttcgaaaagagtacaaattaacatgtagaagaggatctgatcacaccaaatataagttagattatgttcaaagttgatcttcggtagtttgaaatttttctcagtgtacacgtatttttgtaattttgcaggataatgctaccagcgagtttaaagtatgttttggtacagcttacgtggtacggtaaaaaagcccatggcactcacgtttgccaccgtttccaaaaatattggataaaaaatctttttatttttaaccaaaaaaaaaaccacttggttatttataattataacccattttaaatttatgttaaagaggcccttaaattgttaaaaaatatttattccccccaaagtttttaacaaaagggtgggttgtgagggacaaaatttatatttttttgtgttttttatttaatttggaagaattttaaaagaaaaaggggggggaggggggcggtgatttttaccaaaaacctatccttttgaaaaacttttttaataaaaaaaaaaccctttcttcctccttttttaacaaggtcggaaaaaggggctttattttggggcctaac

SEQ ID NO: 307 - DNA, 1315 bp, Diabrotica virgifera
aaaattttccccgtggtgcgacccccttttcgtccagcaggaaagtagaatttctttagcaagcagttgtcgtatagaagagaaccagtgggtgtgactaaaattcaattcctctcaaatcacaagtaactgaagcaaacatgtctaaccagcagtattatcctttcaaatgtacacccactgtctaccccgccgatcccttcgaccccgtggcagatgccgccaccttgaagaaggccatgaaaggtttcggcaccgacgagaaagccatcatcgacgtcctggcccgtagaggcatcgtccaacgtctcgagatcgccgaaaccttcaagacctcctacggcaaagacctcgtctcagagttgaagagcgaattggggggtaagttcgaggatgtgatggtagccctcatgactccactgccacaattgtatgccaaagaactgcacgatgccgtagccggaatgggtaccgatgaggaagctatcatcgagatcttgtgcacattgtccaactacggaatccgtaccatcgcacaattttatgaacaaatgtacggcaaacctttagaaaaagatttgaaaggagatacttcaggacatttcaaaaggctctgtgtttctttagtgcaagctaacagagacgaaaaccaaggcgtcaatgaacaacaagccctcgccgacgccgaagctttgatcgaagctggcgaaggaaaatggggcaccgaagaatccatcttcaacaccgtcctcatcaccaggagttaccaacaattaagagccacattctctgaatacgagaggctaacgggcaaagacatcgaacaatccatcaagaaagaattcagcggagatatcgaaaagggattgttaggaatcgtcaagtgcgtgaagagcaaagttggatacttcgcggaacgtcttcactggtccatgtccggtttgggcaccaacgacaagactttaatccgtatcatcgtctcgagatctgaaatcgatttggccgatatcaaacaagctttcttggacaaatatggcaagactttggaaagctgggggcagggcgataaatctggagaatacaagaaaaaactctttggcatactccactaattccccaattaaaccaaaaaagactcaaaatttaaaatcagaacctataaaaaaaaaattaaaaaagaaacttttaaccacaaaaaaaaaacaattaaaaaaaataaaattttttttttgtttttgtttgccgcaaaaacccccccacacaaaaccggtgaaacccccatctcgtttttttttttttttttttttttgggggg

SEQ ID NO: 308 - DNA, 965 bp, Diabrotica virgifera
taaatctaaaacatgattaaattaccaaactttataaaattaacgcggaacttcaatttatatttaaacagttgtaagttatcatcaaatacggaacaatctttgtcctcaaaactcgaagaaaaatcaaaagaactccaaaaaccgaagtattctcccaaagatgttacaccagcagatatgaaatggagaacaccttggcatcaaaaagagggacagtattatagtgttttaagaaatttttacaaagaagatacaaataccagccttcttcaaaaaattcaagctcctatcgacttatctccgggtgcaataaagaaatggtgggcgaagaaaaaagaacatgaatcaaaagttctacagtcttatatacctgaaagacatcagatattaggtaacgaactagctgctgcacatttcatagttcatagaggtggctcagtaaaattttttaatgaagacaagtggataaaagcagatgatgacaacaattattcacttcctagacattatgaagaggaaaaaattcttcaagccattgactgcacagacatggacttatattacgaaggtttagttaatataagagatttagcaaaagtggaatggttaagctttaatggttgcccccatatagatgattggtgtctagacagaataagtaacatcttcagccatagtttaatatatttagatttacgaaattgtccaaagattacatttaagggattagcggcattatacaaattagaacaattaaaaatattgtatttagatgattttcttagatcaactcagtatgagttgacatgtttattgttacaagaagttaatccagatttagatgtaagaagtgatcaaattacatttgatatatcgaaatagacgacaaatttaaaaaaaaaaaaaaaaaaaaaaaaaaaaagaaaaaaaaaaaaaaagggcggccgctcgcgatctagaac

SEQ ID NO: 309 - DNA, 1053 bp, Diabrotica virgifera
gcaataaactgtttcagagatacaaggtgttgcaatttttcttacaaactgatagtttgtttgttgctctgaaaccggttgagatatgcaaatgaaatttggtgggttttaagaggtagttgttgcgcattttttgacatacaattgagaattttgtattcaccattggcgtgtatccgggtaatatgacccgtaagcgcgccaatggagaatataaaatttttaattgtatgtcggaaggttcggaatagctacctcttagaacatatgtaatttcatttgcatatttcaaccggatttggagcaatagataaatcgtcagtttgtaagaaaaatttcaacatatcatatctcggaaacaaagcataaacatatgtttataaagcaaactgtcattgttttttcatcgggaattgccccttaaagtttgtagcacttatttagaaacaccctgtattgatggggaacatggctagttgtacctaacttttttattatccaacatgggcgaatgaatcaaaaaacagaatgttaaaaaaacgaggctatagttgtgttttaatttcagtattttttgaatgctggaatattcgacagggtgacgagaactttgagagacaatcacagtttgattggtgcacccggtgtacagtggcagtttgcctgtctagcagcaatattattacagcgatattgttaaagaatgaggctattattaataggcatattaaaaaatcacttaaatcggaacaggtttaggaaattcgagacatcaaaaatgacctatttttggggtcgtgcgttaatttcttggagtagtatattatagttttaattgttaaaaagttatcttcattccagtgatgtattaatgtaatgtgatgtaattaaatatttatctaattatccaccaacagtgtcttgaatttctgaagctatttatgttatcagttatgccggaagtacatattcaattgctttttgtcaaaacggttaaatttattattcaataaattttacacacatttgccaactcttgactaaattgctatg

SEQ ID NO: 310 - DNA, 475 bp, Diabrotica virgifera
acccacgagtccggctgtttgaaccaacacacttcagatctttccgtgcgggctggatctgccaatcttacaagtgggggttacataatagacgtggacgattttgtaattcatccgaaatacaacaagaaaacctataactctgacatagctctactcaaattcgcaaaagaagtggagggaagcaatgtttcaattgctcttgtacctttccacgatacaagcgatgtgtccgatcataaaggggttgctatgactggttggggtgctcttgaatagggcgaaaattttaccgaagtgctccaaatgggatatccttcctcaatctcgagaagttcctgccaaatggcgtacccgaccaaaatcatatcgttaaacatgttttgtgctggggtttacgacgtccaaaatattacagcttgcgatggagattttggaggacctgccacctttacaaattgtttacaagggataa

SEQ ID NO: 311 - DNA, 1211 bp, Diabrotica virgifera
  misc_feature (1139)..(1139): n is a, c, g, or t
  misc_feature (1175)..(1175): n is a, c, g, or t
  misc_feature (1181)..(1181): n is a, c, g, or t
  misc_feature (1187)..(1187): n is a, c, g, or t
  misc_feature (1196)..(1196): n is a, c, g, or t
gaattaaaccatttattccatcatcctcagtaactgttttagatccctctcaacaatatttgttgacattgatgaaaatgagacttaatctagattttaaatatttggcctaccaatttggcatttctcaatcaacatgttccacctattttaataccatcatctcaataatgtatcaaagatttaaaaatagcataaaatggccagatcgggaaattattaaaaaaaacatgccttcttgctttagagaagtctttcatgataagaccacaattatcattgattgctttgaggtgtttatccaaaaaccagctagttatttaacccagcagcaaacatggtcaaactataaacatcataacacagttaaattccttattggaattactccccaaggctgtatttcatatatcagtaaagcatggggaggaagaacatcagataaacaaatagtagagctctctggttttttggataaaatagaaccccaagatattgtgatagcagatcgaggttttttaataaaagaatttttagatgtgttacaagcaaagctagtaattccagcttttaccaaggggaaaaaacaattgcttccactagagctggaagaaactagaaacattgcacaggttagaatccacgtagaaagagttattggctccattaaaaataaatttaatattttttcagagccacttccgatttctatgttaacccatgttactgatggtataaatatagttgataagataatttttatagcatgtgttttgattaatttatgccctcctattgttccaatttaattaaatttaacctatttcaccagattgtcgcctttttagtatttcttttaataatttttggtacacatctgaagtatcactacgaaaaacaatcaatgacacctttggccaaaactaggatatatatatgccatgttgtcgaggttgtcagttagttttgaattataaatagctacagcaagaaaacttgcattgtttcagacaaaatcaaacaagcttatatttttctaaaactttttttgttggtttttaaatatgttaaagtaaaaagttctactcacagatttggccgctaattgtttaaagaattaaaactcttttgtatacttnaataattttaaaatattgaattcatcattttacaantctttngtgtgnggaagcttngcagtctgatgatct

SEQ ID NO: 312 - DNA, 1046 bp, Diabrotica virgifera
aatcaaaaatttatttaagaatatttattgatctgaatttttaaatcattttttacaatacaggtttcagactttttaaggtgggtttacaaatgttttgaacacatttttatccaaaccttctaaaattttgacatcctcatcgcttatgataaaatcgaacacattaaaattttgctctattcgttctggagtcacactttttggaattggtacaatgtttttctggatcagaaatcttaaggctatttgggaaggtaatttattgtactttttggcaatttgttttacagtctcgttgtcgataatatctaatcctactccatattcaccccctgggcctcctaagggagtataagctactactgtgatattgttctttttgcaatactctacaaattctttacgctgaccatacaaatgtacttgcacttgtaaattgacaggctttactctgccgttctgcaaaatatattctatttgttcgatagaaaagttggacagacctatatatttgacccttcctgcatcaacctgttcttctagtctcctccatatttttaggttcttttcattatcatcagatggattatgaattagatataagtcaacataatccagctgaagatcctctaaggtttttttaagtgtatcttctggatccaattcatctcttggttgaaacttgctggtaataaaaatatcttccctttttattttattgggaacccatttctttaaaactttccctataagagcttcgctttgataaacgtaggcagtatcgagatgacgaaagcctatttctagggcatgatctagggcattttcttgagcgtcagctgttccatatccaatagaagggattttgaacccgttaggcagagtttgaaatagcgccatgattgaagggattacactgaaataatttcaccaacaattgaattattatattatatcttattatcgtcaaatcattgtttggttttatatctaaacattccaaataaaattgaccttgattcagaggatgaagtacctagcac

SEQ ID NO: 313 - DNA, 567 bp, Diabrotica virgifera
cttgctgcgtagaacattgtttaagtagacgaaaaaatgaataaaatctttttgtgttttgcagttttgtgctgtgttcaacaaggatttgctttattaacaccagttagtctaggaaagcatattaacaaagaaagtaaatcacttcaagcgaattgcaaagtattaacaggtgctacgcaagaccagatagatcaagtaagacaaggtaactttaaccaaggaagcaacataaagaactatgcagcttgtatatatctccaaagtagattgatggacaaaaattttaattttgatgttatcatgatggattactttatgccaccaaagcaggatttatacgtagaatatctgaagtgtaacttacagtggagaaacgctgacttgtcattcgtagacaaactttggaatcagatccaatgtgtttatcaacatgacccagcaaacttcatttttatttagaacctaaaaaaatggggagaaaataaacgcagtaggacaaaccgtagtatatataataaagcattttcgtattgtctattgtaaataaataaattatataatttt

SEQ ID NO: 314 - DNA, 1035 bp, Diabrotica virgifera
  misc_feature (980)..(980): n is a, c, g, or t
ctagttctagatcgcgagcggccgcattttacttcaaaatattttttaaattttcttcacatggtgtttttttatttaaaatgtttagaactcctatactaagatgtatcagacagctacagttactagaaaataccataaaaacaactgtcgtacatacaaccagctttcaattacaaacaacttccctttataaacatccagaaaaatcagaattaacaaaaaataaaccttctagcagtgaccataactttttagtaaaattaaaatcagatcctgatacgtttggaacgcagcaagaagaagatcctttagtggaagacgatgtcaaagaagataagtattttacggaaaagcctttaaggtctcaaaagctaagtaccaaacagtatgcagatataattaaggatctaataaggaagaggaagattaaagaggccatagatgttgtagaggttcgcatgttgaaggaggatagagtgaaacctgaaagttatatatacaacttactgctaggtgcctgtggacgagttggatatacaaagaaagctttcatgttatacaatgacatgaaaaaacgtggattaaaaatcacacctggaagctatacagctctatttaatgcatgtgcaaacagtccatggcctttgacagacggactgaaacgagctacacatttaagagaaatcatgatagaaaaaggctaccaacccaacgataccaactacaatgttatgattaaagcttttgggagatgtggagaccttcctatggccttttctttggtagatgaaatgaggtcaaaaaaaattcgtattagagacgagaccataaactttcttttgcaatcctgtatcagcgataaagaagctggattcagacacgccttgcttgtttggaggaaactagtcgataaacatattaaacctagtatttatacttttaatttgttgttgcgttgtgttcgagattgtatatgngagatgtggaaacaacaaaagatgtcattgatactatttgcaaggatcgaaaaat

SEQ ID NO: 315 - DNA, 965 bp, Diabrotica virgifera
  misc_feature (872)..(872): n is a, c, g, or t
tgcagtgatagtttaagtaataggtgtttcttacacgaagtaaaaatgttaggtgtttctaaatcctttaagtgtgcatgcttagcggctgcagtggtgatggtagctatagctggaattgtccttcttgtaatattaaagccaaaagaagttattaaccacaaagtacacagaggtgctgtagtatcaaattcgcccggatgttctgatattggggtagacatcatgaccaaaggtggaacggtagccgatgctgcaatagcaactctattttgtgaatctgtaggtagtcctcagtcgttgagtataggagcagggtttttaatgacaatttacaatagaaccacaggagaagtaatcacattaaatgctagggaagtagctcccatgaaggcaacacaagacatgtttggaggaaatgctatattagcatctattggtggtttggcagtgggagttccaggagaacttcggggatattggcagctgtatcacaaacatggagggggtgttccatggaaggatttagtacaacctagcattgacttgtgttttaatggcataaatgttaccacatatattgagagtgctttaaataaaacacgagtacttattaaaaataatactttgctgtcagaaatatttattaatccattaacaaacgaaacttacaaagcaggagagttgtacagaagaccaagactgggaaaatttttagaaaaggttgcagaagaaggcggtgaagcgctccataatggatctttcacagaaagttttgttaaagatatccaagacaatggtggaattattactgtagaggatatgcataattatagtccaagatggagtgcagcaatcaatacgcagtttanagaacggaaggacgatgcatacacattcattacccaagtcagggaccaatatttaactttaatgttaaaagggggggggaagggcttttttga

SEQ ID NO: 316 - DNA, 1027 bp, Diabrotica virgifera
caaaaatgtcacttactgccttttaccttaacagggtagtataattcgttccatattaacgtatagaagtaagattcaacactgaaccagtgtaaaacaataaaataattagcctttgaacggaagattccgcacgatttttgggccttgtagagacgagataacagaagagtggagacgaagacacaaccaggaactccaagcactctgtggagatgaaaacatagtacgacacatcaaggaaaatcatataagatgggcaggacatgtactgagatccaatgatgagagactattaaatacaactttctgggaaagatgaaaggctgcagtaacgagtgattattacgcaagatcggtaatagtaacgtggccaagactcagagttgtagagccaaggaagaagaagaagagaaatgaccagatgatgcgtatatgtgcaaatgtaaaggatatttttaaggatcattattcgcgtgaagtaagtcgatttcgcagatactcatcgtcatttatggattcaccgatgactttccgacaaaaactgtggcagtattttggtaggggagattatgaatgtgagggtaacaagttattaaaggtatggcaatactgtcaaactttctactaaattcatagttcaaacgaggctaggtttacttggcagtacctattaggtgggatatctcataataatatattataatcattcttattaattcaaattattttcatggcaaagcacatatatttgaacttgacatgtaaaatgtctgttaaaggttcgaacactgaaaactaacggaaataattgtattaaagtcagtattttaaagcaaagatggtatattgtgttcaataacttctgaaacatatcctatgatttaaaaatttttattgagcctaagaaaaagctctaagattgacacttcacaagtgcattcgacataaaggccgctttgaacggctttttagagcgtggcgtaagaaccttgtaaaaactgcgatacgtatttaaactgcgcat

SEQ ID NO: 317 - DNA, 1950 bp, Diabrotica virgifera
cccatttatgttgattgttatttacgactaggttgtatggctagagacaagggtcacgtgtatgatgcttccgattggtttaaagaagcctttaggatagatactgaacaccctgatgcatggtctttacttggtaatcttcatttggcgaaacaggaatggggccccggacagaagaaatatgagagaatcttaaagaatccatcaacgtcccaggatgcttactcactgatagcattaggcaacgtatggttgcaaaccgttcaccagcccaccaaagataaagacaggataaaaaggcatcaggatagagcgttaatgttatacaaacaagtacttaaaatagaccctaaaaatattttcgctgctaacggcgttggagctgttctggctcataaaaacgcagttaatgaggctcgagatatttttgcccaagttagagaagctacagcagatttttcagatgtttggttgaatattgctcatatttacgttgagcagaagcagtttgtaagcgcgattcaaatgtatgaaaattgtttgagaaaattctacaaatacaataacgtagaagtcctgcagtatctcgctcgggcttatttcaaagcaggaaaattcaaagaagccaaaatggtattgttaaaagcaagacgagtagctccccaagacacgatacttttatacaacatagcacttgtattgcagagattggctaccgtaattttaaaagacgaaaagtccactttatcaactgtattgcaggctgtgcacgagctgggcttatctcttaagtatttcaattatctcgtagaattagctgacaaacaacggtacgacgttgcagttgcagaattagaagccagacaatgtaaagatctgttatctcaagctcaatatcacgttgcaagagctagacgcgttgacgaggaagaacgattgatcagacgaaaacaagaagaggagcgagtagcattcaaaatgcgacaaatcgaagaacaaaagaaattcgcagagttccagaggctcaacaaggaacaactggtgcaaaaacgacaagaatacaaagaaaaaacaaagaacgcaattatattccaagatatgccctccgagaaaaaagcagcaaagggtaaaggaaggagtaaaggcgatattatgtctagttctgaaagcggtggagaaaacgaaggcccatctagggataaaagagagaagaaagaaaagaaagaaagggggcgaaaacgacagaaaaacgacggcgaaaagaaatccaaaggaaaacgaggcagaaagcgtaaggacgacgatgactccgatggaagcgacaaacccagaaagaagcactcaaagaagaaagaacctaaagctaagaaagacgaaggccttagttcgaaacaaaagagcagaattgtttcaaaagctactatatcatctagcgatgatgacagtgacggtggcaaacttcgaatggcaagtggggatgaaagcgaccaaggatatagtggtaaacgcaaaagaaaaatatcttccggctccgactcatctcgtggccgatctaaatccaggagtagatcaagaagtggatctcggtcgaaatcgcggtcgaaatctcgttccaagtcaaaaagtagatcgagatctagatcaaaaagcggatcaagatccaggtctaggtctaaaagtggttccagatctaaatcaagatctcgatcacgttcaaagagtggttcaagatcaaggagtggatcaagagcaagatcgaggtccaaaagtggttccagggaaagatctagatcaaaaagtggttctagatctaaaagtcggtctaggtcacgatcaaaatcaggaagtagatctagaagtgcttctaagtcgccttgatatgattgtatttgataattttaaaattatgtctttattgtagactatcattgaaatatatgaattaatgtt

SEQ ID NO: 318 - DNA, 869 bp, Diabrotica virgifera
gcggcatttaccaaggtaggtcctacacgatcgccccgttcctcgttcaaaccgttcgctgcaggctgtgaaagtttttttgacgcacaccatacacctctagatttttacgcgttcgaaagtgccatcgcttcgcgctacataaactttctgtgatattgttaaaaagtagaaattttaaaaaatgtcagcaaaagctatacgggaggcgacagggaaacacctcatcaacaaatacctcggcggtaacacagcggccgtacaatgcagatttgcttcagtcgaggctgacactaaattctctgaattagtaagcaacaacccatggttgaaaaccgaaaaactagtcgttaaacctgatcaactaatcaaaaggagaggaaaattaggactgatagccgtaaataaagatttaaacaccgtcgtggactgggtaaatgaacgcatgaaccaaaatcaaaaagtcggcaacgccacaggaaaactacgaaacttcatcatcgaacctttcgttccacacaagcaagaagaagaggcttatgtctgcatatactcacatcgtcacgcagacactatcctcttttaccacgaagggggtgtcgatatcggtgatgtcgacagcaaagctcttaaattagatgttcctgttggacagactgtggacgcaggaactatttctaaggtactactaggagaagttccagcagccaaaaaacagatggtagctgattttatcgccaacctttacaaactctacgtggacttgtacttcacatacttagaaattaatcccttagttgtgactgataaggagatctacatttttggacttagctgccaaattagatgccactgccgattttatatgc

SEQ ID NO: 319 - DNA, 920 bp, Diabrotica virgifera
aaacagtttaaagaagatattaatttaattgcctataaataatctataagttttgaagttactttcatataattttgttgtttgttgctttaagaataatcaaaatgaaaatattaattgcattcgcagccatcattttgagcgtcagtgctttatcacttaaacaacattgggagaacttcaaagtcaaacatggcaaagtttacaaaaatccaatcgaagaaagagtccgcttctcagttttccaatctaatctgaaacttatcaacgaacacaacgcaaaatacgaacaaggacttgaaagttacacaatgggtgtcaaccagttcgctgacatgactccagaagagttcaaagccaagttgattctgcaaactaagaacatgcccaacatcgagaaaagccttcatgttcccaatctaaatgatgaagttccagacgctattgactggaggcaaaaaggtgctgtattggaggtgaaagatcaaggaaagtgtggatcctgctgggctttcagtgctactggtgccgttgaaggacaaaactacatcgtaaatggtcaatcagttcctctcagtgaacaagaacttctggattgttccggaggatacggcgatggcaattgccatgatggtggccttatgactaatgcttttaagtacattcaggatttgggaatagaatccgagtctgactatccctacaaagccgtaagacaatattgcacacgaagtgctagcaagactgtagttcaaattcaaggttacaaagagctagaagctaatgaagaagcttttaaacaagctgttggtgctattggtccaatttctgcagctattttcgctgatccaatccagttttattcttgtggtatttatgacaacaaaaaatgcaaagctgaaagatatctcttggaccac

SEQ ID NO: 320 - DNA, 1410 bp, Diabrotica virgifera
  misc_feature (1285)..(1285): n is a, c, g, or t
  misc_feature (1331)..(1331): n is a, c, g, or t
cgaagacgaattggcccatcgacaagcacagtctatgaagaaaatatatcaagaagagagacggaagaaatatctgcaggttagcaagtcacttcaagaacttcaagacatgaattccagaaggcacacagacaatttcattccctcccaaaaatctccaatatcccttaatcgatatgatgactttgacgatctagcaccatctgtaaaaccacgacctcgaacaccagaacctcgaatttgcgctcgagccctttacaacttcgttggtcaatcagctagagaactgacttttagaaaaggtgacatcatctatcttagaagacaaatagataagaactggtatgagggcgaacttaatgcaatggttggtctgttcccggctaactacgtagagattattccttttgaaggattaaaatccaaatctaccataagaaaagcacacgagggccaagcacgagctaaatacaattttgtagcccaaactcacttggaactgtcccttgcaaaaggtgaactagttgttattacccgaaaagtcgatgaaaactggtacgaaggaaaaattggtggaagaaaaggtatctttcccgccaattacgtcgaggttctcatcgatccacaaacgccacctacatctaataccaagccggtagcatctccagcagcccactctctactacttaacggatctgcgggcggtaaagaatctatgggtacgcacagctatactcctaacatctcgagctcccaacttgggcccagttatcatgcgaaacccgttcacgttcttaacaatggatctattggttcgtcacacacaagcagaaatgcggcactgaatcaagcgctgcatatagaaacccagaatgaacccacaccataccgagccatgtacaaatataagccccagaacgaagatgaattagaattactagaaggagacaccgtgtacgttttagaaaaatgcgatgacggctggtatgttggttccagtgaaagaacaggagccttcggtactttcccaggaaactatgtagagaaaatttagcaaaaaattcctttgctgtatcttgtttaaattgaatctgtctgtcatttaacccgtttcaattatggtgcctaataatttataaccatcaactgccaatttttgaaaaaaaaagttagctaagccgagatgttattaaccacgttaagcacaaatttcggtttcttctgccaaagaaatgtgttaccttttctgaaaagatgtttctaaatagggcttccgataatattnaaaactaacagagtagcaaatgctgatcaaaaattgagtcttcttngcaatgagtgaaaaacattgcgactaacccagcttgtagattttgtatgatcactaatatttagttttcgtaaacatgc

SEQ ID NO: 321 - DNA, 1562 bp, Diabrotica virgifera
  misc_feature (1473)..(1473): n is a, c, g, or t
  misc_feature (1486)..(1486): n is a, c, g, or t
  misc_feature (1493)..(1494): n is a, c, g, or t
  misc_feature (1514)..(1514): n is a, c, g, or t
atttgtgaagtttgtgaaggctaaaataaatggagaccataggataaaattttaaattaatcaattgttgagaccgtgaaattacttcttaatcagttaaaatggcatccagagttatgaaaaagaatacatttaatttgggccaaaggatctttagggcccaatccacaatgtcagcctttgaacttcaacataaaacacccctaattaagaaacaaacctcaatacccattgctttatatggaggtagacatgcagtttcaatgttacctggaggtggcattggtccagaattaatggcatatgtaagggaggtatttaagtatgctgcagcaccagtagattttgaagtcattgacatagatccaaaatcagaatctaatgcagagttggaatatgcacttacatctataaaacggaatggtgtggccattaaaggtaacatcgaaacaaaaagtgaaagtgctgaagtcatatcaagaaatgttgcaattagaaatgaattagacctttttgtcaatgttctccatgttaaatcatacccaggtgtccctgctagacaaaaagatattgacattgtaattatcaggcagaatacagagggtgaatatgctatgttagaacacgagagtgtagatggtgtagtagagagcatgaaagttgtgacagaatccaattctgacagagttgcaaggtttgcttttgaatgggcaaagaacaatggtagaaagaagataacaactatccataaagccaacattatgaaactctctgatggattatttttggaaacatcaaaaagaattgccaaagaatacccagaaattgaacacaatgaaatgattatagataactgttgtatgcaactggtttctaaaccccatcaatttgatgtaatgatcatgacgaacttgtatggaagtatcgtgtcaaatgttgtttgtggattagtaggaggagctgggttactttctggaaagaattacggagatcattacgctatatttgaacctggtactcgtaatactggcactgccatagctggaaaaaatattgccaatcctattgccatgttgagcgctagtgttgatatgttaaaacatttgggacaccaacaacatgcaaatttaatcgaaagggcaatgttcaaaacgatctctgaagataaaattcatacaccagatttgggtggtaccgccaaaagcacagatgtagttcagagaataattgaccacatattacaatccgacattagaccatggtaatttgaattgctctgaatgtggttgtggtgatggcacactaatatgacatgtcattaattgccagaaacgatgttcgttgttaacaaataacattgtcatcaaacatgtttgtgcatgttctgcatttaatctgtttgtgcttttacactcacactattcatcctcgaatctatttttatattttatttcttttgcagatttcagccancatagtattattngatattnnggtaacatgtgtttgaatantttattatattttatttgtaaatacttacataaaaaattccgtaccgg

SEQ ID NO: 322 - DNA, 1351 bp, Diabrotica virgifera
  misc_feature (1197)..(1197): n is a, c, g, or t
  misc_feature (1283)..(1283): n is a, c, g, or t
  misc_feature (1291)..(1291): n is a, c, g, or t
ggttataaacgacaaagcaaagttctcaaactacaaaaggctttatatggactaaaagaatcacccaaatgctggaaccaacgattcaacaaatgggcaatcaaaattggttttaaaagtgcggaaagtgactgttgcgtttatacaaagaaaaatgtgtgtatgtgtatatgggtcgatgatatcctattgtgcggtgaagatagcgattcgattcaaaaaattattgaaagtttaaaaagtgagtttaacgcaaaaatcttggttgtgtaaacaactttttgggtattgattttgaatattctgtaaataaaaatgatgtaaaaatgtatatttctcaaaaacccttaatcaataagataattgagaaatttaatatgacgaattgcaatgttatcaaaacaccaatggaaacaggttttcaggttgacaaaactaatgctaataatcaaatctctgtcaatgtgccttataggcaattaattggaagcttaatgtatattgcattgggtagtcgccctgacataatgttttcaatctcttatttgagtcaatttctcgattgtcctgatgatatattatggaaagctgctaaacgtattattagatatttaaaaaatacaattaatttctgtcttatatacagtaaaaatataaaaagaaaacctttaatatttgcatattcagactcagattgggcagcaaatgtaaatgatagaaaaagcatgtcaggaggtatagtatattttctagacaatccagtttcatggtattcaaggaaacagagcactgtttcattgagcagtactgaggccgaatatatttcatcaactgttacatgttgtgagttattgttcacaaaaaacttagcagaagaattattgaacgagaaaataactggtagtatattatatatagataaccagggagctatatgtattgcaacaaattcatttaaaggtaaaaggtctaagcatatagacacaaaatatcatttcattcgaaatttaattgaaaacaatgtaattactttacagtacataaatacaaaatcaaactgtgctgatattttcactaaagctccttcaaatgaaatattctcacgtctcagaactttgatcaaaattcaagaatgttgaaagtttttatagattagtacttttatactttaggcacaactcatgtgaattatctatnttgcttttttttattttttatcatattctcatgttaatattttttgagttaatgaaagttttttttttgaatatttttctatatantgtatgangtgtaacctgagtaatgtaggatgtataagtatgtttttatgatttcattagttcaattt

SEQ ID NO: 323 - DNA, 979 bp, Diabrotica virgifera
cggacgcgtgggcaaaaaacttcaaattaatattaaatcaaaaatcaatgcaatttacagtaaaccagaaatgatattttacaaaatataatatactaacaacggttttgaagattttgctacaaggaaaatgtcagattacggacctcgtaaaaagttagactccaagaaaaaaaatttcaatatagtaaaagaaacaataactggaactgatggaagaagtttttcgggatccaagactgaggggtcattaaaattaggttcaagtaatgatactccaaagaaacaacccacaattctgctgaaagcaagagaaccaaatacagaagatgtcagtgcctctccaaagcgcaatcagaaagatgatcatttacatacacatactactgttgctagctcaaaggatgaagcaaatacagcaccaactttaaaaataatgtcaaaggcaatgaaactaatagatgaaggcgtgatttgtacagaatctttacaggattattttaatgaaaacaatgaatttcttatagttggagttgtaggtgctcaaggtgtaggcaaatcaactatcatgaatcttctctcctacagcaaaataacggaagacttaaagaaagaaatatttaaaactgaaaataattctattagtaaagaatgtgatattaaaattttaactgagcattttgaaaaagttgatttaaaacaagatgaaaagttaagaaaggagatatttaaaattgaaacttcagaagatatagaaagaggattcaatagaacacaaggaattgatatatatgtgacaccaaataggcttatccttttagattgtcagcccatttcatcggtatctgtcttagaggaattgataaaaagcgaaactaagagaaccaatttagttagtgaatttatacccctagaaacagtggggagattcagggattacagctaactacatttctaatgtctgtgtgtcatgttttat

SEQ ID NO: 324 - DNA, 982 bp, Diabrotica virgifera
tcactcttagtcaaaatggtcaattcagagtgctggactgcgctcccagttctaagtgaaaaataagattgttttgccttcgcattgcaaccgaataaaaatgtcaaagggatcaagtagcgtcagtattcgtgcggtaacattattgaaaatcactttgttattcgagcacggttttttcggagtccaattcagccaatttaaatttgtaatgagaagtcagtcttagggagtaaacaaacgaaataggatcgttctgaaagacaatatgagtacgaaagagattgtcttgccgcttgtgattgtgcaaatagttcttttgattttattttgtgtattcgggagatatgcaccaccaggaggggatgaaaaatatccattgtttcaggatgtccacgtcatgatattcatcggttttggttttttaatgacgtttctgaagcggtatgggtacagcagcgttggatttacattattattgggatctttcataattcagtgggctatactttgccagggattcttcgaactcaacgcagactataaaattgaaatagggatcgaaagtatttaccgagccgatatagctgcagcaagtgtactaatttcagtgggagttgtgcttggaagaaccaccgttcttcatttgctcattatgggtttgattgaaattgtagtattctcagccaactcatatcttggaacaaaggtcttgcaggtcgcagatgcaggtggttcgatattcgttcacgctttcggcgcttacttcggtctagccgttagttacgtgctgaacaggaaaaagaagaataaggaaggaaactcggaaacagccgcttccttagcagaagctaactacacatcagacttgtttgccatgataggtactgtgttcctatggatttattgggcaagctttaacgccatagaattggaaggtagccaaaagagcactgccatcgtcaatacctacctttgcact

SEQ ID NO: 325 - DNA, 819 bp, Diabrotica virgifera
gtattctgtatgagaatatgcattcttgtaagccagatgactactatagggatgtaattgtacaaccagtaactcggaaaactattaacagagaaactgaggtgatagcagaggatgaacaagcattcttaacaaggcaacaacagatttcatttggaggagggccacctactgtaagactaggagaatccccagttagaccacccctaggaggtatacaaggttcccctagaaagcttgatggttcaaaggttgttagttcaccaggaggggaaggtgttctggctaatttcttcaattcgcttctctacaaaaaaactggctcacctggagggggtatggccaaggcttctggatcagagagtttgcctgataaagctaccatgagaactgatgcagctgctgaattagatcgactttctagaggagcaggaaagaagtctctaggacctgcttcgactcctggaagtcttggatctagtggctctacagaggaagaaggaaacaagaaaagtgcagaaggaggaaatgggaatggtgagccaggtcctggaggtgtagatttcaatgctactgattgttagaaatatagtgtatttaattatttaacgtactttctatagcttttcttatattttctatctctgtgataacctgtttttatgattttttttatctagaaaaacatatgtgtagcttcaataaagatatggattactttaaaaaatgtaatcactcaaactcaagttttcatctatacttatagatcctgttcaaaaaagttatattgacatcaaataaattgcatatattaaccct

SEQ ID NO: 326 - DNA, 779 bp, Diabrotica virgifera
cccgtctcccctcaaagaacgttcaacatcgatcccaacaagcagcccttccccgtggaaaacagactggttgaaggccacattcaggacttcaacgctctttccacatatctatctcaattcgcatttaacgagttctttaccgctatcaatgatttccatttgctgctctatatctccaccatggagatgctgcctatgcgcgagtttatagaacctctgctcaaagctcttagaaacaaggacagggaagccgctgaggaatggtcgaggtcggagcattgggctacgttagaacagctgattgccgctagttctccaccaccttcaaggccaggcagtgttgcttcaggtagcataacgtcatcgcctggtgcctcgagtggaccaaaatggacctgccccttttgtacttttcttaataatgctgacgtacagaactgtgaaatgtgcaatctgcctaggtctagcagaccacaataaggtgtgcagatgggattaagaagaaaatcttgtgatttgctgcatgttttctcgtttgtaagaatgctttctagagatttgaaataacatcgtaagaaaaaaggaatgaagaaaaaaattaaataactagatataaaaaaatttaaaacggatatggatatttttctaaattgaaattggagtttcatttttacgatgaagaatttcctcatgtcgtcttgtacatactagctttgagttttatttaatattttttgtagatataagttctgttcatttaacttatgtgtatggtg

SEQ ID NO: 327 - DNA, 1619 bp, Diabrotica virgifera
agtttttattttcattaaaacaataattaaaagtattatattatattaaattttcaaacaaaataagtttgctatgcttatatattttagaaaattaatctaaaatggcatttaacaagagcagttgttattttctgcaagcgagatgagaaagccttcattttgtagtagtagtgtagcgtattgacaagttttgcctaccacctttaaaattcttatcgaaaatgaataaacaatactacgtcgtcgtatttcattctatataagctgaaacgacagtcaagaacaaacacattgtcgtgcggacgcggtggtttggtctgtgaaacggtcagaaacgcaaaacaaaatatggcgtcaactaaggacaacttgagtgctgttctctatgggatcaatgacctaagattggaacaaagaccaattccagttccaaaagataaccaggtccttcttcagatggaagtagttggaatttgcggttctgacgttcattacctagttagtggaagatgtggtccatttgttgtcaaagaccccatggtaattggtcatgaagcttcaggaacagttgtgcaagttggaaaaaatgttaagaatcttaaaccaggtgacagagtagccatcgaacctggtgtaccatgccgtacctgccatcactgtaaaactggtgcttatcatctctgccccgatatcttcttctgtgcgactcctcctgatgatggtaacctctccagatactacgtacatgacgctgatttctgttggaaacttcctgataacatggatctcgaagaaggtgctttgatggaacccttgtctgttggtgtccacgcttgtaaacgagctgaaattaaagtaggtgacgtttgtcttattaccggagctggaccaatcggtctcgttactctcttatcggctaaagctatgggagcttcaaaagttgttatcacagatattttagacgtaaaattagagatggctaaacaattgggagcagattataccatcaaaatcgaaaagggtatgtctgaagaagacatcgtcaaaagagtaatccaacttttggggcaagaaccaaataagagcatggactgtactggagtcgaacaatgtgtcagagtttgcgtatctgcaactggagtaaatggatgcgtagtacttgtaggattaggtaaaattgaaatgactctcccattaactaacgccttgatcaaagaagttgatgtcagaggaacattcagatatgttaacgattaccccacctctattgagctagtaagatctggaagagtaaatgtcaaacctttggtgactcaccactataaactaaaaaactcagttaaggcattccatcccgcaaaaactcaaaaaggcaaccccggccaaaacccggatcccccccctactcactggtatgaacaccctttaataatttttccccccctcccccttttttttttttttaaaattttttttggggaaaaaaaaatgttttttttgtgagtggtagatgctgtaaaaaaatttaaattgcgacacacgaaaataaaaataaaaaaaaaatatttttaattgggtgttaaaaaaaaaaaaacaaaaaaaaaaaaagagagggg

SEQ ID NO: 328 - DNA, 1927 bp, Diabrotica virgifera
cgtgtgctaaaaatccattttacaagcaggcagccaccttttgctgtgagtcggccataactatcgaaggaccgaatttccaagaccaaaaatgttttccgccttcttcaacaaggcctcttgccaggctttacctgaaaaccaaactttaccacaaccagttgacgactcaccaagggcattagtaaaatcattggtagctggaagacagattgcagcagctgctgctgctgaaggtgacagttgtgaatttggatcagcacactactttgctctttgtggtctaggaggtatcctctcatgtggtatcactcacacagctgtagtaccacttgatttagtaaaatgccgtatccaagtagatcctgctaaatacaagagtgtatttaatggttttaaagtaacccttgctgaagatggtacaagaggtttagctaaaggttgggccccaaccttctttggttattcagctcaaggtctttgcaaattcggtctttatgaagttttcaaagtaatgtatggtgatatgattggcgaggaaaatgcctacctctacagaacttggttgtacttatcagcttcagccactgctgaattctttgctgatattgccttatcacctatggaagctgctaaagtcaaaatccaaaccacacctggattcgccaacaccctccgtgaagcatggcctagaatatacagggaagaaggtcttaatggtttctacaaatcacttgttcctttgtggatgagacaaataccatacaccatgatgaaattcgcatgctttgagcgtacagttgaacttctctacaaatatgtagtacctaaaccacgtgctgactgcactaaaggcgaacaattgattgttacatttgctgctggttacattgcaggtgtattctgtgctattgtatcacatcctgctgatactgtcgtcagtaaattgaaccaagaaaagggatcaactgctctcgaggctgctaagaaattgggaatggctggattatggaagggattgactcctaggattgtgatgattggtacattaactgctttgcagtggttcatctatgatgccttcaaggttgccatgagaatgccacgaccaccaccaccagaaatgccagaatcattaaagaagaagttggagggcaaatagagaattaatttattaacactaatatgtaatttatgactttatttccagaaaaacgaaatcgcagtatttccattagttcgttatagttattgattgtcatcaactttgcgaattttgatatttttaagttcataccagttatgtccgatattttagattgtaaatagataatcatcaatatacaactggaactccgttaataaaaaaaaaaaaaaagggcggccgctaaaggaacccaagttcaaacgcccgatgcaacttttccccctttaacccttggcagatgcaaatgaagcttcaggaacagatgtcgacaaaatggaaaaaatgttaagaagattaaacgaggtgaggaattagccatcccccctggcgtaccaatccggacctgccatcactgaaagattgatgaatatttaaatctaatgcgatatgatatgatgtgcgactaaatgcgatgatggtaacctcttgagtcgtacttatagcgacgctgacttctgatggaaaattcttttctgattaattttatctctatggaagaaggtgattagacgaaaacctaccatccctggagtcgtcaacaacccggaatccagctgtatttaacgggaggtgccgactgtcttcactccggacactgccccaacctccccacgccacgcccacatcgcctaaacctacgggagcatcaaacgctgtgatcctaaatatataaaatgttactatataagatgccccaccccatctgctctacacctcctt

SEQ ID NO: 329 - DNA, 1790 bp, Diabrotica virgifera
  misc_feature (217)..(217): n is a, c, g, or t
cttgtccttctactattttttcattgattggttctagttttaggttttgtctaattgtttcgtttcgtattttgtctgttctctttctgtttgctattttcctcaggaacctcatttcccatagcattgactctatttttgtctccccgtcaaatgtccatgtctggctgctatacatgattgttggtctaactactgatttaacgactgccgtttntactttttccggtatctcttttttcccaaaaaatgttgttttcatagtgttaaataagcttcccgttcgttccattctctcgtttatttccatgtcttgtttaccatttgattcgattattactcctaggtatttaaaatattccacttgctctaattgtttcccgtctaattctattgcgtgtgtcttcctcgtatttgaaattatcattgtttttgttttctctgtattcattttcatatttatgtttgatattaatatcttaatattaacgtctttgttcatatctctgcagcgttggatgagtaactgtacatatactaaaaagtgcttctcttgtgccaagagcattactaagcccgaactgcgaatcttcaaagttaccctcacattttttgcttattctgttgtttataatcctggtatatgccttcataatgtggttaatttgacttatcatacgatgttgattacaagactttgcttttggttttttcggtatgacgacaaaacggtttgttcggaaactcccagctgttataaatatgtattaggtccctattaaaaagtccctacagtcggaaaaatgaaggaatagggcttttcattcacagtcattcgtttcgagcttctgtcatgtgtcacataatattaatatatctacgtcatacgttattgatatatacaatgatacaaaccaaagacgtatgacgttattgatgttatgtgacacatgacgggggctcgaggcaggtgacagtcgatgaaaagccctattctttcatttttccaactgtatctgtaatatacgctgagctcataggtagaggggataattaaaaaatcgcgagagccagtagtgacaagtctgtaaacctttactggaaatttgacataaatgtcaaagtgaataatttaaaattgaaattaaaaacattaattagaaaaaatattagttggccaaagctgtggtatatatttttatcttaagtatacttacggtttaaatactgaattattaatctttaacgttgtggctgaagtaatattacaactaggttacattgacagttcttggtgtcatttcgggttgctctttaattcacttgtcagttggccattgaaatccaatatgtgaggttttcaccaaaaaaagttccaaccacgtggggagagtcctgtgttgccctgggtaacatccaggtttatctattacatccgatgaattttatataaatatgtaaaacatctttattatttacatttaaagggtttttaccctatacattttggtggctcaggcatgcaaattttgtaagtatgacctcttgttcttgaaaacctctgtcaattttaacttttatctcatttaattaggttatacttaattttagggcttttaaacactgatgatggattccttaatccgaaaaagtgttgtattttgacccttattttacgggattttaatatataccttttacaagaaactggccttttttgattacaatttaacttacttttttgcgttgtaaataattaaacgaataaaattaaataataaatttaaaaa

SEQ ID NO: 330 - DNA, 1557 bp, Diabrotica virgifera
  misc_feature (1409)..(1409): n is a, c, g, or t
  misc_feature (1442)..(1442): n is a, c, g, or t
  misc_feature (1462)..(1462): n is a, c, g, or t
  misc_feature (1475)..(1475): n is a, c, g, or t
  misc_feature (1508)..(1508): n is a, c, g, or t
ccctttacgtccgtgcaattaaatcgatggcaatagtatgagaacgtataattcagtttgacagttttggtgttgcatttcattgtgagcacgtcaataaacattaaaaggtgtatttgcgtgcttatttagcatctaattttttattgtagttaattttgtatatcttttctagaagtacataaaaaaacttttaatgttgatgtattaaatgaagacagactttgaatatccttttagtaatcgatacatgtacataaagttacatatagttgttctattatatacttgcacaaacatcatgattcatttgcaaacaaattaaatcaaaacattaagtgaaacgtacgtcgatatagggcttttctttaacagtcatttgttcgagcttctttcatgtgtcacataatattaatatatctacgtcatacgatattggtatataccatgataaaaaccagagacggatgacgtgggtatattaatattatgtgacacatgacagaggctcgaaacaaatgacaatcgatgaaaagccctatgtaacaccattgatatgtacctattgtcaatgtaatgacaatttgtatgttagaaaatattagttgtctcattagcgtaaaaaataaatgcttatccgaggtaatcaaattaagtgagctacagtttagcgttctaactattatgtttgaaaacaaaaattacaatgacatataaaaatactgaaagtttaaataatacgaagaaccaaataaaccaataaattcaacaaatgcgctaatgttacagtcactgaaaatgataaacgtcaaaatttatagtgaacaaggtcacagtttaatgctaaagaattggttaattcattctcgaattttgacggttagaattttgcaatctactcatgagacaaaattttgactgcgcgacgataaagaccaatcacttcaaacgtaggatgccgttagctgtcattcatctgcgcgaaggactacaatttttgatgcgccgtcactaaaatggaacatagagaacaaaggattttcgcggatcctactgattctttagcattatgctgtggcaatagggcttttcattcacagaagctcgaaacaagtgacaatccatgaaaagccctatgtatcaaagacatgccgtactgtttatccttgtttaatttattgcggtgtctatggaaaagcggctttattttgcgatactagtttctttgagtaaaaaagatacctagtatgaaaagtaattcgtgaataatttcatgtatgtgcaaagatacaatggaagaactatatctataaaaaaattcattcaactgtattacttaaaataaatccttttaaatattataaacatgttaaaattgatttggaataatttaacgactgatttatttncatagaaatgttgatttatataaactgtacaanattgtacatattaattatancaattacctgtangtacgttacacatactttttttaaatttgatgntagataaaaattgtattcagttttcagagcaaggaaaaatttgttgctt

SEQ ID NO: 331 - DNA, 914 bp, Diabrotica virgifera
  misc_feature (776)..(776): n is a, c, g, or t
  misc_feature (887)..(887): n is a, c, g, or t
gtttaacgtggtttaacctcaaataagtgttcttgtaataatacggcaaataataaaattaattatcataaaatagttactctaaaaatgaaaaaaatagtaatatgtacagttttattctatttattttcaattgcacaatcaaatctcgaagtagttcaagatgaagagttaatgaacttaattagaactgaaaaacatgttatagtgttattttcaagaaagtactgtgaatcatgtgataattatgaaaatgagttaactgggctcagggaagacatagtagaaaccttaaatgcatgggttgtgaaagttgaagatagtcaattaaccagattgtatagtcctgataaagaaccagtattggtatttttccgacatggcattccattactatatgatggtcctttaaatgatgaattaattctgcatacgtttacaacaaataaagaacccatatctaaagagttaacagacaatacatttgaacacttaactcaagctgcaactggtgcaactacaggggattggtttgtaatgttttatacctctgaatgtgtagaatgtactcgcttacaagccagatgggaggcagttggagcccacattagatctagaataaacattgctaggatcaataaaggaggagatggagctataactggacgccgttttgaagtaacaaatgttccatcattcatattatttagacaaggaaaattgtaccgttatcatctacaaaagtatgatgtacagtctttagttgattttgctcnaagttggcacaagaatgtaactccagaaaaagtacctgtaccaaaatctccgtttgatgactttgttgcaatggttgtagaatatatgagggaaaatccatgggtgtggcnaacttggaggtggaactttttgttttg

SEQ ID NO: 332 - DNA, 1111 bp, Diabrotica virgifera
  misc_feature (1058)..(1058): n is a, c, g, or t
gggcggccgctcgcgatctagtacttttgtccatgataactgtatagcgttatgaagcttgttttaggaaaactaatatagttaatatagcgtatagaatccattttttaaatctgaatattgaaaaaattaatgatgaagtccgttgcttttcttttggtacttgtgattgtgtgtactggttgtaattgtgaaatatcatcatccgcgtcaggaaatgtgtctgtatcagcatcagcatcagcatcagcatcagttgacatatcggccgtattaaaggcatttcttggttttcaatcatctattgtggattcttttaaaggagtagttagtatatgttttgatttttggaagtcctggttccaaaatgttgatttttgtattggaagtttactgaatattgacttatttaaacctgtgttttcaatactagcagattttagggaactaatcggaagtatatccattaccataacagagatcgccaatttctttttaaatgcttttgacgaactgaaacatgctatcacacaagtaataattccttcatatccaatgacagaacttaaaaatataggagacttgtactttgttattgtagaaatatttaaggcgttcataactacttcaatttctatatgggaaacattttgggaaaaacttccacctccacctaatgttccagaaataattgtgaactactacaaagccctattccaaattttcttcaaagcatctagcgacaactttataaactttttatcgactgtaaccgacgcttattctttagtaatacattttataagcaggattgatgatattctggtacaactattaagtaaacttccgtttccggtcttgtcaaatataaggaacgcaattcagttcgttttttgggatcttagagcaaattaaatactggtacataaatattgttgacaagattttttggaaacttcctgtaccagctgcattagcagacctagctgaatattatctccaagtgatgttggactttagaagtctctgggtatcaggttgtcgatttcatcgacggnatatttgatacttattttgcttcttttgaatcattattccctaagttgaaaat

SEQ ID NO: 333 - DNA, 412 bp, Diabrotica virgifera
aaagaaaaatacaaaatggttaacgtaccaaaacaacgtcgtacgttttgcaaaaaatgtaaagtccacaagccccataaggtaacccaatacaagaaatccaaagaacgtcatgcatcccagggtagaagacgttatgaccgtaaacaacaaggttttggtggacaaactaagccaattttccgtaaaaaggcaaagacaaccaaaaagatcgtattgaggatggaatgcagtgattgtaaatttagaaaacaaattccacttaagagatgcaaacattttgaacttggaggtgacaagaagcgtaaaggacagatgattcagttctaagttattaaaccttgtttttaagttaagacctcacaaaataaaccaagtttgtatataaaaaaaatgaaagtaacgacagggg

SEQ ID NO: 334 - DNA, 1514 bp, Diabrotica virgifera
tgtcacgatgacatcatttagatggctggcattcgctagaaattgcctattcaataaagtgaaaaaaagagaagaggagggagcacccctctcagatgtcaatttgaaccatgtgttttattaattttatttcatcctataattacccaattaatcgaaacaaaagtaagtaagcacacaaatattatattttaacattttgatactttttacctacttttttagctaatttttatgttaggaccttgatagtaatgtccacatggcatttttcctgtttttttcaatttaaccagttttttttttggtagttcttctttaattactttcttattttgtcgtaactttccaaaacccaagagaatttttccatttattgtcatattttctgtactttttatacgtactatttcttctacgttctttttataggtacttctgtgtactctaaagtgtatttaaatcttgttttattacttattttcaattactttttacttattcttatatttcctagttgttttcatatatttattaccaattttgtacaactaccaaaaattttgttgtttccgtcgaactttctgttcggatggtatatactactttacttgtatagtaaagactaggacaattttcaagttcttttctttcattaaggtattttattcttattcttcttctttacgtattcagaatattaatttaaatcattcttcttcttcttcttgtgttggatctcaaaaaaatttttgttcgtaaagcatgatattttacatttttcaattttttgcattattgcacttatattaattatgataaacattatatttaacatcttttttatttaacaatgccctatttatctatatattattgttttattattttattttgggtgttgtactgatttttgatacagattagcatgaaagcctcatccggcacttataagttgtgtatggcttatatatagctgcatagacacctagtgtttttttttctagggtacatataagttatccatagggttgggccagatctattgagtctgagttccgtttttttggtcttaatgactgttgatatacagttgaatgctggatattatttttaggatgatgtgttttataaattttctcttttgaagttaaaataattctatgcatctctactcttcatgagcctctggtgtagaattatggcgctttgaagtatgattgcagattagctactaacatttgttatattccatctttgcaaatcatatttatgcattttaatacatatattttgcacattagtgtagataccgggaatgcatatgttggaaggatgatctcgttgatgtatcattatctctctctatattaactcatttgttgaagcaattatgactactgagatgcagccagaaaagctttttgcggcataaatgggaacggtaacgtctttcgatgaaagagacaacattggtctgctcgctgttaaacaacaaagcgcccacccaagtt

SEQ ID NO: 335 - DNA, 1514 bp, Diabrotica virgifera
gttgatcttcagaatattttgaaaaaattgtttatcatatttttatactaaaaaaagacaacttattgtgtattattcattatttccgttttaaatttaaacaatctaaatatatcacatccgctgagacctagactttgtaacccagcaggtagcagatccccttcaccaaaaatttccagtccccttcaagtatttacatcatcaaaccttgtaaagataattaagtccgataacctctacttgtactttcaagtcgattacaaaatcaccttatcatcgtgccggttatttcgttctcgttctgtggttaagtactaggtggtggtacgatctgcgctaccgtgaccatccagattttgatttttttgaccttttcctgacgacatttcatttcctcatgtcagaagtaggtttacacgccggggtgataacagagccgcactccaagaaggccaaaaagatgtccaacaccctggaacaacttaaagccgtgactacagtggttgcagacaccggggactttgaggctatgaaagccttcaagcctaccgatgcaaccaccaacccttccctcatattggctgcagcggctctaccacaatacaaacccatcatcgacaaagctatccaatacggcaacaaactcggcggagacatgagccagaaattggacaacaccatggatatgctatgtgtcttgtttggtgtggaaattttgaaaattgttccaggacgagtttccactgaagtcgatgcaagactgtccttcaacaaggaagcaagtgttgccaaagcccgcaaaatcattaacctgtatgaagaacaaggtatttccaaagacagaatcctgatcaagttggcatcaacatgggaaggaatccaagctgcaagagagctcgaaaagaaacacggcattcactgcaatctgacattactcttcaactttgcccaagctgtagcttgtgctgaagctggtgtcactctcatctcaccttttgtcggccgtattcttgactggtatgtcgcaaacacagataagaagagctatactggcgatgaggaccctggcgtcgtctcagtcactaagatctacaactactacaagaaattcgggtataagactgttgttatgggagcctccttccgtaatgtaggtgaaataaaggcattagctggttgcgatctgctcaccatcagtcccaaacttctcggcgagctggaagccagccacgactcacttcccgtcaagttgagtgtagaatctgccctaaaaacagacctcgagaagatagaaatggatgagtctacatttaggtggatgttgaacgaagatcagatggctactgataaactttcagacggcattaggaagtttgctgcggattccatcaagttggagggaacgttgaaaccgttgttgtgtgctgcaaagaaatgatgatgggttgtatgaggttgatatatattttttttgtaaatttaaattgagaagtaaagttttatctatttcg

SEQ ID NO: 336 - DNA, 880 bp, Diabrotica virgifera
  misc_feature (636)..(636): n is a, c, g, or t
  misc_feature (660)..(661): n is a, c, g, or t
  misc_feature (804)..(804): n is a, c, g, or t
  misc_feature (809)..(809): n is a, c, g, or t
caccttgaaaaagaacagtttattgtgcattgtttaaaaaatagtaaaatgtttaaggttaaaaatgttcatcctttggtattttttataccaaatttagttcttaattatgataagctggaactactgtaagcactgctgttgtcgtcaacatcatttacagttaactgtttaactgtcaactcatttaaatcttcatctgagtcataataatcggactgaggttctctaggtgaaaacttgcatccacgtgaaatataagctttcagcctatctttggcagctaatatgagacctaaaaatggaggtgacggtctcatgggtcttgataaatattccgggtggtattgcacggctacataataaggatgtttgtctaattctaaaatttccattcgcttcttgtccacgtcgacacctacaaaatgcatgccgctttcctcaaaagcctcaatatattcgggatttacttcatacctatgcctgtgtctctcatcaattttatctctattttcatataatgttttgacaagactagttggtctattaaaaatggtagttctttttcctaacctcatggtaccacctttaccgccagtattatgttcgggcatatcaataaccaccccccatggnagtggttttcattgacttcagtgnnaattggcacctggtaaattaagaacatttctggcatactctatcacagctgcttggaagcccaaacatatactaaaaaaaaggttttgtcattcagcctgcaccatttacaagctttcattttccctttcactcctcgttttncaagngcctcaggtacaacaacgccatcgcaaacacataaatttatgcaagcattatggtaaaaaagcaggatcgt

SEQ ID NO: 337 - DNA, 3253 bp, Diabrotica virgifera
gtcccgggaatatacccgggctcgacccatctgcgtgccgctcggtcacaaaaatacaccaaaacaaaaactccaaatcaacagcggtttcatccctggtcaagtcgctgatgttcgtgctgactacgttaccggcggaggaactttgaatctattccacgccaccctaaaactcgacgaagccaatttccttaaaccagactacaacgtaaatgcaaagggaattgaaaaagtatttacccaaggcaaagaaggagtatctcgtttcgttaacggtctcgaaaaaatcgaagacgaaatcgaaaaagacatccgcaaagaagctagtcaactctctgaattggcaaagaaagcagctcccaatcttcaagctgtaagacaatactattctaccgaactgcaaagaatcaaaaacgaaattgtgcaggataaatctttacaagaatttggagaactcataaaaacaatattcttctctgttagcgaacttgtagaaacaatcttcgttagagtttttgaagtactagaagctgtaactcatgccgtccaaagcgttgtagtggccttcgttgaatcattcgagaaacatatcgtaccagctcttaaggatctcgtcgaaaaactctccggtattgctggtgaaatccttaatacgttggtggaaattacttcaagttatttggccacagtcagcgaaattatcgagaaataccaaccagaaatcaaacaattgactgctacattcggtgaattgggacaagatgttgctaggtttattcagaaatcatacgaacaagttagacgaatcttcattaacttgtacagaagactcgttgaagaacttagagctcttccaatatttgaagagctacgcgcacaatgggatgattttgtcaagaacggattaccaaatgctgatggaatcgtaggtgcactaaaggaagtagctgctaccattaaagatttggtacctggtgatctctttgtttctaaggaagtctatgagttcgttgatattcttactgattatttggaaaagaaaatcaaacaacaacccgtagatgacatcgcagttttgaacagacttttcacagttagcgccaatcttgttcaaaagattttgaccttgataacatcttctactgctgatattcaacaaccccaagtatcaatttctctcgacttctttaagaagctgccaaaattggttgctgttaagttatcaccaataaattacatcctacttgaagatccttccaaggaaatccttgatctaggcttgtccttagtcacgaaaccaaaagaatggttggctccattccaattattcggaatgattctccaggctcagcacgtctatacattcgacggaaaataccttaacttccaaggaacttgcaaatatcttttggcaagagacgctgtcaacggcaactttactgtcattggaaacagcgcaaacggacgtcttaacaccatttctttgagcgacaaagaagatattatcactgttaatgaacacggacaagtcattcttaacggagctcacgctgaattccctgttcgcaaagcagaacttgcagcttacagaagctacgaaaacatccatctaaaatccactgccggcgttcatattgtttgcacaccaacattgcaagcatgtggagtttacgtctcaggcttctaccacggccaagttaaaggtcttcttggtaaaggcaacaacgaacctttcgatgacctcactgttgccaacggtaaaattgtcacatcagatgtcgagtttgtcaactcctacaaaatcggtaactgccaaccagccgttgtacctccttctgcaccatccaatccagcttgtgaaaaactcttcggatgggaatctcctctaagactgtgctattcatttgttgacacagaaatttacaagagagcctgtaactacggttttgcaaacaatgtaaaagatactgaaatatccgctgcctccgcttatgtaggacgttgccacgaacacaacattccagttagtgttccatctagattagctcaatgcctgaacggacctgaacctcacaacgtcggagaccaatttagcgtaaaagtaccaaagaatgcagctgatattgttgttctggtcgacactatcaaatctaatgagccagtttacaatgaactagtaaaaccccttattcaagagcttaccaagggattagctgccaaaggattaacagatgttgaaacccaccttattacctacggaggtgagaaccaatggcccagccatgtcaccgttggtggaaagcttgttttcaaaggaaaagctcccgaaattaaattctccgaaaatccccaggaaccaccagttgttggagaactatccaaatctgtagaggccctccgtagtattcttagagacatcaagctggcccttggtcaagatcttcaagctaaaacctacactgaaggatacgagtatccattccgtgctcacgccgttaaaattatcctggccgttactagcaaaccatgcgaagtaggcaagctgtatccaaaattgagaactcttctcttcaaaaacaaccaaatctcccttcaactgataactccattcgaaggtcttcaagttaaagatgtcaaaaagaccaaggacgtgattggattcaacgatgaacacgtcttcaccttctcacaatccaagaagaagcccgaaggtaccgctgaattgtacaaagaattacaatatgatgactactgcgtagactttacagttaagaaccgcggaaatgtcttcgtaacagacaatttcctcgatgccaaaccagatggtaaaaaacaattccttcataccgctgcccataacatcattgaagaagccgtcaacctcgagcaaggtttggactgcgaatgcagaccatcgtcagcttacggaggtaaaaatatatgcagggagtcctattccaaagaaaaatcagcaccaaaaagactttcaaataaagcgtgaagtaatccacaggcagtgagttaattttaagttacatataagactatatagataagttatgtatagttatttacggtatgttttttacgtcacggtattgaaatttgtataaatcatatttatgcacctacatctaacagaataaatatatgaaagtttacaaaataaaattttttttttataatttatcgataatgtatgtttatcggtaatgttcaaattttttatacattgttaatataatcatccaat

SEQ ID NO: 338 - DNA, 1581 bp, Diabrotica virgifera
  misc_feature (433)..(433): n is a, c, g, or t
gagacaactggtgccaaaattatatcccaaacttcaaagcaattggtcaaacagtccaaaagctatttaatttgttcatcccaaattaaattttttgcaacactataaatcagaaaatgatgaagttatagcaatacttcggacagtctatgaaagaagaagatttacaccattaatttaattaaaaaaaatgacaaaaaataattccaaatattgcaaaattattttgcaagaacatgtgaattaaaaaaaggggggctaacttcgtcccctattgtcctaggacaattgtttttattattttaattgttattttaattgtttataagtaagcaaaaaatcgacatgtttttgcaaaataattttacacggttcaaaattatttcttgtccttttttttaattaagttaatagtataaatgcccctcccccnacaaaccgtccgaagtattactgtaacctcatacttttcttacagtgtcccaaaaaaatgaatttgggataaacaaattaaacaacttctaaactatttgaccaactgccccgaaatttaaaatacgattcaagcacaagaagtcccagcactccgtgtaataagaaggttgtaactcaattcctacacaagttatgaacatttataaaatctcaaaattcatcatttacctcgcaatcctctaagcaacaaataaggacagacatattcagtgaagtcttttatatgatttatgagtttcccactctcaaacctgtctagaacgctccactctttagcaatagaccaaaaaaagaatgtgtgtgtactttgtacgcacgtaagaagttatacttctattacatatgtgattttaacgaaattgatataatgtactttaaacagtttatttatatttcatttaaatattaaacgaattttaatacttactactttccaaaaatttttattaagacaataccaaaaatttaaaaaaataaaacgcacacaaacccattgaaaatgccacaaagaaaaaacgatttctgaacgataataattgttggcaaaaattttaaatacgcattttctgaaaaaaaaatataataaatatacttacaatcataaaatgcataaaacaataaaaaaataaaaacttgcatcgggatttgaacccgcgaatttggggacgctttgattcgtaatcgaagcctagtttcactcatccaattactcattatttgtcatgtggaaaaatagggcaactgaacgttttactgtttgacagttattctgaatttaaatcaaattatgtagtttgatttttgtggaagaaaatattaaaatataacaaaacagtaagaaaacaatatattagatgaagattggtagaacttttgttggtaatcaaattaagcatgtaaatcaaagcattacatacctactagataaataaatctacgccaaaaaatcataatttaaaaataaaaatcggacctaatttcggatttctttctaaaatccccattcttgagaaaataaatttattccaacctaatccaaatgtttaattacaatatgattaaaataaaaactacttaccaaattag

SEQ ID NO: 339 - DNA, 490 bp, Diabrotica virgifera
ctctaaaatgaatcgttactgtttatctgtgttcttggttgcgtttacagtagtaggtgtagtactaagcgctccggaaaaatcgttcgaggaatatttggaaattcttaggaaagttaatgtggatgatgtttttaagaacgatcgcctcgtcaaaagttatgttgattgcttcaccggttcaaaaacttgcacagtcgaaggagctgccttaaaagcaatttggaataaaattcttgatatagatggttttgaagaagacaagagaaaagtaaaaaaagctataaagcatctctatgtagaccaccgcagttggtacgacgaggtgcaagataaattgcctaaagacgaagaattccgcaacaaatacaaaaaatattttgatgctatccttaaagatgatactttgtaaaaaaatattagtttttttaaacgtttttatgtaatttaagctgtgaaggataattattaagaataaagtgaagaattt

SEQ ID NO: 340 - DNA, 1994 bp, Diabrotica virgifera
gacactcacaactcagttcttcgttatccgcgccagacctcgcaagcctaaaaaggctattctgatagtcgatatgttcaaaataaatattctgatatttttaattgttgttagttcgagctgcattaattgccagctggatatttttcaagatctaccactagaagctgactcacaggaatttgatgagttggaacaacaaataaacaatgacatttgggatgaggttgaaaaccaacaccaagaactcgattccccggagaaactcctacaaaagatttgtgcactatacgatttcgaaataaaaactgaaagagtcgaatgtcaagatgttaaaatcgtttcaaaaagtcttaacgtaaataatcacgtaatccacaaaagacaagctgaggatgaattagaaggctcaggagacgattctcctattcaaactgaagaggaaaaacctgaagaatcagacacaaatcctgaagaggctaaaactgaagaaccactagaaacaacagctgctgaagcaagccaaaaggaaaaagttgtagaggaaaatattgctcctgttctgccagaatctgataaagcgactaaaactgaagaaccactagaaacaacagctgctgaagcaagccaaaaggaaaaagttgtagatgaaaatattgttcatgttctgccagaatctgataaagcgactaaaactgaagagccactagaaacaacagctgctgaagcgagtacagctgaagaacaaagaattaaaccttttaagcctttcaaaaaacaagcactcgaaattccactagaggaaccaattaaagatgattctattcaaagctccacagcagcgccctccgttgaaattacttcgaagcaagagcaccatgaagaagaaaaatccatagaagaggtcacaaaaatatcacctgaaatcaaaaatgaagaagcaacaactgctcaagctcattccgaagcacctttgaaacaaccggagttggatatcccagaaatggtagctcccaaagaggttccagttaatgtattagttaaaaatcaagatgaatctactaatgcacctaaattagaaataccagtaaaggaagcggaatcaccagtaaaagaagacgaagcatcatctaaacagcacatcgaaacaagtgaaactaagaaagatgatattcaattaccagacgaagaaattattctgcatcaaagcggaaatgctattttgaatgacaataaagacggtatgtctaacgctgagaagacagttagaaaaatggaagcaaacgaaagcattaagtctcaagtgtcagatatcgaagaacccaaagctggagctacgagcgaaggtgccattggtggaaaagataccaaattattgataatcatcgggggtctagttgcagcagtgggagtcgcagcttttgcttataacattctgaaaaaaagggaaagctactggctgacagagtcccaaactcccaacccaaatgaacggaaatgggggacaggagatgatccccaaaaaaaggacaagaaaatgaaacctttttgatggaagtctccccccccccaaccagcagggggccaaaataataaaaacgaaaaatcatggcaagggggggcggggggggaaaaaaaaaacaaccctaatattttttttttgtgtaaattaaatgggaatagggggggcttttggtttaacccccacatacgattgggaaaaatgggttcccaaagcttcaaaccgggaacttggggagggggtcgccgcggatttttttcgtgaacacatttttttttctattccttaacaaacctcgcgaaaaaaaacaccgcaatatcttcccaaacaatgggcctttttttttaattggacaaaaataagcacagggggggcgctctttcttttttttctttataaaaaaaatatttttaccaaaaaaaaaaaatattttcttcctcacaaaaaaaaaaaaaaaaaaaaaagggggggg

SEQ ID NO: 341 - DNA, 1568 bp, Diabrotica virgifera
aaaaacaaatatatttaacaacttaaaaatatttcgtaagaactaattaaaccaagattcttagttttgtataaaattatttgtactatcacaaactatacatttaaataaaaggtcaggaataaagataatattcgattttatctagcatcaaaacaaacaactgtttaagaaacacgttttaacaaaacttgttttaaagtaataataattataaattatcagagtgttggctataagtttgtgagacaaaaatatctgtgttatgtatctactatacaaaatatatacagggtgattcattaagattgttcaatctatgagttgtagatcctagacctcaaaatattaatatttaacccaaatcacttaacgttttgaggtctagaatgtacaactccctgtatcaccctgaatcactctgtatacaaaaatatcgagtttataaaaccttaccaggaaccaaataatttagaggctattttgccaaatagagagtctgaagtttcgatcattttttcaccttcagatctaggtctagcttctggtaaaagaacaagggaaacacaaaactgttgtgccttatgatagacaggtgtgttatttgcatttgaacctggtactgcttgaatatcggtgtatattttggacattgtagccacgcttttgtaaatattgtgcctaaccgtcataatatctccgtagatggtaactacagatatacaaggtagagcgatcttcttaactttggtgattttgttgcatggcaaagcattctcacatgttagtgttgctttcgtgcacaacgtccttgtggctgttgtttttgttacattttgtagttaataacatgtctgttaaacacataactccaccgtcattgagacaaattaaagatgtggtgtttggacaaatcagaccagtatctccttcacatgcacgcaagtcaaaagcttggaattccagatttccaggaacaacctcgtttgccgtgctcgtgatagtgaatagaataatgatcaaattgttgtgcaatgccactttgagcatacaaataagcattaaggaaatagtaggaaggatatcgtattttcggtagtctgtactttaagaataaccctaatgtggtcgtacccaaatttgtatatttgtattttagtaaaagtagaggatttggcgcatcaggaatgccagttacctttctacgttctggatctttggtaatagttttttctcctggtaacactaaaatacccacgcaaagttcacgaggtgtaactatagtttgtggtgcaacacctgtggttacatttgatagctcataagttctgtaagtccgagtttcgttaattgcagtataacttcttaccataatgctgacatttgcataaaccttggctgtagaaaaacatgggatttgaacaggaacagctgcattaggattctgcacacaaaacggaaatttaagttgatcgcatggtatagagctgtttgtatagtcagtttgaagttcattactgaacgctgtagatgttttgtcagttacgcaaataactgcaccgtcattc

SEQ ID NO: 342 - DNA, 1783 bp, Diabrotica virgifera
  misc_feature (1624)..(1624): n is a, c, g, or t
  misc_feature (1650)..(1650): n is a, c, g, or t
  misc_feature (1666)..(1666): n is a, c, g, or t
catacttgttcactgtaaaatttattcattttgctttaatttcaaattaaatttttaatttttccagtgtgttttatttattctacacaacttaatgcagttttgtcctacaatttacgaaaaaccaatcacacctctcgatttgacattaaacataataatttaaagtcatgtcaagatttatatctgtcattatttttgaattgaaatattttcataaattataataaaacacaaatcaatgtatgaatacttaattgagatgacggaaaattaccattgttttagtttttagtaggtatattaaaaaatgcggtctgtcgctctcagccccgtttttacctagtttgatataatattttcgttgaactggcaacgttgccctagaaattagaatgacacttgtgacaagatcaacttacacaacttgaaaaacacgattttcggttataagagttgtaccagttttttttgacgcggagtgtacatggcgggtagttttcgtagtaattttcatcctggctatgaaggtagcgtttccttctcctttgatttgtacctctcgcatttatatgggttggccggtacgacgtagaaaaaattccatttacatggtaggtactgatagtttgtttgaattttttcataattttcatcaacttcataaaacgccacaactttggtagccatttagacgtattttacgacataaagacacgtactatatcgcttttagtttagtagtaatttttgccttgcaataagacaattcttaggtttagttaagtcagtacattaagtacgagtagtacctcactaaacgtcacatcacgtgattagctagtctaaaaaattttatacatatttttttatatttttacataattatttatttattttgaagttatttttaatgccatatcgcctccttctttccttcgttcgatacggaatagacaaaatatttatgcggcatttgaaaatgatgtttttgaagtttattagtaaataagaaatcatttaagttgcatttttttctcattgtgacttttatgggatatactgagtgttttattaaagtagctgcagtagtcacttccatcttacaaaaaaaccttgtagggatctatttttgaattagatatggaactaccagtgataccagcttaccagcgacatctacagacgattccgtgaattatttttaatataattttgaaatttcgattattttagtcaaataaagatatttagctcttaaaaaatatatccccctgaggttttttaatgagagtggaaagttacaaaatgtggctactttgggcattcagctttagataggagttcagtgttttttgttacaatatatttttggcgtgaagaacaaataagttataattttgtaatgaatgtttgtgggccgatgtaacaatatggatttatctaaaggatgacttcaaatggaataccactctgtcaaatgagaagtttgcttatgaattctgcatttctctttccgatgctacgatgaggtctaattagaccgaaatgtgtcacattgtgaacgaagacagacttttaaacggaagtaatgtcctggtgtattttacagcgccctctatanaacaagtcagataaatttgtttctgngtagagatattttttnaatacattttctttctgtcttagctggaatattgcctgaacactcagtgtaatctaaagaatattattagagatcttttttgtggctattgcggtcttggtctaattttgtatcatc

SEQ ID NO: 343 - DNA, 1549 bp, Diabrotica virgifera
  misc_feature (1178)..(1178): n is a, c, g, or t
attcaaaaatggaagaaacacgttcaagcccccccccccccccccaaaaaaaaacgtggaggttttataagttataaaaaaagactttgatttgatctgttttggggtttataaaatgggaaaaactcctaaaaaacagtttttcggattttttaaggtggcgcaccttactgaaaaaaaaattggaagtatagtttttgataaaatacatagaataaaaaataaaccggcgccatctcaaaaaaaagtttttcaaaaaaaaataaaatgcattttggggttatgtacgaacactcaacctatgtgtcaattgtttgaacttgataaattgattgcatgccaccataaaaaaaataaaaacgaaaaaattacgttttggtggtgggtggaggcttaaaattgcacctagtcttattttttaatatcatagaacgtaaaccaattgaattctgggagtgaggacactttgcatatcataacggggggtacactttgaaatacaccattatgatacttctttgaagatatgaaaactaaaaaatttgctatattcgcacaacgccttgctaccaaaacctcaccccctatcgatattgttgatacatcatttcagtaatacaagtaataaactatataaagtacagtcgtactacatacatcttttttacttaaatcttttgtgctctagtgtaagaggtatgttttaaactcgagaggtatgggaaaaataatatgtatgcttggacgttatcgctcggcctctttaattataggccagggtaataagacaaaaatataccctgttcgtgacacttcaacgaccagagtgctgaagcgttttttcgataggtgatacctgtaagaacggattgtaactatttccttcgtaggatctggcggccatttttgtttataaacaatttagtgtcaaaaaacgacattttttccttttttcattttttccatttttatttataaacaatttagtgtcaaaaaacgacattttttcctttttttccaaattgatggagaacagtacgaattatggttttcttagtacgggcatcgtcgagagaatggagggggctttaaggtggcgtggtgcaaaagttggtacactcatttattggtggtataattgcgaaggaagggtggaattttcaaaaaaaattaatttncgaataactattgtaagagtgagtatggagctttgaaatttttgtcgggtgagagggtcttttgtgcttgatgtgcggcagaaatttcaaagcgattccgtgaattgggttaatggtgttcaaattggttgtcccggagaagttttttttggattacggtaggcaaaaagaattgtggtggaaccggtcttgctgtggtcgatgaaggaacgtgggctagactttcaaggtggtttaaaaaagtgaatggagagtgcatgtattagtaataaataattacgcaaaactatcataaatttttatttttttgaatcctttaaactttttgaataacttttttctaaaaaatctattttttacccatttttttg

SEQ ID NO: 344 - DNA, 2408 bp, Diabrotica virgifera
gttcaaattctgaaacaattaggtgtaatttttaggagctcaataatagtgttatttacatgatagaatcctaataatatatattgaggaatttccttagggaattccgacttgtaatcttcaaaaatgagcacatatgaagagtatatacaacaaaatgaagatcgagatgggattagatttacctggaatgtatggccttcaagcagaattgaagctacccgtctcgtagtacccttagcttgtctgtaccagcctataaaggaacgtctggatcttccaccaatacaatatgaccctgttttatgtactagaaatacttgtagagcaatattaaacccactgtgtcaggtagattatcgagcaaaactctgggtatgcaacttttgtttccagagaaatccatttccacctcaatatgctgctatttcagaacaacatcaaccagcggaattgatgcctatgttttccaccattgaatacacaataactagagctcaatgtttaccaccaatatttttgtatgttgttgacacctgcatggatgatgaagaactgggttccctgaaagactcattgcaaatgtcccttagtttgttgccacctaatgcgttaataggactaataacatttgggaaaatggttcaagttcatgaacttggcactgaaggttgtagtaagtcatatgtgttcagaggtacaaaagatcttagtgctaaacaggttcaagaaatgctgggaataggcaaagtggctttaggtcagcaagcccctcaacagccagggcagcctctaagacctgggcaaatgcaacctactgttgttgcaccaggaagcaggtttctacaacctgtatccaaatgcgatatgaatctaacagacctaataggagaacaacagaaagatccttggcctgttcatcagggtaaaaggtatttaagatctacaggtgtagctttatcgattgccattggtttgttagaatgtacatattccaatactggcgcccgagttatgctatttgttggaggaccttgctcacaaggacctggtcaggtagttaatgatgatttaaaacagcctattagatcacatcatgatattcagaaagataatgcaaaatatatgaagaaaggtattaaacattatgatgcgttagcaatgagagccgcaactaatggtcactctgttgatatttattcttgtgctttggatcagacaggtctgatggaaatgaagcaatgctgtaattctactgggggacacatggtaatgggggattcatttaattcttccttgtttaagcaaactttccaacgtgtgtttaccagagatcaaaaaagtgatctgaaaatggcatttaacggtactttggaagtgaagtgttcccgagaattaaaagttcaaggaggtatcggttcgtgtgtatcacttaacgtgaagagccccttggtttccgacacagaaataggaatgggtaatactgtgcaatggaaaatgtgtactttaacgccaagtactaccatgtctttattctttgaggtcgtaaatcaacattctgctcccatacctcaaggtggtagaggttgtatacaatttattacgcagtaccagcattcaagtggtcaaagaaaaatcagagtaacaacagtggctcgaaattgggctgacgcaactgctaatatacaccatatcagtgccggattcgatcaagaagctgctgctgtaataatggctaggatggccgtttatagggcagaatctgatgatagtccagatgttcttagatgggttgacagaatgctgattagattgtgtcaaaaattcggagaatacaataaggacgaccccaattcattcagacttggtcaaaacttcagtctttacccacagttcatgtatcacttaagaagatctcaatttcttcaagtattcaataattctccggacgagacttcattctacagacacatgttgatgatggaagatcttactagatctttgaaaatggaaacactcttctagtattaaaatacagttcccaaaatataatgcatctactcaaaatcatataagaaaatattagatacgcacaaaaacctaaaactataatcgatcggattataaactgttatccgaatgtcaactacaggcatatatttgaagaagaggatgttggattattatcacaactggtaaaatcatataaagtgcgccatatgtgtcagaatgctatgcttgatcggtataaaagatactatagaaaacgcatggagtttctcgggaaggaataagtgtagaagcttatacatctaacgatgataaaagatacatattgtaatgacatcggacctactgaaatcttctcctacaatttaaaaggcaataaactcttctttactacatga

SEQ ID NO: 345 - DNA, 1390 bp, Diabrotica virgifera
gcgactttaacaaattagcaccatctgttttttaaaagcaattatataaacatacaagtacaagttctcagttctctgacactgttatttgaaagctctgaagttttgttagctgaacacctctagtggatgcagcagtgttttgatgtccagcagctgtgttagttagatcaaacaatggaaaattatacatctgacagtagtgatagtgaaaatagtgttaaagtaatagattatgcctatctactgctcaacccagacgagacagaagacaaactagagaaatattttgatgaaaagaaatcgtttgaattagtcgagaagttaatactacatcacaatcaacttattacactgcctgactctgtatatcagttttctaatacaagagtattggatataagcaataacggtattactaccttgccagatgtattcaagtaccttccgttgaccagttttactgccaaaaataatttgctaacctgtagttctataccaaagagttttgaaaagtgcctttctttaatcgagcttaatctgagtggaaacaagctatgccattttccagagcaaatcctggatttcgttggattaaaatttttatatctaggaggaaatggaatggtagagatatccaaaaatatttggaagttacaaaatttgcagatgatatcctttggaggaaataagctcactgaagttcctgcagccattggccttttgcaacacttgcaagccttagtattatgtgataaccatatcgaatgtctgccagcaaatatagccaatttacacaaactgaagacgttacttctgcacaaaaacaaattaaggaccctgcctccagaaatcgtagcgttaaaaaatctttctgagttaagtttgcgtgataacccactaattataagattcgtcagtgagatgagtcacagtccttcaagtttgttagaactgtcggcaagaactatcaaattatataatattggatatggacccggagatatacctgccacactattcagctatataaactctggtcatcattgtgttaatccccattgcaaaggtgtatactttgacaaccgtgttgaacatatcaagtttgtagacttttgtgggaagtacagaattccattgctccaatatttgtgttcttccaaatgtgccaatactgcctccgtaagagaatggaaggacgaaagtatcgatagaccctcgagatcctacatgatgaagaaagtcttattgggttgacgaaccttcacacagattctattggcttggaccaaacacattttgcatttagttcaaaaatacatgaactccgaaacactttataagtgaaaagaaatatttgtgatacaagttattaaattttttaactttt

SEQ ID NO: 346 - DNA, 944 bp, Diabrotica virgifera
aaaagtaagatgaaggctttagtttttttctcactgctggtcggtgtttttctgtatcagataaacgcagcagtggtagaaccaagaaagcacgacgataattacgacaacgaattgaaacaaaacttgacagaatgtaagcgttcgctttttctagcattcaaggaagctgttcacgatacttccgactttgtagtgcaaaaagctaggaaggttaaagcttctatcagaaacaaaacgcacatggttatgcagaaagcaagagccaagatgcagtcagtaagatgtaaattacatctcataaaaagtaaattctatcctcacgtgcatctacaagatccatgtaatatgacagatcaagtattagaaaaaggaaaagaggttattaataaaacagcaacggtaattgattcagcctctggtacagcaaaaaatcaaataacttccaaggtggaaaaagtaagagttattccagatccttccagaaatagaatagtaaatgatcctgatgaaagccaaacaatatctaattctagaagaataacaactagagtaggaagtgatcccgaaagaagcgtgcattacagaagaactttagtaggtggaaattctaacacaacaagaataaccaccgatcctgataaaagtaaggtacattctagaactataatagtaagaagagaccctgaccctgatcagtccgatgaatccagtgaaacaaacagaactcaagtagtaacgagactggtcaccgaccctagagggactaaagtagtctatagaactatagttaggtcgaatcctaatacaaaaataaatgaaaccgattctgacgaatctaatgaaacccactgaaacagcagaaaccgtagtagtcaaagaagaaaagctgatctattgacgagtgctgcaaattttactagaaataagataatcacgaaaaa

SEQ ID NO: 347 - DNA, 1234 bp, Diabrotica virgifera
  misc_feature (1141)..(1141): n is a, c, g, or t
  misc_feature (1160)..(1160): n is a, c, g, or t
  misc_feature (1180)..(1180): n is a, c, g, or t
acctttattagaactgtgatatttgttagttgtatatgtggatacttagcggttaagttatttagcgatacaaaaaactcaaatgtactagtggaaacaacaaaaggatgggtgctgggaaaggaagaaaaaactgtttatctatgaaagacatatggacactttgccgtgattccatatgtcaaacctccgcgtatcagatctagcattcgctcctcctgtgaccaatctagtctcatgggaagggattctggattgccaatcaaaaggtagttagttgtcaattctcagaggcgaaatgttgcaactcgtcttaatattcacagcagtagtcctcttctactattttgctatcaagcctatgagctactggaaagacagaggagtagtacagtcaaaaccagtatggttttttggagatcaatggaaacaaatattcagactagaaaatatatacgagtttttcgaaagaggctacaagttgacagatggaagatatgcaggaatgtaccaatttaatataccaactttaataattaaggacccaggacttctgaaacaaattgccgtaaaagattttgatcattttgtaaatcacagacccttaattccagaaggaggtgatcctttatggtctaaaaatctctttgctctcacagatcaaaaatggagagatatgagacccgtcctaagtccatctttcaccagcagtaaaatgaagatgatgtaccagctcatggccgattgtgcccaaaatttagtagaccacttctccaaaataaacgaagaagttgcagaagtttcattcaaggacgtatcgactcgtttcgccaacgatattatcgctacgactgcttttggattacatacagattctttgaagaataaagacaatgaattctatttgatgggcaaagaaattacggattttacttctgttagttcggtttcacgaattttaggatttatttttatgcctaggatacttaagttattcgatgttaagctgttcagtggtgcatcacgaaattttttcattaatctcatagataaaactataaaggcaagagaagaacaacacattgtacgacctgatatgatccatttgttactggaagctaaaaaaggaaaccatcacaangatgaccataatggtacgnatacaggatttgccattggntaagatgaacattttgggaaaagcgcctactacagtcgcaaacgaaataactaa

SEQ ID NO: 348 - DNA, 1631 bp, Diabrotica virgifera
  misc_feature (1530)..(1530): n is a, c, g, or t
agcatatttatgacagacaaattaatggaagtttagtagtgagtagtgaaaaaatatggccggagcaatgttatttgaaagagccccgtctgtttcttctcaacacgagaagcttttaaaattatccagggattcagatgatgaagatcaaaatattgtcaataaagaacaagacatccttaatcttggtgagaaatataaaaaggagggcaaggcaaaggaactcgcagagcttataaaggccaccaggccttttttgagtttaataagcaaagcaaaagctgctaaattggtaaggtctctagttgactacttcctagatttagaagctggtattggtatcgaagtacaactctgcaaagaatgtatagaatgggcaaaggaagagagaagaacttttctacgtcagtcccttgaagccaggctgattgctctttattttgacactggaatgtacagcgaagcgctacaactggaatcgaccttactgaaagagttaaaaaagttggatgacaaaaatttgttggtggaagtacaactacttgaaagcaaaacatatcatgctttaagtaatttaccgaaggctagagctgcactaacttcagcacgaaccacagctaacgctatctattgccctccaaagatgcaggcagctttagatttacaatccggagtattacacgctgcagatgagaaggatttcaaaacagcttattcttatttttatgaagcttttgaaggttttgatagtgttgaatccccaaaagccctcacagcccttaaatacatgcttttgtcaaaaatcatgataaacagtccggaagacgtccaacaaatcgttagtggtaaattggcctttaaatacgctggtcaagatatagaggctatgaaatcagttgcacaggctgcacacaaaagatcactagcagatttccaacaagctgtaaaacagtttaaacatgaattagaagatgatgttattgttagagcacatttaggaacgttgtatgacaatatgttggagcagaacctttgcagaattatcgaaccatattctagggtacaagtagagtatgtagcaaaaaccataaaactcccagtactacaagtagagaagaaattgtcacagatgattttagatgccaagtttcatggaattttggaccaaggcgaaggtgtcctcatagtattcgaagaaagtgcagtagacaaaacatatgaaatggccctagaaacgatccagagtatgagcaaagtagtagatactctttatcaaaaagcaaagaaattgtcataggtataatgtagccgagaatgttatgaaaataataaaatgactgtaaatttttcagaactagattttttgtagacactgtgtttatataacctatttaatttgcttttgttaattcttgtctttttaaggattcttataactcatagttttcggagcttgagggttttggatgtgatggagtttttttgttaatacagtatagatattttttaagatacttaaagcttatctanatctaggaaaatatcatgcctaaagtcataagagattcataatccatatgtaactaactcatagaactattttctttataatattttttacaagcaatgaa

SEQ ID NO: 349 - DNA, 978 bp, Diabrotica virgifera
attcacttaacagttaactgtaaaaagctgaaatttaacatttcattgtcgtgattttcacaaccgacccaaatgaaattgtttatttactgtggtttgctagtttttctagtgctcagttttactgtttgtggggtactgaccgattctgccaatgaactaattgtggatttggtaactccgaaaggacaaatttcaggtcacacacttcaaagttataatggtaacgaatattatgctttccaagaaattccgtacgctgctcctccagtaggagaccttcggtatcagttacctcagagtcatccaggatggaccggagtactaaattgcacaaacaatacaaaagtatgccctcagcctcaatccacttacctggaccaagatgaagattgtcttttcgctaatgtttatactcctgtaaaacctggttctaatatcttactacctgtatatgtatggattcacggtggtggatatgcagtttgggatggtggatttcaaaggtacaacccatcatatcttatagatcataacatcgttatcgttacttttaactatagactgggtgctttaggatttctggccacagatgattgtgtaatacctggtaacttaggccttaaagatcaaaattttttactaaaatgggtatcagaaaatattcatctatttggtggcgattcctccaaagttactatcggtggtgagagtgctggttcaagtgcagttgctgaccatattttaagcaaaatgagcacaggtttatttagaggagctattcaagaaagcggaagcgctataaactattttaactttgtacccagccctagtgtttatgcgtataaattggctcaagttatagataattcaattaatccacaaacaacaaatacatcagtactattggatttttctcagaaagcagaaattggcgatctagtagcagcatcattaaaggttcccgctgtggcaaac

SEQ ID NO: 350 - DNA, 1799 bp, Diabrotica virgifera
cattacgcgtccgatccggcaaagagagaagaatgtgaattattcggaagttaaacaaagaagaaaaaacgagtgcaagtgcaactttttcaactgtgatttgatgtaaattgcatagtggaataaattaattgatgcaaatttgatattctaatttctaatattgcacttaatacattgcatttttgagatcaaggttcaaggttacaaatcctgataagtaatggttttttaacattttgacctgtgccactcgaaaaatatctgtccttttgaccacatcactaaccctactgattactaaatatttttcactttccggtctacaatgagtacagtaggacaggttattaaatgcaaagcagcagttgcgtggggtcccaaagaagatcttaagatagaaaccattgaagtagatccaccaaaggctcacgaagtaagattaaaagttgtgtatactgctgtctgccacacagatgcgtacactctaagcggacaagatccagaaggccttttcccagttgttttgggacatgaaggatctgggattgttgagagtgtaggggaaggtgtaacaaatgtaaaaccaggtgaccatgtaattcctttgtatgtacctcaatgtggagaatgtaaattctgcaaaacaccaaagacaaacttgtgccagaagattcgtataactcaaggacagggcaagatgccagacggtacctctagattcagatgcaatggcaaggaattgtatcattttatgggttgttcaacattcagtgaatatactgttgtagctgatatttctgtaacaaagataaattccaatgcacccttggacaaagtctgccttttgggttgtggagtccccacaggctatggtgctgcccttaacactgccaaagtagagaaaggaagtacttgtgcagtgtggggacttggtgctgttggattggcagtaggattaggatgtcaggctgcgggagcttccagaatcattggagttgatttaaatccagataaattcaaaatagcaaaaaattttggattcactgaatttgtaaccccaaggattatgaaaaacccattactgaagtactagtagaactgacagatggaggccttgactacacctttgaatgtgtaggtaacgtccacaccatgagagctgctttagaatcctgccacaaaggttggggtgtttccactattgttggagttgctggtgcaggacaagaaatcagcacaagacctttccaactggttactggacgtgtctggaaaggaacagcttttgggggatggaaaagccgtgatagtgtaccaaagcttgtagaggagtatttgaataaaaagctcaagttggatgagtttgtttcacattccttgaaatttgaagaaatcaatgaagcttttcacctcatgcacaaaggtgtaagcattcgcactgttctggctctgacacaaaacagcaacctttagaaccaatattgaataaaaggtatctatttttataccagtggtattaatgaaataaaatgtatttctgtttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaaaaaaaaaaaaaaaaaaaaaaaggggggggcccctttaaaggaacccaattttacaaccggggggggggaacgtaaaatttttttaaaagggacccaaaatttaatttccggggcgcttttttaaaaagggggggaggggaaaa

SEQ ID NO: 351 - DNA, 1061 bp, Diabrotica virgifera
  misc_feature (907)..(907): n is a, c, g, or t
ccctaacgtccgggtaaacgtaaacgaaaacagtcgaaaaatcaaaacaattggttgaaaggctacgtgtcgataaagataaaatgtaaataaggttttacttattcactacaattgtacaatttaaatttgagagtgttccaagaaaatgctaaaagccgtaattttaattggagggccacaaaaaggaacaaggtttaggcctctttcgctagatataccaaaacctctttttccagtagctggtttgccattaattcaacatcacattgaagcatgcagtgccatagaaggggtaaaagaaattcttataattggattttaccccatatcccaaatccaaccatttgcaacagaaatgcaacatttgtacaacataacagtcaagtacctccaagagtatgtggcattgggtacagctggtggcttgtaccattttagagatccaattagatttggaaatccagaggcattttttgtaatgaatggtgatgtatgttctgattttcccttagctgagctttaccaatttcacaaagaaacatgggagaaatctggcaaaaaagcattagttacaataatgggaacagaagcaactagacatcagtccctaaactatggatgcatagttacaaataaagagactttggaagtgactcactatgttgaaaaacccagttcatatgtgtcaacattgataaattgtggagtatatgtattttctcctgaaatattccacacaataggcgcagttattatgaaactccaagagcagtacagcaaaaacggaaacggaaatggtaacagagaagccgggtatatccaactagaacaagaaatactagctccacttgccggatctggacaaatatatgcgttaccagtcacaaattggtggtcccagttnaaaactgccgggtcagcaatctacgccaatcgtcattacttgcagctttataaggcaaactttccagaaagatttatgtcaccaggaggtaatgaagaacggtgtgtaatttaccccgatgtcctcatagataaaacagcatcgattcatccaa

SEQ ID NO: 352 - DNA, 1459 bp, Diabrotica virgifera
gttctagatcgcgagcggccgccctttttttttttttttaaataaactttactaaaataactaagtacttctcatttacattacaataaataacaataaattttaaaaataatacaatttaaaacatctatcaaattgtctgttgggtaggacaagttggattaatttgatctaattgattgtttattatggcctctaatcgttgatttaggagtagtaactgatctttatggttaatgaaattgtcgtgcgcaaattgggtgtctgaaactctcataaatccacattgacaatctgatcgtattttattatacgcgagtagtgcattggatttttctgctaaccaatcattatctgaaacaatatatgtaactggaacattaatatcactcaatggatattcgggtggtgtagcgctgttatatgccaccagatttccggctgatccatagtcaaacttctggaatcttcctgaattaattagttgtgcgtaatgagttatgaccttttcgcaaatgctgtctggattatttgtaatttgtatcggacgcttctcataatctaaacaggggtaattatttccaaaaatgggcaccgtaacagagtaacacatttgcatcgtaactgggaccagtgcgcagaaactcgtgtatgctgggttcttcttaagtatttgaccgttaaatgccaacttggccattggctgaactaaaggccaaatagttgctaagcctcctaatatagatcgtatttgtttatttaaaattacaactggtgccattgcaataaaatttcttactctagattgagctgtcgctggatctaaagagagataaacagttgtgactgttgttcccatagaatatccaattactattgccttttgtccagtggtggtccaaacaaactccagggcagctgcaacatcgtacttgcccatctcgtgccatgaaaaattccagtaggcgtagttactctgatcaagaccatttatatttccagtactataaatcgtacctcttaaggataagaagaaaacttgcctatcaccgccgcctgctaccagaaattgatacgcaagacttttttcttgtgaagacataaagcctctagtattcatataaataccgtgaaccattaaaatgggtgccaatgaagtattcaaatttttactgtatgctctgatgactgaaacttgataaccgtctccagttgttagtattttttcttcaacagtgcagccccatctccccaaaatttccataggactggctcctccatcgggatcaatttggcaagtgccaccattagtttgaccaaataaattaaaataatattccagttcagtagtacaagttttcacacctgcagtagttaatgtgaccgaacacgaaaaacaaaggagtgataaaaaaagatatatcggtgaacccatttttactgttccggacgcgagggg

SEQ ID NO: 353 - DNA, 1133 bp, Diabrotica virgifera
gtgccttgattaagttccagaacactatttggaagtaaaaattgtgatatatacattttataatgccaaccaaaataagatatgccaacacaggagaaccactcgatgtcctttatttggaaaattatgatatgccagaaccagaaaaagatgaagcattggtccaaatgatagcagctgctgtcaatcccgtagatataaatattgtacaaggaaaatacccattaaaggttgatagtcctgggtatgaaggtatgggaaaagttataaaagttggttctgaagtgaagaatctaaaagttggagatcatgttataccaattgtttatgcaggaacatggaggactcatatcacattgccagaagaaagtttattccgcattcccaaaagtattgacgttcctgaaggggctacgttgcaagtaaatccagtaacaatgtatacgatgctgaaagaattcgtaaacttaggacctgaagatacagttattcaaaacggagcgaattctgcttgtggagttattgctattcagatgtgcaaggcatggggaataaaaactgtgaatgtggtaagagataggccactgatcgatgacttgaaaacatttttaaaaagtttaggtgctacatatgtttttactgaagaagaaattaaaaaaaccgacatatttaaaactggagagttgaacaatcctgtattaggactcaactgcattggtggaagttcagccactagcattatgaggcatttgagtgaggaaggagtgttagtaacttacggtggtatgtcgttagaacccgttacagcttctacaacggctctggtcttcaagaatatccgactggaaggtttcaacatgagccgatggaataataaagaagagaatttcgccaaacttcctaaaatattgaatgagatcgttgatatggtgttagaggagaagctgaaagcaccaccgcacgcgttagttgattttttgaattataaggaagctttaagaaataccctaagtccaggtggtatgattggaaaaaattcattttggattttaggaatttgagtagtaaaatttaaggatgtattataatatattttatgaaattaaaacaacacattatacttaataaaaatt

SEQ ID NO: 354 - DNA, 980 bp, Diabrotica virgifera
  misc_feature (769)..(769): n is a, c, g, or t
  misc_feature (859)..(859): n is a, c, g, or t
acccacgcgtccgcccacgcgtccgcccacgcgtccgcccacaaaagagttcagtagaattttatcggctgctttttattataatttgctattaattttgtgagatggagtatacattttgtttattatttctttgggtaggaagtacaacgtcggcaaaacttcctatgtatgatttccccaaaaaattctcgttcggcgtagccacgtcagcatttcagatagaaggtggttggaatgcttccggaaaaggagtgagtatttgggatcaccttgtacatgatacgaacgaaatcatcgtagatgggtcaaacgccgacgttgcttgtgattcttacaataaagttgattatgatattctattgttaaaagcccttggagtaagccattaccgtttttccattgcttggactcgaatactgcccaatggatttagaaaccacgtaagtgaagatggtgtgaagtattataattatttaataaacaagttattggaaaatggaattgaaccttgggtcactatcttccactttgatataccctacggtatgtttctgataggtggaatgttcaatgaaaaattcagtgaatacctctcagactatgctgatctattgttcaatctatatggggatagagtaaaaacgtgggttaccatcaacgaaccttattcagtttgcgtaagtggcacacgagttttaggtgaatatcggccaaacggtatagtagaataccctttgtggtcacaccttcctcaaagcacatgcangcagtttatgacctctaccagaggaaatataaatcacaacaaaatggaaaaaataagtatgggcttttaacttacaatgtaactatcccngaacgaattcagcagaagatatagaagcagcagaaaggccatcattgcctttttaggttgtttgtcattcctgtcgtggttggaactatcacaagtgatgatcgacagtattgccatatag

SEQ ID NO: 355 - DNA, 1007 bp, Diabrotica virgifera
gatgtcataaaaactgtaccacgcaaaataatagcggtggtttccaaggatgcgttgaaagccaccgcttgctgagtttacacattgaatttttcaccgtaatctgacgtcattcgtcgcagtgttacggtcccagttgtcggtgccgctttcgaggaaacccaggtttcagagcaacagtgacttagccacaaatcgatcatttttatattaatatatcaataaaagcagcaacattaaatctttggattaacagcggccaacacaacctacctctatatttggctagatggcgctacataatttatagcgccatcccataaacataatgcaaagattacatttgcctcagaacttcgtttttggacataggtcactgttgatctgatagcctcaattacataatgatttcacaaatgtttactgttattttaatgtttttttggttttcctatcacattgctaatatcttctgtatattaatctatatagtattatttttatatcttcatatagtaaacttgtattttaatgtaaacatccgttaattcttccattaaacgaaatgttttagaagcaatattttatctagaaagctttaaaatacagtatgctgcaaaataaacagtacctactgcaatgaatattgaaatgtttattattatttatatatttattatacatgatacagccttgcaaacattattcacgacgacgttccggataaaacaaatgtttaagatgccctcctttcagtttcaagcatttttcgtagcgttcatgaagattctcagtcatgtttgtgaacaaaaactgcctccttcagcattcctcataggtacgcattaggtggcgttagatctggcgagtgcgatggctatctaaaatcactaccacacgaaataaggccccaaaatgatttcgcaacaattaaagagttaattgtttaattaacggcgtgggacgggttggccgcgtccggatgaaaccattgtttgtttacgggg

SEQ ID NO: 356 - DNA, 442 bp, Diabrotica virgifera
gcccgggccgatccacacgtcaacggacgcgtgggcggacgcgtggggactcttcctgcactctccgatttaaccagagtattatgcagctgctgcattttcgtgttgcaaagaaattgaaaatgtttatattatattctttttatcaatttatgtatagtaactgaactgacagccctgaaatcaattgtatatatgttgaacaccgctaaaatgaagataagataagcttatgtttaaattttcgcattttcgaaataattaacattattaactatatcggacattgttccatttttatctaatcggatatttttgtaattaatatatgaacattctgataccacatgggtttttccaaatattgttttggtctttattggacgttaattaataataagtctatttgcgaatatattaaagtacaaatgtttgaaagacg

SEQ ID NO: 357 - DNA, 1483 bp, Diabrotica virgifera
  misc_feature (695)..(695): n is a, c, g, or t
tgctttttgatataaaaaaaaacagttgcacttttaaaatgaatacaatttaatacttgagaacccgatacctcaaagtagtgaattttgtttgcttttacatacttggcaattggataacaaattatagttgcagaacatttttttaattttaaggaagttccattattgttttgtttttaatttcgggaagctgttgacggaacaaagtatcacttttactaaaacacacgtaatttttgttcataaatattaattagtcctaatctcaactattctatctgcctaaaaacattgcttttaataaaacaataattataagttaaaaaattcaaatgtataaacattttcgtgttgcaaagaagtttaaatagtttatacattctaattcatttactcttttgttgagcactaaggaatctttcttgttggaacttttaccacgctgagcagatgggttgtgaattatttaaaattctctcatcttaatttcctcggcatcctgtatgatttataatttttgaaaatctcgggaggttgtaaccaaagaaagtattctacctgttgtcaatctggtggtatggagacgatatttattgtcgttttctgtgctacttcgattgatagcttatttgtcctttcggtagatggctctagttcatccgtgacatttctttctttgcaattcggaaagnccgaaagtatgatacgtggagaaatcggagagaagaggatatgggactactgatgagggggaaaagacctctgaaaccggtatagactcttcctgcactctccgatttaactagagtattatgcagcttctgcattttcgtgttgcaaagaaattgagaatgtttatacattcctataaagagcttgatcaagaaatgtaaagacctacagatcaagtgtatcacattttggttactttgtgcgagaaaatgataaattttaagttaaaatcctttgtcattacatttctcttaaaaaacgcaataaccaatcgcttcacacaaaagcattcattataataaacaataaatattacttttaatccaaaagtatataaaatctaacaaactaacattaatagatttttagaaaacgtgtacagttttacaaattaggatttgttaacttcagttatcgatgtaaatgtctacaattcgtttgttacttaagaaaaagcgacatgaataaggctaataaatatacagtgtgatccacaaatcatacatactccagacctttcacgcaaatggtcaaggttaagacagcaaattagtggtctttccaatccagagatgtcgccttcagtgaattttcttgtcacatttaacaattaaattaatgggttatttttcaatttactttacaatttatgacttaattattatagtggtgttacgattttaatcagatttaaccacaattttagtcaatttaattagccttctcttcgttttatgagtagaatttc

SEQ ID NO: 358 - DNA, 1741 bp, Diabrotica virgifera
cccacgcgtccgcccacgcgtccgaatttatacatgattacatacattatttaaataattaaattcattccgataattattagtttatcatattgtgcctcatttaatgttcattgagctatcatctatatgatttgggagcctttttatatgtacagtaaaacctaccatatccggatcaatgtggcgacagaccgatccgaatatgaaaaaatccggatatcaagaccactacttcttttagtctctgaaacgttttctcctttacacattccagtaatcaacgccgtcaataactttcgtcgatagacaagttttatagattctataatacattatttcgccatcttttagttcttcttttagtgcgttgtcaaacagcaggactgcctttctcggtagatttcgatacatccggacggcccacaaccgtccggatatgacaggtccggatatggcaggttctactgtatacttaattcagacaatacttcattacagaaatcaaaaaatatagtaatagtttaatgtgtaactagagactaaaaatcaccaaaagttttaagaattaacttttaattgttgcaagtatctgtgccattctgaacccagttagtatcatatacatactaatttaacatgtgatcattccatttggggaacatatcgcataaattgataaaataccatttctcaattagaagtttatgtatcaatttgaataacttagataaaaaatattaaaatacaatagttaaatatccgaagtttttgttgctacataaaatcgtcgtattcatcgtagtcgttaacgtaagctgataattggttaaattgattatcaccttcaatgtggagcttcgctttgccttttcctttattctttttcgccttgtcacctttttttattttttgtttttccaaaaatagattatctaatgagtttttaacttttttaatatccaaagatgacattgtggcacataaacttctagtcaaattttctacaaaatttggatattcagtacttttggatagagtaatgagttttttggaaagggtatcagtaaagctatcaaattcctctgttgaattaggtaatgtaagatcagtaagaacttcagtagttttgttaccaccaaaagttgtttcaagagctaatttcaggtcagattcctgctgacgtctaagtttttcttctggtggtatatcctcttcagcctcttccctaagtcttcgttccatttcttctctttttaacctctctttctcagctattttttcagctagactcttctttttaggtttcttttgatctggatcagcctttccatcttcttttttttcttcatcttcgtcttcccaactttccttaatgtcttcctcctcatcttctccttcccacttgttagcagctactggaacaactgtaggagcagtgggctcaaaattgtcatcatcccacgattccatattgcagattgtactagcaccgaacctcaaaatgaccacttcacgtgtggcttatggacgattataactaacgatgattcaccaaccaaaatcgttaaaattggttagtaaatcaagaaaaaataaactgctatcaaacgcgatgtctgggttttttaaatttttgataagaaattataaaaacacaaaaattcttcaaattatcactatacaaatttgaggtcgaccttcgaacatccatttcaggttcactttgcccacgcgtccg

SEQ ID NO: 359 - DNA, 1001 bp, Diabrotica virgifera
  misc_feature (988)..(988): n is a, c, g, or t
caactccccaacccacaacaactcttgtgaaaaaaaaaattaaaatgaaactgttcatcgtctgcttggccatcttgtcagtctgttacggacgtcctgctgacgcacctgctgcaagtggtccaccagctaacgctcaaccacccgttgctttaatcaaatacgagaatgaaggcgtcaacgctgatggatcatatcagtggagttttgaagcagccaacggcatcaaacaagaagaaaagggatccttcaaaccaggtgctagtgaaggcgaaagtattgcagaagtctcaggccaggtcgagtatacagccgatgacggtacccccattcatttatcatacatagccaacgaaaacggcttccaacctcaaggagaccacttgcccactcctccaccaattcctgaagcaattcaaaagtctttggactttaatgcagcacatccacaggctgaggatgctggagctggagcagggtcacctcctggagcagctgcaccccaagaataaggatattttctatcttgtataatttaactaaatctgcattaatgctacgaagacagaaaaacttttgtaaaatactctctagcttaattttatattatcagtacctaccatttctttacatgtattaaatagatattattgtatttatttttgaactgatagggaagccagaaaaaatgcaaaaaatacttgattgttgttagcttgatctagttttctataatttcttaggtttatgagtaaatttttatgaacaagtagtggtagtatttcaaaaatatgccttttttagagattgtgccatatcaatattttttagtattttacaaaagtttttgtctgcaaaaattctggttttggaatatgcagcaatgtgagctgctgatgttcatggtttggaatccaagccttgaatgggattattaatttatttcttttatacttttattattgcaaataaaaaattgacctgtccnccaccccacaacc

SEQ ID NO: 360 - DNA, 927 bp, Diabrotica virgifera
agaggatttgacctactgaatactgacgtcaaataatttaaattaaatttcactttcaaatacataagtcttgaaagatgtcttgtccattcctttcaaaattaagccaagcttatttgaagaattatgcttctcttttggtcaaaatgtatggtaaccaatgtcctgtgatatccagaagcatgaataatgttgccagtaaggctgaagttaaaactcaagatgacgtgtttgcctacgatcagttcttccatcagcaaatcatgaagaagaagaaggaacattcctacagagtttttaagaaagtcaatcggttggcaggacctggagaatttccaaaagctgtagaacattcatggggacaagcaccaataactgtctggtgttcaaatgattatctaggaatgtcgtctcatcctgaagtaaaagctgccgtacgagatgcactagaaaaatacggaactggagcaggaggaactcgaaacatttctgtcaattcaactctgcacgaaaagttggagtccaatcttgctgagctacacaataaagatgctgccttgctgtttacttcgtgctttgtcgctaacgactcaactttatacactttggctaaagctttaccaggttgtcatatattttctgacgctgggaatcacgcatcaatgattcaagggatcagaaatagccgtgttcctaagcatatattcaggcacaatgatccagcacatttagaagaacttctccaaggagttgatcgaaacgttcccaaaattgtagcatttgaaactgtgcattccatggccggagctgtgtgccccctaagaggaactttgggatttttcccctaaatatgggcgctttaacattccgggcaccaaccccatcgccccttgctcgccaccccaccgcccgccccacccatttctc

SEQ ID NO: 361 - DNA, 1272 bp, Diabrotica virgifera
  misc_feature (1205)..(1205): n is a, c, g, or t
cctcgaccggaatctaaaatctaaattagataggaataaaaccctattttaaagcagtatatgccacatatgttaaacaaaaaatgatagaatcatgcccaaagaaacgtatgttattgggaatcacggtattaggaattttaacaatattagtactatttattgagtcacactggacagagtcgacacgaagagacaaaaagtcaaatttcattgttgagcagaattcaacctgttgggaggctggtaattttgaagtgatcaaggaatgtgaaccatgtacagcctttgaaattcgtagcaaaactattggtgtttgcattcatagccattacaaagaagttctcaaatgtgctaatggtgagactgtaaccagaagttgtgataaagctgtttattatgatgagctatcgttttggaggtttgaaggatttatgtttgccataggattaatttctactgtttgtgtgatatcaagaagaagagtactaaacaaaaggattttacaacgcgttcaacgacaacttgctaattgtgtttaaaaagatgacgcatgcgactctgtacataagtgcttacttggattcatctgattctttctggatagatattgagtctctaatagtattatttgtctacaaaatagcaaaaactgatgaagttaaacttatcattaaatcattattaggtaaacccgcagaacctcttattaaagtttcttctgaagggctaaattttaataccaacaaaacgatacctgacatcgcaaagtttgtggtgtggccagcaattgtatccgcaaatcaagtaactgctggcgtatgttccgtaaccagaagcttaataaaacgtagtcctaacaatgatataagaaatttgcttggatttagagaagcttgcttattttcatgctcagagacatcaatatggactcggttttgtgaagttgatattgtgcagacaataaaacatattttgggaaacaactgttgtattggcgaggaatttcatttgccttcggacatagtaagatttgaataccacttatctactccagtcaggatacacaacatttataaggttgcaagagttaaaaacaaagataaaggcatcaaatcaggaataccaacagaagagctgaatatacagcacatatttagcgaaggaccttttatgactctagctgatgttatattatatatatngactatgaagtgtttttgaaaaattgtccattagatctaattaaaggaagaatacctttaacccttt

SEQ ID NO: 362 - DNA, 1393 bp, Diabrotica virgifera
  misc_feature (1303)..(1303): n is a, c, g, or t
  misc_feature (1340)..(1340): n is a, c, g, or t
gtgagactgagagtgctttttctataaaaaaaaaaagaatgtcctaccaacgaccgtctttttggcaatggcgagcagataacaataagaaaaaagtgggattcggatctcctgtggagggtgtccttcacagaggtgatattattaccaaagtaggcaactatgattcaagagatattcgtcatcaagatgcgcaaaatttattcagaaatgctggaaataatattcaagttgtagtacagagggaaaacgctcctcacagtaccggatcatcaaggacgagctcgcacaattacagcccactgtcagtttccccccatctctctccaaaaggttatactgtatcatcgggatacagtccagctggatcagccctaacgccatactactccactccccttacccctattgacaataattattttgaagtttacgaacacgacccaaaacgcagacacgaagaagacaataaggatgttcacgttacacaacagccgtatcgtactacccccctggtacttcccggtgctaaagtgaaacgtgatcaaggacccactgaaagttaccttcgccatcatcctaacccttcggtgagagctcctcctctaaatatgcttggacatacaaatttcagttctcctcgtaatctgtaccgtgaatcaaatatcgatactatgcagaaccaaacgagaaataaatcgcaaacacgtagacaagtaaagtttaatcctgccgaaagcgaaacatacaaggctctacaagaagaagaatatgaatgtgataatatccaagaagtgactgttccaccacaaagtaaagtgtatgctccaaacaaaactattcccagcaagaaaatggcctatgtggtaaaccaaaatcctcaatctcaatatggcaacgcactcggtactgacccagaagtgattcaacaaagcggatctttcaaaagattgatgtggagtgtccttcctggctcccaattttaaatgaacaaacttacaattattttagtaataaacagtttttcggtgaaatactacgtcgagaatatttaatacgaatatggaacagtgtcacaaatgttcatttaatatcagtcaaattaatcaatttttaaattagcgagcacgtaaagccatctttgttaggtagctactagctatttagaaatcgtttcttttgtagattaattttataaaaggggtttttgtcaaagcgatacctatatgatcaatttaaaccatttaagttgacttgcatagtttaagctagcgtattaattcctatttgaatatttcattanaattgtttaaaaaaagtataaacagaattataattanacactaagttaattagctagggttattagtaaactacatcggtcataacagtt

SEQ ID NO: 363 - DNA, 1241 bp, Diabrotica virgifera
gaaaataaaatggtagacgaaggcactaggaaaacattaagtaatatcccattattaaaaacaaaagccggcccaagagataaagaactatggatacaaaggttaaaggaagaataccaatctctgattaaatatgtccaaaataacaaagcagcagataatgattggtttaggctagaatctaacaaagagggaacaaagtggttcggaaagtgttggttcatccacgaactgttaaaatatgagtttgatgtggaatttgatattcccatcggataccccacaactgccccagaaatagcccttccagaacttgacggcaagactgctaaaatgtatagaggtggtaaaatttgtcttagtgatcatttcaaaccattatgggctaggaatgtacctaaatttggaatcggtcatgccatggctttggggcttggtccatggttagctgtggaaattccagatttaatagcaaaaggagtgatatcttacaaagaaaagacaagtcaatgatccatataaataaatttatagttaagaataagagcaaaataaatattttccattttatgttgttgtggttttcgtgggtgtgtacaaagtttagtttgtaataatcttgaggttggtaatagaaaatatgccaaacaggttaaaactaaaaaaaactactcagtcagtgtttcatgttgaagaatatactagttctagatcgcgagcggccgcccttttttttttatagcaactatacttaaccctcccattctatttagaaatgatttcgtaccactcatattaaaaagtaaatgattacttacatgttaaaataaccttggcatatgatgttacttaattgataatacagttgaacccacttattggaataaccttcatgccaagcaaaagtattcctataagcgggatattctaataacctatcattggtggatagtaaaaatgtttcgggacctcaaatatatattccgtaaaccgggatattcctttattaggggattctaagaatcgggttcaactgtaactgaaattcatttgaaattggttaacttttcatttaattgtttaataaatgtgaacattaatgtgaaatgtgtttaaaataattctctatctgggggttttctctatgggtttattattctatttttggctttttttaatatagggatggaatgagaaatatagaattttctaccaataaaaatatattattatttcccgtc

SEQ ID NO: 364 - DNA, 1192 bp, Diabrotica virgifera
gcgagcggccgctcgcgatctagaactagtcaacagtgatgatagtgaaaaacctgacgtaagaatcttacacattgttacagttttttaagtttcattacatgtgtgaaataaaaaggcattcccagtaaactgtacaaatatctacagaaaaaataggtgcaatggcagaacaatcgctcatgagttttatggatgaattactagaaagcatgtgcctcttctgtgcagtttgtaaagatattttaaaacctcctattatgttagtggagaatgtaggaaacgtctgtacaaaatgttatgaagaaaagcaggaagtaatgaactggaagagtatgaaaaactcagctttggaaaatatattgaatttattaaaactgccttgcaaatataaagccaaaggttgtgctgtaagggtatcgtacgaagatttagattttcaccaaagtggttgtaaatatcgcaccaaagtatgctccatgttaaagttcggttgtgattgggaaggaagtacgattgatttcatagaacactttaaagaatgccatggcgatcatgttattaactttgaaaacaacttgtttttcttagaaacctccctcaatgatacaaacatggtaaagttactggtaatgaagcaacacacttttatacttaggatgcagaccaatcttcaaaaaaataagctattctacataatttgtagtgtagatgatgattactcttcgttttgtgagtactcagtcaagcacaaaggaggtagtgaaaactacattaaaacaaaatcaaaaattgtttcttcgtatcacatttataacgagtttaatgaaaacattgctgtggaaatcgacctagatgcacttaagcaaatctcccacatttctgatactattactaatatatttaaaatcaaattggaagaatcttcaggggaaacaatcgatgataaaatattacacttttttgaatgtcctgtgtgtaaaaactttatgaagccacctatttttcaatgcagttcaggccacagtatttgcaacatgtgtagacctagactagaaaagtgtccaacatgcagatcagcatttggtaatacccgaactattctttagaagcctgacagcaggtgttcatatccgtgtgtgtatcacgattctggatgtttagaaataggattttgccatcatatcgtaaa

SEQ ID NO: 365 - DNA, 963 bp, Diabrotica virgifera
  misc_feature (887)..(888): n is a, c, g, or t
ggggttgatattttaaaaatgttcctaccaaaaataaatcgtattatagatcctttcaagtccttagcaatccaaaagaacattgcagcaactgtaaatggagcccaaacgatgtcaacaactgttgccccaagcgagcagaagaccgaaaagaaacctatcagcaaagcaatgaaggcttacttagaacgagccaaggagcatgacgagtttatgaaaaggcaaaaagaggagtttttaataggtaaaagacatttagctaacatgatgggggaagatcctgaaacattcacccaggaagatgtggacaacgcaatacagtacttatttcctagtggtttgttcgaaccgaaggctagacctcacatgaaacctccagaggaaatatttccacaaagaaaagctgcagagttcgatgagactggtagaccttatcattttctgttctacacaggaaaaccttcatactatcaagtattacatgacttaacgagtcatataaacgatcttattaagtttgaagataccatgattcgaaaaaacctacaaccagatcccaatttaacatttagcatgtctggttttcaatggttagataaacagtctctagagacaaaatttgttgaaacgctaaaagaaaaagactacgaatattttattacttcgttggagaggctcagtgctatgccatattcctacaaagttaaagattttattctagaatatgctaatccactcattaataaagttcagtcacaagagactccgaaagccaatatagacaaagacggaagacagttcgtaactatatatgaatgtatgaggaaaagatctcgaggcgacgtcacaattaagttaccaggtacaggaaaaatttctattaatgnnagagatattaccctactttaagaaagaccaccgagagaaacagtgctgtttcctttgatattcacccagcatgct

SEQ ID NO: 366 - DNA, 1145 bp, Diabrotica virgifera
ctcctagcgtccgggagaaattcatacaaccagtcaacactagttagtttagtcactgttttaagtgcactgaaacaaggggaacatctggctgaattgaaattcagcagataaaatgaagctgtgccacttaggattaatttttctcattgtctttctagtcactgacattgctgctgagaaagtagtaaaacgcaaaaagaccagaaggaagccaatacacattgaatcttttgattctaaaaatgatatacaatctgaagaagctattccaatagctccaccaggtgatgaggatatcgacaatcgggttccattagtggatccatgtatgcaggtccgttgtggagccggaagaatctgtcaagtcaatgagttgagagaacctgaatgtgtttgtattccaacttgtccagaagaaagtgaatctcgtcgtaaagtatgctccaactacaacgaaacgtggtcttcagattgcgctatctaccaacaaagatgcttgtgtgctaaaggagaccaggaatgcaaaggaccccaatataaacatgtacacattgaatattacggacaatgtagggaaatgcctcattgtactcaagaagaaatggctgatttcccacgcagaatgcgtgattggcttttcaacattatgagggatttggctgaccgtcaagaacttactcctcattacatgaacatggaaaaagaagctgaatcaaacatgactcgccgctggacaaatgctgctgtctggaaattctgtgatttagatggaaatccaccagatagatctgtttctcgtcacgagctgttcccaattcgcgcaccattgatggctttggaacattgtatcagccctttcttaaattcatgtgatgcagataataaccacagaattacacttcacgaatgggccaaatgtcttcaactggaagaggaggaaattgagcaccagtgtgaagaaattagtgatatttcagcagagtaatgcggaccttacatataaattgtaaatatttcaaaggtgctgtagaattcataaaaaacgtgccatgatattttatttttttagatatcttaacgaaatttaaatatgacgtttaattttagtatatcctgtatagattaataaaatttctaatagt

SEQ ID NO: 367 - DNA, 1497 bp, Diabrotica virgifera
aaacgtcaacaatctgcggactcggggatgtttagcctgacttttgagtaaaattaccgaaaaacataattaaaattgatttattaagagtacataataacgtacgaaaatgaccgcggtagaacaaccttgttacacactaataaacttgccaacagattcggagccctacaatgaaatgcaactaaaaatggatttagaaaagggtgaggttaaagtaaaaataagagcattagaaaaaataattcacatgattctggcaggagaaaggttgccgaatggattcctaatgaccattataagaaacgttttacctctacaagatcatttggcaaaaaaactattattgattttctgggaaatagttccaaaaacaaatccagaaggtaaactactacaagagatgattttggtatgtgatgcctatagaaaagatctgcaacacccaaatgaatttttgagaggttctacacttcgcttcttgtgcaaactgaaggaaccagaattgttggaaccattaatgcccagtattagagcttgtttggatcataggcacagctatgtgaggaggaatgctgtactggcaatttttaccatttacaaaaattttgaagccctcattccagatgctcctgaactgatctccaattatttggatggtgagcaagacatgtcttgtaaaagaaatgcgtttttaatgcttcttcatgctgaccaagaaagggcgttgtcgtatttggcatcatgtttagatcaagtaaattcatttggagatattctacaactggtcatcgttgagttgatatataaggtgtgtcattccaatcctgcggaaagatctagatttattagatgtatatataacttgttgaactcaagcagtcctgctgtcaggtacgaagctgcaggaactttagtcaccctctccagtgccccgactgccgttaaagctgctgctagctgttacattgagttaattatcaaagaaagtgacaacaatgtaaaactcatcgttttggacaggctgatagcacttaaggagcttcctaatcacgaaagaattctgcaggatttagttatggacatactgagagtactctctgctcctgacttagaagtccgcaagaagactttaagtctagcccttgaattagtctcttcacggaacatagaagaaatggtattagtattaacaaaggaagtgagtaaaacggtagacagtgaacatgaggatacaggaaagtacaggcaattgttagtaaggactctacattcgtgttccattaagttcccagatatcgcacgtagtgttataccagtcttgattgaatttttatccgataataatgaactggctgccacagatgtattgctgttcttaagggagccatacagaagtttaaagaattgcaaccgttaaattattgagaaactcatcgaaactttcaaagacattaaattggtcaaagtccatagagcagcaattttggattttgg

SEQ ID NO: 368 - DNA, 1130 bp, Diabrotica virgifera
ctagttctagatcgcgagcggccgcccttttctttttttttttattcgtactcatataccaagatgatagcaaaaacgttgtgttttcttttagtgcttttctatggtcaccaagttaatagtagaactactcaaggtgatgtcgttgagtggcaggattataatcccgattctatccctgacgatgcaatcccgtctggtggcacattagatgggcaggatatttatattggattagtgcactttaataataaagaatttgaaggttttatacctacaaatattatcggtggacaaaaatgtgtgcatattcctgtaggtttggaagagattgaaacagtctgtgatgacattaagatcctagttggaaaaaatgattacataaacaaactgtactgggagattgccagaccttatttttttgaatcatactttgactcagatgattttcgtcctgtccgagctggatgggaatctcatactactagttacaattcttcgctgtatattggaaaacagtacttttctggcgtgaattggataggaaaaatatataatagctatcctaagacagatgaaaatggtgccgctgtttatgttttcgaaaattatttcgatccagaggaactcaaaatttataaaggagtttattacggacttctattatttagatactaaaaatctttattatattatttgtgatattcagtcttttgtaacaattaaataacaaaaccatatattaaaaaaaaaaaaaaaaaaaaaaaaaaaaaaaaaaaaaaaaaaaaaaaaaaaaaaaaaaaaaaaaaaaaaaaaaaaaaaaaaaaaaattaaaaaaaaaaaaagggggggcccctttaaaagaaccaagttttacgaccgggggttgggaacgcaaaattttttttaaagggcccccaaatttaatttcccgggccgccttttaaaaacgcggggaggggaaaaccccgggggtaccccaattaatccccttggaacaactcccccttttccccagtgggggaaaaacaaaaaaggccccccccaacccccctccccaaaagtggcccacctggaaggggaaagggaccccccctggaaggggggattaaagcggggggggggggggg

SEQ ID NO: 369 - DNA, 796 bp, Diabrotica virgifera
tttttttttaaataattatttcgattttattatattctatctttacaaatttagacaagaaatctatattagttaattatttgattcgaaaaaatcgaaaaaaattattctggtggtggtcttatcatataccaagatgatagcaaaaacgttgtgttttcttttagtgcttttctatggtcaccaagttaatagtagaactactcaaggtgatgtcgttgagtggcaggattataatcccgattctatccctgacgatgcaatcccgtctggaggcacattagatgggcaggatatttatattggattagtgcactttaataataaagaatttggaaggtttatacctactaatattatctgacggacaaaaatgtgtgcatattcctggagggttggaagagatagaacagtctcagatggcattaacatcctagttgggaaaaatgattgcatatacctacatgtactgagagattggcacacctcaattttttggatattactttgactaagtatactgtcgtcctggtcggctgtgatgggaatctcatactatacagtaccattctttccttgcaatggaactacagttcttatatgagatgacagggataggaaaatatattatagctatcctaagacagatgaaatggtggcgctggttattggtttcgaaattatttcgatccagaagaaaactcaaattataaagggagttattacggacttctatttattagatactaaaaatctttattatattatttgtgatattcagtcttttgtaacaatt

SEQ ID NO: 370 - DNA, 1017 bp, Diabrotica virgifera
  misc_feature (895)..(895): n is a, c, g, or t
  misc_feature (981)..(981): n is a, c, g, or t
  misc_feature (983)..(983): n is a, c, g, or t
ttcagattggaaaaaattgccgaagccaaccacaagcgagttcttttggaagcagaagccgaagctgaatctacaagattaagaggggaagctgaagctttcgctattcaagctaaagccgcggccgaagccgaacagatggccaagaaggccgaagcttggaaagagtacaaggaggcagctatgattgatatgtacctggacgtattaccgaaggtcgctgctgaagttgctgctcctttgtctcaggccaagaagattaccatggtatctacaggaacaggtgaagttggtgctgctaagcttacaggagaaattcttgatattgttaacaaagtaccgatgcttgttaagagtatgactggtgtggacatttccaagtcggtccatgccgcttaaacatcacaggaaggacaatattaactgaatcaacttcttcaacctttggaagttcttgttaatccagctaaatccaatattataatccattataccttttaaaatattataccgattttacggctattcgaatgttataattatgaatgttattttatttttatgttttattatttgtgaaaaattggcttttataggaaacagaacttaaatattttagcagttagtttgtgtttagtaaatgttaataaaaatactaggttttctgtttaattgtaagtgtagggaaaatatacaagtgataggtttgtaatttccttttggagacagctcttatacatcttgattgtttatgcattcttagtattccatttacgatgattatataggactattcatcgccgccatttttctcgtacacttgacatatgacgtacgatatgtacgtcatacgtcattggtatataccaagacgtgtgacgtatatatatcgtgngtcatatgtcaattgtacaggaaaaatggcagtgatggcggtattatcaatgtattgctagaaatataataatacatatttaattngngaattttatgacagaagcatttacgtatgacgta

SEQ ID NO: 371 - DNA, 1679 bp, Diabrotica virgifera
cttgttttttgggtgtttatatgggtgtatgtctgtgtgttttgtagtgttttagtgttcatttgtttgttaattaattttcacatagaatgacgtggggatttgttacctgtggtcccaacgaggcactggtaatctcaggatgttgttacagcaagccactcttagtgcccggaggtcgagcttttgtttggccctccatacaaaaaatacaaaggatatcgttgaatacgatgactcttattgtagacagccccactgtgtacacaagtcaaggtgttcccatatcagtaacgggaattgcacaggtaaaaatccaaggtcaaaacgaagaaatgctcttagccgcttgcgaacaatttttgggtaaaaaacaagatgaaatccagctcatagcactccacaccctggaaggccaccagcgtgccattatgggttccatgacggtggaagaaatctacaaagaccgcaagaagttcagcaaacaagtcttcgaggtggcgtcatccgatctcgtcaacatgggaatcacagttgtctcatacacgcttaaggacattcgagatgaagaggaccccgttgatggcaggggttaccttaaaagtttgggtatggcccgaacggcagaagtaaaacgagacgcaagaattggtgaagccgaagctagagcagaagcaacaatcaaagaagccatcgccgaagaacaaagaatggcctccgtcttcttaaacgacacagagattgctaaagcaaagagggacttcgaattgaagaaggctgcttatgatgtggaagtgcagacgaaaaacgccgaggctgaaatggcttacgagctgcaagctgccaagaccaagcagaggatcaaggaggaacagatgcagattcaagtggtagaaaggacacagcaaattgcagtacaagaacaggaaattgccagacgagaaagggaactcgaatccacgattcgcagaccagcagaagcagagaaattcagattggaaaaaattgccgaagccaaccacaagcgagttcttttggaagcagaagccgaagctgaatctacaagattaagaggggaagctgaagctttcgctattcaagctaaagccgcggccgaagccgaacagatggccaagaaggccgaagcttggaaagagtacaaggaggcagctatgattgatatgtacctggacgtattaccgaaggtcgctgctgaagttgctgctcctttgtctcaggccaagaagattaccatggtatctacaggaacaggtgaagttggtgctgctaagcttacaggagaaattcttgatattgttaacaaagtaccgatgcttgttaagagtatgactggtgtggacatttccaagtcggtccatgccgcttaaacatcacaggaaggacaatattaactgaatcaacttcttcaacctttggaagttcttgttaatccagctaaatccaatattataatccattataccttttaaatattataccgattttacggctattcgaatagtataattatgaatgttattttatttttattttttaagatgtttgaaaaattgaaaaatattggaatcagtaatagaatattttagcaattagtttatttttagacaatgtaactaaaggggtaaggttttaaaaaggtgtataaaaaaaaaaaaaca

SEQ ID NO: 372 - DNA, 986 bp, Diabrotica virgifera
agttcatatctgttgattaaaaaatttagaaggaaagtccaaaaatgaaggtttatgttttaatattatttttggttacattggttgcgttcggggtacaaggattgataggaggcaccctaatttatccacacagtttgccttatatggttttcctaaacgtttctggatcaacaaatacaactagatgttcgggagcccttatttccaaagattatatcttaacagcagctagatgtcttaaaaattcaaccgctgtacgggtagtacttggtgcagatgatataagtgtaaacgaagaaatgcaagtttcttttgatactacccaatctaattttataatacatgaaaattttgtcgacgaaaccctagaaaatgatattggattaataaagctaccaagttcagttgaaagtaatgagtatatacaagtaattccgatggctactgaggatcaagaagaggcacaattaggtgaactagttgtcgtatccggttggggtctcacatactatggttacccagaatctatggcaactgtaccaatggccgaatggttagtggtattaaacaatacaaacaaagaatgtcaacgctttggaaccttagttaaagatacgaacatctgctgcagtacgaccaactcttgggatggcccattgcaattgtgtgatggagattggggtgatccattggtaaatgatggcaaaaataaaacactgtatggtattgccagttttacagcatatgaaagttgtgtaatgggaaaacctaatgtatttacaaatgtggccaaatacagtgaaatggataagttctaatgcaaatatatgaaaatattattttatataatctgattttgatttttggtaaaaataattaattttatttaaataaagtcttactctgtgtttaaaaaataaaaaaaaatcaaaaaaattcaaaaaaaagaggggggcgcacccatagggggggccatttttttt

SEQ ID NO: 373 - DNA, 419 bp, Diabrotica virgifera
  misc_feature (335)..(335): n is a, c, g, or t
  misc_feature (396)..(396): n is a, c, g, or t
tacaagcccctaaattgagtcgtattaacaagctttggtcgagaatccaaacgttgataaaatcgccttcactggatcaacggaggttggaaagctgattcaggccaatgctggaaaaaacaacttgaagagaacaactctagaattggggggcaaaagccccaatatcattttagccgatgccgacctcgaacacgctgtcgaacattctcaccaaggagtcttctacaatcagggccaggtttgctgtgctggaaccagatgtttcatcgatgacaaaatttatgacgaatttgtcgagagatccgttgaaagggccaagaaacgtgttgtangggatccattcgacttaaaaactgagcaaggaccccaagttgacgagacacaatttaacanaattttgggattaattaaagaaa

SEQ ID NO: 374 - DNA, 1447 bp, Diabrotica virgifera
  misc_feature (1191)..(1191): n is a, c, g, or t
  misc_feature (1196)..(1196): n is a, c, g, or t
  misc_feature (1230)..(1230): n is a, c, g, or t
  misc_feature (1275)..(1275): n is a, c, g, or t
atcttaatagtcgttattgcgtttcttagggaaaaaacttgccagtgaatagtttctaagtcaagaaaaccgttgaaaattaggaaaaatgagggaaaagaaaatttcacaggttagccagatgtctaggagcttgagtaaacaggaggagctactcaatgttcaaacgcagtattttcttaagttagacgaaataaaattgacgaaaaaagaaagatttaaaaaggcgatatacgatcccaaaacgaagaaggtgtttggaagaacgagtattagttgggccaaaattggtctcttttacttaatcttctatggaatgttagcagctttggtagcagtatgcatgtgggtatttttccagactcttgatcctagaataccgaagtggcagctagatgaatcactaataggcaccaatccgggtttgggtttccgtcctatgcctgagaaaaacgaagaaagtacgttaatatggttccagggctccaacaagacgagctattcttactgggtcgagaacattttaaaatttttggataagtactacgttcccagcaaaatagctaaaggaaatggccaaattaaaacatgctctcatcacgactatcctactagtggagaagtatgcgaagtcgatgtcagagattgggaagaatgcaacagggatcaattctttaattatcacaagaattctccatgtatttttattaaattgaacaaaatatataactgggagccaatgtattacgatgatccatacgatttacctgaggaaatgccggataatctgaagcaacatataaggggtatcaacaatactagagagttgagaaacgtttgggtctcatgtcaaggagaaaatcctgctgatgtagaatacttgggccccattacatactatccccgaagcgtacagggcttccctggttactattttccgtacttgaactctgaaggttacctaagtcctttagtagcagttaaatttgaaagaccagtggctggtatcgttattaacgtagagtgcagagcctgggcaaggaacatactttacaacagagccgatagaacgggctctgtgcatttcgagctgctaattgattaaatattattttacccaattggacaatagaagaatccttcaggactttttaattcaaatattatatagtaatagaaatgttgccttanaatanggggcttttataaaatagccgatcgatcacatanagtaagctataagaagtacattccaatatgaaccacccataccanatatttttatacattttataaatttatataacttttttaatcttactgaaatatccttttggcatccattgttgcaatttttgtttctagattaaaatatattgggttccatattatttttaaagggatgaataatttttggaaaagaaaaaaatttttgttttggtggggg

SEQ ID NO: 375 - DNA, 1761 bp, Diabrotica virgifera
gaaatggtgagctctaggacggtcggtttttgtttgagtgttttggtatgttctgtggtatgcaatgattacccactggttaggattagtgatgggctactacagggagcctttttaaaaactcgaaataatagaaaatttagtggatttaatggaataccatttgctaaacctccggtgggccaactaagatttcagccaccagttccaaatgatccttgggagggacaactgaacgccactggtgttcatgccgaatgtcctcaaagagatgtgtatagaagatctcccaaaatatcaggagaagaagactgcctgtacttgaatgtgtatacgccaaagttgtcaaattttgaaaatgatctactacccgtaatgatatggtttcatggtggtggattactatgcggtggtggcaattcggattggtacggacctgatattttgttagacagggacattgttctcgtagtaacaaattatagattgggtccattgggattcttggcaactggagatgcagttgtacctggcaataacggtcttcgagatcaatcattggccttacgatggattcagaaaaatattaggaaattcggaggtgatccaaatctagttaccttatttggtgaatctgctggaggatccagctctaattttcatatgatttcacctttaagtagaggtctttttacaaaagctattcttcagagtggtacaacattatccccatggacctttagtgagaaccaagaaacagaaaaaaattcaagaaagctggctaaagccttaaactgcccaactgattccagtcaagaaatggttgaatgtttaagaaaagtagaggccagaacatttgttgaactggatgatattttcaaggtatgggactacgatcctatgattccattcaaaccagttgtagaaccaagtgaagttgaagacccatttatgcctgatcacccattaaatattatcaagtctggaaaaagtatggatgttccaattattgtcggaatcacaagtcaagatggtgctcttaaaaatgcaggttacaaaaacgccaatttgctcgacgaatttgccgaccggttcgacgaacttgttccaatttctctattttatgataggacggaaaaagatcctcaaagagtgactcgccgtctgaaaaaattctattttggaaataaaagagttcaagacaatatccaaggcataactgatatgtatactgatggctggttcttcaaagcttccgatgatgtggcaagacttcacacaaagttctacaaacagcctgtctacttttatgtatttggatataacggaagtgtaagcttttctaaagtttttggtggaggtgacgagcatttcggtacggttcatgctgacgatttacagtaccttttccccgttggtgatggacttttcccagatgttaaaccgtcagaaagtgataaaagaatagccaaggtttttacaacactctggaccaacttcgctaaaactggaaatcccactccagaaaccaccactttacttccaaataaatgggaaaaatatactttagaaaacgaagagtactatattatcgataatgataacttggaaacaagaacaggagttttaagaaacagggctttgttttggagagaactcattaatgatcctctcaaggagggtaaaagagaagaattgtaaataggataattaataattattgtaaataaaaatttctttttataaaaaaaaaaaaaaaga

SEQ ID NO: 376 - DNA, 1259 bp, Diabrotica virgifera
gtacaatacctgcaaaaactagaaaaggaggttcaagaacgttggaaaaatgaaaagatcttcgaaattgatgcaccagaaacgccaagaaaatctgaggatgaaaagttcttttgcaattttccatacccttacatgaatggaaggctacatcttgggcatacgtttagtttatcgaaatgtgaatttgctgtacgatacaaccgtctaaaagggaaaaaggtccaattcccctttggttttcactgtacgggaatgccaattaaggcatgtgctgacaaactgaagagagagatggaattgtatggaaatccacccaaatttccagaagtagaagaggaagttaaagaggaagaaaaggatggtattcctaaagataaaagtaaatcaaaaaagagcaaagctgtggctaaagctggtccagcaaaattcccgcgtccgataatgcaaagtattggtctcgatgataaggatattccaaaatttgctgatgcgctgtattggtgtgaatttttccctcctaaagctgtggaagatcttaataggtttggaatacatactgactggagaagaacattcatcacaacagatgcgaatcctttctatgattcttttgtacggtggcaattcatcaggttaaaagagcgtaataagattaagtttggtaaaagaaatactatcttttccgtaagagatggacagccttgtatggatcatgaccgtgcttcaggggaaggtgtgggaccacaggaatatactcttatcaagatgaaacttttggctccatatcctgcaaaattaagccctcttaaaaacaaaccagtatttttggtagcagcaacattgaggcccgaaaccatgtatggacagacaaactgttggttaagaccggatatgaaatatattggcttctcaaacgaaaaataatgaggtatttgtttgtacacaaagggctgcaagaaatatggctttccaagaatttaccaaagaacagggaaagtttgacatcgttgtggagttgacagggcaggatcttcttggttgtgccttaaccagcccgttatcagtctaccccaaaatatacgccctccctatgctgaccataaaagaggacaaaggaactggtgtcgtcaccagtgtaccttccgattctccggacgattacgcagctattgtagacctgaagaagaatcaacccttcagggaaaagtacggaatcacggatgatatggtactaactctttgagcctgttcctgtg

SEQ ID NO: 377 - DNA, 953 bp, Diabrotica virgifera
aaaattatgagaaactaaagtttggcatatttgaataacaaaaatggatcatatttttacaattagcaagaaacctagtagatcacttaatccatataaacaaaatattttcaataaattggaaaaatccattctttgctcagtttcaagcaccaatgttattgcttttagtacggaaagcaatattgaggaatgtaattcattatattggagttccaatgtatatgtagctgacctcaatagcccttggcaaattcataaggttttaagcaattcatcaccagtaacagtgctacaatgggattttacaggtgaacttttactaattgctgatgaaagtggatgtgtaaggatatactcagcaaaagatcatatattaaatgattggaatatagttctgcaaacagtactacaaggggaacatattttggcagctgctttttttcattctggtaaaaggatatgtctcaatattgagaaaaaagacagttcatcttacatagaaaaattccagcatgtaaaatttgcttgttctgtgaaacagtttggaagtaaaccagccatcggtgcccttttactcacaactactggaatgctagctgctgtattactaccacagccaacatgtcaaactccgatgactatggcaactgaaagtttgggcccaacaagaatgttcattaagactgccgatatctgttatggaaaaaatggtcatttcctactagctgttagcagtggagatccttcatgcccatttcatgtaccagggttcggtaaaaaaaaaaagagaaaagtgtactattgtaacgccatctttgcttaattccttcttcaacgagcaccaaaagaagctctaaatggatcaatatcgcaagaaaaaaattgtactctcagtcacataaagtggatcatgcgaaaaaaaatccaaaattttttttagggggggctcc

SEQ ID NO: 378 - DNA, 966 bp, Diabrotica virgifera
ttctacgcgtccgaaaacaactttttctttggtggaataatcagtccaatattaggaatgtcaacctcttaatcttaacttttctgcaataacataaatattaagaggtacgaagatgtgaataccatctcaaaatttcaaccagattcttgtgtatcttcaaaaccagattcgatgcaaaaatttgtgattgtgtacataaaaacatggtgccaacatgtttgaaatctttttgtgtgtttttggttgtagttagcctttccaatggacaatatggaggagacccttgtactactcccgctggaatacagggaaattgtcttcccgtaagatcatgtccatctatgatgacggctcttctcactgttcaaagacccttatctgatacagcaagagaacaacttgaggcttactattgcagtacagactttaaggtgtgttgtcctcgtgtaccaatcgtcataaaggaactggccaatcgaacggatcctgatacgtctgatcccggacaaatttcgtctgatgtagatatgactaagcatagaaactacggactgttgccgtcagactgtggttatttggatgtggcggttacaaaaatcataaacggacaggacgcaggacgtgattatccatggatgactttactgagttttagaggacctgataatagaggagcgttcgactgtgctggttcaattatcaacaatagatatatcctcacggcagcccactgcttagtagatagatcgagattgttgggtgtaagagtgggtgaatacaacattaccaataaaggtgtggactgttttgggaagggtgatgagatggactgcaactatcctactcaggacttagctattgaagacataatttcacatcccaactacgaacaaaaacaacagataaacgatattgctctgttaagggttacaccaatcacttttaacgacaaaaacataaaaa

SEQ ID NO: 379 - DNA, 990 bp, Diabrotica virgifera
aaacgagcaaataggaagcttattgtcgaatttttacggaatataaataaatgctgctgcaaatgtcaaaatgtttagcaactatttaccgtggtatatttttactctttcgttattggaattaataatttaaactcatccaacactgcatgacagcagtcatggcttcatcagcaaaaatccgagatacttcgatgaagaattttcgcatttacacgaggaatttggtttaccaagaacttccaagttaagtgatgttccattgaagtttcacatgaaatttgaaccaacatttcttgattttaagaaaagaccctttggaataccccatatggaaaaagttactttatttaatatcgataagaacaaaagcatagatatgacatctatatccggaagtacagtgcatttccatagttctttcttcgcagataggaacataccaccaaagggaaacacctccttcaacgtggtattcctgggccgagaagaaggatatatagaaagcgacctgtacatacatacttcagagggatttctgaagtacaatgtacgtggtgccagtacatacagccattacaggatacgacccataggggtcaaactgccattgaattcaacgtttgcaccgttaatttttttgcacaatccccatttggaacctctccaaattgtagaagtacatggcgaaggagggggatttcatctcgaattaccaaatggggaatcagagggggctaaagatctgtggaagttagatccccacgaaactaaagccatcattcgggtgtttatacaacccggagatcttacagaattataccgcatacgttaggatacgtttaaataaaccagacctaacactagtggtgccggtagaggtggaggtaaccgaagacacggagatatccatccgagcggctatgtcgacttaggtttgggcgggcatttggatcacccgacagaaataaacctatggctgcataatcc

SEQ ID NO: 380 - DNA, 1108 bp, Diabrotica virgifera
  misc_feature (1004)..(1004): n is a, c, g, or t
cgtcttttgaatcacagcgacccagaagttcaagcagatacctgttgggctctaagctacctaacagatggcccaaatgaaaagatccaagctgttctagacactggactcatcgagaggttggttcagttactgtacagtgaacacggtacagtcctgacacctgccttgagagcagtaggtaatatagtgacaggaaacgatcagcaaacagactgtgtgatcaacgctggagccttaaatgtattggcagaccttctgcaacacagcaaactgaatattgtcaaagaagctgcttggacagtgtccaatatcactgcaggtaacagtgaacagatccagaaagttatcgatgctggtatactcccaccattactccatgtccttcaaactggcgactttaagagtcagaaagaagcttcttgggctgtgaccaatttcactagtggaggtacaatctcgcaacttgccaaattagtagaggctggtgccttgaaaccaatgtgtaaccttatcaattccaaagatcagaagactgtccttgttgttttagatggacttaacaacatactcaatgcagctaataagatgggtcaagtggagaaagttgctattatgattgaggaatgtggtggcctagatggaattgaagccttacaatctcatgacaatgaaaagatatatgagaaagctcttagcatcatcgagaactacttctcagagggcggtactgaagataataatatgcctgccccagttacggcagatggccaaatgcagttctcttcccccacacaagtgcctaatggaggattctcattctaaaaccaaatttcattaagtatacaacgttttttactccagtttatccgatctcgccattccataatattaaggatagaaatagaaaaagattgctgattaattgttaaattagaatgattagaatcgagacccggaaggagaatgtaacaatgtcatcggtagcattttgtaaagatganatactccatgattttatttctgtatcataaattttgattttttaaaatgtcttctttctgtagcgttgaaataatcagaagggcgaataatttatttttaatat

SEQ ID NO: 381 - DNA, 428 bp, Diabrotica virgifera
acgaccacgcgtccggttttgtgtatcaaatatacaacaacgtgaaaattatattttatattgatgaccatgaaagttttactattgttagcaatttttgtaccatttgtggtaggccacgatgtgaagattacagaactactctctcaagaaatcttgagagatgttgatgttgaattattactaaaggaaatggagacaatttatttatttgaaaaaaagagttctggaaatataacggcagtgttgaatgagttcatagacaaagttttgggaaatgctggaaattacctcatagatcatggatatgattcatgccatattccagacacagttttacatcttccaataacagggaccgtctcgttaaagaaaggatgggtacgaagattgggccatgattaatagatacaaagatactgatgtag

SEQ ID NO: 382 - DNA, 1428 bp, Diabrotica virgifera
aaaaaaaaattttgttttttttttttttcccttttttttttttttttttttttggcagccccagaggggtataaaattttttttttctttttttgggcccattttcaatggttttgaattaggttttttatttgttcaaaaataaattcaaacgaagtaaccctgtttttaattgagcccgaaacctcggggagaagattctttccaatcttgaatattttggtttatttgagcctttttgatttgccaacatgtcccgtttctgttttcacccactggcagtttttgttaagtctcgatatagtcctttcggatgccttctatagtttttacaaaagcatacactttctttttcctctgcattcactttcatcatatctttgccaacttcttcactgtacaattttaacatcttctctttagaagaagcatggaccttaaacgcacctagcaaaaacgggaggttatctttttattaattcttgttttagtaattttataagcccattattaaaatttaaaacaaaatatttattgggaataagccagaattttactataataatgttgacatttcaatttccacttcggaagtcgttctcaaaatgaaaaacataataaattgaacaaattttgtaaaaaaactttttatttgtttaatttattaatttaggtactatttcagttgggaataagccaccattttactttgaaattgtttcttttgaaaaaataatattgtggcttattcccaactaaaatagtaaattactttcgaaatcgaaaagtaataaattaagcctaataataaaaatagtataaattatataaatttatattctcattttactttacatcagcacataaattaaaataattcatgaggattcatataattgtatgctattctatcgtacgtaatacctaattctaaataataagttattactcattatccacctattaataattatatgttaaataaaatgtaattagttgtttatataatatttataataattacagccgtccataacaaattgtatgagttttagtaagtactaatgggaaatgtaactttctagatttgtatttgataataatattttaaaattagaaaaaatgttttattcataatgaacttctaaaattcatgaaaaacttagttcgtaaattgccgctactagaaagtttaaaagcgccccctttaggagaattcttaaactacatagttcacggtatttggcgccagtgtcagtgtagacacttttagcgccctctttaggagaaacgctgaactacgtagttcacggttttgccgcagtggcgctagtatcgactttttagcgccctctttcggagaaacgctgaactacgtagttcacggttttgccgcagtggcgctagtgtcgactttttaagcgcctc

SEQ ID NO: 383 - DNA, 993 bp, Diabrotica virgifera
ggaatttctgtgaatacagttgtttatcccgagggatataacccaataaaggaagaagaagaagaagaagaagaatacagttgttttcttgtttatgtaatcttcaagtaatacatttcttctgtaaaaaaaatttgaagtaaaaatgttgaaacaacaggtattcacaagatgtcttgtacctaccgttctggcagccgtagccacagataccaaagagaaagctgtatccgacaataaaattgatccaaaactgtgtaggccaagtgaactaccattgtacacacctgatcctatccataatgttaaacaaattgatgatagtgaaagcaatcaacttgaagaagtaataagggctaccaggctgaaattagttgagattaacaaagaagtcgaagcttataagagggtaggagttgaacagtttgagaaaggaaaagatgaattagactgggttgtaaattacctaagacaagaagataacactctgccaaaagtaggtgccataggaattggtggtctaaccggtcttatatttggtctcaggggtggttttatcaagaaaactgtttatgctgctgtaggtgctctaggtatatcagctgtatgttatcccaaagaagcatccgagtattcccaagtggcactaaccgaaggcaaaaaatatgcagtagtagcatataatttcgttcatggagtgaaaaaagatgatccaccattagaacttccttctctgcctaaactgccaactagcttagatgaggcttgggaatccgtgaaatcattcgtttcatctgattcatctgaaaagacaccagaaaaaagtaaagatcaacaataaaaggtagccatcttgacgtaatgtggtgatttatcatacatcagccactgaagtaatgcaactgtacatattttaaaagtaaattataccgatattgttttgtttttgtattataaaaatgcttattcgatgtcataaaaattatatatact

SEQ ID NO: 384 - DNA, 778 bp, Diabrotica virgifera
aacattaaccagtcccccgcgtccgcgggcatttttcaaagtattaacttattacgatgcagaaggcactaatttctttgactgtactatgtttggtacagttatcttatgccgcattaccccatagacaattcgatgaaccattgaagaccgactttcaaatgtggcacgacaactgtgaaatttacattcccggtgtaacccaagaagaaatcaatagagttagacaaggacactttgatacaaacaaccaagctattaagaattatggtgcgtgtgtctggttggaatctaaagtcattaacctggatatggttatgaacaaggcactgttggacatttacatgcctaggaaaattatggaagacgaatacatcggttatttgctgtgtgctaaagaaaatagagagagaaaggtaccctttgctgataagatctggggattgctccagtgcaattacaaaagaaatcctaacgactttatcttcctctaataccacaaatgaaaaaatagaagtaacacttcgtgttcttcgaaacactagaaaaaaaagataatattatttaatattataaaggtaatattttttaataatatatttataacagtaacatattttaaatatacgtttaaaaatctgtaaaaaaaaaaaaaaaaaaaattaaaaaaaaaaaaaaaaaaaaaaaaaaaaaaaaaaaaaaaaaggaaaaaaaataaaaaaaaaaaaaaaaaaaaaaaaaaaaaaaaaaaaaaaagggaaaaaaaaaaaatgggggg

SEQ ID NO: 385 - DNA, 1009 bp, Diabrotica virgifera
  misc_feature (976)..(976): n is a, c, g, or t
cgccaattactcccgtcgaccccccacacgttaagtgtcattggggtgtggtggatttgccgtgtgtacaaaagtttcaactaaaaataaaaacatttaaaaatgtctgcaactctgaaaccgtatttaacagcagttcgtcacacattaacagcagcaatgtgtttagataatttttcctctcaagtggtagaacggcacaataaaccagaagtagaggttacaacttccaaagaattactactcaacccagtcgtgatatctagaaacgagaaagaaaaagtatttatagaagcatcagtaaattcaattagaattagtatagcagtgaaacaagcagatgagattgaaaaaattctctgtaagaaatttatgcgatttatgatgatgagagccgaaaacttcattgtacttcgaagaaaaccaattgaaggatacgatataagctttctcattaccaattttcacacagaacagatgtacaaacataagttagtcgattttgtcatacattttatggaggaaattgataaagaaatatctgaaatgaagttagctgtcaatgctagggctagaattgtttctgaagaatttttaaaacgtttttaaaaagtaatgtatgcagtgctaatataggtgctaggaacattgatactatatcaagacaatgtcatttgagtaacaagtatgaagaagtactgataaaataattgtaaaagatagagctcattgtaaaaatgttagttaaatcttttgatatccaaagtcttaagactacaattgaatcgtttattgttgaaaggaggtaagtgccatttttactttttgagttttagtaaaaaaaaccatcctctctttctatatccacctcaaagcaaacataggcattgtatggatatagtttatattctgtgaaactacatttaacaccagaagatgcggatatagagagaagatatttttactataactcganaagtggaaagtggagcttgcccccttttcacat

SEQ ID NO: 386 - DNA, 1062 bp, Diabrotica virgifera
ggagtatagttgaaagcatattactttctcaaaaaagttatggagtacacaatatgtcatgacaatgatatatacagtttttagatttaaattaatagtggtatggaaaattcgaaatctgttagctaaaataccaaaggcattttctacaactcgccttgtccttgacaggcggtaattgaatattttgcgttcatttgttaattctctttgattaaacggttttaagaaatgtggcgctaaggcaaaagcttcaacaccaataaacacatcactaagcattttatctgaaccactgagatgatcaaagactggaatttgtaatgtattttcttttaatttgttgtaaaatattgtttgctctataacacctccatcacaaattctcccattcacaccaaattcgtatattatgaactcataattagcatttacaactgccatcaaaaccatactgtgaaatcctttatagttataaaaataggaaccttgcccatttggtggaatactctgcacatatttgccgtcaacggcaccgaagcaatggggaaagttcaatcttgcttcaaattcctttgctatatgtttccattattcttgtggctttggaatctaacaaaaatatttttttaggatttctccgacacagtttccagtacagaactgccacaggaatctccagtggagttgcaaccgctctcacggacgtccacaaatcaagttacaaaactgttacatgactctctattggagttgcaaccgcaattggataaaagtgaaattcgaataatgccagaaatactataaccgtccaaagtgatagtgtgaaattaaaatcaaatgattacgtataaatcatatttataataattataaatagtagctgtattttttaaataaacagatttgataagttaaaaaaaaaaagaaaaagaaaaaaaaaaaaaaaaaaaaaaaataaaaaaaaagtaaagggaggcagctctaaaggctacaatctataagggagcgtgcatgaaaagtgatcaaccttcaataaatgtgaatgaattcaaatcactg

SEQ ID NO: 387 - DNA, 1587 bp, Diabrotica virgifera
cgccaatccgccatcgccatcatcatacataccacagcgaagcgtttcctgaacctcgatgtgcgaggtttgtgtttaatttatcctttggcgctgtagaagtttattacacgcatgcattaagaaaagtacctccaattaagattaagaatttaagcaagttttaagaatttagggccagttttgtcaagtttagaaacaagatttgggcaagaggttcgtaagagggaagaatagaagaaagcaactaatacagtttgtagcattttagaaaaaaaaattagaagataacttgaaaacggagactaaactttaatggcgtcatcgtcattcgagcgataattcaggaggttgtctccgaaggttatggccgattattctcccaggcacgaggattcacctagggaatacaaaagcagaagtcacagtcgcgacagaaaagtttatagaaacggtgacaaaggcaaaagatcgagaagccgttctcattctgaaaagcgttacagatcttcaaagtactctcgcagcagatctcgttcagctgattacggacgtaggtcatcttctcacagcccaatgtcgagcaggaagcgtcataccggtaccagggacaaccccaaacagtccaggtgtttgggagtctttggattgagcgtttacaccactgaggatgaattataccatttgatgtccaaatacggtcccgtagaacgagttcaagttgttatcgatgctaaaactggacgttctagaggcttttcgtttgtctacttcgagaatgttgaagatgcaaaagtagcgaaggagcaatgcactggtatgaaacttaatggaaagagcattcgtgttgatttttccattactgaaagagcacatacacctactcctggaatttatatgggaaaaccaacatacaaatattccgatcgctacgataggcgtcgagacagaggggacagagatgattactaccgtagttctcgctacaggcgttctccatcgccttactatagtagtagtagccgaagaagacgttactctagatctagaagttattctcctcgtcgctattaaacattctatcttcttggatgcacttcgtttgatttcagttttttcctagattgtaatgtcttactttaccgtagatataaattatctagttttataccttaaggcactagtgcggattgggacaatggttttaccctaaatgtatattttttgacataatccatattggaaattagtaagaaatgtatgcgattaatttgaaaaagcccagtcttcacattattgtgaacagaaaaattactaactcaaatattttagccaatccgctacttcttttgtaaaacatgtgtttattttgaattaattttaagattttttttaaatatgtgacttacagttagtggtatccaataaatgttctaacaccaaaaaaaaaaaaaaaaaaaaataaaaatgaattaaaaaacttctaaacatctttttttttataatatggagaaaacaaagaaaaaaaataaaaaataaaaaaagaaaaaaaaaaaaataaaaggggggaaaaaaaaaggggggggg

SEQ ID NO: 388 - DNA, 1068 bp, Diabrotica virgifera
cggacgcgtgggcggatttcggcccgccaatccgccatcgccatcatcatacataccacagcgaagcgtttcctgaacctcgatgtgcgaggtttgtgtttaatttatcctttggcgctgtagaagtttattacacgcgtcatcgtcattcgagcgataattcaggaggttgtctccgaaggttatggccgattattctcccaggcacgaggattcacctagggaatacaaaagcagaagtcacagtcgcgacagaaaagtttatagaaacggtgacaaaggcaaaagatcgagaagccgttctcattctgaaaagcgttacagatcttcaaagtactctcgcagcagatctcgttcagctgattacggacgtaggtcatcttctcacagcccaatgtcgagcaggaagcgtcataccggtaccagggacaaccccaaacagtccaggtgtttgggagtctttggattgagcgtttacaccactgaggatgaattataccatttgatgtccaaatacggtcccgtagaacgagttcaagttgttatcgatgctaaaactggacgttctagaggcttttcgtttgtctacttcgagaatgttgaagatgcaaaagtagcgaaggagcaatgcactggtatgaaacttaatggaaagagcattcgtgttgatttttccattactgaaagagcacatacacctactcctggaatttatatgggaaaaccaacatacaaatattccgatcgctacgataggcgtcgagacagaggggacagagatgattactaccgtagttctcgctacaggcgttctccatcgccttactatagtagtagtagccgaagaagacgttactctagatctagaagttattctcctcgtcgctattaaacattctatcttcttggatgcacttcgtttgatttcagttttttcctaaaattggataggtcactttattacccgtataaaataactttattcttaggttttaaaccccttaagggcactaacggggggattggggaacaacggggtttttaccccacaattggattatttttttt

SEQ ID NO: 389 - DNA, 1182 bp, Diabrotica virgifera
ctgggggcgccggatacataccacagcgaagcgtttcctgaacctcgatgtgcgaggtttgtgtttaatttatcctttggcgctgtagaagtttattacacgcatgcattaagaaaagtacctccaattaagattaagaatttaagcaagttttaagaatttaggcgtcatcgtcattcgagcgataattcaggaggttgtctccgaaggttatggccgattattctcccaggcacgaggattcacctagggaatacaaaagcagaagtcacagtcgcgacagaaaagtttatagaaacggtgacaaaggcaaaagatcgagaagccgttctcattctgaaaagcgttacagatcttcaaagtactctcgcagcagatctcgttcagctgattacggacgtaggtcatcttctcacagcccaatgtcgagcaggaagcgtcataccggtaccagggacaaccccaaacagtccaggtgtttgggagtctttggattgagcgtttacaccactgaggatgaattataccatttgatgtccaaatacggtcccgtagaacgagttcaagttgttatcgatgctaaaactggacgttctagaggcttttcgtttgtctacttcgagaatgttgaagatgcaaaagtagcgaaggagcaatgcactggtatgaaacttaatggaaagagcattcgtgttgatttttccattactgaaagagcacatacacctactcctggaatttatatgggaaaaccaacatacaaatattccgatcgctacgataggcgtcgagactgaggggacagagatgattactaccgtagttctcgctacaggcgttctccatcgccttactatagtagtagtagccgaagatgacgttactctagatctagaagttattctcctcgccgctattaaacattctatctccttgaatgcacttcgtttgatttcagttttttcctagattggaagggcttaactttcccggaaaattaaattattcaggttttttcccttaaggccctaatggcggattgggaacattgggtttttcccctaatggaaattttttttttcccattatcctctatttggaaaaattaaagaaaaaaaatggttagggcggaattaatcttaaaaaaacacccccccctttttcccctttttatttttgggg

SEQ ID NO: 390 - DNA, 1526 bp, Diabrotica virgifera
gagatgttgtctattgttaatgcttgtttgaagtttcaccagtatatttttggtcgtgttgatgtgacaatcgagacggatcacaagcctcttgttggagtttttaacaaacctctagtggatgctccagctagacttcaaagaatgcttgtcatgttacaaccatatagttttactattgtttataagaaaggtaaggatatgttttttgctgatgccttaagtagggcttttccaaaatcatatgatgaaacatttgaaaataaattcagtgaaattgaatcacagcttctaagcattacagagagtttcccaatttcaaattgtaaaattagagagtttcaaaaacaaactgcagaagaccctcatttaatacaactcatgaaattaattacagaaggattccctgatagtaaatacataaatcaagaatttcaaaaatatttgccatttaaagatgaactaagtgtagttcaaggtataattgtaaaaaataataaattgcttgtacctaaacatctaagggaagaaaccctggataaattacatatgtcacaccaaggaatacagaaaacaaaattattagctaggcaatattttttttggccaggaatgtcaagagatatagaaaatgttgtgaaatgttgcaatatttgcctatcagagagaaaatgtaatcagagagaacctttactgcctcacaccattcctgacctcccttgggataaagtcggaattgatttatttgtttttaattcacaaaattatattttagtggttgactattattcaaaattcgtggaaatgtctgctttaacgtcacaaactagtaatagagtaatacagttcttaaaacaaattttttgcagacatggaatccctacagttgtgttttctgataacgggccttgcttttcttctatggagttcagtcgttttgctgcagaatgggggttttctcataaaacatctagtccccattttcctcaatccaatggtcaggtagaaagatttgtacaaactgcaaagtcaatgttaaaaaaggcattcaaatctaataaagatccttatttgtgtatattagatttaatgaatacaccaatatcagataaagttccaagtcctgctgaattgctatatagtcgcaaagttagaacaacttttcctgtattaaaatcaaatttgagaccacaagtggtaaaaaacaatgtacggaaggaattaacacaaaggcaaaatcaatataaaaagtactatgataaaaatactaaagaattgcctgtattaaaaattaatgatcaagttaaagtaaaaaattttaatgaatctaacaaagaaaaatggctagatggtatagtagttgaaaaactgtctaatccgagatcatataaaataagattatgtggaactaataatgttgtagtaagaaatagagctcacctaataaaagtagagttgaaaaatgtaaattcaggtgaagctccatgtagttacaatcagtttcaatatgataatgcaccttctgc

SEQ ID NO: 391 - DNA, 1257 bp, Diabrotica virgifera
gggaatcttacataataggtataattagtttggagaattttaaactggccgttatttagaaactggccgttatttaaaaactggctgttagtagaagtggccgattttaacaggtggccgttaacacaggttttactgtattataaatggcttaaaaaatctactgatggctactgattttttgaaagcaaaactactgacgacatcaaaactgacctggcaaccctgttctcgggttgtattgtaaattgtaaaacttctaggaattcgtttacatgaacccaacccaaaagtgcagttttataatagtttttatccatttttaggttgttttttatacatttttaataattaagctataatgcagacgatcaagtgtgtggtggttggagatggagccgttggtaaaacttgtttattaattagttatactacaaataaatttccttccgaatatgtcccaacagtcttcgacaactatgcagtgactgttatgataggaggggaaccctacaccttaggtttatttgatactgcaggtcaagaagattatgacagactacgccccttaagctacccacaaacagatgtcttcttagtatgtttttcagttgttagtccgtcctcttttgagaatgtcaaagaaaagtgggtacctgaaattacacaccattgtcagaaaacaccttttttattagttggtacacaagttgatcttcgtgacgatggagctaccatagagaaactagcaaaaaacaaacagaagcccatatcaattgaacaaggagaaaaactagccaaagaactgaaagcagtaaagtatgtcgagtgttccgccttaacccagaaaggactgaagaatgtttttgatgaagcgattcttgcagctctagaaccaccagaaccagtcaagcgcaaaaagtgtgtcatcttgtaaatctaattacacacctttaaaccccatcagaaagtatcaaaagtatttctaaggagggacaaaatagcccaaaacaaggacaattttttatctctttcctgaagttggcatcgagttgaaaattaatacttttggtatatgcggctgttggtaggactttcttgtattatttcttccaacatattggattttcttcctatttgatgtgtgtttgtgcacaataattaatttgaaaacaattttacagggtgtaccataattgttagatactttagttaattgataatagatggcatcatttgagattaaaatttgatttt

SEQ ID NO: 392 - DNA, 1339 bp, Diabrotica virgifera
  misc_feature (1289)..(1289): n is a, c, g, or t
cgaactacagtaaattatttatcctcagtttgtcgatcattaaaaagaatcataaatcaattagaagttagagtacttggagcagaccatgggtaacgagagctctctgcccatggagctatgctctaactttgacgccgacgaaattcgacgtctcggtaaaagattcagaaaattagatctggacaactcgggggccctcagcatcgacgagttcatgtctctgccggagctgcagcagaatccgctcgttcaacgtgtgattgacatcttcgatgccgatggtaacggagaagtcgatttcaaagaattcattcagggtgtgtctcaattcagcgtaaagggtgacaagctctccaagcttagatttgctttccggatctacgatatggataatgacggatacatctctaatggagaactatttcaggttctcaaaatgatggtcggaaacaatctgaaggacactcagctccagcagatcgtcgacaagaccatcctgttcgccgacaaagatgaagacggcaaaatttccttcgaggaattttgcaacgtggtcggcaacaccgatatccacaagaaaatggtcgttgacgtctaggcgtcaccaccaccctacttcaactcgacacctggtcttttagaaatacgcgatttacaaaaaaatcttagaacagcaagacatttttgtttcctgtcgctgaaacatcgccgtccaaatcgacaggagtctgtgagacgtctgtccgtttgggaggcggtgttttgtttgtagaggcggcttctctatatttactcctatgtatcgacttcacggcttttaaaatcaccacatagcaaatcaggtggtcgagtgggtagcgcagtttatagctttaagtccatttcactgtataaatctaaagagctcatatgcatgttttgtgctttcctgttactaaatattttataaaaaacaaaaagaaaaagatacgatatagttgttctttatactttaatcttaatgtcgtgtgtgtatagataaggaagaaaaatatacttaaatattattaatcaacctaacgctttaaactataatgcttgtaacttattgaacttttcacacaaactgaattttcttctgggttcgtaggtacagaaaagtactcgaccaagccgttcggttgaaagggtgcgatagaacgcttgctccaactactttttgattctagtcactgagttcaacagctcaatgggacggttccgagacttgttcgctcgagcgtgggtcggaaagcggaaacagatcnggcgtcatactagttttgcccgcgccgttttcccgtcttctcttccgaca

SEQ ID NO: 393 - DNA, 1451 bp, Diabrotica virgifera
gttgaagatatgatgagcccaaagcatttgactttgcttcgctacctgatttatatttgtttaacattcaatctcgtagctgcagaaagtcaggaacttcattataatagaaaatttccagatgattttttatttggcgcagctacttcagcgtaccaaattgaaggtgcttggaatgtagatggaaaaggagaaagtatttgggatacttacgttcacagagtaccctccccaattaaaaatggagatactggagatattgcatgtgatagttattacaaatacaaagaggatgtcaaacttgctgctgacctcggtataaaactatatagattttcgatatcttggccaagagtattgcctactggaaaagccgacaatatcagtgaagctggtctcaattattataaaaatctagttaaagaaattcgtaactacggcatgattccagtcgctactatctaccactgggaccttcctcagaagctctatgatgaaggtattcattggagtaatgttagtttggtaccatatattgtagactatgcaagaattgttataaaagcgttacctgacgtaggatattgggttaccatcaatgagccaaaacaagtctgccgtatcggatatggtgccactatgctagcgcctgctttaaacagcagtgggctcttggaatacgattgtgcctatgtgcttgttaaatcccatgctgctatttatcgtatgtataaaaaggagtttcccgattataaagcgaaaatgtccatagtcatagattgtcaatggatagagccacaaacaaatgcgcctaaggataaagatgccgctgaacgacaacttcaatttgaatgtggcttatatttcaatcccatcttcaataatggtgactggccaaaagtagtgaaagacagagtagattttagaagtttgaaagctaacttaactacatccagactccgagctttcactgaagaagaaaaaatatataataaaggaacatatgattttctgggattaaatcattattatactatgttagctagggacgaagcagaagaagcgccatttaatgaaaccaattatgaaaatgacgttggaactgttgactcattcgatcccaaatgggttgtagaatcaaatggattatttgtgatagttcctggtggtgtgtttaaaattttgaaatggattaaacagaattatggagatcaagatatcataataactgaaataggaatgagcgacaatggtacttatctcaatgacaaagatagaatagatttttacacagaatacttttgcaacatccttgaggctatggatgaagataaaagtaaaggaatcatattgtggagtttatggataatttcgaatggatagtggtacactgctcacttgggaatattcacgttgattttcaaaatccaacagaacccaaacccccctaa

SEQ ID NO: 394 - DNA, 922 bp, Diabrotica virgifera
cgaaaaagagatgtacaatatttacttttgaaatctgtttgaaaaacattgtaaatttgtattgtaatttgattaatttgatactttgataggttgcggttaagggttaaaaagtcaaaatgaaacatcaaaaatacaaagtttttacattgatcaagataaaatgtgataaaagtgacagtagagataattaaaacacattattcatatttcctcgtggtttcaaactgaaattcaatggaaggagagttttttagaataaataacttaaaaccaagaccaacaagcagcagcaatggtctatggatacaatttttacttccactttctgtaattgtttctgtcttcaagcactcaattacttcaacacctacttacaaattagcttcattaatatgtatgggcatgatatttgtctctttgataatatccatgcagaaatatagaaagcaaagactgaaagtatttagtttatggaccatattagctttagctgctacttctgcactgtttcatatatgtttacataaagatgtgccattttcagtatttggaggatttttctcaacagtggtatatttccaaatatacaaatttgtcttgaaacattttaaagaaagctttacgcttggggaagctggaattatctgccaaggccttactttaatgttatattttacaatactaaatgttgtcaatcataccacaagacctcttccatttaaaagtaatattcaagtagcaacattaataattcagctaggtcttgtaggaattctggctattgctttttgttcctattatttcaagataaaaaatattgttccattttatactatttcaagtattataattgtcggcggtattataatcccactgcatgttctactgcaaagaagtcctgtattatgaattttgaatc

SEQ ID NO: 395 - DNA, 1511 bp, Diabrotica virgifera
cattacgcgtgcgccctgccggtggatcgtaacaaacattcgtaatgaaaaatttagtttgacatcagtgttgtgccggcaatttttcaatcgatatgtttctcttattgttattttctgtgattgcgtatttcgtatacaagaagattaaacggctcatgggccatcctcctctacctaaaaaactagaagagacatggtggggtcctggggctcctggatctgtcaaaccggaagttaaaccttttactattagcgtatcagatgaggtactcaaagatcttcaataccgccttgaccaccaccgacctttcactcctcctctcgaaggaatcgtccacgaatatggcatcaacaccaatctagtcaagaccatagtcgactattggaggacgaaatataactggagagaaagggagaagtacttgaaccaatatccacagttcacagtcaatatccagggcttagacttgcactacattcacattaaacccaaagtttcgtctgatatcaaagtgctgcctcttttaattttacatgggtggccgggatccgtaagggagttctatgaattatttccgttgttaacaacaccacaaaagggaagaaactttgtttttgaagttatagctccacatattccaggttttggtttttccaaaccagcagtgagaccaggtctcagcccggacaacattgccttggtatttaagaacatgatgcatcatttaggattccaaaaattctatgtacaaggcggtgattttggatccatcattcttcgcaacatggtcgtactctatccggaagtgatcgaaggtttccattgcaatttcccggtggttacaagtgctcgccattatataaaactgttcttggccagtctgttcccatctttgtctagttggtatgttcgtccagaacacaggaataaagtgttaccaatgaagcagggtttcgaacgaacattaagggaaactggatatcttcacgaacaggccactaagcccgatacattaggtgttgctatgaatgagtctccaattggtttggcagcatatattttagaaaaatttgtgagcgccacaaaccatcaaaaagccttactggaagaaggtggcctttcggagagttatacctacgactccttattggacaacatcatgttctattggcttaatagtgctgccactacttcttttagattatacgcagaaacctttaacaaagcgactaatcgtaaagctatcctccagcaccctattgagatacccacagccgtcgcaagatacaaatacgacttctactcaccagatggtgctatcaacgatatttttgtaaattgtgttcactttgctgacatagatggtggacatttttctgcattcgagaaacctgaagtattcgctaacgacctctatgatggcatcgaaaaaatcttaaaattgaagaactaattttgcaagaatgtattttgttttgtttttttgtatataaagtatgttttgttg

SEQ ID NO: 396 - DNA, 2040 bp, Diabrotica virgifera
gtcttatccaaatatgttaacaccaccttcaagttctgaagattctccacattcaacttatttagtggcatcacctagttctaatacatttgaatatgacaattatgagtatgctcctgtacaacctattatctacccaaagcctactgtcattgtagatcctaatttactcacggtaaaaatggaaggtccaacaacaccctctgcaacactacactttgtagaacaaccaacagatcggtttagatttcgctataagtcagaaatggcgggaacccatggaagtcttactggtattaattccgacaaatcgaggaaaccaacatatcccacagtagaactaagaaattgtggcaatcacgacaaagttgttataagatgttcaatatatcaagcaaatgcaaaccctaaaggtttttatcctcatgctcacagattgatgatgaaaagagggcgtgaagagttcgacgatcctcatgatgtggaggttgggcatgaagatggctttagagccgtatttcaaggaatgggaattattcacaccgcaaagagaaatctggtaactgaattggtaagaaaaaaggttcaactgcaagaggaacatgttgccagaacggaaaacagaagaggattgacccagaaggaagtagtagagattaaggggttggctgagagcgaaagtaaatcaattaatctgaacatagtttgtctaaggtttgacgcttatattaaaaagaatggtatattatttcctctttgtgagcctattttttcacatagtatcaacaatttgaagagcgccttaacgggtgatcttaaaattgttaggctagatcatgtcgttagcccagcgaaaggaaataaagaagtcttcatattggttgaaagagtcacgaaaaaaaatattaaaatccgattctatgaacttgacgatgacgaaaacgttgtttgggaaggttggggccaatttaatgatttggatgtccatcaccaatacgcaatcgtatttaagacacccaaatatagagatgaaaacatcacttctccagtcaatgtcttcgttgaattggtacgaccgtcggaccaagctcgctcagaagcaagagaatttagatacgtaccaaataaaaatatggccaaacctgggcaaaagcgtgcccgatacgattattactcgtcttccagctacgatagttccaatgtaggaagcgaagaattaccagctgtaatcaatacgcttcaaattggacaggactctcacatgtcctttaataacattccaagcggtttaagtgacgagataaaaagagctctgactgatatgaactctgatgagttccaacaactacatgacgctcacgctgatgaatatcttacactactagagaatttggctactgatggagttaacgctaactctatgccggtaagaaaacaacgacgtgacatacaaattcaagaaccgatcaaaatggaagtttcgaacgaagacaagagaatggcgataatggtagtaagtgaattgagaagttttataaggactacacatacagcagcaaatgccataacgatattaaacaagtattttaatgcagataattgtaccaatgcgcttcacgtttgtgcagctcttcgagataatgattcggctatgctgttactgaaagtaatagcagtctatagagtgtttcatttattagataaaaccaacgaccaaaacttaacagccttacatatcgcagttatgtgtcataataaggatttgactaaggcattagtattatgcaattctaaactgtctgttacagatagtaatttaaacactgtcttacacatagcgataaaatccaatgttccaattgagattttcgaaactcttttaaggccctcgagatatacttccgtggatcaggtgaaaggctttattgacatggtaaacctagatggaaataccgcattgatgatggctgtcgaggcaaataaattagcttatgtccagcttttgtgcttcaaaatgcagatgaaaataaaaaacagccg

SEQ ID NO: 397 - DNA, 1612 bp, Diabrotica virgifera
cttgatgttcaagtatgctatccaaatgaatctcaaataaaatataatgaaattgatgtctttgtgtcaaaatacgacataaatgtagaaatggtaaaattcttttcgtttcttaatgtcgcaattcccttagtggtactgtggtattttatcaattataaaggaaaggcccaaaagaaaaaaatccatagagttgagattgaacctcttcaaattaaggaagaaagtttgccgaaacaggtgttatggaaaccctcaggaagatgtcaatcgttgtatacgatgaaactctcgccttcgaaagacacaagtcttttagatttagatgatatacaaaaaattcgatatatagaaaatcgggaaagtcaagaggacgaaaaagactataatactggtgggtatatgcctatcaatattggagatattcttaaaggacaatacaaagtttgtagaaaacttggatggggacatttttctacagtttggttgtgtcagaatttattaaatgatgggcctacttatgttgccctgaagatttgtaagagcgcgcaaatgttcaccgtagtggctcaagatgaaataaagttacttagagacacgaaactgatagaccccagtcaccttggctataagcatattgttcaaatggtagatacttttaagttattgagcatcaatggagtacacactgccatttccatggaaataatggggccctcactattacacttacttgtacagtctgactttagaggaattcatttatgtggagtcaaacgaattattactcaggttttaaaaggattaacttaccttcatgaagcatgtcgcataattcatactgatattaaaccagaaaatatattgataaaagttgatgaaaactacatcaaaagcataataggaaaaacagaaaagttcactgaactaggaattgatatgccacggtcttatgttgcagcagattgctggatagatagagaaagaagtttacgagactccgatgaaaatatcctgtctaaatttgaggaacagagaggacaatcgtacccttatgataaatttttaggagaattacctgattttagaagacggcatggagaaccacgcttaaatgcaccgatgtgggttagtcctaacatcgaaattaaaattgctgatttaggaaatgcttgttgggaggagcatcatttttcatctgagatacagactcgacagtatagagccttagaagtgatattaggagctggttacagttttccggctgacatttggtcagtaggttgcatgggatttgagatggctacaggagaaatgttatttagtccgaaaggcgaccgagaaccttctgcaaatctggaccatttgtgtctaatttgggagacgttaggtagtataccgcaatatataactgaaaaatggtacacacgcacgtcagtactttacaaatggtcaattgctgggtatcgataagaattattaagaatatggaagatagaagatgtttttagtagaaaaatataaatggaagagagtagatgctattcccctttgctgaatttttagaaagtctcattgaaccaaatccagcacttcggtatactgcatctat

SEQ ID NO: 398 - DNA, 1504 bp, Diabrotica virgifera
gttggtcgttaagtaagtttatccatccaacgtttacttcgcttaataggcctttatcgatattattaaatagaagtagttaatttacacttctcacgcgtaattcaaatcagaatggcaattgccaccaatgtggtttttaaatttccccaagagccatgcccctttaacctccataataatccgaagaaactatctttgtgttgggtgtggctattccatatgctcgagatgcatagcactagaactgtatccagaaccgattggattgtccgtcatagcagaagcaaaaagattaataaattttgagctcgaagctatccaccaggcgaaaaataatgacgaaaaaaaggggtgttggtgccaaaagatgagtatgtgcgagcggccgctcgcgatctagaactagtccgaaaattttcctatgatggcaaatataaaccggggtgttgaattatctagtgttataagtattgcttcttttacacctgacatgtcatccgaagaagttcagaaaaaaattgctcatatcatagacgaaaatatacgtctgaagatatctatcaaaagtcagcgtgaagaatctcttcacatgactataacttccctaaaatcacaaatggaagcttcagcagaagaagttaatacactccggacacagttaggtgagacccaaaatgctttaacttggatggaagcgacaaggagtcgtgcgtattcacaaattcgtgagttgacagatgaattatctgaagttagaagtcaattagagtcgttacaatcacaaactcaagaaagatccagagatagtgaattggatcacgaggagatgagtgttctaaaaatgcagatggatgtatataaaacagatttcgaggaagaaaggcgcgctagagaggttatgaaaggcgaaaaagatcgacttgaagaagacctccaaaacatacaacgacgtaaccaacagcttcaagaagaaatagagttgctcagaagagaagggaataactttgtaatcccaccacgtacttctcctccaagagtagaacagattcgtcaaccgtcagctccttctccatcaagaaacgaattattaaggtgtcccaagtgccattttgctttcaatgatcttgtccatctcgaaacgcacgtttaccgatgtttggatatggagcttttttaaattatttggatacagtatatggtatatatacagggtggcgccaaacctctgggttttcttttaattaggggttaaactatgaaacataacaaaaaaatggttttaaaaagaaagcaaaattaaaataaattattaaaaaaacagttttttacctaaccaacaaacattttttgttttaatttttttaaaatttttttttgtatttttttaaaaccggcattcccaaatttgggaccgggccaaaacgttaaaaaaaaaaactttttttttttatataaaaaaaaaaaaaaaaaaaagggggggggccgcctctttaaaagggaa

SEQ ID NO: 399 - DNA, 911 bp, Diabrotica virgifera
cgcgcggtggctgagaattgagaatgctgttgtaaatttctttgttaatcaaataaaactttgtttcaacatattgcaaaattcatctaaacgttcaacatgtcacaaactgaaggctcgacagaggcgagcgtaagtgcctcagaaccaatggaagaagcagagaactcggaattggctcaaaatgaagaatcttcttcagatactacctctaagggtgaagagttcgaggtcaaagtggcttctgacagaggaaaaagatttgactacttgttgaaacagactgaaatcttttcacattttatgaaccaaacaaaatctcccagtaaaccaaaaactgggaggcctaaaaaagagaagagtgatacatctgatttaagacatcgtaaaactgaacaagaagaagatgaagaacttttagcagaaaccaaccttaaaacaaagactacaactcgttttgatgcctcaccaccctacatcaaacatggggaaatgagagattatcaagtccgtggtttgaactggatgatttctttgtatgaacatggcatcaatggtattttagcagatgagatgggtttgggtaaaactttacaaaccatatctctgcttggatatatgaagcactataaaagtacacctggtcctcatattgtcattgttcctaaatctaccttatcaaactggatgaatgagttcgagaagtggtgtccaaccttgagagccgtttgtctcattggtgatcaagaggctaggagctcatttatcagagatacgatgatgcctggtgaatgggatgtttgtgtaacctcgtacgatatgtgtattaaagaaaaatctgtatttaaaaagtcaactggagatatatggtcattgacgaagctcatcgtataaaaatgaaaaatctaagc

SEQ ID NO: 400 - DNA, 1147 bp, Diabrotica virgifera
gatgtgaagcttgtatttctacgccttaaacagtgaagatggcagaggggcaggtttcaaacgcaaaccatgaagaactgataagaaaggtggatgatttggaaaaacgtctgcagaccaaagatgcagaaattcaagtctacaaaatgctcatgtctcaaatggaggaagaggcagcgacagcaaaaaaatacaaggcccttcacgaaaagcaaacccaagacgtggacggcttaaggacagaatctgagaaaacgttaacgaaggcgaagagtatgatctttgagaagacaaaaataattaaaaaccaagaattacagatagaagcgttcacccaacagatcgaatctcttagagaagtggtacgcatcacaaaagatcttctggaaataagaaatatggaagtaaagcaacttgaaatcaagatcgaatccatagaaggtaagcaaaaagctgagaaggaacggtacgacctaatgcataaaaaactggaaatgatgatcagacacaacgcagagttgaaaagagaatatgagactcagttgtgccttttcactgccttaagagaaagatatagcgagagagagttagctaaagatgtaattgagaacttaaagacaccaacactaaaaattgctagtcaaaatgaagacaacacgacacaaaaggaaatatcagtagtacctaaccaagaaaaaccaattgaaagtactgtagaagacaaacaaaagtcagctgctgagcagaatacaactacgactgtagaatctgccccaccaacaaatcagcctgagtctgacaaagtagtacccgttgaccaaaataaaaatgcaacacctactgaaattgtacctaaaatagaagattctattccagttccaaatgaagttgttcctgaacccagcaagctagaaaacaatgtgttgagccaaataagcagacagaaactaacaataatacaaattcgtctgaacagaagctcaagaaccagttattactgcacctgagacagtcgttaaacaagaaacagctgccggacaaagcaacaccatttctgaacagactgtagttaagactgaagcttctgttgcagctccagtagatcagacaaatcaagatgtggttgcacaacctgctaacggtgtac

SEQ ID NO: 401 - DNA, 904 bp, Diabrotica virgifera
cacaaaagtaatagttcaatagacccagcttaatgttaaaatctggtaataatatttcacactgcctaattgcttccgatgtacacttaatgttaacaccgacaactaaaactataacgaaaaacccttaaaattgatattttcttcagagaacttttccaaatatccgttttttaatttgacgtttatgtgacactcgaacttattgtttgtataataaattttatcaaaaatggtaaatacaaatattccattaacgtcaaatatgtcataatatgtgtaacatatgtttaacgtcaaattgtgttcgccaaaaatttcaggcgactacgctaggtgtcgcgtcagtcatgcacggagcgaataggaccagacagtccctacaggtaagacaatacaacataggggttaaaacttttctcgtttggaggtagctgccaagctaaacacatccagaaatgctacctgtacctacagaggatagtcagagcacccaggcacagcatagaaaacgcaacagcagtgacacactagaaggcgggaaaagttcgcgcactattactgcgcagatcgtcggccatttttcgcatagtgccagacagtgtagaaaatcgacagtgttgacgatttgtacagttactatcactgaatagtttacaccttaatttttatattgcaatactgtaaaattgcaatgtcgtacggatttgataaatgtcaaagttaaaaaatttcaaaaagtcaatttttgtcaaaaatctcgcgagcgttgaaaaataaaaccaaacgatatcaaactcccccacaatggttataacgcatttgaatgatgcgcaaaaagcaagagcaattgccaaaatcgaaaaaggtgagtaactaagggcagttcctgcagatctgaacg

SEQ ID NO: 402 - DNA, 2294 bp, Diabrotica virgifera
  misc_feature (1956)..(1956): n is a, c, g, or t
ctagttctagatcgcgagctgacgaacctttttataatattttcttaaaatgatatccccccaagcaatgtatcggtatatgttttagaatttcatacaaataagcacattgtatctggtgatcggataaggaaatgtttacgatgcgcctgaaattgggttcagatagaaataaagaatggacatcttgcttttgtttgcatgttcgaacagctacaatcctatttgggatatggcatttggtgcttcatattttggctctgacagtactggcactgatgatgcgcaatcatcatgtgattctccaaaagaacgaagacctacaaactgatttcttgcctacccctctaagcaaaaaagatgatgacaatccctactatttgcccacaactcaggatagccgcaaaatatacacatctgacatcgatatgggagccctaatgacggtttgtaccttatccattacccttcttatggtctacggaacaattaaaggaaaaccgacacatgtcctcccattcttctgcctacaacttttcgattttgccattacagctctaaccgcaactggatacttttgctacttgagatctgctcatcgcctaatcgcagaaaactggaaccttcctctgcgccaagaacttctccagttgagcccgcaagttttgacgctcatagtgttgctggccttcttattttcaatgttatggaaggcatactggatcagtgtagtttggagatgctacaagtacctaaccttccgccaacaaactaaccgaaacgccattcgatacatcattcctgaatccgaccaccgtggtatcaccgatccagattatccgaacctgttccgcgatcaagaggctgtctttggtgttttgaaacagactccgcctccctcatatcaagatgttatggatgaacaaccgccaccatatccttgcactacgcaagtcgtacaggagacgccaaacagatttaggattatacagaacactacggaaaatcaggaacctagcacctccgccgaagctgtcaatgtcacacccgtaatcgaaactagtgctgaagtatcacctgctgtagtaccagaatctcccgtatcccaacaacccgaagagcctgagttacaaccagaagtaggtaaagccgaagccgttgaaatcgtagttgaagctgatgagccaaagaaggagaccgagcaagacccaaaagttgagtcacccactaagaaagttgctgtcgtcccacaaaacgaaaactagatctatcatcttcaaaatttaattcactttttgggattttatatatcacccaatttgctccaatttttagctagttctcataaataaattaaaaaaatgttttaactttcaatcactttgcaatgtgatttttattttgggtatacatgttaaataagagtgctttaatgacagttgcatggtgtaaggccattgtcccatcaaagctacacgatgtcgtcacgtttcacgatgtatctttattgtttaacctatggtttatatacaccgtactcccaccaacgctcctgcaaaaagacattcaagttatgtgtcggtatcttgttgccgcgactcaacacactcgacagatcagtttaatagaaagattcaagctgtgtgtgcgttagtcaatcgtattcatatcatcgtcttcacttgatgaaattgttcactgaactaaatgtagtagagacacagcatagaaaacgcaacagcagtgacacactagaaggcgggagaaaagttcgcgcactattactgcgcagatcgtcggctatttttctcgtagtaccagacagtgtagataatcgatagtgttgccgatttgtacataattatcagatttacttaacttttatgacattctgataataaatattttttaacataattttatacgtatgcctgtgggaattatgtcaataattgngacatcacacaaaatattgacgatgaatggcgattgtaatcttttgcagaaattccagaaaatattcaaaaagaatctcttacgggtaataaagttagtacaacaactgatactgcagcagtgcagaaataaaaaaaaatcccgttttctgagatatcgttgtctgtcgacttttaaatgcgatctgtggccaaatattaaattagtgttagcaaaagtgaaggagtaaaagaatgttactcctttcaaacagacaaaaaatgttaaattattgtaatcacataaagtcttcattttcacaagatgaggacgaggaaattttattttgaagcgttcca

SEQ ID NO: 403 - DNA, 1104 bp, Diabrotica virgifera
  misc_feature (970)..(971): n is a, c, g, or t
  misc_feature (1044)..(1044): n is a, c, g, or t
  misc_feature (1052)..(1052): n is a, c, g, or t
accacgcgtccgcccacgcgtccgagaaaacaaagtttttgtagaactggaaaattcggttgcctttggtatatattttggttttgtacgaccaataactcggctacaaacataggcgatcattagcgggtcactccttcgattttcagatctggtcgtacaaaaatacattttttattaagtacaaaagtagtatcgatttttaatatttaagaaacatcatattcactccgtgcgtgaccatagcggggatacacgaaactatgtcagcgcccgtagcgccgaaatatgacaattttggcgaatttttgtaatgtcagtgtcattatgttcgttcgtggaccctgtcggtgacttttagtccacaacaatgcatgcttactttaattccatattatatttatttaatgtattatcgtttattgataaatataccttgtatatttatctatcaacaacggtattatttatattattttaaagtgcgcatgctccacttgtcgtggactagtctctgattctttccgcgaacacacttattgtttatataacaaattttgtcaaaaatggtaaataaatattacatataatatgtcgtatgtctatcatatatgtttaacgtcaaattgtggtcgccaaaaatgtcaggcgactacgctaggtgtcgcgtcagtcatgcacggagcaaataagaaatataatagaagaaacttctaaaaatcatgtattagacagtaaatgtcactaatcaaagagtttacaatttgtgtatatagatatgtttgaaacaaatcttttccagcatcatatattaaccaaaaagattatgatgttttcatatctaataacaaactacaaaatcagactattgcttgacttctggctattattgttatagcttgctacatgttggtggacatatggcattgcatattatgccactagcctttagctgtgtgaagcatgaatnntaaactaaacaaacatgacttaatgcagataaggtaatggacattctttttcctcagcttttccttttcaggngtcgacangtgggattacatatctgcagataaaaggaggtaaaaagagaacatataggta

SEQ ID NO: 404 - DNA, 919 bp, Diabrotica virgifera
attttcggtaatgacattgggaaattgtaacaaaatgtctgaaaattaatttagaaatggggtgaatactattaaaaagcaaattttattttagtgataacaaaatattgaaatataccaaacatctaataaaaaacattgcctactagaattttttagataatatcaaaaatataccaaaacagtagatatctactaaatgtggcaacgctgttaaggagaatgatgcacttcattgcactggtcacatgacctctgtcacccaataagagagtgcgttctaaagtggttgggatagtcggtccaggccgtgtttggtcggcgattggacttctcggttgtctcatccgtctatggttggtaataaggtatattttaagtaatattggtaatgttgtttaatgcaccattttagtttttttgggatgtaaagaaaataaaaacacaaaatataaaaaatgcaggcattttctaatacctttaaaagcaccatcaatacattaaatttatacaaaacatctttaacataaattctggcttttatattaaaattagattttttaaatttacatattttttgtcaaaaaggtgataaaaaatgagcgcgtgtattttttaaaggtgaaatatccatatttgacggtaatctgagatgcgtttataaatttcacatcaggtaattctgtttaagtccttatttatgtaattatataaatttaaatacctgatatgatgtcaaaatagtttactttttatataaaaaaccagactctttgacattggcaaagttaaccccaataattaaaaagggggtttttcccccttttaacccgggccccccccaaattccccctgggctcccccccccaacaagggggggttaaaaaaacttttttttgtggaaatattttaagggggt

SEQ ID NO: 405 - DNA, 1278 bp, Diabrotica virgifera
tgaataagcaaaagtagtcaaatgagcaaattatagtcaatatcgatctatcacatcgcctctaggcagatataaccagtttgaggcggttcgagaccggtactcaccggtaatcacatactaactcagaccagagaaacatcgttcgtcacaattaatttgaacagtataatagttagcattagtaatctagtaactcaacgtctccatcggacgaaagttttcgttagtagttgtcacctctggatatgttgagtacgtgaattattttcgcgatatacttctgaagaaaatgtggatatagcgaaatgataagccaaacttataaaagcgttccaaccattttcacatgcgttaaataatattagttattctatgtcatttaaaatttatttttacgttataataaaaatgtcgtatacatagtttcattttagtattgacttctgcaaataggaataataatgaatacttcatttcaagtatttctctacttaacaaaagtacctcgagtcttatgaaaatattcctaattgtttaaattaacctgtttttacaaaattttcagcactaaaggagcgtaaatagctttttctttgttttaaatttcatgtttttctttttttttttgttttaagatactctattatgttttattattagttttagtcctccttgcccagttgcggaccaaaggggccttatagttatctgttaaaaactatttttaattttgtgtgttagcataaaattatttatataatcataaaataattttttgcccgatcaatacagaaatggccggtgtcttcaaactaagactaaataacacaaaagtgactgtttcacaacaactattgaaagttatctttattttcactttttatactgttaaaacttcgactgtttagtttttttattttatcaccgataaccattctgttttccacagatctattatattaactatattttagattgattgattgttatcttaggttaaataatttttttgttaccaacactttggactattaaagtcgatacgtattattacagaggcatggaactgtcgaaccttccaaaaataaagccacgtgtaaaatgtacagggtgtcggatttaagatgaaaacagccctatatttcggctatcaaaataaataaagatttgaagttttggcagccatacaggttgaaaggttaattttttttaagataagcaaactgaaattttaaattttaaaccgcaaaccctaatgggaactcccacaaacag

SEQ ID NO: 406 - DNA, 1487 bp, Diabrotica virgifera
  misc_feature (1431)..(1431): n is a, c, g, or t
tcttgtccggaacccaaggagaggacgtaacactccagctaaaagtatttcaactgtcgatacaccaatgcgttttggagcccctagaaatgacattgatgctcaaagcgagattccgtcatctcctgcacatagtttagcgcccacaagtcctggtacagggctggcaatgagtgaaatagatctaagctccccactcaactatggaactccaagttctttgggatcaattaggacaccaagatcaggtattagaggcaccccaattcgtatgagacctgatgttcgttctgataagagaattagacaagtcaatgtaggaggagatgcagctttggaagccataccagaaacacaggaatctgattccactgctccacatttggtcatttggggaaccaatgtatctgtggcggaatgcaaggaaaaattcaaacagttcattcttcgtttcattgatcccaatgcagaagaagatgagataactgatgatatgaatgtcaatgaacctctgtatattcaaaaactagaagagattcatacattagacgagccgttcttaagtgttaactgtgcgcatttagaaacattcgatgctaacttgtatagacagttggtatgttatccacaagaagtgataccaaccttcgacatgtgcgttaacgaaatgttttatgaaagatatccagctgccgttttagaacatcagattcaagttagaccctttaatgcagaaaaaacaaagaacatgagagctttaaatcccgaagatatcgatcagttaattacaattagtggcatggtcattaggtcgtcaaacataatgccagagatgagagaagctttcttcaaatgcatcgtttgtcaatttacatcaactgtagaaattgatcgaggccgcataaccgaaccaactttatgttccagctgtaacaccaatcacacctttactcttgtacataacagatcacagtttacggataagcagatgatcaaattacaagaatctccagatgatatgcctgctggtcaaactccgcatactgtggttctctttgctcacaacgatttagtagatgctgtccaaccaggtgacagagtcactgttactggaatatacagggcacaacccttgcaaataaatcccagacaaagaaacatacgctcagtatataaaacacacatagacgtgttacatttccgtaaaattgatcaaagaagaatatatgaggaagaagatgggaaagatcgccgttttacaccggaaagagttgaacttttaaatcttttgtcgcaaaaagctgatatatatgaaagactttcaagagctattgctccttctatttacgaaaaccaagatgtaaagaagggcattcttctgcaattatttggaggtacaaagaaaacctttgttacatcaggcagaaccantttcagagctgagattatattttactatgtggtgatccaggtacatcaaaatctca

SEQ ID NO: 407 - DNA, 882 bp, Diabrotica virgifera
ccgtggtcgttggtcggtagatagttgttaatcattcctcaaatttacgcaaacgaaactagcgacaattattaataatttatatatgacttgtgatcgatttggtagtgaaatttggatgatacgactgtagtttgatcaaaataaagaactttatgcaatacgctggtctcaatgggtatatgttgttatggtaacttgtaaagaagaactagtaataaacaaaaatgactgctgtacccaacctagctctagtaaggttagcagtcttcttaggaatggtagcagctactgtcactctattatatttagctccagtaccaaatcaatcaatcaaaagctgtgatcgaccttgccacgaacttgactggcccatgatatgtagatttaagttaacaatagaaaaattacccacatctgtgatatgccaagaatgccaaaatagcgtcgactgtccatactgcacgtctcaagctgacctaccgcaagaactaacactcattaaccgccagcttccagctcctaccttccacgtatgtcacaatgacatattaatagtagatgtagtcaataagttacaaacagaaagtctcaccatgcattggagagggcaaaacaacgaagagacgccatttatggatggtgtaccattgataactcaatgtccagtaggaccttacacaacgtatcagtataaatttagggcgtcttcaccaggaacacactcctatcacgcgttttcggattttgaacgaacaaatggacttcacggtgcattagtaataagaaaagcagagaagattgaaccaaatatatataaactacgatgttgacaataaggatcacgttttgggtgtagcagaaaccaataacagtgtttta

SEQ ID NO: 408 - DNA, 1777 bp, Diabrotica virgifera
  misc_feature (83)..(83): n is a, c, g, or t
  misc_feature (1704)..(1704): n is a, c, g, or t
  misc_feature (1729)..(1729): n is a, c, g, or t
  misc_feature (1746)..(1746): n is a, c, g, or t
tttcaatcgtatcaatataacagtgaatccttgggatgaaattatgtaagtttaaataggatatgccactagttgtccagggncatggtatgttattagaccgcctctgttggttctataaaattcagctccttcttcttcttaaagttccatcttctatcgaaggttggaaatcatcatagcaatgcggaccctgttgactgccgctctaaatagctctgcactactgcattcgaaccattcccgtaagttcttaagccaggatgttcttcgtcttcccacatttcgctttcctcggattttgccttgcataacaagttgtaataatgagtatttttgccctctcatcacatgtcccaagtactcaagtttttgtcttttgatagttagtattatttccggttgatttcctatccttctagttacttccacgttcgacattctttgaatccatgatattcgtaggattcttctgtaacaccaaaattcaaaggcggccaacttattcaaatggacttgtttcaacgtccacgcttccaagccgtaaagaagagtagagaacacgtaacatcgaagcatccttagacgtagttctaaccttatatcctgacaacaaagaaactttttaagtttaatgaatgatgcacatgctatttcaatacgtgtcttaatttctttggtttggtctacatttgatgttatccatgttcctaagtatttgtagttatccacactctcaatcacagtatcttcaatagttaattggatgtttacttgtgctgatttagttatgatcatgcatttagttttctttaaattcatcttcagtccgtactcatgacagcgttcattaaggcgttgcataacgttctgtaaatcattgttgttatctgttattattactgtatcgtctgcaaaacgtaagttgttcaaaacttctccattgatagatataccttctattgaatttgagagcgcttcttgaaataccgcttcactgtagacattgaaaagtagtggagacagcacgcaaccctgacggactcctctctgtattttgatatcttgggtgtcctggttgtcaactcttatcttggcagtttgacaatattaccagttaattgtaaatatttttatcaaacaatcatgcaaaaatcagctgtgtgagtataaattgtatatctctttatgatgagtgcatccccccaaatatgggtttcgcactatggggtcataaatcgtcgtcaacacaagaaaaccgcataattccaatttttacttaaaatgagattttactgccatccattagccaatcgtgtattctagccatccgacaaataatacatcatttaaatgtagatttatttataattttaaaatgtatactagaaaagcagttacatgttcttctaatgttgcatgttactctttttaggctcctgaaaaatttaggaaaatggagttacgtgtttttcttgtgttggcgacgaaatgctgatttttttgaaggattttttgataaaagtacctataattcattggtaatattgtccgacaaatttttaagcgtattccaattgacagatgtagcaaaaacctctatatttacaaaagacccccatcccgaaaattttccgaaacaaaaaagttgtactcgacgtgaataattgaataaaaaaagtctcatgagagaagtaataattnttttttttttttaatgtgggcccanggtctaatattgatttntaagtcatttctaattattttattctttgca

SEQ ID NO: 409 - DNA, 964 bp, Diabrotica virgifera
ctgttgcactgacacaaaaatgtgctctcctgtttctcctctttcttcttcttaaagtgccatcttctgtcgaagggtgaaatcatcatggcaatgcggaccctgttgactgccgctctaaatatctctgcactactgcattcgaaccattcccgtaagttcttaagccaggatgttcttcgtcttcccacatttcgctttcctcggattttgccttgcataataagttgtaataatgagtatttttgccctttcatcacatgtcccaggtacttaagttttcaccttttgatagttaatatttccggttgatttcctattcttctagttacttccacgtttgaaattctttgaatccgtgatattcacaggattcttctgtaacacaaaaattcaaaaacggcccacttattcaaatggacttgttttaatgtccacgcttccaagccatacagaagagtagagaacacgtaacatcgaagcatccttaggcgtagttctaaccttatatcccgacaacaaagaaactttttaagtttagtgaatgatgcacgtgctatttcaatacgtgtcttaatttctttggtttggtcttcatttgatgttatccacgttcccaagtatttgtagttatccacactctcaattacagtatcttcaatagtcaattggatgtttgcatgtgctgatttagtcatgatgatgtatttagttttctttaaattcatcttcagtccgtactcatgacagcgttcattaaggcgttgcattacgttctttaaatcattgttgttatccgttattatcactgtatcgtctgcaaaacgtaagttgttcaaaacttctccattcagagatataccttctattgaatctgagagtgctccttgaaataccttcttcttcttaaagttccttctgctatcggaggttggatatcataatggctgtcactttgttggct

SEQ ID NO: 410 - DNA, 1587 bp, Diabrotica virgifera
  misc_feature (1491)..(1491): n is a, c, g, or t
ggggtgcttcagacttttccagtggcccgttctaatgatatagagaaagcagttgggctgtaaaacttttggatggccttaggtggagcctggccggtcaaaactttgggatggccctatgtggagcctggcctgtctccaacctccacaactgaagactaccctgaccagagtactgaaggcacctcaatcacaggttcgggtcccacaggcagagaggatgagccccgtcttggtcagagcaacaccatccagtgctctcttgcactcaagaaccagcttagagctgatcttaagcgcttccaaagcctttagcactgcctggctgtcagagcagatagagatggtcctgcctaagcaagccccaagtctgacaactggagttcccctaaaaatttgtgtgacaatattaccttcttcttctttaagttccatcttctatcgaaggttggaaatcatcatggcaatgcggaccctgttgactgccgctctaaatatctctacactactgcattcgaaccattcccgtaagttcttaagccaggatgttcttcgtcttcccacatttcgctttcctcggattttgccttgcataataagttgtaataatgcgtatttttgccctctcatcacatgtcccaagtactcaagttttcgtcttttgatagttagtattatttccgctttatttcctatccttctagttacttctacgtttgacattctttgcatccatgatattcgtaggattcttctgtaacaccaaaaaaaaaaaaaaagggcggccaacttattcagatggacttgttttaatgtccacgcttccaagacataaagaagagtagagaacatgtaacaccgaagcatatttgaggctgctgaagcgtaatcagaagatgcttctacgttgtttcataaatgtcaacgaaacatgcatccactggtacataccagagaccaaggaatagtcgaaacagtggactttatcccgcgaatgtgaagactgttctatcgaccggaaaggcgatagccaccgttttctaggatacacaaggtgtaatctatgtcgacttcttgtaagaggacaaaacggtcacagagctttactacaccaaattattgggccgattcgacgtcaaattgcagagaaacaaccccaattggcgaaaaaaaaaagtgctcttccacaatgccaacacagcggctcacacctccgccgtcgccatggccttactgggctacgagctgctgtctcatccactatattcttcatatttgaccccgaatgacttctttttgtttccaagcttgaaaaggtctgtactgaacccgctatagtgttctaaagtcctacgtaagaaaagtcaattaccttacagctacggccttccgaagtctcagcaaatacacgaaccgggttgacgtcccctgcgatgagacaccaccttcagtatccgtcactgtgtcactgcaccccggtccagctagccngtcatttatattccaattctacactctcgacgacacttccgacattgttagtacggtatacgcgaattcgtatttttctccgcggatcactattgc

SEQ ID NO: 411 - DNA, 930 bp, Diabrotica virgifera
  misc_feature (896)..(896): n is a, c, g, or t
aatggagagtacacgtcaacgtcatctcagtttggtttattgttgggtgtaatgtttaaataaaataattattattttgtaaacctgtgccattaaacaaataaagcgatggtgctaattgcagcagcagtctgcacgaaagcaggcaaaacaattgtgtctcgacaatttgttgaaatgaccaaagctagaatagaaggtttgttggctgcctttcctaaattaattcctacaggaacccagcatacatttgtggaaacagattcagtacggtatgtttatcaacccctagagaaactgtatatggttcttattacaactagagctagcaacatattagaagatcttgaaaccctccgtctattcgcaagagtgattcctgagtactgcaaatctttggatgaaaatgaaattgcagagaatgcattttcacttatatttgcttttgatgaaatagtggcattaggttatagggaaagtgtcaatctgtctcaaattcgcacatttgtggaaatggactcgcacgaagaaaaagtttatcaggccgtgagacagactcaagagcgcgaggccaagaatatgatgagagaaaaggcaaaagaacttcagagacagaagatcgaagcggccaaaaaaggagggaagacctcgtttggtagtagcggtggctttggcagctcgacaggttatactcctacgccatctgttggtgatgtagctaaccagacaaatgatgttaaaacttcttcatacacaccagcccctgcgcaaaaacctcggggtatgaaattaggtggaaaaggtagagatgtagaatcattcgtagatcagcttaaatcggaaggagaaaacgtcattactcccaaacaaaatagtatttcacagccaggaactanagctccagctatcaaaactgacatcgatgatgtt

SEQ ID NO: 412 - DNA, 1313 bp, Diabrotica virgifera
  misc_feature (1169)..(1169): n is a, c, g, or t
gtcttaataccagtaagtgctcaacatgaaggtgctagtgttactctcggtactatctgcatttcttgtttgccaaacatcaggtgcggaaaaacgggtcgtttgttatttcgccagttggaccatttatagagcaggaaaaggtgctttcgatgtcagtaatatagatccatcgctgtgtacacacattaattttgctttccttggtcttaatgaagatggttctattcacattttggattcctgggagtcaagtgatgctggtggtcatgagggttttaaacatctcgtagagcttaaaaagaccaatcctgaccttaaggtatgtgtaagtatgggcggttggaacgaaggttccaagcagtattcagcagtagcatcagatccagcaaaaagagtaaaacttgcagatgaggttttagcttttatcgaaaattggggcttcgatggttttgatttggattgggaatatccaggattacgaggaggaaacgaaactattgataaagagaattatgtcgaacttttgaaagctcttagtgacgtccttgagcccaaaggatacttactcagtgtagccactgcaggcgccgttgaaaaaatcgacgttggatttgacgtctcagttataaatgagttggtggatatgattaacgttatggtttttgattttcatggagcatttgagaattttgtaggacacgtttcaccattgttcccagctcaagttgattacgaatatgaagctaatagtacatacaatgtagacacaggaatccaacactggatattgagtggtgcagatcccgcaaaaataaacctcggcattgtcacctatggaagaacctataccttagctgataaaaccaatacttctctttatgcaaatgttaccggtggtggtaatacagggccatattctgcacaatctggatatttaggatataatgaaatatgcgaattttatttaaattctacgtatgtctgggatgatcagcagaaagtacctcacagatattgggacgatcaatgggttggatttgaagacgaaagatctataacagaaaaagtcaactacgctcgggataatgaattaggaggaatgatggtgtggtcattggattacgacgattttagaggaacttgtggagaaaaatatattttattanaggctataaacaaaattcatgatcagttttgaatttataaatttgattttatgaagtaagtattccagcaaatgtcatgatacttatgtaaactagccatttagtaaaccataaaaaacaaataacataataaaaatacattat

SEQ ID NO: 413 - DNA, 1239 bp, Diabrotica virgifera
atcacgtgaaagaatgatagatgagaatgtagaacaattgtggtgatgcagaaataccaaacatatcagaatgaaatgagaagttccatattatttaaacaataaatctgaaacctcccgtggaaccaatttctgggtacatcgttaatctctgccaaaaaagggattacaatacagtcacattccgtctattcatctaggaaaaattccaaccaaagttgattctgtgtactcaaaatatgagtaaaatgaaagacaacttatttttttcattccggttcagagatatttctccagatattttgccaagggccacgtcgctcatttttgatatacacgtattactaactttcatggctgtggatatcaattgcccctgagagtagtatccggctaataggcttttggcctattccattgcgaccttttcagatccattttgctcctttagatctagtcttactctttttaaggtttaataacttcccaagtctgtaagactgacaaaatgctctctgttgtttcttgtaggtgacaaaatctgcatatattatgtgataatccaatcagttttaactgcctattcagcttacagtggcctatgagcagacctactatggctttgacttgtctttgctattaggtatgttaaattttggtgaatgttctctaatgtgctgtttcgtctgtctttgtcctggtgaattcctccactatctcatagatttgtaagctatccactttcttgtctctgcctttgcaacagtacaattttttgtgtattgtaagaatgatttccaaagttaaataaacataatttcaaactacaattgtggcttattcctaataaaaatagtaaattgtattaagatgccataagaaagtagcttcaggactatatacattgtgattcagaaatgtactaaaagagcgaaaccaaggttttgagcttccatcactgaacaatgtatcgagtccaaaatgattcatttcaagtgagaaagaacatgcatccatattgtacagccaccatctgttagtgcttctcgacaagctactgccaaagctagttctagagggtagtatttagcagccgaagttacacaaatatagaaacaagtttcatacttttaatgatcacacaatatttttgtggcttaacttcgcaggacattagtcccactgagaatatttcgggtgatacttgcaaagacttgaacacttaaattaatgttacct

SEQ ID NO: 414 - DNA, 1381 bp, Diabrotica virgifera
  misc_feature (1351)..(1351): n is a, c, g, or t
gaaaaatttccagcagaaaatgattttgattcatttataaagaaacgtggtggtaccgacaatgcttcaacagacacggaaacaacatcgttattattttgagtgtcttgaaaaaaaattacatgaagccttagataaatttgctcaattctttatttcgcctttaatgaagaaaggggcaatgacaagggaaagagaggctatagagtctgaatttcaaatggcactcgccttcagatccacacagaaaagagcaactactccttcagttggccaagcctgaatctcctgttaatgcatttggttggggtaatttaaagactttaagagatgatatcgatgatgataagttatatgagggagtgcatgcttttaggaaaaggcattactctgctcatagaatgactttggccattcaagcaagactgcctttggatactctccaggaatatgtagtaggttgcttctcaaatgtcccaaacagtcatttagataaagatgatttcagtgcctttaaagaaggtgtatttgacactccggaatttagtagaatttactatatcaaaccattacagcaagtgatcaagctggatttaaattggagtctaccatcactcaaacatatgtacaaaagtaaaccaatgggttatgtatcctgtcttataggagatgaggggaaggggagtttgttgtcttatttaaagagcaaatcatgggctacttcaatgcaagcaggcaatgaagattcaggaagcgaacacaattccatgtacgccatattcaatgtatcgatagtactaaccgaaaacggtttgaaacagatatatagcgtcatcgaagcagtattctcctacattaatatgctcaggaatgttggtccccagagaagaattttcgacgaacaaaaattaatagcagatactacttttagatttgcagcagagttaactccggttgataatgtagaaaatttgtgtgaagctatgcaattttatccgccagaggattatttggctggatctgaactattctatgaatacgatccgaaggctattacaatggtcgtggattctttagtgcccaaaaaagttaatattatggttaccactaaagatctgccagatggtttagtgtttgataaaactgaaaaatgggtttaaggctgaatataccgcaatagacattcctaaagatcttataacacaatggggaaactgttaaaccttactcagaactgaacattcctcccgtcaatccatatttgtcgaccaatttctccatattaccgaaatcacccaaacatcctgactatccacagaaaatcatggatactcctagggtagagatgtgntatagaaaggacgagaaagttcaactgcca

SEQ ID NO: 415 - DNA, 1183 bp, Diabrotica virgifera
  misc_feature (15)..(15): n is a, c, g, or t
  misc_feature (22)..(22): n is a, c, g, or t
  misc_feature (26)..(26): n is a, c, g, or t
  misc_feature (36)..(36): n is a, c, g, or t
  misc_feature (58)..(58): n is a, c, g, or t
tgagggcggaagaanatataangagnaaaaagaggnatgaccttttagaatcgaaagnattaatattttatatgtacaacttgcttagtaaaggtgtaagtacgaggctatcttatcctatcgctcgcttaaatcaatcataaaagtaattcagacttaattctacacccggcggtagtacacactaagttggaaacatgagggaaattgtacatgtgcaagttggacaatgtggcaatcagataggttcaaaattctgggagatcatctccgatgaacacggaatcgatcctcagggtcgttatgttggtgattcacaactccagctagatagaattaacgtctactacactgaagcaagcggtggcaattatgttccaagagccatccttgttgacttggaacctggaactatggattctgccagatccggtccctacggagccctttttagaccagacaactttgtatttggacaatcaggtgcagggaataactgggctaaaggacattatactgaaggtgccgaattggtagacgctgttatggacgttattaggaaagaatccgaaagttgcgattgtcttcaaggcttccaacttgcacattctctcggaggtggtaccggttccggtatgggtacccttcttattgcaaaaatacgcgaagaatatcccgatagaataatgaataccttctcggttgttccatctcccaaagtttctgacaccgttgtagaaccatataatgctaccctatctgttcatcaactaatagaaaacacagatgaaacttattgtatagataatgaagctctttacgacattggtatgcatactttgaaactgccatcgccctcttatggagacttaaactacttagtttctttaactatgtcaggtgtgacaacctgtctaaggttccccggtcaattaaatgcggatcttcgtaaattggccgttaatatggtacctttcccccgtcttcacttcttcgtaccctggatttgtgcctcttacaccaaagcaaagtattaagtatagagctttaactgttgcaaagctacacaacagatgtttgatgcaaaatatgatggttgcatgtgatctcccaaggaaatggaaagggaattttaaaaagtttgccccccgggtttctccaagggtcaccttgttcccacttg

SEQ ID NO: 416 - DNA, 1990 bp, Diabrotica virgifera
ccttacgcgtccgaccttctcgaaaggtcacatcacatcagttatcttgtttaaataaagcaaacgttttttaattaacgcacggcagttgcgctcggcaattcttaattgtatatacactttcgtttcaaggttcaaaatacaagtgccggaaacaatgtcctggttttcagaagttgaattaggacctccagtggaagtttttgctctcactaaggcctacaacgatgatactttcgataagaaagtgaatcttggagtcggagcttacagaaacactgaaggtaaaccatgggttctgccagttgtaagaacagcggaaaaagctctagccaatgatgaatcgctcaacaaagagtacttaccaattttgggcttggaagctttcagtactgcagctactaccatgttgctaggacaagattcacctgcaatccgtgaaggaagggcatttggtgtccaatctctatctggtactggagctcttagagttggtgccgagttccttgccagagtattaggaaagaagaccttttacatttctgatcctacttgggaaaaccacaagttgctctttaaaaatgccggctttacagaagaacgcagctacagatactgggacaataaaacccgtggtctagacttcaatggtatgatagaggatttgaaaaatgctccagagggcgctgtcatcattttacacgcttgcgcacacaatcctacaggtacagatcccactcctgaacaatggacagcaatcgcagctgttttaaaagaaagaaaattgttccccttcttcgactgtgcctaccaaggtttcgcctctggtaacttggtcaaagatgctgctgtggtaagaaaattcgccgccgaaggctatgagttcttctgtgcccagagttttgccaagaacttcggtctctacaatgaacgtgttggaaacctaacagtagcggttagcaaaccagaccttatggcacctgtaaaatcgcagcttactctcatcgtcagaggaatgtactcaaacccacctagtcacggagccaggatagtatcttttgtgctcaataacccagatttggcaaagcagtggcaagataatatcactacgatgtcttcaagaataattgaaatgaggactctgttgagaaacgcattagaggagttgggcactccaggagactggagccatttaactaaacacatcggaatgttctcttacacaggtctaaatgaaatccagtcagagcacttggtgaagaaacatcatgtctacctgctgcgttctggaagaattagtataagtggtttgaacaatgacaacgtgaactatgttgctaaagccatccatgaaacagtaaccaccctacccagcaaaatataagtgttttagaatttttatgggaaaatgccacagaagaacaaatattttcattttttgccttagctcgttctttgatgagtcatttcttgcgaaccaaagagaattcgtctataataacgtttctaataagctttttattattattctggacatttccatgatttatattgatttgaggtctattaaccaaatattgtcatgaaaaaatatagaagaatattatctaattatgtggtaaatattttgttcatgacaaatatcacataaatatgaaaaatacctcaaatactcaaaaaaaatatgaatatcttttcaaattttaccaaaatatattttttggcatggtttttaagtttttaacaccatcttgacacttgcacactaaaaataaaaatgttaaaacagttataagttctatctacttttattatattatttccaaaaaagattataccactgggatttgcacaaatataacgagcctaatgacaatattgtttgtggttgtattcccaggagcattttatatataagtattactgtaagatacaactgtacagctaaataaatatgttatgtccgtttataaatattaagaaaaaaaaa

SEQ ID NO: 417 - DNA, 1425 bp, Diabrotica virgifera
gcaagtgcgtggtgaagtgaaatagtttaaaaaaagtgttcgcgaatttgtaaaaatatttatcggaatgttagcagtttcacagttcgtgtaaacaattataaatatgattgaacaattcgtcttaaaaggaccgattttcacagataggtgaaaaattatggaagaatatgaagatgaaccagatataaatgaacaaatttttcacaataacgtgagggagcaaattatatttctcctgctctttatcatcttatacgtatccagtttcgccttgctgtgcagattcaaacgacgaggcaaagaagactacttcagtaccgatgaagatgaagtcaccgtgtacaggatcagcacgtggctatgctctttctctttggcggtttctatattggcagtactactgttgcccatatcgatcgtctccaacgaggtgctggtcaactaccccaacagctattacataaagtggctgaattcgtcgcttatacaaggtttatggaattatgtgttcctgttctctaatctttctttatttatcgccctcccttttgcctacttgttcaccgaatcggaaggattcttcggtcatcgcaaaggactgatttcacgagtgtacgaaacgttcaccgtcctgggtctgctagcactcgtcgtcttgggcatgacctatgtgatatctgcacttatcgataaggataaatctagtatacaaactatcttaagcctttggacttattacctgccatttttatattcgtgcatatcattttttggggtcttgatgcttttagtatgtactcctttaggattcgtaagacttttcgacgtagtcggccagtttctcgtcaaaccccagtttcttcgcgatctcaacgaagagtatttctcgtgcgccttagaagaagaatgtctgcgcagacgcttcaaacaagctcaaaaaaccgggaagtcgtacgtagatccggcgcccatgtccatctacacagaaggaccaatcaaagacgccgactaccaattgcctgacaatttgttgagattgagaaacggagagttacagtttggactcgctaaaagactgactgaaatcgagaagaggagactaattttagataaacagagacaaacgtcttcatttcgaagaaacgtcgtttatccaatagctatgctcctacttctcagtttaacggtgatagctgtgctactagtagtacaaaacacgttatcactgcttataggcattaaagctttaccaatcagctcgaagcaatttactctaggagtaagttccttatcgaagctgggactgttcggagcctcattagaaatagtatagatcgtttacctaatcgtcacttcgtccatcgagctgtacacggcgacgtgcatgaagagaataagacaaagtctacgagtacccccttt

SEQ ID NO: 418 - DNA, 1149 bp, Diabrotica virgifera
  misc_feature (92)..(92): n is a, c, g, or t
ggtcgaccacgcgtctacactaacgtcctgctaaaaccatgtatccggttttagaatctgtgtgacagcattttggcaaaatactgtcacanagattctaaaaccatgtatccggtttgctcactcattttctttatttagttcctatgaccaagtgtccgtttatgtttgaaccgttaactgtggtaattgaaatatatcgtcaaaggtaaacgttttcctaatattcatcgattttttgtttcaatatttcaacttatttcttattcgcaagtttagaaatattatattatcaatttctatagtttaagataatctataaaatattgttatggaatatccttagctcttttccagttttctttaaatggttctagcatcttagttcccgattataagcagcatattactgcctgtctttttttcgtccacgtttaaatgattcaatattattttcacttcagatgaatcacgaaaaataatgcactttttagaatgactacgtcgttaccaacagttagttgacagatctgttaggattagttatgtagcttttgtctgtagtaaagatctaaatttctctaagcagtcaacagtaaaggatgttactgaatgagttgtttgtatagagtttagttgaattaacatgccttataatttttctgtgatggaaaatgtaatagtaaggtaaatgaaaggaattgtaaaaagtagggaattgatgatttgtatgttgctagtatcagtatgtagagtgtaggacgtggtcaaaataacttctaaatagtaacgtcacgttttgtgtccattttaaagagtttaaatatttacattcacaaatttgtatcgcctaaatgtgattttgcgaagtaaaaatggttggttttgcaaaaattataataaaaatttaaaattacacatcgaaatttacgtgtctcgaaatttctacattagcgattaagttttaattttttatcaactcaaaagtatattctgtctcttgtatcagtgtcccacagctatttgatatttcgctatttctgtatcctccgacttatcaaaaaggctgtgtgtaggtaaaaatgattgaaataaaaatcttcatgtatgtgtgaatgtgtttataaacataaatatataatttaggat

SEQ ID NO: 419 - DNA, 1403 bp, Diabrotica virgifera
gttaagaagacatgaagacaacgtcaattaacaaattattgtgatagtttatttttagatactgttaatctttgtttttacgtgactgtgatagtatggatgtacattgcgttttgttttgcttgttgtttatttttaaaggttttacaagcgaacaattagaaagcaataacaattattccacattaagacaaagacgacaaagtagttttaaatgtacactgcccccacaattacaaaatgggaggtggttaataactgaagcagatgtcaaaccaggtgaccaggtagaggttaattcgattttaagattagaatgccacgaaggttaccagttacaacctaatactcctttccttgtatgtgatacgaactgggaagggataaaaattccaacatgtaaaaaaaaatgtcctccgttttattcaacagtaactacacagttactatgcaaagataaagatgaaaatacagtaacttgtgacaaagccattgatggtacatacttaacttacgaatgtgctgcttattatgaaattccacccggaggcagaaatgttctttactgtaataatggtatttgggactttccaaaaccgatatgtcaaccaaagtgtggaaagaagtttaataaggaaacaatagcacttacttggggtggaaatgatgttaaggattttgagtatccgtgggttatagctttgtataagaatgcaggtggacgataccggaatgtatgtgggggtaccttaatcagccgaagagttgttataactgctgctcattgtgttactgacgattatggcaatgctattggtagggagaactttcaagttgctgctggtaaatattacaatgcttttggagatcaaagagatacgaaagcgcaatacagaaagatatcacaggttattgttcacaaaggatatagaggagtcagtcagagatatattggtgacttagccttactcattactcaagaactgttcaaactagacccagtggttcagccagtgtgtactgataatgtcaataatatgttcctaacaaattaccaaatgggagaagtcgctggttggggtcttacagaaaacgacaaaccctccgatcgtcttagagttattagaataccatacaaagaaggtggcacatggtgctagagagctgccagctagctgggagcaagagtataatttcttagacaaaatttgtgctggtcgtcagaatgaaagtattgcagtctgtcagggagatagtgggagtggtcttgtatttcaaaaccgagaagacaataggtactacatccacggaatagtaagcatagctccaaatctatatactgccagctgcaacaaccgaacaaatgctctatacactagcgtgatattctattatgcttttat

SEQ ID NO: 420 - DNA, 1197 bp, Diabrotica virgifera
gcttttcaatggagatcctcattcctaaagtgctgtcaatagttttgtaacatttcgactattttactgcaaaaataattacaaaggcgacctgtatatctctctaatcatcgagaggtatttatattatttggattttttctaatattagtgataaaatgccctcagcggctagtgtcaagattgacaagcaaattaacccggaaaatgcattagcagaatctgcacaaaatttaacacctcttaggcaagctattactgttatcgaacacaaaattaggaatttggaaaaacgaaagtcaaaattagaatcttacaaggacttacaaaatgccggaaaagaactgaatgccgatcaaaagactgctgtggctaaattcaatgaagtgacgaatacattagactttgctagagatttatgtaaacagttcctagggattgcagtagcgtccgagaaggaagcgaaaaagattgcgaaaaaagaagctgctgcgaaatatcaggcggaattggcgaggttaagggaaattttattggtccaagatgcgcttaaccagatgggtaacgagactgttcgagaggactttttgcaagggagaaatggagctgctcaattaactgaatcagatctcaaactactagacgacctataccctgaagtgacaccaaaacatgaagctggtaatgctaccgccttcatgaatgaagtacaagcggctgctgagcatctgttagcagcagttgatggcaaacctaaagaagtatttggaggctcctatagccagattaaggaaatattaggaaagattcatgaaagtggatattttgatcaggcgcaggtatatgaggagttcgcagttgtcgaacccgaattagtggaaaaaacccgaggtctcccatctgagccattaaacaaccatgagaactgggagcttgtgatggggcctccgcctccacaacccctaccaaaaacccacacagccgacgacaacagcgcgcccacccgacatgccgttgatttgtaagtttgaaaggtttggaacaaaaaaaaaaaccgggtttacccttaaattaaaaggccccccccacacccccgggggaaaaaaaccccccccttgggggccccgcccccccccttctaacaaaaaaaaacccccctattgttttttttttaaaaacaaaaaccctccaaaaaca

SEQ ID NO: 421 - DNA, 956 bp, Diabrotica virgifera
cggatagatcataaacgatgaagctggttctaggaacgctgttcctaggtgtcctgattttcaataaagcttctccccggcaaatcagttatggaaaactagaaagactacaagatgccttgaaaagattttcgataaacgatattaacttgttgcccaatgaaaacgataggcttaaacaaaccactcctgaaaaacgaggttgtatgtatcttataggcgaaagttgcagtaatggacgtgtgccaggtgcaggagctgacagcgactggataagaaatggaggaaatgttcctggaaaacgaacttggaaattgttcgattttcacaatctcccaattttatcaggaaaacgttgtgtaaatcttttagacgagagctgtagtaacggaggagcttctggtgcgggagatgacagtgactggataaatggtggaaacagtcctggaaagagaagtttaaacgtcatggatgatcataatgttccctttgttccatatagtggcagaataacacctggtaaacgttgtgtgaatcttttagatgagagctgtagtaatggaggagcttctggagcaggagatgatagcgactggataaatggtggaaacagtcctggaaagagaagtttaaacgtcatggatgatcataatgttccctttgttccatatagtgacagaataacacctggtaaacgttgtgtgaatcttttagatgagagctgtagtaatggaggagcttctggagcaggagatgatagtgactggataaatggtggaaacagtcctggaaagagaagtttaaacgttatggatgatcataatgttccctttgttccatatagtggcagaataacacctggtaaacgttgtgtgaatcttttagatgagagctgtagtaatggaggagcttctggagcaggagatgatagtgactggataaatggtgggaacagt

SEQ ID NO: 422 - DNA, 950 bp, Diabrotica virgifera
cgataataccagacccgataattacaaagtgatttcgtagatctgattttacattttatagttcacacacaacaaataaataaacaaatcagcctagattacttatcacgacttataaaagaggatttatcagctattgtggtttcagattgtgtagtcataatggcaaataaacatgtaggaaaactgtctatgggcgctcacactttcgaaattccacccatactatatgaaaccaatagaaagagacttgtggaacgattgaaaaaagatatagcaaactctgtcgtagttctccaaggtggatctgaggtgtccatctatgactcagacacaacatatctgttcagacaggaagcatacttcaattggtgttttggagtcgctgaacctgactgctatggaatcatagatgtagtaacaggagattcccatttattttttccccgtcttccagtagagtatgcagtatggatgggtcccctcactcctctggatgaatttaaaaagaagtataagtcacatcatgtacactacgtggatgaactgaaacaagtactcgaaaacctaaacagagagactttactgacattgagtggtgttaatagtgacagtggtcttacagctaaaacagctacttttgagggtattgaaaagtttaaagtgaacaataaggctctatttccaataatagcagatcttcgagtaattaaaacaagctacgagctggatgtactgaaatacgttactgacgcgtgcttcagcagcacatacgcatgtaatgcgattcgccaaagccggaacattcgaatatcagagccaatcacaattcttaaaccactgctacaatcatggcttatgcatacatgatgaatatacttgtatatgcggatcgaagattgacggggatgtattgcactatgtgcacgctggagctcccaacaactttc

SEQ ID NO: 423 - DNA, 940 bp, Diabrotica virgifera
  misc_feature (794)..(794): n is a, c, g, or t
ctagttctagatcgcgagcggccgccctttttttttttttttggaaaatctaaatactgtatttccggaatatctacttatacattaaacatggattataacaacaatataacataaattatttattttatttattacttagtaatttattagagttttgggaatgcataaactgcaggtaaagcaggttggtagtccgtattgtacatctgagctttgatgaaagcttctttgtcttttggttcgggaagtaccgttgcattgccttcttcgtaagcgtactctagaagtcgtgttgcgattcttagtgaacaggcaacgatgctctctagtggtgggtatatccttccattttcaaggttgtcttccgttaccaaattggcgagtgcctctgctgcaaccaagaagtgttcttcgctgattttttggataccagcagtaactgtggccaatcctactccggggaatatgtatgagttgttaccttgtcctgggtaaaacgtctttccatttaaagttactggatcgaatggactgccgctggcaaagatggcagtaccatttgtttctctgtaacattcttcagctgtacattctgctttatgcgtaggattgctcagagcgaagatcacaggtcgcttgttgtttttggccatttcgcgcaaaatttctgaggtgaaagcgccacctatggctgcggctcccggacgcgtggatggtttgatgctctttacaacttcagtcagtgtttttacggggtggggtggggcgtgtgcgtacatttcctttgtggntgggttgattcctcccttcaggtctgtccttaactattaaacctttttgagtctaccatccatattttcttcctggcgtcactctcactagtaccttcccccacgcgtccgaaacggaaccacctcaacttaagacaacatgaaac

SEQ ID NO: 424 - DNA, 964 bp, Diabrotica virgifera
gagatcaaaacacattttaaaaatgcctgcatttaagaaattaaatacaaaaatctaccaaaaaagtggccctgtgatcacacctgagtatatatactggaaaaaattatccgttccagttttggtaaaagaatttggccccatagattacatagatttttctccaattgagccccatcattttgctgtgacatgttcagtgcgagtacaagtttacaatccaattaccaaattagttgttaaaaatttatctaggtttagagaaaatgcttatggagcagtttttcgttctgatggcaaattaatattagcaggaggagaagaaacaaatgttaagctgtttgatgtatcgtcaaagagtttattaaggttattcaaaggacatactgcccctgtacatagagttcacttcctccacggtaaaccacaaatttcgacattctcagatgataaaacagtgaaaatatgggacattccaacagagaaaaacttattcacctacacaggtcacactgactacatcagagcaggaacgacttgtgctgctgttccagacatagttctctctggcggatatgaccacaaagtaaaaatgtttgacaccaggacagagaaggaggtaatcacagttgaccatggaagtccagtggagtcactgctctttctacctgcaggtggaatatttttgtcggctggtggaacagaaatcaaaatttgggatagtttggctggtggaagacttctggggaatatttcgcaacatcataaaactattacttgtctccagttagcttcagataataagagatacttgtctggaagtttagacaggcacgtgaaaatatatgatgtttctacctttaaactgtgcatacattagattttcctaatgcatctttaagtttaggtgtttctaaaccggatgacactctgttgctggggtaaggggggggggatttggggg

SEQ ID NO: 425 - DNA, 1158 bp, Diabrotica virgifera
aagttcataaaataacgtaatcgaaaatttcatttcttgccttgactggcctacgaaagcatctcgacattgcaatcgagttggccatggaaaccgacgcgacggtggcagaaattttattatacatattctaagccgtcgcgatttttaacgtcgctcagttgatagtttgcctttgtggtgcatgcattaataacaataaaactcgcttgcgaaccaagttaatacattacatcctcttttttttgttggaaaagtacgaagctttaaatggataaatattgatgtttttcggtcgatcgaaaaagtgtttagtgcaaattgaaggctagaacgaaatgtgagaaaataaataaaacaccagtttgtttttgttaggagattagtaatttaaaaatggtgcaaatttagaatcgctttaaattttcaattcaaaaatttagtttactgctatatctatatggtagcagtagaagatgacgaccaacggatataatgtgataaattttacaataattgctgtatgcgtcattggtattacaaatattccaaatgtggaaagtgccgtaagatgttttaaatgtttacctgctctacctcaatactacacaaacgaaacaatcagactgtgtaaggacttcgactactccgacaaatttatcgtagactgtccatattcaacgtattgtgtgaaaaaaattaccagtgccaaaataccaacggctatcaatggaactgaaagaaactgcgctaatcaaaaacatgtaattcaaaattaccaccacggacaatggcatcaagaagtatcagtggaagaaccatatactcctggatgtcataaaatcaacgacaaaggtgctcggacgtcttcaatggagtattgttattgtaattcagatttatgcaactctgccagcagttacaatgtacaactcggagttggatttgtgatagctcttattatctttcttttaccatgataactatttctttatataaatgtacagaaaataatattttctaaaaatagttcaaaaaaaaaaaaaaaaaaaaaaacaaaaaaaaaaaaaaaaaaaaaaaaaaaaaaaaaaaaaaaaaaatttaaaaaaaaaaaaaggggggggccgtctcaaaaggacccaagtttacaacccgggg

SEQ ID NO: 426 - DNA, 955 bp, Diabrotica virgifera
aaacaaaagttatatttacagagaaacaatctaaaaagaaatctaaaagcttcataccactcctttagttacttgcaattgttctattagcaagaaggcagtttcttttcaagtctacgcattcctggaaggcttgaactactctagcacacttcattggttcatgaggattgcacttgtagcattccatgacagcacgttctgtatctttgcatggaggtatattttgggcgtatcttcctaattttccagatgacatttcttctaaagctttttgatactcctggtccaagacatcattcattttcttatgtttctcttctaagtttttcagcctctgttgccaatactcatcgtttttcttcagttcagctacatttgcctgtcgaagttgataggaggttaaactaggttcatttataaatatgggaaaagagcccccttgaactggtggaggaacagcttgttgtttgaattcatttcttaccacttgacttccttttaatcgatccacaacttcttctgaaactttaatgacgcttgtaggatcatcgttttctactgttaactttcttgttgcacttgacgaagcacccattattgtaactttttttatttaactacatacaaaaatttgtttagacatcactccatttttttttatttattttaaaataataaaatattttttagtaaaagtaaagaaaaattttatttaatgatagttaattagtattgtgagagaatattttatttttataaaagaaaaatttattttttgtaccttgtgtatcagggattattaattaataattatatatttattattttcgaatttaaagagctaaaaaataaaatttttattgtaaaataaatatttaaataatttttttgtatggaatgttattcgtttttaatatatctaattttttaaaaaataaattaaatttattta

SEQ ID NO: 427 - DNA, 1580 bp, Diabrotica virgifera
  misc_feature (1412)..(1412): n is a, c, g, or t
  misc_feature (1463)..(1463): n is a, c, g, or t
  misc_feature (1499)..(1499): n is a, c, g, or t
  misc_feature (1546)..(1546): n is a, c, g, or t
aaattagaaagtttttttttttttttttttttgttttttaaaaatccccggcaattttttttgttatatttttttcttgggaaaaaaaggcccccacccccttaaccccccccccccccccaaattcttaaatttcaaaaatttggaaaatggccccccctttggggttttttcgacaatatggaaaaaggagacttaagaagcccctttttttttttttttttttttatttattaatataaaaaaaagggttcttagggtaaaaaaagttttttttatcctttttacaaaagaaactagatgtagttcaatttaccattttccaaacccaaaagtttgtgtagtgtcttgtttagtttgtgtagttttagaaaaaaactcacaattctgttccactatatattaataacaggcggctttaattctgttatttccttaaaaaaccattatatagagcgtttcacgttaagaatataacattccggagatagccccatgtatttcattaggggagtgcatatagattttcacttcggaaaaaatcaaataagatagaactttttgtaatttcattaagaaatgtttaataaacaacatatcgactagttctagatcgagaagcggccgcccttctttttttattatacaaatgaactacaaaattaaatgtttttttaaataactccgaaaatataaattttagaaaaaaactgacttgagcattgaaaaattcagaaaattttacaaaaaaaccttatataaagaattttctaaaattaaatctgtatcgtctataattttttatttataacgcttaagtcacccttctcacaaacattggcgcactgtaaactagcgtacggcgaagtgcacggttgagttattttaatgtaattctttaactaatggatgaaatgaaattttacaaattgaacatgaaagaagaataattaagctatcttatggttatatataaaaagaaataaaatgtatgggcataagtacggtgggggcggaaagtgagccttacatgaattttgtttaaaaatgtgtaactaatacaatttttcttataaaaccctaaattttgcacaacttacctttcaagcatcttactaaatgatgtttcattcaaaaagattctcaaaaatttaattcaaatgatatgacgtctcaaaaaatttaatttttgaaatcttcgtagttttatagaattaccaccactttaagacggtattactcaagtttgaacaaatctattacagttttataagtgcttttttaaagcttaggatgtaatctttaaaatgcactgaattattttactttagaaataaaataaactatttctttttaagaaaattaagaaagataacaaaaatgtaatacaaaaaccgaaaattaccagctanaaaaatgtttatacaaagtgatcaaaactttttttctgtaaaacttacctnaaatacatttaataataagctttcacaataataaantgtcagcaaaaatttttttttcgtagctcctatactgcgtaacttgnaacctaatgaatactttttattatcagttctgcg

SEQ ID NO: 428 - DNA, 914 bp, Diabrotica virgifera
  misc_feature (807)..(807): n is a, c, g, or t
  misc_feature (883)..(883): n is a, c, g, or t
tgaatgtccattctacctgtttttttttttggtttgaatcgctcatttgaataaagatttttgtaaatacgtaacaatgaaatttttgagatatgtaaccagtaaaatattattggttgctctagctactaattttgttactggggactacgcaaatttagaagacgcaaatgaccatctagttgttcaattagctagtcacgaaggcaaagttaggggacatactcttcagagtaccaaagggaatacttattatgctttccaggacatcccttacgctgcaccaccagtaggcaaactacggtttaaggtacctcaagcacatccaggatggacgggaactattaatgctacaagcaatacgagagtttgtcatcaaccaattcccactgatttacctcaaagtgaggattgtttattgattaacgtttatacgcctgtgaaaccagatccagatgctaaattggcagtatatgcatggatacatggcggtgggtatgttgtttgggacggcactattcatcgatatgggcctgcccatctgattgactacaatatcattgtagtaacatttaactatcgtcttggtgtcttaggctttttgaccacaaatgacggcgtaatacctggtaatttgggacttagagaccaaaatttggctttacaatgggtaaacaagaatatccacaaattcggaggtgatccagataaagttactattggaggagagagtgcaggctcaggatctgttagcagtcaaattctaagcaaaatgagtcgaggtttatttaggggagctattttggnagagtggtagtgctttgaataccttttcaaatgttccaaatcccagccaatacgcattcaaactagctcaaagggntggatagtactttagatgataaggatactac

SEQ ID NO: 429 - DNA, 1255 bp, Diabrotica virgifera
aacacactgaagagttacaatatatgtggaaaggtgacaccgacaaatatgtcaatgattatcaaccaatttataggaatgttgtttgcaaactttggagtaattttgttaaacatctaaatccaacaccagaaaaggacgaagatctcggaaatgtgatatggcccaaagttaaatcgaacaacataaagtttatgagtatagacaaaaccttagaagttaaaacacacccaaagagatataaagagactagagagatatttgacgtatatttgaggccaccattttactcgtattaaatagataaaattaaaaatttaaattttaaaatgttgtactatgtctttccccacataacaatgatgttcgtatcatgttctaagcatatactaccaacattcgtcggagtatattctgtttaatatatatgcgtagtacaagcatagcatgtaccttaaaaaacattctaaatttcatgttctttgcatatactttaaagtatattctcgtaccgaatatactgagtacattcgtgtacgtagtaactcggaatattcgtaaaagtttattcttagaatatacctttatcgaatattcttagcacatacttataagtacattcttaacacatacttataagtagatactattcttagaatatacctttatcgaatattcttagcacatacttataagtacattcttaacacatacttataagtagatacttttaaaatatcttaaaaataatatgtatgtatagtatatgaagtttatcaacttcgttatattttagaataattaataaaatttatgtatgtaggtagtattggacgaatttcatttcaaaattgttgtatggtaaaaaagtttaaacattaattgtattaacgtttacatagatactattaaaaattcgttttcataattgaaatgactttaccatttcgagtttatcatgaatcattagtatttttacatccttggaatttgaatttaggtacattcaattcaataggccattccgcagaaccaaaacgtgccaaactgcacaaccaaagcaaccaaaggctttggcgttgccaaccgtcgagtaagctttttccgtcaacttaccttaaaaattcccacttttataaaaaaaaaacttccctcctgtttacaaaatctgagaagatatgttgaattattttcaaatattttgattttttcttaatattttacaatttggactggaacaataattcccttttgt

SEQ ID NO: 430 - DNA, 2070 bp, Diabrotica virgifera
  misc_feature (1943)..(1943): n is a, c, g, or t
  misc_feature (2047)..(2047): n is a, c, g, or t
  misc_feature (2053)..(2053): n is a, c, g, or t
catttcgcgtccgaaaaattagacaaagcagccttgaacgtcgacgctcctcatcataggtatactatgtttaaagtttggtgatttgttgaaaagatctattaaatagatactgtcatggtaacttcagtaacaaaatgagcgctacggtaaattttgttgtaggaatcagtgttgcatatattgcctacctttttatattcaatgactacgcaaatttagaagacgcaaatgaccatctagttgttcaattagctagtcacgaaggcaaagttaggggacatactcttcagagtaccaaagggaatacttattatgctttccaggacatcccttacgctgcaccaccagtaggcaaactacggtttaaggtacctcaagcacatccaggatggacgggaactattaatgctacaagcaataccagagtttgttatcaaccaattcccactgatttacctcaaagtgaggattgtttattgattaacgtttatacgcctgtgaaaccagatccagatgctaaattggcagtatatgcatggatacatggcggtgggtatgttgtttgggacggcactattcatcgatatgggcctgcccatctgattgactacaacatcattgtagtaacatttaactatcgtcttggtgtcttaggctttttgaccacaaatgacggcgtaatacctggtaatttgggacttagagaccaaaatttcgctttacaatgggtaaacaagaatatccacaaattcggaggtgatccagataaagttactattggaggagagagtgcaggctcaggatctgttagcagtcaaattctaagcaaaatgagtcgaggtttatttaggggagctattttggagagtggtagtgctttgaataccttttcaaatgttccaaatccaggccaatacgcattcaaactagctcaaaggttggatagtactttagatgataaggatactacacgactattagaagttttgcagaatgttccagtaaaggatattgttgatttgtcagctacattagttgatgataaagctacgcaaacagtcagtataatacccgatcttatttgggccccatcagttgaagaagaatatattgaagagcctttcttaaccaaacctcaacatcaagcatttttggatggagattttaaccatgctactttattagctggatacacatcacaagaactgttgtggtttattccgtcatcttctgtccgtactccatggagcgttgacacatgggaagagtttgacgcaaaatctaaatatgctgatggtgatcccagcagacttgtacaccctgaacttaacgtggctgaagctgacagagctactgtaggagcattactgaaacagctgtatacaaataccacatttcttgaaaaccgaactactttaatcgagtttaacagcgaatacttttttacgaatggagttattcgtcaagcagatttgacctcacagtatgctcccgcatatctcttcgaatttgcgtatacacccactaaccagattggtgttgaacacactgaagagttacaatatatgtggaaaggtgacaccgacaaatatgtcaatgattatcaaccaatttataggaatgttgtttgcaaactttggagtaattttgttaaacatctaaatccaacaccagaaaaggacgaagatctcggaaatgtgatatggcccaaagttaaatcgaacaacataaagtttatgagtatagacaaaaccttagaagttaaaacacacccaaagagatataaagagactagagagatatttgacgtatatttgaggccaccattttactcgtattaaatagataaaattaaaaatttaaattttaaaatgttgtactatgtctttttttgatcattttggatttaggtacaaaatgttcttttaataatgacgcanattataaatataagtgtaagtataagtataagtataatttagtgatacaattatacctcaaaacgctgaaaattaattgggcgctgtatatacttatttaaatnaagatnttattacttttatagtt

SEQ ID NO: 431 - DNA, 992 bp, Diabrotica virgifera
gtttgtataagataatttaattaaacaataagtggttccaaattctagtcaattaaatgaacttcataccaacgccataatattaacaaacattattatacttgtcatatctcatttaaatgttaaaactaagaatcatttattttctgggtgatgagtgccagtgagactatacctattctgataaatacaagtggctcagaacctgaaacacacggggccttgtcaatagtttgtagtgatagtgaggacgttcaattagtcccagaagtagtatttgaatctacattggattcacctggatttcgagaatcacagcctttattgggagggcttgatgtctcttataatcagttcccagatgatcctgcatttagtgacttggtatggcaagctgaagcggctattgatcatggaatatttcctgaacgaatatcacaaggttctagtggatcttattttgttaaaaaccagtctgggaaaacaatcagcgtatttaaaccaaaggacgaggaaccttatggcaggttgaatccaaaatggaccaaatggacgcataagttatgttgtccatgttgttttggaagatcctgtttgataccaaatcaagggtatttgtcagaagctgcagcctcacttgttgatcaaaagttgaatctgaatattgttcccaaaactagagtagttaaattagtatcagaaacttttaactatttaaggatagataggcaaaaagctagggtaaaaagggcgatcatggaacagtttcctaatgttggattaagatttaataggataggtttgccaccgaaagttggtacattctaattgtttgtatatggaggcccagatgctgactattgtataaggagatttgaagttgaaccatttactccatcgctagctcgtaaattcaattgcagtttgagcgactggaagtttttaaattacataatcaaggaacactggatcggggggaatgataatttggt

SEQ ID NO: 432 - DNA, 1573 bp, Diabrotica virgifera
  misc_feature (1439)..(1439): n is a, c, g, or t
acaaaatatgcacctgattatttaaataaataatcatagttatgactattaatctataatttaaaatgtgtgtatctttatcaaagagcatttaatttattaaccttgaagtttgcacccaaaagaatttcaagaatagtgaattttagttgtaagaataggaaaaataaaaaatgtccgcgaaagctgctcaagcaatagtattaacattaactggatgtatgctaaacaatgtttttcttgaatatattatcaaattagacccaggagcaggacatttgataacattatgccagtttttgtttattgctgtacatggactcatttttacctcaaagtttggaacagttaagcccaaaattccattaagtggttatatgacgttagtagtattattcttcactacaagtgtggtgaacaattgggcgtttgcttttaatattcctgtgccattgcatatgatctttagagcaggttcactaattgcaaatatgataatgggtattattgttctgaagaagaaatacacactagaaaaatacatatcagtacttttaattaccttgggtattatcatttgcacaatttactcaagctcagagaaaccaaaggtatgtgcagactgtgaattaggtgtagagactcattcagatgcagtagcagatcatttcttctggtggatcattggaataatcctgctcacaggagctttactactatcagcaggaatgggtattttccaagaggggctgtataagaaatatgacaaacatccagaggaagctcttttctacacacatttgtatcctctgcctggattcctaatttattcttcaagcctgatagagcacatcggcatagcaaacaaaagcgatttgataaatattcctatagtgaattttgcagtaccagtactatgggcattgctatttttaaatgtagtcactcaatttgtctgtatcagcaacgtgtatgttctaacctcagaatgcgcgtccctgactgtaacattagtaattactctaagaaaattcttttctttagtgttttcgattatatactttcaaaatcccttcaccattgttcactggatcggtactattatggtgtttgcgggtactttgatgttttcggaaacacaccacaaaattaaaaacttgatggtttcttctgaccaagacaaaacaaaaaagaagaattaaaatgactgtaagagaatttaatataatttattggtttttattttgtataatataagttagaaattaattttctaatttcagaaatgtttctcgtcttgtttaatttcctactttccttttgtacttatgtacttctttacagaatattcaatacctttattcttgaaattttcttaaattatttaaatattttattgtaaatttgcagttttttgtttatgcatattttattaattntctctctttttccttaagttttctttattctatcttggtctactcagtatttacactctttgtagaaccaattagctttttatagtgtctggtcataattttattttgcttttaaccgtttttatagtttgtca

SEQ ID NO: 433 - DNA, 1052 bp, Diabrotica virgifera
  misc_feature (998)..(998): n is a, c, g, or t
cggacgcgtgggcggacgcgtgggttttttttttttttatcaattgtgcaaatgtccaacgcgtgggtttttgttgacttttgtattatttacaaatattgcagtaatcgaaaatgtcacaatatcaagaaaatgtggaaactgaagatgaagaggaattgtctgattacatggttttggaccaaatagccaatggacatgttgattcagatacatcagatgatgatattcctatatctcaagaaggcgattttgatttggatttacctacaacacacaggtacttgggaaaactagacaatgttagaggatacactctatttgaagatggagttgtgatcaacacattagcaatatataccacaactatggtctttcctggctttactctacctttggttataaatatctatatggaaaactcaattataaaaaaatttctcgaaaaggagaatgtttttgtcttgttgtgtgcaaatgcaaatcacactggtgtttatgaatatggcgttacaatggaagtatttgaaacgcaagataaacattacgctctcagcatcaaagcacgcggaagacagagatgcatgcttgtgcccggaatggagcaaaaagcattaaccggtagactgaaaaaagtaactgtacaaatattacccgaacctaatatatcaactcctctttgtgatacgcagatgctaaatttgaaacagaagagactgtttacgtctacagattttaatgacgtaaagaaaaattacaagtatagaaggtatcatttggcacaattccctttttcttcttgggtttatgataacaatgaaataagctactatgttaagtcaatccttaaatatctgtcccattacagtgcagaatatgtgccccaagatcctataaagttaagttattggtttgtacagaattatcagctaagccacgatgagagattatatattctgaaactcaattcagccctagagagggctgaactggagtantaactggtacatttgaaagaattatgtgctgtaatagctgtggagtacaaatac

SEQ ID NO: 434 - DNA, 891 bp, Diabrotica virgifera
  misc_feature (885)..(885): n is a, c, g, or t
ataaaatttaagtaatatatgttcataataagttattagatagtacggataatacctatatcttgaaaataaacaaccttcgttacaataaacagctttttgtttacaagataacaattcagttgcctcatatgaatagttcacagtttttttgcttcggttaattggacacacacctgcctttcaaaaatgatttccgatgtatggatcaaggggaattgtgttactcaaatattaacaaaacaaaaatttgagaaatacgggcatctactaaaatggaaaaagaacgaaagcattctcgagtttggtgcagcagatggaaatacttcagttaactcagtattaccagtattaccaaaggattacaaagaatatgttctaacggatatatcacctaatatggtagaacatatgaagaaaaatctaaatatacccagaagtaagatcatgcaacacgatattggtaccataagacttcaagacgatctcaaaaataggtttgaccacatttttggtatatttgtgatgcacatggtaccagatcccaggcaaggttttattaacatcaaggcaatgctcaagccaggcggtcaagcatttgtatcaatcttggaacgcacacccatggatcacgcttttgatgctttgctgaaatatcctaaatggtcaagatacggacacatgctgtcccctcattactacagcgacaatatagaagaagcgtataaaaaagatatcgaggctgcagagttcgaatcctattcctttcatgtccaaaaggactatccgatctggtttgaaagcgaggatagtagaagaggtctacttgccggaattaataacgtcctaccaaggataccctgagaactgagagaagatacttanaggata

SEQ ID NO: 435 - DNA, 1283 bp, Diabrotica virgifera
ccggttcagtaaatatgtgtgatatgtggcttaagttttttctaacaaaagaatgaaaaacctcggaatttttgcagtgtttaccattctattagtttatacacgtgctgataatttggacgattttccattatgtaaagcatgtggctgtagcttcaactccaacaacactgaagctaatgtaacctgcacaaaacaaaatccgagccaactcctacaggattacttctggatcaaaaagggaaccaacaactcgataccgtataatcgtgttatgataaacaacgagaaatttattaacttcacttacgttttcccaagttctccattagtgtatttgaatttggcgtacaataatatatttaatatttccgatagtattttcaagaacttgcaaaacatgcaggtgctcattcttagttataacgacttggaagtaatccatccggatacctttaagggtttatatttaccagagagactaatgcccttaaaaagtctcatagaattaagactggaccacaacaaactccatacactcaaccaagatacttttgatcatacaacggatattcaaatattggacttgagctataatccgcttgaagtaattgatcaccatactcttatagctatcaacgaattattatatctaagagaactgtatcttcaaaacaccgaaatcaaaacgctgcctgacaatatgttgcatacaccacaatatttaagggttttagatttatcaggaaaccacggcattgaaaaaataccagaaactttgtatcaaggaagaaacctagaaaagctgtacctaaataacactggatttgtcaacttaacagagaaaaacggatttccacctctgccatctcttcaagtactccatctgtgtagaaacgagcatctacaccgtattgcaagattcgcttttgcaggtttaacaaatttgacagatctgagactatgcgataatattgatttaactaccatagatgattttgctttcgccaaatcgactaatgttagcggcggggttatctggccacctcttaaaaagctttatattggaaacaacaaattgtcttacgtagacagcgacatcgtagcccgttgggactctttgaccgaattagacattagagataatccatggacttgtgactgtgaaaaccaatggcgggtagaaaaaaaaaaaaatatttacattaaactcgataaaaattcaaaaaaacagggtacctgtgctgctcctagggggggggacccaccttccctccatcagc

SEQ ID NO: 436 - DNA, 1289 bp, Diabrotica virgifera
cacagcgctcactggcgttttattaagatcaaaatgccatcttcaccggaggaaacaacttttcctcaaagactgcagtcaagcaacaacttaggtgaacaaaattcaaaagaccaaataaaaaaaaatggttatttcgagcaagatttggtatggaggaatgtaattatatatatagtactccattatctgttaatttttgcaatatggagacttttgaccggtcaaatgaagcttggaacttttatttttcattgtatttacgctacggcttctgtccttggtatcacagctggaaatcatcgtctctgggctcatagaacctacaaagcaaaactgccattgcgaatatttttaatgttaatgcaaacaacgaccatccagaataatatttacgtttgggccagagaccatagactacatcacaaatacacggacactgcagctgatcctcacaactcgaatagaggattcttcttctctcacgttggatggctattaatgaagaagaaccctgaagttaaaaacaaaggaaagaatattgatatgagcgatgtagcagctgaccctgtggttcaatttcagatcaagtattatggaagattagctttacttatggcctatattttaccagcaatatgtaccatgtacctttttggcgagacgttcgcaaactctttattagtctccaatataagacatttactcggtttaaatttcacttggtccgttaacagtgcggctcatctctggggatggagaccctatgatagctctatcaatcccgtagaaaatccatctgttgcgctcattaccttaggagaaggctggcataattatcaccataccttcccatgggactacaaagctgctgaacttggtaactatgctttgaacggaaccactgcatttttggatctaatggcttatcttggccaagcgtacgacctcaagacagtgtccccggagatggttaggaaacgagtggccagaacaggagatggatcatataaacatggtaaagttcctttgcaaaatggtaatgcgaaagatcaccaagatactacgacaaaagatgaaggtttcgtttggggctgggatgacaaagatatgaaagttgaggatattaaagacgctaccataacattcaaaagtagctagcaaaataaaaacactaccatataatattattgtacattaaaaactttgtattaggtctttcagaaacgaataccgactgtatattaatttataggtaaataaataaaaagacatgtctttttaagaat

SEQ ID NO: 437 - DNA, 1152 bp, Diabrotica virgifera
cggagaaacattatagatcaatagataaaggcaaaggtttttgttggactgttctctttcaaactttatctttattattggtgggtctttgggttatatgctgtacctatttatttcttttatatccacactcaagcgatatttcgttgtattagttactatgtatttaacttcctagaagtctaatattagttatctgtctagttataccatactattatgtcagaaacatattaacaataaaaactttcatttgctcagtttcagttgctccaaaaatgtgaaagtaactgatatcgttttacttgctattgtcaattatctgaatattcttgtagatgatgcagccaatgttagtggatttgtctgatcaaatatgtagtatcaagaagaactaacagactgttatgaatgagtcagtgaaaaactttatttaatatagaaggagcgatggcattgctttttgaggaattaaaagtcaaatatcgaatttcaaccaaatgtgcaagaaagctaatgctactgtttccatcttcatatttagttgagtatgaatttagtgctgtaaatgatttactggtaaacaacaaagtaatcggcttgatataacacaaggagacttgagactgaagttaaggaaattggaacctaatataaaatctctggacagcaggcagcaagaatcaagcgccaggagctcatgtaattaaaataaatcaatttagaaaaatctggaaaattaatatttggcatttgaatgtttcattatatgttttaaaaatccacttactccgtttcgttacaaatttcctagcgatttcattctaaaacctatcatattagattttttaatattaaaaattatgtatggcacatagggggcataagaattttagaaagaataaggtggggcgtggcacaaaaggggttgggaaacactgactaagcgttctttaatttcattgtgcgatttccattacaaaaacaagaatttaatcaccaacggacattgctctttttccatttttctaaaatcttgcagacacgcccgcttccacacgctgtcaaatataactaagagtccgagatttggctgaaattttacataggctgtctagagcatgtattacacgataggagatatatcttgcg

SEQ ID NO: 438 - DNA, 707 bp, Diabrotica virgifera
  misc_feature (678)..(693): n is a, c, g, or t
  misc_feature (696)..(699): n is a, c, g, or t
atacagtacgggctgtgtccacgaacattgactaaagatgacgatttcagcaaaatgtcttatagtagtctttgtgtttgtttctatcagcgaagcttacattcaagatgatggaaatactgcacacactgtacctgtacatgtttcttcaagacctcaatgggaaaaaaacttcgagaatggagtaaaatcggctctgccattggttcgtttcgaaaataaactctattacttcggcggtcacacaccgttgagttggatggaatctctaaacttttgcgaaacaattcacatgaagttggcatcaattaattcagcaagagaaaataataaaatcgcgcagttcgcaagacaagcaggtatcagtaatctatattggattgggggagctagattcgtagataacgtcaaatggttgtggataccttatggaagagaagtcgactacagcaactgggccgccggtcacccagttaagaatactcttaattgtatactggggtcgaactggggagtgggcgaacagttcacttgggttgtgggagactgttatgcgcgactgaatttcatttgtgaaagatatgtggatgatgtgggctctacacttgggggcgctacactatcttgagtgatatttaatacaaattatttttttaaataaagtttttttataaatannnnnnnnnnnnnnnnatnnnnatttatag

SEQ ID NO: 439 - DNA, 1274 bp, Diabrotica virgifera
ggaaaactaaagcaaaaggacgacgtaactgtcaagtcatgagtcggagtcgaaagagtcgaaatcgtcgccatattcgctattgtttagtgtttaccactattcctagttgaaaaaccaaaatcccaactgaagtagttcccctatttagtaatttttaatttttttataattttgttggctataaacaaatggaaacagaagaagttgaagttgtggaagttaataaagttaaccaggaagacactgaatattttattcctgttttattaccaacatcttccacaaaacctacactttcaatacattctaggggaaaatattataaacaaacatatcgggcggcttgggagcacatgcccgattttaaagggtggctgaagggggtagaaggtgagcctacaagagcttactgtacatattgccacaagaacttacatgcacacatgaatagtcttttaaagcatacttgcactataagacatcaaaaagctgctcaattaaatagtgctagaaagagtaaaatagcaataaacatgaaggagtccatatcaggcaatgaagatgataaagatgtctcaaatgaagagtctgagttggaagaggaagatgatgagagatctagagaactaaaaccaattagtgaatctactgcagatcaaaacgtcgaaataaaattatttcctgaaaaacctcctatatccactcaagtgatggacatgacgaaaggaaaaccaatttcaggacttcaagttagcctctataaacttattgatggaagatggacttttgttaatgagggaatgaccaatagtaccggaaaattttcagagtttatggatagacctgattttaccaatggaagatacaaactacactatgatgttgatcgatattttgaagccaaaaaacaagaaacaatttatccatttattgaaattatctttaacgctggttgtactgaatctcaccatattcctctattgctgagtccatttggatatacaacatacaaaggaacttaatttattgcttatcttgtagatttaaatatgtcttggatacagttggtactgaatagaaagattttaataccatcacatacatatatcgtagacatagattgtaactcatatctatacagaattgttgaatttcttcattttagtgaattttacgtttccgatatggtgaaatttagcggattttttatacgtgcatatcgagaagattgcatgctgctataaccaataatgtccgataagaatttttta

SEQ ID NO: 440 - DNA, 1082 bp, Diabrotica virgifera
agtggtgggtggtgagatgatattgtaaatctgtttagtcatccattttttagtgtgaagtactagtagaactagaaattgttgtgatatagataatacggaaattaggtgttctgcaagtgcaatcatgaagaaagtgttagttttaacatgtatatgtttaattcaaatatcacactcggcttttccgaatttttacccaaaaatagctgtagagccgatcacagacgatcctggggttcccctgctactcacacctcttatagaacagaacaaaataaccgaagctgtggcagcttccaaggtatatttcaacggatttaagaagattgaaagctactccggttattttactgttgataaaaccttcggctcaaatttatttttctggttcttccccgctgcaactaattacgaaaacgcccctgtcgtgttatggcttcaaggaggaccaggagcatcttcgctgatcgggctttttacagaaaatggtcctttcaaagcaaaatctaagaaaggtttgaaactgagaccttattcctggagtactactcattctatgatatatattgacagcccagctgggactggatatagcttcactaacggaggattcgctcaaaatgaaactaaggttgggcaagatctgtatagtgcccttactcagtttttcacaatgtttcctaatcttcagaaaaacgatttttatgttactggagagtcttatggaggaaagtatgtgccggctatttcgtatactattcataaaaataatccggatgccaatttgaaaataaatctaaagggactggctataggaaatggtttgatcaatccagaattccagttaaattatggagattatttatatcaattaggatttgttgatgtgaatgggcagcaagtttttaagcaagcggaacaagaagctgtcaatacatccagaacaaacagttcgataaagcacaggatatcttccataaactcttagatgatgattacgacaaccattcatcgacattcacaaatatcacaggttttaccaactactatgactatctgtaccctattgatccccacga

SEQ ID NO: 441 - DNA, 885 bp, Diabrotica virgifera
ggtcagctgtgtacgggagttgaagtcgagaaatgcgccttaggcatgtaagtgtggctgtcggagacactcaaagacagcaacatgtacgtatacggtttcgacattacatagacgtgtaatatgcgtgcgagtgcttgatcacggtgaagttctggcgtgaacggtggctcggaggaatcatggcgtcggtggcgggctcgcaagaacagccgcccgccgcgcacggccatagcttctgcaagaagaccttccacaagcccacctactgccaccactgcagcgacatgttatggggcctcatccagcagggcttcatctgcgaagtttgcaacttcgtagtgcatgatcgctgcttaaggactgtggtatccccgtgttccagcgtctccgccagtcaaataagaaatccggttgcacactgttggtcggagtcgtttcaccataaaagaaaattttgcaacgtatgtagaaaacggttagatgacagcgaatccattcattgcgaaatttgtgagtatttcgtacatgtggagtgccaggattttgcagtagctgactgtaaagaaaatgcaacttatcttccgggaaaacaacttaccttcgtgcgtcatcaacatcactggcgcgaaggaaatcttccaagcaattccaagtgtgctctctgtaaaaagacgtgctggactactgaatgtttatccggatacagatgcgaatggtgtggaatgacgagccatgcctcctgtcatacgagtattaatagtgaatgcactttttggattctggaacctatctatctaccaccgcatgctgttagtataccgagaacagaggtaccaatggaggctatcatcggagtacaagttagaagaaaggataccctgt

SEQ ID NO: 442 - DNA, 1026 bp, Diabrotica virgifera
gaagaagtaactaaaaatgtggttaatttttgtgaggttttgtatttaatttttaaaattaagtagaaaaatgcttacatactcaatttgccgtacgtttactaaagaaatagttaaaagtaaataccctttaaaaatatctgtattggactgtgttaaacatttctctcagtttagtcaaaataaaggcaatcattctttgccattgccgaaattgattttaaattactgcacagatattaaaaagaacataaatgtaggtacaatcggtcatgttgaccacggaaaaactacacttacagctgccataactaaggtactacagaaagatggtcttgcaaaatatgtttcctatgatgagattgatagagctccagaagagaaagcaagaggtattacaattaatgcagctcacattggttacagtacgaaaaagagaagttatgctcatacagattgcccaggacatgcagattttataaaaaatatgatttctggtgtgtctcagatggatggtgctatattagttgtagctgcgactgatggacaaatgccacaaactagggaacacttattattggctaaacaagttggagtaacaaaagtcattgtgtttgtaaacaaagctgacttagttgatcaagagatactggatctagtggaactggaaattagagagctacttgaggattttggttttgatggcaccaatacgccatttatatttggatctgcattagaggctatgaatgataaagaaacaaaatttggtatacctgcaattaaagaacttattgcttgtttagatagttatataccagatcctcaaagagatgttacatcaccttttatgctacccatagacaatgcatttacagttcctggtaaggaactgttgttgttggaacaatatttcggggtgttatgaaaaaattgcaagaggcaaatttacttggtttttgacatcagtttaaactactgtacagatatacagtatttaaaaaaaagtgttgcagaggcaaaagc

SEQ ID NO: 443 - DNA, 1066 bp, Diabrotica virgifera
taggttatgtaaagttagaaaaaatcaaaaaaattattttgaatttatttataaaatcttgtttctgtcagttgtgttcaatattttaagtttttaaagttgaatgtggaaatgttaaaaaaggatacataagtgcataatgttttttatgtggaaatttgttcaatatcccctttgtagacaaggcaaaagaacatttcatacatctcctacattaaatgtcttttgggaacgagatgataagggtggatacagaaacttagacaacatgcctcccttaaaagatcgtctaagggaaggcttacatgaattaaagaatgaaattaagctctggacccaagaagttaaagaaagatttgaagatgatcctatcctcatattcagaccaggagaggtagatgttaaatggaggttcggaaatgaggaatcactgaagaactggaatataacaagtgatagtgataataaggaaggattcagcaaagcttcacttactcttacagaacagggtaaagcattattttctggaaatctctctatgagagtacctaaagatggtagagttaaacgttcagggtattgcagtatgaagactcatagagcaaggaaatcatttaaacgagatggacatttggactggacggcttataatatgttagtgatgaaagtaagaggagatggaaggtcatatttgttaaatattcattgtaaaggatattatgatcttacatggaatgatatgtatcattatgttctgtttacaagaggtggaccatattggcaagtagcaaggatacctttctcaaagttcttttttggttcaaaaggacgagttcaggatatgcaacgtcaagtacaattggatcgagttgctagttttggaattactgctggtgaaagatatggtggtgactttgctctagaaatagattacataggtctggagtttgatccaaatcatagggaagaatttgcttatgaaatgtacagaacagatagttatatagcatcaacgtaaaaagaagttgtttgtctttttgaaatttaaataaatatttttattgtt

SEQ ID NO: 444 - DNA, 1207 bp, Diabrotica virgifera
  misc_feature (1110)..(1111): n is a, c, g, or t
  misc_feature (1116)..(1117): n is a, c, g, or t
  misc_feature (1123)..(1123): n is a, c, g, or t
aaaacaggtatgaaaattatctccagcattgcagttaatgttacatcaaaatgaagtccaacgttgtgttagtacttctggttacgttcttctttacgctttcactttctgatccatccagtgatgatgtaattttcaatttttacaaagaaccgaagatatccacagaaattattattagtaagattgatgagttgaaggatgctggatttgatgcaactcatgataccgttcttttgatttacagttatggagatccatcagatttagaaactaaatggaagttgtcgagttcaatttttggagtcgttgctgatctgaatatttttgtcgtcgattggagtaaagcaactacaaaagattacttcgaagctcaaaaggatgtgacaacagttggtggatatattacagagtttcttaatgcacttgtatctaaatatacattaaacttagatagagtcaccatcatcggctgggatcttggagcacacatcgctggaacagctggaaagaaaatggataagaagttatctacgattataggtcttgatcccgctggtccactctttgtaaacaaagacacttccaatcgccttcttgcaacagatgccaactatgtacaagtgattcacacaaatgctctcattaatggattttcttatccttgtggaactgcagattattatccaaatggtggagaaaaccaaaccagctgtggaaacgacataactggagtatgctcgcatcagaggtctttggcattctacgttgaatctctaactagtgataagtttgtgagttacaagtgtgacgactatgatagttacaaaaatggaacgtgcaaacttcaagatgataataagtccataatgggccagtttactaccaaaatagatacaaaggcaagcggtacctattttctggacacgaatgataaacctccctatgccaagggttaaaatctgaaagtgtttttatatttattacttagacctaggtagatgatcatgaaattataagggtttgtcttatattatatgttaaatatagttaattgacaattgtatttacaataatacaatcaaagaaataaagttaaatttcgaaaannaaaannaaaaanaaaaaaaagaaaaaattaaaaaaaaaaaaaatgggggggggggggggggcccccacccccccattaggggggggtttaaaaatt

SEQ ID NO: 445 - DNA, 871 bp, Diabrotica virgifera
ctctacgcggccgccattcttaaattaagcgagcgaaaagccacttttaattgtgatttaatgctgcgtttaatattttttaagaaaaatacggtttagttacttagtctatgaaaaactgatcgccattccactaaatgagaaaaccatgctatgaaggactatgatctacccaaagttcactccttccagatgtttattatcaattactttaacaagtttagtagtagtgttactctttatctcttcttcaaacgatagtacaagcgaagtaatatcacctgggagaatctttaacaatgaaatcaaaccaggcagaaactacacaccaggagactttgtcaactatctttatccagagccatctaacgaaagttactgcaccttcaattacaacgtccccaaggattttaattatggaaatgccgacgtagactttggaccggaattgggaaaagaaacttcctacagaattgtctacaatgtacttatggctcagatggcggacggaattccagaggtgacttacgctactcacgtatccgctgattttatgtattttttgccagaactagttagatattgggatggctttattagtattactgcttttgttcccgatttagatgttagccatgtaatagagcaagtaaaccaatactgctactgtcttccaggaatgtcacgggtgtcactgcattttgtctttgatagatttgtatcgccttctaggaaggatgtgtattttaccaaaccaaataattgtgaattaatagattcttcaaaaataaaaacttacaggcatgcagacgacagtgtaatgtatcccattaccgtgtgtcgcaatgcaagcgagaactgctgcagtaac

SEQ ID NO: 446 - DNA, 992 bp, Diabrotica virgifera
agagtgagtgagacaatatatttagtaggaatgaaacaaaatttccgatttggggaaagccggctctgtagtgctctgtgtgtgttacaaacggtactcatatctgttacgtacgcgatgtctaccaatacagatattaagacgttctttccacaaataaatggaaattttagtcttgtaacttgggcacatgcagttaatgataaggaatacctcaaaaaggtgcttaacaatgataaaataatgatgatagaagcagatatcgttattggaaaactcagtaaccaagaagacaatattccaattatggctcatccacccaacaaaacatctgacttaagtttggaagattttttagaccaaataagcgacttcaatgaacaagcaggcattaacaacaggcaaggaaaaggggtaaaactggatttcaaggaaactgtggcatttactagtagtattgaaattcttaaaagactaaaaaaaagacactatccattatggctcaacgctgatattctagctggatattttggaacagcaaacaaaactgaaccagtagatgctaaaacgtttttggcatatgcaaataatgttgaacaagtaacattgtctttgggttggaccacttgtaaatgtgttccagatcaaacgtatggaaatatacaaattcaagaaatgatagacactattcatagtaatcatgtaatcaatactattacctttgccgtcagagcttgtttaatagccaacacaaatagagacaagatgaaagagctgttagattcaactaagaataataattctagttttactatttggtcacatcaccaggacgaagttaacattgacagtttgaagaaaattattgctcaatttggagttgaatcatgttctttgacgtactcaagaattgcgagaacagttagattgatacataaaataaattgttaatactgatttaatgatattaatataaataatttgtacaccct

SEQ ID NO: 447 - DNA, 989 bp, Diabrotica virgifera
  misc_feature (925)..(925): n is a, c, g, or t
attataaggaacaaaaaagatgaatatgcaagaaattaataatattgttataaattaccagaagataagtgttaactgtacttcatagagtctagattatcctaataatacttagataataatcagttttaagattttcaaaatgaaaaattctaccgttcgcaagttgtagtagactgattattttccgaaatgcattttgcatatcaaaagtaaaccgccaatatggcaaaatattttcgacgaaactttggtaatatttcagttaataaaacgcacaacgatttggaatggttacttgtggataattccatatcaaattattatacctagaaatacatacttatcgaactcgataccatcaattaaatatttaatttattttacttgttaaacaccaaaatcaattgcacacagattgtgctgacattgacgtttgacatttgacgtatggtacataacaatactttcgttataaaaaaaataaataaaagcaaatactaaagtaacgatatttttatgaaccatacatttttaaacgaaataattacgagatgcaaaaatgaaatattaccaattcgtcctcttaggttttaaccgaattcaacctaaaataataacgtaactatttatttaattagtattacaactttaaattataaagcgaataataaaacagttataacctaagaataattacaagatctcaataaagggctatgaagccgtaaaaaaagtaataattttgatatgttgtgctacacattgttaatctgcattgtatattacttaaaatattttgtctccaagaaatattccagattcaagcaattaagagaacttaatataacagaaatgatatggatttctgaagataaaataatacctatatttgaactgatttttaccattttctatttattgnttttctttagtttactcaaattgttcatgctcttttataaaatggtttaaatatataataaagt

SEQ ID NO: 448 - DNA, 1945 bp, Diabrotica virgifera
gagtttcttcttgcgtaaataatttggtatttttttatgtttattgattccgtttatcccttccatttttttcgattattattcctgtggaatagattcgcgttttctagtgtcttctcgtactaatatctcctctatagaaactaaataatataaaaaatatataagacaaatataaaatctgttacacaactgtcattagagattgaaataaagcttaagattttttaacttgcctacaatagagttgataacaggttttgtttcacatctctatacttatgcctgtaaactgtagaatctgttccgaatgtcagcattaagttacacattaactgccgatatctgttctttcttaaataattgccagaaaatttcgtctaatcttcaacgccataaatgcaatgtaaaaattaatcttagtatacttgtgagtgcagaaggtgtgctattgcctttttaaacacatggcatacttacattatattatcgttaaatgtattcctatccagacctcgttccaacatattgcggctaggagcagaagaataagacagctgacaagctaacctactgacagttgacattgacattattattatgaatgacacaaaatgtatttaagttcagtcatcatttttatataaaattcacatcttattgctaaatattattttccagttatttgattataaagatcagtgcaacgtagtagcctatataaatattctaaatctactcacagccaagaagaaacaggctaaacccgctaccttattcggaaagttggttacgtgatgattatgaatttgactctttttattagctgtgaatatgtatttagtaataaaatatactttatatcaaaacggtaactttgcttcacaatagggctatttattgcatcattgccaccatttttctcgcacacttgacatatgacatacaatatgcgtcatacgtctttgatatataattggtatataccaatgacgtattacgtatatattgtacgtcatatgtcaatagccatctggaacatgcgcatatcgtaatatttcactattatctcaactgtcacttacctctgcaaacaggtattcaaatgcaggtctggaaactggctttggttaagattacgcctaacggtagcataatgtaggtgtgttataactaaaaataaaaagaatcctacacttacggacacctacgatatgtgttaagcactgttaaaatgctatagttctattataaggaacaaaaaagatgaatatgcaagaaattaataatattgttataaattaccagaagataagtgttaactgtacttcatagagtctagattatcctaataatacttagataataatcagttttaagattttcaaaatgaaaaattctaccgttcgcaagatgtagtagactgattattttccgaaatgcattttgcatatcaaaagtaaaccgccaatatggcaaaatatttttcgacgaaactttggtaatatttcagttaataaaacacacactatttggaagggttatttgtggataatttcatttcaaatattattcctaaaaaaacctacttatccaactcaaaccctcaattaagtttttaatttattttacttgggaaaaccccaaaatcaaattgcaaaccaaattgtggctgaccttggacgttctgaccttctcacctaaaggggaaataccaaaccttttccgttatcaaaaataaataaatcaaaaatccccctaccttaggggtaccgaatatttttatataacccatttattttttttaaaccaaaataaatttcctcttttgccaaaatgggaaaaattttaccccattccccccccctttaggctttttaacccgaattttaaaactaaaaaaaaaaaaaacctataaaataattttttttttattttcataaat

SEQ ID NO: 449 - DNA, 800 bp, Diabrotica virgifera
aaaatctatggtagttatttatccattttcacatttggatttaggaaaaataaatctattcattttgaagagctacacgaattaatatggccaaatactttggcattgataaattttttgtgtttttaaacacaatcaaagaagctggaggaataagagcttccttgtataaactttataggatggacaacttgagaccgggaacactggtcggtacagacaagtacggaaataaatattacgaaaatcctcattacttttatggcagaaatcgatggattgaatatgcaccttactatggtttggactatgatggaagccaggttcctgctgaatggtttggctggttacattacaaaactgaccttaccccagataaggatccatctagaccaaagtataaatggatggcagatcacacagaaaatttaagtggaactccagggcagtatatgccatattccactactagacccaaaattgaagcatggacccccccaggaaaatagaaaaatgttattttgtgtagtatattgtgaattttatgtataaataaattaaaataaatctaaaaagtcaaacatcagtcttccagttttatccagaaaatagtgaacagatggaactagttacatcgcaggcaatgaaggcgggattctatggaggagtagttgtagattatccaaacagtacgagagctaaaaaatactttttagtactgatgactggaggtagtgtacctttgccagccgctttaggtaccgaacaggattctcaaggcgtttcatataccgcaaaga

SEQ ID NO: 450 - DNA, 1308 bp, Diabrotica virgifera
ataacaaggatattcagcataattgcagaggcatctttcaggtagtctatggaggcatccaaacctgaagcctttagaatggtaaacatcgttaggcaagttcaatcaaacgaatcgtttttccaaagcgtggtccaatctctggctccagaactgcagcaagctttacacgtggccctacatacaacagcagcagcagcgacatcttagctgggaatataaatttaagttattgtttttaacattcatttgattaattcagagttgaaataaaacattatgaactgttatcggacagttctaaagaaatttgcatccataaacgacatttagacttttgtcgcttattacttttggtaatcgaaaaatgttggcgattcatggcattgtttgtggttaacaccttcgctgcgtttagagatatttataaacttgcgtgaactgcgttacgacccacatatgtttaacaaagccatttaaaggctgcttgattcgaaaattaaagatattgttacgacagttctgtagattgatcctacataaaagaaaaagttccttaaaatgggttggtaggtttatttgaagataccaatttatgcgctattcacgctaagagagtcgccattatgcctaagaacatccagctggctagaagaatcagaggagaaagggcataaacaaatgtaatataagaaattaatcttgaaagacaagaaaggtacatcttttgcaagatgctggctagaagaatcggaggagaaagggcataaacaaataaaataaggtacaccttttgcaagatcagataattttcgacatattgtctacgcagccaacccttagtgtaatacgaggtctatatgtctcataacgcagcgaaggtgttgatttcatataaacatgacaatgttttttattaaactgtaccttttgttttcttttgtgattttccttaagtgttttaacctaagtctaattatctaaaagggatgcacattgttttagaatatccatatataaattatttttatatttgtgagttattgatagataaatctcgtcatgtgtagtggttacatagaaattttttacgaaacttttttataattacctaatcacaggtatttgttttatggattcattattattgtacatagatattcacaactctgaagtatatgtgatacgtttttgttttcattaaaattcataaaatatttttgtctacaagatcgacgttagtgtttaaaagttgaatatgaatcactaatgaactataaaatatctcaataaaatgcatttctcgat

SEQ ID NO: 451 - DNA, 1599 bp, Diabrotica virgifera
cggacgcgtgggataattgcagaggcattcttcagggaggctatggaaccatccaaacctgaaggctttagaatggtaaacatcgttaggcaagttcaatcaaattatgaagtataataactcacagattaaccttgatgaaattattccactgtggttctcgtggttgccagttatagaagatgtagacgaatcgcctcatatttatgggtatatgtgcgatttaatagagcagaataatcaacacattttaggcgtaaataattccaatataccaaggataatcagcataattgcacaggaggcctttgtcaaggaggctatggaaccatccaaacctgaaggctttcgaatggtaaacatcgttaggcaagttcaatcaaacgaatcgtttttccaaagcgtggtccaatctctggctccagaactgcagcaagctttacacgtggccctacatacaacagcagcagcagcgacatcttagctgggaatataaatttaagttattgtttttaacattcatttgattaattcagagttgaaataaaacattatgaactgttatcggacagttctaaagaaatttgcatccataaacgacatttagacttttgtcgcttattacttttggtaatcgaaaaatgttggcgattcatggcattgtttgtggttaacaccttcgctgcgtttagagatatttataaacttgcgtgaactgcgttacgacccacatatgtttaacaaagccatttaaaggctgcttgattcgaaaattaaagatattgttacgacagttctgtagattgatcctacataaaagaaaaagttccttaaaatgggttggtaggtttatttgaagataccaatttatgcgctattcacgctaagagagtcgccattatgcctaagaacatccagctggctagaagaatcagaggagaaagggcataaacaaataaaatacatattaaaaatgtaatataagaaattaatcttgaaagacaagaaaggtacaccttttgcaagatgctggctagaagaatcggaggagaaagggcataaacaaataaaataaggtacaccttttgcaagatcagataattttcgacatattgtctacgcagccaacccttagtgtaatacgaggtctatatgtctcataacgcagcgaaggtgttgatttcatataaacatgacaatgtttttttattaaactgtaccttttgttttcttttgtgattatccttaagtgttttaacctaagtctaattatctaaaagggatgcacattgttttagaatatccatatataaattatttttatatttgtgagttattgatagataaatctcgtcatgtgtagtggttacatagaaattttttacgaaacttttttataattacctaatcacaggtatttgttttatggattcattattattgtacatagatattcacaactctgaagtatatgtgatacgtttttgttttcattaaaattcataaaatatttttgtctacaagatcgacgttagtgtttaaaagttgaatatgaatcactaatgaactataaaatatctcaataaaatgcatttctcg

SEQ ID NO: 452 - DNA, 3301 bp, Diabrotica virgifera
gttgcagaggctgcgttagatcgtctagcttgtggattagggggtaaaatcattcttcctctcgttacacaaagtgttcccagtatgttggcaagtccagattggaagcaaagacatgctgcccttatggctctaagtgctgttggagaaggttgtcacaaacaaatggagggtatgcttcaacaaatcatgaatggagttcctggtgtaatggatggtgttatacgatatctacaagatccacatccaagagtgagatatgcggcttgtaatgccgtaggtcaaatggcgactgattttgcaccagttttcgaaaagaaattccacaatcaagtagttccaggtttgcttatgttactggatgataatgccaatcctcgagtccaggctcatgctggtgctgctttggtaaatttcgctgaagattgccccaaacatatactgaacggatacttagaaccactgatgagtaaactagaaggaattctaactgcaaagttcaaagagttggtagaaaagggcacgaaattggtattggaacaggttgtgacaacaatagctagtgttgcagatacagctgaaactgaatttatagcttattatgaccgcttaatgccatgcttaaaatatattatccaaaatgctaacaaagatgagcttaaattactcagaggtaaagctattgaatgtgttacattaattggtatggcagttggatccgaaaaattcagcatagatgcaaccgaagttatggatatgttattgaagacacatggagatggagctgaattacccgacgacgatccccaaactagttatcttatttccgcttggtctagaatatgtaaagttcttggtaagaatttcgaacaatatttgcctttagtaatgggaccagtaataagaacggcagctatgaaacctgatgttgcccttttagacaacgacgatatgcaaggagtagaaggtgatgacgattggcaatttgtatccttaggagaacagaagaacttcggaattcgcacggcaggtcttgaagacaaagctgctgcctgtagtatgcttgtttgctatgcacgtgagctaaaagaaagtttctcaaattatgctgaagaagtcgtcaaacttatggtaccaatgctcaaattctacttccacgacggcgttagaaatgctgccgcagaatctctaccatggctattggaatgtgcaacaaataaaggaccagccttcttaggcggcatgtggagttttatatgcccagaactgctcaaagccatcgacaccgaacccgaaagtgaagttttaatggttatgttagactcattgtcgcggtgtattcaaaaattaggaccgagttatattgatcaagaatccatgactgaaattttgaggataattgacaaattaatgaaagaacattttgaacgagccaatgatagacataagaaacatttagacgaagattatgatgaggaagtacaagagcaattggaagatgaagaatcagacgatatatatgtactcagcaaaatagctgatgttattcactccctatttctagtatacagagaaagcttcctgccgttgtttgatcagatttgtagtcactttgttaatctcttaaccccaaatcgcagctgggcagataggcaatggggaatatgcgtatttgacgacgtcatagaattcacgggtccagcatgctcaaaataccaaggctatttccttcaacctctggccttatatatgaaggacaaaaccaccgaagtcagacaagcagtggcttacggatggggagtgctagcgcagtttgggggtgaacagtttgcaggagaattagctaaagctgtacccatgttagtcgaagttataaacgaacctgaatcgaaagaccctagaaatattaacgctacggagaatgctatatcggctgttactaaaattatgaagtataataactcacagattaaccttgatgaaattattccactgtggttctcgtggttgccagttatagaagatgtagacgaatcgcctcatatttatgggtatatgtgcgatttaatagagcagaataatcaacacattttaggcgtaaataattccaatataccaaggataatcagcataattgcagaggcattcttcagggaggctatggaaccatccaaacctgaaggctttagaatggtaaacatcgttaggcaagttcaatcaaacgaatcgtttttccaaagcgtggtccaatctctggctccagaactgcagcaagctttacacgtggccctacatacaacagcagcagcagcgacatcttagctgggaatataaatttaagttattgtttttaacattcatttgattaattcagagttgaaataaaacattatgaactgttatcggacagttctaaagaaatttgcatccataaacgacatttagacttttgtcgcttattacttttggtaatcgaaaaatgttggcgattcatggcattgtttgtggttaacaccttcgctgcgtttagagatatttataaacttgcgtgaactgcgttacgacccacatatgtttaacaaagccatttaaaggctgcttgattcgaaaattaaagatattgttacgacagttctgtagattgatcctacataaaagaaaaagttccttaaaatgggttggtaggtttatttgaagataccaatttatgcgctattcacgctaagagagtcgccattatgcctaagaacatccagctggctagaagaatcagaggagaaagggcataaacaaataaaatacatattaaaaatgtaatataagaaattaatcttgaaagacaagaaaggtacaccttttgcaaggtgattattttttgtttaaaaatttgacggatcggggcactgggattaagccgataaaaaaaaaggggtccaccttaccctgcaaaagtaaaactatttttttgtcacagactcccctacgcgataaaattatcttgaatgactagaacaggatgttagttaaacatgtgaaatctatgaacatgattgacttcgcgagagcgcagttcccattcgctttctattacattatagtagcagagcttgaaacctttggagactgcgtccgtcccttctcgtaagttaccgtgtggactctcataatagacgtgttggaagcatatgcccccggtatgatgaacactacctcactgtacgacaagtgtgtctaggacagggaagcagatattgacagattctgctacgcagacacgagcagcctgatttgggtatcaact

SEQ ID NO: 453 - DNA, 1250 bp, Diabrotica virgifera
  misc_feature (10)..(10): n is a, c, g, or t
  misc_feature (60)..(61): n is a, c, g, or t
  misc_feature (63)..(63): n is a, c, g, or t
  misc_feature (67)..(68): n is a, c, g, or t
  misc_feature (70)..(70): n is a, c, g, or t
  misc_feature (89)..(89): n is a, c, g, or t
  misc_feature (155)..(155): n is a, c, g, or t
caagcaggtnttagaccagatctttcctgcatagatcacattaatactgtgaggtatatnngnacanntnggtgaatggacacacctcntatacatggtttgttgatttcgaacgtgcctttgacagcctatctcatgctgctatatggaaaatntagagctaagaaacattctacataaaataatttcgattataaagtcactgtacacggaggcgacgtgcagcgtgacacacaatgggatcaacagtgatgaatttgacgtacttactggagtcagacagggatgtgtgctttctccgtttctgtttaacatagctctagactatgttctctccaaactagacttcgacacaaaagggatacgatggacgttaaccacacgcctaagtgatctggaatacgccgacgatatctgcctgttaggacaaaggttccaggatgtggccgaccaattggaaacactatccactgaggccaataaaataggtttaaaaatcaatattagtaaaaccaaatccatgagaataaacgcaaggaacaacacgctatttaatattgacaatatgcagattgaaaatgtggaaaacttcacgtatctgggaagtgtcataacagagagcggaggtacagaagacgatattcgtatgaggatacgaaaagctcaacaagctttcagcatgcttaaccctgtttggaggtctggagaatatactacaaggacaaagatccgaatattccagtcaaatgttatgtctgttctactctatggatgtgaaacctggaaagtgacaaaataccttacagacaaattgcaggtctttgttaacaaatgtctacgaagaattgttcgtattttctggccaaacaccatcagaaacgaagatctgctacacctgacccaacaaaagagggtagaaaatgaaataaaatacagaaagtgggggtggataggtcacacactccgaaaagatagttccagtattgcaaaaaatgccctagagtggaatccccaaggaaagagaaaaagaggtcgcccagcacaaacttggagaagatccatcatggacgagataagaagtcaaggaaagtcttggaatgaggtgaaggccctagcgcaaaatagaacccgatggcgcgttttcactgaagctctatgctccacttaggagttcaagaacattatatattatatatataaaattacaatagaacgagttcagaattataactatttagggatactttaac

SEQ ID NO: 454 - DNA, 1132 bp, Diabrotica virgifera
ggcgatttcgtggcgtgccacaaacgagaaacttgggatctttcactcaatttctggttctggttaggttggaatgatctaacagaaggaaacctactgttagtggaaataagtgatatttagtagttgtgataaattaaaccaacaaaatgaaatctggattgttattcttagttcttgctctattttcctttgcccattgcgaatcagaagatgatacaggtccaagactactagtatcaaagcaaatcttaaacagatatttagtagaaactaaagatattgaagttaaatacaccatcttcaatgtaggaacttcagcagctgttaatgtccaacttgtagataatggtttccatcatgaagcctttgaagttgttggaggtcacttgcagtccaaattcgaaagaattccacctcaatccaatgttacccatgttgttgttgtcaggcctttgaggtatggatatttcaacttcaccagtgcagaagtatcctacaaggcatctgatgatgcatctgtcaaaatcaaacgttctttgagcagtgaaccaggtgaaggaggaatcattgccttcagggaatacaacaagaaattctcatctcactattgggactggttggccttcgccctcatgacaacaccatcattggttattcccctagttctttggtacagcagtaagagcaaatatgaaaaattgggaaagcccagcaagaagatccattaaacagtgaaaagtggtgttttcatcaaacattcatgatttctatcatcctagttcattgtaaaaatctttttttataatttttctgttgttacattgtttcatgttttatatgaatacatgctgcgtaaaatgagacttagaataaattattttgtatttatgtacattaaagacagtgaaataaacatgttttcataataaaaaaaaaaaaaatccaaaaggaacacacatttagaaatttttttgatgaaaccgttttttttttttttttttttttttttttctatattttctttttttctggccccccattttatttttttttttttaaaaaaaaaaaaaaacaaaattcccaaaaaaaaaaaacaaaaaaccccaccccccttttctccttttttttt

SEQ ID NO: 455 - DNA, 1075 bp, Diabrotica virgifera
  misc_feature (1023)..(1023): n is a, c, g, or t
  misc_feature (1028)..(1028): n is a, c, g, or t
  misc_feature (1059)..(1059): n is a, c, g, or t
gtgacagacaagaggcagctactattaacgatacaccgctctctcgttagtgttcatattttacgtgtagtgtaacagaaagtgcagttttttattcaccatgtctaaccgcaacatccctatcaaaatgggtgacttcagtgttatcgacacggagtttagcagcatcagggaaaggttcgacgccgaaatgaggaaaatggaagaagaaatgaacaaattcagatctgaacttaccagtagggaggcgaacaacttcttcagaagcacaaccaggtcgtacgaatctgaaacggtgactggtggaaataagtcttcatcgacgtccagttcaacgacacagcaaagcagcacaggatcagatttagcccacagagcaccaagtggtgatgtcagaacatggtacgacgatctcaactctcccctaatccaacaggacggtaacgaaaagagcctaaaattaagattcgacgttagtcagtatgctccagaagaaattgtagtcaaaactgttgataataaactcttggttcacgccaagcacgaagagaaaacagaatcaaaatccgtatacagagaatacaatagggaattcttgctgcctaaaggaacaaatcccgaacacatcaagagctccctaagtaaagatggcgtcctcactgtcgaagcacctctcccagctatcacctcaggggaaaaattaattccaatccaacattaagtaatttaaaattccttgtaagccttcgaagcgtttatgtccgctagtaaatactcatcgattaattatttaaaatgtaacaactcatgtgactaacaaaatttttattttatttcattttttaaaacctggcaacgttgtctggcttgtttatgataagtcacaaatttagtgttggctttaaagtacttactgtctacacagcacaagtcacaaatcgttaaatacaccataaacctcatgcatcgttgccggatggttcaaaagctcatactatttgtgactatcttcttgatggcggncgtanatttgaaaggtgattaacatcctttcacaangcttaatttatgcatg

SEQ ID NO: 456 - DNA, 1209 bp, Diabrotica virgifera
cattcggtgacagacaagaggcagctactattaacgatacaccgctctctcgttagtgttcatattttacgtgtagtgtaacagaaagtgcagtttttttattcaccatgtctaaccgcaacatccctatcaaaatgggtgacttcagtgttatcgacacggagtttagcagcatcagggaaaggttcgacgccgaaatgaggaaaatggaagaagaaatgaacaaattcagatctgaacttaccagtagggaggcgaacaacttcttcagaagcacaaccagttcaacgacacagcaaagcagcacaggatcagatttagcccacagagcaccaagtggtgatgtcagaacatggtacgacgacctcaactctcccctaatccaacaggacggtaacgaaaagagcctaaaattaagattcgacgttagtcagtatgctccagaagaaattgtagtcaaaactgttgataataaactcttggttcacgccaagcacgaagagaaaacagaatcaaaatccgtatacagagaatacaatagggaattcttgctgcctaaaggaacaaatcccgaacacatcaagagctcattaagtaaagatggcgtcctcactgtcgaagcacctctcccagctatcacctcaggggaaaaattaattccaatccaacattaagtaatttaaaattccttgtaagccttcgaagcgtttatgtccgctagtaaatactcatcgattaattatttaaaatgtaacaactcatgtgactaacaaaatttttattttatttcattttttaaaacctggcaacgttgtctggcttgtttatgataagtcacaaatttagtgttggctttaaagtacttactgtctacacagcacaagtcacaaatcgttaaatacaccataaacctcatgcatcgttgccggatggttcaaaagctcatactatttgtgactatcttcttgatggcggccgtaaatttgaaggttgattaacatcctttcacaaagcttaattatgcaatgaaaataatttttaacaactttatttgtgacaaaaaaattgaagctaatgtaaaattgtttggttaaattcttgtgaaggtctatggttcgatgttcaataaccagcaatttcaccgtaggcgtagtgtaacaaattgtatcatgtgtaggatatttacgaataaattatttttaatctcgt

SEQ ID NO: 457 - DNA, 1450 bp, Diabrotica virgifera
cgtttatacgaaaatcataatatcgtgaagtataagactaataaaaataattgtatattgtatgaaagtttttgttgtggaaccacttaatgtgatagagatattttggagtactaacggcacatatgttaaccaaacttcaataaaaggtgttctaagcgacccattaaaatcaggtgacgtgatacaactaagttgtcatcataaatacacctttcaaaatggtcctaacgatgatagcattagcgatgaacaattgtgcagaatagcagatacagtgttagaaactatcgaagtagctgccgacacttcactatcagctccacctcctgaaccttatcctgttacgctacaacttgatgtgtatccagattcttctgtaccccgtcctattagacacccggttagtgatacttttcaaccgtcaaaacgattaaaaacgatcaatttaatcccctccacttccgtttcaactaatgttattgatttaacagtagataattttattgaaatcgaaaaccgccgtgatccatctactagtaccaatgttaacggcgaatctctcgagaccattacactggacgatagtagtatccaggtaatatcaataacggtgacacattcggtaaatgcaaattataaacaaaaatataaatgcattagttgttttcaaacgccaaaaataaatgtgtagactctcattatatcggtattccggaatttttgtttgtattttgagaaataaattcttgattatttatttgtaacaacaattttataatagaccaaattctagcgatgtattttagtatttattaaacattttaaacaaatgactattgtaaaaattgtagatggtgacggtagaaacagtttgttcagtggaggtgcaatcttcgaaaattaataatagtcaaacggcttgtactagtgatacaaatatggggcagatagagtcccataaacccgagagcgacagtaacatgatgtccgaatctcagatggagaatgaactacagtgtgccatttgcgccgaaatgttcgtcaaggcatcgacactcaattgttcgcacacgttttgcaaattttgtatagacaagtggaaggaaaaacagacgatttgtccgatctgcagaaccaaaatcacctctcaagtaccaaccctagtcttagataattttatagaaaagataatacaaggttctgcacaagatatacaggaccatagaagagaattgctaaacgaaagggcgcagatgcagaagcaccagcaaaatctgttagaacaacaacaacaaccacgttcagatacgagacgacaagggagaagcaggcgagttcaggtagcattcgatcccgagccggtcgttatggatggggatgattcgtcttctagcagcgacacaacgtccactgagtccgacagtggacaagaagacgccgaatttga

SEQ ID NO: 458 - DNA, 1670 bp, Diabrotica virgifera
cccacgcgtccgcccacgcgtccgcccacgcgtccgcccaccccatattctttccataatggactgcgaggtggcaaaactaagagatccagatttgcctctgccacacgggactgatgacaaaaccacaaactcttctaattacggaccactcaccattgataattggtccagataaggtgttgcaacagattttggaccaaatgatgtgcagaaagaatttaatagtttgaatgtcagcaaggtggcaaggttagtaatttttttaatttaatttttcattttctcaagatatttagacagaattaactgcttatactatttccgcttgaatttagtggctctagaatacagctaagagatgttggtaagattcggtaattttggtaatgtggtccctttgctggtccagaatggacagcaacaacagcaaaggggtatggccaccctgaaggcaatttccatccgtttgaaatcggtcaagaacatccagaaaataacacaatccatgaagatggtgtcagcagccaaatacgccagggctgaaagggaactgaaagctgtgcgccccatcggtgatggagctagccagttttatgagaaagctgaaattcaacccttagctgatgtgcctcagaagttagtaattgctataacttcagacagaggtctatgtggtgctgttcacaccagtgtctctcgttacattcgtacagaattgggcaaagatgatcaaaacattaaagtggtttgtgtcggagataaatctcgttcaatcttgcaacgtatctatggaaaaaacattatgctcgcctgtaatgaagttggacgtttgccccccactttcattgatgcttctaaattggctgatgctgttttgaagtctgattacaagttcagcacaggagaaattgtggataacaaatttaaatctgttagattcttacaacacacagacatttatgcctgtacagccgcgccaaaattatcagtatgatgttgacagtaggctaccttccccaccccccccccccccgtggtggtttttgtgggggagggaggggggggataaatatccccccgggggggggggtccccccccccccgcgcggggaaaaaaaaaaaaattttttttcccccccccggggggggggggggttttttaaaaaaaaaccccccccccccccccccccaccccccgggggggttttttttttttttttttcttcccccgcgggggggggggggggggggggggtgggggggaaaaaaaaaaaaaaaaaaaaaaaaaaaaaaaaaaaaaaaaaaaaaaaaaaaaggggggtttggggggttgtgttttttttaaaaaaaaaaaaaaaaaaaaaaaaaaaaaaaaaaaaaaaaaaaaaaaaaaaaagaaaaggggggggggggggggggggggggggtgtgtttttgttttatatataaaaaaaaaaaaaaaaaaaaaaaaaaaaaaaaaaccacccctccgggttgttgtttttgtaaaagaaaaaaaaaaaaaaaaaaaaaaaaagaggggggggtttttttttttttttttttttttttttttttttttttcccctccccccccccccccctccctttttttttttttttttttttttggttgttgggggggggggcggcgcgcgcggggggac

SEQ ID NO: 459 - DNA, 1950 bp, Diabrotica virgifera
cccacgcgtccgggggtcggcctgcaaggtggcaaggctaagagatgttggtaagattcggtaattttggtatggccaccctgaaggcaatttccatccgtttgaaatcggtcaagaacatccagaaaataacacaatccatgaagatggtgtcagcagccaaatacgccagggctgaaagggaactgaaagctgtgcgccccatcggtgatggagctagccagttttatgagaaagctgaaattcaacccttagctgatgtgcctcagaagttagtaattgctataacttcagacagaggtctatgtggtgctgttcacaccagtgtctctcgttacattcgtacagaattgggcaaagatgatcaaaacattaaagtggtttgtgtcggagataaatctcgttcaatcttgcaacgtatctatggaaaaaacattatgctcgcctgtaatgaagttggacgtttgccccccactttcattgatgcttctaaattggctgatgctgttttgaagtctgattacaagttcagcacaggagaaattgtgtataacaaatttaaatctgttgtatcttacaacacacagacattgcctatgtttagcttggctgctgttacagccgcgccaaaattatcagtctatgattcgttagatgacgaagtagtccagagctaccttgaattctccttagcgtctcttctgttctattccatgaaagaaggtgcttgcagcgaacaatcatcccgtatgactgccatggacaatgccagcaagaacgccggagagatgattgacaagctgacattgacattcaatcgtaccagacaggctgtcattaccagagaacttatcgaaattatttccggggcttctgctctttaaaattaaatccggaagggttattaatggaactggtgatctatatatttatctttaaattttaatgggttggagagtaaattaaaacaagatcatgaggtagatcagaaatgctctagttgcttttactttttttaatgggttagccaaacatggatgacaaacgagtaatacaggctgttactgtaagttgttaaactattaaagaaaatactgcctaattgaacagaagcctgttttttaaactaattaattttttctaaattctaaaatggcgccgacataattttgcagccaggtataagataagaaattggatttaagcccaaattctctcgaaacaatttttgtcataacattatgctgtaataactgttcaaaagtaatggtggaaattcggtatttttagatatttatattaaataataattcctaggtgaatgcaagttattatctagaaaatttgaaggtaacaatatagtttcattagaatcatttcagtaactcttttcgcaatttttgtcttaaaaataattgagaaacgctgtagggttaaaaatttaagttacaagaagttagattttaggtgtaggcttaatgttttgttttaaatactgctctggatggtgcagtgaagatgaacgtaaaaagaaagtaagcccaaattctcaattgaaaaatttttactttcatattcgctgtggcattgagttgatgtgaagaaatggtggaaataaaatttataattgtatatataaaagtaatggtggaaattcggtatttttagatatttatagtagataatgattgctaggtgaatgcaagttattatctagaaaattggaaggtgacaatatagtttcattagaatcatttcagtaactcggttcgcaatttttgtctgaaaaataattgagaaacgctgtagggttaaaaatttaagttacaagaagttagattttaggtgtagacttaatattttgttttaaatactgctctggatggtgcagtgaagatgaacgtaaaaagaaagtaagcgcaagattcctcgaattgtaaacaattttta

SEQ ID NO: 460 - DNA, 1665 bp, Diabrotica virgifera
attagagttagcggggcatggggttaatctattccacaaattgtcaaattggcattagattcttcagtttacaatttattgctaatgtaaaactatagtctcgtttttcatttgaaaaattggttaaatatatttttttatgtaaaatttgatggtgctgcttgtaaagtcaatattgctttctaaaaattaatttatgtaagatatatttacggtctattttcctttgaaagtccagttgatcctaacgcaagcgcattctttatcaaatcacgaagtcactcgattttctggggtcggcctgcaaggtggcaaggctaagagatgttggtaagattcggtaattttggtaatgtggtccctttgctggtccagaatggacagcaacaacagcaaaggggtatggccaccctgaaggcaatttccatccgtttgaaatcggtcaagaacatccagaaaataacacaatccatgaagatggtgtcagcagccaaatacgccagggctgaaagggaactgaaagctgtgcgccccatcggtgatggagctagccagttttatgagaaagctgaaattcaacccttagctgatgtgcctcagaagttagtaattgctataacttcagacagaggtctatgtggtgctgttcacaccagtgtctctcgttacattcgtacagaattgggcaaagatgatcaaaacattaaagtggtttgtgtcggagataaatctcgttcaatcttgcaacgtatctatggaaaaaacattatgctcgcctgtaatgaagttggacgtttgccccccactttcattgatgcttctaaattggctgatgctgttttgaagtctgattacaagttcagcacaggagaaattgtgtataacaaatttaaatctgttgtatcttacaacacacagacattgcctatgtttagcttggctgctgttacagccgcgccaaaattatcagtctatgattcgttagatgacgaagtagtccagagctaccttgaattctccttagcgtctcttctgttctattccatgaaagaaggtgcttgcagcgaacaatcatcccgtatgactgccatggacaatgccagcaagaacgccggagagatgattgacaagctgacattgacattcaatcgtaccagacaggctgtcattaccagagaacttatcgaaattatttccggggcttctgctctttaaaattaaatctggaagggttattaatggaactggtgatatctatatatttatctttaaattttaatgggttggagagaaaattaaaacaagatcatgaggtaaatcagaaatgctctagttgcttttactttttttaatgggttagccaaacatggatgacaaacgagaaatacaggctgttactgtaagtttttaaaaaaaaaaaaatactgcctaattgaaaaaaaaactgttttttaaaaaaaaaaaaaaaaaaaattttttttttttaaaaataaaaaaaaaaggttttttttttttttttttttttttcttcggggtaaaaaatgtgaaaaaaaaaaaaaaaaaagggggggggggggggaaagaaaattcttttttttttttttttatttttattaaccccccacaatattcccctctcccacaaaaaaaaaaatattttttttt

SEQ ID NO: 461 - DNA, 1927 bp, Diabrotica virgifera
cggacgcgtgggtttttttaaagttcaacctttatgtcgaggactattcattctgcgaagaaacttgtaaaaaattttttgcttagaatgacccaaattatacaaaagaatgttttgttttgcgaaaaatcgtttttatgtgatacctcgtacgtatggcatccaaatctggggaactgccagtgaaacaaatttactcaagatacagcgctttcaatcaaaagttctaaggcaactgtgccaagctccttggtacatttccaacgataatatacatagggatctccaagtccaaaccgtcaaagaagaaattgtttctctgtgctccaagtaccacaatagacaggttcacccaaacatattggtcaccaatctcctgacacccctacagaacagaagactaaaaagaacagacactcttgacgtcaacactaactaatcgttcccacttttatcactactattgtattactattcaaattaattcaattaatttattaatttttacttattaacaatctttattgtactcttttaggtattcaccactgggtgaatactgactgtgtcatactcttaatactcatatgtattgtttattatttttttataaaatagattgcagtaaaatagatgccaaaaaaaaaatgtgatacctcaagttctttgtttatggcaatcttatagacatccggatcagctgttgcccggaaagttcgtgttctacgggtcaaaatacataaaaaaacttggataactccatctgagttggggaggccgttgtgcccccactggcgacaggactatatcatcattgatcgtataaatagtagcatgacaaggttttccgaccaaaagcgacttaatcaagatctgtcatgtttggtccaaaaaggtttcccaaattgaaaaaaaaaggtataccaaagggtgtcttataaaaaatatgcaatttagttccattattttatcaagaaatatttgcagaggaacctcaataatttgattgtgtatgtttcttcatcattgaataaatgttatatgaatgaagtttcagatcaattagatcaacaaaatctcgaaaaagaaagtagtcatgtaaatcatttatcgatataatattttgtatatacagagcttatcaaagtttataaagtccttttaataattcctctcactcaagtaagttgtatagcaggtttttcgaaaaattattagaaaccaggcttcgatctttgagatggaaaatgaaaatctagaaagtcttcttatgatgcaattaaaaagaaaagtaattgcaagaattgataatattataaataaactatgtaattgactctattattataaatgaactctgtaattattataaactactgaaatctgtcgcctgtctataatgtaaatcgtcaaatttagtcatttaacagatatttggatataacagatatttgaacagttggataaagatactttattttattgttacagagtaataataatattattaatcaacgtggaaatcgaaacgtcaaaataaacttatgtcaaaggaaaactgtggcgtattcttcataaaacaagtaaaaattcttgttatttatttaaattaaaattaaacgtataaaagaaataatattgatttcctctacattcaatagaatttcaagaaacttagcttaggagggggtattttgcctttgtttgcagtttaggttggagcctttttatgagccagtccggccttggttgtaatagtttacaattttttgtgtacatttaaaattttattattaatagtataaacccacattatctggtattaagggcatcaatatttaatgtaatagtgtaagatttggatatcgatggttgtatttgatatttttacatgaaatattaaataaaaacccttttttgtgcctaa

SEQ ID NO: 462 - DNA, 1582 bp, Diabrotica virgifera
gtttgtacgttttgttatcgctaaattgttcgctgacggccgacagtcgtttggtatttatgcgttgttcgttcacttttccggagaacaaatggcacactggataatttaaagtgttttgactaaaaagtgatgtattcatctgttttaactagtagtacagtgacattggacatgatggagaacccttggtacccacccaccagacaggccttcttagtggatacaactcctcctagcaacagccgggaacaacggaataaagcagaaaaacaaaggagggacagactgaactcttatatcggagagttagcttctttagtgcccatggtagcaagaagtgctaaaaggttagataaaaccagcatcctccgactgactgcaacacatttaaggatcaaacaacttttaaacaacagtagaatagtaccaaacatgggttttccaagacatattgatcaaatccttctggaacaattgatttacgagcaaatgggcggttttttgctaattgttttggccaacgggaaaattgtttttgtttcaagtacagttgaaaaccttcttggacacttacagactgatcttatgggtcaatctctcttcaacattacttctcctgatgaccaggaccgtctaaagattttcctacaatgtgaaggagacattgaacaagaatggaggaaatgcttcaacattaagctgaaacgagcaggtccacgatccgagacttctgtttacgaacaagtgaggatgatgggcatgcaccggcagggaacgcctaccggaattcatcaaaatagtatgttgtcaagcagcagcagtagtagcagctcgagtagcagttcttcaagttcagtaaatgcagacgatattttaatatttttcgcaaaaatatgcagacctgaaccatttatagagaggctaatcgaagcctccaaagaagagtatgtaacccgacatttgattgatggccgtattatagattgtgaccaaagaatttctattattgccggatatatgaccgaagaagtgttgagtcactctgcatttttatatatgcatagggacgatgtacgttgggtgatgattgctttaagacaaatgtacgaccgaggagaaatgcgtggatggtcatgctatcgtttgcagtcccgtaatggacaattcatattcctaagaacaaacggtttcttggaaatagatgatcagggtattgtggaaagttttatttgtgtaaatactttggtatctgaaatggaaggtatgcaattgatagatgatatgaagaaaagatattctgccctttgctcacttgaagttagcagcgtcgggtgtcgggtttcgcctcttatccatttcttccatgcacttctattgatgaccaggttcttcatatcttttatactcatgtgtctccttatccaactgtgcggatctgcgtcgagatcaatatcgacatcctggagagattccatcgaaaactcgcgcatatcacaatgcaccgtggtactgcccgatgacatatcatcgtgatctccaatgaaacagtcaaagagaaattgcagttacgcccaaaata

SEQ ID NO: 463 - DNA, 2315 bp, Diabrotica virgifera
  misc_feature (2187)..(2187): n is a, c, g, or t
  misc_feature (2219)..(2219): n is a, c, g, or t
cgatgacagtaaagaggatgaacatgaacgccacaaaagatctattgatgatgctcaggatgatggaatagaatcaaaggaagaagaagctactttaaaagaagatgcatcaaaggaagattcaaaagaggatgaagcagctacaaaagaagaagtagatgataaacaacaagaggaagtcgaagaggtcgcggagtccaaagaagacgatgtggattctaaagaaggtacaacagaagatgctgacaagtctgatgaaaaagtagagcctcaatcagacgaaaacactgaggataacaaacaagaaagtgccgaaaacaaggatgatgaccaaaaagatggagatagcaaagaagatgacacaaaatcaaccgaacaagatgataaggatgataaagatgatgatgttaagggtgacagtagggaagaaaatgcggatgataagtctgtcgaagccgaaaaagatggtgacgaaagcagggaaaatgattcaactgatgataataaaagtggagaagatggtgctcctgtggaggaactatccttggacacagaaattccaagcgacttacgacccagagatcacgtggagcaacttcttaagctcgacgagcaatcttcagatacagaaacaataattaacagggtctctgaaataaccttaagagatctcaagaaactgtatgaaaatgctatcaagccattagaagttttgtataaatacagagacttaagtaacaggcactttggtgattcggaaattttctccaagccactaattttatttatgggaccatggagtggaggaaaatcatcaattataaattatctgactaacaacgaatataacgaaacctcattaaggacaggagctgaaccatccccagcttatttcaacattttaatgtatggtgaagaaccagaggtaattgatggcagtgagttagctgctgacttcacattttctggattacaaaagtttggacaaggattagaggaacgccttaggggtgttaagctaccttctaaactgctagaaaaagttaacattgtggaaatacctggtattcttgaagttcggaagcaagtttcaagggtatttccatttaatgatgcctgtcagtggtttatcgatagaggtgacattatattcctagtgtacgatccctcaaaactagacgtaggaccagaaactgaagcaatcctagatcaactcaagggacgagaacaccagacccgtattattctcaacaaagccgaccgagtcaaaccagaagagctcttgagagtgcaaggagccttgatatggaacatttctcctttgatgtcatctccgcaacctccaattatgtacacaacctcattatggtcacgaccttacgaaccttgggcccctgtgagactactgcaagctcaggagagagcttttctgagagacttaagaggggctgtcgacaaaagaattgaaaataaaatagcaagcgcacgtagattcgctgtgcgtgtacgcaaccatgccaaaatggtggactgttatctcacaacctactataatcacaaatcggtctttggtaaccggaaacaagtagctgacgcaatcatagagcatcctcaagattaccacatctacgaagggctttctaccctcacgaacatttcccgttacgatcttccagatccagatgtgtacaaagacttcttcaaactaaacccattgtatgaattccagcaactatcagcaacatgtacctacttcaggggctgtcccatcaataggttagatatcgccattgcgtacgatcttccagagctgttggggacgcacaggaaacgggtagaaagtgcattaacagaagaaaagtctggctcaaaacaacaaacttcaacaacgcctggtagttgagctaatagtaacagtccaagtattaaccaaacttgtagatacaagtcctgtgaatactgagaaaactgatgttatcccaaaacattgactaaacgactcgtttattctgaaagaggcttacaatgacagtccaagttttgggataaacatccaaattttatttaagactttaaaaacgcattcagcgttaaaatatcatgagatcttccattttcgaattttgtggtaaatgtttttcttccttatatacgaaaaatgacttttaggacttttgtgctaacgtnggcatatggactgatgtaaactaacttatgtngaacatcgaagacgttttagctatgctttcatggtattcttttcgtttgagcaactgaagcatcccaacgtactcacaactcaccattctttaacc

SEQ ID NO: 464 - DNA, 857 bp, Diabrotica virgifera
ggtacatgcatcacctatcgattttcggtttgcggtaatttaataattttataatttgttcgtttttatcttgatatctaaataacaagatgatgacctcatttcaacaacagcggcttatgatgagtgcttcggcaaaagcacatccgcctactcaaactattagtgctccaccacccatactgccacctcctggtctacccccttcagttctagcacaatctatgcccctaccgcccatgttaccacctagcatgcaagccctcggtatacctcctcctccaatgcctcccatgcccctgaacacagtctctgaccaaatccctcaacctcccatgtcggtggacccggaccctccgttagacgctgaaccagaactttcaccgcaacctgagatggagcctgatcccatgttggaatatgaacctccagcacctggaacagaagaaatccccgagatacccattgacccagcaagactgtgtgagggatacgagtatatctatgatttgattcaaattggagaagtcattacaggtcctggtgcacgcagcagtacaattgcaggaattttaggaggagcgctgcccaaactatcatcggacgatgcagatgcagtcagcaaagcaaagaaatacgctatggaacaaagtattcgaatgggtctcatgaaacagactattgcttatcaacaacagcaagaggctggtcagaggaatctaatccagaggcagcaggctctcgctctcatgtgcagagtatacgtcggaagtatcagtttcgagttgaaggaagacaccatccgttcggctttcctcccctttggccccatcaaatcgatcaacatgtcatgggat

SEQ ID NO: 465 - DNA, 1212 bp, Diabrotica virgifera
aatagacttctgagtatggctgtggacatggacaatatgtacacagccatgagcacagaaaaaaatccagaaactaacaaagtatatttatatttatttaggcttttacgaaaatgtgtattaaccttagacaagcccgttgtagagggacctttgggccaaccgcctttccaaaaacctagcattcacaaagcagtaacaaatttattgatatataagttttcacatattggtcagcaggaattaaagacgatgtacgaattggtaaaaattctgtttcactgcttaaatacttgggattttccaagtccaagcagccagaagcatattgttaatcaggaagaagctatgaagtacaaaatagaatatacaaggtggttagttttttgttatgttcccaccttctgtgattcgttacaacattttgatactacaatggtatttggaagaacattattgcgagcagtgtttaaatacatacgcaaacaaataatggaccagttttacaaggaaagagacacaatgcctcctgaaaggaggcaacttttactcactaactttcctccttttttaaaccaattagatgaagagatctatgcagcacattcgcctatctgggatccagaatttaaatctacttctgtgcattttcagtcacttcttgactctagattaaaagctggccctagtagttctaaaaaaggagaatttgaaaaggtctccttgggaaaatcggatagagaaggttttacgacaataccactcgcacctggaaaatcgattagagctacagagatgccaagtagagaagttaagagaagaaaaatcgctcaagatgaaaaattcgaagatatgcctaaagaaaccgttgcacaaatagttgccaccatagatgatcctaattatatgaccggcccagatatggttttctctgaaaatgctcccgcaaccgacgaagctcctaaactagaagaacaaagaaatattattcagttgcatgtggtgggcaatagccttactacgccagtttcaaagcaaacaatgttatggttaataggtttacaaaatgtattttctcaccaactacctcggatgcctattgagtatattacgcaactcttatttgacccaaaacatcgaactatagctttagtcaaagaaaatcggcctatcggaggaatttgttttcggccgttttcaaacgcaaaggat

SEQ ID NO: 466 - DNA, 1221 bp, Diabrotica virgifera
tgataatcatattctgaaggacatttaccatcctgactatatagtattttaaaaagaagcaacatgtcagagcagtctgttgaaaatatagatggatctgcaagcaattcaagtgagcatgcaactcatggacaaaaaagtactacaaatcaaacaaagtcagagacgaatgcttccccattaaacaaccttcagagaatccaacagaagaagcaagcagtagtttctttgccttacaataagaaattattaaagttggctgtgtattctaaatgtcaggcagaaaaatgtgattgtataggatggaagagagttgaaagtaatcaacaaaatcccacttttacagatccctgtagatgtgagcacctactagaaatgcacatttcccatttagttgataaaccagagcaagaattaaatagacttctgagtatggctgtggacatggacaatatgtacacagccatgagcacagaaaaaaatccagaaactaacaaagtatatttatatttatttaggcttttacgaaaatgtgtattaaccttagacaagcccgttgtagagggacctttgggccaaccgcctttccaaaaacctagcattcacaaagcagtaacaaatttattgatatataagttttcacatattggtcagcaggaattaaagacgatgtacgaattggtaaaaattctgtttcactgcttaaatacttgggattttcctagtccaagcagccagaagcatattgttaatcaggaagaagctatgaagtacaaaatagaatattacccagggggttagttttttgttatgttcccccaccttctgtgattccttacaacattttgatactacaaatggtattttggaaaaaacatttattgcgagcagtgttcaaatacatacgcaaacaaataatggaccagttttacaaggaaaaaagacacaatgccccctgaaaggaggcaacttttactttctcactaccttcctttttcctttttttaaaaaccaattaaaacaaaaaaatattaatgcaccaccttccccccatttctgagaaccccaaaaattaaaatttaacttctggtgtattttttccgacccttttttttaactcaaaaaaaaaaaagattgccccaaaaaaatacataaaaaaaaagagaaattataaaaagggtgcttcccttgggaaaaaatctgatatagaaaaagggtttt

SEQ ID NO: 467 - DNA, 705 bp, Diabrotica virgifera
cccgcctgcaccgaccgcggacttacttcccctttccacccacgcgtccgcagatttaaatgtgactctgttttacgaaggattatgtccatattgccataattttatagtggatcaattataccctggatatcaaaaattatgagacagctttaaattggatgtagtaccgtatggatgggagacctataaaaaaactagccgatggaacaatacaatatacttgtcaacatggagaaaacgaatgcaccgttaatagaatacacgcttgtgtcattgaccaaaatccaactcaatcagatcttataagctttatgcaatgccatttatctcaagctagcgcatataacatttatgaggagttgatggatatggcaaaagattgctctggaggtactatttcttttgatcgtgttcaaaattgtgtagaaggatctcatgcagacgaacttttgatggcatactccgagagacaatcaaaattgtatcctgcactaccatttgtcccaaatatacgatttaatggtgtttatgatacggaattggaagatgaggctaccaaggatttttttgccactatttgcaaagtattaaaagacaataaacctgaggtttgtgggtaaaatgatttttctcaaaacttctttagtatcattaaaaatacattttatagaacaatagttttaaataaaatcattgaactat

SEQ ID NO: 468 - DNA, 998 bp, Diabrotica virgifera
gcgaccacgcgtccgcacacgcgtccgcccacgcgtccgcccacgcgtccgcccacgcgtccgcccacgcgtccgtgtttttaaaggtaatattagttttagcagcttctttgtgcatttcgtgcagtgcgcaggattcagatttaaatgtgactctgttttacgaaggattatgtccatattgccataattttatagtggatcaattataccctggatatcaaaaattaggagacagctttaaattggatgtagtaccgtatggatgggagacttataaaaaactagccgatggaacaatacaatatacttgtcaacatggagaaaacgaatgcaccgttaatagaatacacgcttgtgtcattgaccaaaatccaactcaatcagatcttataagctttatgcaatgccatttatctcaagctagcgcatataacatttatgaggagttgatggatatggcaaaagattgctctggaacaatacaatatacttgtcaacatggagaaaacgaatgcaccgttaatagaatacacgcttgtgtcattgaccaaaatccaactcaatcagatcttataagctttatgcaatgccatttatctcaagctagcgcatataacatttatgaggagttgatggatatggcaaaagattgctctggaggtactatttcttttgatcgtgttcaaaattgtgtagaaggatctcatgccgacgaacttttgatggcatactccgagagacaatccaaattgtatcctgcactaacctttgtccccaatatacaatttaatggggtttatgatacggaaattggagaatgagggtacccaggattttttttggccctattttgcaaagtatttaaaaaaaaataaaccctgaggttttggggggtaaaaagggtttttctccaaaaactccttttatgaaaacttaaaaaatacatttttttataaaacacatagtttctaaaataacaaaccctttgcaccccc

SEQ ID NO: 469 - DNA, 1182 bp, Diabrotica virgifera
gtgtctggttggtctgtctacatttccctttaacaacagtgttttagcaattaaatactctttttataatttaatatgactcgatttgcaagggcaaaaggctcaaaagcatccaatgaacgagttccagaagaagctacaccctggaaccaaatgaaacagcaattattagataaagataaggaaatttctgaaaaaaaaaacaggcaaaaggctgttgatcagcgcaatgcaaattacagagcctttttagaacaaaaggaagaggaggaaagtaaacatgaagagtgggcagaatttccaggcgaaaccccatcaacatttgctagaaggaagaaaaactcattttcaaatactgatgatttggtaattcaaaacgttgatcaaaatcaatctagtaaaaagaaaaaaaataaatcagtctctgagcaggatgatacatcatttgatgaaaataccaatatggatgatgagttatcagataatgatgaaacatttgtagctttgaaagaaaaacttgataagatattaagtgagccaaaaacaaaagttagtaattctcaagagaatgaagatagtgatgcccctccagatgagcaaagttccaaagtggaagttttaacttctccagctaaaataaagaaagggaaaaagaaaaaggttccaataaaaatagaaagtgttactcctaaagatgagaatatacagaaaccggaataacaatctaaaaaacgaaaatctgatgacgaaaatacaaaatataagaaaaagcttaaaactcaaggtgaaatcaaaagtgaagataacgtaaacaaatcaaatcatcaaggtgaaaacaaaagtaaacatactgtaaacaaaaagggaaagaaagatcagtctaaaaaacagaaaggtgataatcaacctaagaagattattaaggaaaatttgactgaacttttaaaaaaagaaaaaacaaagaagaattaaacaagtagaaaagaaaaagagaataaaagctgaattacaaaagcaaaaagaagaaaagagaaaaattaaagggaaaaaaaatgggggaaagtatcagggaaaattaaaaaatttttaaaagggaaaaaaaaaaataaaaaaaaaacaaaaaaaattaaaattttattttcccccctgggagaaaaaaaaaaaaaaaaatttttttaaaaa

SEQ ID NO: 470 - DNA, 930 bp, Diabrotica virgifera
cacagcagaacgacataatgaagatatttatcctgctttgtgcttgccttttggttgcctcagcacaactttcggctaacaaacaatgggttacgttcaagaaatctttccaaagaagttacaaattaggagaagaaaaacttcgtttccaagtatttcaaaaaaatcttcgcaaaattaatgaacacaattcaaaatacgagaagggagaaacgagttactttcttaaaataaccaaattcgctgactggaccgatgaagaattgaacgctatgttaaacccaaaaatagtagctaaatcacaccataaaaataccaaaacgctcgtacgtgatccaaacttttctcgtccagcaagcatcgactggagagatacagctgttttggctgtcaaagatcaggcagcctgtggttcttgttgggcatttagtactacaggtgcactggaaggtcaacttgctattcacaaaaatcagacaatccccttaagtgaacaagaattaatggactgtgatgatgagaattatgcatgctctggaggttatgctgacgtcgcatttgagtacattgaagcaaatggtattagttcagaaagtcaatacgagtatacacaaaagaaaggagaatgtagaaaagtggaaaataaaccagtctctagcatttcaggatggttgggagtaccttcagatgaagatgcacttatagaagctgttgctcaatatggtccagtatctgtttctgtgttcgctaacaacgattggagtttgtatggaggtggcatctttgatcacgacgactgtagatcaaatcctaatcatgctgtgttagcagttggttataccggaaacagttggatagttaaaaattcctggggagcctcttggggagaagagggctacattcgtttagcccttggtaaaaatgaatggc

SEQ ID NO: 471 - DNA, 893 bp, Diabrotica virgifera
aataaattttatttaaaactccgaaaaaatcatatgaatcttttgtcggcttgttaaaaatgttgtcttttataccacggtcactcagatcagtgacagcaaatgctggtcacaagacaattctcaaccaaataccaagaactataaatgcagaagaccaacacaagaggcatctcacaggagacgttatttctcctggtcaagtcatgggaattgaacatctaagggatccacgtttgaataaggggttaggatttacattagaagaacgtcaagcactaggtatacacggtctacagccagcccgttttaagacccaggaacagcaactagaactatgtaggatatcagtcgaaagataccaagaagatctaaacaaatacatctacctcacggaattgcaggataggaacgaaaaactgttctttaggctgttatctgaaaatattgaaacattgatgcccatcgtttatactcctactgtcgggttggcgtgccagaagttcgggttgatttacagaagacccagagggttgttcattacgattaatgacattggtcacgtgtacgatgttgttaagaattggcccgaaccagatgttaaagctgtagtcgtcacagacggtgaaagaatcttaggtcttggagatcttggtgcttgcggcatgggtattcctgtaggaaagctggccttatatacagctttagctggaattaaacctcatgaatgcttaccagtagtattagacgtcggcaccaataatcaggctctccttgaagatcctctgtatgttggacttcgccagaaaagatcaaccggtaaactgtacgacgactttttggacgattcatggaagcaatcgtgacacgttatggtcagaccactttaattc

SEQ ID NO: 472 - DNA, 1415 bp, Diabrotica virgifera
gggtcgagacacgcgtccaaccaaacgtccgaataaatgttggtttgtgcatgtaaaagtgttataaatataatttaaataataatgtataccggtatagtgaatatttctgacgcgtgggttgccatagtcacagcatcttccaaagaatcatcaccagacatcgtggcaatacctgggggtcttagaggcgatgccataactaccagatactgggattgttgtgttgtatcttgcagttgggatgctaacgttcataccaaaaatcgtcaaccagtgaaatcttgccaaaagaatggagcaacctatagtacaagggagaataatggaaattcggtctgttatcctgaccatcccggaaatgcatatgtttgtaacaataattcaccattcgtagttaattccactcttgcttatggatttgccggtgtatcttttcaaggtggagctgacgttgaacattgttgccattgttaccttttaagtttcaaaggtaaacttcaaggaaaacagatgttggttcaaaccattaacacaggagctgatgctgtggcccatcatttcgatttacaaattcctggtggaggagttggttaccatacacaaggttgtcggatccagtggaatgctcctgagaatggatggggtgaccgttatggtggagttcattcggagcaagaatgtaatcaattaccatggcaactacaggcaggttgtaaatttagattccaattcatgcaaggagtttcgaatccagacgtatctttccaggaagttaaatgtccatcacagttagtgtccatcacaagctgtggagatcttttaaataataattgtgtatttgatttttttgttgggatttattaaaaatggtacctgctggtggaaaaaaatataatttaaaaaaaatattaaatttaaatttatatatataaaaaatataaaccacaaaaagatgacacagaaaagagataaaaaaaataataaaaaaaaaaatatattaaaaaaaaaaaaaataataaattggggggggggccccccttacaaaagaaacacacattattacaacccgcggggggggggccgcgccttcatactttttttatttatgggccccacaaaattttttttttccgggggggggggttttttaaacacgcggggggggggggaaaaaaccccgcggggggtcacccctttttatttcccctttccgccccccccccccccccctcccccccccggggggggagaaaaaaaaaaaaaaagagcccccccccccctccctcccccctcctcccccaacatttgcctcgccccttttaaggggggggggaaagagggggaggaggcgcgccccctcctgcgcggtgggggggggagttataatagagagggggcgggggggggggggg

SEQ ID NO: 473 - DNA, 957 bp, Diabrotica virgifera
  misc_feature (929)..(929): n is a, c, g, or t
gtctcagtgataaggaagataggtggaggtgccttaaagctccaaaaatttgttttactattggtcatttccacaaatcagacatataaatgcctatggggattgaatatataattatttaaacaatagcaatcgactgtcccctactgattgtaaggaacttcagatattgcagatcgaggcacgactgaaaaagatatggcgcctataatagagaaagtattagatggctttaagcttgcagaaggtcctcattgggatactaaaaagcagtgtttgtattttgtggatattgttgaaggtaccattttcaaatatgtgccatccacgaagaaactcactaaagccaagattggtaaccacaacgtttcaattataatacctctcaaatacagaaataacgagttcatagtaactttgaacaattctatagctttaattgaatgggatggagaaagtacaaatataaattcagtgaaacaaatctatgaagtggatgctggaaccagcaatgtattcaacgatggcaaatgtgataaaactggaagaatttgggcaggtactatgggtgcatcgcccacatcgattggagaacttgttaaaggaaaaggaacattatacaacttctttaataacaaggcaacaccccatagagatgggattggtatatcgaatggcattgcatttgactacaaacggggaaaaatgtattatacagattcatttagctttagagttgaccaatatgatattgacttcagccaaggcaaaatatcaaatatgaaaaccatcttttcaattaagaatcaaagcgaactggctgaagaaacattttgcgatggcatgacgttggattccgatggaatatatggttagcattgtttatttcttccaaggtttatcaaatagatccttccaaacagagacangtctaaggtttgtggaacttccagctgc

SEQ ID NO: 474 - DNA, 1415 bp, Diabrotica virgifera
agtattcatttttattatattttaacctaagtggttgggtatacaatctaaacacgacaataataaaaataatatctaacaatgatgagttggcacgtacaataaatacatttatagtttaatttgtggatgtcttgacatgatcttaggtacaaataaatactgaataaaaactatatacgaaacaaaacttcacattatcattttagacgtttttgcctaatctagtagatatataaaggccaatagactcagatgggcggggcatgtgatacggagtaaggagaatcgccttataaacaatgcgttctgggaaaggccagatggaagaaggtctgtaggacggcctagaaaaaggtggaaaggtgcagtcaaagaagatctagagaaaatgggagtgagacaatgggaattagtggcacaggaccgacaaacatggaaggcattgatgatgatgatgacgtcagtgatcttgttacacatgagaacgtcagttattgcgggttaaattttgcaattcgatattttttaacaaaatacacaagaaaaactagaaaaaatgttcatgctgtcacataggctactgatccagaacgtcgtcgatcagttactgcttcggtttgtcctgttgttgagttcttactgatggcggttactgctgcaaaaccataatcatctttgaagtcatgttcatgaccaatctttttcagtccattaacaatatcaattccctttgttttatatccttcttcataaataactttcatcgggaataactgatgatgtaatctcatttcatttactgcagtagacaaatcttttccgaaccataaatgttttataatcgtaagagcgtttgctgtcgttattttgctaccaccggctccgcctattaccataattacatttttcttttcatctagaacgatgacaggaaccattgaggacattggtcgtttgccaggtttgataaaattcgttgctgcagggggtaaaccaaaaccatttacagcattcggttgggaaaaatcatccatgctatcatttaaaattatacctgtgctgtttgattgaaatccagctccccatataaaattaattgtgctagtcacagctacagcatctccttgaggagataaaactgaaatatgtgaagtaccgtgatcttgctgaaaatttgtagaagctccataatagaaaggatcttgtgaggtctcgttatctttaattaattttcttgtagcttcagtaaacttcgccgacgtaaggttttttagtatcggtgtaaagtcaaagaaatctggatccgcaaactttgttcgtttggcgtatgcaaacttaaaactctcaactatcctctgatttgttaatacagaatcaggtttggtaacatctatgaatccggacgcgtgaag

SEQ ID NO: 475 - DNA, 1177 bp, Diabrotica virgifera
caactataaaatttgcagggtcctgccaataagataaatatcaggataggtattcgacagggagatattatgtcgcctaagttgttgactgtacttgaacatgctttgaaatcactggaattggaaaataaaggaatacatatcgatagtgagatgcttagtcgtcatccacgattcgcagatgatattgttctgatttcagatgacctaaaaactgccaatgatatgttgaatgaactccgtgatgcagcacgtaaagtaggtctaaatattaattaccaaaagacaaatatgatgacgaatttagttccgagccatcctttaaaggtagaagacgtcgaaattgaagttgttgacagctaactctgggataagcagcatatggaagactgcgtgatatttttaaaggtgatatacctatcagattaaaaagaagagcctttaaccaatgtgtcctgcctgttcttacatatggcgcagagacacttactctaataaggacatctgcacgaaaactacaagtgacgcaacgtagaatggaaagatcattgttgggcataacgttaagagatagggtaagaaacgaagaaattcgtggaagaagtggtgtagaagacattataaaacacatagccaaaattaaatggaattgagcaggacacgtcgcgcgtcgctggaatgagagatgataggtggaccaaaaaaatcttggagtggagaccgagagcggatagacgaaatccgggaaggccacccacaagatgtactgatgacataaagaggatatgtaccaactggattgcagcagcgcaggatagacctgaatggaagtttttcgaggaggcctatgttcagcagtggacgactatgggctgatgatgatgtttggtaaaatctttaaaaaaattattgagaaagaataccagcctcatgaaattgaacagcaagcaggatttagagctggaaaatcttgcgtagaccacatatttaccctaacacaacttaatgacaagaaagttgcaagaagccaggaaatacatcgtttattcgtggatctcaccaaagcgtatgatatgattctagtgagagaattgtggcactctcttgaacgatcttcgttaaatagcacgatcatcgctgcttcaaacaattatacaataaacgagcatcaaaaatc

SEQ ID NO: 476 - DNA, 1022 bp, Diabrotica virgifera
  misc_feature (946)..(946): n is a, c, g, or t
aaagaaaaacggcgtaatgatgaagaaaaacgtttggagtgcgaaatttgtttgaaacggtttcgatctaactctgaagtaaaatcgcataagagaattcatactggagaaacatttaagtgtgaactttgtcccaaagagtatttctcaaattctactttaaaatcacatatgaaatggcacacaggagaaactttttcatgtaaaatatgctccaaacaatttgtaagaaattctaaattcaaagcgcatatgttaaaacacagtggagggggtaaagaaagacgtttcgcatgtgtgatttgctccgaaacattttcaaccaattataatttaagacaacattcaagatggcacactggagaaacttacacgtgcgagatttgctccaaacagtttgttgacaatcattattacaacgtccatctaagattgcatacgggcgcaaaaccttttcaatgtgaaatttgtttaaaagatttttcacttaagtcctcattaaaagtgcatatgagggtacacactggagaaaaacccttcagctgtgaaatctgctccaaatcgtttataacaagttcgcatttaaaggagcatatgggaaagcacactaaagaagagccttacgaatgcaaaaattgccctaggaagtttgcaacaagtagtagattaaaaagtcatatgatggtgcatatgggaaatcgtccttttaagtgtgaaatctgcccgagacaatataaaacaaataaagatcttcaactccatatcaaatcgcacactggaggagaaactttttcgtgcgaagtttgttcacaactactttctacaaattcttcgttggcatttcatatgagaacacatactgaaggaagacccttcacatgcgaagtttgctccaaaggatttttcagccgtgctttgttaaagtacatatgagggttcatacganagaacttttcccgtgtgaagtgtgccctaaacaatttttaacaaattataacttaaagatacatatgagaaggcat

SEQ ID NO: 477 - DNA, 1463 bp, Diabrotica virgifera
  misc_feature (1327)..(1327): n is a, c, g, or t
acaatactcctctgatacgtctaaagatgggaaacaatagatagaatattaatccagcacgtcgattagaactgcagacatataaacaacaggccataaaactagaaaaacgtctccgaaattgtaaggaattgaagaaaaatctacaggagttaatgtccaccaaaaacctcaccagctccccatattttgacggaaacagccatatcgaagcgttaggaatttcctcggccaggagcagcgtccaaccaaagaagaaaccaaatctaagtagagatatcattgatgttaccgaatatagcaatgatggcattaagttaatcaatagagaggaagatatggtgtgtgaatctagacaaggccagactgatttcaatcaaggacagctattaagcgtcggtgatgcatatgaaagtgattcatctttaaataagtcaagcgaaatacctgtctcctctgtgatgtcaagtgctagagaaccgcattcacagtgggctactcctgattttattggaagttgcgacaatcaaggtcatttttcaccgagagcgtgggcgagcccaaaaccgacaagatccacaccacctagaaacaaatcgaaaagtgctacagcgaaaccatcctcttcccctaaaccaagactgattagaagcaactcttatactctcgaatcaccgagcccgatacttttggcccatctccagaaatgctgcaagacaaatctagaagtgccagaagcaagtggaaacctttcacgaggttggacgtctttagagaataacttttctctaaatagtgaagatagtgaatttagcagtttaaacactgtatacaatgctaacttgagcagtcaaactgttagcgataaagtgcctttagatggagtgggtgacaaagagctgaggctacaaaaggatactggacagaagtctcctactattgaggtggtccaaactgacatctctgttcagcatataactgtcaacgccaatagtgagaatatagaacctgtcaaaggcaccttggacttaaccaatccagattgtcaattgatgcaagttctgaagaagataccagaagattattcaaagcagatcatagagctactggaaaaacgtaggcaagaacatcaagataaagtagaaaattttggaaaacaatttaaagaggcttcttcgaaggatgaagaagtagacgataccgactccattactttcggagctggtccagttggtcgaactattgcgcagtcgcggacaaactaaacggagatcgagctccaaaaaatgtatccagcagaaaatagggccagttcaacgattatcangtaataaaaagtttttcgaaaacgagacctattctgggggatagtcctgatagcggggcttaccaagttatcgagagtacccatatggaaaaagaaattggagtcttggatacaaccctttgatggtgattcaaaa

SEQ ID NO: 478 - DNA, 1363 bp, Diabrotica virgifera
  misc_feature (866)..(866): n is a, c, g, or t
  misc_feature (875)..(875): n is a, c, g, or t
ccaggagattctcgacagtggttccacgagattttcggcagcgattccacgagatagttctgagctgcacgctgctggttctgctgcatgctgctggttctgctgcatgctgctgttcctgctgcatgctgctgttcctgatgctacccgctgctggtcctggtgctgcactctactagtcctgatgctgcacactactactcccgttatcataggctactggtctcttgagtatcccatcggtggtccaggatcggtttccaaagcgatagtccaggttgcttcacgacggtgaccttccgaggatatcctacgatcatggttcgtgacgtgtcaaccgactgtgatagcaaaacgataatcgatggtttcgacggttaatccagaagatttattctacagtcattccaagagattcacgacaggtttcgacggcgattccacgagctagttctgagctgcacgctgctgttcctgatacacgccgctggtcatgctgtacgctgttggccctgctgtacgctgttggtcctgatgctacaagctgctgaacatgaagctgcacgctattagtcccggtaccacatgctactggtcctgatactgcacgctgctggtttcttgaatatctcatcggtggtccaagatgttttcaaagcgataatccagattgtttcacgacggtgaccttccgagaacatcctacgaacgtggtccgtgacgtgcccatgactgtggtctcaacgataatcattggtttcgatggttattccagatttgttcgatggtcattccaggagattcttgacatcggttccatgagattttcggcatcgattccacctgcacgctgctagtcctgctgncagctgctngtcctgatgctacccgctgctgctcctgatgctgcactctactagtcctaacgctgcacactactactcccaatgccacaggctaccggtcccaacattgcacgctgctggtctcatgaatctctcatcggtggtccaggatgtttccaaagcgatagtccagattgtttcaagaccgtgaccttccgagaatatcctacgatcatggtccgtgacgtgcctacgactgtgatcgcaaaacgataatcgatggtatcgacggttttcccatgagattcacgacagaggttccaggagattttcaacggcgattccacgagctagttctgagctgcacgctgctggtcctgatgctacaatccgctgaacatgaagctgcacgctattagtcccgataccacaggctactggtctcgatattgcacgctgctggtatcttgaatatctcatcggtgattcacgacatttccaaagctgaaaatacaggt

SEQ ID NO: 479 - DNA, 1146 bp, Diabrotica virgifera
  misc_feature (830)..(830): n is a, c, g, or t
  misc_feature (1019)..(1019): n is a, c, g, or t
  misc_feature (1022)..(1023): n is a, c, g, or t
actagttctagatcgcgagcggccgccctttttttttttttttgtttggaggctttaaagtttgtaatcaatggaataaaccaatttgagaggaaaatatttccttagttatggaaatatgtgaattgactattagataagtcagatctgtaagccagtgtaaaatattgaatcttacaaaatgcccccaataaagttatccacatctaactctggtgttaacgatcttagtgataatgaggtctcaggaaatgagtctcaacattctaattcaagtcgtgaaaatgatgttgctcacgattcaactgaagatgaacccgactccgatgatagctctgaaatggatgaaggagaatgtgaaacaagacgaaatgctttattgcaacatgttcaagatttagaaaaacaattttgccatcttagagagcaattattcagagaacgaatgacacaggttgaatgtcaattagcagaagtaaagacagggaaatccccagaataccttatatccctacatgaactacaggataatatgaaaataagaactgaagtggctggaattttaaaacaattgaagctccagaatattactaatcaatatgaggccgaaatacaagcagcacttcagaactttgaaagtgaaaagagtttgacgtgcgattatatttacagtgaattaatggaaacgataagaaggttagaagaagatagacacaacagtgaaatcagttggggcgaaggaggagaatggggatccaggtcacgatctaggtctcgcagaaaagctgtcaccgtctctggtccttatattgtatatatgctgaaacctncagatattttagaagactggactgttatccgaaaggcgcttaaacgaacttcctgacacatggatctcaaacctccgtatttctataagcataacgatttaaatctgaagtaatttgtaatgattaataactatattagttagggtgagatgataaaattgtctaattaaagattgattgtatttattnaannacaataaaattaatgattatcgtggggggcggggaccctcccaaaaaaaaaacccccacaccaaacaataaaaaaaaaaaaaaaaaaaaaaaaaaaaaaaaaaaaaaaaggggggccccctcc

SEQ ID NO: 480 - DNA, 955 bp, Diabrotica virgifera
  misc_feature (715)..(715): n is a, c, g, or t
  misc_feature (781)..(781): n is a, c, g, or t
  misc_feature (831)..(831): n is a, c, g, or t
  misc_feature (837)..(837): n is a, c, g, or t
  misc_feature (852)..(852): n is a, c, g, or t
  misc_feature (894)..(894): n is a, c, g, or t
accatcatcgccggtaaaaaaaaagataaagttttggtgtaattttaattacattgcaattacatctcctaaataattttgttaagtgtgaaagtattctaaataaacaaaatggtggtgagacaatataaccaggaacttgaatacctggaaaaaattaattctcattgctggagaatcaaaaaaggatttcaaccaaacatgaatgttgagggtgtattttatgttaaccaaaccttagaaaagcttatgtttgacgaacttagaaatgcttgtagacctggcatggtaggtggctttttaccaggtgtaaaacaaatagcaaatgttgctgctcttccaggaattgttggtagatcagtaggtttgcctgatgttcattctgggtatggatttgccattggtaatatggcagcttttgatgtcaatgatcccaaatctattgtttcacctggaggagtaggttttgatattaactgtggagtaaggttattaagaacaaacctctttgagcaagatgtaatgcccataaaagaacagctagctcaaagtttgtttgaccacatccctgttggagtaggttcaaaaggtattataccaatgaatgcaaaagatcttgaggaagcattggagatgggaatggactggtcacttcgagagggatatatttgggctgaggataaagaacattgtgaagagtatggaagaatgttanatgctgacccttcaaaagtcagtatgagggccaaaaagagaggcttaccacagttaggaacattgngagctggcaaccactatgccgaaatccaagtagtagaagaaatctatgancaatgngctgccagcagatgnggtattgaagaaaaaagacaaatatgtgttatgatcactcangaaagtcgtggatttggtcatcaagttgctacagatgctcttgttcagatggaaaaaccat

SEQ ID NO: 481 - DNA, 1213 bp, Diabrotica virgifera
gtcaagtcaacggtcagttactaaaatgatagttcagtgcgcgctttgactgtttatttttcagtttttccattggaaatgtgaaatagacatctcgaatggttgtaaaacggacaagacggatctcctcccagaatgatgaaattttacttcaagtacagacgaagatggatgacattcctgatatattttaccttagcggtgattacaatcgtcctaattcatagcctcataaccgaaaaaaacaccatacaatgttaccgcataaagactgaaaaatctcttcctagcatagcaaatttcaacccgcaaccggggaaatcgatattttttcatgagacttcttgtcgatcgttttacagaggaaagatctggataagctcgaggcaagcttgcgctgtggagagtgtggcaaagttaaatcccaataaagaggtttatctgctctatacgtcacctatggattttaagtttgaaggagatgaatctgataggtttttgaaggtgattttgagttaccccaatgtgaaaattttgcatttagattatgagaattataccagaggatctccagtggaagacctttacagatctggaaaaattgaaagttctcggcatgtggtggcgcatgctagtgatgtattacgatacctaactctctggaaatatgggggattatacatggatttggatgtcattgctcttaaaccggtggacgatctagaagataactatgctggcatagaatctagctctgttgtagcatcaggagttttaaatttcgacgcggctggagagggacacaaactcgtagagcgatgtttgatggacctcaaagaaatttttgatggccatgtgtggtcgaagaatggacctggaagtataaccagtttactggaatctctatgcaaggcaaataaaacagaagatatgctaaataacgattgcgagggatttaccccctacccttcccacacttttttccccccgggcctttggacaaaaaggggaagaatggccttcccaagaaaaattcccttcgaaattgttaatggaaccttgcccccaaaaaaaatttcctcccttttcccccggggggaaacaaaactccggggaaagaaaaaaaaaaaaaaatctcctcccccgggcacaagtgggcccccccttttttttttttttttttttttttaaaaaaaatgtttttttcccccca

SEQ ID NO: 482 - DNA, 968 bp, Diabrotica virgifera
  misc_feature (921)..(921): n is a, c, g, or t
  misc_feature (943)..(943): n is a, c, g, or t
  misc_feature (949)..(949): n is a, c, g, or t
ccttacgcgtccgtttttatattcttttatctatttatttaatataacataggaaagttgtgtgcctatctccatcgaatctaaaaaaacctaaatgccaaatttgttatgattattttttgaaaaattttagttttcgacttttaggaatgtaggaacatttgtttaggacttccttaacataaaatgtcgtgcacaacccagttgttacatttatttttgatatatacctccgaaaaaaatcaaactgtcaacaaaactttttatcaaatcctatttttgcaaagttttatctgaatataggatatactgaattcgctaatctgagacacaactgtctagtgattttagaaatttgtttttggaagttaagttgctagacgtgactggaaactactacacaaccaaacatgcctgctcatagccaatattattaatagtaaacagacataaataacataaaccatacgccaattaataattatttatttacaccattataatgtattgataacaaacgagaaaattatttatcgtacaaattaaaaatattttgatataatgaatgaaataaattccacaaaattttatgagtttagtatacactcccactattttcaataactcttctttttttaatgaaagattaagttgatttgagcagaaaagagtgtatggtaggaattttttgttttgtattgttttgtgttcgctcggctgagcgaatttagtttatcaattcatttcaactaaaattttacaaattagaatgggactttggtcaaaacccgagaataaataataaacaaaagcttcagttttcttgggttgagtttcagtgtgggtataaagtacactttggcacgcacaggcataaagataaaaaattgataactttttatcgtacaaatgatgaaatanattataactacataacattatntagtgnaattctcataaaactgaca

SEQ ID NO: 483 - DNA, 907 bp, Diabrotica virgifera
ctttaaacgactgtgtggggaaataatgaatagtttaaaatatttaaataccaattcatttttatcgatatgtattaacaatgtaccaaatattttttctaggaattacgctttcaagagcgatttaaaaataaaatgggttcggccagaaaaaataccttgtttcaagcctcagaaaagtggagacctacaaggatatcccgatgtagataaaaagcaatttcaactgcagttccgcgattccaaagagctgcaaactgcagatgataatgttaagaaattgtttactttagagtttgctccaaggagctgtagttccaaattgtttcaatacgatatgatggaaaaagttaggaggcatgatcacgattatagtaccgtagagaccagaatagctagatggactggtattattcgagccatgcaagaagtaatggagaggtttccaaggaacaaaaagacaaaggttactctaaaagaactaatagacaggaggaagaagcacttgaaatatttaagacggtgggattataaaaaatttgaatggttgctggaaacgttggatatagtgtataaaccaccacctaaccatttccactggattacaagaaaggagtccttaagaaagcttacagataagtattgtgatggaatcaaagaggacaggctaaaacaatataggttaaaattggaaactgaacagccagcatttctggaagaaaaaattcgtactctgcaattcattagagatgagcaaaaggaatgtggagctgagattacaataactgaagaagaaattgatgaggtgaagagacagttggaagagcttaagaaaaatattggagaagataaaactgcttagtaaaataaagtttttagcaaaaaaaaaaaaaaaagggcgggccgt

SEQ ID NO: 484 - DNA, 944 bp, Diabrotica virgifera
  misc_feature (898)..(898): n is a, c, g, or t
gccaatcgtcaatgtcacttttttttacgtcacacgtcacgtcacagaccgaattttctgtcattggtgtgggttaaggcgaccgaattataaaattaaactttaaaatagaaaaataattccaaatggcttcacaaaacctttgtatggctgtccgcaacttcagcaccagtaacgctgcttcacaattagttaaagccccactccaaatctttggaattgaaggtaggtatgcttcagccctatactctgcagccagcaagcaaaaatcattggaaggtgtggagaaggaccttttgaagcttcaggctgctttaaaaactgatgccaaacttcgaggatttgtagataacccaacaatcaaaagaagtcttaaatcagaggctcttaaagcagttgctcaaaagatttccctcaaaccagaatctgctaatcttttggcattactggctgacaatggtcgtcttaataaactagaaacagtcattaatgcattcaagcaaattatggcagcacatagaggagaggtctcttgtgaagtaaccactgctagagacttagacgctgaccaaaaacaaaaactcatgggtgtattgaaatccttcgtcaagtcaaaccaaagcattcaattggctacaaaagtcgaccccagcatcattggtgggatgatcgtaagcattggtgacagatacgtagacatgtctgtagcaagcaaaatcaagaagtacacagaagttattagtgcaaccgtttaattatactagtttatttaattttgtgtagttattgaaataggatcttcattttatacatcttgtttttaagacgatatattacagtagtactgtaactccattaagaaaattgatgtccgaaaactaccaataaagtttttccnaatgtaaaaaaaaaaaaaaaaaactcgcgactagttcctcgtgccg

SEQ ID NO: 485 - DNA, 941 bp, Diabrotica virgifera
gaaaagagtttaaagagtggtttaccatgaaatcgttactgctagtgatttgttgttgcgccttttacaatgtggtccaaggaagaagcttacaacaattacctgaatatttacagaaatacagctgcaaggaatcagaaccagattacggaaaatgtgtctgggaagggtttcacaatgtctggcctttcttcatgaaaggaattccagaattaggagttctaggtctggatcccttccgaatgaaaatgtttgctgttaacagtactgttggtaatttgataaaaatagatgctgtctgtgaaaatgctgaagttactggattggcaaatacagtcattcaagacttaaaggctgatcctattaaacactacggtgaaataagattgtttattccatggatgtatgcaaattttgactatgatgttaaaggacaacttttggttattcctctagaaagcaaaggacattttgaaggaaacttcactgaaacgcaggtgttagtaaaaggtgatttaaaaacttacctcaaggatggggtagaatattttaaaacaggcaagctttatctaaaagctcgaattggtaatggatgggtgaaactgacgtccctagaaaaggaattccaatatgcagctgatataattaccgatttctacaatgaaaatccccgtcgagttatggacgctattaaccctatattcatccaatattccaaagcttttgcaaggcaagaaatggataaaattctatcaaaacttcctgctgcagcatggctacctaaataatcaattcaaagttttccaattatataccattacctttagaaagttgggaaatgtagaattgttttgttaaagttcaaatgtaataaaaagggtttttataattttcgaaataaacatatacaataaaaccaaaaaaaaaaaaaaaaggggcgg

SEQ ID NO: 486 - DNA, 1603 bp, Diabrotica virgifera
cccacgcgtccgtgtgtctacatcgctgattacaaaagggtttcttttataccatatacagcgatggacatattatgtatcctgctttacattatactaggactccctctcttcgtatacctctaccaaaaatggaaatactcctattggaggaccagaaatgtcttccacttagaacccaaatttccttacggcagtgcccaatcagagctcaaacttaatggtgccatgaccacaatcgtcgaagacctttatcataaagtcaaatcccgcggattaaaatatggaggatactttgagttccttacgcccatgttcgttcctgtcgacttggagctaatacgatgcattatgatgaaagactttccccattttacgaaccatgggacttacgtgaatgaggaagttgatcctttgactggacatctgtttaacttggaagacgagaagtggaaaataatcagggctaaattgacgcctacttttacatcaggtaaaatgaaaatgatgtttcaaactatggtagaatgcaccgaaggtcttcaagaactcttaaaaaaatctgcagcaagcaaagaacccgtagacataaaaagcaatctttcctgtttcaccactgacgtcatcggttctgttgcattcggtgtggacataaacagcatgaaaaatcccgactctgattttcgaaagttcggtaacagaatatttgtacatacaacattggtcagactaaaattcatttttttgtctatctggccacaatggatgattaaaaaaagtggtattaaactcttttccaaagatatggaagacttttacttaaatttaataggagacactgttgaatacagggaaaagaacagtatcattaggaaagactttctgcaacttcttatcgaattaaaggatagtctgactataaaagaaatggcggctcagagttttgctttttatgctgctggatttgaaacttcttctaccactatgtcgtttgccttgctggaactctctcaacgtcaagatatccaagatcaactcagagaggaaatactggaagctttcaaaaaagacggtgatacgatgacgtatgattcgataatggggatggaattattagaaaaagtaatatcagaaactctccgaaaacatccccctgccggaattctcccacgcatttgcaacaagacctacaaagatcccaacagtgatttagttatagaagcaggtaccaggatcaatgtaccagtctatgctatacacagagatccagattactatccagatccagaaacttttgacccagagaggtttagtgaggaaaacaaggcaaacaggacgccattttcatatatgccttttggagaaggtcctcgcacgtgtataggaatgcggtttggaaagttgcaagctaaagtaggattgtgctgtgttttacgaaattacaaagtgaccttgaatgagaagactaaattaccgataacataccgttctggttttgtttcggcagttgaagggggtctctgggtaaatttagaacctcttaaaatgtaaagataattttcatagaattacaattttacttaataaagttttatttttcact

SEQ ID NO: 487 - DNA, 1113 bp, Diabrotica virgifera
cggacgcgtgggcaaaagaataaaaaacctaaacgctcattacctatccccgaatcgcttgaatcatatctaagtaaacaatcaacaccgtccatttttagctatgaccaattaatgatgcttattgaaaatattcaaggcagccaatctcctatcgaaattgttaaagaattcacatctgacttccttggtctcataaatttgcttaccgtctcttatcaatatattccagacagagccacaaaatatcgttttacaaggctaaaaaccctactactacgttttctcggtgaagaagctactactgagagtgaactttcttcaactgaaacataacattcaactcaattttacagtggaatgttgatggacttttccatcgcttaccaatgctcgatatcattcaatcagaacactgtcccgaaattatatgtctacaggaaactaatcctgtatcttctaacccatattggccaatacattttacatgctttcgtaaagaccgaactaacacagctcgcgcaagtgagggagttgcaattttagtaccacttatttcgactttcccgcagtcgttggagtttcacttatctcaacaaaatggtagagtagtcaaattcatttggattccttggaaatgaagatgcagactcgagtgcgcgtagtgcagtgactggtgcggattcagaaacggtattacaatgtgcccctaatgacttgaaagtgttgttaaaacatgtgttcagtgactggctcgatgaatggcaaaattcaaattcaaaacttagacaaattaaagacacagtaaaaagagtcaaaacagtttataaaagttgttatgagcaagcagttttcaaccgcctacgactaggccataccaggcttacttactcatatttgttctcaagatctgaaccacctatttgtgaatcgtgtaacacacaagtaactgtcattgaaatgccaaaaatatacacaagaacgtattgattttaataacgtatcaaatatgtcagtactgggagacaatattactttaaccaataatttactagactatttagaaacaaaatgaagtaatctttataaatccaaaacaattatgtctagaag

SEQ ID NO: 488 - DNA, 1442 bp, Diabrotica virgifera
atttaatgtgttgttaggacaaaagtattagtgtaaaagtgaataatttttgttcgctttggatatttttttggatttatatgaaaggagaaaatggaagagagcgaagataactacgcagtgcaaataactgacgtagacaaattttttggatcaaatatcgttttaagtaagctgtgtatgaaagtaaaacggggaagaatatatggattattgggcgcaagtggctgtggaaaaactacattgctaaaagcagtagttggtatttgtaagatagatagcggagaaatcaatgtattaggaaaattaatcagtgaaggaaatgatgaattcccagtttcaaaacttggttacatgccacaggatatcgctttatgtggagaattcactgtacaagatgccatattttattttggacgtctgttcggcatgaaacacaaagatatattggaaagatatgataaactatataatctattagagttacctccacatgacagatatcttcgaaattgtagtgggggagaacaaaggcgggtatccctagcagccacgttggtgcataaaccagatctcctcatcttagatgaaccgaccgttggattagatcccttaataagagaaagaatctggcagcatttattggaactcaccaggactgataatgttactgttatcatcacaactcattatgttgatgaatgtcgcgatgtggatacgataggtttactaaggaaaggcaaattattaacagaagagtctccaaaatatttgatggcgaaatacgaagccgaaacgttagaagaggtgttcttatttctagcacgagaggataaacaacgaagacgatccagtttaccaggtctagaaaaatttaacaaaattaaacctaagacgaaaacctcccgccactgtataaaaagtttttctgttgatagaaaaagatttggtgctttattagataaaaattggaaacagttttatcgaaatattacgggcatcttcttccttatgtcgtttccactcctggaaatcggagcattcttaacgtctgttggaagagatgtgtcgaatattcctattggtattgttaacaacgaacttatggactgctcaaattttacgccaaatggtacgacagacccatttgcattttttcaatgtcatttctataacatgagttgtcgatttttaacacatcttgaagatccaatgattaataagatattctatccaaatattgacgacgctatgttaggggtaaaacaaggtgatatatctggaattatttatatgcccaagaatttttctgaaaattttgaacttagatttgacacgagagatcctgatgatatcggtgtcgactttagtcagattaaagtttggttggatatgtcaaattaccagattgctttatcgatgaaacagaagctaatcgaaaa

SEQ ID NO: 489 - DNA, 1025 bp, Diabrotica virgifera
ggaaatgaaaaaaagaagtcagtcagtttagtttatacatttttgtagttaaaattgaaaaatcaacaacttcaaaatggtattaattcgcccagaagaaaatcagatctctagcgaagcagaaggacaagtcgctgcagttagagtaaaagctccgaaaaggattttgcatttttcagatggaatcttagaggaatacagcacagatgaagaagacaacactgatagcataaaaaatcaacctcttgttgatccttctaccttgacatggggaccttggttttggtataaggcttggcgtgcaggaaatacaactttaggcgctatggatacggcaggagaatttcttgcttcactttttggcattaccactccaagatactatttcgaacttgaagagtacaagagaagggaagaccagaagagaagacagcacgataaagaagctggttggtcacagccatccggttccagtgtttctgtccccttgaaagatatgggtggagccaacaaaccaattgatgtttaaaccaagtgttcaaaaattgggagcttgtaacatgtacctcaaaaagatatatttactcaaagtgttttaagtgtttttattatacagggttgcgagggagtctggcaacacggttgtttctccgaagccgctggaaggatttttatagattttggtgagtgggggtcttctagtgcggccgatattatagtgtcaattgcattgttgtcgggtcttccgtttttctggaaatctgatgaactgtcttatttcaaatggaacacgctgtgtatgttttgcgttttgaagtccttgagaaatactgattgtttttcatgttatattccctatgcctaaatgccataattttcggagttgatgatacatttagttagaaaaaatttaagcaaagttgtgaaactcaattttttgttcccagtgatccaagaaaccttaaatgttgtctatccgggcaaaaaaattgattttttcgtgattggttttaaaaatttttttt

SEQ ID NO: 490 - DNA, 1330 bp, Diabrotica virgifera
ctttattgttctttggttagaccacatttagattatgcatcatgtgtttggtcacctcaatataactgccatattaataaaatcgaacaagttcagcgtaaattcttacgttattatgcttataagatgcatctgactggtcaaagttatgagtctttactgcaaattattcgacttgattcattacagagtcgtcgtcaacataaagatctttgcttcttatataacttaattcatggtcataaattctgtatcccacttttaaataaaattggtctacatgtaccttcaagaaccacccgttctgtgaccaccttccacgagttcattaaccgcacaaattatggttcaaattcctgtctctctaaaactattaaattagcaaacacattatctccgcaaattgatttctttgtgaacgactttactgcgttttccacacaaccggcccttaatgttctaatttcaagactgatttgtcaactactgttattgtctttgttctaggataagttgtatttgtcaatttcaaaatgttctagctctcaattgttaaatgagagcaagtaattttattctttattattgtttgttatgtatttaccaattttgtacctactagatcttatttttctaatttgtgtgacattttaatttaattgtatcatgtactaatggacttcggtctgtaaataaataataaataaataaataaataactatgtatatgtatatcatcggggtcgactgcaggaggcatataggttattgatatagatgtccatactactcaaaaaatttggtttcggcctggagggggatgtgtcacgagaaaaatcttatttctctggactacaatcttaagtctcacatgttcgataattttcggtgtttttatgctacaaccattcttttatttgtggtttgctcataagtctatctctcaggaactttcacatcattttacccgttgtcgctcagtgttttgtttattttaagcaagtctgagtgagaattcatttctcgcatctcaccgtcattcagagataacgaaacgtgacgaacgcaaaaaagaccaaacaaacaagtaggatacttttgggacatgccccatatacctgtcatattcataattgtttttgataaattatgataatctctggtagtaaagtacagtcggagacaagattcctttttgttaagacgcttatttcgatctaaacatacaaaaaaaaaggataatttcgtttaattatgttctacatatagaactttcgtaaacctgagaaagttagtgtggcgatattcgatacatgaataataaaccgac

SEQ ID NO: 491 - DNA, 1468 bp, Diabrotica virgifera
aaaagagaagtctttttaatactcatataataggaatcaaaaatagtgttgtgacttagtattgttaattttcaaaaaatggaaaagagtcctgaaaaagtacctccagagggaggctggggatacttaatcacactagctgtgtttattgctcacttgtccactgtggttccacttgcatcgtttggcattgttcacggaaaatttctagcatctctaggagatgaaacggcaggaacttctatttccacatcgctatttatagctgttacatgtagtgcaggtttatttggtggtattttgtttaacacttatagctatcgtactgttggattacttggagctgtcttacatttaattggatcaatattactagtatttgctgaaactttatttcaatttatagtttgtctctctattatacagagttttggcggtggtttgctgttgccttcagctttttcgtcactgaacgaatatttccataaaaaattaagtttgcagacagcgatagcccagatattaataaccgtagccactgttgtaaatcctctggtaatgacatattgtgttcactcatacggatataaaacgacaaaaatcatattgattgggtacagtttggtgaatttttttggtatgtggtcgcttcatcctgtagaatggcacacgaaaactgaaaaagataaagctagcagtgatcaaaaaaatattagagaccatgcagaaaaaggagctttattgggaggagaaaaggaaattgatcaagaaaaacacgacaaagaacgacaaattgaagagtcaacatccacatacatgtcctacttcgatctgctaaaaagcgcaaaatatctcaacatagccatcggaactagcctcagttttcacggcgacaacctttttatcgggatgttggcgtcagttctgcgtagcattaattattcctcgatagatattgccaaattaaccatggtgcattttggatgtgatctgattaccagaattatctatgcgagtctgagtgccttttactcgtttaacaatagatatttggtgtacggatcgacgctgctcacggccatttttagaattttattcgtcatcaacgatggttactcatggcggatggcaatcttagttatacttggaatactacgatgttttatacaaacgccttactccttagtcattgcagaagcataccgagataattttgcaagagcttttacactgttttgtgtcctcagtggaggaacgagcttagtattgggacctttaatgagtcttctcaaaggattgaccaacaatgacaatatagcagtacaggttcttactggaggaatgttattaagtgtgttcatgtggactcttgaatttgtttatatcaaattaagcaataagaacagagcatcccagagaaatagttaataataataatatatcctattccacgaacatgcgtctgttt

SEQ ID NO: 492 - DNA, 892 bp, Diabrotica virgifera
aacatctttaatttttgaacaaagatctttaacatgggttcaactgtggtgaccatatgtttatttgctgtattttctttaactgtttattgtaaagttactacagagcaggctgaaaacaaagtggggtgtgccgtgtgtcatccattagatcaggagcgaatcaatatccatttggttccacattctcatgatgatgtgggctggttgaaatcttttgatgagtactactatggtttgaaagcacatgctactacaacacccatagcagtaaaaaatataataacgtccgtagtagaggagttgcagagaaataaggacagaagatatattcaagtggagacagctttcttttataaatggtggaaagagcaagacgaaactatgcgacgtgcgttcaagaatcttgtggataatggacagctcgaaatagttaatggaggatggagcatgaatgatgaagcttgtaccaattatcaatcaactatcgaccaatttactttgggattcaggataattgacgaagcccttggtaaatgtggaagatctagagtaggttggcaaatagatccatttggacacagtagagagcaatcttccattctagctcaaatgggttataatggaatgttctttagtagattggatcattcagatcgctcaataagagaaaaagaacaccggatgaattttgcttggcaaggaagtgctaatttagatggcagcattatatttggcagtatttttcctaatgcaggctacaattcaccagatggtttctgctgggatataagctgtcaaaatgatcaaattgtagatgacaacagtagcattcattttaacctagatgatcaggttagacgtttcacggatattttggatggatatgcta

SEQ ID NO: 493 - DNA, 996 bp, Diabrotica virgifera
gtacaaaaaaaccttgttcagtaataatctcaattgctttgcctgataaaataacaatcactgggtacattaacaaacacataatatgaatgaaggtatatgctactacaacacccatagcagtaaaaaatataataacgtccgtagtagaggagttgcagagaaataaggacagaagatatattcaagtggagacagctttcttttacaaatggtggaaagaacaagacgaaactatgcgacgtgcattcaaaaatcttgtggataatggacatctcgaaatagttaatggaggatggagcatgaatgatgaagcttgtaccaattatcaatcaactatcgaccaatttactttgggattcaggataattgacgaagcccttggtaaatgtggaagatctagagtaggttggcaaatagatccatttgggcatagtagagagcaagcttccattctagctcaaatgggttataatggaatgttctttagtagattggaccattcagatcgctcaataaggaaagaagaacaccggatggattttgcttggcaaggaagcgccaatttagatgacagcattatatttggcagtatttttcctaatgcaggctacgatgcaccacagggcttctgctgggatataagctgtcaaaatgatcaaattgtagatgacaacagtagcatccattttaacctagaggatcaggttagccgtttcacggatattttggatggatatgctaaattttattccaaagataataagaaatatgttggttgtaatggggtgaagattttcagtaccaacaatctgcaatgtattttgataacatggataactaattaagggttttaagaaccacgagaaatataatttgatttattctaccccatctttgtatatgagagtgtgcacgatgataacgtaaatttaacactaaaaactgatgactttcttccccggaaaagtaaaaaaaaaaaccattgaattttct

SEQ ID NO: 494 - DNA, 1453 bp, Diabrotica virgifera
aacatcaaaaactaaagaccaaagtacacataaaaacctatttgttgagtgtaaaataattgtttatattgtacacattattttttagaaatttatttttgttatagtcataattcaaagatgttgcgaacggttattaaaactggtatcaaggagcaaaaaattgtacaaagtattttattgccaagatgtatatctacctctacaacacataataagactgttcaaacttctgaaaaagctcaaccaactcatagtaatgaaagtgcttcttttgtgatgaatatattccgtgggcagttggagcccaagcaaatgtttccttatccaaatgttttaaatgaagaacagagggagacacttcaaatgatgattgaaccaacactacagtttttcgagaaagtcaacaatcctactaagaatgatgaacttgaaaaagttgaagagaatactcttaaagggctatgggagcttggagcatttgctttacaagttccccaggaattaggaggctcagaattgtctaatacacaatatgcaaggctagttgaaattgtaggagcaaatgatttaggtgttggaattactttgggagctcatcagtccattggatttaaaggaattcttctttttggaaatcctgaacaaaaggccaagtatttaaccatgtgttctagtggtaaagtggctgctttttgtttaactgagccaagttcaggttcagatgctgcatctattcaaacaagagcagaattatctccagatggaaaacactatatcctcaatggttccaaaatttggatcagtaatggaggaactgccgatgttatgacagtatttgcgaggacgaaggtgactaatccaaaaacaggaaaagtcgatgataaagttagtgcatttatcgttgaaagagggtttggaggagtaactagtgggccaccagagaaaaaactaggaatcaagtgttcaaatacaacagcattattttttgataacaccaaaatccccgctgaaaaccttttgggtggtctaggaaatggtttcaaagtagcaatgaatattttgaacaatggacgttttggtatggcagctgctctttccggtacaatgaggacatgtataaagaaagctgttgaatttgctactcaacgaaaacagttcggtcacaaattagagagttatggaggtatacaagagaaattagctcgtatggctatgtatcattatgtaactgagtctatggcgtatatgatttctggaaatatggatagtgggtgcacggattatcagttagaagcggctatatccaagtgttttgcttctgaagccgcggggtatgtttgtgacgaagctatccaaattttaggcggtatgggctttatgaaagaaaccggtttggaaagggatttaagagacttaagaatttcaggatatttgaaggaacaatgacttt

SEQ ID NO: 495 - DNA, 364 bp, Diabrotica virgifera
agtactttttgccttagtactttactgctgttcggaagttttatgtaataatgataaacctcaatgtgaaggtatacaatgtgatatgccaaactgcccttttggagatatattgaaatatcccggagaagaagatactgcttgttgtccctattgcgaacataatccaaactgtgaagtttgcggcgatctaccaaggtgcgctcctggatcttcattgaggcttaaacaaaattcttgttgtccctcatgcgaaccattcgctgactcataataaatcaacgaaatattgtaacggtccgaaacaatgacttacatcaaatgaaaaattaccaataaactaatgaattatggcaagactcag

SEQ ID NO: 496 - DNA, 1684 bp, Diabrotica virgifera
aaaagattcaatgtggtttcaaaattgaagtcgtaaagttgtctggccgaaaaattgaagcgaatcattgaacttacttttttgttatcttttcaaatgtgcaaacagttttcagggtttcaatatacagggtgttgttttaaggtcacaattactaataatacctgctttttaatgtggagttcttaaaaaaattcaatataatttcaaaattaaagacaaaaaattgtctggccgaaaaattgaagcgaactattagacttagttttttgtgatcttttcaaatctgcaaacagattttcaaaatttcaatatagagggtgttgttttaaggtcacaaatattttataattttttgttggtccggacctggatttttctcgtggttggtatgttggtcgtttgggttttgaatgagacgtgtgtgtgccagatgtcaaggaaatatacagggtggttctagagttgtggcttaggaaacggatgggcaaggtcgatggagcgccctgtagctcggttataggggtcggtagggcggaaaatttactatatatatacccggctcggtggcctctgttcaccattgaagtatttccgtttcccaatgaaacaccctatatagtccaaacaggcttatgagattcaattaatcgtccaacactatattacggaatacaatttctacgcactctcagctcgaccaaaatggcagagcttgacgtacccaagaaactaactgcggtaacgtaaatgtacgtaagtaattaattgcacaagttagtataggggggggggggggaatatcaaacgctttctgcgtaaatcctggactgagacacggagatccgttgtccccactcttgcggctgaaaagcggtcatatgcactgaggctgaaaaacattttgtgtcgattgcattcacgggaaaactttagataactgttcggcagcaaatatttcttgggatgttttgtccggtatttttggtggggatattttgtcaaaaaaagattgtggggattatttgtccgggatttttgtggtgattctttgtccggggattatctgtccgggaattttttgtccagggatggtttgtggggattttttgtcctggattatttgtccggagattaatttttcctagcttcattttaacccaacttttgacgagcagtttatcttttgccttgcttttaatttactacttatatatgagcttacatggccgtcgtgtattttgaatgctttgaaccgtaatcccacattttaatcaccattgctatcgttggccttcgggattccctatatttgttttccctagggcttctccgtgaaaatttaaaaaatagttaaaaatggtaaatattaataaccaaaggggtaatttagcctattttattaaatttaaagcccaaactttgttcatttttttaaggaaccccccttttatttttaattaatgggaaataaaaataatcaaaaattttttttttattttttttttaggggaaaaagggagcttttaaaccaaatttttaaaccctccccaccattttttttttctaacaggttttttttttttttaaaaattgggaaaattttttcttcccggggtgttgcggtgtttcccttttttataaaacaatttttattttttttgtgtgtgtgttggttttttat

SEQ ID NO: 497 - DNA, 971 bp, Diabrotica virgifera
tactatttgttcaaaatatccagaaatgaagtttatttgatgattagtctaattaaagccacgctgtttttacattatattgaaaaaaattaaattgttatcatagcggtattatattttttacggaaatataatgagtttttttggatttggccaatcagccgaaatagaagttactttagatgggcaagataacagaaaaactgcagaagttaaaactgaagatggcaagaaagaaagattgtatttgtattatgatggtgaaacaatatcaggaaaggtgaatgttagtcttaagaaaccaggcactaaactagaacatcagggcattaaaattgagtttatcggtcaaattgaaatgttctacgatagaggaaatcatcacgaattcatatctttagttaaagagcttgcaagacctggtgatatgattgcacattcaagttatcctttcgaatttagtaatgtagaaaaaccctttgaagtttatacaggcactaacgtgagattaagatactttctgagagtgacaatcatcagaagattagctgatataatgaaggaaattgacatagctgttcacacactctccagctatccagaaatgaataactccattaagatggaagtgggcattgaagactgtctccacattgaatttgagtacaataaatcaaaataccatttaaaagatgttatcgttggaaagatctattttctattggttcgaataaaaataaaacatatggaaatcgccatcattaagaaagaaaccacagggtctggtccacatacatatactgaaaacgtaactatagctaaatatgaaattatggatggagcacctgttagaggtgaaagtattccaatacgagtatttctggcaggttacgatttgactccaaccatgagggacataaataaaaagttttctgtcaggtactttttaaatttagtattaatggatactg

SEQ ID NO: 498 - DNA, 1056 bp, Diabrotica virgifera
  misc_feature (1022)..(1022): n is a, c, g, or t
gtttgaagtttttagaaaaaaactttgtagtaataggtattagataacattagtcatttcgtcaattattgataccacttcatttacgatttaagtaatatattaacaaagatctgcagcaaggctgtttaaagtaaataaatttggaaacatacatcgatattcttcatcgacgaaaagggagttcaaagaaataaagatcaaggtgccgtggggatatgtagctggaaaatggtgggagccctatgatatacgacctgtattaaccatccatggctggcaagataattgccagtccttcgacagactaatacctctgcttaacaaaaatgtaggcttcttagccatagatttaccaggacatggctactcatcaaaatttccgaacggaatgctttatcatctcgcaaattacttactgatcattaaaagcctatcaaaaacctttgaatggccgaacacatcattgatgggacactcactcggtgctgtcacgtcatacatctattcaatgctctacccttcggaagtagactatttgatatgtttagatgcagttaaacctatggtcagtaaaaaacaacaccagcattatgcggcagcactcgaaaaatttttcaaatataataatttcttaactagtggagaaccccccagttataccatagaagaaatatcgaaattagtttcaacagcccatagacattctattttgcccgaaaatgcgaaatatatctatgaaagaaatatagctccttctgaagtccatccaggcaaatactatttcaccagagatccgagactgaagactggttcatttaccacatattgccaaagagatttggttgaattagcccaacatatcactatgcctatttttatagcaaaagctaaggattcaatctattacgaggacaaggagaacttttatgagagtcatcgatgtcataaaaagatcaagttccgattgtgattttcattatgttcctggtagtcaccatgtgcatctaaacatccagaanatgtttctgatttaatcatattttattaggaaaa

SEQ ID NO: 499 - DNA, 925 bp, Diabrotica virgifera
  misc_feature (896)..(896): n is a, c, g, or t
aagaataaaactttttacagtggcataattatttgttgagcagccttcacagtttgttgctacaggtcagggatttggaacgtctcctcaaccgttcattgttggacacattccaccagtgaggcttaaaaatcaaccaatacagaaaaaaatggatcctccagcatgcgttcagaacgccatgatgaccaaagacaagaaacccttcacctacacccccggaggaatagacctctccgaagctcgttctcctcgactacaacgaagaatcgagagaaacgctaatttaggcggagttggtgacatacctcaacaccctgctcctcatcctccaatctcaggccctcttcctccatctgccttggctgctatgcgccctcaaccgcaggtgcaagtttttccttcaggtcctccaccacctgcgcccatgcgcggtggagcacctcccccaccaccaccacccaaacaaggaattcctcccccacctcctccacctagttgtccattacccactcaaaaagtacagacctctgataatcaggttctagaaaggcctgatatgactaaaattatcccagataacccgatggcattgttgagaaagactggaggaccgcaaccaaggagaagcttagttgatcaaatatttgaggaaagtggaaagagtgctccagagcctagaactccaccagtccaaagccagcaacaatatcaacctccacaacagagaattcagtctggagggacaccaatctcccctgtaccacaacaaacatacaaaccttcactaccgcagcaacaacagcagtaccaaccacaggctcaaccacaataccaaccacagcagtaccaaccacagattcagcaacagcagcagtatcaacctccgattcagncaactaccccacccagagaaacatattct

SEQ ID NO: 500 - DNA, 1235 bp, Diabrotica virgifera
gaaagttggtaggagtcataaatattaaatttttggtacgaccgagtaacgaacaacctaggatatccacgccaaattcacaagtaacaagttccagtcctggagtaggagcagccctggcggcgttaggaagtctcggtggaatcttcggcaatcacttacaaatgttaggaagcttaccagctttccagagtccgcagagcctgcaacagctgcagcagctggcgatgctgcagcaggctagcggcaaccagatgaatccgcaggctcagtttttatttcaaaatcagggttttctacaagggttccctagaacaagtataccttctagacccccacatacaatgcaggtacaacaaatagcacaagctgcccagcaactacagcaactgcagaaagtacagcaaaacacaaaccaacacaataccagcattcctcaaaatacgacgttacctcatcaaacgcagaccacgcctccaaacaaccacaatatacctgccagcatgcttactccaagcacgcctagttctggtggacttacgccgcagcatcttaaaacaccctcaaggatactggaaccatctccagaagaaaccacagatttggaagaacttgaacagtttgcgaagacgttcaaacagagaaggataaaactaggatttactcaaggagacgtaggtttagcaatgggaaaactgtacggaaacgatttttctcaaaccacaatttctcgatttgaggcattaaaccttagttttaaaaatatgtgcaagctaaagccccttctgcaaaaatggttagaagacgccgacagcacattaacaaaccctggttccctcagcaatcctctaaccacaccagaaacgataggaaggcgaaggaagaaaaggacctcgatagaaaccagtgcgcgagtagccttacaaaaggcttttgatcaaaatccaaaacctacttccgaagaaataacgatgatgtccgatggtctctgtatggagaaagaagttgttcgagtctgattctgtaatataaggcagaaagagaaacggattaatccacctacatcagtgatgtgctcaccttgttctagtgataacacgcatggaaatatgtttcatatcgctaatagtttaggcactagtcctctttcactcgttacgtcaagtggccataactacaatcatcccgagcgtcatgatcaagaaagaatgaccatcactgaactttttagctga

SEQ ID NO: 501 - DNA, 975 bp, Diabrotica virgifera
ataaaatattaatattaaaaaaataattttttgttttagtagcaaattgaattaaatatatgatttatagtaaatagtactgtgaaggaattattaaaatttttataaaagtagctaatttgggcttaccttttgtatcagggtttattaatttttttaatttaaaatttattttcccgaaattttaagatatataataaaattacatttaatgttttaagattattataaattttattatagtgaatatattttattcaattaaaaatatctggtttttttataaataaatttaatttatgattattttaagtgaaatattatattttgttataatcttcaattttctaggataagctagattatttttctaaaaattaaatttatattgaatttaaggtaggtttaataatatccatcatttatttttttataattattttttatataaaattttatataattttgttttagatttttataaaaattcatattttaatataaaaaatattgtaattatgataaaattagtattttatataaataaaatatagtaactcggcaaatgttattttcgcctgtttaacaaaaacatggtcttttgtttatataaaagatctaacctgccctatgatttattttaaatggctgcagtattttgactgtacaaaggtagcataatcatttgtcttttaattgaaggctggtatgaatggttggatgaaaaatatactttctttattttataaaaataaattaactttttagtcaaaaggctaagattttattgtaggacgagaagaccctatagaactttattttctttttatataacttttttagtttttaataagtttatatatttatgttaattatgttggggtgacagaaaaaatatataactttttctattttttcatttatttatgtgtttttgatcctatatttatggataataagattaagttaccttag

SEQ ID NO: 502 - DNA, 446 bp, Diabrotica virgifera
agcaaacgcgtccgcgatcttttttattttactgagcctgatgttcttggaatttgtcgttggcgatgatgttcaatattatactgattcaactacatctgctcctgatcctgctcctttttggacaacggcaccaatacccagatccacaagcattggtgaagatgtagtttacgtacaagatcgacaagttcccgatccaacctatgagatagatgccgtggaagcattcaaagaagctaaggcacttcatccagttgttgacggtacacaattgttagaaacattttccaagttgtttaacaacaaacatccgatagatggaggatggaaagttgttgaaaatttgggcccactttacaatccaaatgcagactacatatatattgaactgagagttatagatgctaatggagataggacaatccggatatctaacgcaaaaa

SEQ ID NO: 503 - DNA, 869 bp, Diabrotica virgifera
gttaaaaaaccttgacatagctccagtactgacctggccgttaatacagtaatatgaattgttattttctttcaacaatgtgtttgttaaacttttaactggtgtgaatggttcatgccggtgattttgttttaaaatctgttttgttttcttgggctttattcgactccacgtgggattcaaagttcaccgttttcaagtaacctcttgaaatttcgcacaaaatgaaatttaaaattcaattgttatcaacgtttttgtgcaccagtttagtttatgcatacatagaggagcctggtccaagatacccaccaaccaaaggagagctttggccaaaaccataccatcaaattaaaaaccatagtttctttacagtcaggaaggagcacttcaactttaaaataatcaataacacgtgttcaatagtagaagaagcaattaagaactacgaatccatcattttctcaggatatactttgatgcaagaaaacttaaacctatccaatcatcatttagaaaagaaaccgtggctaagtaatcccaaatacctgggaatattagatgttttagaaattagtctcgatatacactgcaacggaaaagagatgccttcagatcacatggaagaagcatatacaataattgtttctgaagatgtaaagcgattaaaggcattttctgtatggggcattctaagaggcttagagtcattttctcagatgatatatatgaccaatgaaggactatcgttacgtattaacaaaacttctgtggaagatcggccacgattctctcatcgtggactgcttatagacacctcaaaacattttattcctataaagaatattctacttacactaaaccccgat

SEQ ID NO: 504 - DNA, 798 bp, Diabrotica virgifera
tcgcaccacgagatgaagtcgatcgtggttgttttattgagcctaatttccttggcacttgttgcttgcgatgattcagttagtacttcgacagacactccggtaatatcaacagaggtaccagcaccgatatcgacaagccttcgtgaagatacagtttacgtagcaacttcaaatgttcccgacccagtcttccagatagatgccgtggaagtattcaaagaagctaaggcacttcatccggttgacggtatagctttgttagaaacattttccgatttgttttacgccaaacataaagtatctggaggatggaaagttgctgaaaaatatgattacttttataatccaaatataaactacgtgtatattgaattgatggttaatgatgctaatggagaaaggagggttatgatatttaactaaaaaaataaactgttttaatagttaacaattattgttaactcttagttttaatttcgtctttccaaataaataaaaataattcactgccacgcgaacgcggagcctagcaaatcacatggaagaagcatatacaataattgtttctgaaagatgaaaagcgattaaaggcattttctgtatggggcattctaagaggcttagagtcattttctcagatgatatatatgaccaatgaaggactatcgttacgtattaacaaaacttctgtggaaggtcggccacgattatctcatcgtggactgcttatagacgcctcaagacattttattcctataaagaatattctacttacactagacgcgatggtttaca

SEQ ID NO: 505 - DNA, 924 bp, Diabrotica virgifera
  misc_feature (900)..(900): n is a, c, g, or t
  misc_feature (911)..(912): n is a, c, g, or t
taataccacattagtgattattgctcattaataatttcgttttgtattagggatcatgaagactttcattgtactatctttcctttgcgtcgccgctttggcctccgaagatttttgctatcaagacgcagttaccgcatgcaatccaactgctgcgaagtatgttgacaagttgaattgtacagccaaatttggagctatcgatgcagttgaatctgacctacagaagttcataaaccatcatttcatcagatccttcgagtatctactcctagccaccaattttgccacatatgaaagaaacagagcaggattcgaaaaacttttccgtggcttgtctgacaacaagtggcatgaaggtattgaatttattaagtatcttacctctcgtggtggacacatgaacttcaatgctatttccaaagacatcaaaggagaagaggcagaagctcgtagctttgacttgcgtgaacttactgctattgctaaagctctggacatagagaagaagtttgttcatgaagctcactccatccatcgtgaagctaccagaaacaacaaacagttccacgatcctgaaatttccgattatttggagaaggaagttgtgcacaaggagagagatcttatcaggaagttagcagggtacagtactgacttggctggtctccttaacggaccagacagttcattggctctgtttatgtttgatgactatttacaaaagcagtaaatatttatttttaagtttgtgatttaataatattccatagataggttagaatcacttttcgataaatgtatcatcttcgtgtgattattagcgagtaagaatgtttgtacattattcacaaatgtctataattatgttttttaaatagtaaaataaatacatctccngataatactannaaaaaaaaaaaa

SEQ ID NO: 506 - DNA, 1069 bp, Diabrotica virgifera
tgcgcacgtcgtttcatattttgatttttggtgcgttattacgaatataaaactaaaaccttgtttattgattgttattcatgattacgctgacgagatgccagggatcatgaaggctttcatcgtactatccatcttttgcgtcgccgctttggcctcccaagacagctgttataatgacgcagttaccgcatgtgatccagctgctgcgaggagtgttgacaagttgaataattgtaatgcaaaattcggaggtatagattcagctcaatcggatcttcaaaaattcgtaaaccacaacttcatcagatcctttgaatacctgcttctggctaccaacttcgacaactaccaaagaaatcgcaaaggatttgaaaaacttttccgtggtttgtctgataaaaaatggaatgatggtattgaattcatcaagtaccttactgctcgtggaggtgaagtcgactttaacgagatttctgacggcgttaaaaaagaagaggcccagccagtcagctttgatttgaatgaattgaccgcagtttctaaagctttggacttggaaaagaagtatgtccatgatgccttctctatccatcttggagctgctagaagcaacaaacaattctatgatcccgaacttaccgattatctagagaaagaagttgtacacgagcaaagagaaattatcagaaaactggcagggtacagcactgatttgtctggcctccttgatggaccagacagttcgttagccctgtttatgtttgacgactatttacaaaaacaatagattttaaatagctagtttaaaactattagatttactttctaaaatatatttccttatttttgcatattattcaacatgtctgtaacataattttcaaaataaatccactcttaaagttaacaacacgataaagaaaaaagaaaaaaaaaataaaaaaaagaaaaaaaaaaaaaaaggggcgcccgctcgcgatctaaaaatagcgctcgttcgccccacgcgcccaaaattatacctgacttgaacggctttcttgaaaaaaagtgaaatggaaattaa

SEQ ID NO: 507 - DNA, 1055 bp, Diabrotica virgifera
gcactttcttgtggttgtggagaattttcatgcgcccgacacagttgcgcacgtcgttttcgattattgagattatccgaatgcgtagacaacaaatataacaaaaacttgaatcgtttattgttattcatgattacgctgacgagatgccagggatcatgaagactttcattgtactatctttcctttgcgtcgccgctttggcctccgaagatttttgctatcaagacgcagttaccgcatgcaatccaactgctgcgaagtatgttgacaagttgaattgtacagccaaatttggagctatcgatgcagttgaatctgacctacagaagttcataaaccatcatttcatcagatccttcgagtatctactcctagccaccaattttgccacatatgaaagaaacagagcaggattcgaaaaacttttccgtggcttgtctgacaacaagtggcatgaaggtattgaatttattaagtatcttacctctcgtggtggacacatgaacttcaatgctatttccaaagacatcaaaggagaagaggcagaagctcgtagctttgacttgcgtgaacttactgctattgctaaagctctggacatagagaagaagtttgttcatgaagctcactccatccatcgtgaagctaccagaaacaacaaacagttccacgatcctgaaatttccgattatttggagaaggaagttgtgcacaaggagagagatcttatcaggaagttagcagggtacagtactgacttggctggtctccttaacggaccagacagttcattggctctgtttatgtttgatgactatttacaaaagcagtaaatatttatttttaagtttgtgatttaataatattccatagataggttagaatcacttttcgataaatgtatcatcttcgtgtgattattagcgagtaagaatgtttgtacattattcaacaaatgtctataattatgttttttaaatagtaaaataaatacatctccgataaatacaaaaaaaaaaaaaaaagagcgacaaaaaaaagggcggccgctc

SEQ ID NO: 508 - DNA, 1549 bp, Diabrotica virgifera
  misc_feature (1449)..(1449): n is a, c, g, or t
  misc_feature (1507)..(1508): n is a, c, g, or t
cccatgccaccggcggaaaataggtgtagtaatttgtgaaatcgtgaaaaaccatttaaagaagtagatagtaaagtttcagaaaatgagtgagtctccaaaagaccgtagaggtcgcgatcgagatcgtccccggaataaccgagataaccggaataacaaaggcgataacagcagagagaggagcaatgatagaggtccccgtgaacctagaagcatgaggccctcccaaaacagagtgtacgtatccaacatcccatatgaataccgctggcaggatatcaaagatctgttccgtagcaaaatcggtgatgtaactttcgtggagctttttgttgatgataacgataagccgaggggtagtggcattgtcgaatttaatgattctgatcttgttggtaaatgtctcgagcttatgcagcgttatgaggttaagggccgtaaattggtggtaaaagatgatcaaggcattacaagagataaatttggggctattgttagtaaccagggaggtggtaaaagaagagagtacaatcgtttcaatgataacatgaacagcatgaatattgatttgggcaatactttgaatcttggtaatgataagtggggcaacacttatggattgagtccacagtttcttgaatctttgaaaatcgatccccctcttaataataaggtgtttgtggccaatttggattacaacattgataagaaaaaaataaaagatgtctttaaactagcaggtagagtcatcaatgttgacatgcctctagataaggatggcaaagttcgaggtttcgccgttgttgagtatgatcaccctgtagaagcagttcaggctatctctatgttgcaaggccaagttttgaatgatagaacattggccgtacgtatggatagagtcaacgataactccaaattaccagaaggattaagatctgtgggcatgggtctgggacctaatggggaagcgttgaaaaacgtggctcacaatttaccttcgttgggtagcggctcacaaggtgggacaactggttctgggcttttgggggctgtacctaatagttctttacagttggccaatgctctctcaggccttggcaatgttggtaacttagcaggtttgaaccaaaatttttccgggctagccagcactttgttgggaaacggattgggggctactgaattttcgtcgctggttcagaatcccctttcagcccaaaattcagcgacccagcaactctccggtttgaacaaccaaaactcaacttccggaaacctaggcaacttcaacagaggttcttcaggagataattatggtaatcagaattcaaacaactggagttcaaacaacaattcaagcaatggaggaggcaggaacttccagagcggaaataataattatggaggaaatgacagaatgagctttaacggaacaagacaagatgncggaggcaaaagcttttcaagaaaaagtgtgatctcgaatctcccctactctgctagnntacagctattacacgagaaattcacagaattcggagatgtc

SEQ ID NO: 509 - DNA, 1140 bp, Diabrotica virgifera
cttcacgcgtccgctgaggccttccttgaagctaaacaagaaggacgtttgccattcttcagagaaaaaccaagtctggctgcaatgacagaaggtcaagacctcgaattgacgtgtttagcagttggcgaaccacaaccgatagtccagtggttcaagaacgactccatagtggcagaatcacacagaatcaaaatctttacggacgcagacggtagatcgcatttcaaactaaccccagcccttaactttgatcaaggattgtatatgtcgtagctcgtaacaaaattggacaagtggtatctagaaccagaatagttctgggtctggtaccagatgaaccagatagtcctgaagcccagcaaatgtctgatactgagattttgttaacctggaaacaaccaagatttgatggcaatgctgctgtaatatgctacagcttggaatataaggcagcggatgagttggactggattaagaaggctgacaatattgatcatgagttttatttgatatctggtctggagtcgaacaagagctatatatttagactagcagcgaagaattcgataggctggagtgatcctggagtaccttctgcgccggttactactaaaccttcaggctcaccaaagattcaactaagcaaagcaatgttacatctccaacaacttacagacagtggaaaagaggtggacgaggaatccaaaacacgcttggattataaattagaatcatctccagtggaatgggaggactctaatgttcaacaggaatataacttcatttctgaaatagcgaggggcaaattctcggtggtacttaaaggcgtcgacaaacgcaatgatactgtcgtcgtagcgaaaattttggactacattgacaaaaccagagaagacgttgagggtgaattcgcagcattaagatcgctcagacacgagagaatagccagtcttctagcagcatatcgcaccaacggcactgctgtatttattttggaaaagcttcaaggcgccgacattttaacatatttagcaagtcgacatgaatacactgaacaaaccgtaactacaattgtctcacagaatctggatggtttacaatatttgcactggagaagactatggcatttagatttgc

SEQ ID NO: 510 - DNA, 1604 bp, Diabrotica virgifera
  misc_feature (1410)..(1410): n is a, c, g, or t
ccgtgagagatagccgccatttttaacattttatattttcgatttcggttttcgtaatttgtatgacgtgtatacccgactagtgataaaaatatgagtagctcaccggagccctccaacaggatctctccaaatcccttctcgccaaattatagacataaaagtgactccggatctaaatcacccgtttcaaatcgcaggcaaaatgggtaccttaaaaaatcacaatatgatagtgacagtggtgatagtgactatgctcaggaccatgtgagagaaaatagaaaggcccgttcacgaagtcctgatcaacaagatcgtgatagggacagacgtgaaagacatcgaaccagagatagagatagagatcacagaaggcagcgatctagaagtagtagttcccgatgggagaagaaacagaaaagggacagagacagagatagatgtagagatgatgatagggacagtactagtgaaagaagctatggttgcatgcccattggagccagtggatctgaaattattggattcaagagccagccaccaaataacactataatgattaggggcctagcacaacacatatctgagtatgatataagacaggacataataggatgtgatctatttccaaaggacatccgactcatcaggaagaaagacacaggtgcttcccgcggtttcgcctttgtcgagttttccacactgggtgaggccgttcgatggatggagaaaaaacagggtgttttgatgctccaagaccaataccgtgctattatgcaatatagcataccgaaggattcgaattccgccgaaaaaacaccatcctataaggcttcagctgattggttttgtataaagtgtggagctcagaatttcaaaagaagggacaattgttttaaatgccacgcatccaaaacagagagtgaggaaggaggtagtggtagtgacgaagtgtgcatgtatgcgaccaaaactatcatgttaaggaatttggacccattgacaacggaagaatctgtcatggctgtactgaagcaaatcataccggaattggtggaaaccatttcggtcgtatgtattggacgggatcctctaacgtcaacctctagaggcctctgttatctagaaacaagcagctactgaatttattggatatgccaatatggcttcggcagacataggattttctgttttggaaaagaaagccttagtaggacccactacatcagctgccactagttctactccacttgcaccttacattaaggaagtcgatgatcggtcacctactcttccaggtcctcttgtagcagggtatggcggagaaagtgattcttcgggtgaggaaagaagatgacttcctagactacacaaatttgatttgcaacctctgcaaacgtagattanactcagcagaagctttaaccaaacttcctaagatgtcatctttgcatctacagaatctcgaattacgcaacaagaaatctacttaagttttcgatgagacagtgggctgataaagctgctttacccgtgatcgtgctaaaagaaagaaggatgaaaattttggggatccagatgctcaaaagcctagtaagctc

SEQ ID NO: 511 - DNA, 428 bp, Diabrotica virgifera
ctctaaagcaattttcttcatcaaaaccaaaatgttttcaactcctttcaaaatcccacgcgtccgtgcagtattaatattggttaccctttcaccatccagtgcagataattataacaaatgtccagaaaccagccatgaacgatacctaatttaccagaatactttaaaggggagagttatccatgtacgcattccaggaacgggtttctttcacgctccaatcacttgtcttcaggtaaccgacataaatgagagttttagtacaccagttatagaagaaggtggatatggaaaggagtatgtagttttacgtattgacccagttcaatcaggagaacaactgcagtacgatgttcagatttatgttgaccaataatcaagttatctttaaataaattttttggtctgtaaaaaacctcgtgccg

SEQ ID NO: 512 - DNA, 1338 bp, Diabrotica virgifera
atattatttgttctgtgaagcagctttgttaggaaaaatcaaaatgttttcagctacgtttaaactgttatttttgataacagtaatattggtatccctttcgccatccagtgcagacaattataacaaatgtcctgaaaccagccatatacgatccctaatttaccagaatacattgaaggggagagttatacatgtacgcattccaggcacaggtttctttgaagctccaatcacttgtcttcaggttaccgatataaatgaaagtttcagtacaccagttgtagaagaaggtggatatggaagggagtacgtagttttacgtattgacccagttgaatcaggagaacagttacaatacgatgttcagatttatattgacgaagctgttacagcctatcctcaataaatgttcggtataaatgtttaagaaattcgagtagcccctttaaagataagcagttgctggtattttaacagcattactgattgtaagttaatcatttcagaccttcacgtaaactatgttgttacaaaaacgcatattaggacaataatccaaattattagacaataaatattaggcaagagaaattaaacgagtttctagttttaagtacaaacaagtgaagttcatcagcaaaacagaattcagaattattctacgtattatattaaaagcactatttggttaaaagttatcatttttgggggtaaaagaatctattaatttgtcttgagtaaaggtagtatttgtttaaatttgccgaccgatgataggtagattgggccaagtacagtgggtgatcatattattagagccacctaatatgttcagtgttttggaggaatgtttacaatgttttgtaatttaatgtttacaatgtttagaatgtttacattaaattacaaaaacgcatattaggacaataatccaaattattagacaataaatattaggcaagagaaattaaacgagtttctagttttaagtacaaacaagtgaagttcatcagcaaaacagaattcagaattattctacgtattatattaaaagcactatttggttaaaagttatcatttttgggggtaaaagaatctattaatttgtcttgagtaaaggtagtatttgtttaaatttgccgaccgatgataggtagattgggccaagtacagtgggtgatcatattattagagccacctaatatgttcagtgttttggaggaatgtttacaatgttttgtaatttaatgtttacaatgtttagaatgtttacaatgtattgtaattcaatgttttggaggaaggggatataattgggctgtatcatttattaat

SEQ ID NO: 513 - DNA, 966 bp, Diabrotica virgifera
attttgtgctgtgaagcagctttgttattaaaaatcaaaatgttttcaactatttttaaactgttatttttggtaacaacattaatattggtcgatatttccccatccagagcagataattataacaaatgtccagaaaccagccatctacggtccctaatttaccagaatacattaaaaggaagggttatccatgtacgcattccaggcacaggtttctttgaagctccaatcacttgtcttcaggtaaccgatataaatgaaagtttcagtacaccagttgtagaagaaggtggatatggaagggagtacgtagttttacgtattgacccagttgaatcaggagaacagttagagtacgatgttcagatttatattgacgaagacactcgtacaacagcatggaggaaaacacgtcaccaactctaatttttttataacggaatcgattttgctaaaaattttggaattagacttatcttatcccccttatctccctcttcaaaagttatatatgcgctggctaatatttttatttttaaggggtgaacacgacctcatattgaaaaaataaatattaaagcatttatggatttaaatcaaaataaatcaaatgcaacaaaaaaatttatattcactgttattgaaatattgtcaattataataatgattattttatacattgtcaacccttcaacaatcttaaaaactaccccctttaataaaagtaaatgtaataaatcgttaacaggctcaaaggtttttgtagtgcagttatatcatctacaatgtaatgctttgcctatatacaaattttttggctaatttacgaacttcaaaatttaaaagtacccctttgtaacatatctatttacgaaaatctttccaccaccttcaaaaatttaaatgtccattttttatcaaaaaaggcctttttttgtcaataaaaaaaaaaatttttgttcc

SEQ ID NO: 514 - DNA, 973 bp, Diabrotica virgifera
aacaactgtttcggtcgatgtatgttgtgcccatgtgttcgatgaatagcgttttgtttggaattaaatacttaattaaatcttttgtgacagttaaagaatgaataaaaatttcgttaaatttcaacaaatagcaaaatatgccacaatggctgatgtacaggcgaggtttgttttaccgaagagatatgaagggtctggatccagtgtttggacggaatacatccaaatggctatagattataaaccccttaatcttggacaaggtttttcagattactctccgccgaaatacattacagataatctagccgaagtatcacattcttcaaatccattaatgcaacagtataccagaggattcggccaccctagacttgtcaaagcaatagcaaacctttattctccattgataggaagaaatctcgacgaaaggaatgaagttattactacatctggtgcatacgaggcacttttttctgctatttctggacatacagacttaggagacgaagttattatattagaaccgttttttgattgctatgaaccgatggtaaagtacgccggaggtgttccagtatttattccactcacgccaaaagaatctcgtggtaaattaccaacatcagccgattggactttcgacaaactggagctagaaaaggcgtttaacgaaaaaacgaaaataatcattgtaaattcccctaataacccactgggaaaagtattttcgatagatgaattaacgtttattgcagatctatgtaagaaatggaatgttctttgtatttcggatgaagtgtatgaatggattgtttataaacctcacgaacatattaaaatggctacattacccgacatgtgggaaagaaccattaccattggatctgcgggaaagtcattcagtgtgacaggttgggaagtttggctgggcgtaatggccctgagtttttaatgaaaaatctacata

SEQ ID NO: 515 - DNA, 1218 bp, Diabrotica virgifera
aaacaagagggcaatatttgaaacaatagatacaacccctattgttaatacagtcgaatcttcagtaccaaaaaagacaaaaaccgctaagcaaaaaatagtttctaaaaaatctaaaccaataataaaacaaaatcaaacccaaccaaattcagaattagttgaaaactcaaatgaggcaacaacagaagaagatgcaaatgaaggaaatgtaaaacatgatataagtactgaaggagcagaaaaaacgaatcaaccaaacacacaaaaagaaaaaaagaaatcactagatcaagatgtacaaaagatacttggtgaagtccagaaacgtattgggaatactggctttacttgtaaaacatgtaatttaagtttttcagatagaaagtcgttcaatctgcacaaacgaacccacggaaaaagccaatgtcatatttgcggccgatacattacaaaagacaatatggggaaacacgtcaagatgcatacagcaggtcccgaagtgtgtactctttgtggactcacgttcaaaaattttgactgtttaaggtgtcacatctatcattatcataagcactctgctcaacagttcatgtgtgaagaatgcggtaaaagctttcgaatgaaatatacattcttattgcataaaaaaaaggttcatatgggtataaagaactgtaaatgcagtacttgtggaaaagctttctttgccaactccaagttattaagtcatatccgaatgactcacgaaaaactgagacctcatgtttgtgaatattgtggtactggctttttttctaggtatgctttaagaactcatgaaagacaacataccgatgaaaaaccgttcgtttgtcagcactgttcagaagggtttagacagcgggtttcattacgatcccatttgaaatcaaaacatggaatagaggaagccaaggacttcttgtgtaaaacttgtgagaaaggtttcgctacagattacgctttgagtgtacatcaaaggtcacacgaaactaagaagtgtgaaatttgttcagaaaattttgctggagatgaatatttggcaaaccatctaagggaaatccatcatctggaagtagaaatgaatcaagatagttaaaattatttttggtttgttgtgtccagtatttcttgaattaagtaatttccttgtattatttgtatgtgctttacctctacgaggctgacataagtaat

SEQ ID NO: 516 - DNA, 931 bp, Diabrotica virgifera
  misc_feature (860)..(860): n is a, c, g, or t
  misc_feature (883)..(883): n is a, c, g, or t
  misc_feature (906)..(907): n is a, c, g, or t
gaataaacttcaaatacattgttaaagtaaattattatatttaaatattaaggaagtaaaatgtgtacagttaaatacgaatacataccggatgatcatctaataaatcgtatatattttgcatcgaaggatggtatgtcaattgccctatacacatcaattggtggacttgacaaaaataaagttaatgaacttttaaacgagacagtggacgatgctgggcaacgatgtactcctcttatgatagccgcaaaaaaaggacatgataaagttgtgagatcgctcttaacaaactacgaacctaatttggaaaaggaaggtatcgtcagatttgacggatatgttatagatggtgctactgcattatggtgtgctgcctttgcaggccacctaagtatttgtaaatatttaataaaagccggttccgacgtaaaccacggaactaaaactgattctacacctctccgtgccgcttgcttcgatggccgattagacattgtgcaatatctagtacaccacaaggctgatattaataaagctaataaatataataatacgtgtttgatgatagcttctttcaagggacatttagaagtggtaaaatttttattagaaaatggtgctaacgtcaacgaaagagctctctgtggcggcacagctctacattttgctgctgaatctgatcacgtcaaagttgtcaaagaattacttaagtacgatgctatattctcaaccaacgaagctggattgacgcccattaaatcagctgcagagaaaacgaaagagagggtagtggaatttttaattagtagggaagatataacagtcgaagatagaatcgaggctctagaactgctagngtgcgtcgtttgctaacgataanagaaactacgatattactaaggnnctacaatatatgctttttatcatg

SEQ ID NO: 517 - DNA, 1114 bp, Diabrotica virgifera
cgttcacgtgacgtgtacggtaacttcgatagtatttattaatatgggtgcttaaaatttttgtgtaaaaataatgaatatcgacgactttttaaactccagtggtgaggaaggcaacagtgatcttgaaaccatggatgttgcattgggttgtgaaaatccggagctcatgagctccgaattttttgattcagtactctcattagagaacaatatggatgatgaatttttcccaaattttgaagaggatgttaatctgtccagcgatgccagttctaacgtagacgaagtcttatcgccgcaaagttattattccgaaagtgataagaacagttcttgcttggaaaattatgatgacaccagtaccatattgggaaatattgatggttttgatgaattaatgtccattttagatccgattccagatgttccagtaaaagaagaaattaagcctgttacagtacctcctactcccgttcaaaaattacccacacaaatcctcattcagaatcctaacaacaaaaaatgtatagcaaggcccatgataactactactagtcaagtgaaaaggcctttaataaaaactaaacctcagatacttaaagtacaacagatatcaaataatggtagccccgttctactaccgcttaatataaaaagtataaaaatactgagcagtccggcagaggttgctgctctgaccaacaatatgagaaaaagaaaggtggaacctaaaattgaggatgatactaacgttgtcagctctacaaatcactatccaccactagtccttacacctgaagaaaagaggctattagctaaggaaggtattgctctgcccacccaccatccactaaccaaaaatgatgaaagagagttgaagaggattcgaagaaaaatcaggaataagatttcagcacaggattccagaaagcgcaagaaagagtatgttgacagtttggaggagagagttgaagaggttctgaggaaaataaaaacctgctacaaagagttaaggcacttcagaggcaaaacaaaacattgattgctcatgtgaataagctgcaggccttaatttgcaactctacaacatcaaaagctacaccatctacat

SEQ ID NO: 518 - DNA, 1542 bp, Diabrotica virgifera
  misc_feature (1457)..(1457): n is a, c, g, or t
  misc_feature (1467)..(1468): n is a, c, g, or t
gatctagtgaccagccttgaagctatttctacacagagtggtatagtgtctggtgtagttgataatctcacaagagccatgactcgattgtcggatagtcgtgcttctctcatcttatctgatggtgatattggattcgttgattaccaaacacgaatggtggactgtgcgaagagtatagctaaaatcgccggagaaattgctagcaaagctgccactgaccctcagaaggtggctcaattatctgcagatcttgcgcacaaatatgcacaactatctggcgatagtattggagctgcagcagctgccactaatgccgaagttgcaatcagactaagggaagttgttcaacaactgggtggcgcctgcgtagaactcgtccaaacaggaggccagtgcttagtccgaaaagatgacgtactcttgcgagaagtaggagattgctcacgcaacgtaactgagaaagtttcccgtgttcttgccacattacaaaacgaatccagaggtacccaagcttgcatcaatgcagcttccaccgtatctggtatcatcggcgatttagaaactaccatcatgtttgccactgccggaaatctcaatcccgaaagcgaacatgaatcgttcgctaatcacagagagaatatattgaagactgctaaggcgttggtagaggatactaagactttggtagctggcgcagcttcatcacaagaacaactggctgtagctgctcaaaattctgttgcgaccatagtacaattagccgaagtagtgaaattcggagcagccagcttaggcgttgacaatccagattcccaagtgatgcttatcaacgcagtacgtgacgttgccagtgctcttggtgacttgattcaagctactaaggctgctagcggcaagcccatcaacgatccggccatggctcatttaaaagacagcgcaaaggttatggttacgaatgttacatcattgcttaagaccgtcaaagcagtagaagatgaacataccagaggtaccagggctttggaatccaccgtagaagccattggacaggaaatgaaggcactatattcaagtgaaggctacagacagggagttgtagcagaagagttaatacgctgcaccaaagcattaacgaacgcgacagcaaaatgtgttgcagctggtattagcaacaaacaagacgatatcattgcagccgccaatctttccagaaaggctatctcagacatgttaataatttgcaaaagtgctgcctacagcttggcagaaactccagaattaagaacagaaaccttgaatgccggacacgattgcgcgaaacaattcagagaacttctgcttcttatcttgcgagacagtggcacaactgaagtcaaacaaattttgcctttgacgtcgagaaagattgcacagagcgttaccgaactgctgagtgtagcaaagaggctgaaagngtctgattgnngtgatccagaagatcctacagtcattgctgagaaatgagtgcttggggcagctgcttcattgacgctgctgcta

SEQ ID NO: 519 - DNA, 1216 bp, Diabrotica virgifera
  misc_feature (971)..(971): n is a, c, g, or t
  misc_feature (1121)..(1121): n is a, c, g, or t
ggacatttattgaccctccttggtcctcgctgtttctactaaaaggttggtcctgcgagggttaactattctttataactttttcgattttaaatatctttttacaaacctggagcacctgctacagttcgtccttattctggtggtgagtgttgcccagattcgtcttgatttgtcgaaacctggcttacttgtaacacgtggcgtattccggttggtaggtgttgcattcatctccgagtactcgactttgtctaaattgtttttaattactaattttgcaatttgtagaagagaaatagttctaaaaatgaatgcttctaagacaagcatgtatgttagtcgccaacctcactgcaatactatatttggtcagtgttactacacgacacatagacttggactctgaaagttgatacgatcattcgcctagaggcatttgagatgaggttgcatggaagaatgacccaaatatcctggagaggcatccataccaacgaagctgtgttaaatagagttcgttggttattgagaactgttaaaataagaaaaaaattcctaacgagggcatgttcttagaggagactaatagtacaggctcattcggcttatcatgaaaggtaaatctagggctgcagaggaatttgaactaagcagatgtcatgatgatgttcttattacaaccaaccaagaactagccacaatgttgactcaactagcacaagcgttagaaaagatagggttaaaaatgaatatgagtaaaacaaaaatcatgacaaatacaaacgtaaataacatacagcgtttttggaaaattaagatggatactaaaaaccacacacatacaacagtaccaaaaaacagtaaagatccgtgtatttgatcagtgcatccttcctgttctgacgtatggctcagaaacatggacattaacaaaggtcaacctaaacaaaatagaaataactcaaagnaaaaatggaaaaaatccatgttttgggaataaaactacaagaaaatcaaacaaacgaataaaagagaaaacaaaagtaaaacatgtaacagaactataaaaagttttaagagtgaagatttgcgggccataatgcgagacaggaagatanaagatggaatgctgaaataccaaactggagaccgtggaacaggaaagaagaggaagacctcagatgccgatggaaggacgatattataaaagctg

SEQ ID NO: 520 - DNA, 2155 bp, Diabrotica virgifera
  misc_feature (2063)..(2063): n is a, c, g, or t
  misc_feature (2088)..(2088): n is a, c, g, or t
  misc_feature (2119)..(2119): n is a, c, g, or t
aggtacaaagaggtaatttttctttaaaataattatttccacatatccgaggagtccaattttcactttttcgaaaattagaaatatgctagtttatcgtagaagtgttagaattcgagttgagtgatgggaatgtcacaaaaatcgtgtctaaaaacagacttgtaacacccatttttacgaaaacatttatgttgagttaacgtaagcgtggctaatcaaggtacaaagagaaaaatgagcagctcagaggaggtatcatggatttcgtggttttgtggattgcggggaaacgaatttttctgcgaggttgacgaagactatattcaagacaaattcaatcttacagggctaaatgaacaagtgccacattatagacaagctttagatatgattttagatttggaaccagatgatgaattagatgataaccctaaccaatctgacctaattgaacaagctgcagagatgttgtatggtttaattcatgctaggtatatattaacaaataggggtatagcccaaatgatagaaaaatatcagtcaggagattttggttattgtcccagagtgtactgtgaatcacagcaaatgttacctttaggcttatctgatgtcccaggtgaagcaatggtaaagtcatactgtcctaaatgtatggatgtatatacaccaaaatcatcgagacatcaccatacagatggtgcctattttggcactggtttcccacacatgttgtttatggtacatcctgagtatagacccaaacgtcctacaaatcaatttgttcctaggttatttggcttcaaaatacatcccctagcatatcagcttcagcaacaagctgcctcaacattcaagacccccttgaggacgattaatttcaacaacggcaagcgctaaatatgaacacttatgaaattgtaaccaagtgaattatcaacatagtttaaatgtgttttgaaggaattatattctgtttctgttgagtggtatcttgtttctagttaatgtatcacaggtagggctgtttttgatggaacatttacttaaggctacggaacaagttacttcaagtacgtttttgttacttgtgacgtaagtattgtcagttaatgactaaaactaccaactgcagctttaacaggagggtatataaactgtacagacaaatatttttggattagctggctttccaaaaatgagaatccttcattattgttttctttatcagaaaaattgttcctgtgctttaatagtgtgttctttcaattacggtccacacatttttttttctcttttttatgcatatgcataaaatttaaatttcagtgatatgcatttccgttaaattgacaataggaattattccttcaaatatgaacctgcagattgttcaaagtcttgaattttacaagaaatgaatgtattgatactgtgagttaataaaattatgtacttcataccatttgccatgctgtttttcaacatttgtacttcaatgctttaaaaacaatattttgacgtattttgaataaaggaaaagatctgtaagcatatattagattagttcaatggatagagaaattaataatctcatagtacaattacagtcttgtatctatatttaacgatgttgaaaatcaaattggcatttagtataactgtatttttttagatagaagatgcaaaactgttttaatttcttagtccttaaataaattattaaattaattgttattggattctttttatttaagatttaagtgatttttttctgcggccttagtttttaagttaaatataattttcaatggagaccatattgagacgtagagtgctagtaattttttcccttgcatatccgtaactactcaaaatcaatacaccatgtcattagagaaagatttgaattttgattcctgtattattgccccatataacaatggattcaaaaccgatcacataacggttctaaataacatcatcaacaaaaaacaactttacgtggacttgaaaagatgaaggttcattcattacatataatagaaaaataaccctgncagctattttaataaatttcatatntcttgaataaatattatattgtaatattttncatatattttatcttgtaaaatatttgtcttgacat

SEQ ID NO: 521 - DNA, 969 bp, Diabrotica virgifera
atgtttacctttaccttgttcaaatttagacattttaaacacctttcattgatctccaccgattgatgagtactgttcggctattcttcaaaatatggatacgatattgtgtgaactagaaaccagaaagttgtaatcaacattccttaatttacacattgtaacttctttgtaattgcaactttttacactacaatgccaaagtttttttctgattcaacaatctttaattacacctgggaccaagttgcacaaggtttttggaaaagatatcccaatcctaatagtaaacatgtgctgactgaagatacagtagaaagagaagtaaggagtggaaagttgttttccaaaaggcttttaacaaagactaatagcattccaaaatgggctgagaggtttatgagctcaagacatgtgaatataattgaagaaagcattgttgacccaaaaaataaagtgcttaccacatacacaagaaatttagggtatgttaaagtgatgagtgtaacagaaaaagtagtgtatactgaaagtgaggaacatcctggtaaaacaatagctatgaggttcgcctggattgattcacaaattaaaggatttagcagagctatttgtgcatttggctatgaaagatttaagaaaaattgtcataaaatggtgggcggttttaatcatgtcctctccaacctatatccacaacaaaatgcgctgacttcaagttattccactgctaaggcaacggcgaaactgaaggatgctgccaaaaatgcatctgaactggcaaagtccaaagctgcgccgatctatgcttctctacatcccaaccaatcgtagaagtaacttacaaaccgaaaacatttattatatcataaatgtgaattatgtaaaattactataatctgtaattgtataaaatataacaaatttaatgtctttgtaaaacatgaatagattggatgctcaaaacgt

SEQ ID NO: 522 - DNA, 1471 bp, Diabrotica virgifera
  misc_feature (1304)..(1304): n is a, c, g, or t
ctcttttgaaagtaagcaatattgctcaactgcattcgtcgatgtgagtcaagcttttgacaaggtgtggcattagggactactctataaactaaaaagggacatataccagaacatgtatgacatactatactcatacctaaaagaaaggtatttccaggtaaaatatgaagacgagataaccggtctacatctcataaaggcaggcgttcctcaaggtagcgttcttgggccgattctgtatctactacttacctctgatttacctacggacaataaagtatatacagccacatttgcagacgataccgcaatactagcagtacattcagatcccgtttttgaaagaaacttcagaactccaagaaaacctaaataaaatccagacatggactaagaaatggaagataaaacttaacgaatccaaatcaagccacatagtattcactaaatgtcatagcgattgtcctcaaatatcactcaacaatgctcccgtttcaacggtagatactgtaaagtacttaggcctacatatgggcaagggactcacttggaagactcatatatggaaaaaaagaaaacatcttgataccatatatagaaaatactattggttgctcggaagaaaatcccagttgtcgttgagaaataaattactagcatacaatgccatactcaagccaatttggacgtacggaatacagttgtggggcactgcttctaaatccaatctagcaatcatgtaccggtttcaaaacaaggtgctactagcaataactgatgcgccgtggtttgtaagcaacaaagacatcctacaataccttcaagtgccaactgtgagtgaagtgatagtttcacacagtgataaatatttacagcgactagaaaaccacccaaaatgtgttagcgctaaatttattggataatagtcaacaaattagacgccttaagcaaaaatttccattagatttaccattcttaagttaagaaacactaattgtaaacgtaattgtaatactcatgtagagtaaatatttattgaaatatttctcttcgcgccattgtaaatttcaacaaatatgtttatggtctgtttttttttgactgattgcacagtaaacacacaataaaaaaatctactcatcccagtcagataattgaatcaagaagaaggatgagaactcaaattgagggtccgtgctgtcctataccacagagagcacaggagaacattcgatggcctatctccaaatgatacaaatagtctacaattcacggttataatatgtcaactaatttctatnaagaatagtcacagaatagcaaggaaactacatatagataaggggaaaatattattagaaattatgtatttaaatatttttaatttggattcccgactagcattattatttcatagaggaataattataatatcacttggtatgtcaataaaactttatccaactcc

SEQ ID NO: 523 - DNA, 1494 bp, Diabrotica virgifera
gattgccgtccacccagggagtgcagaaacggccagtgcgtctgccaagacggttacgtcggtttcgactgtgaacaatcgatttgtcttgacaattgcaaccacgacaaaggacaaggatcttgcgacaagtcttacggaaggtgcttgtgtagcgcgggatggactggaccctcatgcggtataaagaaaaccaaaactcagctgacattcaccgaactattcaacacagtcaagctgtcagagtcattggaacattttcgaaaaaccctaccccgcttcggacactctttggtgtcggatcgtagaggagcgctctggatgttcggaggactgtccctctcacatggtcctctaaacgatgttcgacttttcgacacgaagaatttgacatggatgcaggtcaccatagagtcgacgcctgatgccaagatgccgatgggaagatatttccacggagccgatatcggccatacgcagacgatttatgtttatggtgggttgtcgaagaaacataagaattatcggaataggactttggatgatttttggcagtttgacatacaaaatcaaaggtggggcgaaattgaaaagactgacgtatggcctccagccctttctggacacactctcacataccataaatcacaagaaagcctcattctgataggaggtatatcccctcaaaacggttttctaaacctcgtttgggcttacaagttcggaaaagagcagtgggtgcctatcaataccaaaggtccagggcctctaggaatattcggccacacgactgtttatcatgctcaaagtagtaatttgtttgtgtttggcggtgttgtatacgagaggcagctttcgacaatttctaataatctgtatatgtttaattatgagaacaggacgtggacgcagttgaataatcttggatcgactctacattggccacgcccgagatatttccattcagccattacaactgaagattacatgataataatgggtggcaaaatttacccatggaatattacggacacattatatgcttattcatataattgcaatagatggatgaacttgatgtcaaatgacattgaaaaaattggcccgttccctacccaatcgtacgcacaaggaatgacggtcgaacccgatggagacgccatctacgccataaggtggttggggcatagagacccaaagtaccgtacttcgaattgaactgcccacagatttgtgcaacctcttgccacgacgaataacttgcttatatatgtcaggctgtggatactgtgccagtaaagtcggtgaagatattattgctgaacagtgccactcgaatacgaaaggagtgtactctagaaactccggaaaatgctctctagtaacgaatgaaagccaagtgtgttccccttttacacattatcaaacaagtcccgagtaactgttctacaattcaagactgcacaatttgcatacagtcaggttccctgttct

SEQ ID NO: 524 - DNA, 1224 bp, Diabrotica virgifera
  misc_feature (970)..(970): n is a, c, g, or t
gtgagatgcctgatttgtagacatatagtatttcctgactcattcacttaaaaaaaggaaaataattcgcattttcctcaaaaatgaggtattcaaaaaacccactagtgttcatagtggccatttttgcttatagttatggtttagaagacagttgtccatctatgtgtaactgtacagaagaacaagttgactgtatgagcagagacatagaagaagttcccgattttgaaaccttgaccaatcgtccgcaagttatcgatttatctggcaacaaaatagcaatgataggtgcatatgatctatcgttcgagaagagctatatggtcaaagagctatatctcaacaactctgaagtgatagacgtcgaggacgaggcgttcgatgatttcgaaaatcttcagatgctttacttgggagagaatttattgcgagtggtacctgaagaattcgtcggcgatttaacggaattaatcttattagatctctctggaaatccctttgaaggtaaaatgcccataatacgatctgactccttagaagtactagctttagccaagtgtcaaataacagaagtaacagtagaagcccttagatatttgccgaatctcagattgcttctgcttccagaaaacaacatccagtacatacagcccgatgtattccaagacgtgtctgaatacttctccatcagactctcctacaacacctgggaatgcaactgtaggaccatggaactgtttaggttcctcgcagacaagaaatacctcgacttgaccgaaccctatcaatgttccacaattgatggtaaaattattaatatctccgattttcagagtatggatgagtttaaaaatggatgtaacgctacagaggaagaaacactacaaaggaagcaaacaattggtgtaggaagtttgtccagagaagagaaaaccaactccagcgaatcgtccgaaacaaactcgancaaaaatcgaaacggttgcgtgtttgtacagaagaaaaaacgtatagtattaaagagaatgacagactttttatttttgggggtttccttacactatctagtacagattaagcttttgtgtgttttttttttttggggtttttttttttttttttttatagggggaaaagaaaattaaaaaaaggtgaaaggaccccaaaattttttttttgaaaaaaaagggccccctttaaattttccataaaaaaaaaaaa

SEQ ID NO: 525 - DNA, 924 bp, Diabrotica virgifera
aattttgtgaagtgaacaccgcaaattcttaacactcagtcgattatttcaagaaacttttacatttatgtggattactaaatttatttcaagagggtggaaaaactaaaaccaaaaccttagtctttcaaagtcccatcacagaagaggaattagaaaacatctgggacgaaaaaattcttcgattattgcttgaacaaagcacagaatacgaagaaaggcgaatcatcaggaataggttacgcagcgtaatggcagaacaagaagcttgtgcagatctggtacagaaggcaagccaggaacaagccagcggaaaaatagaggaaagcgtgactgttgaaaaatcgtcgagtgagacaccgacaactactactacaaccaaagttacgaaaattagtacccaacaacaggtaaccaaaaagcctctatcgccattcgctaaatttcaacaattggacaaacaaaacagtaccactactccaccaggtacccccggtaccccaaagactcctggaaacggccctctctttaaatttaccgatcctgcactcagcctttcagcggctaccatcaaggatcgtctcttgtattggtgtaaagtgaagactaaggtgtatgagaacgttcaactagacaacttctccaccagctgggcggacggacttgcattttgtgccctcatccaccatttcctgccagacgccttcgactatcatgcgttaacgccaaaagaacgaagacacaatttcgaacttgccttcaaagttgccagtgacaaggcggacatttttcctctccttgacgttgacgatatgatggccaccagaaggcctgatttgaaatgcgtcttcacatatgtcccagtcatttaccgacgcttcaaagatgaagaaatctaaaaatatttacaatatttatgtgttt

SEQ ID NO: 526 - DNA, 797 bp, Diabrotica virgifera
aggtcgagtaggtatatattttcacggccgcccttttaaatattttttggttggttattagattgtgaatatacaagagctgtaacattatggtagacaaggaagatatcaagattagacgggcgcgtgctgatgaagaaaacgcagttcgagatcatcttcgagcatccttttacaaacaagaacctacttgtgcatctcttggagtagtaacggaagaacgaccaatttgtcccgatttggagtcgtatacactacagtattttaataaaggtttaaatcttattgcagaatataatggacggattgtgggagtttgtcttactgcactattggaaaaagataaatatgagttcgaagaataccctgtaacggacaaaaaatttgaaaaaatcttacgaatgttagagtacgcagaaaggaaaggtgatctctccaacagatttcccgaagttaataaaatactctctattgttgtcctatctgttgatgcatctcttagaggcaaaggaattgcaaagaagcttaccaatgaatcaaaacaactggccaaagaacatggagcccaaatgatgtttctggaatgcagtagtttcttttcagctgctgtggccaaatctttgggatacgagttaatatggtcaatggattacgaaaactacaaagttaatggtgaagtagtactaaagcctgctcatccccataaagcagtgcaactatttgtgtataaactgtaatataattaatttaaagtgggggaagtcaagccgaatgtcaataatgtaaaatatttgctg

SEQ ID NO: 527 - DNA, 1193 bp, Diabrotica virgifera
ccctacacgcgtcagcatcagaggagtgtagaagtataacgatgggaagatagtgtgaaccaacgaaatcttttctttgtgcctaaagtagtcgtgtgaccggccgttttactctttattattcacctttaatttttcatttcaacagttcagtttaccgcggaggtttttttgtagtctcctttttgctaaacacaaaaatcaacaaatatggtcgaaaggataatagaagaaaatgaaaattacgattgcaacggcatcgtaatcaacaatggtgacagcatcgagggttgcaacgggggcgggggcaatggcagcgcctccgacagcggcgatcagatggacgctgaagctcgcgaacgagaactagttcgacgcaaggaggaagccaagagaaggaggcgtaagaagaagcgaaccggatcttcattggtgtcatcatgttttcaagatctgtataaattgaccggtgaagttctgggagaaggtgcttacgctagcgtccaaacttgcgtgagtctgttcaccgatcaagaatttgctgtgaaaattatcgacaaggtaccaggtcatgctagagctagagtttttagggaagtagagacgttccatcattgccaaggccaccccaatattattcagttaatggagtttttcgaggacgaagaaaagttttatttggtttttgaaaagatcaatggaggtcagctcctacgaaggattcaggagcacaagtttttcagcgaagccgcagcggcagagatagtgagagaagtggcctcagccttgcagtttatgcacgccaaagggattgcacacagggatttaaagcctgagaacattctttgtgtccacagggaccaactttgtccggtcaagatctgcgatttcgatttaggatctggcatccgcttccaatccagcgattacaggccttttacagcgcctcaggaaaataacacctatagttctaattataaggtttgttctgcaatacccgatagatttttggttgacaatacttttctgactttagtttcgtatgaagtgatgctatgattaaataaatttccatgtatgattcttctacaataagctaaccctgctgaacctacagaggtggactagagccggttcactaataactgagagatatattttgactgctgcgtattgtgatacaggagatatct

SEQ ID NO: 528 - DNA, 1234 bp, Diabrotica virgifera
atttactgtttttgtctggagtttgccggggttgtaagttgttgtttgtttgtgtaaatacttcttactacttcctatacgatggccactatttccaatattgctaaaaggtgtttttctaccagttcaaccttaaacgttataaaaaatgttacagttatcggaggtggattgatgggttctggaattgcccaggtggcagctcaagcaggtcaatccgttaccttggtggatctaaatgcagacatcttaaaaaaatctgaaacttccatccaaacaagtgtgggccgtgttgccaaaaagctacataaagaagatgcagctgctgctaaaaagtttgtagaagaaactatagcaagagttaaatattgtccggatcccctaaaagctttagacaatgctgaccttgtcgtggaagccatagttgaaaacattgatatcaaacacaaactcttcaagagcttagatgaagctgctcctgcaaatacaatatttgcttccaacaccagctcattatctatatcggaaatagcttcggtcacaaagaggaaggataaatttgggggactgcatttctttaatccagtggcagtgatgaagctgttggaagtaattaggattccagaaactagcgaagagacctacaaagccatgatggaatggggtaaatcagtggggaaggtctgtattacttgcaaagacacccctggatttgtggttaacaggcttttggtgccttatttagctgaatctatcaaactgtttgagagaggagatgcctcagctaatgatattgatacagctatgaaactaggtgctggatacccaatgggaccattggaattggctgattatactggcttagacaccacactcttcattattgatggatggcacaagaaattccctgaaaatcctctgttcgaaccaccagcaaaattgaggaagtttgtagcagaaggaaaattgggccgtaagactggtcaaggcttttataactactcgaaatagtaggaaactgatagaataatgtaagtttttaccccggggggggctttaaaggccgcaaaaaatgaaaattgaacatcaaaaaaaaattggtttaataataaatctttttttttttttattttttgggcataaaacctggggtttttttttttggcaaaaaaaaaatggattttagaaatatttttttttaaaaaaaaaaaaaaaataatttttttgtaattat

SEQ ID NO: 529 - DNA, 785 bp, Diabrotica virgifera
cacagtaattgacagataaatataaatgccataagtataaactaaaaactgtattattaatccattattaatccctaattcctaatcacaattcacaataagttaccaagaaagtatggcagatgaaagtttatttgattttcttcacaacgaaatagttacttatgttttagaaagcaataataagcaaaatgctggaaaggatgaagatttatctgtgcttgaatatattggtttctcaactggatatagaattattgaaaggttaactaaggaaatgcctagattcaaagatgaacttgacacaatgaagtttgtctgtacagatttttggtgtgctctctataagaagcaaatagataatctaagaacaaatcatcatggaatttatgtattacaagataatagttttagatttttaactagactttctaatggcaaacagtatttagatgcagctccccgatatgtagcatttacttgtggtgttattagaggatgccttgcaaatttaaacattatgtgtttggtaacagctgaactccaaaacatgccttcgtgtaaattccatattcaagtacaaagaacctaataatttaacttaaaatttgtatattgtatagttagggttaagcatagttaggttgagtgcttgttttatagatatgattttacatattacacaaaaaagtttaatgtgtgtcattggttaaatattgattttagtttataatccatttgttagtaactatataaaaatatatagctatatagttttacgagac

SEQ ID NO: 530 - DNA, 1019 bp, Diabrotica virgifera
cggacgcgtgggcggacgcgtgggcagttctggtacaaacgaaataaaaatgaaactctttttaatttttgtttttgccttttcgcacgtacgtggtgaagaagaattctgtgaaataaacgcatgtgaggctctgagcaaaagcgagatgaacttgaaggaattttctgatagtctggaaaaggacgggaaggatgagtatttggtgaaactggagaggagagtgaggtctttggaacaaccagtttgggagatatctaacgtaaatgagagatggatagaatgtggaaaaggcccatgtaaatgcacaccagagctcaagggagtcagttgttggcaaagcaatttatctgctatacccgatgaacaagttttgccccaagatgttataacaatggatttaggaataaatttattaacaaccttaaacaaaaatgtgttcagaggtatgacataccttagagaattggatctctttgataataaaattgaccacctaccaggaaacatttttgctgtattggacagtttaaaatatttacgtttacacaaaaataaactcgaagaactctctccagacctcctggctttccaaagaaaccttcaaacatttgatgtttctgataattttttaaagtatcttccgacgaatatcttcagaggatgtcccaatttgatgttgcttcatttgtcccggaataggttaagaaatattcccgaaacagtttttaacaatttggaggttttggaagacttggatttaagcaataatttactggaaacagtgccgaagtttgcttttacagatttaaaagttttgaggaggttgtttttagcagaaaataatataactttattgcctacaggcattttcgatactcttgtaaatctacaggaactgaatttgcgaaaaaaccaaatatcttatttgccgcctcatatttttgataaagtgcagaatctgcgaatttctacactaactaataacaaaataagtcaaataggcgaaaatgatttca

SEQ ID NO: 531 - DNA, 992 bp, Diabrotica virgifera
ggtaaagagagtaatatatacacagtggcggataccgaaggagaacaattatgtcttaagttacacaggttaggaagaatctgtttccgaaaagtaactgaaaaacgagattaccacaagcatagaaaatctgcatcgtggttgtatttgtcgagaatttcagctacaaaagaatttgcatatttaaaagccttatatgaacgaaaatttccagtgccaaaacctattgattttaacagacattgtgttgttatggaacttattaatgggacattattgaatcatgtgcaagaagtcgaaaatattgattcactatatgacgatctaatgaaccttattatacgatttgcagattcgggtgtaatacacggagattttaatgaatttaatataattttaaatgcagaagagaaacctattataatagattttccacaaatgatttccactgaacatccaaatgctgaatatttctttaacagagacgttaactgcgtcaaagatttttttaaaaaacgctttggctatgaaagcgagctcttcccacaattttcagatatcaacagggaggataatttggatgcagaagtagcatgttctggatttactaaagaaatggcaaaacatattaataaagaatttggctatgaagactctaatgatagtagcgaggaagaggttgaaggggaaacagaaaatgaaaatgtaccagagagagatgatttctttgatgcgtctgacaagttagaacataaagatagtgtacaagatttgggatcaaaatctaacagttcaacaataaattacatatttgatcaactaaagctgacgagtaaatttgatgatacagcacaaaaaatagaagatatttcactggattcagatgactcgtcagatcactttgactctaagagcatgctctcactacatctactatacctccagaaggaattaaaaatcgtcttaaaaaaacattgctgatcaaagaaaaa

SEQ ID NO: 532 - DNA, 1303 bp, Diabrotica virgifera
  misc_feature (1221)..(1221): n is a, c, g, or t
  misc_feature (1298)..(1298): n is a, c, g, or t
tattctttttattgttgtcacatgttgtcatgtaataaaaataatattgtttaaaaaaatatgaccaataacttagtaaaaccagtaagctacctagtagtagacactacagcctttatacagaatgcaccattgcaggatgttggagaaaaaatgataacatgtccagaagtagtagatgaaatcaagaacaagcgacagctcagacgtttagtggtgttgccatacgatttaatcgtgcaagatgtctttcctgaaaatatatcaataataacggaattctccaaaaaaactggagactatcccagtttatcagcaacagatataaaagtaatggcccttacctatcaacttcataaagaaaagagtggcactgaaggtctaagaatggaacctgttatgcaaaaagctgaagttactactgagaataaagctcttgaaatgaatccagatgttactggattctatttacctgggaaaacacaaacatcggaagataatgtagcaggggatgatcaagaagaatatacagaagaaattgatcaaaatatagaaggattagataagttagatacgaatgatgttgataatattttgacaccagttaaagatgtagaagaatctgatagtgaagattcaaacagcatagaagatgaaagtgatgatgatagtggctggataaccccatcaaatgtaaaaaccgccaaacaacagttaaactcagaaatcatggaagaaaaccatgtagaagtatcatgcatgactacagactttgccatgcagaatgttcttagacaaatgaatttgaatgtatcagctttagatggaagacttataaaacaacttagaacttacattttacgttgctacgcctgttttaagacaactagtgtcatgactcataaattctgtccaaaatgtgggaataacacattgaaaaaggtggctgtatctttagatgcccaagggaaaatgcaaattcacattaattccaaagacctcttacaggcagaggaaagaagtatagtttacccaggataaaggggggtaaacatccaaataatcctatattggtagcagatcagcctatgccagataataggcccaccatgttggctagaactaaaactaatcctcttgatgatgattacacagcaggtttttctccatttgtgatgagagacgtcaattcaaatcagcgcagctgtgcataagaccagnacaggaaaattaatattggatgaagaaaaatcccaaatgaacagaaagagaaaaaagtgatatatttaaattataanacatt

SEQ ID NO: 533 - DNA, 1663 bp, Diabrotica virgifera
aataataataaacgtcataataataagacgtcacaagaatgtgtgattaaaacagaaaaatgatattctcattctcataaatattttacatagtttataataggataattcctaatatatcaaaacttaataacgtataactatatagtagtaaccaaaattaaacatgggcaatgagcagtctactaatataccaggtatagatattagggaaaaagcagtagaggtttgtgatttttggacacagcattccgcagtaatttttaatcaagaaagcagttcgcatttaactgtatttattggagaactatttatggacactgcttatttatggaagtcacaacctcctctccaaataaattcaaagcatttgatgatatacagacatccctgcattgtaaaatatgtatcttcttggcataaagacttggcaaagtattatctggccgttgaagaaataacccccttgtctcaggaaattgcaaaactaagtggtcttgaaatttcagttggattacattccattctgaaagcacttaattttttacacagtcatgccgaagtatctcacaataatttgtgcatatcctcaatatatgtatcaaaagaaggaaattggaaattggctggaatggaatttttatgcaaatacaaagatttaactgtggattatttaaacaaatgtaagtccaataggtacagtaaatcagttgacccaaatgaggaaaaactgttccagatgagttcgactaggaaagattttattgatatctatgcatttggagtgttagcatctgatctattaaaaacttttaaggatgaaagtgatatggactcattggaaagctttattggattttgtaaaaatgaattactgaatacagacttctcgaagaggccgacatttaaatcaatattagaacacgaatttttcaataacgattttatcacaataaattcatttctcttagaactacccgttaaaaatgataatgaaaaattaaatttctttcaaaatctgaaacacaggttgtttaaatttgaggaagaactagttgcatcacagctgagcggattgttgttgtcacggttggttttattaaataaaacagctcaaaccagttttcttccctttttgctaacacctcaaacaggtgatgaaaatgaagaaacgtcaacattgttttctgaaaacacatttaagaagtatctgtgtcctaaattgttggagatttttaaggttcgagatgttgaaattcgtttattattgttatcgttttttccaaaatatatgcacacttttaatcatgaagaccttcagaatcgaattttaccagagctgctagttggaattaaggataccaatgaccatctagtctccgtcacactgacaacattagcgttgcttgtaccagttttaggttccgaaactgtagtcggaggcaaaagggcgaaactatttaatgactttcgaccaacccattcagttagaagatcatcgaaaaaagtaaacccggaaatctttccaaactcatccacttcagcccagataccccaagaggccgatcagataagttttagtggtctagaaaatgaactaaatattgttagtgaattgcccgagagacccagacctgatgggtgaagaaggtgaaacatcaac

SEQ ID NO: 534 - DNA, 1009 bp, Diabrotica virgifera
  misc_feature (978)..(978): n is a, c, g, or t
attcttgatagcgggtttatcttttattattttttttaactttattcccggttgcgtggcttcagctttggttcgttcctaacacagagaagatgaagctgcttattagctttatcctcctctgcgtgttccaagcagtatggaccaagtcgatagtcaaacgagattgttgtggcaactcttgttctacaccatgcaataacaacaataactgtaacaatagcccctgctataacaattgtaatagtggcaattgtaacaacaactgtaacagtaggccttgcaacagtaattgtaacagcagcccatgcaacaacaataattgtggttcttgcaacgacagaccaaatattcctgaaccaagagacgaagtgaggcctattctggttccatttccgcagcctcagctaagtccctcaggtggcgaaaataccatcaataacaccaatataaataatagtacaatggagctgactttcacgaataccataaacacagtcaacaatatttctatgcctatatctcttaatccaagcaatgaaaattcgataacagtacattttaatcaagtggagagaactaaagaagaaaaagaaatagtacaggaggacaattgttgttttataagtgaaagaaaatgttacgcaaatgatacttgtgtaatggttcgacgaaaagagtgttctgatatttgttggggaatacttccagttgaaccaaaacctagcccagcaccgactacagaaagaccaattgttattgtatatacaccaccaacgccaccaccgaatccagaaccgactacaaaaggaccaactgtaattatatatccaccagaacctacgcaccgaccaataccgccaccaccgaatccaagaccagttataatcataccaccacgaccgtgctctgcaaatcctcaaagacctatatacatacctaattgggcctcatacagaaatatttgggaatactatncatatatacaacaaccttgcacgcgaatgca

SEQ ID NO: 535 - DNA, 1370 bp, Diabrotica virgifera
cagtttctacagtatagttgcagtgttcagtggaaaatattcaattaaggtatactggattggtcctaacattggagcaattctaggctgtgggatatacaaagttttatttgctctaccagaagaagaggaaccacaaactagggatgaagttctaagccttcaagacgttaaaagtgaaaaatcataaggtacatatttatgatttcaagcaagaaatgtataaacattacttccaagttttggtaccatagtgagcagttacttgacaaatattctacagagtatgaaatgttctctgtaaaataatccgattaatataatttattgacacaaaatgattatttttaaacatataaaaagtagatcaaaaataactggactttttaagttgttaatttgtcataaaatgagattttttattattgatgttttttatattcgttatcacaaaataaaactgactgatgaatgtaatcgcaataataaccagttttgcggtaatagaataccttgctgtatcaattatctggtgaaagatcagatcttttattgaaggatcttgtttgttttgtctgatgttgctgacaatatcactaacccagagataatgataaaccctaatttacaaccaatacgctgtattctcttataaattaagttattctacgctgttatcgaacatccaaaattaattgttttatcagtctttaagtaatgtacaaacaaaattcctctcgcatcccaaaaaactgatgtgcacgatccttcttggttcgcaccaggttcacaaccactatttctcctcttgttttgatttatgatcaaaaaccaagtctcattcatagtgatggatcgagaagcaaaatttactttatccttaagaacgctgagaaactcgtatttgaatgtgcttttgttccattgttagcgaatacgacacccattgtgaacacagctttctgaaacccaatccttcagtcaaaatattgcttaaactgctcaatgaaatgtctttgcttctactaaatctctcagtcactcgacgattttccaataccatattctgtatttttttctatgatttctggtgttgttgtttttggacacccaagatatggcgctccatagctctctgagttacacgaatcttgttcactacctttttttgtgagtgttgatgtttcagctccaaaaatgagtacaggtagcacacactgctcaaagattatccttttgagtcatatgggtaagactgatttaaatacatagcttaatttaccaaccgctgcccacgctaggttaatcctatgcgacgggggggatctcatgactggcgagctctgcataatcgaatatatgaccccacc

SEQ ID NO: 536 - DNA, 1269 bp, Diabrotica virgifera
aaagattgacaagccgaagtgtatgtatgctttaaaaaatatctactcaaaagactcccaagatatggtcgacgagtccacagatcacgtttccagaacgaacgaaaaatcgacgatattcgaccaggttaaacagtttttaaaggttttatatattttaataattttgagtgcattaagctttttgttgagtatatttttgaatgtaaggaatgcccgacttaccttaaaatccacaaaatcacctggcatgataccacacttatcaatttttgcgaacaactgtcaaataactattcaaagcaaagaaggaactattactgttttcctgttgacttttctgtcctctgttcatttttttagtggcataattgtgtaccaccctaattaataagtgtactattagaatgtgttacaactgaagcacaattttttatgctatttaaggatatttaatttattaatcattttcaattcagaataaccatcaaattcctggcatggcagatttagaagctaagcaagaagaagttttaaaacagcttgcagacctcaagaaacaaattctctcaattaaattggatttgaaaattaatgcaaactcagtaggaacaaacaagacctccccaagtatttcagcagaaaagctgaatgctcttcctgatcttgttgtgaatgcaagtccaacaaatccgccatattcattactgataattcaaaagctactacatgacattgtcgaattgaaggttacatcccatatacactcctcagttccagcattgaatgaaaatgccaaacagctgggtgactcattggcaagttacgtaccgaaacgtggtgtaccaagtgttaacattaaattgatatggaaaaatgtgggcgtcgacacagaactcatggtatcacacgttccaatttttggagaagtcaacttattaaggtatctaaccagggtaatcagttccccactcagctacagttccgactccgatagtgtagaaatcgattcgatattagacacttgttatcttcttctgagagctaaaacgaaaactgaaaaggcaggacatattgctacattaaataaatccttaggaaaatctcaatggttagcaggtagaagtaggcatagtctgggggatctagccgcatactctgcccttaaacaggttacaagtggtagtgaaattaatgcaaatatgacgaagtggtatcagcggtgtgaaactgttgtataaaattgtttttattataaatataagcttc

SEQ ID NO: 537 - DNA, 948 bp, Diabrotica virgifera
accgaaaaagaacagtcagatatgttttccgttatctcggccatattgcaattgggaaacattggattttctgaggaggaaggacgtactctcatattaaaaccggagcaagtagatattgttagtaagcttcttgactgtgataaagaaaaaatgagtctagcactgcaacaaagaactattgaaactattagagatgtagttactagtcctctaaatagagaattgtcgatatatgccagagatgccttggctaaggccatatacgacagaatgttcacctggcttgtaaaaaggattaacgattctctgcaacctagcgacaaacgaagaaatgttgtgatgggtatcctagacatttatggttttgaaatttttgaaagaaatggatttgaacaactctgcattaacttttgtaatgaaaaacttcaacagttgtttatcgaccttacattgaaatcagaacaggatgaatatgaaaaagagggaatcgtatggcaacatatagaatactttgacaataaaattatttgcgaattaattgaagaaaaacacaaagggcttattgcgtacatggacgaagaatgcttgcgaccaggagatcctagtgacaaaactttacttgctaagttagatgaacgtctgagctaccatcctcattacataagtcacaagaaggctgatattaagttacaaaaaattatgggtagagatgaattccgcttaatacattacgctggcaatgtaacctacaacgtcaaatctttcatcgataaaaacaacgatttattgttcagagatttgagagaagctatgttgagttccaagaatagcattatagagtcagtattcttcgaacacgagcagaaagcaaaaagagaccagagactgccattacccagtttaagacttccgtaaacaacctcctgaatatcttaaaagataaag

SEQ ID NO: 538 - DNA, 736 bp, Diabrotica virgifera
actagttctagatcgcgagcggccgccctttttttttttttttataaaacaataatttattataataaaaatgtgaattactcttcaaattccaatatttcataaaaatctcccaccctaacagcaactcctttttcagacttaatttgtttaggcatatctgacttatcggcttgaaatgagtcttcaccgttaagtattttaattctctcctctatttggaactttgcgtactcagctttatcgatatcttcctctttggttttcttttcttcctcaagtcgttttatagtgtcatcggcagtttgtaacattactatggaatcaggatgggcaattcttttcacaaaatattctccagtatgcactattctgcctttcatatagatatttttacctaaaggaataagagcttcctgctctgggtaggttttaagtgtttgtaaattagtaattagagagtctattgtttcttgttcctttgttaatgtctggattgttttatcatatttatttatgtcttcacctaaatgctgtaggtaggtgtctcgttctttaagtatatctgagggacttttggccattttcatttaaacatatttatttattacactataaacacatatttcaaggaaaattaatacttttaatcaaaccacttgcatcaactgtgtactgtatctattatctatcagagaccagagagattagttaggttaggacatggcaccgaaat

SEQ ID NO: 539 - DNA, 1063 bp, Diabrotica virgifera
aaatgccccaggccctcctgctttatttcgggcagttcttcaaaggacgacagtttcccttgtttacgtccagcatgttcgggtagattccaattggtcagacatgtcagctttgtagattgccctggtcacgacattcttatggctaccatgcttaacggagccgctgtgatggacgcagcattgttattaatagcaggaaacgaatcatgtcctcaacctcaaactagtgaacatttggctgctatcgaaatcatgaagttgaaacacatcctcattcttcaaaataaaatagatttggtgaaggaagggcaagccaaggagcaacatgagcaaattgtgaaatttgtccaaggaactgtagctgaaggagcccctataattcccatatccgctcagttgaaatataacatcgaggttttgtgcgaatatatcactaaaaaaattccaataccaatgagagattttacttctgaaccaaggctgatcgtgatcagatcttttgatgttaacaaacctggttgtgaagttaacgatttaaaaggaggtgtagctggtggcagtattttaagaggagtgttgaaggtgggacaagaaattgaagtaagacctggactagttagcaaggactcagaaggaaagctggcctgccgaccaatattctctagaatagtatctctatataccgaacaaaacgaactgcagtttgcagttccaggaggactcattggtgtcggtaccaaaatcgaaccaaccctttgcagagccgatcgacttgtagggtcagttttgggagcagttggtgctctacctagtatctttacagaacttgaggtgagttactatctattgaaacgtttgctgggagtccgtacagaaagagaacaaaaaggggccaaagtccaaaaataaccaaaaatgaaagactccttgtcaacattggtacccctcccaccgggaggacaagttgtaccccctaaggccgattttggggaaaaaatgcttttaaaaatccagctggaacgagaatcgggaaaaaaatggcccctccataaaaggggtt

SEQ ID NO: 540 - DNA, 906 bp, Diabrotica virgifera
gttaataaatagttatatttattttgtaagtgctatattttaatcttatgcaaatactttcaaaatgcaaaccactttaatagaactaaatcctaatagacaacttctggattcaaactttgatggatacaagttatctttaacagaaataccgaagaaaaagcgagaccttcccattgctgtggacagagttcttttagatacaaaccattgttctttactacacgcaaatctgtatggtttccacaatcatcttactgcagatccctatgatgaaacaagttctgtatatttcgtagatacagagctaagtatatgtaaagtgtatgtggacccatttaatgaagaactaatagatcctatcaaacttttaacgctccctagaaaacgagaaagaacttctggtgattacaatgtttccttaagattcgcttccccaaccgttgctgtaataagtgacggaattgaaaatttatacattgttaatactggaagtaggaatgatgatgatgccttcaatatatgtttctcagatgaagttacagattcaggtcaatcatttgttctaatggatgctatttcaatgactaataaagatagtaatgaagaactacatgttttagcgttaagtcttatacgtgaaactgaacaagaaaggtattatagtttattacattggattacatttacgaaggtccaagatgtttgggaacaaactgctattaagcaggtgaaatccaaaggttgtgtacaatatgcctttatagaaaagaattgtgaagctatttacgttgcatgtgatgatgaatgtaaatttacactaaattctgattttcctgtaagcgaggaaacaccaaggaatataaatacagataacaaagtttatacatggtcacaaaatatcca

SEQ ID NO: 541 - DNA, 1757 bp, Diabrotica virgifera
agtcttcagattagtttgcaaattgtgaatagttaaaaaataggtgataaatagatggagtgttaccaaaaaccttaagcgatggctagattactttcatttacaacgatagtgcttttactatctattttcggttcgtttgctgctggggctactttctttcgaaggggaagaatacttcatccagaaaaagatccagaacctagcaagtatgaaagatggtttactcaaaatctggaccattttaaccctaacgatgagcggacctggcaacagaggtactatgtgaacgaggaacttgctagtggcaaaggcgatctcgcctttcttcaaattggtggagagggagaagcaacagctgcgtggatgaccaacggatcatggatcacgtacgctcgcaaatataaaccaattttgttccaactcgagcacagatactatggtaaaagtcatccgaccaaagatttaagtaccgagaatctggcatatctaacaagccagcaggccctaagcgatttagcatttttcattgaagccatgaaccaacaacacaacctgagttctgatgtaaaatggattgttttcggaggttcttatcccggaaacttggctgcctgggtacgccaaaagtacccccatttggtgcatggggccatgtctgccagtggaccacttctcgcacaattagatttttcagaatattttaaggtggtagcagattctttacgagccagcaacgaaaaatgtccaaatattgtgaaacaaagtactgcccaagttgaagctcttttgcacactgcagttggtcaaaaaaatcttaaccaactattcaatttgtgtgaggatataacagagaacgttcataattctttagacgtgtccaacttcttcatgagcttagctgataattttgctggagtggttcaatataataatgataacagcgcaggaattaaaaagaaaaacctcaccgtcgatcgcttgtgtaacgttcttttggacgaatctaccggacttgaaatcaatcgcttggcagctgttactaagttaattcttgacgcggatggtaatagctgttttgattacaattataataatatggttgactctatgaaggaagttagttgggatagcgatgctgcctatggaagtcgccaatggacatatcaaacctgcacagaatttggttattttcaaacttcctcttacaaacctcatatatttggtacccgatttccacttagtttctccattcagcaatgcctagatattttcggatctttatacaatgaaacgtttctaaatcatgctatagagaggaccaacgttctatatggtggtttagacattgaagtttctaacgttgtattcgttcagggttcattggatccatggcacgttttgggagttacaaaaaccttaaatgataaagctcctgctattgttatcgaaggggccgcccatgccgcaaatatgtttaacccttccgatgatgatactccacagttaaaggcagctcgtgtccaaatagaagaattaataggtacctggatagattcgtaacctagttctaatttgttattaagttgtagtttaatctaattctaagaaaacaacacattattacaattaaagagaccagtatacaaaattgatattgaacaaacaaatgatattataagagtgtagattgttgtagaaagatttttgtttttaataaaggcatttatatattaaagactagttctagatcgcga

SEQ ID NO: 542 - DNA, 957 bp, Diabrotica virgifera
  misc_feature (700)..(702): n is a, c, g, or t
  misc_feature (791)..(791): n is a, c, g, or t
  misc_feature (868)..(868): n is a, c, g, or t
  misc_feature (876)..(876): n is a, c, g, or t
  misc_feature (888)..(888): n is a, c, g, or t
  misc_feature (910)..(911): n is a, c, g, or t
gtcaagtgttggtcgcttgttgctatattgcgaattttgcagcacaattcgggaaaaatcaagtttactcgaacaggccattcacattgcaatttacattccattggatcgcagaaaggatggcctcttaactcgctgtctaccataatttattgttccgtctgtgtcgagataagaacttttttgagatagaaaaacgttgttacatttttgatgaaagaacatatttaattgttgtaagtagtcaaaaatatgtttaattaaccaccctgtattcattattttttatttctcttacttactcttccaagtattcttccaatatttacatttttcattatttagtacacatacataaatatgtacgttaaacagtttttcaacaaaactcttacaaatgatccacaaagaccacagtagtgctctggttaagttttttaacgatgtatgtgctactgaaaatgcccaagaaatagctgaagtctgtttttacagcccttccgaataaacaatgagctaaaaggtgcggcgaatacagattaattagtctgatgagctacacatacaagatttttcttcgcgtggtacatggaaaaataaggagtagatgcaacatcgaacatggacctaaattaaacccagttgggctatcccagtgctcttgacaagcgtgagacacttttttccttaaatagacttnnnttcagagtgtcagaaccaacgtaaaaatatatttatcgattacgaaaacgcatttgaacatatgaagaactttcgggaattgatattanagatatccgtatcactggaagtagaaaagtagtagttcgaaatcgatacagggaatgttacatgcaacaagctatanggacaggngacggacagtantatcactattaattggcactannattgtaaatctatcgtctaaagtctaagctaagccattggcactta

SEQ ID NO: 543 - DNA, 1246 bp, Diabrotica virgifera
  misc_feature (1124)..(1124): n is a, c, g, or t
  misc_feature (1143)..(1143): n is a, c, g, or t
  misc_feature (1170)..(1170): n is a, c, g, or t
  misc_feature (1212)..(1212): n is a, c, g, or t
catttttcatatcatttttcagattgttgtatttgaaaaagttttgttaaaatggggaaaagacaacatcaaaaggataaaatgtacattacgtacacagagtggactaccctttatggagaaaaaaaaaggtggctatacatcaaaagagggagagaattttagaaggcttccatttgaccactgttgtctatctctacagccttatgagattccttattgcgatttagatggaaatattttcgatttagaagcactaattccatttttaaagaaatttaaaatcaaccctgtaactggtaaacccctggattttaaatctttaatacagctgaattttcacagaaaaagtgagggtgtctttgaatgccctgtcttattcaaaccatttaccaatagttcacatattgctgctattgccacaactgggaatgtgtttttaatggaggctattgaacagttgaatattaagaaccgcaattggaaggatttaattactgatcaaccattcgaaaggaaagatatcattgtacttcaagatcccaataatttatcgaaatttgatatttcaaaatttcatcatgtcaaacaaaatttaagggttgaaacagaagaggaaattgcggataagtctgatccacaagccagattaaagaaaataaatccagaaacaaagtataccctagattaactaaataaagagtacaaaccaccaacgatagaagtgaacaaaaaagcaagtacagagaaagctgacaaattcaatgcagctcactattcgacaggagccgtagctgctagctttacatctacaaccatagttccaaaacttcagggtgaagcagccataattcatgaagatgaagttagatacgaacgggtaaagaaaaaaggatacgttagacttgtcacaaacttgggtatgctgaatctagaattacactgtgatatggttccaaaaacatgcgaaaattttatgaaacattgtgaaaatgggtattacaatgggaccaaatttcatcgatccataagaaattttatgattcaaggaggtgatcccacaaatacaggaaatggtgggaaatcaatatggggaaataaattcgaagatgaaatcagaccanatttatcacatacaggtcngaggagtgttgtctatggcaaattccngggaaaatactaaatggatctcagttttttataacttaccgntcttgtaagcatttagataacaaacacactatct

SEQ ID NO: 544 - DNA, 542 bp, Diabrotica virgifera
gttactttggagaatattattcctgttattactagccaaaaatggcttcattgtgtagaagaatcgttacatctacagcaagaaatcatgttctatcaacaagctatagaatggcctctaaagttacaatgggagaccctctagaacatgctactggcttagaaaaacgcgaactgttagcaaaagtagcaggaaacgataatccctttgacatcaaagtaatcaaaagaggtcctggctcaaaagcccaacctaacgaaattccatcagccttcgatgcccgtctggtaggctgtgtttgtgaagaggagtctacaagtataaattggatgtggctgcacaagggggagcctaagagatgtgaatgtggacactggtttaacttagtacacaaggccccagtataaatttaattttgtcatagaactttgagtaaaatagtgcgttataataataaattgatttccttcttttatgcccatattattttatgtaaatactttggtgttattaaatctggagtttttctccaactcccaatg

SEQ ID NO: 545 - DNA, 2062 bp, Diabrotica virgifera
gctccagaacagggtgacagggtaaaacatttctgatcagcttctttctgacgccattgtgattttttatagttcaacaaaatttatttctgtaattctgcattttaagtgccgagttaaacttctacaggtttttgggacttcgttgagcgacagtcgctttttctattttgggcagattagccatgaagcgtggagctgacggtgacatggggtccccgcaaaaaagatcacgtagaggcgatgaggaagttcgtttacttattcccagtatggttgccggttcaattattggcaagggaggatcaaacatcaccaaactgagaagccagtacaaagcatccattactgtccctgattgcccaggccccgaacggattttaaccctatcttcagacatggactccgtctgcaacatcgtccaagacgtaatacccaaacttgaagcgcatggcgcaactaccaacggaaatgaactggatttgcgaatgatgattcatcagagccaggcgggatgcgttattggcaaaggcggatcgaaaatcaaagaaatccgagagaaaactggtgcccgcgtacaaatttacgctaatgttgcccctcaaagtaccgacagagtaattcaaatcactggagagcctccaaaatgcatcgaaacaatcagggacatcttaacactcatcaaacagagtccaatcagaggagcagtcaacccatacgacccccataactacgacgaagtatacgccgcgcaatatggtggatggggcggtgacaaccaaggtggtggtttcaatagaggcagaggaaacgacggacccagaggtggcggcaacagagatggtggtgcccgattcggtggcggcaacagacctgcgggaggttccttaaacagaggaggaggaggaggaaatcgtgatggatttggaggcggcggtttgggtggtaaccgcgacagcttgggcggtggacgattcggtggaagagacagtggttttggtggaggaaaccgagacagtggttttggaggcggaagagacagtggttttggtggatctggatttggttcaagaggaggttctggcggaggagccttcgatcgtaacggttggagcggtggtggtcaattcagcccgccatctggcctcaacacttctcctagtccattcggcagcacaggtggttcttccaataaaaatagcacccaagttaccattcctaaagatcttgccggtgctataattggtaaaggcggtgtcagaatcaggaaaatccgcgtggagtccggcgccaatattactattgatgaacctcttccaggttccaatgatcgcatcatcaccatcagtggaatgcccaaccagatacagatggcacagtatctgctccaacaaagtgtccataacaactctgaacgcaactactgaggggaagcctaatatatcaaacggaatgccatttccaatgatgaatatcatttgtgtaacacattccatttcgatctatgggcattatggttcattagctcattacataacctttaatatgaatccattatacattatatttttgtccattatagcaaagacttatattttcgttttaaattttttttatatatggttttcgttttctttatgtagagggtatttaccttttttatgtaagggtacacctatattggaaccgtatttctcccgaaccgatacggtgtactatcattgtttcatcatgagtttgttttcaatccgtcggatagggagaaatacggatccaatgtaggtgcagtctaacagaagtgtcatacatacaaagaatctctatttacaggagttttgtctataaaagtattggactactgattaaatgaagtctttgcatacaattgatgtaatcactgatttttttcataaaattggtttactttttgagaaaaaaagttcaggatcctagctctccattttgtaatgatgattttattaaaaaaaaaaaaaaagcacgatggtggggggctaatccccccccatgcaaggattttttgaacgtgttcgtgacgctgcat

SEQ ID NO: 546 - DNA, 1263 bp, Diabrotica virgifera
  misc_feature (1158)..(1158): n is a, c, g, or t
ttacttaaaagttataaaggtcaaggttccaacaacttaaaatccaaatttaaaataaaggtaaaaccacggaatggaccattcaccaaacttataataaaaaataataatccggaaaaattcaagaattatttcaagaaatattaagcattttcaatttgtcaatttactttttttcccccttaaagctcacctttcgatagtgttttggatcataacagtcttgatcaaaacgcagattttgtgcctggatcgctgagctctgatacacgtttattttatataatatatatccttttctttgtttttgaagaatgattttacttattttggaatgggacgtgtttatcgtctcttaaatgtaagtgttttgtgtattaaggtagaaattctcacagtttcgctagtttttaaagcatttaactctatttaactagaagtatgtaattgtctatttcaaatcaaaacggtaaacggtttaaatacgagtatattgtaatttccgcagatgttttttttattttattattcattttacacttataagtcttccgatttatacaaaaaaaaatatgtatctgtaggtcagctcctatgtataggggtgagtaatgtcttgttctttttccaggtataaatcttctgatttgccaaaatttcttaactgagtagttttatagcttaaactctttgtttttagttttttgacttcacagtatagtgatttgactttgtcgaaacttcttaactaaccagttgtgcattgctgtcaattattttacttgtccatggcatatccttttgcaacagcttcgagcattatttgtgcaacacaactacatgcgcatgggatgtagccacgttaccaacacttcagtattatcaatacttctttaggttttgtgtcggtgttcagatgctggctgtcatcattttacatttttctgaaactgatctgtatcggctgctgcgcgaaataattctaataccaaccatcaaaatttttttcgaccaatccatctctttccctcctcttttccttataaggcgaagtaaatagtagttaggtcctcgaaatctatgaccgaagtattctgcttttttcctctttttgatgtttcgagtcacccccttagttgctgtcttactgttttgtgnaaataataatttatgtatactaagtatttcattcgtaagtttttgtattgtgagaaataattttttttagatagtaacatatatgtatagtactaaatttaaaag

SEQ ID NO: 547 - DNA, 725 bp, Diabrotica virgifera
gacattacaaaatattgggttagaaaatttattgaataccttcaaaaaggtattaaaaaattataatcctggtcccaaataatagataacaatggttattcttagtactttaagaacattaactcgactgccatcgtcatctttgcgaaatgaagcttccaaaaggctgatgtctgaccatagggtttttcctatgcaaccttctaggtggcaatggatcaaatttaaggattactttcattactatgtaatgttgggactgataccagctactttggctatcacttatgccaatgtgtttattggaccttctactctttcggaaatacctgagggatatactccaaagttttatgaatatcacaggagtcctgtaacaagatttttagccaaatatatttgtaaagatccacaacaagaatatgaaaaatatctggcatacattttcatggaagatgagaaaagaaaacttcgtaaactcgagaaggaagtgaaacacaaaatggccgaaagaaacgattatcaagcttactactatcgaccagttgctgccaaataccacagaattacaagagaagctgctgattacttagaaactatcagaggagaataaatttttccgaatcatctgtaaatatgacattgtttgaacaaatttttgcttaaatgtgtcttgttattcaatagtacgattgtatgtagttaatttaataaatttttaattt

SEQ ID NO: 548 - DNA, 1294 bp, Diabrotica virgifera
  misc_feature (1122)..(1122): n is a, c, g, or t
agaatataaaacatggaggactacgtgtgggctcgtgaccataccgagggctacgttttgggcaagataagcgagctcctggacgatggtgccgaagtgacaccccaaagttccaaatttccaaagagaatcttgccatttagtgaaatatttagagccaatattgatgacaataataaaaactacgatgacaactgtgaaatgatgttccttaatgaaggttccttactaaacaacatacgatcacgttactatcaggacaaaatttactcgtacgtagccaacatattgatagccgtcaatccctataaagatattcccacgctgtatgcatcacaaactatcaaaaactacaaaggaaaatcactaggtcaaatgccaccgcacatcttcgctgtagcagacaaagcttacagggacatgttagttttgaagcagtcacaatctattatcgtaagtggtgaatcaggagctggtaaaacggagtctacgaaacatttgttgaagtatttatgcgacaactggggagctgaagttggaactttagaaaagaaaattttggacgctaatccggtgctggaagcctttggaaatgccaaaactacaagaaacaacaacagttctaggtttggaaaattcatagaagtccactttgacaacaaatttaaagttgctgggggtcacatatcgcactatcttttagaaaaatcaaggatatgttccacagagggagacgaaaggaactaccacatattttatatgttgttggcaggagctccagaaggcttgaggagcaagctgtatcttagccagcctgatgacttcaattatttaaaacacggatgcacaaggtattttacaacaaacgcgtctgaaaaagcattagatgccaacaggaaaagcgcagctcacaaaaaagctggatctctgaaggatatcctcttggacgatgttggagatttcaaagagctggatgaagctctctcccgactggaaattagcgaaagtgaaagactacaaatctactccacagtggcagctgttctgcatttgggcaacgttgatttcgaagataatcctgaagataccagaggtggatgccgagttggagcttctggaganaatccctacttttggcctccaaacttctgggaatagatcccagtgaattgaagcaagcgctgatatcgcgcgtgatgcagagtgcgagagggcggatttgaaggtaccgtcattatggtacctttgaaaatatacgaagccacaacgccagagatgccctagctaaagctct

SEQ ID NO: 549 - DNA, 1205 bp, Diabrotica virgifera
gattggaaaagattccaaacgaaaaacaaaacaatgtaataaccacaaaacccctttcgaaatcctccgactggactgaagttgatctggaagtacctgataacgaggaccatccgattcaccttcacaatccaaaacttaatctcatttttaataacgataaaggaacacccacgcctcctccaagaaaacacaagaagaatttaagagagaaaatcgaagcagtagcaaaaactggactgcaagcctttcagtcaaagaaatcgcaagtagaagctactcctccgaaaccaccaacagaagtagaagaaccactgtttgtcaaaaagaccatagactacagatgtccgatttgcgatgccgatgaagccagtttcaatagggaccatcatcatcaccaccaccatgaacataaccatgtaaacgataaaaatgataacaaaacggacaagtttattaatttaagagacggaaaagagagcttgaaaaggaaaaagactttatcagtgtattcgcttcctaattacgatgaattgaagttgactgtttccgaatttaaagatgataataaagggccatcctctctaaagacggacaaaaaaggtcatccttcagaaatatctctaccagtagaccacaaaaagactgcaacaggctctacgggaaagttggatacgtacataacaagatgccgaagttttggatccattttcccacagcaactgaagaaattacgtccgcgaaaagcaccaacagatattgaaagcgatgattccttttggtggtttagaagactgggacttaggactaattgaacattataatccaaaagatgctagtttaccaagaccaaggaaaccagttgttaatgatgattcctaataaccaggcctaaagggatgatggtaccgaaaaaaaaaaaaaaaattaatcccaaacccaagctaaaacagctggcccttcgcaaaaaaataaaagaaattgcaaaaaaattggaaaaaaaaaaccaattgttaaatccccaaataccccagctacctcgccccataaaatccaccctccggccttccccataaaaaaaaccgggttttaaaaaaacctatcaccccccgccacaaaaaaaaaaaaaaaagaaaaaatttgaaacacccccaggttttataaaaaaaacttttaaaaaaaaaattttacgccggggccgccgg

SEQ ID NO: 550 - DNA, 1140 bp, Diabrotica virgifera
ctagacacaacctaaaaatttccaatttccgcattagtgctcgacccttggggtcgaaaactgttttacgatgaagatcacaattttaatgtgttgtttaacgggagcaatgtgttatcttcctccagccaaggaaagtcttctctctgggctatttcttcgcgacttggtaaatcgtatcaacggtaagggcatctctgaaggggatggagtatcttacttggattttactgatggactgccactagatgggcgctctttatctggtactctcgaagaagagcaaatgtttccagtggattatgaaacaatgggtgaaatgaacatgcatcccagcattcgtgatcaagaatacttgcaacacagcaccttatgggggaaacagtatttgaatggagacagggatgaaaactcaatactacatcacaacggatttaagaataagaatggtctaaaaggtgaatccactttgccagcttattgcagtccaccgaatccatgcccgataggatatacagctgatcatggatgcattgagatgtttgacaataccgcttcattcagtcggagataccaagcatcacaaaactgtatgtgtgatacggaacatatgtttgaatgccctacctcaaatgatatttctgatgacaattccatggatatgatcgacagttatcattttaacaagatgttacaacaatcggctaagttgaaacaacttttttcgcaaaagaacgtgtatgcaaaaaaagatcttcagattaagtctaagaacaatccctttttaactggagaaaaattacccgtggcagctaaaaaaggcaacaatgttttactgtaaacgtacaacaccaacccccaactatgaaccaatccggacgacaacaaataatgactttggctatgaacatggacgatccgaagaacaataaccattttaattcttacccctgtacgataaactatatgtaagaacttagatagtagttgcttttaatgtgagcatataataaacaaagaatggtacccatactgttagagttagagtaattacaacgtacaattccgttgtatacccaacaatttctcaaaagaatgataaatatgcctaaatcgtaataaagtgacatatcacgatat

SEQ ID NO: 551 - DNA, 1376 bp, Diabrotica virgifera
  misc_feature (1264)..(1264): n is a, c, g, or t
  misc_feature (1314)..(1314): n is a, c, g, or t
cccttggggtcgaaaactgttttacgatgaagatcacaattttaatgtgttgtttaacgggagcaatgtgttatcttcctccagccaagtatttgaatggagacagggatgaaaactcaatactacatcacaacggatttaagaataagaatggtctaaaaggtgaatccactttgccagcttattgcagtccaccgaatccatgcccgataggatatacagctgatcatggatgcattgagatgtttgacaataccgcttcattcagtcggagataccaagcatcacaaaactgtatgtgtgatacggaacatatgtttgaatgccctacctcaaatgatatttctgatgacaattccatggatatgatcgacagttatcattttaacaagatgttacaacaatcggctaagtctaagaacaatccctttttaactggagaaaaattacccgtggcagctaaaaaaggcaacaatgttttactgtaaacgtacaacaccaacccccaactatgaaccaatccggacgacaacaaataatgactttggctatgaacatggacgatccgaagaacaataaccattttaattcttacccctgtacgataaactatatgtaagaacttagatagtagttgcttttaatgtgagcatataataaacaaagaatggtacccatactgttagagttagagtaattacaacgtacaattccgttgtatacccaacaattctcaaaagaatgataaatatgcttaaatcgtaataaagtgacatatcacgatattgaccaaaaatacaaatagatcaacttaagtatgttttaggccctattgattttgaccgatctcttaacaagcggcaaaaagcttggaatggatagctttgcattgctagctgtttgaacctttataaggcatctgacaaaatcaaaattatacttaagtcgattacatcattttaatcgaactaatgacctagaaactcttcttcaatcagtgaatgaatatataattgaatataatgatttgttaatggacatacaaataatattacaaaatgtaaatattgtacatgagcaaaatcatgatctactaagtgaaagaggctcttcagtaggtatttaaattatgtaattttatttccgcaagggagcagattttaatagtatttatatctctaaatgtattgtcttctattatcttccataatatagtcttacaaggttgaatttctgtagaatagataaacaccaatatttgagngtcttttatgctgcatttgaattagaaaataaagcggaaatgaatcttanacagttttttattatatagaacatgacaaaatcttgtgaaactattatgctggacttacaaa

SEQ ID NO: 552 - DNA, 1576 bp, Diabrotica virgifera
gtcgttactaagtaagattatttttaatttagaagaagactttgagttttccagatatttcttcaaaatttttaggtttagcaatattggaagctaataagtgtaaaacatggtaacacagactgtaacaaagattgttggcaaatctgaggaaacacaaacagaaaaaacatggtatcaagttgtagttgtttctacaatttccttggtgtcattaaactgcggaatctcctttgcatggccatcaccattcctaatcaaacttgtaaacgataaggaaaactacaatatatctgaagaagaaggttcctatttctctgtgataagcattgtagcagtcgtaatcctaccagtattcttgtcgttgatagtcaatcagattggaagaaaacgcttgctactgttaacagcatttccttatgttactgcgtatgttcttgcagctttctctagaaatatctggctattttatttagccagattgatcactggaattggtgattgtattgcatatacttgcctggtagtttttattgctgaaatatctagtccacaagtaagaggtacctggggcaacgcaatcgtttggtcaggctttttaggccaattcatcatcaatgtcttaggcttatattgtagcgtgatggtcgcttctctcgtttgtgcagtatttccagtaatattcttatttatttttgtatttatgccagaaagtccctatttttatttaaataaaggacaagatgaagaagccaaagttagtttaagaagacttaaacgtaaaaataatgtagaagaagagttctcaagattaaaagaagttatggaaaaggagttgaaggaatctggttcttggtcagacttggtaacaaataaaacaaacagaagagctttatttgctgcaatttttctacgagtcagtcaaatattctcaggtatattcactcttggcccctacatacaatttatatttttaaaatctggtactaacattagcatggagctatctacaatattatttacgtttattaattttgtcttatattctgctgcttcatatggatcaaacaaactgggcagaagagtgtctcttatttcatcgttactgggtacatctatcatctttttgttggaagctgcatatttttttgttgatacgttttatcttgatatcaacctgaaacctattcagtggtttcctttagtgggtctcatactgtttttggtagtttcgtcgtacggaataggtactgttcccttcctgatgcctggggaattatttgctcccaatatcaaagcccaaggaatatctgtagtcatttcggcttttggattatcaaatctgatcatgaatacattattttacagtttaaacaatgtgacaggacttggggggccatttttagtgtttggactttgtaacattatttcagctgttgtggtatacaaatttataccagaaacaaagaataagactttagaagaaattcaaatcatattgagtaaaatgtaatttattttaataaaacttttgtatatattaaaattaaaacataaaataaaatatttatagaag

SEQ ID NO: 553 - DNA, 892 bp, Diabrotica virgifera
caccttctattttttggtatggtacagattacctgatgtctctttaagatattttaaaaggttgaaataaaaaatatactatgtaaatagttttaagaacgtctgaaatattctttaagttaacagaaaactaagttatattaagtgtcgggtcgagatagttacataaacattcaataatcgcggttttctcgtcgggattctgatttgctgaagattatgaatacattgagtggggtgctgcctttggtgctaggcgtaggtgtgatagttacgtcatttgtgatatataagttcttttattcttctccagatgcacctagcaaagttactaaaagtaaaagtaaaaaagtcctcttgaaagatccacagatgaaatatcaactaccattaatagaaaaaactattatcagccatgatacaagaaacttcaggtttggtctaccagaaaaggatatggtgcttggtcttcctattggtcagcatattatactgtccgctaaaatcaacgatgagttagttataagatcatacactcctgtgtcatcagatgacgatcaaggatacgttgatttagttattaaggtatatttcaaaaatgttcatcccaaatttccagatggtggcaaaatgactcaacatttagaatcccttaaaattggcgacactatcgatgtacgaggtccagcgggaagaattgagtacttgggtcatggtaaatttacagtgaaaaaacttaggaaggatccaccagaagaaataacagtgaagaaagttaacctcattgctggaggtgtaggaataactccaatcttacagttgatcagacacatcctcaaagacccactgacacaacagaatgtgcattattgtttgcaatcaaacagaagac

SEQ ID NO: 554 - DNA, 1298 bp, Diabrotica virgifera
ggtaagttcaatattcaatgtcattaataaaaattaagaccacaaaaactagcagctattttttaaattcagttgtttcttgagtgattggttatttttgtaagtttaagtacattgtgtaatggattcgggagagagtcaggtgctgcctttggtgctaggcgtaggtgtgatagttacgtcatttgtgatatataagttcttttattcttctccagatgcacctagcaaagttactaaaagtaaaagtaaaaaagtcctcttgaaagatccacagacgaaatatcaactaccattaatagaaaaaactattatcagccatgatacaagaaacttcaggtttggtctaccagaaaaggatatggtgcttggtcttcctattggtcagcatattatactgtccgctaaaatcaacgatgagttagttataagatcatacactcctgtgtcatcagatgacgatcaaggatacgttgatttagttattaaggtatatttcaaaaatgttcatcccaaatttccagatggtggcaaaatgactcaacatttagaatcccttaaaattggcgacactatcgatgtacgaggtccagcgggaagaattgagtacttgggtcatggtaaatttacagtgaaaaaacttaggaaggatccaccagaagaaataacagtgaagaaagttaacctcattgctggaggtgtaggaataactccaatcttacagttgatcagacacatcctcaaagaccccactgacacaacagaatgtgcattattgtttgcaaatcaaacagaagacgatattttgttaagaccagaattagaagaagcagtgaagagtagacctaatagtttcaagttatggtatactttggacagacccggaccagattggaaatatagttccggtttcatcaacgaagaaatgttaaaagaacacttgtttcccgcttctgatgatgctttagtcctcatgtgtggtcccccaccaatgataaactttgcttgtactccaaattttggagaaacttggccacgaaaaacaaaaggctgcttggcttattgaaaaaataaaaaatttaaatgtttatttttgtttttttttttttttttttttaatagtgagggaaaaaaaaaaaaaaaataaaacaaatttaaaaaaaaaaaaaaaaaaaaaaaaaatataaaaaaaaaaaaaaaaaagggggacaaaaaaaaaaaaaaaaaaaaaaaaaaaaaaaaaaaaaaaaaaaggggggggggggggccttattggggggggggggggggggcccccc

SEQ ID NO: 555 - DNA, 1033 bp, Diabrotica virgifera
actagttctagatcgcgggcggccgctctggatctacgcaaaagttgagtcttgaaaaataataatgacgtctaaagtatctcgtgatactctatacgagtgcgtgaatggagtcttggaaaatgccaaggagaagaaaaggaactttttggaaaccgtggaactccagatcggtcttaagaactacgatccccaaaaggataagcgtttcagcggaaccgtcaagtatgtaacctgatcagtaatatctttaggttatgttgtccatattctcttttacaataaccattatttgatggtattcattgatttgataagtgtttaacctaaagatatgcactgactcaggaagccctaaaggcggacctgcacccagggtcttaaaataactgggtagatcctgctaggtttacctagcagcatcgaccatttcaatcattttcgtgctataatgtaggattaaggttctgactaaagcacattcctcgtccaaagatgcaggtatgcatcttgggagatcagcaacattgtgacgaagctaacgccaacaatgttccattcatggatgtagaagccttgaaaaaattgaacaaaaacaagaaattggttaagaaactagccaagaaatatgatgctttccttgcttctgaagccctcatcaaacagatccccaggttgttgggtccaggtttgaacaaggctggtaaattccctggtcttctctcccaccaggaatccatgacacagaaaattgatgaagtaaaagcaacaatcaaattccaaatgaagaaggtactctgcctttctgttgctgttggtcatgtaggcatgaatcaagatgaattggttcaaaatgtccatctttcaatcaacttcttggtctcactgttgaagaaacattggcagaacgttaggtctctccacgtcaaatcatctatgggacccccacaaagattgtattaagttataatttttatactgagacttttattacccacttaaatggggtatctaaataaaatcgtttttaagt

SEQ ID NO: 556 - DNA, 1654 bp, Diabrotica virgifera
tatttattttaaaataataaaatattttttagtaaaagtaaagaaaaattttatttaatgatagttaattagtattgggagagaatattttatttttataaaagaaaaatttatttttggtaaccggggaattccagatcggtcttaagaactacgatccccaaaaggataagcgtttcagcgggaccgtaaaactaaagcacattcctcgtccaaagatgcaggtatgcatcttgggagatcagcaacattgtgacgaaactaacggcaacaatgatccattcatggatgtagaagccttgaaaaaattgaacaaaaacaagaaattgtttaagaaactagccaagaaatatgatgctttccttgcttctgaagccctcatcaaacagatccccaggttgttgggtccaggtttgaacaaggctggtaaattccctggtcttctctcccaccaggaatccatgacacagaaaattgatgaagtaaaagcaacaatcaaattccaaatgaagaaggtactctgcctttctgttgctgttggacatgtaggcatgaatcaagatgaattggttcaaaatgtccatctttcaatcagcttcttggtctcactgttgaagaaacattggtagaatgctaggtctctccacgttaaatcatctatgtggaccccactaagatcggattaagccataagaacatcgtcagtcgcagatttcgactcactaacgctctacttaggttagtacctaactgattttttttacaaaaaagtgattttacagtgtagtttttaagtttctaacataattttcggacgaacgaccgaaaaagaccgaatctagaaagaaagttaacatccaacaactaacaccatgtctttcaaggaacatttggagatgataagccttaacgaatccccttctaagaaggctaagttctggcaggcctttgtcagatccctaaaaggatccgatgacttaagggcaaccgattcagtcagttcccgcaggggcatcttccgtcccatcagtgacatcccagaaatttcatcctcttggccatacaccaaatcaatctatgacgagcccagcgcagctgcagaacgtatccacgttcccggctacagatacgatccagttcacagagatatctacggttactcccccaggccaatttacccacacaactatggctctctacagataccggcccgcataccacgtcacaaaaccaaaaccaatcgacgctgacgaggcatggaaacaccacattgaccgtgtaaaaggacgcgagccatcacaatggcccagcagcattttccacacatcttacccattctctcgctatccattgtacttagtgtacagtaagagacctgctccagctgctgacaaatacgatccacaccgctcctggttggatcacatggaccgtcttgccgagctcgacaaactctatccctccttatggccatccgttggaagcagaagacaactccaatcaggcttttgcgactccccccaaaccgtcgtcacgcttttctactaccgtgcccaaccaatttcataacccaccttcaccgcgccgccccccatccacacgatcgttcttgaggtccggcacaaatttcccttatatagatacgaaaataaaa

SEQ ID NO: 557 - DNA, 1109 bp, Diabrotica virgifera
ccccccccttgttggaaggaaaaagaccctttgaggggaaaaggggataaaggggcaaaaccaatttgtttttttgtccttttgccccgtttttggggggggtataccggtggttttggccaagtgggttttttctgccccttttattacaaacccaaccatttctcattttgccaggggggcatttttcgggtccaatatgaaaaccaaaataaatttttaaattataataattggtatcgtttttattaataggataaaaaataaaaaccgtaaaaacctttcggttttcagggttgcaggacccccgcgtccgtgccgccgaacatcgtcagtcgcagatttcgactcactaacgctctacttagggacgaacgaccgaaaaagaccgaatctagaaagaaagttaacatccaacaactaacaccatgtctttcaaggaacatttggagatgataagccttaacgaatccccttctaagaaggctaagttctggcaggcctttgtcagatccctaaaaggatccgatgacttaagggcaaccgattcagtcagttcccgcaggggcatcttccgtcccatcagtgacatcccagaaatttcatcctcttggccatacaccaaatcaatctatgacgagcccagcgcagctgcagaacgtatccacgttcccggctacagatacgatccagttcacagagatatctacggttactcccccaggccaatttacccacacaactatggctctctagacagataccggcccggtaggttcgaatacaaacattagaaatcacaactgaaagtcgttctctcagtattttatgttatctgccacttcaagtgcctttatggacagtttgatagcttatgagtccaagcacgggtccttgtagcataccgcgaacaacgctgcgttcactgctctcgtgcgattattattattttatttgtcatctttaattctgtattttcttgtaatcttttgtgttgatatttgataattctatacgtgttgtatatcattaatggataataaaatgtttaaaagccaaaaaaaaaaaaaaagggcggccgctcgcgatctagaactagtcggacgaaa

SEQ ID NO: 558 - DNA, 1499 bp, Diabrotica virgifera
ataaatgtgccaaaaacagtgctatagtgaaaataattcatgttaaacgaaattatatgataaagtattggtttgcaatgcacattgattttaaaatgatatgggaatggctttacgtttaactaaatgtatgacgtcattcaaaaagctccaaaatgtgaaattctgctcaaaaacaaccaaaaaccaacaaacattggaatcttcttcagacaattcaaaaaatgatttatccaaagaaagaaaatatccagaagaacctacaacgtgttgtatgtcaggctgtgctaactgtgtatggatagagtatgcagatgaactgcagaaatatttccaggatggaggggagagagctagagaagaaattaataagagagtcactgatccaaacatgaaggcgtttttgtcacatgagcttagaatgaggaatataaaataaatgaaaacttaaaaaaaaaaaaaaagggcggcccggacgcgtgggcggacgcgtgggagcttatatagaagtttatcaagatgttgatgccaaaaaagaatagagtatgtatttacgaatacctcttcaaagagggagtcatggtagctaaaaaagattaccatgccccaaaacaccccgaactagaaactatccctaaccttcaagtaattaaggctttacaatcacttaaatcaaaaggttacgtaaaggaacaattcgcctggaggcattattattggtatttgactaactctggcatcgaatacctccgcacattcttacacttacctggagaaattgtcccatctaccttgaaacgcccagcaaggacagaaaccacccgtcctagaccagctgctctcagatctgagacatctaaaccttcagaagaccgtgcaggatacagaaggactcctggaggccctggagctgacaagaaagctgatgttggtccaggaactggagatgttgagttcaggcaaggattcggacgtggacgggcaccacaataaatttattgataagttaatttttataaattgatcagccaataaaaagtttggttaccgcagatttcgactcactaacgctctacttagggacgaacgaccgaaaaagaccgaatctagaaagaaagttaacatccaacaactaacaccatgtctttcaaggaacatttggagatgataagccttaacgaatccccttctaagaaggctaagttctggcaggcctttgtcagatccctaaaaggatccgatgacttaagggcaaccgattcagttcccgcaggggcatcttccgtcccatcagtgacatcccagaaatttcatcctcttacaccaaatcaatctatgacgaggcgcagctgcagaacgtatcataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggaaaaaaaaaaaggggggggg

SEQ ID NO: 559 - DNA, 3547 bp, Diabrotica virgifera
cgtacatcaaggtttgtatgactagataccattaagctattaacaaattttcagcttgctgttaatcgactttttttaggtatgcgggatccaggccaattatttatttaaataaatattctatataaccctaattactcttaaataattatctacttttgttaaaaatatatgtagtacttcgtaaggccctaactatgttcaaatatgtcagtagaaatatgcttaattaaagaaattcctatgtttcaaaaaaaaaaaaaaaaaaaaaaaaaaaaaaaaaaaaaaaaaaaaaaaaagaaaaaaaaaaaaaaagggcggccgctcgcgatctaaaactaggtgccgaacatcgtcagtcgcagatttcgactcactaacgctctacttagggacgaacgaccgaaaaagaccgaatctagaaagaaagttaacatccaacaactaacaccatgtctttcaaggaacatttggagatgataagccttaacgaatccccttctaagaaggctaagttctggcaggcctttgtcagatccctaaaaggatccgatgacttaagggcaaccgattcagtcagttcccgcaggggcatcttccgtcccatcagtgacatcccagaaatttcatcctcttggccatacaccaaatcaatctatgacgagcccagcgcagctgcagaacgtatccacgttcccggctacagatacgatccagttcacagagatatctacggttactcccccaggccaatttacccacacaactatggctctctagacagataccggcccgcataccacgtcacaaaaccaaaaccaatcgacgctgacgaggcatggaaacaccacattgaccgtgtaaaaggacgcgagccatcacaatggcccagcagcattttccacacatcttacccattctctcgctatccattgtacttagtgtacagtaagagacctgctccagctgctgacaaatacgatccacaccgctcctggttggatcacatggaccgtcttgccgagctcgacaaactctatccctccttatggccatccgttggaagcagaagaccaactccaatcaaggctggtgaatttgctcctcgtccaaacgaagtagcctttaactacgctggccaaccaatttatacccgtggagggttgtatccaactgccgtttactaagtggaagaaaaaagaatgacacaacgaggagtcaacataaaatcagtataccacaagcgactgactgaacaaaaaaagcattgaaacatctgtttgcacttatttaaacctatgtttcaaccgagtgttcattttaacaaaaaatataagttatatacacatacttactacaaagtgccttaaattatacaaagtaatattaagaacacctaattttatgtaaaatatgtaacatatacactgttttctttaattttttgtaaatgatcctttgggacgatcggtgctgactataagcgtgtctcgcattccatcattatattttaggaacgtcctagagtgcaggaatttgtaaaaattatattatttttgattggtttcaattttggtaatcatgtaaagctttaccaattaataaaaaaatttaattcagtgaaaaaaaaaaacggacgcgtgggaaaaaaaaaaaaaaaaaaaaaaaaaaaaaaaaaaagggcggccgctcgcgatctcgcgttcggtcactttcatgggagtagccagttcgaaacaaaaataaaattttaattaatctggaacatctcccaattttttagaaaacttacattttcaatatgagtgctataccaggaagtattgcatttgatgaatatggacgacccttcataattcttagagaccaagataagcaaaagaggttgaccgggatagatgcacttaagtcacatattttggcagcgagacaaatcgctcaaactataagcacttctttgggtcccaaaggtttagacaagatgatggtgtcacctgacggtgaagtaacagtcactaatgatggtgctactattttgaaaatgatggatgttgaacatgaagtagctaaattgctagtacagctatcacagtcccaagatgatgaaattggtgatggtaccacaggtgttgtagttttggctggtgccctgttagagcaagcaggatctttattagacagaggtattcatcccataaggattgctgatggttttgagctagcttgtcaaacagctgtagctcatttggaaaaaattgcagaactatttccagtatcagcagaaaacactgaaccattaataaaagttgcaatgaccactctgggatctaaaatcattaacaagtgtcataaacagatggcagaaatagctgttaatgcagtcttagctgttgcagatttagaacagaaagatgttaattttgaacttattaaagttgaaggcaaggttggtggaaaattggaagacacaacattagttaaaggtgtagttattgacaaaacaatgtcccatccacaaatgcccaaagaactaaaagatgtaaaattggctattctcacctgcccgttcgaaccaccaaaaccaaagaccaaacataagttggatgtcagcagtgtggaagattataaggaactaagacagtatgaacaagaaaagttcaaagaaatcgttggtttggtaaagaaagctggagctacattagcaatttgtcaatggggcttcgatgatgaagccaatcacttattgttacaacaagaattaccagctgtaagatgggttggaggtccagaaattgaacttatagcaatagctactgggggtaggatagttccccgttttgaagagcttactcctgaaaaacttggtcatgctggtttggtacgagaaattgcatttggcaccactaaggatagaatgttggttattgaagaatgttcaaattcacgggcagttacgattcttgtcagaggaggtaatcaaatgttagtagctgaagccaagagaagtctccatgatgcattatgtgttgtcaggagtttagttcaagaaccaagagtagtgtatggtggtggagcagcagaaattgcctgctgtttggcagtcgcggctcaagcagatcaactagcttccttggaacagtacgcctatcgtgcatttgctgaagccttagaaagtataccacttgctttggctgataacagtgggctatctgcgatccatacgctaggagaagtcaaggctaaacaagcagctacaggagatccagctctcggtatcgattgtatgaatactggaaacctcaacatgagagaacaacatgttatcgaatcactcagatcaaaaagacaacaatttttgttggccacccagttggttaaaatgatattgaaaattgacgatgtacgccaacctgcatcgggataaaatgacacttatttttgtactaccggcgttaatttctaattctcactaataatgacttttataagttgatctgcgtaatgcttctttgttcttataatcactgaaagtattaatataatttat

SEQ ID NO: 560 - DNA, 3242 bp, Diabrotica virgifera
ttttttttttttcgttaacgtagacagccgcaaaagttgtgtcttgaaaaataaaaatgacgtctaaagtatctcgtgatactctatacgagtgtgtgaatggagtcttggaaaatgccaaggagaagaaaaggaactttttggaaaccgtggaactccagatcggtcttaagaactacgatccccaaaaggataagcgtttcagcggaaccgtcaaactaaagcacattcctcgtccaaagatgcaggtatgcatcttgggagatcagcaacattgtgacgaagctaacgccaacaatgttccattcatggatgtagaagccttgaaaaaattgaacaaaaacaagaaattggttaagaaactagccaagaaatatgatgctttccttgcttctgaagccctcatcaaacagatccccaggttgttgggtccaggtttgaacaaggctggtaaattccctggtcttctctcccaccaggaatccatgacacagaaaattgatgaagtaaaagcaacaatcaaattccaaatgaagaaggtactctgcctttctgttgctgttggtcatgtaggcatgaatcaagatgaattggttcaaaatgtccatctttcaatcaacttcttggtctcactgttgaagaaacattggcagaacgttaggtctctccacgtcaaatcatctatgggacccccacaaagattgtattaagttataatttttatactgagacttttatttacacacttaaatgtgggtatctaaataaacatcgtttttaagttcagaagataaaaaaaaaaaaaaaaggaattttttttttttttttaaagcttctatagaagtttatcaagatgttgatgccaaaaaagaatagagtatgtatttacgaatacctcttcaaagagggagtcatggtagctaaaaaagattaccatgccccaaaacaccccgaactagaaactatccctaaccttcaagtaattaaggctttacaatcacttaaatcaaaaggttacgtaaaggaacaattcgcctggaggcattattattggtatttgactaactctggcatcgaatacctccgcacattcttacacttacctggagaaattgtcccatctaccttgaaacgcccagcaaggacagaaaccacccgtcctagaccagctgctctcagatctgagacatctaaaccttcagaagaccgtgcaggatacagaaggactcctggaggccctggagctgacaagaaagctgatgttggtccaggaactggagatgttgagttcaggcaaggattcggacgtggacgggcaccacaataaatttattgataagttaatttttataaattgatcagccaataaaaagtttggttacgatttcagcggaaccgtcaaactaaagcacattcctcgtccaaagatgcaggtatgcatcttgggagatcagcaacattgagagacgccttacgacaacaatgttcatctgggatgcagtcagtgccgaacatcgtcagtcgcagatttcgactcactaacgctctacttagggacgaacgaccgaaaaagaccgaatctagaaagaaagttaacatccaacaactaacaccatgtctttcaaggaacatttggagatgataagccttaacgaatccccttctaagaaggctaagttctggcaggcctttgtcagatccctaaaaggatccgatgacttaagggcaaccgattcagtcagttcccgcaggggcatcttccgtcccatcagtgacatcccagaaatttcatcctcttggccatacaccaaatcaatctatgacgagcccagcgcagctgcagaacgtatccacgttcccggctacagatacgatccagttcacagagatatctacggttactcccccaggccaatttacccacacaactatggctctctagacagataccggcccgcataccacgtcacaaaaccaaaaccaatcgacgctgacgaggcatggaaacaccacattgaccgtgtaaaaggacgcgagccatcacaatggcccagcagcattttccacacatcttacccattctctcgctatccattgtacttagtgtacagtaagagacctgctccagctgctgacaaatacgatccacaccgctcctggttggatcacatggaccgtcttgccgagctcgacaaactctatccctccttatggccatccgttggaagcagaagaccaactccaatcaaggctggtgaatttgctcctcgtccaaacgaagtagcctttaactacgctggccaaccaatttatacccgtggagggttgtatccaagtaagaaactattcgacgacattttaaacccttctccaaatctccctgtatccgctgtatctcgtgatcccttctggtgggactctcctctcaaacccgcttctgtgcacaacccatggggcaaatccccattctatctccgcgactcatatctttccccagtcaagaggacgttcctgtgggacaaacaccccgttaggccgttcgctgccgtttactaagtggaagaaaaaagaatgacacaacgaggagtcaacataaaatcagtataccacaagcgactgactgaacaaaaaaagcattgaaacatctgtttgcacttatttaaacctatgtttcaaccgagtgttcattttaacaaaaaatataagttatatacacatacttactacaaagtgccttaaattatacaaagtaatattaagaacacctaattttatgtaaaatatgtaacatatacactgttttctttaattttttgtaaatgatcctttgggacgatcggtgctgactataagcgtgtctcgcattccatcattatattttaggaacgtcctagagtgcaggaatttgtaaaaattatattatttttgattggtttcaattttggtaatcatgtaaagctttaccaattaataaaaaaatttaattcagtggaaaaaaaaaaaaagaaaaaaaaggaaaaaaagaaaatttttaaaaaaagatagaaaaaataaaaaaaagggaagtctcgcctgcactgattaatttgaatggccgcggtattttgaccaaacttaatttttttgaaaaaaaaccccacccgcacggtcacccacctaaattcattgatacgctactccttataaactgatccaccaatacaccgcacgatcacgaaacaaaaaaaaaaacggtccgcccc

SEQ ID NO: 561 - DNA, 975 bp, Diabrotica virgifera
gcccgtaaaaaaatattagaaaaactcgaaaacgtcagataagaaaagttcagttaagtacaagaggaacagtgtaaaggaaaaaagcgaatatttcgcgaaatgaacatcagatcaaaaaattgaataatacgtgttcaatatttttcaaaaatctgtcgaatgacacccctgacccccacgtaggtggggtgggggattaaaagtcttaaatgggaacgcccattttttatttgcagatttgcattccttatgtaaaaataaggaatttttattcgagacattttttctaattatgggtagatgtcgccataatcggaaacaacgatttttggaaatggaaaattaaattaaaaattggaaatcattactaaaatggaaaatacaacttgactctttttggttttataacctaatcttcgcaatccagcaggtccccatgacgctttagtaactgcaaatttagcatccaaggctcctctactattattttaataggtataattgccaaccaatcggcgtgttttaattcagttcagtcttcttacgagcctctctgatgacgggtagacctagaaacaggtgtccgaggagttatcataattttatgatgggaacgacgatcccacaacaaattaatgtgaaagtacccacagaaaaaaatgtttatgaaccatgaatcaatctcaaagaaaatatctaacctaaaaaaatatatgataacgaacatgccacgtccacgaactggcttggggctttaaaatgtgtaaaaaataaaaccacattccaataattgtggctattgccttagttttaacttttataaatgaaaaaaaaaaaaagaagctgaattttccagctccccttctgtgatctctaaaagaaaaaaattgactccaattgtggggatcttaataaggtatttttttttaatatacttgggatttttttatattcctttttgaaaaatttata

SEQ ID NO: 562 - DNA, 948 bp, Diabrotica virgifera
gtcaacagtatgagtgacatcagctgttgaattattaaattaatccaaaaagtatttattccaacaatttaggctgcttgtaaaaaaatggaaggaaacaaagacgaagctcttaggtgtgtagatttagcagaaaaattcatccaggaaaaaaacagacagaaagctgagaaatacttgaacaaagcagagaaactctttcctactgataaagcaaaagatctattacttaaaatcaatctgatggctcctagtaaccctgaaaccacccaacccagaagaagagtaaccactcagaaatcagaagaaaaggaaaacaaagctccggactatactccagaacaagaagaagcagtcaagagaataaaaaaatgtaaagattattatgaaattcttggagtcagcaaggatgctaccgattctgaaatcaagaagtcttataagaaattggcattgcagatgcatcctgataagaacaaatgccctggagcatctgaagcgtttaaagctgtaggtaatgctgttgctgtgctgactgatacagaaaagagaaagcagtacgatctgtatggatcagatgaagaccggttgtcatctcattcccatcatcacacttacacaagaggttttgaatcggacgctacagctgaagaactctttaatatgttcttcggtggaggtttcagcggacccaatgtctacgtccgcagaggaggcagatggcaaagacaaacggcttctagtcagtcacatcaagaacattcacatcacagagagcaacaaagcagttacacggcgtttattcaactcttgcccatcttgctggctatctaattatcgatggcttccagtctctttatttccgatccagcatatagtttacaagtcagcacgaaatacccctattttaagaaagacagccaattttgaacataccttactacgtca

SEQ ID NO: 563 - DNA, 946 bp, Diabrotica virgifera
  misc_feature (917)..(917): n is a, c, g, or t
ccccacgcgtccgcgacaatcacagattagacagatacgtctacatacatcgaaaatattttttaaaatttaaagtttgactaaaccgaaaaatgaaggtacaaatcgtagttttggcagttcttctggtcttaaccgagactatttatggaattccaacagcaaatgacgacatcgcagacgagtttgtcaagaaatctctggagttgcagctgaagatcgcgaaagaaataaaagacatcaccggccaacagatctacgtcttcgacacatccaacacattcgcagatgcttccatcgttgttatggcgaacatcagagtcttggagaccaaaaataagcaactaggagtgctatcccaagcggctcagatgacattcagtaccagcaatcaatacaagaagttcaccaatgaagatcttcatgttgacgaagtaggtctatacatttaagaactggcaaatttttggtgtagtccagaactacagtgaacggtaaacttttattgtataatatgtttaatttttaaaattaactttattttttaacaaagttctgtatctgctttctgtttcttgtaacatgtctaatttatgtattatgtttatatggaatttagccacaatgattgatgtaacgaaaattaaatttttaattaactaatgtttgacgattcgattaccactacagaaatcgttctaaaaaatattctaaaaattctgggaagatgtataacttattttaagttttattagcctactcaactaataaaactgggttatacatgttcccagaatttaaaataatttttgttatcgaaaagtaaaacattagttctttaaaaatgtgattttcattacaacaataaataatttgtggcttaatccatataaacatattaatcaaattccatttanttcgttgaaaaaaatattttttaatactt

SEQ ID NO: 564 - DNA, 969 bp, Diabrotica virgifera
  misc_feature (895)..(895): n is a, c, g, or t
aaaaatctgaacaacatggacaacttaaggctctatttagctacctacaatgtaggtactagttccccagatcaagatttaagggagttattatccataactgacaggaaaagtgagacacgtcccgatttttttgcactatcctttcaagaggtgaaggcacaaccacagaatatgctaatggatacattatttgatgatccatggacttttgctattaaagaactcctccagagagattacattaaactaaaatctctccgattgcaagggcttctattaatagtattttccctaaggaagcatcttttgaatataagagaaattgattccgagtatacaagaactggtttaggaggaatgtggggtaacaaaggagcggtgtcgattagactaagtatttatgggtgttcactttgttttgtaaatgctcatcttagtgctcacgataaccacttagatgatcgagtagaagattacaacagtattattcatgatcaagaattccatgtacctgaaactacaaaaatattttatcatgattacgtattttggatgggagaccttaatttccggcttaaggaggaattcgacaagactcccgaagaaattgaaagactagtggtgaaaaaagaaatgaaagctttgttcgaacatgaccaattgcggtacgtgatgagaaagggtgaagcattcagcgaattgacagagcaggatccaacgtttcctcccaacgtttaagtttactgtaggaactccttgctatgactacaagagacgtccagcttggtgcgacagaatactgtataaagttaactccaacaactatgaaacgtaacactgaaagtagatcagctttcgtacaagtcgcatccaactatggtcccttagtgantcataaacagttactggctgattttttttataaagggtattttcagattatgctgaagtctggtgattgaattt

SEQ ID NO: 565 - DNA, 1578 bp, Diabrotica virgifera
cggacgcgtgggcgttagtgcgtgcttaaaatttaaacgtcatcttttaaaattgtaagttttagttttgaagataaacatcttattagcttattatttaaaactaaaagttataattataaaaagggacaagggactacatcgtgttgcttatcttttaatcgctattaactcatagagtcgctggaattgaggttaaatcattttgggagtggtgttatattttaaacaattacaatgttggatgaaaacttattgcaagaacgattagctcaatttaatcccgaacctttagtagacattactcacaataaacccaaagaaagcatcgaatcctatactatccaggaggatgagaacaacattgatttggccaaaaccaactttttgaattttttggacaatgaagaaataaaaaaatcggctgaaaatataatacgaaaatatggtgtaggaacatgtggcccaagagctttttacggcacaaccgatgttcatctcgatctagaacagagacttgcagactttctgaatatgtcagattcgattgtttattcctacggttttgtagctatatcaagctcaattgcagcatattgtaaaagaagtgacactgtatttctagacaaggaaaccaactttccaatactacaaggtgtaatagcttccaaaagtaaaattgtgtattttgaccataatgatccaaatagtttgagaagagaagtggagaaagtgattaaaaatgagaagaaaccatcaaggaagtttttaattgtagaaggagtatcttggaagactggtaaactgctgcctttggaagaattcttaaaagtagctgaagattacaaaatccgcattttcctagaagaatcttattctatcggtatatacggagatcatggtaaaggtttaactgaacattttaacattgatccctcaagaatcgatatgataatagctaccttggaagcagcatttggttccataggaggattttgcgctggctcccatttaacaatcgaacaccaaagattatcaggagctggatatatattttcagcttccttgcccaccttcctcgtacaagcatgtatagagtctattagactcatggaagaccgtcccaaacaaataagagcatttgcaagggaattccaggtatttttagaagagacatgccaatacaaagttgatagtgaccctgaatgtgcttttaaagtttttactgttaaggaggaaaccggcagaaaagagaaagaggaagtaattctctcatatttgcaatcaaaatggtgtacatttcctgatatctgaagggggtctaatgataaacctttcaattaatatctttattaacaagagtagattggagaaggtttataaagttttggaagatgcatcaaaactataataattaagtctggtagcaccactttaggaatactacagcacaactgcacaattatgggcatttacttgatacaacttccgtaatgtattttaatttaaaatccaattaatattatggtaacacaaagctggtattaccattccttgcgcaaaaataaaatgtattct

SEQ ID NO: 566 - DNA, 1442 bp, Diabrotica virgifera
aaatagaaatagaaaatctaaaaaacatatttttaacatttaagaaagtgagaaagttaaaagttaatattttcattcttttacttgttatttatatacacttttagtttaggtttaacaaacatatattgtatatcctgctgtatattccaaaatgtccagaaagagggatatatctagggaagaaatagccaaacaatttcttttgccagaaaggcagtccaaaattgacaccctgttaaaacaagatggtcaagcctattgtatttgtagatcatccgattcatctcggtttatgatagcttgtgatgcctgtgaagaatggtatcatggggattgtgttaaaatatcggagaaggaagcaaaacttataaaacaatatatctgtgttcgctgcaaggaggaagatccgtctttgacgactagatggaaaaccaagaaagaacatgatgaaactttttctttgtctcttggacaagaagaacgaaaatccagaaaaagaaaagaaaggggcgagaataagaatgataaaaaaattaagaaatgtggtgaatgcatgggctgctacagaacagaagattgtggtagatgcgatgtgtgcaccagaaagaatagacatagttcatctaaaaatagagaaaggtgtaagcaaaggatatgtgtaaatgcattgggaggtgctagaagaaaaaggagggactccagttcagatagagagcaatctcacaatgaccatctaaaaacagactatccaaggcactgttacgggcctaagtgtacaaacagtgcaagatatggctctaaatattgttctgatcagtgtggcatgaacttagcaagaactagaattcttcaaattcttcctcaaaggttacatgaatggagtttgactcctccagctgcagaggaatccaataaaaaagctcttgatcaaatcaggaagcagcaagtcgaagtccaacaaattctgcaagagttagataagcgccacagagaacttgatgttgttatagaaagagccaagaatgcaactattgatcccagactagaacataatgaagatgaagatactgagacctcaatgtattgtgtaacttgtggtctggagatccactcgaaaacagccacaaagcatatggagaaatgctttaacaagtatgagtcccaatcttcttttggatctgtggttaaaacaaaaattgaaggaagcagcatattctgcgatttttacaacgcagaacatagaacatattgtaagagattgaaagtattgtgcccagaacattgtaaggatccgaaaataggagatcatgaagtttgtggatgtccattggtaaaagatgtattttcttcaactggagaattttgtagagcaccaaaaaaatcatgctctaaacatcagttttgggaaaaaattcgtagagcagagatcgacctttgaa

SEQ ID NO: 567 - DNA, 978 bp, Diabrotica virgifera
acacaacaaacacattttggtttaaaacgaaaaaatgggatctatgcttgctgttccctgtacttcacaatctagattggatggaaaaacggccgtgataacaggagcaaacacaggaattggaaaaataacggccaaagatttttataaacgaggagcctacgtaatcatcgcatgcagaaacttagacaaagcaaatgaagctatccaggaaataaaacaagactgtcaaggtcaagaaaatttggggcagctaaaatccgtcaaacttgatgtttcaagtctaaagtctgtaagagaatgtgctgaagaactgaacaaaaccgaacataaaataaaccttcttgtgaacaatgcaggagtaatggcagtaccctttagcaaaacagtcgatggcttcgaacttacttttggtaccaatcatcttggtccctatttgctgacgttgctgttgttgcctaagattatacaaagcggaccaggtgctaggattgttaatgtttcttcttcagtgcactcaatgacttgttctgggccagatttcgaagatttgaactttgaaaaaagaaaatttaatactaaccaggcttatgtatacagcaaattggcaaatattttctttaccagagagctgcatcgaagactcagagatcatggtatcgatggagtaaatgtttattccctccatcccggtgcaatcaaaactgatttaagtagaagcatgaacgaatcgttgtttccaggagctcgattcattttgaaggacctagggggaatcttcatgaagacgccagagcaaggtgcccagacccagattcattgctcagtcgatgaaaaatgtgctgaccagagtggattatactacagtgaatgcaaacctgttgagccctcgaaaggtgctttgaacgacgatatggcagcgaagatgtggaatgtgagttggaaattggtcggattagacgagaattatgatccatt

SEQ ID NO: 568 - DNA, 1043 bp, Diabrotica virgifera
  misc_feature (977)..(977): n is a, c, g, or t
caaatagaagtggaaagtaaatgaaacgaagtcaacccaagttacatttacaagccgaagggatgaatgtccaacaataacactaaatgatacacaattaccagtcagcacacaagtcaaatatttgggactaacccttgacaaaagattaacatggaagccgcacattcaagccaagaaaacccagatcaacatcaaaatacgacaaatgagctggcttattggtcgaaaatcaaaactcaatattgaaaataaactgctcctctataaaactatgataaaaccaatttggacctatggtgttcaactccggggttgctcaaagccatcaaatatcaagataatacaaagagtccaatcaaaaatattgaggatgatattcaacgcaccctggtatgtaagcaataaaaccctacacgaggactcagctacacccttggtagaggaagaaattccaaggatcacaaagagctaccttgatggactgagaagtcatccaaatgatgaagcaagactgctgaacactcctcccgaattcgcaagacgactgaagaaactatggccaacagatttagtaaattaaatatacatattgtgatcaaatgtaaaaattataataggagggttgccacaagccagcttctccctcatgtatttaacattcaaactatttgcttatagcttcgatgaagcagattgtaaataaaaatatgtaataaaaaaaaagaaataaaagaagacttctagaatcaaatatatatatttgaaaatattcccaaatgctaatgcaaaaattagaaaagaagtaatatacatactcaccatagtaaaatatagtctacatgatgtaacgaacgaaaatggttacttttgatgatatgatcattatgaacacgtacttccaacacaaaagaatataccaaggaacatgaaagatgggaaaactgtaatcgaaaatcaataatgtcctcgtcgtnaaagacatggaagaatgtataaaaaaacatgacaacatagaggacccagatttgactaaatataaa

SEQ ID NO: 569 - DNA, 939 bp, Diabrotica virgifera
  misc_feature (819)..(819): n is a, c, g, or t
  misc_feature (874)..(874): n is a, c, g, or t
agaagatataacaatacaagtgacagaaattagaaaagctataaaagaactgaaaaacggtaggtctccaggaccaggggatatcccagccgaactaataaaatgtggatcacaaaaattgtttgaaaccgtcacttggtataatggttctcccgtacccgacgagtggaaaattgcttatatttcgtcgatccataagaaaggagataagcttaaatgtgaaaactacagagggatatcagtgactagtacattcagccgtttgtatggacgaataattagagaccgcattgagaaggagtacaaagaccaagaggaagaagaacaatccggttttcgaacaggaagaagctgtactgataatatcttctgcctcaaacaactaatagaaaaaaaattaagcacaaatcaagaaactcacctcatctttattgacttgcagaaggcgtacgatacagttcctgtaaacaaactctggaacgtgttacgacagacgaatattagtgtcaccttaataaaagccttaagaaatttgtatgaagggtcaacatcacaaataaaaactggaaacagattatcgcaaagcttcctggttaataaaggtctacgtcaggggtgttgtgtatcaccgaccttatttaaaatatatgttgcaaaagcattgaaagagtggaaacgaaaatgcagaggcatgggcgtagaccttggagagatttgcttatatacattgcagtttgctgatgaccaggttgttatagcaaacgataaagataatttagagtacatggcaaggaattacaagaagaatatagaaagtgnggactagaaattatacagaaaaacaaaatacctgggccatagtaccgaactatcngacatcacattagaaaataatgaaatcatcatgccctgcgacattacactatctaagaaatcgtt

SEQ ID NO: 570 - DNA, 1039 bp, Diabrotica virgifera
ctcgtcaagaaagagtgtgcgcgtcttcatccaaatttacattgcatgcatctttgcaaagaaaactccgatttgagttgtatgtgcattactacgtatgcatctttaccaggttatgtaccagatcaaatattcgaggccagcttggaagatagttttagatgtctttcgttaacccaaaatcaacaaaggaacaattcgatatctaaaaatcaacaattgggagtaccagtcacagcgagagaaattgttttgagaaaatgtggacaaacggagccaattcagttttctcaatgttttaccgacagtatccttcagaactgtcaaaaaattggagaaggggtttatggagaggttttcctcttaaggaatcccgatggaggaacatcagtgctgaaaattattccagtggagggcgaccagatcgttaatggcgaaagacagaaaaaatttgaggaagtgttatcagaaatcataatcacaatagaactgagtaatctcagacataacaagagaaatggaatatcttctttttactgaagttcagaaaatacagtgcgttcaaggaacgtatccagaaaaactgatagatctgtgggacctattcgacgaaaccagaggttctgagaacgattgcccagatatgtttaaggagatcagttgtacatcgtttttcagatggcctacaaaaagtggaatctttcgttttcaacaacgcaatgcaagcttactccatgttcacaggcattagctgatagctgagctctttgaacatcggtacgtgatatctactccaatgtatgaacagatatactgatagttaagtatttttatattattagtattaagtatttttaggggatgagcttaaaaataaaattttattctaatttaatttttcaggacaaattacgaatacaaattctcatattttagaatatgtcagtatttattattatatctcattatttttattcatgatataccttccactgatacagaccctcatgttattttaatatcgtacggatgaaagata

SEQ ID NO: 571 - DNA, 1159 bp, Diabrotica virgifera
aaaatgactgcgacaagcttattgtttgtcgtaaatttattagcgataatatttgttgaagtttcctcagagaatgttcaagtaactacaaatgaaggtacgatcttaggaacgacttcattatcagaaaaaaacaaaacgatgtacatgttccatggtgtaccatttgcagaacctcctaaaagattcgagctcgctgttccaaaatctaattggactggtgttttaaactgtacgtatgaaagggaccaatgtgtgcaaggaattggcatagtggaaggttctgaggactgcttatatttaaacatagctagtccaaaactaaatggaagagctcccgttcttgtgtggatccatgggggtactttcaatgctggaaatggatctttaataacatattcacctgaattatttttagaagaaggcctagtggttgtaggtattcagtaccgattaggcgtcttcggatttttaagtacgggagatctgacctgcccaggaaactggggactaaaagaccaaactcttgctttgcaatgggttcaacggaatatagcacattttggaggggatcccaaacgagttacaatttggggagcaagtgcaggttcagcgtctgtttctttgcatttaaattctccaagatctaaaggactatttagtggggctattatgaacagtggcgtttctttgtgtttatgggcattatcgagaacgggtaatgaattggctcacaacactggaaccgcattgggtgtaggatccgcaaactcgagccagttaatagaaaatctaaaaaaagttgattatgctagtctacaaaatgcttcagctattttatctgtaacgacgttcaacattttcccattgattggtatcgccctaggacccagtatagaagttcacatccgacagctttcttgacggtaaaagtgataatgccttattatcaggaaagttccctccaggtccaataataagcgggaaattatttaaaaggaaattggggattatgggccccggcataattttccgggttctatccaaaatttacaaaaaaaaaccaagaaaaaaaacaacttgacgaaattatatttcaaacaaaaaatttgaggcgaaggggggatttgaaaaaataaaaaaaaaaatttttttgaaa

SEQ ID NO: 572 - DNA, 343 bp, Diabrotica virgifera
cggacgcgtgggcgaacgcgtgggcggacgcgtgggcaaacatgaaaactgcactagttttggcacttttgagctgcgttgctctcaccgtttacgctcaacatgagcctacacttgggcctggtcctcgccctgaacctacccgtggaccgattcctgatgaacttaggtgcgacacttgcgtaactttggcagatataattaagggctacgctgatgagcgtattccactggatgaagttagacatgaagcagagaaattgtgccgtgatttgcccgaacaattgagagaagcttgcgaaagagaattgctaccaaatcttgacaaagtctacgaggagct

SEQ ID NO: 573 - DNA, 1097 bp, Diabrotica virgifera
cacagtaacatcaaccaacttcaatctgatagaagacaagcgattccagtacgtccttgctgctgcaactagcatagctactaaacaaaacgaagacacgctaacgtatttaaatcagggacagagttatgaaattaaattgaagaagcttggggatttgtcttactacaggggaaaaattctgaagactttcattcgtgtatgtttccatgagagacgtcttcaatacatggaaaaggagcagatattatcatggcagagttcccgcccaggtgacagaatactcgaagtagatgtgccgctttcttatggggcttatgatctgacccaaccaactaatgctctgaatatgattcattttaactgggatcctactaaagaagtcggcgtatatattaaggttaactgcatcagcacagaattcacagccaagaaacatggtggagaaaaaggtgttccgttccgcatccaggttgaaacgtttcagaacagcgatcagaatacacataacgcgcagaagatactccatgcagcagcttgtcaagtgaaggtgttcaaactgaagggggccgatagaaaacacaagcaggatagagagaagattatgaaacgtcccctttccgagcgggagaagtaccagcctagttacgaatgtacagttttgaatgacttaccaaacgaagttattatgccatcaccacctctctcacctataagtaccgatgctaacagtatagatagtaaccctccagttcagaataataatttacttgtgtccaaggcagatacttcggcagatagtgggaaaattattcctaaaataatatctagtcctggattggacctataaggaagttgtacataccaacaatattatccagttgactcaatattcctccccggaagaaacccacgaagtgggtgtccctgaacagattcgaaaagtacttggacacatttgaaagatttttcagagacgatatggttcaggatgtccagagaagatcttattcaaattttgtgggcagggccgacgggcattcgcttgcccaaacggcaattccccctaaaaaaaatttccccccaaaaatggaaaa

SEQ ID NO: 574 - DNA, 761 bp, Diabrotica virgifera
gtacggtcgtaatctccgccccgacccacgcatacgaccacgcgcccgtgacatttgtattatgtcagaagtttaattactattttatcaaaaaattatattaaacaatattaaaaatgtctctaatattcaggttagctggtcaaagatgtggtagtcaatttttgaaaaataatagtggaataattacctgtgtacgacctgtaacattgaaagcctctaacgtctcaagtccaaaagaggaaggacacgatgaacgtaacatgaaattagggaggccccagtcgccccatttgaccatttatgctccccaactaactagtatgttgtctattactcacagagctacaggtatggcattgtccttttatgcaattgcctttggtcttacagctgctgtagcacccgaatcaatttcttcatatattgagactatcgaatgcgcaggcgtaggagcggcaaccatagctgcagcgaaatttgtattagctttccccatgacttaccacttctggaatggtattcgtcatctgttatgggatactggaaagttcctcactattggagaagtctatactactggatatataatgcttgctctatcaattgcttctgcagttgctctttgtatgatgtaatttatattagctgagaacttttttttgttatgaccggtattatattatattattttcgatgaaaactctgttattgtgttaatttttttcaaaatatacatatttgtaaaaaaaaaaaagcga

SEQ ID NO: 575 - DNA, 973 bp, Diabrotica virgifera
  misc_feature (841)..(841): n is a, c, g, or t
  misc_feature (870)..(870): n is a, c, g, or t
ccccattaactaattgtttcatcacaattacaagatgagtccacaaaaagtggctgtgttaactggtgggaataaaggcatcggatatgccactatcaaaggtctgtgtgaaagatttgacggcattgtttacttgacagctcgagatgtaacaagaggtaaatcagctgtggcaaagttagagaaagaaaacctgaaagcagtatttcatcagctagacatcgacagccaaactagtgtagatgaatttaggaattttattgaaaaagaacatgggggtttggatttactaattaataatgcagcaatttgcttttggtcagcagctccaaatcctacgtttgcgcaaagctcacaaactatagaaaccaattattttggaactgtcagagtttgtgaggctttgtttcctttattaagaaacaacgcaaaagtcgtaaacgtctccagttgtgaggggcatttattaaaaattccgtcagagaatctcagaagagaattttccagaaatgatttaacgataccggagctcaatcaattaattgggaagtttctcaaagctgttgaaatagaaaaacacagagaagacggctggggaggatcgacctacggtgtttcaaaagtggctgtatcggcactgactttcatccagcagagaatgtttgatgaagaacagccaaatcgtaatatttccatcaatgcagtgtatcctggatttgtgaagacggacatgacagaacatcatggttttttaactcccgagagggagcaaaaagttctttatttgccgcgttagacgccgatcttaagggaaatatatctggacagattgcagtttaantgaattgggtacagtaaaccaaatgccgnatccccccatactaacgccatagtatctataatgctaccagatgatccataaattgatgtttaactttaattaattaataaaagctatttgattatccttttc

SEQ ID NO: 576 - DNA, 939 bp, Diabrotica virgifera
  misc_feature (755)..(755): n is a, c, g, or t
  misc_feature (795)..(795): n is a, c, g, or t
gtaaaatgcgaaataattgtttgaagaatatgataaagacatgcagatgttaaaatcagtggatgacaaaatattatatacaaatattaaatataaaacagataaaaattaataatagttggtcatttttgttccccagttaaaatataaaaaagtttggtttttgtttacaaacagtcatattaatttctagttaaactccctctgtggctcaattttaagagcgcctacctttggatcgaatgaaccgatggtcgtgagttcgaatctcaccagggtagagaatttttcgtttattataaattaataaatgaaaatagtctctatccttgtgggatcggtacccaccggagggaccgcagacgttcggatacaattagcgtctctgcaaagacaatgacatcgactttgcaaagtaacaagacacttactcaacacacacactacacataacactatctacctaattggtaaaatccactgtaccatcaccatgccaatgcccattagttgtcgaggcattagctaaataaaaaaaatttctagttagtcagctgttatttttattataaaaagtcctaaattatatacaaatatattaataaagttttatagtatattttagtttttgataagtagattttagtaagctaaattacagtagattttctaaataaaatgtggcaacgctgtgttagtggcagttggcagttttgttttgtgcatttgataaacttcataaactgaaatggcgnatatggatttttcaaaaaagaaaacacgatattgcagctngtgtattgattcatataaaaatactgaatataacagtactggatgcatttattatattcggaaacattgcgtacatgtcctgcatcaactaaatcctttctttttatggtggttgctgatttgaaatgggatatcatggggaaa

SEQ ID NO: 577 - DNA, 1178 bp, Diabrotica virgifera
attattccagggtcctggggccagggcccgccaccgccacctcctccataacctcctgctccgccttgattccaatctccacctccacggttccagtttccacctccgccacctattatatgacgcaagttgtcttggttgaagtttccacctctgccaccacccattgaacctcctcctctatttccagaacgatccatctctgatttgctcaaggcctttttaacatcgacattcctacctttgattgtgtggcttctttgtaagataactttatcaacagaatcataatcttcaaattcaacaaatccaaatcccctcttttttccagaatctttgtcgcaaacaacactgacggacataatgttaccaaacttcgtgaaatactcttttaggtcttcttcttcaatatcatctttcattccaccgacaaacaatttttttaccgttgctccagcgtcaggtctaccaatatcttgtcttggtatagctctcttaggttcaactactctaccgtcaactctgtgaggcctggcattttgagcatcatccaccatttgggcctttgaatacgtaataaagccaaatcctcttgatcttttggttgtaggatccttcattaccacaacgtccacaattgtaccccatttttcaaaatgttcctttagagattcgtcagtagtgcggaaatcaagtccaccaataaatagtttcctgaattgctcaggttcttggtttttactatcatcccccttcattttgaacctttacacaccaccagctcaaggcgtaatttaaaatagagataatgtaataatactaattattattacttaactttaaataaaataacactaaaattcaataatttcttaatggctggtggtagagtagacattaagatgaaaatttttcatattctacaagatgttattatttattattatatataattatatttattttttataaaatttttattaaaatataaaattaaattattgaaaattagaaatgatgataatattagaattaaaaaagagtatatttactacccccatatagggataataatgaaatacatgaacatttatttcacctgtttattaaaaatatgtgtttttgcagtatatataaaatctcgtctgcccagtaattaattggaatgaccccgctat

SEQ ID NO: 578 - DNA, 1497 bp, Diabrotica virgifera
  misc_feature (678)..(679): n is a, c, g, or t
tacaattaaaaaaaaaagtaatttttatacatttttgacttcatattatattacgtatttttcggctcatattacccgtacgcgcgccaatgttgaatattaaattcttaactgtagttaaaaaatgtgctataactacctcttaaaacccaccaaatttcatttgcatatctcaaccggttttaaagcaataaataaatcgtcagtttgtcataaaaacttcaacaccccctatctcggaaacgaagcatttgcggaaatacgtttataaagcaaactgactttattttgtcatgcaaaattattccttaaggtggtatgacacaatgttaaaatttatacagtttttaggtacagttaccgtcattatttcaaaaccaatcttcaacttaggggtatgtacgtgaactgtagactttctattttaatagtatctagttaaaatttccaaagaacgtagtatattttttataactgtacttaaaggagtgcctgtcataacttacttagtaacttgttgtaaaaattcgttttgcataataatttttgaacttcggtagaaaataactatcagaaacgattaactgtttctagatctttaggaatttcaaaattgcactagcaagaaagagatattatttaacctccattatcacacttttttacaacatatgaatnngatgacgacataaatttttacatcttacattacacaaaactaacagaactacgcaattttgaagtctgtagactttttaatgatgcagacattgtcaaaactatcaaaacgaatcatcatgcgaatgatagaagtgatgtagaggaagatattgagagatataattataaaattcttaattttatgtcaaaaaatccgcaaacgaaacatttgcggacatatgtttataaagctaactgtcattattttttcatgcagaattaccccttaaagtttgtcgcacttatttagaaacacagtgtattgatgaagaacatgtctagttgttaaagtacctaacttttttattatccaacataaacgaatgagtcaaaaaacagaatgttaagaaaagctgaggctatagttcggttttaatttcagtattttataaatgctagaatattccacaggttgatgcgaactttgagaaaaaaacacagtttgattggtacacctggtatacaatgaaaatttacctgtttagtaacaatattattgcagtgatgttaaagaatcaggctataacatgttcaaaaaatcacttaaatcggccaacaggtttaggaaatatgagacatcaaaaatgaccatacacctatgcacgtaagtttatgtagtctattatatctgagttaattcttattcttctcttgatctctgttatttattctatctcttaatgttactctgcaacttctccttaggaattccatctctagttttaaatacaaaaatatcacaatttatttatggttctgtgtagtttatgtattaat

SEQ ID NO: 579 - DNA, 1556 bp, Diabrotica virgifera
aaaaatcatgtcaggctttgtttgatgctataaaaataatttacacattttcataacatatttattattaaaaatgataatttaacatattcatagtcaataatctgaataattgttcttgtggatgtctgacctaccgatccaagttttttcacaatgttgagtgttattctagagctacttgttccaaagtttaaatataaaataattccatgggtacaattttaaaatagggttatttttgtaaaatgctatgaaggcagtaaaactagttgtctttttttgtcccaaatgaagattattactggcaccgaaactattatttcaacaaatatacatgaggtgtaaaacccgtcagtaattcgtggaattaattagtgcaattattggtatattataaaattatgaaaatacccaaagggattacaaaatttttcaaaacgttttctcatttttagctacaaggaaacataggcatatgtaccgttatgttcaacattatttaccggttatgtcggtagacctaactagatcctataacctaagtagatccgttcataaccactatacttatctcggttttacattggacaccaaattaacatgggattaccatgggatgatcttctacaaacagtcgtcttaaaaaactagaccgcattaaggacaaggttctgtgattagttctggtcatattacccggtcttattacccgtatgcacgcctatggtcaatataaaatgtttaattgtgtgtcaaaaaaatgcgcaataactacctctcaaaacctaccaaatttcatttgcatatctcaaccagttttagagcaataaataaatcgtcagtttgtaataaaaaattcaacatcccgtatctcgaaaacgaagcatttgtggacatatatttataaggcaagcggtcattatttttttcatgcagaattaccccttaaagtttgtcgcacttatttagaaacaccctgtattgattaataacatggcaagttgttaaagcacctaacttttttatgatcccacataagcgaatgaatccaaaagcaaaatgttaagaaagcctaaggctacagttaagttttaatttcaatatcttatatacgctagaatattccacagggtgttccaaactttgaggaaaaaaacacactatcattgtgacatccggtatacaatgacacttaccttacttcttgaagaataaaggtataatatactgaaaaaatcactaaaatcggacaacaggtttaggaaatacgagacatcaaaaatgtctcatttttaatgtgatgcgttaattttgaagcttagtgtataatatgaatgtaaaagctctgaaatttaatattctaggaacacaaagcgaaacttacagacaaggaataagttggaatatatgtacagtggaacctcgataagtcggattaatcgggaccgcggccgatccgggttatcgaaaatccaggttagccggagaatatggtaagaattaataaaatacaatacacttcgagataaactccattataattgcaaaaacag

SEQ ID NO: 580 - DNA, 985 bp, Diabrotica virgifera
agaaaaaaaaaccctttgaaaagatttttttcaacccatgtttataacaaatttttgtgaataaccaagaaaaattcgggcccaaataaaaaattttttaatttaccaattgataagattgagcaaatatttcaaaaccatttccgttttttttttggaaaataagccacaatttttttaaaaaataaattattaacgtttcgaagcccaaatcgggtttcgtttccaaaatcaaaaatactattaaattcaaaacaagcctcgaaatttcggtgcaaggacaggaagaaatgaaaaagagtcacaacagcagcaaagacatacaggaaactatacatgacacaaaggaataatccacctcacctaagcataggattttgaacaccatggcattagatataatccctagggattgtaactctaaagtcgcccttacaagtacttgaattcgagttactctactcagagtgcatgtcagaagtataaacgccttctcagggcctcttgttacttggatacgagcatggatggaagttgaacacaaaccaagtagcaatacaagagcacatgtaatttacaaataaaaaaaaaagtggaactaagataatttatttaattaatataattttagtaattatattaaacttaatttcaaaaaaaacattttatgatcgagaaaagaatagaccatttgaatgtggatttgatccaaaaacatttgctcgtttaccattttcattacattttttttttaattgctattatttttttaatttttgatgtagaaattacattacttttaccatttattataattttaaaaattagaaatattataaactatagaattattattattttttttattataattttattattaggagtttatcatgaatgaaatcaaggagctttaaattgaagagattaaaaaaaaaaaaaaaaaaataaaaaaaaaaaaaaaaaaaaaaaacccacgcgtccg

SEQ ID NO: 581 - DNA, 2162 bp, Diabrotica virgifera
ataagaataccaaaaatctactaaaaaatattgcctactagaattttttaaaaaatatcaaaaatctaccaaaaaagtagaaatctactaaatgtggcaacgctgcactaacagcgctggagaaaaccgtcaaatcccctctcctctacccatggcgcgccatttaaatttatcagataaatgcacaaaactgccactaacagcgctggcgaaagctgtcaaatcccctctacccatcggctcatggccatattggctgtgagtttcgacggtagcgcaatctcgcggtttgaaacttatacttttctgataaaatttatgtatgtgaaatatacaaaacgagaaaaatagatacttatctagaaagacacaaattatgaactgaaatattattgtaacctgattactaaatgaatacacagaattaatagtaaaattaattatgtttttttattttattcattataattttaatatttaatatataagttcgtgcgactggatgactgattacgcaggagaccattgagaaaaagaataagtttaaattaattatttaacattttaaatgttacctctggttatttttgtgtgcttactgatttgcttattaaaatttgtaatttgtatgaattgtaatttgtttgaattctatcaaaatggatattaaacatattggacggacgcgtgggcggacgcgtgggagaacagggtagcatcaaaatgttatccaaattgttaatatttgtatttgctgctgtttttgtcagtgctgaaatcaatagaattccactgaagaagtttgaaaagccgagggatgcacttaacagaaatggactaaaggaaggattattagccaaatacaatagaaatgtcaatgacgatagcgccgtcgttttaactaactatttagatgctcaatattatggagaaattggtattggaactcctgctcaaacctttaatgtaattttcgacactggttcatcgaatctctggattccgtctagtaaatgtggatttttggaagttgcttgcttacttcataacaaatacgatgccgataaatcttctacctatgtgaaaaacgacaccagattcgcaattgcatatggttcaggggaagttgcaggacttatttcccaagatgttgttgattttgggggtttacaagctaaggatcaattatttgctgaagctacccaggaacccggtttagctttccttgtgggaaaattcgatggaattttaggaatgggataccctgaaatttccgttaacggaattactccagtatttaattcactggttgaacaaggcgctgtgcaagaaccagtcttctccttttacttgaacagagaccctgatggagaagttggtggtgaattgttgcttggtggatcagacccaaactattacaaaggtgactttacttatgtagatgtttcagctaaaggctattggcaagttgttatggacagtcttaacgttggatcttccttaaaactatgttcaaatggatgtcaaattatcgtagacactggtaccagtttgatcgctggacctagcgctgaagtcgaaaagttacataaagaaataggcgctttttcattccttaatggtgaatatataattgattgcagcaaaattgatcaactacccgaaattagttttgtttttggaggaaaagaattcacactttccggaaatgattatgttttaaagcaatctaacggcggtattgacatatgtatttctggattcatgggattagacctcaacactagaactcatgtggaatggatcctaggagatgtattcattggaaagttctacaccgaatttgactttggtaataatcgtgtaggattagcggaagcagtttaaatatacataataaataagtcatagaatgctctaaaaaaaaaaaaaaagggcggccgcagatttaaattatttaaatttagcaatgatgataatattagtattaaaaaatggtatatttaataaaaatatataggcttaataaaggaattcggcaacatttttttcacctgtttattaagaacatgtctttttgtattaaatattacgtctcgcctgcccactgattaatttgtatgaccgcgcgatatagaccgtgctaaggtagcataaccatt

SEQ ID NO: 582 - DNA, 1233 bp, Diabrotica virgifera
acagaacattggttatctaatttttagttcgcttaaaaataggtttaacatgtattaaaaaatattaaaataattgacaaatatattgccatggagcatttattaagaggtcaatttggtcgaatcataataagtacatattcccatacacctttaaagtatggtcctcaaaaatcttgtcaaagaggaatgtgtatattgtggagtggaagaactcttgatagatctagacctttcctaaaacaacaatatatttatcaaagaagagaatatggtatgcttatagcacgagcccttagaggagtattaaaaataagatatttgttgcttggtggagctgtagcaggtggaggagcattgcaaaagaagtataatgattggaaagatggattgccagatatgaaatggctagatgaagttctgcccgacaatgaaaaatttcaacagtggagagccaatttagttgattttaaagataatattaaaaataatattgaacttgatcctagaataaaagcacttactgaaaataaatacaatgagtttaagtcatggtttgatcaaagactggatgatgccattgctgcagcagaagcgcaagaatctgcacaacctaataaagaagaaggcaaaaaggaaatcattcaaaaaactatggtttatgcagctaatccattttctgctgatgagaaagctagaaaagagactcaagagaggttaaataatatacaagatgaaatgatgcaaactcaaattaagtaccaaagagaattagaaaggttagaaaaagaaaataaagaattgagaaaacaaaacttattattgaaacaaggaaagaagccacttactagaaaaattaaacgcagccttattgatatgtacagtgaagtactagacgaacttgctgattttgacagtggatacaatactcaagatcagttaccccgtgttgtggttgttggagatcaaagcagcggaaagacttcagttttagaaatgattgcgcaagctagaatcttccccaggggagcaggtgaaatgatgaccagagctccagtaaaggttacattgtccgaaggaccataccacatagcacaattcagggattctaccagagaatttgatctcacaaaagagtctgacttatcggatttgcgtcgggaagtagaactaagaatgagaaatagtggttaaggtggaaagactggttcatccgaaagtatctccatgaca

SEQ ID NO: 583 - DNA, 1215 bp, Diabrotica virgifera
ggccgcccttttttgtgggtttttgcttattgcagtattttatttaccacctcttatactaatacataaaaaagatatttgcaatatcataaaaataggtatcgtttcaatttttttactttcaccaaatccaaccattgaatagtatatccggaagtgtttgactgtcaaaagatttgaaaatgattggacgagattcaaatcagcatatttatacctatttttagaatgacattagtcgctaataataaaaaaacaattctataataaacacagaactatttaccacagtttatgaatcaatataaatattttgaaataaattagttaataaactttggcattcttttgtatgtccaaagtttatatatattttttgtatgctagtttttaaatgtccttgttctgtgcttactctacaacacacacaagtatcatactatgtgactatctgaactttaaattgcatatcaagaatttgataaaaattcatagaattttaaaatgaattttacgttgtcacactgtgttctttgtgtgccaaatacaaacctaaatttatgataatcattttcgttacatataaatagaaatgttttcactaaattataagtcaggaattatgtaatcttggcaacttggccgttgcatacatacaagcctttaatggcgcatatcttcttggaggtgatggtcctcttaatccaggtctcctatcatcgaatgagtctctgctaaaatcctcatacatcctactactcctcaaacttcccggaaggtggcggcgacctcctgctaaacataccataatcacttgcgcttctcgaaaaaccgctgtctcttagactgcctcccataccgctggaaggccctctctctcacccgatggacggcattgggaaggcagaggatctctgcgtgggggggaaggggaggggggcatgaaagcccccccggcctgcagcgccccgcatgcccccgtcgcggctaaaacggatttccggaaaaaacgagcttccgaacatggcaccaaaaaacttttcaaaggaaggggaaaaaaaaaccattcgaaaccctcccccaaatccccccccttctgggggggcgggccgggaaaagggggggggggggggggggggggggggggggggggctccttccggaacaacagcgctcctgcgaagaattcttttttgcctcccacattcacttctt

SEQ ID NO: 584 - DNA, 696 bp, Diabrotica virgifera
cgagagggcatatggtaaagtagaaccgccagtcgtagagtcggcctgggagaggggacttcgcacagccaaagaaatgctccgaaaatcagttaagaggaaggaacaggatatagattttgaagaaaagaaaatgaatttgagtttagtacaagaagaatttgataaagaaaatggttattatggaagggcttcaccagaaccaaggtatgtgcgccatgttgagtatccggcacgaccacctccagaagagtattatggccgcagacaagttgtctacgaacaacaagattatatgccgccacctcgtgagagagctcgaccttatcgcgaacttccaccgcatcgtatgcctgattattatagcaataagtacaatgaggaggaagcgcctccacattccagcggaagtaccggtaaaagaagcaacaagccaaagcgagaagtgattgttcaaagggttgaaagcgagcgcccatcctcaggaagaggggatgaatggcaagatccttggatgagatccaaggatcaaggcagaaggaaagaagcaccaggccgtaagaggtcgtatagtacaggatcgtcgtattcatctagcagttcttctagttcctcggattcgagcagaagttcctatgcgtcacgaagaagggctcggggacgtagatcaagatcgcgcaagggaaagcccgtttc

SEQ ID NO: 585 - DNA, 848 bp, Diabrotica virgifera
cgtccgattaattatagaattctttctaaattcctattatttgacacacctcgtataaaattaacaaacttggataacttatggttgcatcttgaggtttggaccatgcacagatttttatgaagaataactttttttcataaaattattaataaaagagttattacatgtctaataaataaaaatgatgttcggaatcggtaatttaggaaaatttcagaatttttttttcaagtagaaggctgttatttcatatttgaatatggtttttaaatataaataacttttcataataaaattttttgatattttgaaatataaaggtatgtagtttgctcttgagtgaaattcatattttttgacatacctcgtatactgttgacagggtttgatatctgatggttgcatcttaggttttggactgtgcagagcactttgtggagaatgactttttttcgtgaaattgatgttaaaaaaagtttcccatattatggttccgagttacgcagacaccctgtatatctaactagcgacgtcatccatctgggcgtgatggcgtaatcgatgatttttttaaatgaaataggggtcgcgtactagctcatttgaaagattgtccaattgtctattcagtgaaataaacattaacgtaattgtttgtgcagtgtgtctaaaacattttttttaattaaattaagtgacacaaaaggcagaagactgtaatttatttgaatcaaaaatatttcactgctgtcagaaacagaaacaagcttgaacattgaatttaagtgaaaacaatgtttatttatgaaataaacattttttctgttttctgacagcaataaaat

SEQ ID NO: 586 - DNA, 1591 bp, Diabrotica virgifera
gtgcaacaatttgcagcatccaacttggggagcatctctaactgaattcaggcgtgttttaagaccaatttacgaagacggtcttcaaaaaccagttggttggattaaggataagaaatatcatggatatacgaagccaagttctagattagtttccacaactttgattactaccaccaagattactcctgatcctgaaataactcatatggttatgcaatggggtcaattcctggatcacgatttggaccatgctttaccgtctgtaacgtctgaaagttgggatggaatcgattgtaagaaatcgtgtgattatagggcgccctgttatcccatggacgtaccacaaaacgacccgagagtgacaaaccgacgatgcatagattttatccgaacctcatccatatgcggatctggaatgacttccgtctttttcgattccatacaacctagagaacagatcaaccagttaacctcttacattgacgcttcacaagtatacggattttcagaagagttggctagtaatttaagagaccacaacactaactggggacgattgagggaaggacccatctttccaggcaaaaaggcgttgttaccatacgccgaaaatcaaggaattgattgcagacgcaatctcacagaaagcactttaaactgcttcgtagctggagatataagagccaacgagcaagtagggcttctagcaatgcacaccatctggctgcgagagcataacaggatagccaaagaacttaaaattatgaacccccactgggatacagatcagctctaccacgaggctcgtaagatagtaggagcttccatgcaacacgttacttacaaacagtggttgcctattatcataggaaaaaagggaatggagaagctgggcgagtaccaaggttacaatcccaatattaacccttctatttctaatgtgttcgctaccgccgctttacgttttggccacactctgataaatccggttttgcacagattgaacagcgattttaaaccgatcagggaaggaaatttgccgctttccaaggcgtttttctcgccttggaggctcgttgaagagggaggaatcgatcctttacttcgaggtttcttcactgtcgccgcgaaaataaaaaaatcagacgaaaatctaaactcagaactgacggagacactcttccaagcagcccatgccgttgctcttgatctggctgcaatgaatgtacatagaggaagggatcatgctctacctgagtaccttgagtacaggaagttctgtaatatgacacccgtaaacagcttcgacgatctaagatatgacattagtgatgcgaatgttaggagaaaactgcaacagctgtatggtcatcctggaaacatcgacgtgtttgttggaggaattttggaagatcagattgatggaggaaaagtaggtccacttttccaatgcatcttgatcgagcaattcaaacgtctcagagacggcgaccgtttttactacgaaaatccatcagttttcaaaccagaccagttagctcaaatcaagcaatttaatcttgcccgagccatttgtgacaacggtgat

SEQ ID NO: 587 - DNA, 1728 bp, Diabrotica virgifera
  misc_feature (1521)..(1521): n is a, c, g, or t
  misc_feature (1558)..(1558): n is a, c, g, or t
  misc_feature (1596)..(1596): n is a, c, g, or t
  misc_feature (1609)..(1609): n is a, c, g, or t
  misc_feature (1622)..(1623): n is a, c, g, or t
  misc_feature (1650)..(1650): n is a, c, g, or t
  misc_feature (1686)..(1687): n is a, c, g, or t
aactttcttaaaaatggaacctgccaaagttaagaacaagattggtgacatttttaataatatggcttatggacctaactttgaagatacaaaacttgcaattgaatggttaaagactaaaaaatcttcctttttcgcatatataaaaaaaccaacagaggaattgaatgggacaccattacctttattaagtacaattaatcaagaacaactttgtacaataaatgtgccagatattgatactgttaaaaaaattttggaacaagaagaaaaatcatggaaaggggtaaatccattggagaaaataaaaataatcaacaaaattggattagggattgaaaaaaaggccgaactttttgcccagttggagatattaactagaggaattctatcaaaacataccaaaagtaaagctgtaaccctgttagctcaatactttcaatattattcagcatttgcacttcgctgtgaagcagaatgtaaagagcgtggtattgcagttggagtcatatcaaatgaaaattatttagctcatttaggtctattcgtcgcccctgctttggctgctggacataatgttgttttacaaattggatctctattagcacctgctgcttttttgcttcaagagattgcattatcagttggcctaccagagggtactttgaaaatcattccgtccgacgatggagaacttgtaccatatttcaccatggataatgttaaagttatttcattatttgtggatttaaataatgataaatatcgtggatgtcataatcataacaaacatctaattgtcttatcaacatataagacacccgctgtaatttttgatagtgctgatttagatgcagcatctgagggtataatagattcatcgtggagttaccagagtatgttgccatggtcaacgaatactatcttagtacaagaaaatatttttccaacatttctagccaaactaaaatcaaaacttaaaacattagaagtatctactgcagataacaagtcagcacgtatatctatcaatttaaataatacgtcacagttgaatgacttgaataatagtataaaacaagcaagacttcaaggaattgaagtttttcaatccacagataagtctgacgtctggaatccaactgtctttgtaggaggcaaaattaaccataatgctctgggttctaaagacggccaatctaatgttatcactgtcgtggcatttaggtctattgacgaggccgttagtttagcgaataattccaaccaaggattatgggcttcagtttggtctgataatgcaaacctcattaatgaagtaacaagaaaactaaaggttagcaatatatctgtaaatggtagctatgaactttcaccagaagttgttatatctcctactaaggacagcggaatgggattcttcggaggaagagaaggtttcatggagtatttatcaggaccaattgtgccgacatgttgtactaaattagaacgtagcgactcagttgctaatgttgattncattgttaatactgctaaaaaagcacaagagagtggncaaaagataccaactattcagaaacaaaaaatactacnagattttgctganaatgtatctacgnntaaaagtagcgaatggggtaatgattnactgaaatgcgtttataaaatcatccataattcatnncagcacaatgtcacatctactatttgtggatataacttaac

SEQ ID NO: 588 - DNA, 937 bp, Diabrotica virgifera
accgtacaatagtatatagtagtgtgtttagtttagagtttacctattttttgcaatggtgtctagttcaatggctttctttggaaattccttattattcatgtgttttatggtggctgttaaatctcaaggattttggggtaatgctaatcaaggttgtcggactccaactggtgaaactggtgactgtatacccgctaggcaatgtagagcgttgataactgtcctacaaactgtaaaaagaccattgactccaagcgttactaaacaattaaacgcatattactgcagctttgcgtataacatggccaatgtttgctgtccacaagggcctataatactccaagatgattcgagtcaagaagtgcaacaagacccgccagatgtatcgaatcatagaaacttacgtttgctaccgcctgactgtggctacctagacatacctaataagattagaaatggacaaaatgctgaaataaacgaattcccttggatgactttactaagatatagaacaagtacaggcgcagagtttagatgtggtggaactattatcaataataaatatatacttacagccgctcattgcataacacgtttaaaagatccattgttggatgtaagagtgggagaatataataccagtagtgtaatagattgtgttatggatcaaaatggaatagcaaaatgtattaatgatcctattcaaaatttggcgatagaagaaattattccccatcctgagtttaatcctaacgtaattgcaaacgatattggacttttgagggtgtcgaggatgaatataaatgcagaaaacgctagacccagtttgtttgcctcttggtgagcatcgattggatgaatttcgcaagagtacagttactggatggggatatacagactcttatgcagaagtaaaaactgatgtcccttcaaa

SEQ ID NO: 589 - DNA, 1123 bp, Diabrotica virgifera
aaacaatctgatttgtgaacaatgttttatttgattgctaacaaatttaagtttactgcaaatgaattgaggattaaaccgatgtgtttttcttaattttctcacatgttttgtacctacatgtttcgttgcaagtggcaaacttgcttttgctgtcttcattaatttgatatgacgttagaggatcctttttttgtcgttaaagacgaggttttcaaagccttaaacaaaacacgaggtttgtttcttcgatggagtgagctacaagaagatggtatctgttgtacaaaggatgaagtcgaatggaccaacacagaattaaaaaactctttgagaagcatagagtgggatttagaagatttggaagacaccattgatatagtcgaaaaaaatccatccaaatttaaaatagacaataaagaattaaccaccaggaaacattttattgattcgactaaaaacgaagttaagtacatgaaagaaagcatcaacatgagcaggagtcgtagtaaagatcgttctgcacgtcagccactcttggagagcagtcctgtaagaattgccagtgctcgcgttacaactaaatactctaaacttgaaaatgattttgatagtccccaaagacaatttctaaatgatacacttagccaacaacaatatttaactagacaacaagatgaacatttggaagctattagtgattctttaggatctttaaaaaccgtttctaggcatattggaatcgaattagatgagcaggcgggaatgttggacgagctaggaacggacttagaaaatactgattctaaattagattctacgatacaaaaggttgccaaagtactacgtctttcaaatgatggaaggcaatggaccgtataaaaatattgggttggaattctgtaattgggaaacttttatttttatactgtgagttatgtagtgatacatggtaccttagcattgtaacatatttgttggtacaaatttagttggaagcaaaattacttattattttatttgcaaatgtaacccccttttgtaagggcaaattttaaaaatcaattaaaggttaaattttattttttaaaattttacctttttcccccaaaaagggagggtt

SEQ ID NO: 590 - DNA, 2418 bp, Diabrotica virgifera
ggttaagtacttatcggaccgcctgcctactagtttctgttgtggttgatagtttcactttaatttctttatctctgcggcgtaagatgcgcccaaaacattaagaatttaagtgttgctttaatgtttgagtttctcggttaaatattcacaattttttttctcttttcaacaaaattaaatctgaaagtacacaatgatcactgccaaaaaatatagaataactaagaagcaaatttcgcgatatgagaccgttcctgtaagaaaaatgctagatttcgtatatcttggtctatgaataacattaacataagtatttaataatagatatttcataaaaataaacatcccctgctagatttagagacttctcgcgaaattgcgaaagagaactaaaaccgaatcaaatgcaacactggcggttaaatttatactcttaacgaagttaaagaacaatcagcaactataatttataatctaatgcttactctaatctatataattttgaatatgattgttaagttgttgattttcattgttggttgctgttttcgccgttgacttgatttggccgagctttcgacgcattatgtggagtcatcagtactttcagtacttcaatttaaaaatttttatcttttgttcttcttatttttcatctaaatacaaatatatggtaaaagtaagttatatagatataaagcgctattgtttgagtaaaaatggcaactgtaggtaaaaatctgttaatgattttgaaattgtaattgcattagccgccagatgtcgccatcggtgacagttctcccgactttcgccgaaacggaggcattgcggcctattaccggcactaaataagtagagatgttatgatgtttataagttagttgcgaaccgttgcaactctcttccctcactgtttgctgcattaaaatagataaaatggcctggcgacgtacctggactcgcgaataaaggttcaccgacattgaaactgaataaaaagagagaaaactttgctggtttcttttttctacgatattaatcgatgtcttccgaaacggaggcattgcggcctattaccggcactaaataagtagagatgttatgatgtttataagtttttatgttttttaatttttttgctatgtatgttgtcgctccgagctataatacggttaggtacgtactgtaagcctattttgggcaacagcctgtggacataccaaacaaaagattgctcatgtactatatctctatcactgatatgtatttaattcgaatttatcgtgagtaatctctaaagaacaatactacgacaataaacgatggagtgattctattaaacaaaacaatactttcaggatgatccacgggctggcctacatatcgggacatacactttagatggcaaaaattagaataaatgggcggggggtaagaaattctgtgatattaaaaaatgatttcatgtctacattgaaagtgatacgaaggaaacgttagtaaagacgacgaaatcgactaatgcttttggaagtatactgcgggacactcacaatgcggactagatttaacttcgaaacacgtcgcattccgtcaagtcacatgatctactttgtccgtccccgattttgaaataacacgaaacaacagtgaccgattttcattagtgtgtttggcgacgtgaccctctagtgattgaaatataaactacgttgtgaaaagtgacaatgacagttacatcacttgtcaaaagtgactgacaatggacatttatgtcacttgtcagaagtaattgacaattcaacaaaattcaggcgaaagtttacagtaatattactttatagtccaaataattaaaatatttttgcgtttgcttgatttgagtctgctcggtatggtaaacaaaggcattagaagctgttacaacaataatgggcaacatttttcttttattataactgtctataaaaatgtttattatttacttgttgtggaactgtagtttcctggaatcagtcggagtatgatattatattttgaaaggttggcaacgttatggaaacgtatccaacatcgatgttgccaaatttccaatgtgatctgggattgccgcgcaatctgcacattcttgtcgagtttttgtactaaggggaaacgaaaaaaaaaaaaaaaaaaaacgaaactaaagtgtctggaccgtatctccatatatgcatacttgtcgcatatcattgtgttatcaatatattttatatttatattttttgaacttttatatatttttatttgtgtcataacttctctgcccccttttttcgaaaaaaaacaggcagtgtgatcgtgccttccttacaatttcattttttatacgatcgtactaaaattggtgctactatagtatgcggtctacct

SEQ ID NO: 591 - DNA, 1605 bp, Diabrotica virgifera
gacttaaacaatgtagtagacacaattctacgacacatgacatcgtatgatcttagtaaaatgtaaaatcatctctacagacatgtcgccggttgtatttatattcgtaattaaaggataagtgtatgaagagaagaatagaatggctagaagtgtggagataagttctgaaaaggagtacagtgaaaaagatagttttactactgaaagggcgagagtgtggccacaagttctagcgtgtcttatagccagtttgggagcattcacacaaggtatcctcttctcatggacatctccgtttatagtaaaaatagcccaggataaagtaaactataacatatcagaagaagaagctgcccgtttaccaaccatccaacctcttacggtgctgctaacctccttgatattcttcaagctccccgacatcatcggaagaaagaagacactgcttcttatcagcattccgcatatactatcttttataactgcagctgtagctagaagcatatatgtgttttatttgtcaagggttttttcaggtctagctaatggcttcttgtggacagcgttgccgatgtatatcggcgaagttacttgtcccaagatacgaggtctttgtgggacgttaataacaacagctatctttgtagggcaattagctgtgaatgtggtggggagctattgcgatgttgccacaacttcctatatttttatgccagtatcgatattgtttgtcattctgtttgcatttatgccagaaacaccgtattactatctgataaagaaagactatggagctgctagaagatctttaatatttctaacacgaaagaaaaatgtagtcgatgacttgaacaatctgaagagtgacgttgatcggcaaatgtcagagacaggaacatggaaagacctggtcgtaattgaaagcaacaggaacgcgttgttttgtgcagtttttctgagagtgtctcaatcctacagtggtatatcagtttttatccaatacactcaatacatcttcttaaaagctggaggaaatgtatctccccagatggcttctattatctacagtattctttgcgtcgttattactttattagtaacattattcgtagtttctaaattcgggaggaaacctctatactcaaattcctctgtcctatgctccataatacttgctgtaatggctgtgtatttttatttagaacaattcgtgccgacatttgacatatcgtctttgagctggctaccaattacatcactagttacctatcaggtttgttcctgtttcggtgtagctataatacctagtattatgctaggagagcttttctcagcaagcgttaagtccaaagctgtagcaacgatgacattcgttaatagtggtgggatattcctagcaaacgctacttttaactttttaagttcagtagggggaagttacgctccttttctatttttcgcaatctgtacagctgcaacagctgtagttacaagatttgtggttccagaaacaaaggataagactttggaagaaattcaaatgaatctcaaaaaatcggttgagaacgagagcgtataaattttgtataataaagtttttat

SEQ ID NO: 592 - DNA, 1075 bp, Diabrotica virgifera
ggtcgatacaagcctctacacagacgtccgcgactttcgtctgtatcagtttgttatcgtgtttcatcagttcgtgttaacagttcagtgaagatgaaggccgtagtcagtgcattgtgtaccgaaaacgggatttccgccatcagcggaaaaatcaccaaacgcaaggatatcgagaacgaggagattcagatgtacctctccaaactcaaggatctcgttccgttcatgcccaagaacaagaaactatcaaaattggaagttattcaatacgttattgactatatttgtgatttacaaagtgctctggaaacgcatcctgccgtcaatgcttttgatgcagctgctgccttaggacagaagaagtcacaagcagcagtcagccccaggcagcctctaggagtcaggccgagccccaacaccatcctggcaccttgcgaagctcctgttcttcaaaatgtcacgagttccgaagccttaacgccatcagataggctaagttcctgttaagaaacatattgatctccatcaccgtgatcattttcatctcattccatttccctggaagaagaaaaaccaatgaagatagaagcactgtttggatataaaatctttgaaaaagaatccggggagccgactgattatcatcttaatttatatacttcgggtgattgtaaacttttttgtgcgaatggaggatgttgacgatgttgtagctgcatatggtgttattgacgcacccagagaaatctacgatttgtggaggccccttaactggatgcgccagtgcatttgacgtacctgttatgttgcaatttgtttattagattttattttattgttttgtacataaaaaagagaataggcgggtttacaacaatttaaaagcagctttttaataagtaatcatattttttttatataatgttcgctagtttaacagtctcagattcatttttcatttgtttcatccccaagagcgtaacaaaaaaaattaactttttttatttcaaaaaattagtattgattttttttttcccaaacttttttttgtttttaaaaacaaaattttcct

SEQ ID NO: 593 - DNA, 344 bp, Diabrotica virgifera
caagaatccatctagagtattaagttcataaggaacggagtaacacattaagcaagatgacatgattagaggaattaactcaagcaatatgatgaaaaccccatatttttatcctcaatggcaacaatacaatacgtgccttgctgcccctactatcactgggaaaggcaccgcaagattgaacccaaagctaagcacttctcccatggcaagaaagatcaatctagtatgccaaactaaaccgataattcaaagagacttgcaaagatatcaaatcatgcatatacgaattcagagaagaaccaaataatattcatagataatcttgatcataaatccacaat

SEQ ID NO: 594 - DNA, 1543 bp, Diabrotica virgifera
  misc_feature (1490)..(1490): n is a, c, g, or t
gtcagcaccatgtagatacgtatagtgttaaaacaaacaacattttaagtgaaatatagaattgtattaatagtatttgtcaagatggtatacgtttttatgttgttattatgcgttttaagtgttgtttcggaaaaaattacgtttgtggatgttaaaatcacgctaagttctaagaagcaacaagatctaagtgagcaaatcgtaataacaacgaagaatcttccaagtagtatcaagaattataatatagacacctacgatgccatcaaaattgaacatcaagttcttcccattgtttacgaaaacgcttttcaatatttgaacacgtcgcacctagccatagtcgagactgatttgaaggaattcgagcctggtgcctttaacgatctaaagaaattggaaactttaacagtaggggccaacctcctgaagtctattaggaaagggatttttaataaccttccgattacgaagttgtatttggatgacaataaaataaaggttattgaaggtggttcttttgatggcatgcaacgattaacacatatagtactaagtatgaataaaataatagtattagaaaaaggtttatttaaagatttggccgaacttgtctccattagactggattttaataaaatagaacgaattgaagaattggcgttccaaaacttgccgaatttgcaccgtctggatttagacaataataaaataaaaatacttcaggcatcttcattagtaaatctccctacattgactgtgcttctccttcaagtgaacgaattggagagtatttctttgaaaaaccttgacagtttagtcgtgttgtggttatacgagaacaaattgaagacgttggatatgcatatgttgaacgatttaaagagtgttaaaaaaattaacgccacgaacaatgagatcggagttttgaattgcaaatcttcaaccggttttaatgttcaattctttgatttctcttataacaaaattaaaaatatcagcgaggactgcttcaatggatccaaaattgaacatttaaaactaagcaacaacaaaatacaaaacattcctgcagagtcattccgttcagctaatatcaaagaactccatcttcaaaacaacctgataaccgaaatcaaaaaggggacatttgcaaacctccacatgagccaactgcttctcgaaaataaccagatagttgacattgaagcgggggctttcgagaattcgacgtttcaatccataaacctggacgggaataaactcagatcaatcagacacggcgtattcgataacaccaaagtggcgttcatttcgatattgagaaatgacgggattaacgaaagagcattcaacaacgtgtcgaacctttgggattccaaaagtggcacgaacaaattagagtttcgaaggactaccgataaagtattcgcggatgagccgttttgaacaaaaccgcatttgtatagcaatacatcttttgttgnaaattgttgttttctgtttgtgttctattgtaaatataagcttaagtaagatg

SEQ ID NO: 595 - DNA, 848 bp, Diabrotica virgifera
gtttactcgtttcgaatcttctcaaaaacaagtgaaaaaatgtctgaaggtgacgtagttaatacttcagaagaagtccaagagaatcaagaagttgtagaagaatctatcgctccagtcaagagcgtaaaaaacgtcgaggctgcaccaccaaacctattcgacatcttcaaaccaaaagatgcagcaaacgcagacaaggatggagcaaaaccagaagacaagcccgcagatggtaccaaacccgcagatgaaaccaaacctgcagacggaaccacagaggctaagcccaacatcttcgatgtttttaagccaaagaccgacgcagtaactaaaccagaagagcccaagcctttgttccctgccaatgatccatttaactttaagaaaaatgcagaagaagcccaaaaggcgttcaaagagaagggacttggaggttggattgctacagtgcaaaaaaatgttcaggagaccctaaatgctctaataaaaggaggcgaaggaaaaaaattagtcgaagcaattatcgagtgggttaagaatttaataaaaaccgttcaggaaaaaggactgcctgcagtcacgaagcaagtagaagccaaactgaaagaaatcctagcccgggcaatcgtagaaaacaacaaatggccaatgaaagcacttacgcagaaataaaatatataagcattgtttttaaatattttttacttaataaatatattgttaatatcttacttaaacactatgtattttagacatatctacattttctatacagttaagcgtcctagtgcggactcgcatatgtaataaatagtactcctaatatattttgttcttgtgaatgt

SEQ ID NO: 596 - DNA, 1030 bp, Diabrotica virgifera
  misc_feature (954)..(955): n is a, c, g, or t
acggacgcgtggggtacttgatataattccttacaacagaaaattaattttcttgtcaaaatgtctgatttatttagtgtttcggaatttgagaaacatgctttggaagttttgcctaaaaatattcgagattactacagaagtggtgcaggacgacaggagacattggctgataacagaaaagcattcttcaggtataaagtaagaccaagatatttaagaaatgtagaaaatatagatttatctacagtagttcttggagagaagatttccatgccaattggaattgctccgtctggtatgcaaaaaatggctcatccaatgggcgaactggctgttgttaaagctgcccaagaaatgggtgtagtttacactcttagcaccatgtcaacatacagcattgaagaagttgctcaagctgctccaatggctgtgaaatggtttcaagtatatatttataaggacagagctttaactagaaatttaattttgagagcggagagagctggttttaaagcaatagtattaactgtggatgcaccgttattgggtttgcgttttcctgatttgaagaacaagttcacattacctccacatcttaagttggcgaatttcgaaggaaaaatttccgaaatgaatcagaatctcacaaaaggatcaggtcttcagaactacgtcaatgatttatttgatccgtccatcaactgggaagacattaaatggttgaagagtattacacatcttcccatagttttgaaaggaatattgactgcagaggatgcattactcgctgttgaagctggggtagctgctgttcaagtctccaaccatggatctaggcagttggatggaacacctgctgcgattgacgctctctgtgatgtagtaaaggcggtaggtgacaaaatagaagtttacgtcgacggcggagtgacagatgggcgttgatgttcnntcaagctgtgctcttggagccagatggctctggtaggacgatctgctttgtggggactgggtcatagtggacagc

SEQ ID NO: 597 - DNA, 1172 bp, Diabrotica virgifera
  misc_feature (1105)..(1106): n is a, c, g, or t
  misc_feature (1112)..(1112): n is a, c, g, or t
  misc_feature (1133)..(1133): n is a, c, g, or t
gcaaaatggtactgggtcgaaaaacaagaacaacttggacagtccaatttgcaccagtactggagttgtcttcaagtaccatcttggtagtattgcattcggatcttttataataacactaattgctatcatcagagctcttcttacttctttgaccaaaaacaaggcagtaaaagcaatagtcgatgcttgcattggagcacttgaagattttctcaagttcctgtcgaaaaatgcttacatattaatcgctatgcatggtaaacctttctacaaatctggtaaaagagccgctaaaattatcttccagaatgctgttaacattgtttctattaactttgttggagatttcgtattgggaatggcacaactgttgattgtgctaatttctttactgattagcgttggacttatgcgtggtgttaagagcgaatgggagtacgttgtttacttgattgtattcttcgtatcgctctgcgttgcgattacttgcttctcaatatttgagacgacgatcgacacgatcttcctctgcttctgtgaagacagcctcttgaatgacggcatggcccgtccatacgccatgtctcgtgacctaatggagttcgtggagaattccaagaagctgtacggcgagaagaaagactaaaactaaacttttaaacaaacccgtgacgcacaagtcatttataaaaagatataccaagctgttcgtagcaaatacacactatgtagtcagccatactacgttattataattatataatataaatgtgtaaattgctgttttatacaacactcgatattgtaggcagtaaggtatgttagttttgtttgtctttttaaaactattgaaatgctgatcttatttgaaacatttttcgaaatacatattacattcattagacgttttataagcacataaaatatgaatggatatgtttttgacgtgacaagacatcccgtaacgccacagttcgtaaccccacaaattcgtaacggcgacaattcgttactcttaattgtgattattctgttgatttttgttaacgtggaatctaacttttattagagttacaattattgatattacttggattaattnngtcagncagcatcagggataacatttnttacatatttcatatttcgtgagaaatatatttttttaa

SEQ ID NO: 598 - DNA, 975 bp, Diabrotica virgifera
  misc_feature (934)..(934): n is a, c, g, or t
caaattatcaacaaaacagacgccattttgctaaaattgaaatatccaacaaagtagaaagagattttaaataaatctaaaacatccaaacttttttttgggaacgtatcggaagtaatgtgtctgtgataaatagtaaaaaatattaaagcgatattttcgtcgaaactgatatgtattaaatttatcttttgtgttattaaagagagttaaacgtagctaaagaagaaaaactattagtgatttaaacatgagtacgaaagatgatgaatacgattatttatttaaagttgtccttattggtgattctggtgtaggaaaaagtaacttattgtcaagatttactagaaatgaattcaatttggagtctaaatctactataggtgtcgaattcgctaccagaagtatacaggtggatggtaaaactattaaagcacaaatatgggacacggcaggtcaagagagataccgagcaatcacggcggcctattatcgtggtgcagtcggtgctctactcgtctacgatatcgccaaacatctgacatacgaaaacgttgaacgttggttgcgcgaattgcgcgaccacgcagatcagaacattgtgatcatgttggtcggaaacaaatccgatctgaggcatttgcgcgccgtgctgacagaagaagctaaggctttcgccgaaagaaacggcctcagcttcatcgagacttcagccctagattcgaccaatgtcgataatgctttccaaaatatactcacagagatctatagaattgtttcccaaaaacagatcagagaccctccggaaggtgacgtaatccgaccacaaaacgtagaaccaatagatgtaaaaccaactatgaactctgatggcgtgcgcaaacagtgttgtcagtaatataaataatttagcataatatgcatgttacactanatatggattttcagcggtagtgcccgctttgtccactcact

SEQ ID NO: 599 - DNA, 1056 bp, Diabrotica virgifera
ccgtaatcagcagtacatcgacattgtcaacactggcgacgacgtatctgtgaccttgtcaacgaaaacaaaaccgctaaaaccagctgtcactccgaccgcgaaaatgagcccagccgatagagaatccgatgtgcaatttgaggaagatggatttggcatgttcaccgacagaacgactgggaaaagtgcctcagtgagaagatttacttggaaaaatgccaataatgttactgttcaggttattacttatggagccacgatcacgtcgataagattgccggggaagaacggggtagttgaggatattgttatggggtttgataacatggaaggttatttgaatcacctaaatccgtatttcggtgccactgtcggtcgtgttgcaaacagaaccggttacgccaaaataaccatcggagaaaatacctacaacgtttcggccaatttgggaaaacaccagctccatggaggattcataggattcgacaaagtcaactggaaccatcacgtccatggaaaaaaagtgatactcagttatttgtcggttgacaaagaagagggctttcctggagatgtgctgaccagtatttccttcgaattaaacaacgataatgaatttttggtggactttaaggctactagtagtaagcctagtgttattaacttaaccaaccattcatactttaacttggctggacatgataagggtgctgaggagctatacaaacatgttgtgtcgataaatgcagatcatactacagatgtggataaggactctattcctacaggcaaacaacgataatgaatttttgtgactttagctactagtagtaagcctactgttattaacttaaccaaccattcatactttaacttggctacatgataaggtgctgaggagctatacaaacattcgtaatgctactacagtgctctttcctacggtggtagacacggtattcgatttgagaattcccaaaggtctttggtgacgtcatccataaaataccgggctacgatgaatacgatcacaatttctgcatcaacaaagct

SEQ ID NO: 600 - DNA, 857 bp, Diabrotica virgifera
ctcatcacaatttataataatcacttaaaacatactacaaaatcatacttcctggaaccaagactgtaaaaaaagggaaactaaatttaatacaatttaatagtaaatttctctctaatgctaactcctggttttctaactaccagaactctatcctcatgactgtaagaagtatcgagttctacagtgccgagacttttgctggttaactttgcccccttaatgcccttgggagggcctaatatgacaagtctttctacccattctttggttggataatcagtcttatcaactaaaacactgttgaaagtgttatcttcgaaactaaagtgcagatacaaatatttctggtttttgtactcaaaactttcgttgtcatcgacataaaggtaaccactagcctttttgttagaatctagagcaatatatagggtaaaaggatcgtttttcatcaaaggagacgctctcctgggcctatccttccttggtataatactaccacctctgtaaaacgctaaactcttgtctaaagatactggaatgttatagtttccggttccttggtacaatctgaagtcttcaatatcataccaatattcgttagcgccacctggtaagtaaacgccgacactcgacgctccaggttctgcgatcattgcagcaaggactgaatctcctacaagaatttcgttgtcgatatcaaccacgttttcgtcatttggatattggtagaacaggggtctaatcacaggctctcccgatatctcgtgttgccaaacagggtgtagaagagcggtatgtgagcgtatctgagccctaaagcggttctaatttctgtcttgactcatctgggaaaa

SEQ ID NO: 601 - DNA, 352 bp, Diabrotica virgifera
attcccgggccaacactctatcgtaagtcatattattaaacgttactatatcgaggaaattaaaaacaacaagaccttttacactgattccaatggcagacaattaattaaaagaataagaaatgatcatgaattccacgatgatgatgtagaagctgcttcgtctaattattatccagttacgtcaaagatttctatagaagacatcaaaagtgacttaaagctctccatattaactgacagatcacaaggaagaacgagtttaaaagacggggaagtagaatttatgctccctccaaggactttaaaggacgactaccaaggtttagaagaacctctacaagaaatggaa

SEQ ID NO: 602 - DNA, 927 bp, Diabrotica virgifera
aataaagtatttagtattagtaagtacttaggcgtacaatttaatatttcttaaattaatttgaatttttggtataagtcgttttacatataaattatcatgtctgaagttgagagtagaaagcttgcagatttacgcgttatagatttaagattggaattagaaagaaggggactggacaaaaatggcgtgaaacaagctctacttgaaagattgacgaagcatttgacagatcaaggttttgatccagccacatacatcttcaagaaaaatgaacaaaatgaagcgtttgaagacactgaggaagatggtaagagtaaaaagagtaatgagggatccaagaaggttactgatggacatgattctccaattttacttagtttagaggaagatgagggagcaaataatgcagataagaagaaaagagaagatagtaaccagtcatcatcaggacaagcatcttcaggaacaaccaatggagagaatagtgaaaatagagctcgggatagcaaaaatgagaagaagcttgggtcaaaaagtaatcccacggtcgtttggattagcaatcttgctgaaaacactcgggcaagtgatttaaaacaagctctatctgcttgtggtagagtaacaggagccaaaattgtcgtcaacgcaagattcccagggtcttgttgctttggttacgtaaccatgggttctgtagaagatgttgaaaatgtcatcgaaaaattaaacaatacagagttaaaaggtcaaatgatcaagattgagaaatatgatttggtcagagcggttcagttgaaaaagaatgagaaatcacaaacctagttcaaaagacaccccagccaaaataaagaagtctaaaaagatgataaaattgagaaaaaaggtaaaaaaaaaagaccgattctgaaagacccgattctg

SEQ ID NO: 603 - DNA, 1213 bp, Diabrotica virgifera
gtcatactcacggttgtttttgtaaaacttgtaggtaacgaattttcgtttttagtgaattaacaaaacaacagagtgattttccaacaagaataacttatttattagtttcattaatttgataaacaataaaatggatagacttcttcgactaggaggtggaatgccaggtttaactcaggcaccgccgccttctgatgctcctgttgtggatactgccgaacaagtatacatatcctccttagcactattaaaaatgttgaagcacggccgagctggagtacccatggaagtaatgggtcttatgttaggagaattcgtagatgactataccgttcgtgtaatcgatgtatttgctatgcctcagactggtaccggtgtcagtgtagaagctgttgatccagtgtttcaagcaaaaatgcttgacatgttaagacagactggtaggccagaaatggttgtggggtggtatcattcccatccaggtttcggatgttggttgtctggagtggatatcaacacccagcaaagttttgaggctctctcggaaagagctgtagcagtagtagttgatccaatccagtcagtgaaaggcaaagtcgttattgatgcctttaggttaataaatccgaatatgatggtattgggccaagaacctcgccaaactacatccaacttaggacatctacagaaaccatcagtccaggctttgattcatggtctaaatcggcattactactccatcagtattaattacagaaagaatgaattggaacaaaaaatgctactaaatctccataaaaaatcctggatggatggtctaactttagcagattactctgaaaattgtagtgtgaatgaaaagactgtagctgatatgttagaactagccaagaattacaaccaagcctttaaagaggaggggaaaatgactttcccccagctcgctattaaaaatgttggcgaacacagtaccctaaagcattttttaaaaaaaaggggattttttttttaccaataatattcgccccggggttggaactatgctagataccgttgtttttaagtaattggtggatctcttttttttactattaattgcactttatttaaaaaaaaattttttcaataaaaaatttttttttttgaaaaaaaaaaaaaaaaaaaggggggggcccctttaaaaagggttcccaaactttcctaaccccgg

SEQ ID NO: 604 - DNA, 1069 bp, Diabrotica virgifera
gatcttcagcagcatcctcgaaaatgtcacacaaggttatcgcatttgttgctttcttggccgtagcccaagccggagttatttctcccgctctcccggtccaagtagacaaagattacgactccaacccccaatacatgttcgcatacagtgtgaacgatccttttacgggagacaacaaaaaccaagtggaaggcagagtaggagaccgagtagaaggtcaatattcccttgatgaacctgacggcacccgtcgcatagtagactacactgctgatgatgccaacggattccaagctacagtcagaaaaactccacaagtaaaaaccgctcttatcacaccagccattcaggtcaagacagcggcagtacctgttgtgtcctctgaggtgtccttgtctggtgactcagtaataacaaattctgctttaccagttgtcgatgctaaagtaaccaacgtagtagcccctgcagtttcatctgtctccacagcagagcatctatcttctctagccaaagtatcttccgtatcgactgtgcagcacatcgcccctgtagctaaagtagctcacgtagaaactccagttgctcacgtatcctacgttactcctttgtctgtagcccatgttgctgaagtagccaaaattcgcaccgtagccccagttacattaaccaagataattccacagactaggataaccgaacactcccaaagcattgtacatggagcagcccaacactcccaaagcattgtacatggagctgccctctcaccttacagactagctacatattcagttccagttaggcctcattacacctactcagttccatacagctacgatttcgctccaacttactacaatgcatacccatacagttactatgaatattaaataattcaatttttttagattaactaaataatagtgagattcgtttttgaatcaatgttcaataattttgttctttgtacatttgcctaaaataaataacaaataaataattagataagagaaaaaaaaaaaaaaaggcaaaaacacggaaggacaaaagcaattttaatatg

SEQ ID NO: 605 - DNA, 1020 bp, Diabrotica virgifera
  misc_feature (898)..(898): n is a, c, g, or t
  misc_feature (907)..(907): n is a, c, g, or t
  misc_feature (993)..(993): n is a, c, g, or t
gctaagagaacatgtgtgaaattaaaaacaaaacagatgattctagttctaaccttaaaaaaaaacttaatgttaaatttaaacttttgaggaattcaggattcagagtcagagtcttgtgtcttggttatatttttgaataagtaatgatttctacatgaaaaatattgccattttcacaaactaccatgtttagtgttacaagaagagtgcttaaaaactgtttcaataagcggtttatacaaaatctacaatctctagaaggaactattgaaggtacaagtaaaaatcactcaccatcactacttataagttgtaagcgaaaaaagttaaactaccatgcaggggttcagtataagaaatttgatgaggtacctcttgcttctaagggatggaaccattcaaaatctaagggagactttttcttaataaataggttgaagaatgaaaaaagtcaaagatattcttttgatgaactaaacattcaccctaaaataagagatgctttgaaaattgacgagataagggaattaaccgagtttcaagcaagatctattaatgaggtaaggaaaggatctcacctcctcctagcagctgaaactggttgtgggaaaacactttcctatcttataccgattattcaggatttaatctccaacaaatcagaaactgctaatacaccaaaagcagtagttatagtgcccaatagagagttagcttatcaagttggagaaatagcaagacatcttggcgaagctgttggacttactgtaaaaactgttgttggaggaaaaaccaagtccttaatgatgaatcctgtctttgaagatattgatatatttggttgccacccctggggcactcggcaaactttctacagtgggaatttataaactanatgaggcanaatatgcagtcttcgatgaagcagatacttaattgatgatagtttcatagaggaaaagggaaagttaaatcaaaagggttaccccnaatccagttcatactagtatctgcaac

SEQ ID NO: 606 - DNA, 1229 bp, Diabrotica virgifera
gtaaaatagtttcaaaatgcatcaggaggccatacaactcatccaggtgctagaaaaaacagtttcaccggataaaaatgaattggaacaagcgtcatcgtttctcgaacaagctgcagtgactaacctactagaattcatcaaaactctatcagatatattaagacatggcggaaatagccctgtggcccgaatggccgcaggtttgcagttaaaaaatcaactcacctctaaagactccaacataaagaccacctaccaacaacggtggttggctttcccagaggacgttcgggggtatattaaaaataacgttgtgtgcgcacttggaaccgaaacaagcagaccatcatccgcagctcagtgcgtagcatacgtcgcagtaacagaactaccacaagggcaatggccagatctcatagcaacgttggtcaacaatgtttgccatgcaaattccacagaaatgcaaaaggaagccacattagaagcgtccggttatatatgccaagaaatcgactcggacgtattagtatctcaaccaaacgacatcttaacagctatagttcatggaatgcgagcctcggaaccgagcaaccacgttcgtttagcagctacacaggccctactaaactctctagaattcacaaaggccaactttgaccaaccgacggaacggaactatatcatggaagtcgtctgtgaagccacgcagtctccagattcacagatcagagtggccgctttgcagtgtctagttaagattatgtctttgtattatcaacacatggaaccttatatggctcctgctctattccctatcactctagaagccatgaagtcggaaaacgatgctgtttctctacagggtatcgaattctggtctaacgttagtgatgaagaggttgatttggccatcgaagataccgaagccactgaagcaggtcgaccacctacaagatgttcacggcactacgccaaaggtgccctactatatatagtaccgattctgctgcaaaaattaaccaaacaggaagacgtggacgacgaagacgattggaatccttgcaacgcagccggcgcttgcttaatgtttctcgccccgggttgggaagacgaaatcgttccacacgttctgcccctcttcaaagaaaaatattaagcctgataaattggcgattccgagatgcttttttggtggcttccggaattatttttagggggttggagaa

SEQ ID NO: 607 - DNA, 974 bp, Diabrotica virgifera
taccacagaaccataccacaaattttaatattcaaaaaattctaatgaaaatgtaaaatatattcatagctaattattatagtttttaatttttatttaaaataaattttggttttcttctagtcaacaaattttaaaagaaatatataaacaataatgtggagattaattcaacaaaatttacataacaaattattattccacaatagtgcaatatttaagaaatatttctgccagggtcatattaaaaattatatctccagaacagtgtcccaaaaaccagttctaaaatcatttataccatcaaaagttgcaacatttggggttacacttactggtggtctaattataaaattgtacatatcacacaatggggtattatgcgaagcaaagaagactcgaatggctggttatgaaaataaatcagacaaaaatgttaaatttgattgggcaaggctatggaagtacttgaaaccacatatttggtacttcttagcagcaattgtgggggcattggctgtggctttattaaatatacaaatacctcaagttataggtggtgtggtgaatgtactagcaaaatttagtgaaagcagggatagtgaattatttcttaatgaaatgaagagacctgttataaagttaatatccatgtatcttgctcagagtgtatgtacatttttctacatatttatgctttcgaatttaggagaacgtatggcatataaaatgaggacagatttatttgaatctatattaaaacaggatatagcattttttgatcagcaaagaacaggtgaaattattaacagattaacagcagatgttcaagactttaaaagtagcttcaaccaatcgttttctggagggttgcgagcgagcacgcagaattgtcgggttgttcagtatctttaattatgctatcacctcaaatgacattcatttctctactctgcataccatctgttatagcc

SEQ ID NO: 608 - DNA, 993 bp, Diabrotica virgifera
  misc_feature (795)..(795): n is a, c, g, or t
aattgcaataagattattaagcatacttaataaatccgacccactggcgtttcccttttaccatacttaagtttgacttgcgcgtctgtgaaaactctcttctaaagaattaaaactttagttaaagttaaagtagtgaaatcaaaacgcagcagcaatatgaagtgaaattacaaccgaagtttgacccacatagtttaaagaccaagctagtgtacatgtgtttctgtttattcgtgatggtttgttaatgaaaacttcgtgaatatggtgtcttaaaaaacattcctcgaaagaaaatgtccaacaaaaaggcaggggttaaaactaatgcggaacctgcagttttacctcctcgctatcagccaccccctatgcctactgggcagggcattttgaaaaactcgcccactgaacctgccaaaaagcctccaaagactggggaaaatgtaaaattgttgtatccaaacgacccacacgctaaatttttcccaaaccctcaggcaagaatacaccagtatcctccacctttgagacaaattccggatgaagttcggaccacacagttgcaaatacatcacgaaaaccctcctccgagaccacgtctacctgaagaatctggagctcaacaaatacacctcgatttaagagtacctcaacagcgacaacccattagatacgacgacgaatttttgagacctgaaatgctgaaatttgtgcgaaaacctgacgatccaaggtttatagaccctaatagacagtttcagggtatattgctagagctgagatcattanaagaagcaaaccaacatctagcagatgacaatcaagaattgcgagatctttgctgttttttggatgacgatcgtcaaaagggtcgaaaattggctcggggatggcaacggtttggacgatatacagctagtggtatgagacaagaagtttctgcttatcagactaaacttcgggaattggatataaagcacaggaatt

SEQ ID NO: 609 - DNA, 1308 bp, Diabrotica virgifera
ggtgttttgtaaagccatcaatgtagagattaatttttttttatttataaatatgggttgtggcagtaaagtcaaagaagatagagatcatgaattgtatacaaagaaattccttcagacagtcaaattgttgctccttggtactggtgaatctgggaaaacgactatcatcaagcagatgaagattttacatatcaatggctattcaaatgatgaaagaagagaaaagattccttttataaagcaaaatattcatgagtccatatttgacattgttagtaatatgagtagaattaatcctccagtagaagcccaaagtgaagaaagtaaagcatctattgaatacattctaaacctaggaccaggttgtccaagtgaatttacagaggaatacattcaccatgttaagacagcttgggctgacgccggcgtacaaaagaccttcaacagatccaatgaatatcaactcattgatagtgcagaacatttcttaaatcaagtagacgtcgtttgcaaaccggactacataccaacaaatcaagatatactattctgtagaataatgactgtatccatctcaaaaatagaatttgacatgccagtacctaaacaatacggaggaggtaaagcagagttttggatgttcgacgtaggaggtcaaagaggagagagaaagaagtggattaaggtatttgcaggaattcagggaatcctgtttctaattgctgctagcgattttgatctaatgttaagagaggatacaagcgtaaatagacttgaggaatccttcaggttatttcaagacatttattctagtgagtatgtggaaaaaagtgccatgatagtatttttataaatcaacatctcttacagagaaaaattgagcaaggcaggaaataatattagtactttccagaataatcacattttatcgtaagcgataccaccggggaaattaaaaaaccaaatttttttttgaaacaaaattattaaggcttttcccaaaccccccgggaatggaaaaaaaatcggccaaacccgggcaaaaatttttcctgaaaaaaagcccccaaaaaaaaccccacctcccttttttaaaatttggaaaaaaaaaaaaaaaaaaatttaaaaaaggtttttttgtccccccccccgaaaaaaaattttttttaaaaaaccgcggcaaccaacaaaggtggggggttttttttttttttttttttaataacaatttatcttttttttttttttttttttttttaaaaaaaaaaaaattctctccccccaccacatactatctacccctcc

SEQ ID NO: 610 - DNA, 1529 bp, Diabrotica virgifera
cggacgcgtgggcacaatataatttaaaacaagaatgttaccactaaaccactttttaaatattaatcatgaatatttactagagtttacaatttcaaactagtgtgtttgattctcctatacctatattttacttttttagtaaacttcagactgttcaggatagcataatagcataggaggcgaattaaaaagaattaatttacttacaagaaaagatatcacaaacattaaactctcttatggcattgatttgaaagatgggtatatgtacaatgatgatgcaaccagtgtttatttttgggttgaatgcttacagactcatgtccaatattattttacaaacaacagggcatactaatggatattcattctgaatttaacatttatgatttttgtcttattttccttaatactgtgccaaaaggaaatgttaattaagtttggtaaatcctttatcgcaatcgatggaactcatgggctcaattcctatgactttgaacttatgacagtattagtaaaagatgaatttgggaatggattttgtactgctttcttattttcaaatagaaaagatacctactttaatttaccaattttttaaaatacatgtctgtgttggtattatatgtatagtcaaatgttttcatatcaggcataagcgacaccttttacaatgcctcgtcaaatgtaatgggtattgctcctaatagactgttaagtgcctggcacatagatagggcatggtaagtaaatcttaataaaatatctgattctgaaaaaaatcctattatgtatacaagatgtattaatgatggtttagagagtattaatagctttttgggtagacttctaagtgatgcagatacatacaattttagtaagtatttccagtagaactactgcaataacatccaacaatgggcctattgttataggaagaggttgtggaattaataccaatatgaccattcaaattttcataaaattttggataaaagggtatccattagttgttatcagttaagtttaaaacttggcactcatggagagctataccataatatataataggtatatctcataatattacatctcatattgttcactcattacaatagtgagcaatatgagatataacatattatagtataagtctctgtgcatgaccagattaacatgtttggtgcccatctcgaacaagctccacttagctggtaccccatacttaaatcatttatttagttacccagtactactcacataacttatatgtcgtcagtaccttccgtaaaaccttcgtgatgctacccatacgtcatggcccctgaatgtgttaaagcttgttaatgtaggagagttatactaaaatatatatcttatattatattgccttaaatagaaaaaatatcttatttaaattgtatccatgtaagttttgatttaatgaaataaaccttttaatcaaaaaaaaaaaaaaaaaaaaaaaaaaaaaaaaaaaagggcgccgctcgcgatctagaactagt

SEQ ID NO: 611 - DNA, 447 bp, Diabrotica virgifera
aggtttccgaaatgaaaccctaaggacaatagtgtgaaaccaagaagagaccggttgagaaatacaagcattagagagcaatgcaaaattcaagattttgtaagatggggaaggcagcgcaagaggatgtggtacaactatgtaagacgaatggatgataatagactcccaaaaattgccctagaaaacaacccgccctgttcaagaccccccggaagaccacctaaaagatggaggggtagttggcaatctacctcgcaacaatctacctcgctacctcgcaaattaaccagaggcagcttcagaattaaacaggtcgaaagatctccaagaagtaaaagaataataatgcacatatctagaaacattttagaaaatgcaatacgaagaacaaaaaatacaatgccgtcttttcaaccatcatagcgaaagcgtagaagacgtgac

SEQ ID NO: 612 - DNA, 1205 bp, Diabrotica virgifera
aacaaattgaactttcgtcaaatctcagaaatatttaatcatttaagtttaaaaagactcgtcctgaggagtcggatcaacaaactatctacattgttaggatgtctgcgggagatagtctggtcaaatccgtatatgcgcacagatagtaaaattagaatctacaagacttgcatacgacctatcatgacatgacatatcttacagaagtgcgcgaagacaccaacacaacgaaacagatgctaagggttgccgaaataaaaaccctaagaaccatagtggggaaaacaagaagagacagggtgagaactacaaacattagagagcaatgcaaaattcaagatattgtaagatgggaaaggcagcacaagaggatgtggtacaaccatgtgagacgaatggatgagaatagaatagaaaacaacccgccggttagttggcaatctacctcccaggaaattaatcagaggcagcttcagaattaaacagatcgaaagatcttaaagaagtaaaagaagaagtttaaaatgagatttcttctgatgtgtccgatataaaaatttgtaaaatatactgtacactgtacatcaataaacttgccaattgcttgcccttgttatatatttttgcaataaaatcgatatcattatattcaaaattggcatcattgacaaaactaaactaaattattaattatatatttcttgtatgttctatcgatacattgaggtgatgaatttcaaagctttttgtgtctgttataaggcaataaaagaattttatcgaaaactaataaacttttttcaaaaaaatattaattctcattaaatagatacataaattccgactataaatatgtttacatatcgattaaaacgcctacaaatattttaatatccttttaaacgtagcgataacgttacaaagaagaaaaatattttaattcaaactatctcactccaatagggcttttcatcgattgtcatttgtttcgagcctctgtcataagttgtataatctgtgtgtaatattaatatacacggattatacgacatatgacagaagctcgaaacaaataactgtgaatgaaaagccctatacgatgatcgtgaatgatcgttataattattaaagtatactcttcacagaaaagtatgaacgtgaactataatagtcataagaaaactctttccactgagattatt

SEQ ID NO: 613 - DNA, 1089 bp, Diabrotica virgifera
tgcgggaatccttttggattacttttttttcaatttttttttttattgacttctttgttttttttttcacttattaaatatttatttaaatttctactataaatattttaacatatcgattaaaacgcctacaaatattttaatatccttttaaacgtagcgataacgttacaaagaagaaaaatattttaattcaaactatctcactccaatagggcttttcatcgattgtcatttgtttcgagcctccgtcataagttgtacaatccgtgtataatattaatatacacggattatacgacacatgacggaggctcgaaacgaattactgtggatgaaaagccctattggtgctggatacaaccactaagctgctttctgacagtcggccgctgtggtcgtccgaagtccgaacgcacccattcaaaattttgataggcgatattttgcgcctttttccttaagggcatttggaatcggagccagaatacctgctactgctccactgttaacgagtgcacaccgtatattagcacgtttaagttttgcaccagaacatgtcgattgagatactaacgactggactaatattctttttactgactcaacatttttgctttctaaacttttttcatttcatcaaatatatacaagaatcttcataaagcagaaaacgtcaaaagatttgtattgccatttaaaaaagacttgcaaatagcattttgtgatttcggcaactttataccttattttccgaataatattgttttcaatcttgaactaatacaaaattgattgttatttacgtacatatttttattttcatttattttttacaactttttttataactagctggttttatacattattcaatcactttggcatttttgtgaagcattttctaggaaaaaaagcggtttaatggaaaatttctggtgctgtttccattataaatgaaggacagcgtgcaattcatatacctatgtatacaccttacggacagaccatcaaaaaatgttcttgtctctattacataattatatatatttactatatttactggtaataataaagcatttattgctg

SEQ ID NO: 614 - DNA, 924 bp, Diabrotica virgifera
gccccagttcggtgactaggcgcaaatcaccccaaatgtgtgtgtatgtgtgcgttaccccccttcagtcaagagtttttgtttgcaaagacaataatttaaatctttgagattgaaatatatgtttttaaatatttataaacaacaaattttgtccataaacattattatgcctattacaatgtacagagacgatgttcgttgagacaattatggtgattcaatgtaaaaaatgagctattgttggggcttaaaagttgatgttctttaaacaaacatgatgactgaaagagctaatgttaagagctttattattgatttatttagttatataagggattacccccattacaaaaaagatatatgcagtataaaattaatctctataatgtcttataaactagagtaatattaaagtcttaattacacattaaacaaaatataaacaattatatgtgacacaaatgaagcttctgtcatatgctatataatctgtgtataatattaatacaacacggattatacgacatatgacagtagctcgaaacaaatgactgtaaatgaaaagccctattctttaatttttccaactgtatattgtaattgtattattatgggttaagcatattacctgtgtgatataagctattggaacagcacagtctctcaaacggttgaaagtgaagttctgtcaatatctttttctaaaaaatgttttgaacatactgctctattaacaaatctgatcaatacttcatgccttcctcgcaggatcttctggaaagctttgaaacattattcctgcagatttttttatctacattgcttctgctactccaactgattttatgcactatattaataatactattaaagttattataaaagtatccgaattaaaaaatattcttaaaaagcacaaat

SEQ ID NO: 615 - DNA, 1453 bp, Diabrotica virgifera
catacaccagtctcgccagcgtcatgctacgattcagttcgcttcagacgctgaaaattagaaaccttggtcagccgatggtggtggcctcgaatcgaatttaatctaaagctatatttccttaaaaaacgtgtattattcttttgggatattcttaaggcaatgccttatctctccattatctatattatatcaaaatattttgatcggatttatgttgggtatttattgcgattacttttacatttaacattacatttctacatttaacattactctatgagctatttgaagtatatcataactccaactttttgacaatggtgctaatcacgctctttcactgcggcatttttttgagaagatatgccatggtgctcactttctactggcaacccaaagttgaatgcgtcatgtttctcttgtacactgacatgatagtcgtgataattacatccaagaaatggtagatcagcctacctgattatacatctatttagcgtctctatatatttctttattatattttttgagttgttcattttaaaataaatctatttatttactacaaatcaactcaagtcttacataagaaaagcaggacatgtccctaaaaaaagtttgaaatccctcttacaatattcatgaaaaaccagataggaggtactgtcacatcaccgacgatatattatattattaaaatatggtcatattgtctttcaaacaattatggtatatatcagctttttataactttctaagtgctctaaactttgttgcaaacacatgctaaacacagttgcttgaaatgacatggtgtagtttacctctgaggtcaagatatataattttaataagtgataatctttcagactctttacaactaacaccaaaagaatatacattgaatcgatttaataaatttactgggaatatgccataattttgcttatgaaacgtcaaaataaacttgttttaaataaaattgtggcttatacccagtaaaaatagtaaattgtattaaggtaccacaagaaattaacttcagaacgatacagtgaatcaaggctgtacaacaatagggcttttcatcgattgtcatttgtttcgagcttctgtcaaatgtataatccgtgtatactattaatatacatggattatagaacatattatgaatacatttgaatcagtgtaaacaaaaacgtgtctttttttcacttttgacattttgtggattacattatgaatttttttgacattatgtggattatattaaataattacattatgtggacatggtgttgttttaaataagttccatcaattcacttattttattagttggattatacaaatttggatatatatagtattttcactacaaaaacgttattacgcaggtcaaaatttttgacgtaagagaactgtcaaaacattagactgcgacttttca

SEQ ID NO: 616 - DNA, 1691 bp, Diabrotica virgifera
  misc_feature (753)..(753): n is a, c, g, or t
  misc_feature (1539)..(1539): n is a, c, g, or t
  misc_feature (1609)..(1610): n is a, c, g, or t
gaataggtaacagttcaattgtgtaaaccttactatatgcgtgttttattgactataataaagcattcgacaaagtacgacatgaacaaattaatgcatgtcttggaatcaaagatgatagacttcaggattatatcgaatttatactataagcaacgagcaaaagtgcgtgttaacgatcagctgtcagaggaaattgaaatcagtcgtggagtgagaaagggatgcgtgttgtcttgttgtcgaaaaaaagctcttgagagtgaaacagctggaataaaggtaaatggagttcccattaacaacattagatatgcggatgacattgtcatcttagctgaaaatattggggatcttcagaggctgttgaccagaatagcgaagtttggacaagaatatgatctaacaatgaacgtcaagaagacaaagtttatgagaatatcgaaaactcaaagaaaaaatgagcatctcttcataaacggatccaatatcgaacgagtcgaacaatatcataccttggaacaatgatcaactccacaggagattaggtacttacaagaaatcaaaataagaatagaaaaggctagataaaattttaacaaaatgagaaaagtcctctgcacaagagatttgaagttggagctaagagttaggttgattaggtgctacgttttcttgactttgttttatggaatggaaacttggaccttgaatactacatcaatgaaaaaactagaatcattcgagctgtgngtatacagaagaattctgaaaatatcgtggacaaaacaaaaaaggaaaccgacaataataaagagtcgggcaacttaaatatcatcaaaacgtataaatcgaatatatacatcacatattaccaattcgaagacaagttcggtccgtcaaagaagatcgtcaaagtaaattttcttaaagttatcgttatcgaaatcgaatcgccaatatcagggcttttcatcgatggtcattcgtttcgagcctctgtcaaatgttgtataatctgtgtataatatttatatacacggattacggattatacaacatacgacagaagctcgaaacaaatgactgtgaatgaaaagccctattgaaccagccagggccgcgtttaggtcaattgacgccctgggcaattctctagtagccgcccttcaaacatgtaccatttttgcgaaaaaaaaattgcagaaatttttatttaaataagaatacactaaaaatggatataaactaagatgtttaaatacctataaaagaaaaaattgtcattccagttcgatcacatcagagacttctttaaaaaaaaactttccaaaaaaatttttttttcttgacaaaatcgacaaattgttaacacgttcttgcgtcatatttgatgggaaattattttgttccttgagatatcctctaaccactcaccaattttcatgcaaatcgatggagattcaaaacgaaatcggaggtagctcatatccaccttcagtgactgcacgaactcttctttagatattaagatatgtncattggtgattttattgtggtatccaaattcatgtatgaatgcattcacttgaagggtcagtatcttggnngtatgtatcttggtcgtctttattttgtagatatcagattttcaacttctttaggtaataatttcttcattgcttaatttt

SEQ ID NO: 617 - DNA, 1919 bp, Diabrotica virgifera
gggggggtttgtggggcccccaaaattataggtcttcttcttttggtaaaaccacccccccccccgccggttataaaggcgcgtctcaggggggggggcccccttccccccttctagggggcgccccttggggggggggggggggggcggggggggctcttcttttttttccccccccggggaaagggggggtttttccaaaaggtgtatattggggtttcccccggttttttcccccccccccccttttttaaaacgcggccccgaaaaaataatttttgtggcccataaaaaaaaaaaaaaaatttcccaccccccccttttaaaaattttttttttttaggggccccccccccctgttttttttcttttttattttttttttttttttttttttttttttttttttttttttttttttttttttttttttttttttttttttttttttttttttttttttttttttttttttttttttttttttttttttttttttttttttttttttttttttttttttttttgttttttttttttttttcctattttataatttattattataagtaccattttgatgtcaatataaacagaacaaaatacaaattgatgtgtatatatcaaaaacagcacaactctctatttgaaagattctcatcctttttttgtatataatgaaatctagtaatataaaaataaatccaaaaacagccttacagagtatgttaccagatcagaacaaaattacatggtcttatttagtaaaacgcttaaaaaatacacttaagaaaatattggtttagtccattagctgtcacaaaactacaaaataaaaaatgcctattctagaataacttaagaacggatcagtctcattttaaaagataagtgcaatgttgattatttgttaatcagtaatcagttgtctattggtaaacaataatttatttatagttgaaaatgtaacatttaatagtttcttatggtcttaatatttgaaggaattaaactatttatagaactgattacagattaaacgatgaatgaactagttaaaatttatggaaattgaggtaatcacattaaactgatatatcgctcatcaggaagaaaagtgacaaatcgtcggtctaaatcgcaaattgccaagtccattttttgcgaaaattgttttttggtttcatctagtagtagacggtaaaagctactgcctgacaattcccacaagcgcaattattattttatttcacggcaatttcggtaaacgaaagttattttactcataggacataggcaaactccacacttttttgtctctcctctaaaattttcaatttgtgacttaggcaatttgcgacttagaccgacgaaatgcataattccagttatcttgttaaatgactccaaaagtcgtatacttttaccaagaagtttcacattgcaagatggcggtagtgtcattattcttttggcagtaaaatcaatattttattccgaaacaatgacagttttcagttatattctggcgttctacattaacatatagttgagaaaacccttgtatgtattttgagaaatctcctaggtattttgcattaatgtttaaaaaagcgacatattttaaaagaaaagtgacaactcaaaattttgatcgtttttatttgttaaatcaaatatatagttttcttgattgctaatagaaagacagtcaacatttaaattaagttctaaaatatattttttaacgtcttttctttgtttatgccctttctcctctgattcttctgaccagctgaatgtctttagccataatagtgactgtcttagcatgaatagcacataagttggtatcttcaaataaacctaccaaatataaaatctgtaaatctgtcttaaaatcttgagtaatttcacgg

SEQ ID NO: 618 - DNA, 1892 bp, Diabrotica virgifera
ttaaaaattaaattttattatttattatatgtaaattttatttgagaatagattgcagtagataaatttaattattaaagaaatttggaattagaaattttaaataatattgacttaatttgtgccagcagttgcggttatacaaataatataatttaattttatttatattaattaaatatttatttataattatataataaaatttattaggtgaaattttaaatttttataaaattatatttttaaattgaagttaagaaatttaaattttaaactaggattagatactctattattttaaatgtaaaatttttatttaattattattagttatggtctttaaaattaaaaattttggcggtattttagtctttttagaggaacctgttctttaaatgataatccacgattttattaacttttattattaatttgtatatcgtcgtaattaaatatttttttagaattaaaatatttaaaatttttataaaaaaattaatcagatcaaggtgcagtttatatagaagtagaaatgggttacaataaatttatttttgaattttaaatattagtatttaaatgaaattggatttaaatgtaatattaattaattagttaatatgattttggctctaaggtatgtacatattgcccgtcgctttcatttaatatgaaataagtcgtaacaaagtagatttactggaaagtgaatctagattatcaaattagagcttgatagaagtattttagttacattacaaagttaattgtgaaattcaatttaatttgaaataaaaaatttattttatttatatttttatttattttaaaataataaaatattttttagtaaaagtaaagaaaaattttatttaatgatagctaattagtattgtgagagaatattttatttttataaaagaaaaatttattttttgtaccttgtgtatcagggattattaattaataatttatatttttttttttctcgccgtcatatgtcgtataaaaaataaaaatttattaatatacaagaaaaaattttaaaacgacatttttttggagcgcgaaacaaatgactgctattgtaaagcccctatggaattttgtctgcgggagatagtctagtcaaatccgtatatgcgcacagatagtaaaattagaatctacgcgacttgtatacgaccgatcatgacatatggcacagaagtgtgcgaagacaccaacaaaacgaaatatatgctaaggtttgccgaaatgaaaaccctaagaacaatagtggggaaaacaagaagagaccgggtgagaaatacaagcattagagagcaatgcaaaattcaagattttgtaagatggggaaggcagcgcaagaggatgtggtacaactatgtaagacgaatggatgataatagactcccaaaaattgccctagaaaacaacccgccctgttcaagaccccccggaagaccacctaaaagatggaggggtagttggcaatctacctcgcaggaaattaaccagaggcagcttcagaattaaacaggtcgaaagatctccaagaagtaaaagaataataatgcacatatctagaaacattttagaaaatgcaatacgaagaacaaaaaatacaatgccgtcttttcaaccatcatagcgaaagcgtagaagacgagactgtggaattcaggacatatttaacgtatgtttgccgaaggatgctgaagatggcttacaaactcaagttgacgaatatcgcgaccaaggtggctgaacgacgtgtgaagatagaccaagatctttgcccatccagctagtgctagttcaacacgctagcaccagctgtcgagccattgctagttcaacacgctagcaacgactgttctcctggc

SEQ ID NO: 619 - DNA, 1942 bp, Diabrotica virgifera
gataaaatatatgttatataccatggcttagtatagcgttccttaatctgatggacgtcgtagatattgcttttcgtagaataaggaatgatttcatttgtttatagctaatctaatgacttgtgattcgctcaagtcaattaaagtgtttatctctaaagagctttatcggaagcacctttccatagtttaaaagaagaaattgttgactttgagaggatcttattttcatgggcgtatacatgacgctttttatagtttaagctgtttttggagttgtgacttatgggatccagatgagcaatatattgaaaatctataaaattaactaatttgaaatactacattatttacaaattatgacctcaacttcagaaaatatccctggcaaaaatatatattttgtcaggtctttgctaaggagtcttaaagttacattttttcataaataatgtggtattattaccacaaaatcttttttcagatatatgcataaatcaataatttgtataaaacaaatgtcaacaaaatgtattaaaatttgagcttgattttattaacgaaaatacatttggttaacccaatttgtagaatcacattctacaaataaatttgaattaatacattatatatcgatcacgccacgtattaagagtataagtcaaaaatgacagcttttcactacagcttttcgaagtttttattaccactgttgaaataactattacaactaaacatcaaaatggtgatgaaatatgattcataactgtagtaattaactattttactttctattttgataataccttaataattataaaattcaaattgtagaagtatcccgaaaggtcttttttaagacttatagtagttagtctccttacaccttacagtaggagggattatgattatatatagtagttatagtcttagtacatagtatgtgatatataatttttttttctgaatatacttttttgggtagatgtttgtagaatctaatcgtatagactagacacatcagattaactagtgaagaagaattcataatttcccaaatatgactattcctaagatcctttaatccacctattttattagttggattatacaaattggttatatcgtccgtgatgtgacaatatacgatatattatcatcataaaatatggtcatattgtctttcaaacaattatggtatatatcagctttttataactttctaagtgctctaaactttgttgcaaacacatgctaaacacagttgcttgaaatgacatggtgtagtttacctctgaggtcaagatatataattttaataagtgataatctttcagactctttacaactaacaccaaaagaatatacattgaatcgatttaataaatttactgggaatatgccataattttgcttatgaaacgtcaaaataaacttgttttaaataaaattgtggcttatacccagtaaaaatagtaaattgtattaaggtaccataagaaattaacttcagaacgatacagtgaatcaaggctgtacaacaatagggcttttcatcgattgtcatttgtttcgagcttctgtcaaatgtataatccgtgtatactattaatatacatggattatagaacatattatgaatacatttgaatcagtgtaaacaaaaacgtgtctttttttcacttttgacattttgtggattacattatgaatttttttgacattatgtggattatattaaataattacattatgtggacatggtgttgttttaaataagttccatcaattcacttattttattagttggattatacaaatttggatatatatagtattttcactacaaaaacgttattacgtaggtcaaaatccctgacgtaagagaactgtcaaaaattttgacctacgtaacgtttttgcagcaaaaatactatatatt

SEQ ID NO: 620 - DNA, 2796 bp, Diabrotica virgifera
gtatccgtcaaaaacacgcttctatatcaacgcggaaaaaaatattataaatgtagtaaaagtgtgatacgatgagtgctcaataacgagtgtgtgctaatcttatatttcgaacgtaacatctcaaccggctcaatctcagtgtagattagtcggtctggaaaacaataaatccaaacaacaaaagcggcaaaaatccgtgtcaagtattttatcaacaactgaacaatgtcactgcttgcaaacgctttcatctgtgctacagacattaacagcacaaattatgacgattcctatcaggaaatagttaaagacttagtgccagactgggtttgtgctctggaatatgttccctggtgctgggccatctttggatctctccttgtcggacttagcggggttttgcctctccttgtcatacccattgatcattcggagaacttgaaacaaggagatggtgccaataaacttaagactctattgagtttcgccgtaggaggacttttgggggacgttttcctgcactccttgcctgaaatttgggccaatgacacagtcacaaaattgggaagtggacacatctcaaacagcggactattgatattaacggggctcatagttttcgtggctgccgaaaaggtattctctgtgatagaacaaatagaagacaatgagaaaagtacatcgcaaagtgtcgagaacaacaataccaaaggactgagtcagccaatcgaacacaaaaaatcggtttccggttatttgaacttggtagctaacaccatggacaacttcacccacggtctgtcattgggtggcgccttcttggtatcccttagactaggactgctgaccaccttcgccattttagtccacgaaatcccccacgaagtcggagacttcgccatcttgcttaagtccggcttcacgaggtggcacgccggcgttttccaccttttgaccgcaggtggcggtctcatcggcgccatggcggccatcttgttcagcggcgcacatacagctcttgaagcgaggagctcctggatattaccatttacagggaacacattccttcacatagctttggtaaccgttcttcccgaatttttgactgttcatagttgactcagccttttttcctctctgaaaaaaaacatacccccatcaaataattcagatgaaaaagcgcgtttctgcgttagattctcggggtgaaaaaaaggcagatgggggggccctcgctgcccccttgtgcctcaatctttgggggtagcagatgatgtatcaatggctgtcttaggtgaagcatctgctgctccagtttttgtcgcacctctaaaattgtcaagttgtgccttagtcaatttgctttttagttcgacgaaatgcataattccagttatcttgttaaatgactccaaaagtcgtatacttttaccaagaagtttcacattgcaagatggcggtagtgtcattattcttttggcagtaaaatcaatattttattccgaaacaatgacagttttcagttatattctggcgttctacattaacatatagttgagaaaacccttgtatgtattttgagaaatctcctaggtattttgcattaatgtttaaaaaagcgacatattttaaaagaagaagtgacaactcgaaattttgatcgtttttatttgttaaatcaaatatatagttttcttgattgctaatagaaagacagtcaacatttaaattaagttctaaaatatattttttaaagtcttttctttgtttatgccctttctcctctgattcttctgaccagctgaatgtctttagccataatagtgactgtcttagcatgaatagcacataagttggtatcttcaaataaacctaccaaatataaaatctgtaaatctgtcttaaaatcttgagcaatttcacggataagacgttggaaaggtagttttctaataagtacttttctggtagcgtctaatttcacgaagggctacggtatctggcctgtagcgatgaggttttttaactcctccagtggcaggtgcactcttacgagcagctttagttgccaactgtttgtgtggtgctttaccactagtggattttcgggctgtttgctttgtatgtgccattttttcatgtgcgtatactaactgcgtttcctgaaaaaagctgttttttgagttgtgactctcttcttccagatgagcaatatattgaaaatctataaaattaactaatttgaaatactacattatttacaaattattacctcaacttcagaaaatatccctggcaaaaatatatattttgtcaggtctttgctaaggagtcttaaagttacattttttcataaataatgtggtattatcaccacaaaatcttttttcagatatatgcataaatcaataatttgtataaaacaaatgtcaacaaaatgtattaaaatttgagcttgattttattaatgaaatatacatttggttaacccaatttgtagaatcacattctacaaataaatttgaattaatacattatatatcgatcatgccacgtattaagagtataagtcaaaaatgacagtttttcactacagcttttcgaagtttttattaccactgttgaaataactattacaactaaacatcaaaatggtgatgaaatatgattcataactgtagtaattaactattttactttctattttgataataccttattaattataaaattcaaattgtagaagaattccgaaaggtcttttttatgacttatagtagttagtctccttac

SEQ ID NO: 621 - DNA, 3675 bp, Diabrotica virgifera
cgtctctaaaatacgaatagctatgatgattgccgacctccgccgcggagatggcacttaaagaagaagaatttatttatatctttaatgcagtttgggtttattttttttttgttttttggtgggtgtttcattggaattcccccccccccccccgccatggtaaatttccttcccaaggtaaatgtctaaatgcggcagtgctacgcaagccgtccgttttacgtaatactgcagccatttgacagactgatttgagtcattgctacgtctacaacagagtctaatagcacaatataaattagctctaagaataaagaatattcgcccaatgctggttccagacatgacaatatttattaggagaaagagccttaaaaatttattattttctggctttccaaaatcatacagtacagacagtcacagcggtcaaaaattgatggtgccaataaacttaagactctattgagtttcgccgtaggaggacttttgggggacgttttcctgcactccttgcctgaaatttgggccaatgacacagtcacaaaattgggaagtggacacatctcaaacagcggactattgatattaacggggctcatagttttcgtggctgccgaaaaggtattctctgtgatagaacaaatagaagacaatgagaaaagtacatcgcaaagtgtcgagaacaacaataccaaaggactgagtcagccaatcgaacacaaaaaatcggtttccggttatttgaacttggtagctaacaccatggacaacttcacccacggtctgtcattgggtggcgccttcttggtatcccttagactaggactgctgaccaccttcgccattttagtccacgaaatcccccacgaagtcggagacttcgccatcttgcttaagtccggcttcacgaggtggcacgccggcgttttccaacttttgaccgcaggtggcggtctcatcggcgccatggcggccatcttgttcagcggcgcacatacagctcttgaagcgaggagctcctggatattaccatttacagccggcacattccttcacatagctttagtaaccgttcttcccgatttactcaaagaagaagatcccaaagaatcattcaagcaactgttagccttgatcctggggataacagtcatggcgttcgtcaccaacgctttcgagtgatggcgaccacaaaacattatcacaaatgtacttgaagcaatagtttatttgaaataatcagaaatttccataattagtggttagtattattagttgcggttttattaagtgtcaactgtcatttgtcaaaatgtcaactgtcatttgtcaaaatgtcatctgttatttgtcaaaatgacagatgacaataactcaactgtcagttgtcaaaaagatggcgtaaaaatatataaattagttctgtagagtataaaagtcctttatgtaattcttactttcaaataaactcttgcactgacaaattaaatgtaattttgacagtttctgaaaggtttgactaaatgtaaatgtcagaattatatatctgttgatttttatacaggcacatcaaacatattaacatacacaattgaagatcgttgtaactgatatctgcagtcaacaatttggaaattgcttcacagctaactcaaattagaagttatgtttcacaactgcataaaataattgttaacaggatcaatattttattgtttatattagtttttgtaaagatatgtttcactagtacttaaatatcgatcagagacacaaactgtgttagaaaaggtccatggaatgtatcaatatgattttattttttatatcaccttcatttgtgcattccggtctcaataattaatgtaaaacgtcaaattttcgtttcaggcgacaattactgatactgcctacaaatagtggtataaggcttttcatcgattgtcatttgtttcgagcttcttctgtcatctagcaggcaagaccgcctaaatgcggtataatttctagctatttcagctatgtttaggtatgcagcatgcaaacctgcctttggtcgtatactactaagtgtacttgtaaatatttggttaacgctaattgattggctctattaagtcaaaagatatcaagctttgaatttttccattgaaaataaaattggcctgctagagggataatctgtgtataatattaatatacacggattataccacatattatgacagaagctcgaaataaatgactgaatgaaaagccctatggagcgagacttgtcagaacatgttttggtttcacctaaccttacataacctacaatttatctgaatagctgtctattgagatatattttgtctgccactgtctttttatgaataacaattactgttttacctaaaaacaattaaaaaacatgtgataatgcgcgcgtacgcatttaatattttattaatatgcatacttcgacagcttcgattcagttcgcttcagacgctgaaaagtagaaaccttggtcagccgatggtggtggcctcgaatcgaatttaatctaaagctatctttccttaaaaaacgtgtattattcttcttttgggatattcttaaggcaatgccttatctctccattatctatattatatcaaaatattttgatcggatttatgttgggtatttattgcgattacttttacatttaacattacatttctacatttaacattactctatgagctattaaagtatatcataacccaactttttgtaaatgatgctattcccgctctttcactgcggcatttttttggaaggcatgcccaggtgctcactttctactggcaatgaaagtttgaatgcgcatgtgtgacacgcacactgaacactttgcctgacactgatccgtgacatgcgcagtaaaaggtttaactagtttcttaatgatctcagttacaaagatattcacctgtgtaatgtatgatggaaaacgtgccgttctatgctgtgttaaaaccggtgccatattctatgcatgtcaaggtatatgtaaaaaattaattctgtcagatattagttactagtagtagtagttttcgctacgggtacagtggacaaatggacatcataaatttgacgtcacaaaaagtgggacggtcagacctaggctatccattgtcgctgacaatttctaacctcacttaatataaataataccgttaatagataagtatacacggtatatttacttttaattaatattaataaataattattaaattatgctatgtaaatataccttgtttatttatctattaacgatattgatattatttatatcattttaaagtgcgcatgcgttttgctgctactttgtcgccgactagtcgtcaacaggcacccgcgcacgcacttaatagggcttttcatcgattgtcatttgtttcgagcccctgtcagatgttgtataatctgtgtataatattaatatacacggattatacgacatgtgacagaagctcgaaacaaatgactgtgaatgaaaagccctataaggcaaaagtgatagcgcatacggtcttcaagatcttcttacacaagaatggatccctattgccccaaaacgatattgataatttaattttaagaatgccaaggcagcgtcaagctgtattttac

SEQ ID NO: 622 - DNA, 2634 bp, Diabrotica virgifera
cccgtcgccataatcgcggcgagatcgtgagagtgttttgcaacaaagaaatcgtcgttttcgacgaggggagtctcctgctcccgatcatttcggcctattcgttccaacaaatcctttttgtcattcaaatttgagaaattactgttattttacggttttttcttgtttgggattttataaacatggctttttaaaatgtctgccttcaaattgtgcatagccactccttgtggaggagcttcaaactccaataaattatcatctacttatactggaggacgtcgggatggagaagaaaggaaatcgcaatttgcctcttgcaaaaggctccactactgattccaaaaaagatggcattagtagtaaaccgtggccccgcggcagtagacgccgcgagtgtgcgggctctagtcttagttcaaaaccggaagtatcccggaaacctcaacctcagcgcgttaaaacctttgataaacgacctaggccccgtggtggtggcttgtgtggaaccctggctagaaatgagacgcccagcctagaagatacagatgaccaccaacaagtggaattgggttcagtttttttaccaggcagtaagaagcagagcctgaatcatttattgaatttctcttactcaccaagagacagcttccacaggtctgaaaggggtcaaggtaatgggaataatgtcaacaggatgatgggtactaagaagcataaatataataaggaacactttttacaagctaactgtcaatttgttgttaatgattctggtgattacaagcaatacttgaacaacccagatgccctagttgactggagcttagtggaacaagtaaacattcaagtatcggaattccctacatgcccgatttgcctatacccacctgttgcagctaagatgactcgttgtgggcatatttattgttggtcttgtgtactccattatttgtcgctttccgacaaaccatctagaaagtgtcccatttgttttgaaaatattcaaaaacaagatatgaagagtgtggtcgcaattccttatacatcgtttaacacagatgaaacaattaccttcaaattaatgaagagacctcgaggctgtttaatagcatatcctgcagatgccgaaaccaaaaacgaaaatgacatattcaacatgtcagatcagggttcaagagatgtttattccaagttacttttggcaaaaactgatgatgttctaacaatcatcgagagggaattcaacgaactcaaagaggagcttaaagacgacattagtccagaaagatgtttcatagagcaggctatggttttgttaaaagaacgagaaagtgtagtttgtgggcatgttattaagaacgatcacagtttggaaccatctgaagaaaatcaattggtagattctttaaaggaagtagaaattagtgctgatgatcagtataagcaaattacagacgaaattttggaagattgtagcagcatccagcctgcaaagtttcattatttttatcaagcctccgacaatcaacacatctaccttcatgccatcaatgcaaggatgttggagcacagctatggttctttggaatttggtccgaagacaattaccggaaaaattcttgaaaaggaaggtggctccatgacggaagaacttcgtaagagattaagatatcttcagcatttgcctgttacttgccaatttgaggtggccgagattcaacttaagactcctgttgttaataaggacacccttgagcattttcgtgatcaaattgagattcgtaggaagaggcgtcaaaagcgcgcgaaggaagaaaaacgccgcgaaaagcgcatagaggtagaagagaatcgtaaaatgggtaaatacctacatccaaatttgcatttagattcaaatattcagtttcctgagtttggattcgaaacacgtttaaggtcagaatctgaaagtacaatacctagcgaaagaagtgcttcaccagatttagcaggtacaccaacaagtgtgtcgctagaaggagcttatagtggtccttcatttgcaaagatgctagccactgagaaaaaatcatcaccatcttggcctggtttaaaagcgacatcatctacatcaaaatcaccggatttgatcaatgttactggttccaaaatgaaaatgctatcaaccgttcgggttcccagtgacaacgaacaagatccggatggttacgaacctgtaccttccttcaataggagctttggtgatgctatagcaaaagctcttgaacaagctgaaaaaccagaggaagaaagtatccaatcttcgggaaaaaagaagaaaaaatcaaaacaaaaggtattatttgcaactaatatggcttattcgggaaaataatttattggtttaatgcgtgtagaagtaaagaggtataatttaagagtagtaaaaccacattcaaactaaaataaaaccgaagaaatgaaaccgttgtgttacctttttttctcaaaaatattttttaatatattttgtttacaaattttatgtaagtcatcttattttatttgttttagtaatgaataatgacatgaaatatttgtgtttaataaaattgatttaatcttaaaaaaaaacggacgcgtggg

SEQ ID NO: 623 - DNA, 1595 bp, Diabrotica virgifera
  misc_feature (787)..(787): n is a, c, g, or t
catgtacattatatttaaaaacagtattgtttaaatataaaataaattcttgacgattgtcagacgtagaaaatgttacaaagtgtaaaaaagtacgatactattatcagaaccattgatgatgatgaagaagttgaagatttatcagaaaacagtgatgaggaaatagagtttcaaccatccaaacaaaaaactcgaagtaaggaggattttgatacggaatttaattttgtcagttccgtagaagaatataataaagatgtttggaatgatttgactaaatacgttaaaaggaaagcaaaacaaaaaactgatgacaaaattaaaaaagtcagaggcacacaagctgatgaggatcaaacaaacactgaaaacggtacaaatgatcttgtcgattccgatatatctctttcagaagatgaactaaaacatgataggattaaacttaaagaaaagaaaaagaaaaaagtaaaagctgacaatgatacagaagcattttttgaagaggttgaattaaattctggagaaactgttagtttttatcagatgaatctgtcaaggcctttgttaaaggcaattgctgagatgaaatttgtacatcctacacctattcagtctgcgacaattccagttgctttattaggaagggacatatgcggttgcgcagccactggaactggtaaaaccgcagcatatatgttgccaactttagaacgacttctctatagaccatcagatggaaccacagttataagagtgttagttttggtaccgacgagagagttgngtgttcaagtataccaggttactaaacaaatatgcccgtttagcgatatacaggttgggcttagctgtcggtggcttagatcttaaaacacaggaaaatattttaagaaagaatccagatatagtgatagctacgcctggaagacttatagatcatttaaaaagtactccatcgtttagtttagattcaatagaagtgttgatcttggacgaagctgatcgaatgttggatgagtattttgccgaacaaatgaatgaaatagttaaacagtgttcacgtaaacgccagactatgttattttcggccacaatgacagaagaagtagaaagtttagcagcagtatctcttaccaagccagttcgattatttgtagatagtaatcgcgatgtagcgtttaatttaagacaagaatttgttagaattagatcagacaaagaaacagatagagaaccaattctagctgcattagtttgtagaacgtttagagaacattgtatggtgttcgtgcaaacaaaaaagcaagcgcatcgtttacatattgttttgggtcttctgggtctcaaagtggctgaattgcatggaaacttaactcaaccccaacggttagaaaatttagagaggttcaaaacgaagcaagttgatgtgcttatagcaacagatgtagcagctcgaggtcttgacattgtaggtgttcaaactgtgataaactttgtgatgcctgccacaactgaacactatattcatagagtcggtagaactgccagagctggaagggctggtgtgtcagtaagcttagctggcgagaaag

SEQ ID NO: 624 - DNA, 903 bp, Diabrotica virgifera
  misc_feature (852)..(852): n is a, c, g, or t
agttgaatcattgaacaagaaataatttttttatttatatagatttgctgatggctccattttgtgtgatttgtatttttttattttgttttgtgtgctttaaacaagtttgatattggttgtgtgatcaacaaaaaacaagtactcaaatttagtaaaataaacttgtttgaagcgcgcgccatttgattgtgttttattcctatttattgtttttttgttcgaattttgccaattttggtaaaatttgacgtatttcaagtgttttttcattttttcactgaacgatttaaaattatccgatttgtgataattttcagttcagtgatagtaatgaaaataatatgaagatggcatattttgtcaacttcttggtgatttttcatttttttaatgcatcaagattcatctctggtgatttttcaatgcatcaagattcatctctggtgatttttcaatgcatcaagattaagtaccgtattacactttcgttaaattgatgttgagaagaaatccaaaatttaaatttaaaatttggaacattctcacatcaatcatgatcgaaaatgtaaatattttaattcaaggttccaaagttatatttttaattttggaaccatttgcatattggcgaaagaattcgttttatagaacaatttatttaaattgttcgttttgttcgtttataaatttggatcttcaaacccaggtgatcatagttgctagcagtcccagtgctagggtgtaaaagatgtccacctgcaaaattagcatagacgtccttcgtttattttaaattagtattttgtatatcaccagcagaaaaaagacatttttgcgcccacttgcagngccgttatcgccggcccctggtgctaggcatttttatcgcgccgttataaa

SEQ ID NO: 625 - DNA, 1246 bp, Diabrotica virgifera
  misc_feature (1097)..(1097): n is a, c, g, or t
gaaaattgattggcccttgaaatttaaaaataccttatttgaagacctgtacaagacttcctaaatgttttttatgaagtttgtctggttttagcattataaaacaagaattgatcgcacaaatttttatattagctagaaatattcttgctgcattcggtattttgaaaatgttttactttaaacattttttgactgagtgtaataatcatttcgaactaatatacattttatttgagttagggaccaatgttgtggagttgagctattttgaacagatacaatttcactaggtactaaatgctgcaacataactggattgattggttcagctactttctgtatcagtcaattgacagatgttttcgagtatttagtatctgtgaattgtgttatttcgatttttaatgtttggagaatccattttccaagtgttttctttacaaaagtattaaatatgcaattttaagtcttgatgacccatactataatcaaaattattatttttgagtttgtgaatgaacagacattttctcagttatttagttgaatcattgaacaagaaataatttttttatttatatagatttgctgatggctccattttgtgtgatttgtattttttattttgttttgtgtgctttaaacaagtttgatattggttgtgtgatcaacaaaaaacaagtactcaaatttagtaaaataaacttgtttgaagcgcgcgccatttgattgtgttttattcctatttattgttgttttttgttcgaattttgccaattttggtaaaatttggcgtatttcaagtgttttttcattttttcattgaacgatttaaaattatccgatttgtgataattttcggttcagtgatagtaatgaaaataatatgaagttggcatattttgtcaacttcttggtgatttttcatttttttaatgcatcaagattcatctctggtgatttttcaatgcatcaagattaagtaccgtattacactttcgttaaattgatgttgagaagaaatccaaaatttaaatttaaaatttggaacattctcacatcaatcatgatcgaaaatgtaaatattttaattncaggttccaaagttatatttttaattttggaatcatttgcatattgtcgaaagaattcgttttatagaagaacaatttatttaaattgttcttttataaatttggatcttcaaacccaggaatcatagttgctagtagtcccagggcta

SEQ ID NO: 626 - DNA, 951 bp, Diabrotica virgifera
cgttaaccacatcaaaacaaagtaggtaggtagaagaactagatctgcttgaaaatggaaacaaaatcaaacaaccccaataaaaagaagtccaaaccagtaggcagaaatgcatttatatatactcgagaacaaagacttgtgatgactgtgtggtaccacgaaaggctattcactggattaacttttgaccaattgagtcaaaattttttagtgagatttaaaactgcatccccttcttataaatccgttattttatgggaaaaacaattatttaaacatggaagtattcctgttacgaatagtttaaaagttaaaaataaggcaactctagctagattggtacatgttccatatgttaaagaatccttaattcgctttccagatcttactctaagtggacgagctcatttcctcggattgtgtacgggcacactatcaactatattaagggaagatttaaaatgtgatttagatcagcagaaaaaggcagatacagaaaagaaatgaaattattagattggaaaatgctaagaatttctagctctaaacaatgctcgaacacaaaattaatatgctttattaatattatgtttcagttatacataaacttgtttaaataaaggtgactgaagtgttacttttttctaaaatacagacataataatgcattagttaattttatcaagtatgtataacctattccacgaacaatgactgttttggattgtctagataatgaatattttactgtgcaaaatatgaagaacgaaaataacttgcagattacattgttgtttattggaataattattagagccatttacttttgtacttctttatgttgcagactaaaatattcattgtctcgacatccaaaacagtcatatattcgtggaatggcttttatttttatatcaagtgttttcagtggttttaatgcctaaccag

SEQ ID NO: 627 - DNA, 1254 bp, Diabrotica virgifera
  misc_feature (1248)..(1248): n is a, c, g, or t
acttgatgttgcgaatatgtaacatgtgccaaattgtatgtacttcctgtgaaaatatttcgcggcacattttgtgaagaattcttttagacattgtaataacaatccaattgttcaaaaatcgacaagcttatgcaaccaaattcacattataaatgtagaatttgtcattagaatgaggattagtgtaactaacgacttaacattaaataaaactatgtagccctacttcctgaacaattaatttggtaacgactttgatctaaaagtcgaaaaactaatataaaatcgtcaaatattgttttattgctttccatgacaattaagcagacctttcttacgagcaaatatactacattcatttccattataagctgagacgcccgtttcagacacgttatcggtgggtgtgtcgttcttcgcagcttgtcattggttagagattaatgacaagctgcgacggcaaaaacacttactggtgacgtgtctgaaactggcgtcttagcttatcttgagaatgaacgtagcataataatattcaaatataataaggtgcaaaacgattaggctaatatagataaacctattaaagctaatagttctattttatcacccggatatgtaaggcatttaaactgttacgtgggagaattgttctttcatactatttagcacgacttgtccgctttatgaggaattaagacattttatttaagtcttagtaaatatgttcttaactaacggaattcttgctaacattgctgattaagaacaactcttctaccaggattagatgggagtcatatcgaaaaaattgagcaagttcaatagaatatcgtgtacagagaattgtccaaagaacatactaatttggggttgtgtgattgacatccttatatctgaagtacacatgttgaacacgtttaagctcagttttgccgataagtcgttatttcaaaggtcaaaataaacttgtcttactctttttattattggcagtcaattcaaacgtacctacatgctcattattaaaaagattaagacaacgatgatttgccctttggaaatggaaaagtagttgaatatccgctttctgcatatttaagaaaaatacctgtcaatcgtcaaggcggttagaactgtgaattaaggtgccaaactagaaaataagaagtattacattattagacaattatatattggtgtcatattagcatgtcaatgtttatttcaaatatatgtgtttanacctcc

SEQ ID NO: 628 - DNA, 1156 bp, Diabrotica virgifera
ggttaataaaaatagaaaacatttataacaaattttctgttttatattatacaagaaaataatgttaatgtgaaatatgtggcgcagctcattacttttttccaaaatcttcaacaatccttttcctaaagggattattgctcaagaaaatatatcgcaatcatggcttcgaaacactatattcacctcttctcctttgaaaatgttcattcaaacacaagaaactccaaatccaaatagtttaaagtttgtacctggggtacaagttctagatcctggatcaaccatcgatttcccaaatggacaggcagcctattgttctccgttaggaaaattactttttcgagtcgaaggggtcaagagtgtgtttctaggtccagatttcattactataaccaaatcagaggatgatgaagttagttggaaactgctgaaaccagaaatttttgccacaattatggatttctttgcgagtggtttaccggttttaaatgaagccagtccgaatcaagacacacaaattaatgaagatgatgatgagacagttcagatgattaaagaactgttagatactagaattaggccaactgtacaagaagatgggggtgatataatatttgttgcttatgaagatggaatagtgaagctgaagatgcaaggagcttgttccagttgtccaagttctgtagtgactctaaagaatggggtgcaaaatatgatgcagttttacatacctgaagtaataggagtagaacaagttttggatgaagctgataaagttgcagagagtgaatttaagaagatagatgaaaaaatttctgcgaaggaagactctaaatagtttaaagaatattataattagttattttcataggtcttaagttgagcatgtacatattttaaataaatgttattttgttgaaaaaaaaaaaaaagggccggccgtccaaaagaatccagtttaagtacgggggcttggaacttaaaattcttctataggggcccctaaatttaattcctggccccgcttttttaaaggtggtaatgggaaaaacccgggcgttaccccaatttaattcgccctggccgacatctccccctttccccgtgtgggggttaaaaagaaaaaagaccccccacccatgtccctttccca

SEQ ID NO: 629 - DNA, 1256 bp, Diabrotica virgifera
gacgagaaaagcgaaaatttgccgttttctgatcttcatttgtttatgactatgtatatcatcaagatcggctgcaggaggcatggaggttattaatgtggatgtccacactactcggagaatttggtttcggcctgaagggggacgcgtcacgagaaaaatcttatttctctggactattaaactcaattgacgttgtctgatcatattttcctcagtcgtcccaatgatctttcatttggcgatttgtctcttgctattcgtactacatattctattttctgtcattatctctatgtgttgattccattgtatttttcttcttttggtccacatgtttatttcctctatacgacatctcgctcgtatttcctcacttcttactctgtgttttagagtttagttggttatttttcgtaagacttcatttctgctgtttctagcagtctttttgttttcgctgtatctgctcttttttcgctgtgtacgtcattatcggtgttattattgatttatatatcctggttttcgtttccgttgtgagatatttgtttctccagattgtgttgttgagacatctctgttcgccatgttgacagttttattcccaagtattccgtttccatcacttgttctattattttgttatttacgaccagtttacaatgtctcagttccgttgatatcactatcgatttagttttttctgttgagatcaccatgttgtatatgaacgccgtgtcttcgaattctttaattaatctttgtaggtcatcttcattttcggttgttattatggcgtcgtcggcgtagcatatgatctttatttccttttctcccattttatatcctcttctttttctaccgttctttatgatttcgtccatcattatcagattaaatatcaatggaatcagcgaatctctttgtctaatgccagtttcatatttgaagggttgcgatagttttcctttacaccctaacataacctacgtaatctttaatattaaatttcccaaagggtttttaccaaaatcccgggaatattccctttttccttataataaattaaatattggaataccaataatgggggaaaaaatttctttccaaaacggaaataacaggaacgtaaaaaaaaaaaagtattttttcgaaaaatttggaaaacaaaaaattttgtgaaaaaaataattaattcttttctttttgacaaaacaaaattggcacaaatttacctctattggattttattt

SEQ ID NO: 630 - DNA, 940 bp, Diabrotica virgifera
  misc_feature (909)..(909): n is a, c, g, or t
agtaaatagttgtaaaaatataaattcattttttagaagttaaaatgtcaggatccttaaaacagttaaaacggataatcggacgaaatttatcagtaaaatataactttctaccatctgtgaggttattaacatcacaaactacaaatgatggagaaactcattttggatttgaaaaagtgaaagaacaggaaaaagaaaaaaaagtctttgaggtgtttgaaaatgttgctgtggactatgatataatgaatgatacaatgtctctgggaatccatagactatggaaagattattttatgtgtagcttatctcctacaaataacacaaagttattggatgtcgcaggaggaacaggtgatataacttttagatttctagattttgtaaaaaatcaaaatttacaaaattgccatgcaacagtatgtgatattaatccacacatgttagaagtgggaaaattgcgaagtagtagatataattataatgcaaatatggttagttggaaagaaggaaatgcagaaaagttggattttgaagataattcattcaatgtttataccattgcattcggaatcagaaatgttacacatatagacagagttctatcagaggcatatagagtgttacagcctggtggaagatttatgtgtttggaatttagtcatttagaaaatagtactcttcagtggttgtatgaccattacagttttcagttaattccagtattagggcaacttattgccggaaagtggcaaccatataaatatctagtagaaagtattagacaatttcctacacaggaaaactttaagctgatgatagaggaggctggatttcgccaagtgacatacgaaaatcttaccatgggaatggtagccatgcattctggatttcaactatgatatnaataaaaaattgtttatttttctcttacatt

SEQ ID NO: 631 - DNA, 1112 bp, Diabrotica virgifera
tattttttcacaaatcataacaaatgcttcagatttgtggttatctcattggactaatgttgaagctagaagatatgtctcaactttaaacttatctactgaattcatttctacaacgatttcttctataaacaaccataccgtgacagatatgctcaagtctgtggcttttacaaacacaaatcctcaggaaattatcacaactgccgatccttcagttagtgcttcaaagttgtcttcaaatatgtcatcactagagttggaaaattttaaaagtgaaggatactatatatgggtatattcagctttgatcatagctgtagtaatattacagatatggagatgctttttgtactatcaagtgtgcatgagctcatctaaagcattacacaataaaatgtttcataatatactccaagcaccgatgagattttttgataccaatccgtcaggtagaatactaaatcgtttctccaaagatatgggagctgttgacgaattactaccaagctgccaaattgatgcgattcaaattttgatggtttttgttggtatattggtaatggttgttatagtaaatccttggatgatccttacaaccataattatcggtccggttttgtttattcttcgaaaaatgtacttaaaaaccgctcaatcagtgaagagacttgaaggaatctcaaaagcgcctgttttctcgcatatatcagcatcactgtttggaattaccactattcgggcatccaacgctgagaaaatggtcactacagaatttgatattttgcaagatcaacactccagtacatggtttttgtttttggtcagcggaagagtatttggattctatctggatgttatttgctgcatatttttggctattgttacaattcagtttttactttttagagacgagaatacgttgagtggaaacgtaggtttagccatttcccacagctacatcttaactggtatggtacaaatgggtatacgccagagccgtggaagtagccagtcatatgataagcgtcgaacgaattttacagtataccaaattagaaaaaggatggttgtatttgaatcactgcctgctaaaaaaactccccgagact

SEQ ID NO: 632 - DNA, 1258 bp, Diabrotica virgifera
aaaaatgagaaaaacacgaccgcagcttcgtagtgtcaagacaaaatacgcaaatccatacattgtattttttatttttgtcttagttatttgtatattttacttttcactgaaaagctcaaaaagcttaaaaaatgaagttgatgaggttcaaagcaatgaagaaatcaaggaaccatattttaagagagaaaaaccaatatcttttaaaggccataaggttgtacatttagatttaaaaggcgccccgccaaaaatagatttttataaagatttatttcctttacttgccaagtttggagcaacaggagttcttatagaatatgaggatatgtttccttataaagataatttgataaatataagtgccacaaatgcatatacattacagaatattagggaaattaatagattagcaaaagagcacaatttgacagttatacctctcattcaaacatttggtcacttggagtttgttttgaagcttaaagactatgagatgttacgagagatttcagagtatccacaagtaatttgccctacacatcaaaagactgaacagttactagaaactatggtacaacaaatgcttgcagctcacccagatagccaattcatacacattggggcagatgaagtgtattatctagggatatgcgaacgctgtactgacactatgataaaacataacctttcaaagaatctcttatttatagcacatattaaaaatgttattagcattgttaaacgttttaaccctcatataacggtattaatgtgggatgatgagtttagatcttttagtgatgcagatctggctaatagtaatttacataataatgttgaacctgtgatatggaagtatactaaagatgtttatgatgagttaggtcctaccttgtgggacagctaccaaaaagtttttaaaaatgtttggattgccagtgctttcaaaggagcaacaggcagcaatgagattgttccatatgcaacacactatctacaaaatcaccgcagctggatgcctgtggttgcagaatactcaaatcaggttaattttaaagggatcatcattactgggtggcaaaggaatgatcacttctgctgggctctgagaaaaaattacctgccgccctacccaccatggacatggaatacgaccaatttgaccaggctctccgacgcttccccctccaactccccccaaaacgaaactccctacagaccatgcaaaagggggcaacacctcagcccctcc

SEQ ID NO: 633 - DNA, 1285 bp, Diabrotica virgifera
gacacgatagtgcgaggtccagtgggtgctgtaattttcacatttttccatctttttaaaagactagttaaagttaaattcaatatataaggaaatcaaaaagatatattaaaatgctttccagggcagcaattctttcaggacaggcctcaaaatctctagtagcaaattgcttaagagctacaagcacttcgaccgccaatacccaagtagccaaaactgatgaaagacctggtgaagtagcttttgccagacctgcaagacaagaaccaggaaaagtacgcatgggattcattcctgatgagtggttccaatttttctacaaaaaaactggtgtcacaggaccttacactttcgcagtcaccttgtctacatacctggttagcaaagaaatttatgttttggaacatgaatattacagtggtctctccctattgattatgtgggtatatggtatcaagacccttggtccaaaattggctgcatatcttgataaggaaattgaggaatatgaaaacgcatggaatgaaagtcgtgtaaaccaaaaacaatctttgaccgaccaaatatccgatgaagaaaaagcccagaaaagcatggaaggccaaactttattggttgaagctaaacgtgaaaatgtagctcttcagttagaggccagttacagagaacgcctcatcagtgcatactctgaagtcaagaaacggttggactaccaagtagagaagcaaaacatcgagcgcagaattacccagaagaatcttgttgactatgttgtagctaaagtacgatcctcaattacagctgatcaagaaaaacaaaatattaacaagtgtatcagcgatttagcaggattggctaaagcataagattacatttaataaatgtttaagtatgtatgtacagtctataagtaagccccaaagtgtagacgaacatttttaattttcttttctttttattcttacacagtacatttatacgtgaaataaaataaattattataagaaaaaaacaaaaaaaaaaaagggggggcccctccaaaaggatcccaggtttaggaccccgggggatgcgacgtctataactttctctaatagagggtccccaaaatttcatttccccgggcccgcgcgtttttaaaacggccggggaacgggggaaaaaaaccggggggttttacccccccattaaaaccccccctttggacaacaacacccccccctcttctcccccaggcggggggggggaaaaaaaaaaacaaaaaaaagaaggcccccccccc

SEQ ID NO: 634 - DNA, 1223 bp, Diabrotica virgifera
cccacgcgtccggaagcggtgagttttgagtttattagtgtttaagtttagtgttacttttttcgctaatttatataaaaatataaactatttcttcgttttaaaatggctaagccaggaacggactcggaatccgataaagaaaagaaaaaagagcgaggaagagaaaagaaaaaacgttcagcttcaggaagtagcagtagtagtaaaagcagttcttcagacagtagttcttccagttccagatcttctagttcgtcaagctctgcttctagctctcgatctagcagttcttcgtctgattcttcatcgtcaagcagtgacaataatagaaccaggtcaagaaaaaggtctggttctactgctaaacctgcagccaaaggaagagatgtaaaagataaagaaaaagataaggataaggacaagaaggaaacaaaagataaggataaagaaaaagagagagtagattccaaaaaagatgaaaaagaaaagaagggcttaactccaaccaaagaaagagataaagataaggagagggatagaaatcatatccgtaatagatctaggtcgagatcaccaaggaaacaacgccgtcgtcgttctccaactcctcgtcccacaaaaattcatattggtcggctcaccagaactgtcaataaagagcatattatggaaatatttggaacatatggcagtattaaacatgtggaatttccaaaagatcataaccatcaacatttgggacgcttatattgctatgttgagtatactactgctgacgaggcagaaaatgcaatgaagcatatggatggaggtcaaattgatggacaggaaataacagcagccccagtattgatcccaaacccgaggctatgcctccaaggagatcaccttcttcctccaattaaacgaggacctaatacataggagaacaccccctaggtttaaaaaaaaatggcccctaaaactataaaaaaaacatcccctaaaacgcaaacaaactttttaaaagccccccccctaaaaaaaggaacattttcaaatttagcttctagaaattcttaattaaagtttttgaaaccacccgggagggtaactttgaatttttggtgaaaaaaaaaaaaaaaaaaaaaacatttggcccggggaaaaaaacaaggtttttttttaaaaggaacataaattttaaaaaaaaaaaaaaaaaaaaaaaaaggggggggggg

SEQ ID NO: 635 - DNA, 1124 bp, Diabrotica virgifera
  misc_feature (804)..(804): n is a, c, g, or t
  misc_feature (819)..(819): n is a, c, g, or t
  misc_feature (845)..(845): n is a, c, g, or t
  misc_feature (851)..(851): n is a, c, g, or t
  misc_feature (861)..(862): n is a, c, g, or t
  misc_feature (901)..(901): n is a, c, g, or t
  misc_feature (913)..(913): n is a, c, g, or t
  misc_feature (943)..(943): n is a, c, g, or t
cgtatgtttacgtatatgaaattccccacaatgtacgacaaagtacaaatctacaaatagtagtgaggtgctgattcattatttcatacattattttgtagttgtttgaaactaaaacatggatcaaaaaaatattttgtgccttttcgacgttgatggtactttaacaaaacccgtaaacgtgatagaaccagaaatatattcgtttttgttagacaaagtaaaggcatgttgtactgtggggctagtaggaggctcagacttcaagaaaattgcattccagatgaatggggatgatgtaattcataaagtgcattacgttttttcagaaaatggtctagttcaatacaaacatggaaaagaaattggacgacaaagtattcagaattttttaggtgaagataaaattcaaaaatttatcaattttgtgttacaatatctctcaacgataacacttccagttaaaagaggcacctttgtggagttcagaactggaatgctcaatatatctccaataggtagaaattgttcacagcaagagagagatgcctttgaaatatatgataatgaacaccaagtacggaagactatgatagaacagctcaagaaagaattcccagatttcggtttaacatatagcataggtggcaaattagttttgatgtctttccaaatggatgggataaaacctattgtttacaattgttagaaagagaaggctttgacgaaattcatttctttggagataaaactcattaggggaggtatgattatgaaatttatagtgataaaagagtaataggncacaaagttactggntccttagacaccaaaagacaattggnaagaanttactcattnnatataaatgtaataatctaatgtttttattttatttaancacattcacggnacacgcttcacatgggtagacacgttttcnttatggggagtaaatgacttcataatgcagggcgtgtcctgggggatggggaaaaaaaatataaactgggtaaatttttcctttaaatttttaaacccccaaaaaatttggcctaaaaagaaaggggcccccaaaaagttgggaaaaaaaataaaaaatttatttaaaaattttttttttt

SEQ ID NO: 636 - DNA, 1106 bp, Diabrotica virgifera
  misc_feature (1081)..(1082): n is a, c, g, or t
cccttttgcgtccgattacgaagatatcgttgtaaagtaaatacccttataagaagactacttagatcataatagtaaatactttgccggaggggattgccactgtacagcgagattggatggtcgttttcagaaacagaaaatattaatgtaaagtaaatattaacataagaagactacttagatcataataggtgctactctggttcttgcttgcagaaatattaataaaggattggaggccaagaagtacattcttaaatattcaaacagtaaaaatatcaaaatatttgtcaaggaattagatctctgtaaaatctcgagtattgttaagtttgcagaaactttgaaaacagaatttactgagatctatgctttagtaaataacgcaggagttttttatcaccctcaagatttgacagaagatggatttgaaattactcttcaaaccaactatttaggtccatttatcttgacgcatcatctgttggacttgctcaaaagatcagtacatgcgaggatagtgaatatttcttcagaagcacatcgactcgtcaatgtgtatgatttaaatgcagtgacgaagtgccaaacagaatttagagacaactttattgcctacggagtgtccaaattagcgatcaatttatttactaaagaattatcacaaaaattattgagtaccaacgtaataattaacgccgcaaatccaggaaacgtcgaaacttcaattttcagaaacttccctcccttgagcaacccatggttgtatgctcttcagtggccaatacgaatattagtcatcaaaaatcccaaacaaggagcgcagacacctctccatcttcttttaacgtctaatagaacgacagggcagtattttagtgattgcaaattggcattacccagcccaatcgcggccagcgacaaagcagcccacgactattacgctctaactttggaaattcttgctgacaagtttaatacggaatctgagtggtaaataatggtttatgagtatttaaacgatagtattaaaaaagagattatagaagaaggacaatgggggggataaacccggatnngaaatagtaatgcactattactat

SEQ ID NO: 637 - DNA, 1440 bp, Diabrotica virgifera
aaggatgctttgaagaagcagatcgagaatatgaaataccaggcggctatggagcggtggcctctgtcaaaatctattgcagcaatgcgggagtatgtcgaagaaaacgaaaagaacgaccctctcatccacgcccccgacaaaaagaataacccttgggcggagaaaggaaagtgcgtcatcatgtagaatcaacagctgatcttcggcttcctagttattattttcccctttctgataatgattttgcccaacattaacagtttgttgcttaatccgatagtcctttattagtttcgaatccggatccgaatccgaatcctagaagaatatgctccagcggcgcagcagtccattctgacagtgcatccaaaacaaaaaccctaaaagattttccaagaatgccattgttatgtagtttaactataaccagtttgaaatttttaactattttttattacacgtagtctaaggagtggaatttttatttccagtcgtataagccggtcaaaaacctcgtggaggatagattactcacctcatcttctatccaatacgcccaggagctttgctggggaggaacaaacaacaaattaaatatattatatactgagtgtatctagcttgatattagctttgttggcaagtgtaatctaaggtgacccagctgtaacccagcaattattaaaaattttattacttttaagatactcacttatatatatgctatgtgtgtatttgtagggtagttattcaagattttgttcctcccccaacgaaacaagcaaaaatcctttcttttggtcgttttatacctacacaagtaaagattccgctctaaaatataacatattttaaataatgcttgtttgtgtacttttattactatcatagctgtagaaatatttattgtatgatattgcaaaagtatcttatttatcccttttgaaatacaagacgaatagttagttcattatgacaaaatgacaatttacatttaacactgttattgcttatactcttaaactgttatactaccaccctattccttatttttcagctcattgataaatagggcccccaatgaagctcttctccccccccccctttttttgggtccaacatatgacgaacaaataatataatacgccataacgtcatttgtcctaactccttccccccgatggaaaagtcccttctggccttaacaaatggccaaaaatttaattttttttgggttattttcccctttggggggggattcctagaccaaaaaaaaaaaaaaattttaaataaaaaaaataaattttttttttttttttttttttttttttttggggtgggggggaaaaaaaaaaaaaaaaaaaaaaattttttttttgtgattttttttttttttttatttttttttattatcgccccccccccccccttcttctt

SEQ ID NO: 638 - DNA, 936 bp, Diabrotica virgifera
cttttagagaaagcttatatgaaggttatgggaggatatgattttccaggaagcaacagtaacattgaccttcatgctttaactggctggatcccagagagagctgcaataaagaactgtccagactttaacaaggacgcggtgttccagaaaattgaatcgcgcatggcaaaaggagacgttttggtgactgtagctacaggagagctttccgatgcacaagctgaaagaactgggcttgttgctactcatgcttatgctgtaatggatgtgcagactgttgatggggtgcgattatttaagctcaaaaatccctggtcccatttgagatggcgaggaaactactccgaactggatactagacgttggacacccgagttacagaggagactcaattttgatccgaacagcgcagctcagttcgacaacggtgtattttggatagattatgacagtctttgcaatttcttcgatgtattctatatgaactggaacccagaactgtttaagcatacaacctgtattcatcaatcttggaatgctggaactggtcccgttaaagatctttacaccatctcagcaaatcctcaattttcgttggacgtacaaggagactcacctggagctgtatggcttctcctttccagacacattacagatattgaagattttagggacaacaaggagtacattacgcttttcgtttatcaaggaggaagaaaaatttattatccctttgatcctcctccttacattgatggagttaaaatcaacagtccgcactatctctgcaaaatattgttgagtccctggtctagcaggaagttttacagttgttgtttcccatatgagaagtctacaaccatttattatactttaagagcgtatgcgactttaccatttacgttgacgaaaatagttgatccgtacaaatat

SEQ ID NO: 639 - DNA, 960 bp, Diabrotica virgifera
  misc_feature (872)..(872): n is a, c, g, or t
  misc_feature (893)..(893): n is a, c, g, or t
  misc_feature (895)..(897): n is a, c, g, or t
  misc_feature (917)..(917): n is a, c, g, or t
  misc_feature (926)..(926): n is a, c, g, or t
agatgacttgcgttggtctaattatggtttaagaatattaattaatactgtatcccacccatttgaatacgcaaaagtgttaatacagatcggctatgaacctattccccctaggcctggaaaaactttttttggaaaaccagcattgaagttaccaaatatttttgagtatgtaaaatatattaaatcagtagacggattcgtgggctgttacaatggccttgctcctaaagtttgtggtaatattatgagtgccattgccactcaaaagttgctggattatctggagcctccatcagaggaagaggagtttggggaagaacctacagaagacgagaagaggaaaatttttgttaaaggtgtaaaaaatgaaataataatccatacagcagctatagttgttagccaaccttttcatgtgattactgttagaatgatggcacaatttattgggcgagaatcaaaatacatgggtatcttaagctccttgagagaagtctaccgtgaaaatggacttgtaggatttttcagcggcctggttcctagattggttggagatataatatcccttctgcttgttagtagtcttacatatgctatcaataattatgttatcgaagaaaaagaactcggtatctacactggatcaatcatgagttttttggcgacatcagtaacatatcccttccaagtgatttcaaactgcatggcagtaacgaacagcggattggtagccggctctccaacgtacatgccccactacaagtcgtggatcgactgctgggtggatttgtccaacagaaatcaattgaaacgcggctccagtatcctagtccgctactacacaggaccttccatcgttattggaggancagccgttcccctttcatcanannngacaacagtaatttcttaangttgacttncagatgcaatcatagtaacttgtgcgattgtaca

SEQ ID NO: 640 - DNA, 1311 bp, Diabrotica virgifera
atctgctgaaagtgttttaaaaaactgtttcatttactatttttaataaattatgacggaaaaagaaagtgttagcataccaacaaacgaagatattgtaagtgaaattactaacgatttacaaacggaattaaatgtaactgaacctaattcagaagaaatacttaatagtcatcataatgaaggtattccaaaagatttcgataaggaagaatctgatacagacactactactaaagacccagacgattatatagacgaagaacagctaaaggtattagaaaatgatttatctgatgaggaaaaagcagaaagacaccaaacagcattagaattaaaaaataaaggaaatgaacaatttaaatcaggtttgcatgtagaatccgtatgtagttatactgaggcattaagaatgtgctctttaaaatttgaaaatgatagatccatcttttatgcaaatagagctgcttcgaaaatagcacttaatcgaaaagaaagtgctatcgaagattgtaccaaagccatagagttgaatgattcatatattagagcgtacttaagaagagccaaactttatgaagaaacagaaaaattagatgaaagtctagcggattataaaaaagtgttagaactagataagaataataaagatgctttacaagcccaatataggttaccaccattaatagcagaacgaaatgaaaagcttaaaactgaaatgttaggaaaactgaaagatttgggtaatatgatcttgaagccatttggactatccactgaaaacttccagttaaatcaagatccaaattccggaggttattctgtaaatttttcacaaaataaatgacaaaatatgatgttattccttacattatagttagttaaatatttttaagtttattttattttattctgttgttgatttgttattatttttcatttttataaagtacgcattttatggagtacattcaacagaataagaactatataagaaaaaagtaatagtgcaaattatacagaagcagaataccagacttataagtatcagtatttaacattaacttctcaagaattttgctttttgatcatctacaatatttgcaatgattttcccaaaaatggttttacgaaaaattacataagtgcatcaaaattacagagaatttacactatacaactaaaaagtaacgctataactatatttttatttcggaaaattcctaaatttaagcctgtatgaagtaaatatctgggatttcccgattagaatgattttactggactgaaatgcatttttgtatgacataa

SEQ ID NO: 641 - DNA, 828 bp, Diabrotica virgifera
  misc_feature (804)..(804): n is a, c, g, or t
gtgataacaagaactaactacctaccaaaacaatgaagtcgatagtagcagctattctccttgtcgccaccatcgtctctgctgagcctccacgtcaatttctgagacagaaagccgcggaagctccctacgaaccaagtggttggaaaccaaatggacctcttctccagtacccagtgagaagtaacgttcaagcctatggagctccagaacctcaaactatctatggacctccagagccacaaagcagctatggacctcctacgaacgacactgagttagagcctactacaactgaaacatttgaagaaactactactttggagccacaggccgaaaatataaagacatcgccttcatcaggaaaactacaagccaaaaaatcagaaaaatccaccgctccacagccaaaccaattcttcttcatcgtgaacccagcccaatctgaaagattggtcttggcaccattgagagttacaccagtaaatgcaaaaccagttgcaccaataagggccccagcacgtgtcgctgctccagctcgtttggaagagtttcctcaggtagtagaagtagaccaaacagttcccgttcaagtagagcaggccgtacctgttcaatacgcacaagttcaagcagttcctttccttcctggatatgtttctcaatcatcgattgtgacaccatacagttcctcttttgtacagatttaccaataatcttttgacaatcgtatttgtgatgctattttatttatttaatgtttacaataattttaaggctttattaataaatgtattgaatttngattgaaaataccagagggataat

SEQ ID NO: 642 - DNA, 988 bp, Diabrotica virgifera
gtgaggtctgggttagaataaataagtagtatttatatactttttataactacttacttatttggtagaaatgggtttgattgagtaattaatcggaaaaatggtgaggaaaccgaggaaatccttctggcgcgtgaccaggaaaactttaaagcatttggggatattgggattcagcaaaaatgaaaacatcctcggtatcaaccccattatcgtttccactacctacatacttctcactttgttcctcgcatctgtattaagaaaaatagtaaaattaatttacggagacagcgaaaagttcagcaaacggttactattagaatttattgccactttggaattgtgtgcctgttgttatgaactcattataattgctgataactggggtatatcagcttacgcattctacctatttttgctgaccgtttggtgggggtcgaactggggaagtgcaagtgcatgcccatactctcctatagaagaagttattgaaggtaaccaagatatcaaaacggccttttggttgattggtgcacaattagcaggggcccttctaacattcagagacgttcaagtcctttggtcactagagttagtagaaacccacttagacaaagcctatgaagactgcaccacagatctgcaagtagacacgggtcttggaacgataatcgaagctggagctacatgtctgtgtagaatcgtttcgagaattttaagcgaatccgacgccaaactgtgcaattatttcgacgcgttttttgggaccatgatggtggttgcagcattcaatttctccggaggatacttcaacccagcgttggcgacatctttgaagcttggttgtgatggaaatacctttgtgggacatgtgatagtctactgggttgtggccatcataaccggcgccatcttatttaattttccttttaaaaccacggggtcttccaaaaaataaaaaccttctcgggacccaaaaaaccca

SEQ ID NO: 643 - DNA, 856 bp, Diabrotica virgifera
aaactgctttttcaaggcgttggacactgtaactaaaaaactactcgagaaatccacctaagattttgcatatattttctatatgacatttcgtgaggtaaagctgtcgagatttatttgtttttatgcttatttttggcttaacaataataaatatgttgattttcaccgtttttgttagaaagaatttcgtttttttttaattttcgagtgataccaaggactcaaaaatcgttaaaaataaaaatattcgaccgcattatctcgagaaacttattaagctaataaaatcttattaaattttttgtttcacataatccagtaacgaagttctgatgaaatcaattttttttaagtgtctgtaaaaatttgccaccgttgggtctatttttcaaaatttttgtttgaaattttttgtttaatattatttgaattgtacttgaaaatgtaatcgtaaattgtcagttttagacaattcagtcattgcttaccgtaattaataattttctctgaaaaatgaaaatatctcagaaactaataaacttagacatagggaatgttattaaaaaattaaagtacggtaatagtacttttcgatagtgatataaaatacagggtgtttcatttaaaattactgagaaaataatgtatttgcgttttgactcaccctgtattcaatataaagaaaattaggaatatcaataatttatgaaaattttgacaaataaaaaaatatggcatcaataaaccattgccgttgtgcttatttttattataccagggagttgacttgttacgatttcctataaatttgttatattttgtaatatcctgcatatataccaacttatatttt

SEQ ID NO: 644 - DNA, 926 bp, Diabrotica virgifera
cggacgcgtgggttgggatttaacaaatacgtcgttctaaatttctaaaactgcatacaaaaaatccttaaaaaactagtgaagattactaaagtgcaatagatacaaaaacaatatttttacgtattcaccataataatataaacgtagaaaatgaatcccgagtatgattatttattcaaacttctgctgattggagattcaggagtaggaaaatcttgtcttctactgagatttgcagatgatacctacacagaaagctatattagtaccattggcgtagattttaaaatcaggacaatcgatttagatggaaagacaattaaattgcaaatttgggatacagcaggtcaggaaaggtttagaacgattacatcaagttattaccgaggagcacatggtattattgtagtgtacgattgcacagaccaagattcattcaataacgttaaacaatggctcgaagaaatcgaccgttatgcgtgtgacaatgtaaacaaattactggtagggaataaaagcgatttgacaactaagaaagttgtcgacttcactacagccaaggagtatgccgaccaattgggtataccatttttggaaacctcagctaagaatgcaaccaatgtagaacaggcctttatgactatggccgctgaaataaaaaatagagtaggacctccatcttctgcggtagaccaaggaaataaggttaggttcgatcaaagtcgcccagtcgaaacaaccaaatccggttgctgctgaaaatatttagttctctttggttgaaggaggtcactcatgtcatctcttttgtacggtagcagcgctacagttactcttattctagtaatatccgtctgtatgtatagttattttaaagtttttgattgattttcaatttaaattttttttgtctaaatatagta

SEQ ID NO: 645 - DNA, 1711 bp, Diabrotica virgifera
  misc_feature (1543)..(1543): n is a, c, g, or t
  misc_feature (1608)..(1608): n is a, c, g, or t
ctaatttaggggcttagattagtatttccttatacaataagttaaaaaatatttattttcttttagtttaattgtttcgtctgtagcactataagattattaaataatttgtgttaattactacttaaattacaaagtttattgttactctagactctagacctaacaaattatatgttatcttaaaaaaatagtgtgttcactgcatgatactccacaaataagaatagttcagacagtaactttcttttaactatcgacacataagataacatttactccttggcaagttcattggtgccctaatcaatcacaatagggaacttgcacttttttgttttattatataatattgtttagtttcctttaaaaataagatttccaaaatttcacgcctcaaaatctcataataacttagaagtacaaatttaaaatcttctatgtatttaaatcatttcaaacgatctaaaaatcgcgcgaattcttgtgacgtcatatgatcatattttgtatgtcatttctaacgtctcatttaaattacatacaattttgtttactttggagttcaaaaacacagtttttgaagagatagtaatgaattgtgtgtatttttattatggaaaataaaagtaaatactatgaaagtgttgtttaataacattctgttaaattaaaaccattgaaactcccaataaaatatttattagattaccagcggataagaaacggagattaataaagtggttacaaaggacattaaagacatgttagttcattctcaaggtcttcatggatgcgaagctaatgctaatataggggcctgttgttttaatgtaatatgtgttgtctgcttaatagtctttttttataaatcaagtatatatagatggaaaagataaaaataatatataatatcaattgtgtgaaaaattttcttccttttgaaaatatgtggcacctggacaacataaatatatttacaatgggtaaagttatcagactgccctttaggaaaaccctcttcggtcattttaaaaaattgtcttaacaaaaacactcaaatattatgaaatatatagttcacagcaactatctaaagatttataaactgaaatagaccataaaatgattacaataatcataaacaatattaaacaaaaacttaatgaattaacgacgctgaatttaaacattataataatacgacgtcgcgaccaatcaggtcgccttttgggctggccgctataatgtgaattgtctctcgatattaatcatctttaggggccaaatgaaagaaaaaaacaacttttttcctttggtatatattttaaattatggtctgttgggatttatagcattttgtcgaatttaaaattctatgtaagttccctattcatttaggattgatgagagattgtaaagatcaattatgtcaacaaagctaaaatcattgtgaaaaagtggttatttacatagctacataaatagctttttcttacatttgtcaaagaatagagttgaaagggacactacatagtcttanaactaattatttcaagaagtattattcattgtcttgagtatttcaaactgaaacatcgtttcagngtgtgatgagtttacttaatattaaaatttacttttaatttaaataatctgcataagcttgaacagtatttagatttcagcaaacatatttgttattatcttg

SEQ ID NO: 646 - DNA, 905 bp, Diabrotica virgifera
cattattgttaagaagaatgaaaaccctagtgttattcatttttgtgggaatttctgctgcatatgctgaacccaagaaaaccaaacgtggtgtctttggggaacacaattctgtaggaggaattccaccaccacaatatggcccaccaggtggaggagctcacgcacatggtccaggtataggcggtcccagtggtccaggctttggaggtcctagtggatcaggctttggaggacccagtggtccgggttttggaggaaacggtggtcctggttttggaggacacggtggtcctggttttggaggacacggtggtcctggttttggaggacacggtgatcctggttttggaggtactaacgatccaaactttggaggtcacgctggcccaggttttggaggtcacggtggtcaaggttttggagatcctggtaatttagggtcacgaggtcctcttcgaggtccccaagtaggtccacctcaaccgttaggtacatccgttgacctggggaaacaagtactgaaacaaattaaagtaatacacagagtaggccatcattatgctatacctattggtgttaaatatgatcgggcagtacctgtaaaaatacctaaacatgttaatgttccaacacctttagatattcctgtacctgtacctgttcaagttaaagttccagtgtttaaagatattcctataccagttgagactaggctgacccgcgctgtcgaaagtaccccccattaccctttttgactcagatacctccacggaagtccgtgaaaaacctgtaccaaccactgctcatttcataacacaaaacaattttttttttccaagttacaaaatccttatacttttttttaaaccacccagaacaaccctctacaagtttttattaaa

SEQ ID NO: 647 - DNA, 933 bp, Diabrotica virgifera
gaaattctgatcacaaactagttctgcactatacattaaacacgatgctcgtccgatcgatattagtattttttgtcgtaattgttgcgtccaagtgtgataatgttaataacaaagtggaagacgaatgtcatttaccggagaaattggtcaaggaaattcaatcttataaacctacagtgcacagaatcatagatgccgtaacgaaaggaaggcacaagggaaaggtgtataaccatctatcggattttatcgatacttttggtgctagagtatcgggcaccaagaacttggaaaattctatcgattacgttcaggatttgttggtccaagctggattggagaatatacatggcgaaaatgttacagtgccccattgggttagaggcacagaaattgccgaagtcctggagcctcgaagatccaaaattggtgtacttggcttgggacaaacagctaatactcctcctgagggaataacagcagaagtcctagttgttcgttcctttgaggagttaaacaaaccagatatttcagcagcagctaaaggtaaaatagttgtcatcaacttccagtttgaacgttacggaagatctgtcaaatatagaagccaaggacctgtcgaagctgctaaacatggagctttagcggtacttataaaatctgtaacaccattttccatgtatactcttcacacaggatacctccaagtacaggaaaggatgtcaagaagattccggctctttcgatcacagttgaggatgctaatatgctacaaagatatcaggacaaaggtaaaagaattgtaataaaactacaagtagactcgcaacatctgcctgatgaaacgtctagaaacttggtggcagaaattaaggatcagaaaaggagcaaaaagtcgttattgtatccggtcatttggacagttgggat

SEQ ID NO: 648 - DNA, 953 bp, Diabrotica virgifera
atttatttttactctactttatttaaattgatcagtttggagccgaacaacttaaaaagcactactccttttaatttttataaagattgttaattaaataaagaaattatgattaattcgggaaaacttgctggccttacaatattcgtaactggaggaagtagaggaattggtaaagcgattgctctaaaggcagcgaaagatggtgccaacgtagtcgttgctgctaaaacagctgaacctcatcccaaacttcctggaacaatatatacagcatgtgaagaaattgaaaaagctggaggtaagagtttagcatgtgtcgtagacgtaagagacgaaaatactgttagaaaagccgtccaagataccgtaagcaagttcggaggaatcgatattttaattaacaatgcttccgccatatctttgacgggaactgcagatactgacatgaagagatacgaccttatgcacaacatcaacaccagagggacctttttagtaactaaagaatgtcttccatacctaaaaaaaagtaaccatgcacacgttttgaacatctcaccacctctaaacatgagcccccattggtttaaagggcatgttgcatatactatggctaaatatggtatgtcgatgtgcgttttaggacaacacgaagaatttagaccatataacatcgccgttaatgccttatggccaagaacagccattgatacagcagcgatgcaaatgttatctggaaaagaagcttctgctcagtatagtaggaaaccagaaattatggcagattctgcatacgcaattttagtcaaggaccccaaatcattcactggtaatttctgcatagacgacgaagtactgaaacagtccggagccactgatactgacataaggaactacgcctgtattcccgaaaatgctgataaccttatggaagacttcttttttttggg

SEQ ID NO: 649 - DNA, 1752 bp, Diabrotica virgifera
  misc_feature (1669)..(1669): n is a, c, g, or t
gctaaagcgacacgccgggatttggttccggtagaaaaattcagaaaaaatctattttttcgtttaaacaagcataaaaaataattaccaaatattaataaaacatttacaatcgtggtaaacgtattttgaattcatcatgtctgatctaaaatcctttctaaaccaatggtgtcagaagaataaaaaggaaccagcttatgaagtgagacccacgggacccaagcataggcagagatttctctgtgaactaagaattgatggctacaactatgttggagcaggaaattcaaccaacaaaaaggatgcacaatctaatgcttcaaaggatttcatctctttcttggttcggcaaggaatgattaacaaaaatgaggtaccagctgatattgatgctgctcctacacctgccattcaccacggccaacaagaaatgacaggtggcgggccgcaacatcaagtgtttgagaaaggtatgggtcctgccaattttggtgaagcataccgtcctcgtggtcgagaagatggagaatggcattatatggacagagctcaagaacagaaacgaatggaagaagcagaagatttagatgtgaatgctcaaattcatggaaattggactgtagagaatgccaaatctaagctacatcaattcatgcaagccaataagattaacacggattataaatatacacaagttgggccagatcactctagaacattcgtcgcagaactcagtttctatgttaaacaacttggaagaactattcatggaagggatactggatctaataaacagactgcaagtaaaagttgtgccctatcagttgtgcgacaactttttcacttgaaagtcattgaagctttttcaggaacattaaaaaaagaaaagaagtcagcaacagaaatgcctcctttccaagtaagactaagtcctaaattgaaggatcaaatttctgactgtttgaggtcattaaacgtgactcccactccagtcacctctaatcaagtggacgataaaggcgaacctgtacccgtgtctctactaagcagccacgttttagacgactttcatcccgcaaaacccacagcggctggtgtggttccgtggtcgccacctcaaccaaactggaactgctggacaggttgtaatatagacgaagggtatttagctagtgctacgttggatgatttaagtgaacagatgcttactgattggaaacacagaacagcgaatgattcttcgctgatcactagtatgcaagacagaatgattttgccggtatatacgaagaaatcagagattatggaagctatcaacgaacatcctgttattatcataaggggaaatactggttgcggtaaaacaactcaggtatgccagtttattttggaagattatgtaatgtctgggcaaggagcctgggccaacatctgcgtcacacaacccagacgtatatcagccgtttcggtatcagaaagagtggctgccgaacgatgtgaagagctcggtcagtctatcggttactcagtgcgttttgaatcagctttacctaaaccgtacggatcagtaatgttctgtacagtaggagtgttgttgaaaaaagtggaaaatggtcttagaggagtcagccacgttattgtagatgagattcacgaacgagatgtncatagtgactttatttatggtgttttgagagatatgatccacacatatcccgatttgagagtaattctatgtctgctacatcg

SEQ ID NO: 650 - DNA, 902 bp, Diabrotica virgifera
  misc_feature (856)..(856): n is a, c, g, or t
acggacgcgtggggaagccggcatttgcgcgccattgtagttagtactaggaaaacgggagttatttttgcatttaacaatggttgtttctcttcattttgcagctttaaccctcaaaggtaaaaacagtgaaatctgggatccagaagcgaagggagcagaggattaccaagggggacacaaattgatcattaaacaagctttgttgggacccgaagcccaagaaggtgaagtaaatgttgtacaagtagaagctatgacgtggaaagactcggttaaaatcccaattgccacactaaaagccggaggcccaaataaccaagtattgttagatctgtcattcccagacccaccagtcacattttcacttatacaaggtaatggaccagttcacattgtaggccatcatttaattggtagtccgatggaagaattcgatgaaatggatgaattagaagaggaaatgttggatgatgaagaaggggaagaaggagccgaggaagatgaggatgaagatgaacccaaagccaaaaaagcaaaatcagcgactaacgccaagggcaaaactcccgtaaaaaacaattcaaaggctgcaaagaaataaacaagttcatctaatccccaaaccacctcctttgtaatgttaagttagttttttaatgtatctcgggagttgttatacatccatttaacagatcaaccgtaacaatttctcttaaatataagtataatattttatgtttcttgacgtcataagattttgtgaaagtttcttttattccaggtgtaactcttagttttaatgtgatcaatatttttaagctggaaacgtatttatttcctttgaaatcatccnaattttgttgtaaatatgcagccctcattaaaccattttttgtagt

SEQ ID NO: 651 - DNA, 1119 bp, Diabrotica virgifera
cacgcgtccgccaacaacaacctcttttcatcttcgacccgtttgccggcgttagcttgtaaaacatttctgttaaaatcacgaaccatccgttaaaagaaatggcagatgaatatttttttgctttaaccctcaaaggtaaaaacagtgaaatctgggatccagaagcgaagggagcagaggattaccaagggggacacaaattgatcattaaacaagctttgttgggacccgaagcccaagaaggtgaagtaaatgttgtacaagtagaagctatgacgtggaaagactcagttaaaatcccaattgccacactaaaagccggaggcccaaataaccaagtattgttagatctgtcattcccagacccaccagtcacattttcacttatacaaggtaatggaccagttcacattgtaggccatcatttaattggtagtccgatggaagaattcgatgaaatggatgaattagaagaggaaatgttggatgatgaagaaggggaagaaggagccgaggaagatgaggatgaagatgaacccaaagccaaaaaagcaaaatcagcgactaacgccaagggcaaaactcccgtaaaaaacaattcaaaggctgcaaagaaataaacaagttcatctaatccccaaaccacctcctttgtaatgttaagttagttttttaatgtatctcgggagttgttatacatccattaacagatcaaccgtaacaatttctcttaaatataagtataatattttatgtttcttgacgtcataagattttgtgaaagtttcttttattccaggtgtaactcttagttttaatgtgatcaatatttttaagctggaaacgtatttatttcctttgaaatcatccaattttgttgtaaatatgcagccctcattaaaccattttttgtagtaaaaaaaaaaaaaaaaaaaaaaaaaaaaaaaaaaaaaaaaaaaaaaaaagagaataaaaaaaaaaataaaaaaaggaaggaaggactaaaaaattcaagttagaaatcaaaatttatggaaaataaaaaataataaaaaggggggccccctcaaaagttcatggccctgtgtcagcttgaagtcatttcaggaacccccc

SEQ ID NO: 652 - DNA, 1013 bp, Diabrotica virgifera
caaaagtgaaatcaaaatgatccagttaacttgtaaacttttaatttttttgtttgtgatacaaggtgtgtattcattttgtgaaaacaaggatgcgtttaataatgtaactgtggatgtgcatatatcgagaaatataagcagtatcaagcttgttctttcagttttcctaatataagcaagatcactattcaataatagatgtcaaaaaaggtaatattacagatctatgcgatggtattattaaaaattttccggtactagaaacgctgtatctgattaacgtaaatctatccagaattcaaccaaatgcttttcaagcagtgcccagattaagagagttgtctttggcagtaaatcacatagaagatttagtggatggtagctttaacaaccttgaggccctagaaactctttacttatctgggaacaaaattaaatacattgatggcgagactttccaaaacatgaaaagcttaaaacaccttcatctagatagaaacctaataactaaacttagtccaaattgccttagaggaagttctttattaagagtgttagacttaagacacaattcaatggaaatagtagatggtaacacatttccagttatggaaccaatctttacggatccagtaaccatctatttagaaaacaactatatcaaagatgtagatccaagtgtttttacctttaagaatcccgtaaaccttcatttagaacgaaacaacctaaacacagcatccacgcttttctatggtatgagggaatacagtgttctttacttaaacaagaatcaatttaactgtttacctgacgatgtgttggaaaatgttaagaagacaacaaagactatataccttttagataatcccatatcgatgtgactgtctgaagactatagagaaatattttgctgatgaactatacggagtagaacatttgatttataatagcggttttccgatgtaatatgccggtttatcttatcccttaagcaacccacgcgtccg

SEQ ID NO: 653 - DNA, 1270 bp, Diabrotica virgifera
  misc_feature (834)..(834): n is a, c, g, or t
ctcaacttgttaggtgtgaattatttttattttttcgttcattatcagaatctgtttttagaagcagtattgacatatcgatagcgacaatcagtcctttgtattcaaccgcaaagatgcaccaaatgactgcactaattggactatcaaaagagaattcagtggtagagtctacacacagctgctgggtcttataattcgatgttgctctcattaaactccgtatgaagtacctgaaaaaaaaaaaactaaagatatgatgcaacccagtacttcgacagagtcctgggactttccatggcaaaacaaaatgaggaaaaaaatacctaaaatagtctctccgagagaaagaggcagacatcctggagaagtctgctttttgatgtgttttctacgtcttcttatgttaacttctagtctagtcttaattggtatctcagtatggtctatagtaataaaagtaaaacattatcgatacttatttgatataagggtcgatataccttactttagtctaccggcgggtattttgcttctgccaggcgtctggctagcctcttatatacatagtaatcgaaaaagaagactctatatacttctgctattaggtgtaataactttaaccagtatcttggttatactcgggtcaaccataggtttcttgtacagcatcgaggatgctaatggagaatggcatgtaactaattctttcgatcttcccgatttgaacaaatcggtgagtcattcattttaccaattcaacagcagtaaaaaccaccagaaggcatggaataacatgcaacaacgtctcgagtgctgtggaatttcagctancatgattggacggctatgggggtagatattccagttcttgctgtgataatctcaattgtacatcaaaagcatacttaacaagttccctgtttggatttactcagtcgagacctatggtggcacgagaatatccctaaatctcaatgctatattatggcagtcataaagattggcaagggagtactaaatcctaggagtttatatagctgacaaattatcatgcccccctgagggctttatttttttttttttttttttaaaaaataaaacgggcaaaacttaaggggaccggggggcccctttgggggtttttttttttttaaagggaaaaaaaaaaaaaatattttttttttttttttttaaaaaaaaaaaaatttttttttttaaaaaaaaaataaaaaaaaaaaaaaaaaaaaaaaaaagaaggggggggggg

SEQ ID NO: 654 - DNA, 2262 bp, Diabrotica virgifera
  misc_feature (702)..(702): n is a, c, g, or t
  misc_feature (2183)..(2183): n is a, c, g, or t
cctgaccaaaatgtgtgtgattggccagaaaacgtagagagttgttcacaatttacaccagcgcctccaccaagttaagttaaattatgttgagtgggagtattcagactgtatctgataaatattttattttgttttagtcaaaagacagcaaagcgttaaatatttactttatttaaaaaatgtatctctacctaaaaattatgttcttttagaagcgccgtggcataatcaacggctataacttacaaaaaattaaaagggtcaataattaatgtatattttgaatgtagtgctacataacataatttagtagaattattcacatcacataaaactagcaattctagaaagatccggttgaatttgacgcgataaaaactttcgataagatgctggttgcaagtgatacaaaacgtgtgaaagatatgaatttattgactctaaaacactaaattaaacagtaaaatatagggtaagtccgttacactttgaactgtctaaagtttgataaacacgacacgtatgctttgaagtgatgcacgctaagaggggttgtttcacccatatgactttggccgtggtgtggcgaatgcttttgcgacagtttcttgggtgactgcccttatcgtatgaggtcatgtggatatatcgatataaaaataccacgttgccacgtcataagaaaagacattacattanatgaattagaagagggtataaacaccggtgataaatagattaccagcaaaaaatttaatgttgattcgtgtttcattatctgcatatcaagtttatgtaaggaagagccaggtccagaagctatgcgttccaggatccatgaaacttcattttttgaaaatacatatactatgctctatatatccttcagcatttgacgtactctgccattcaccatgctgcttcaacgttctcacactgcctccagcgtctgccagaacagttaccgatgttcgacgaatgcagtgacctataggtatacatacttttgatgatcgcttaaaaccagatattttgcaatgatgaagggaatttccaaaatgtattttttccaaatgtagaatagaacaggcaagaaataccttcttaaagatgcgacagttactctctacccgtaatcttgatctgtacctacgataccgcatgataaagtgttatgtatacagggtgaccccgtaaattgtgcgttccttagaggtagaggtagaataggcacaatttagagcaaaatactcttataacattttcttctaaatttatccgtttaaccaaaaaacgaaaatacattttgatatacaaattgaagtctggcaacaacgcgcaactcaaaaatctaaatattaaacaagtaggtttgtaggtcagttgcatctggtaggtaaaataatgtaaatatcaaccaaacccatattaattattttgcaggtaggtacctacgatgtcaacaaccccaaaatcacacctcaaagtaaataaacaaggggttattaggttaaattaccacagtcacagcaagttcttctaggctacgttgctatgtcattcaaatttatgaaaataaaaaatcacttacctatatggagaacaatgtaatttttttcttggcaacggcgaactttagaaaaaaatgttaaaggacttttttgttctaaattgtgtattatatccttaccttagaggaacgcactattttcggggacaccctgtagagtgtatacggcatggaagcttggacgttaccaattagatcgttatgacttttaaagggctttgagatgtgggtatttcgtcgtatgctgaaaattccatggaccggtcgcgttagaaattaagaagttttaaggtatatgaatagagaacgttaactcacagaaaactaggaggattactaaattaccggcatttgtaaagtgtcattttgaaaggacactggccttatttgggttaagtgttttattttaaactttaattacttcaatgtttgaccctattcatacatattatatacaaatttctggaaatatttttgaatatttaatgttttgctgtctttttatacagatataacacaacaacttatatcgttttttataatttccgttaaaaatgtttttattctacatcatcttgaaaagatttaatacaattataccttttgatangtaatctttataagatcgtttagttaaattttttctcatttatctatatttagtaaaataggaaaacatctagagtttg

SEQ ID NO: 655 - DNA, 1011 bp, Diabrotica virgifera
tggtactcgagcagtgagaacatttgcttcagttggatttcataccatgaaacctaaagttgtgttcgtattagggggcccaggggccggaaaaggcacccaaagccagaaaatagtcgagactttcggctatacccatttatctgccggcgatctgttaagggaagaaagaaacaaccctggatcacagtatggggaactcatagagaattacattaaagaaggtaaaattgttcctgttgagataacttgcagcctcttagaaaaagccatggaaaaatcaggcaaggaaaaatttcttatcgacggtttccctaggaacaaagacaacctagatggttggaataggcaggtggccgataaagtaaacttagaatttgttttgttcttcgactgtcctttggaaatatgcctcaacagatgtcttgaaagaggagcatcaggtagtggtcgatcggatgataacgaagaaagtttgaagaagagggttaatgtgtaccttaatgaaagtaaaccaattatcgaccattacgatgaattcaacttagtgaagaaaatagatgctactcaaaatgaagataaagtatttgacgaagttaaaaagctttttcgagacagtggagaccactaggtgtaattgcaataagtaaaacgttggtcagactagtcaaaacatatttggtttaatgcaattctttgctgtcatataagttgtctcaagttgtacttaattgggggcatttttgttatttaattcgtacgcaaaaacctttttacaatttacttaaacttaagtggaatacattatttttattaataaatatcatgattatttgtacttatttttttatacatcaatgatttttataaaatttttataacgtattttatatgtcaaatattgtaggcttcatagagcttgtttagtgactaataataaaaagtgtgcccttataaagcgaagtagtcataattttttttagttgaccatttaacaaaactatctctctt

SEQ ID NO: 656 - DNA, 2003 bp, Diabrotica virgifera
ataaattaaaaatttatataaaaatgtatactacaaacaaaacctattttttagttgtcctttttctccgcgttttcttgggttcttcgacttcttcttttacgatatttgttactgaacctttattccactctttcttcaattcttgtaacatcgttggcgttaaaatcccctgagccaaaagacgttccgtcaatttgcctttgcccaaagtcaatgatttttgtcctcttaaatatgtttgtttttgtctgctcatggcgaactcttcatcatcagcagctccagtacccgaactaattccagtttcggaattcctcaacaacctcgttagctgaactataccttgttgtatgatttggtctaattcacgttgcatgtctcttactaagtttggttcattgaatagatcaacaaaacggtaactaagccacaaatacaagtccaatacatcaaatactgcttctaaatgaactaaatctaatatagtcctcggtggttgtaatggccatccgatatttctacacaaccagtcgaatgttatcatttcatttttgctgtattgtcttgcaaactttaaaaacatagtacacacgaaaggcatctttttattgataggtgcgcagcagaagagatatcttgctcgcaaaggtaaaggtacatgttggatcatatctgccaaaaatttgaaatcttctgttgggcacataaaatagagggaatcgtccacggttgacaaattaataaaaatatccataagattgctaagggtggagttcggtaaatgataagcgtataattctatttgttctgctgttgggtgaagcccagcttgaattatgggatctggttgtgacgctaaaagattctgtagagtaggcaagtcttcggacttaaacgtcgttgctgaaccctctggccactgagttccgtatcttcctgctctacctgcgatttgtagagctgaagacacagaaatagtatccatttctctctcacctttctcgttcattgtagctttgattaaggagtaaaatatgacacgtttaatactcagattaagacccatcccaatagcgtctgtagctaccaatatcttacagctattttcaggatcattgaatttagcagcttgagccaatttggttccagggggaagaccaccatatataacagctacctccttccccgttgcttctatgcccctagaaacactgtaaatgtcatttttactaaagcatactatacagtcgccaggaagaacattttctaaggaacctacagcagcattttcaatttttaacggagtcagtcttttatagttacgaacttctaaatcttctcctgtagttagacatatttgtctgaccaaatcgactgccccagcttcaccacacaaatggatttcttctgctttaagacctaacagtgccctggtccaagcccagcctctctgtacatcttttatcatttgaatttcatctatcacagccacctcatatgcatttgttacagatgtcatttcaactgtacaagaaacgtgattggaagcatttcctgctggatctgcaaaatttctttcttcccccgttaccagatcacatggtgtccctctgttattagatttgttaaacacttcactggctagaagttttaaaggcccacaataaactccagattttgatgtcataaacctttctaaagcatggtatgtttttccagaattggtaggtccagaatgaaaaattatttttctgttaatagcccttgcttcaggataccagttagcaggtgatcttaaatcagaaatttttctaagatcatccatgcagtcgagatggggaaacatcattttggcatgtcgtagaaagtaggggaaaatatcagtgatatttccagctccctgtagaatgtcactgaagactacgtggatatctgctggtaaattttgtgcttctaggcaatatattcggaaactcacataggcttggtgctgaaggtac

SEQ ID NO: 657 - DNA, 1344 bp, Diabrotica virgifera
aaggtttttaaataaacatggtaaatctttctcaactttataagaattttatttgatcttattttaaattatatctaccttaaaatagtaaggtaatgctttttagaattactaaaaacattagcaggttcttttcacaagctgattttctatcgaaaggtccacaattgccgataacaagtatttttccttcaatggaacctaaaccctttaaaaagaacaaatacgatggacgtaccaagaaacgacaatgggaagaaaggcggagggataagggtgaaagtttaagagaaacacccgaagatccgaaaagggtgaaactggatgaagaccaagaaatggaaaaagataaaataaaacgtaggaaattttgtcttttattaggttattcgggcaataattactttggtatgcaacggaatccaaataccaagactattgaagaggatttgttgaatgctctctttaaaacacatctaataactgaagattgctaccaacaagtgcaaaatatgcagttccaaagagctgcaaggacagacaaaggagtttctgcagctagacaagtagtgtctctaaagttaaaagaaaacatagatttaaaccaaatcaatgctgaacttccagaagtcatccgagttttcaattacaaaagagtcaccaaaggctttaacagtaaatctcaatgcgatggtcgtagctacatctatttaataccaacagtagcgtttgctcctcacgataaggaagtttcccaaaaagatttccgtcttgacgatgaaacatttacaaagataaatactatattagaaaactatctaggcacaaagaacttccataattacacctcaaaaaagaagcacaacgatcccagcgctaacaggtatatgaagtccttcgtatgtgagaaaccttttattaggaaagaggtggaatttgcaattttaaaagtccatggacagagttttatgttgcatcaaattagaaaaatgggtgggttgtctgttagcaattattagaggtttagctacggaagatattataaaggagtcgttcaaatctgacaaggttattattcctagagcacctggattgggacttgtcctcgaatatgtacattatgacaggtataacaacagatatggtgctgatggggtacatgaaaccattaacttgggatgaggttgaagataaagttcaaaagtttaatgaaaaaaacattttttccaacgaatttttttttaaaaaaaaaaatttggggggagggaggggcggttgtaaaaaacgggggggtaaaaaaaaaaaaaaattttgatgcaaaaaaacatctctttttttaatttt

SEQ ID NO: 658 - DNA, 1022 bp, Diabrotica virgifera
  misc_feature (885)..(885): n is a, c, g, or t
cacaagcagtgttgcgttagcgatttaaggatatatctgaatttgttggattcggaaaagaagacagaattagcctctaggttaatcaaggacgttggaattagctcaactagtgtaccacaaacagaaagacaaatgcaaaggcacatatccgctttacaactttcaaggctgtgcggtggccatcggaacctccaaccggatcatctgagagccctaataaccgccttatcccttcattatcaacacggttttcaaacgtacggcgaaaacctccttcctacagacttaggtccgtctgatccgtatgctctgatgtcagcgcacgtgttatacgatttagcacacatagagaagagctcaaattgcatacaagtggctctgaggctactagagtgtctgttgaattattctcccagtaattttcatgctaagttgttagcgattaggctgtatcatgagttgggtggaagcataagtgctcacgatatgtactgcagtttagatgtgaagcatttgcaattagactctttaggatttatccattgtgccaggttacccacgacgggactcttcacactatgtacgaatctttttgatgcgactctgaaatttttttctagtaattacaaagatagttcggatcatttgacattctcctataaatttggttcgtttatgaaaatcgatgagtttatggactttagagaaagactgaacaacagtttacattattccacagtagtcgtagataggattatcttaaatttggtggaatgtatgtcgttggaaacgttatattctttagccataactccacaggattgtaacataaactggaaatcattaatcgacaaccacgaccttagtgcatatacaacttgngacccagaacgaataaatggccaacccgaagactggcaacaaaccaaagacttgttcgaacaggacatatgggtttctaaactacgatcttcggttctactcgggatagcacacggtatagaaattgtcaaatccat

SEQ ID NO: 659 - DNA, 907 bp, Diabrotica virgifera
ttttaaagggccccccccttttttttttttttttttttctttttttatttttggatttttttccttttttttttctttctcgagttatagatctttttttttttttcttccaggcaagtcttcattcaattcaattgtttgtaaatataaacatttttattgcaatagaaacaagttaaatgatggaacatcacagcagaaaaaagaatacgaaagagcacttatatatgataaattgttaatgtatagatcagaagcttttgaagactttgtggaactgacattgatggatagggtacatgatgttgaaataggtgatataaatatcaatagatttttagaaaagaatgaattgataactatagttaaagaatcaaaaaagacacctgatataatgtttattttaaatggaatcttgtatataggagatattgctgtttcacaaagtataggcagtgttacagaaataaaaaaacaaaaatatggtcccttaatagaagagattagaagtatgaatgaaaaattgactataaatgagttgtatctcatattggatgaaaacaataaaaacttggatgacgtcataagcacaatggaagatataactgggatcgctcataggaggacatataaagaagaaatgttaaggaagctgaaaaatattaaggatgcgagaagagaaatattaaacaaggtaactaatagagaagcatttgaaaaatttattaaagaaattaagaattctcaaccatcagcgtatgatagttatggaggtggagcatcaattattccagttactagtagaaaagatgatttaactatatttaacgaaatagcataacacatagaagacaaacaattaaattttggattaacagaacataacagaacgttaatggaagacatt

SEQ ID NO: 660 - DNA, 1493 bp, Diabrotica virgifera
ctctaaaaaccattgacatctgttttgagaaaccatgttcctagaaaccattgataacaaatatagacagttacctctgcatttgttgtatcatcttactaccctatccatagcgagtctaatttttaaacctataataattgtttacgtgctggtttcataaagatgcttcaaaaatatatatgggtcttactaggcagcacagccatgcctttaatagcttttccaattatattttcaatatgcttattctagttaattaagattgcgggataaaaagaccactaaatatttgagttcatttttaggtatcagcattgactctacagcccatggtgggtcttggcctgttccagaatcagcttccactctttcctatcctttgcttggctttccaatttctcacttgggcatgaatttttggtatatatgggattatattgtgataacgaccagatctatgagaatagtatgttgttaaagaagattgtggtgacactattcatgaatatctgataatattggttaatgtgaatggagtccaaaatggggtttaggctgttatataaaaaaactaggtcattagcatatggaagtagggcgacattatctggtattaaattatgcgaatgaggagaattaagcctaaaaactctatttattctgctaatcaatatgattttgatatattttaatataaaacatatgttattctttctagggacatctcctctgaaggaattacaattatttgccagtatgtcaaatgaattttcaacatcagtcatactttcatgaatttattgatgaaaataaaactaggtacatgatttattatttacttctaagggattctaagatactatgtgtaaaaagtccaatatgcagtgatgagcatgctaataactggcaaaatatgggatataacgccaaagatgggaaactatgtaatgttatcgtcggctaagagtgttaacctgctaactctatttttcactgtgagtgatattcgggtggtttctgggtctgtgtaccttcataccatgtcccacaagcccgctggttccactgtagtttagagatagctatttctaaactgcattggtgtcggcgggtttgtgtggtggtgtatgaaaatacacggacccagaaactggcccaatatcactcaaagtgaaaaatggaggttaaaactcttatccaaggttatgttgatttattcgtttataacgataagttccacttctaccagtttcatctctttttatctcacaagttaatatgttttccatcttttgcgttattttgccggttattagtgtgagtgctcattactgtatatttacgattctgtgatttctcaatatgatgctgagtaggtatagatctgagtaagtatatagtaggtatctacaaccctttcaaaacagaaatttataagttcattttatgtacctattaaactttattttaaggatgaatttgaaatgctt

SEQ ID NO: 661 - DNA, 909 bp, Diabrotica virgifera
cagaacaacgtgacatttcaaaatatctgatttttgtattattcgttaaataaatccgccgtatttcattctatatactgaaaaaacgtggtatctttaccattaaagtaaactgagctttagagggacagagacagaaattatgtgacaacccatcttgtagcgttgtttcttttggacacctcgttattttcgatagtgtgacatattagttgtgatctgtttggcgtagggtaaagtgctctctgttttcacaaacaacgtgacatcgcgcctataataccaccctgttcttgcatagtattggtagtctaatggcgacaaataaaagcctttactttggatatggaagcaatttgctggaaagacgaatgcaccggtctaatcctaatgctgttagatatggaaaaggtgtattgaaggattacacattagacatgggcacatatgggcacttttggaaaggctgtggtgcaaatatagtccaatcgcctggagacaaggtctggggagctctatggcagttgaaggatgaagattttgtgaatttagaccggcaagaaagcgtacataagaatgtttataaacgaataatagtacaaatagaaaccccagaaggccaaaaactaaatgctatagcatatcagaatgtaaaacaattcgaacggtttgatttgacgaacttaccgacagaaagacgacctagtccagcttacatggatgtcataatcaaaggagcccaagaaacaggcctgccaatagattacatcaactttttaaagactatttcgaccaatggcatcgatcatgttccaaacttagatccagaaaaataggatacgtgtatattagctttaattgtaaagttgtttgtaaattgtaaataaagaaaatttattttgttggtac

SEQ ID NO: 662 - DNA, 1028 bp, Diabrotica virgifera
attcattgttgcatggcagagcttattaaccttgttatgtcttccttattccttacattgctcattgtgtagatgaaaatacatttctggggtcgaactattattattaaaacgttttcttttagtgttaaagagaattggtgctatgagtgaaaataaagatattccaaaaggcaacaatgatgaacaaggctcatctagaattagaaccaccagtgagtgctcttatacaagtgatgatggatcttctggatttacagggagacgtcagcgcaccacttctcatcagttcatggttgctagtggattgactgctgcatctccaccaaagtttgtttcactggaagagatcatgcaagcagctaatggtatgagagatatggctttggtgcatcaaatagtggttgacaaggattttaggttaaaaagggcagaaccagaacctaatagtgtccagggaataatcaagaacacaatgcacaaagcattttgggatattttaaaacaacagttaaatgaaaaccctccagtttacactcaggcgttgaatcttctagaagaaattaaagaaggattatttgctgtattattaccacaacatacaaggatcaagcagcaaatttcggaagttttggattctgatttgatcaaacaacaagcggagaagggtactttggattttaagaactatgctcaatatgtggtctctgtaatgtcaaaattgtgtgcacctgtacgtgataataaaatacttgagttatcaatgacagtggatgtcatagagactttccaaggtatactcgagacgttagaccttatgcagttggatatggctaattttacccttcaaatggctcgaccagacattattgcgtgtagtgtggaattggaaagaaagaagtttgccgattatcttgctgtacaatacgatggtcttgagcaactcgtaaatgggtattaagatatataaatagtggccaagctgtaccggagaatgtagaatatgaaaattttataaaaggtgtttt

SEQ ID NO: 663 - DNA, 1649 bp, Diabrotica virgifera
  misc_feature (1448)..(1448): n is a, c, g, or t
gtctgactgtcatcacatgagaagcaaaaattgtggaatttttgtttttatcaatttaatatttgaataaacctataaaacagtaaagtaagtttatatatttgtgaacaattagagaacgatctctttttataaacttttatcgaactctaaagaaattaagtgtgtgtttttttctcgaaaagttatatgaacttgtccaataatggggaggctagtcaatatgcaatatttgtttagtttaactacgttgttactattttcttcaataatttctactcaagctgaagatgtacctttatcgaaacttagccaacatattgggactcctactttaagatttctatattgttactcatgtggatacaaaaatatgtttgatcagttctccaccataataaaccaaaaatatccagagattcttgtagatggggcaaattatgatccacctggcatgaacatgttcatagcaaaaatgataggatggataaaaatggcgataattctatgtatattggccaacatcaacgtattcgagtatttcaatcaaccaagaccaggctggtggatttggtgcgtggaaaacaaattatatgcctgcatgatgctgttcttcttgtgcaatattctagaagggcagctcatccaatcaggagccttcgagatcacattgaatgacgttccagtttggtcaaagttagaaacaggacgtattccacaaccagcagagctgttccagatcattgatagccacatgcagttcgacacaaaaatagaatacaataatttcgctaaataatatttggaaaacacaagatactagaggagatttaagaactgtatattgcgagtgtcaaaacagtacgaagaatattgtaaatcctcgaaacaagttttttagatgtcatgttcatttgtattgttattttcttaatatttcacatatttctttgtactgtataggagaggattgatgcaaaatgaatttatcaaaatataaagttgtggtgtccaaaattgtacgattgttatttaatgtagtagtataaagacagtaaaatatgtttggttgtttcttcataaatccattgcacgtcagccaattttgacattttgatttccatacaacgttgccataatgtcataataagtaaaaatctaaggaattatgaaataaaaaataatatctaattatattattatgatgatataatactaaattatttaaataaattgtattttgttaaggatatgatgtatataaataagatgacatatattatatgtaattaatgatgtgcaacagacctaaaaaggtataataatagagatattttaagaagtatcacaataacgaatatttttactatcacttgatctagtatacatgttaatgtactacatagaagttaaagtaaagtctaacaagctatctaagagactcattntgttcgaggtttgaaattatatagacaagggatcatctcatcacttgtttatgggatttcacacctcgaaacagtagcagcctgctcagctgaataattattgagtcccctagagaccttgctagactataatatgttacatatttgttaatacaaactataaaaattgtctttgatgtatttttttatttatttctatgt

SEQ ID NO: 664 - DNA, 1936 bp, Diabrotica virgifera
gtaggacgtgttaggtgttagtagctcttaggctaagtataatattagttttttaatttatcggcacacaggcagttctaatggagaacggtgaagatttttcaaaagatgtctcagcagagcatcaaaatggatcaggtgatgctccagccgatagtggaagtgcagaaacgcccggccgtgacgatgataggtggctgagtcagctaagtggaagatgggaagatgaggaggacattggagcacttggacccatggtatttatccttgggcactttcttctgccaacacttagtaaaacagaaccaataactttaattttgacaaattcagtcacgaaccatttcataaaatcaaaatgatcaattttaaagttaatgataaatttgctgtagttttgtttcacaccattttttttgttttattgttttaaaacgataactttcagatcacttagagattgctgttccatttgattgattgatacttttgcagatccaattttgttcaatttgtttttactttcagtaaagtcatttgtaaaaattttgattgattcaaaaattaaatatgctaaaaaagataggaattgatcatgccattcttcattttaaaacacgttttttattttcagaaaattatttgttggtggcatgtcttgggaaaccactgatagggagttacgagaacattttggccaatatggcgaaatcgaaagtataaatgtaaagacagatcccaacactggtagatcaaggggatttgcattcatagtatttaccacaacagaagctattgacaaagttgtagctgcaggtgaccatgtcattaatggcaaaaaagttgaccccaaaaaagccaaagcaaggcatggaaaaatatttgtaggtggtctcacctctgaattgagtgatgatgacatcaagaactatttctcacaatttggatcgatcattgatattgaaatgccatttgacaagcaaaagaaccaaaggaaaggattctgcttcatcacatttgaatctgaacaagtagtgaatgagttactcaagcaacccaaacaaaccattaaagacaaagaggtcgatgtaaagaaagccacacccaaaccagaccaaatgggcggccccatgatgggcatgcgcggtatgcgaggcggaggcagaggcggtccaatgaggggaggtcgcggtggccgaggcggctacggaaaccaaggaaactggaaccaagcctatggtggctatggttatggccaaggatacggctatgatggctacagccaaggttatgactactacggcagtggctatgggggttatggaggttatgattactcaaactatggcggcggtaactacggtggagccggcggataccaatctggtggtgctggcggaggccccaaacaaagaggagctggtcaacgcaaccaaaggttccaaccctatcagaagtgaggctggttaatatcataagagaatagttcgtgattcaaacattttccgtaataagtcatctcatcctcaactgaattttccaatcattccatttcatcgcggcgcttggaaaatatacccgacaacgtacaaaatttttatgttacaagtccaacataaaagtcaactatccagtcgagattttttttattttctttttgataaatcggttaggaaatgttaaaacaaattgatggtcttcaaattatgaatttatatataaatgatacattgagttttgagttagtcaaagatattttctcttttttgtattatgtttttctttatttaactctagtatgatgtaaacgtagtttttaagtttatatgtataacttgtatgagtgaaaggaggcgttgtgtacttccattgtatgacaaaatttaataaaacgataaattttgtgtaaaaaaaaaaaactagttctagatcgcga

SEQ ID NO: 665 - DNA, 2698 bp, Diabrotica virgifera
caaggttatgactactacggcagtggctatgggggttatggaggttatgattactcatactatggtggcgactaactacggaggagccggcggataccattctgctgctgctgaagaaggccccaaactacaaagatccgtgcaaagagaaccaaagatatcctaccccatcgcaagtgcatgatggtaaatataatagatagaatagatcgagatgcaaaatttatccatgaatatggcatcaacatcctcgtatgtctattttcacaatctccctatatctgagaggagtgatagatagtaccgcaacacagatcatatgtctgagtgatgctgttcatcttgtggtatattctatcaggccagatcatcctttcaatacccttcgagatcacattgaatgacgtgccagactgagtcgatgaagatacagaacgtattccacaaccagcagatctgttccggatgaaggtaggaggtgttattaggtgttagtagctcttaggctaagtataatattagttttttaatttatcggcacacaggcagttctaatggagaacggtgaagatttttcaaaagatgtctcagcagagcatcaaaatggatcaggtgatgctccagccgatagtggaagtgcagaaacgcccggccgtgacgatgataggtggctgagtcagctaagtggaagatgggaagatgaggaggacattggagcacttggacccatgaaaattatttgttggtggcatgtcttgggaaaccactgatagggagttacgagaacattttggccaatatggcgaaatcgaaagtataaatgtaaagacagatcccaacactggtagatcaaggggatttgcattcatagtatttaccacaacagaagctattgacaaagttgtagctgcaggtgaccatgtcattaatggcaaaaaagttgaccccaaaaaagccaaagcaaggcatggaaaaatatttgtaggtggtctcacctctgaattgagtgatgatgacatcaagaactatttctcacaatttggatcgatcattgatattgaaatgccatttgacaagcaaaagaaccaaaggaaaggattctgcttcatcacatttgaatctgaacaagtagtgaatgagttactcaagcaacccaaacaaaccattaaagacaaagaggtcgatgtaaagaaagccacacccaaaccagaccaaatgggcggccccatgatgggcatgcgcggtatgcgaggcggaggcagaggcggtccaatgaggggaggtcgcggtggccgaggcggctacggaaaccaaggaaactggaaccaagcctatggtggctatggttatggccaaggatacggctatgatggctacagccaaggttatgactactacggcagtggctatgggggttatggaggttatgattactcaaactatggcggcggtaactacggtaaatacacccacaggacacattaataaactttttactcccaaccgagatgttgttaatatctcgagtggtgccttgtaagctcggtgtatatgtcaagtgataactgtgtcagggttggctgtaggaaacttgttaccaactatacaaaaacgttatttttggccaaatacattttataaattgtaaacctggttgttctacaataccttgttaaattttaattttcgacggcatgactgttggtatttttcagtttcctacagctaacccattcttagttctacacacaggaaggtcatatataacaagtgtgatattcacactagagactatgtggtcttgaaatattttttttattatttaaggacatatttacactaagtcgacagttgttctgttcctatacataaattatatgttgacctttatacatatatttaatagtatggaagaagatacattgtgaaaatatctagagcttgaaataaagcatttgttgaaattctacattccctcaataagggtaacgggacgaccttttccggaatggggggggggggcctttggaaagcgtccgggggggagaggctgcaaattaccaccaatccaaaacacttttaatcggaaaggtataaatggttaaagaccaaattcccaacccccttgggtaaaaatcaaaggggggatttttgcccttttcctaaaagaattttttcccccccccacacccgaaaagactctttttttggaacaaaaaatttttgttaaccttttctcggggggggaaccccccttgttttttttttttttttgagggggagcaaaaaaaaaaaatttttgtgttcccccccccccccaaaaaaaaaaaaaccccccccaaaaaagggggtggggggggggggggtgttgtgggggaaaaaaaaaaaaattattttttttttgttttgggggggggggggggggggcccccccccccccccccccccccccctcgtaagaagatttatatgtttcgggggggggggggggggggtgtggggggagtggtcgttctaccgccccccccaaatccaaaaaaaaaaaaaaaaaaaaattatattttttttttttttttttttttttttttttcttttccccacccaacaccaaacagaaaaaaattatttttttttttttgtgtggtgggggggggggagggcagggggggcccgccccccccccccccttccctcttcc

SEQ ID NO: 666 - DNA, 2212 bp, Diabrotica virgifera
  misc_feature (1666)..(1676): n is a, c, g, or t
attgaaagctggaatgaagggttggatgaaaaaaaaactgtctttatttaatttataaagaattttatttttaagttaaaaagcttaaatttttttaaaagacgagaagaccctatagagttttataaaattattaataagtttttttagtattaaatttatttatataataaatttatttaattggggtgattaaaaaataaatttaactttttttatattattatattaattaataattttttgatccaatttttttgattataagaataaattaccttagggataacagcgtaattttattggagagttcaaatcgataataaagattgcgacctcgatgttggattaaagtttataattggtgtagcagctatattattaagtctgttcgacttttaaaattttacatgatctgagtttaaaccggtgtgagccaggttggtttctatctttaatttattaatatattttagtacgaaaggaccaaatatataaaataatttttatatttagataaatattaaaaaaaaaaaaaaaaggcctcgatactcgactctagacttctcctcgtgtccgagcgaaggtaggacgtgttaggtgttagtagctcttaggctaagtataatattagttttttaatttatcggcacacaggcagttctaatggagaacggtgaagatttttcaaaagatgtctcagcagagcatcaaaatggatcaggtgatgctccagccgatagtggaagtgcagaaacgcccggccgtgacgatgatagaaaattatttgttggtggcatgtcttgggaaaccactgatagggagttacgagaacattttggccaatatggcgaaatcgaaagtataaatgtaaagacagatcccaacactggtagatcaaggggatttgcattcatagtatttaccacaacagaagctattgacaaagttgtagctgcaggtgaccatgtcattaatggcaaaaaagttgaccccaaaaaagccaaagcgaggcatggaaaaatatttgtaggtggtctcacctctgaattgagtgatgatgacatcaagaactatttctcacaatttggatcgatcattgatattgaaatgccatttgacaagcaaaagaaccaaaggaaaggattctgcttcatcacatttgaatctgaacaagtagtgaatgagttactcaagcaacccaaacaaaccattaaagacaaagaggtcgatgtaaagaaagccacacccaaaccagaccaaatgggcggccccatgatgggcatgcgcggtatgcgaggcggaggcagaggcggtccaatgaggggaggtcgcggtggccgaggcggctacggaaaccaaggaaactggaaccaagcctatggtggctacggttatggccaaggatacggctatgatggctacagccaaggttatgactactacggcagtggctatgggggttatggaggttatgattactcaaactatggcggcggtaactacggtggagccggcggataccaatctgggggtgctgggggaggccccaacaaagaggagctggtcacgccaccaagggtaaagggatttgggggagaaagggggacaaaaaaggtaaccccaccaaaaaaattttttaaataaatacaccaaaaatacactnnnnnnnnnnnacgcaaccaaaggttccaaccctatcagaagtgaggctggttaatatcataagagaatagttcgtgattcaaacattttccgtaataagtcatctcatcctcaactgaattttccaatcattccatttcatcgcggcgcttggaaaatatacccgacaacgtacaaaatttttatgttacaagtccaacataaaagtcaactatccagtcgagattttttttattttctttttgataaatcggttaggaaatgttaaaacaaattgatggtcttcaaattatgaatttatatataaatgatacattgagttttgagttagtcaaagatattttctcttttttgtattatgtttttctttatttaactctagtatgatgtaaacgtagtttttaagtttatatgtataacttgtatgagtgaaaggaggcgttgtgtacttccattgtatgacaaaatttaataaaacgataaattttgtgtaactctcgatttttttatgcatattgtcccagattttgtacagaaaatatttaat

SEQ ID NO: 667 - DNA, 990 bp, Diabrotica virgifera
cccacgcgtccggcgaaggtaggacgtgttaggtgttagtagctcttaggctaagtataatattagttttttaatttatcggcacacaggcagttctaatggagaacggtgaagatttttcaaaagatgtctcagcagagcatcaaaatggatcaggtgatgctccagccgatagtggaagtgcagaaacgcccggccgtgacgatgataggtaagtgtttttcttttttatattctaaaatatacatgaattttagttatttcgtagctatttgtcgtatattttgttttattaaatttccgatgtattgatatttatatttaataaagtttggcacctcgtttttctcgttattaatctgtaaacatcttactaataacaattactttgtaatattaaatcgttaaatttgtatgtttagatcgtaagaaatttgaataacattgtattgatttgatttagtagatattttgtgataatttggcattttttgtgaagatcaggcccaactagcttttgaagaaaatggcggatgacgctcattgattttttggcgcgttattcaaatccagttgtactaagttgaagagtttcctaaagaatgagtaacattttatataaaattacagcttgttttaaaatttgcatttcaggaaccgtaattctaaaaaattctcattaacttgttcaaaatcattaattttgggtcaatctaattagattcaaaataaattcgggccggtgataggatgccaggatttaggatatttttcgtatcccatttaaacttggttccttttctccaggtggctgagtcagctaagtggaagatgggaagatgaggaggacattggagcacttggacccatggtatttatccttgggcactttcttctgccaacacttagtaaaacagaaccaataactttaattttgacaaattcagtcacgaaccatttcataaaatcaaaatgatcaattttaaagta

SEQ ID NO: 668 - DNA, 2926 bp, Diabrotica virgifera
cactttgcgacggattttagatagtttaacatcgaagccgactacaggtgactacagggtatagtatggtgattcaaaaggaagcccttttgggcttattgttgtgtatttcaatagtaacttgtttcccacaagtaagtcaatcagacagtctggttacatcaattgcaagtgattctgttgaaaacaatggagacaattcaaacaaggaaaatgtccctgttcttcctaaaatatacgaaatgagagtcgacgctaatgtttccaatagatttgccaaatgtcaaattactagcaaggttagaaacttggacaaaaacgcacacgaagctacattttctgtagttattcctgaacaggcttatatttctgaatttattatggagattgaaggcaaacaatacaaggcttatgtacaggaaaaggaacaagctaagaacacctacactaaggctgttgaaagtggacaagctgcagctcatgtatcagtcagcgcaagagattccaatagatttacagtttctgtcaacgttgaaccgcaaaagaaagcagtcttctatttgaagtacgaagagcttttaacacgtgctaataaccagtacgaacttgtcattaatattcatccaggacaaccagtcaaaaaattagacgtagaggttcatattgacgaatctcgccctcttaaatttataaacgctccaccactaaggtctggaaatgaaattgctaagaaaggtgaatcactgaatccaaaagctgagatcgttaaggtgaatgccacgtcagccgttgtcaagtttagtccagatatagaaaaacaaaaacaatatgctaccgatttgggaaccaatgcggaaaatggtctagcaggacaattcgtcgtccaatatgatgttgaaaaggctggtcctggaggagaagttttagtcgatggaggacatttcgtccatttctttgccccaagcgatattccggcacttccaaaacaagttgtcttcattttggacaccagcggtagcatggaaggaataagaataacccaactaaaggaagctatgaagagcattctgccagaattaaagaaagaagatatatttagcattattgaatttggttctgtggtcaaagtttggaacatcgacaagtctgctgttcaatatcagtctggtatcgatgaatggggttatgaaccagaagatccagaagcgattttcaaaaataaaactcaacaaccgattcctccaccataccctgcatcggaagaaaatattaaaaaggcggaggatgttgtagaaaaactaaaagcttttggcggtactgatattaactcagccctaaccactggtcttcaaattatattaaaaaataaggaagacaaaacccaccaaccgattatagtctttctaactgacggagaagcaactgtaggagaaacgaacaatgaaaaaatcatcactactatcactgaactaaatagcggcaaaacaccgatattctctttatcatttggagatggcgccgacaagaatttcttgcaaaaattagccttgaagaacttagggtttaacagacatatttacgaagctgcggacgcatctctacagttacaagaattctataaacagatttcctcacctcttttgtctaatgttgtgtttaagtatgtcaataatgtaacagaagtgactaagcaagtctttcccatcttgtttggaggctccgagctagttgtctctgggcaaatcctcgatcccggattttctccttcaaccgtcgaaggttggggcataaatggaccagtaaagctagtaccagttctgaatcaagctgttggtagtttagaacgactttgggcttatttgacattaaaacaatatctaaaacagagagaagcagccgacaacaaaacaggaccaacccaagaagctctcaggatagcgttgaaatattcattcgttagcgatgtcacttccttggttgttgttaaaccaaataaaacggacgcagtggatactgaggatggaagtgataaacgctatccaataattgccagtggaattcctctatcagctttacagtccaaagcacctatgctaggctctgcagggagtagttacattcctttatcaaactttggagcaccgaactactttgcttctccagtagcagctgaatctgatgttgattcattgtcagatagaatttatggaggagctttgcctgcacccacttttagcaacaaaatatacccaagtactacatttagaccaccaaccacttatagtacgacgccctttacaccaatatgcaatacacaaactccaaaatcactacttcaaatgttgaaggagaaactaccttggctagctgccattttaggagatgatgaagtattaactctttcaaaaggtaaattcaagctaggtcttaatgaaaccgaatctagcaaacctgattgtccagaaactcctctgagtcaacctggagaatgtacattaattcaccactgtagtcaagtgtacgagaaattgactgatattcaaacgtacgaaaaatatttctgtgatttacaaggatttgccggcatctgctgccctaaacaatcctaagatacccgacaaatacattttagagtaattactgcagtattgtctaatattccgtaacagctggacaacataaataacttataacagaaacatctcaaattgaatatctaaattaactgtgagatgaagatgaaggtattatcactatatttagttttaattagacattttactgaaacactatgttagttgtacttatttttgtatgcgaatcgtattaaaataaatattaaaaataaaaaaaaaaaaaaagggcggccgctcgaactaaacaattagcccacgcgtccgcccacgcgtccgcgcacggggtggag

SEQ ID NO: 669 - DNA, 1320 bp, Diabrotica virgifera
acaatgttgtcctacttacagaagggttgcttgcaaatacaacggtaaagtacaagaagtaggagacaattggtttatggaaggtgactactgtacctccatcatgtgtgtcaaatctgatgccggatatattcagaaacagaaccaagtcaaacattgtgaagtcaattgtgattatggatttgaatacgtagcaccaactgtggaatccaaagaatgttgcggatactgcaaacaaatcgcttgcgttgttgaaggaaccatatacgaaattggagaagaatggtcatctccagatgcttgcaccaaatatgtttgtacagatgttgaaggtttgattcaagttagagctcaacttaccaactgtccagtaatatcccaagaagatgccaaaaactttgttattcaagacgagattgtcaaaggacactgttgtcccaaacacgtgaagacagcttgcaaagtcgatggcaatattgttaaggttggagaaacatggccctcagcagatgataaatgcaagagctacaaatgtaacgaaaaaggagaacaagaacttgtccttcaagaatccgtccagttctgcaagactgaatgtgcaaagggttgggaatataaaccatctgaaacaaaatgctgcggtgaatgtgtccaagtatcatgtgtcattgaggacgaagtctggctagaaggtcaaacctggaaatcagacgataactgtacaacattcagttgtgaaaaattgggagaccaatactcgattacaagtcagcaggaatcttgcccaccgttggatagttcttgcgaacctaaaaatatatatgtacagggatgctgtcaatactgcaacagtagtggatcagcactaacacaatgtatggcccttccagttcccgaaaaactaacaattggactattgaaatactctgaatgttctaatgtcaacccgatcaagaacttcacagaatgtgttggtagttgtgaatctgcaaccagcttcaatccaattttgggaatgatgcaatccaaatgttcttgttgtcaagccattgccttcaacaacttacaagtcgaacttcaatgccctgacggcagtgtgctcaagaaggacgtagaagtaccatccaaatgtaattgtaacataacagcttgcgaaggaaacttgaaatctatcgagcctaggtccatcgttcacagaggaagaagatatggcgtctattaaaagatagaatagtttgttttatgactagtgttacgtgttttattattaatatgtaagagttttattagagttaaataaagttggttgattttgaagac

SEQ ID NO: 670 - DNA, 982 bp, Diabrotica virgifera
acagtagatcactacattaccggtattcttctaaactgtgaatattcggattttgaggttttgactatttatatttaaaaataatgcattttttaaccaatgcaataattttgtacactttttaataattttatagttgaattttattattatggatcagaaaccagatttagatctggtgatatcggcagtttcagcgttgtacaataaccctaacagcagtgagaaggaaagggcttctaaatggcttttggaactccaaaaatccgtccatgcctggactgtagcagacgaattattacatttaaaaagggacttggaatcatgttactttgctgctcaaactatgaggacgaaaatccaccagtctttccacgaacttcctctagaagtgcacacgtcattaagagattcattacttgaacatattggccaaattaacgaagcaactaacactgttatagtgacacaattgtgtgttgctttggcagatttagccctacaaatgccatcctggcagaatcctacgttagacctaatcaatagattctcccaaactaatatatggccattgctagaaattttgactgtgttacctgaagaattggaaagtagatctgtcaggctaggtgaaaacagaagaatagatgtgttagaagagatgaaaatttctgctccaacagtgaatgaatttttaaaacattgttctaaactctacgaaactaattggcaagagcatgttcagttcaatgtaaaagtattacgctgctttacgtcctggatctccataggagctattaatctgaatgatcttttctgataagatcgttattaacaaagcattccgaaatactcaacttcaagccccaaaaatgatcaacattaccctaatcagctggcttccaatggaagttccaattgtctgcatttttattctttactaatttcttaatatcactatactccaacttcgctctgcaaa

SEQ ID NO: 671 - DNA, 464 bp, Diabrotica virgifera
gtgcagtgaatattatataattgtaatttttaggctgtcctaaaaaaccgtgaaaatggcatacttgcttaaccagggcgttcgtagattcatgcaaacgtctgcaaaaagagcagcccaaattgaaggcccctcagccgtatctggtggacatgaaggtggttacaagatttggaaaaacctcaccattttcgtagctttcccatcaattatactgtgtgcagttaactgctatctttctcaccaaagcggtcaccacgaacccccagagttccacaagtatgatcacatgagagttcgcaccaagagattcccatggggtgatggcaacaaatccttgttccacaatccacactgcaatgctttacctgatgggtatgaacaccattaaaataattttccaatagaaagtgtattatttaaataaaagatgtctttgtaaaataaatgtagttacaactaac

SEQ ID NO: 672 - DNA, 1122 bp, Diabrotica virgifera
acgccattgtgaactctaacgactttggaaccaagctgaagtaatccgtgattttttgtgccatcggtgtttcctagtactttttattcacaagtttaaattcaaaaaatcatggctggcgaacaagatatgcccaccttcaaatgcgtcttggtcggagatggaggtactggcaaaactacctttgtaaaaagacacatgactggtgaattcgaaaagaaatatgtagcaaccttaggagtagaagttcaccctttagttttccacacaaatagaggacaaattcgttttaacgtatgggacacagcaggccaagaaaagtttggtggtctgcgtgatggatactacatccaaggacaatgtgccataattatgtttgatgttacatctagagtcacttacaaaaatgttccaaactggcacagagatcttgttagagtttgtgaaaatatcccaattgtattgtgtggtaacaaagttgacatcaaagataggaaagttaaggcaaagagcattgtcttccataggaagaagaatttacaatactatgacatctctgcaaaatccaactacaactttgaaaaacccttcttgtggttggctaggaaactcattggagatcccaacttagaattcgtagctgcacctgccttgcttcctccagaagtccagatggatccccaatggcagcaacaaatcgaaaaggatcttaaagaagcctcagaaactgcactgcccgatgatgacgaagatttataaactcattaaccaattactaaaactctgtcatcgttccaaagcgcgtgtgtaacaattgatatcttacaagacttaagttaaattacattttatgtatttctgaagcagaactgttgatatttttatataaatgttttctaaatttgttgaaaggtttgtctggagtctggacgtatgttcttcatatatttggagatatggtttaaaggggttaatggctctggttaaaaaagcggtttaaaatccagacaaagcgcaatcggaatttttataatattgttttttttcaaaaaaaaaaaaaaaatgggggggcccctaaaaatttttttttttccgaaaaaaaaaaaaaaaaaaaaggggggg

SEQ ID NO: 673 - DNA, 1289 bp, Diabrotica virgifera
gcgccaagcaacacaacacaacacaacacaacacttagaattatttacacattaactaattcggtaacagtttgtgattataatttgggatattacatacctattacaaagtcttgttctgtgtttgtacagtgattgtcgattagtattcgggttcggtattgctttaatgagttgtcattaaaaatactgttcattttatagttttatagaatgctatactacctgctaatactattggcagtgcttctggtgtggaatatcgagtccagatttcaaaaatgggctaaatatggagtctacgtagcttattgttatttagtgccatttttgattcccctgtggctatttaatcctggagatagtgcaaatgcattactaccagccaggggttttcgaatagtatgtagactcttaggtgtgaaatactccgtagaaggaaaagaaaacgtaaatcccgatagcgggggagtagtcctgattaatcatcaaagtattttagatcttttagttttatccattctatggccgactattccaagatgttcgacaatagccaaaaagtccctcctgtacgtcgtaccaattggtttcgcaattggattatgtggcgccatcttcattgatagagaaaaatcgtcacaatcgcacgaagctgtcaacaagactgccacacaaataaacaaaagacaggctcgagtacttatatttccggaaggaaccagaaacggcggtctaaaactgctacccttcaagaagggtgctttccatttagccatagccgcacaatgtcccatccaacctgtggctgtatcgaggtttaccttcttaggaaagaataaatttacctcaggagaaattaagattaagattcttcccgcgatttctacaaaaaatttgacaacagaagacattccaagattattggtgagacttacgaactaatgtcaaaaactgggacgaaatccctcagtaaaaaccatagggccaaagggaaaaaaattggatgggcatttttttttaaaaggggggaaggggaaaaaattttgggggggggccccttaaaatttttaacttggcttaacccaatgggtaacattttatttgagtgccaacacaactttttttaaaggggaaaaaaaaatttgtggtttttaaaaaaaagttttttttaacttttttatttttttaaaaaaaaaaaaatttgtgaaaaaaaacccccctcgcgggtttttttttctccttttttttttttttttttttaaaaaaaaaaaaaaccccccctcctt

SEQ ID NO: 674 - DNA, 1039 bp, Diabrotica virgifera
  misc_feature (978)..(978): n is a, c, g, or t
  misc_feature (1016)..(1016): n is a, c, g, or t
  misc_feature (1021)..(1021): n is a, c, g, or t
attgatggtgatgttatcaccattatccattacgtgcatgtgttaatctatcaacgtgttatttgagtgtatgactatagatttccaacatgtcttggttaggccaaaacaatttaactagtttccaaaagttttgtattaaagttttgaaatatggacctgtgccacaacacattgcaattatcatggatggcaatagaagatttgctaaaaagacaaatgtccagaaagcagaaggccattccaaaggttttgaaaaacttgctgaatgtttaaattggtgccgagagctgggtatcagagaagtaactgtgtatgcattcagtattgagaattttaaaaggtcacaagatgaggtagaccacctaatgcaattggccaaagaaaaattccaaaaactatttgaagaaaaagaaagattgatgcaagaaggtatttgtataagagtaattggtgacttatctttactctctgaagatttaagaaaactagttgcagaagctactcttcttaccaaagataacaatagatccatattaaatgtagcattttcttatgtttccagggaagaaataactaatagcatcaaaacaattgttaaaggtgtggaggagggttatttagagaacaacgacatttctgaagaattgatttcaagttgtttatatacctacttgagctccagtcctgatatcttaatacgaacttcaggagaggtcagattaagtgattttttgctttggcagatatcacagagaacagaaatttgtttcactgatgtcttatggccagaattttcaatttggaatttactaggaatcatttttaagtaccagagaatggtgagaaataatgtattccacgatgagggaaatatacattccagattatataataaacccactgatggatgtcatccaccgatagaaattttagtagagaattgaaattaaaggagaaaacactggaatatatgcnatgcataaaattgcaattattatgatcagtatctttangtacnaaataaaacaatatttag

SEQ ID NO: 675 - DNA, 1685 bp, Diabrotica virgifera
cgacaatgaagctgctgcagaaaacagtggcaacgagaatggaacaggcgcggaaaataatgctaatgcagatgcccaaaatgatgctgcacaagctaatgaaaatggagctgccgcagaaaacaacggtaatgccgatgctgcccaaggtaccgacaatgaagctgctgcagaaaacagtggcaacgagaatggaacaggcgcggaaaataatgctaatgcagatgcccaaaccgacgccgcacaaggcagcaccaatgaagccaacgcagaaaataatgccaatgcagatgtccaaaatgatgctgcacaagctaatgaaaatggagctgctgcagaaaatagcggtaatgctgatgctgcccaaggtactgacaatggagccgctgcagaaaacactggtaatgctgaccctgcccaaggtaatgacaatggggctgctgcagaaaacagtggcaacgagaatggaacagcggcggaaaataacgctaatgcagatgtacaaaatgatgctgcacaggtgaataacaatggtgctgctgcagaaaacaatggtaatgctgacgccgcacaatctaatgacaacggagcagctgcagaaaataatactaatgctgatgctcaaaacgacgccgcacaaggtactgccaacgaagccaacgcagaaaataatgccaatgcagatgcccaaaatgatgctgcacaagctaatgaaaatggagctgctgcagaaaatagcggtaatgctgatgctgcccaaggtaccgacaatgaagctactgcagaaaacagtggtaatgctgaccctgcccaaggtaatgacaatggagctgctgcagaaaacaatggtaatgctaacgcagcccaatctaatgacagcgaagcagctgcagaaaataatggaaatgcagatgctcaaaatgacgccgcacaaggtactgccaatgaagccaacgcagaaaacaatgccaatgaaaatgcccaaaatgatgctgcacaagctaatgacaatgaagctgctgccgaaaacaatggtaatgccgatgctgcccaaagtaccgacaatgaagctgctgcagaaatcagtggtaatgctgacactcaaaacgatgctgcacaaggtaacgaaaacggagctgctgcagaaaacactgttgatgctgaccccgcccaaggtaatgacaatggagctgctgcagaaaacagtggtaatgccgaagctgcccaaggtagtgacaatggagctgctgcagaaaaaaatggtaacgctgaccccgcccgaaggtaatgaaaatggatctgctgcaaagaacagtggtaatgctgatgccggtccaggtaatgacaacggggcagctgcagaaaataaaaactaaatggcgaataccccaaacgaccgcccaccaaagtccgcaaatgatgcaaatgcaaaaaagaatggttgatgcccaaaaagggggctggacaagggaaacgaacaagggccttgctgaaaaaaacttgaaacccttgaaagcaaaaccaacccttgcccaaaaaaccggggaaggaacccaaccaaaaaaaaagggaaagggaaatttcaaaaagagggcaccaaagagaaacaaaaagaaagcttgttcgaaaaaaaaacaaaaaatggtgggtggggccccaaaaaaaaaaataaagggacccgggct

SEQ ID NO: 676 - DNA, 3090 bp, Diabrotica virgifera
  misc_feature (2996)..(2996): n is a, c, g, or t
cccttaacgtaaaaatttatcgaaaaccgacataatgagatcagtaacagttctttttgcaattatttgcgctatatcactagcgacagttattgctcagaatgcagatcctgcagtggatgttgcagatccagcttccagcttggcattagcatctgaaccatgtgtaaatgatgatgatgtgtatcctccagacgaaccttttccagacattccagcaaatggtactactcgaaacggaaccgaagtggtaaatcaaaataccacagttcctcaaaacagcgatccagaagggtcaggaaatggtgaacaggaaattaatggtaatgctgataaccaaactgatgctcctcaaccaaatgatgataatactacagcagaaaatagtacagatggacaaacagatgctccacaaggtaacgaaaatggagctgccgctgaaaacaatgcccaaacagatgcccaaactgatgctgcacaagggaacggcaatgaggcagctgcagataacaatggtagtgctgacgcggcccaaggtaatgacaacagagcagctgcagaaaataatgctaacgcagatgcccaaaccgatgccgcacaaggtagcgccaatgaagccaacgcagaaaacaatgctaatgcagacgctcaaaatgatgctgcacaagctaatgataatggagctgctgcagaaaacaacggtaatgccgatgctgcccaaggtaccgacaatgaagctgctgcagaaaacagtggcaacgagaatggaacaggcgcggaaaataatgctaatgcagatgcccaaaccgacgtcgcacaaggcagcaccaatgaagccaacgcagaaaataatgccaatgcagatgtccaaaatgatgctgcacaagctaatgaaaatggagctgctgcagaaaatagcggtaatgctgatgctgcccaaggtaccgacaatggagccgctgcagaaaacactggtaatgctgaccctgcccaaggtaatgacaatggggctgctgcagaaaacagtggcaacgagaatggaacagcggcggaaaataacgctaatgcagatgtacaaaatgatgctgcacaggtgaatgacaatggtgctgctgcagaaaacaatggtaatgctgacgccgcacaatctaatgacaacggagcagctgcagaaaataatactaatgctgatgctcaaaacggcgccgcacaaagtactgccaatgaagccaacgcagaaaataatgccaatgcagatgcccaaaatgatgctgcacaagctaatgaaaatggagctgctgcagaaaacaacggtaatgccgatgctgcccaaggtaccgacaatgaagctgctgcagaaaacagtggcaacgagaatggaacaggcgcggaaaataatgctaatgcagatgcccaaaccgacgccgcacaaagcagcaccaatgaagccaacgcagaaaataatgccaatgcagatgtccaaaatgatgcagcacaagctaatgaaaatggagctgctgcagaaaatagcggtaatgctgatgctgcccaaggtaccgacaatggagccgctgcagaaaacactggtaatgctgaccctgcccaaggtaatgacaatggggctgctgcagaaaacagtggcaacgagaatggaacagcggcgggaaataacgctaatccagatgtacaaaatgatgctgcacaggtgaatgacaatggtactgctgcagaaaacaatggtaatgctgacgccgcacaatctaatgacaacggagcagctgcagaaaataatactaatgctgatgctcaaaacggcgccgcacaaggtactgccaatgaagccaacgcagaaaataatgccaatgcagatgcccaaaatgacgatgctgcacaagctaatgaaaatggagctgctgcagaaaatagcggtaatgctgatgctgcccaaggtaccgacaatggagccgctgcagaaaacactggtaattttggaccctgcccaaggtaatgacaatggggctgctgcagaaaacagtggcaacgagaatggaatagcggcggaaaataacgctaatgcagatgtacaaaatgatgctgcacaggtgaatgacaatggtgctgctgcagaaaacaatggtaatgctgacgccgctcaaggtaatgacaacggggcagctgcagaaaataatactaatgcagatacccaaaacgacgccgcacaaagttccgcaaatgatgcaaatgcagaaagtaatgctgatgcccaaaatggtgctgcacaaggtaacgacaatggcgctgctgcagaaaacactgaaaacgctgatagccaaaacgacgctgcacagaataccggcaatgaagccaacgcagaaaacaatgcgaatgtagatgttcaaaatgatgcagcacaaggtaacgaaagtcaagctgctgcagaaaacaacagtaatgctgatggtgcccaaaataataataatggacctgctgaagaaaataattctaatgcagatacccaaaatgatgctgcacaaggtaacgaaaatgggtctgctgcagaaaatactggtaacgctgatagccaaaacgacgcaggacaaggttccgctaatgcagccaacgcagataataatgctaatacagacgctcaaaatggtgctgatcaaggtaacgagaatggatctgccgcagaaaacaacggtggtgctgatggtcaaaacgaaaatggagctgctgcagcgagcagcggtaacgcagataaccaaaataataacaatagcaataatgatagcggaaacaatcaaaacaatggtagcaattccgtggaagaaaacagcaaagaagattcaggtaacgaaagtcaagaaaataaagataataatgacacgtcagaagataactctgaggaattagacagtagcgaaagggaagaaaggcgcaaggaagaggaaaagaaacaaaaggaggaagagaataataacaattctgtggaaganaatagcaacgaagattcaaataatgaaagtcaagaagagaaagatagtaatgacacatctgaagatgactctgacgaattagatagtcgcgaac

SEQ ID NO: 677 - DNA, 2369 bp, Diabrotica virgifera
ataataatggaataagacctcggttctattttgatgtatttcgaaaccccaaggtaatgacaatgaggctgctgcagaaaacagtggcaacgagaatggaatagcggcggaaaataacgctaatgcagatgtacaaaatgatgctgcacaggtgaatgacaatggtgctgctgcagaaaacaatggtaatgctgacgccgcacaatctaatgacaacggagcagctgcagaaaataatactaatgctgatgctcaaaacggcgccgcacaaagtactgccaatgaagccaacgcagaaaataatgccaatgcagatgcccaaaatgatgctgcacaagctaatgaaaatggagctgctgcagaaaacaacggtaatgccgatgctgcccaaggtaccgacaatgaagctgctgcagaaaacagtggcaacgagaatggaacaggcgcggaaaataatgctaatgcagatgcccaaaccgatgccgcacaaggcagcaccaatgaagccaacgcagaaaataatgccaatgcagatgtccaaaatgatgctgcacaagctaatgaaaatggagctgctgcagaaaatagcggtaatgctgatgctgcccaaggtaccgacaatggagccgctgcagaaaacactggtaatgctgaccctgcccaaggtaatgacaatggggctgctgcagaaaacagtggcaacgagaatggaacagcggcggaaaataatgctaatgcagatgtacaaaatgatgctgcacaggtgaatgacaatggtgctgctgcagaaaacaatggtaatgctgacgccgcacaatctaatgacaacggagcagctgcagaaaataatactaatgctgatgctcaaaacgacgccgcacaaggtactgccaacgaagccaacgcagaaaataatgccaatgcagatgcccaaaatgatgctgcacaagctaatgaaaatggagctgccgcagaaaacaacggtaatgccgatgctgcccaaggtaccgacaatgaagctgctgcagaaaacagtggcaacgagaatggaacaggcgcggaaaataatgctaatgcagatgcccaaaccgacgccgcacaaggcagcaccaatgaagccaacgcagaaaataatgccaatgcagatgtccaaaatgatgctgcacaagctaatgaaaatggagctgctgcagaaaatagcggtaatgctgatgctgcccaaggtaccgataatggagccgctgcagaaaacactggtaatgctgaccctgcccaaggtaatgacaatggggctgctgcagaaaacagtggcaacgagaatggaacagcggcggaaaataacgctaatgcagatgtacaaaatgatgctgcacaggtgaataacaatggtgctgctgcagaaaacaatggtaatgctgacgccgcacaatctaatgacaacggagcagctgcagaaaataatactaatgctgatgctcaaaacgacgccgcacaaggtactgccaacgaagccaacgcagaaaataatgccaatgcagatgcccaaaatgatgctgcacaagctaatgaaaatggagctgctgcagaaaatagcggtaatgctgatgctgcccaaggtaccgacaatgaagcttctgcagaaaacagtggtaatgctgaccctgcccaaggatgacaatggagctgctgcagaaaacaatggttgctaacgcccatctaatgacagcgaaacagctgcaaaaaaactaaaatgctgatgcagggaacgcaaaaacgactgctgcacaaaatactgtgcctaatggggtcgaccccccgtccggaaaataatgccaatgcagatgtccaaaatgatgctgcacaagctaatgaaaatggagctgctgcagaaaacaacagtaatgctgatggtgcccaaaataataataatggacctgctgaagaaaataattctaatgcagatacccattttcgttaccttgtgcagcccaaggaaaccaaaaagggcctgcctgcaaaaaaaatgggaacccctaataaccaaaacaacccagaaaaaaggtcccctaaatggcccccacccaaataaaaaggtaaaaacaaacctccaaagggggttgaacaaaggaaacaaaaaagggatttccccccaaaaaaaaaccgggggggttttggggcaaaaaaaaaaaaaggggacttcttgcccgcgacggagggggaacaccaataaaaccaaaaaaaaaaaaaaaaaaaaaaaaaaaaagaataaaggaaaaaaaaaaacaaaaaaaaaatggggaaaaaaaatttccccgggggagaaaaaaaaaaacccccaaaaaaaaaaaaatatttcgtgggaacagaac

SEQ ID NO: 678 - DNA, 2216 bp, Diabrotica virgifera
gttcgcgactatctaattcgtcagagtcatcttcagatgtgtcattactatctttctcttcttgactttcattatttgaatcttcgttgctattttcttccacagaattgttattattctcttcctccttttgtttcttttcctcttccttgcgcctttcttcctcttccctttcgctactgtctaattcctcagagttatcttctgacgtgtcattattatctctattttcttgactttcgttacctgaatcttctttgctgttttcttccacggaattgctaccattgttttgattgtttccgctatcattattgctattgttattattttggttatctgcgttaccgctgctcgctgctgcagaaaacagtggcaacgagaatggaacagcggcggaaaataacgctaatgcagatgtacaaaatgatgctgcacaggtgaataacaatggtgctgctgcagaaaacaatggtaatgctgacgccgcacaatctaatgacaacggagcagctgcagaaaataatactaatgctgatgctcaaaacgacgccgcacaaggtactgccaacgaagccaacgcagaaaataatgccaatgcagatgcccaaaatgatgctgcacaagctaatgaaaatggagctgctgcagaaaatagcggtaatgctgatgctgcccaaggtaccgacaatgaagctactgcagaaaacagtggtaatgctgaccctgcccaaggtaatgacaatggagctgctgcagaaaacaatggtaatgctaacgcagcccaatctaatgacagcgaagcagctgcagaaaataatggaaatgcagatgctcaaaatgacgccgcacaaggtactgccaatgaagccaacgcagaaaacaatgccaatgaaaatgcccaaaatgatgctgcacaagctaatgacaatgaagctgctgccgaaaacaatggtaatgccgatgctgcccaaagtaccgacaatgaagctgctgcagaaatcagtggtaatgctgacactcaaaacgatgctgcacaaggtaacgaaaacggagctgctgcagaaaacactgttgatgctgaccccgcccaaggtaatgacaatggagctgctgcagaaaacagtggtaatgccgaagctgcccaaggtagcgacaatggagctgctgcagaaaacaatggtaacgctgaccccgccgaaggtaatgaaaatggatctgctgcagagaacagtggtaatgctgatgcggctcaaggtaatgacaacggggcagctgcagaaaataatactaatgcagatacccaaaacgacgccgcacaaagttccgcaaatgatgcaaatgcagaaagtaatgctgatgcccaaaatggtgctgcacaaggtaacgacaatggcgctgctgcagaaaacactgaaaacgctgatagccaaaacgacgctgcacagaataccggcaatgaagccaacgcagaaaacaatgcgaatgtagatgttcaaaatgatgcagcacaaggtaacgaaagtcaagctgctgcagaaaacaacagtaatgctgatggtgcccaaaataataataatggacctgctgaagaaaataattctaatgcagatacccaaaatgatgctgcacaaggtaacgaaaatgggtctgctgcagaaaatactggtaacgctgatagccaaaacgacgcaggacaaggttccgctaatgcagccaacgcagataataatgctaatacagacgctcaaaatggtgctgatcaaggtaacgagaatggatctgccgcagaaatcaacggtggtgctgatggtcaaaacgaaaatggagctgccgcagcgagcagcggtaacgcagataaccaaaataataacaatagcaataatgatagcggtaacaatcaaaacaatggtagcaattccgtggaagaaaacagcaaagaagattcaggtaacgaaagtcaagaaaataaagataataatgacacgtcagaagataactctgaggaattagacagtagcgaaagggaagaggaagaaaggcgcaaggaagaggaaaagaaacaaaaggagaaagaaaagagaaaacaaaaggaagaagaaaaaaggataaaagaacaacaaaagcgagaagaggagcgacagcgtagagaggaagaacgtctgcgacgggaagaagaacgcaaacaaagggaaaaaaaaaaaaaaagggcggcc

SEQ ID NO: 679 - DNA, 2554 bp, Diabrotica virgifera
gttcgcgactatctaattcgtcagagtcatcttcaaatgtgtcattactatctttctcttcttgactttcattatttgaatcttcattgctattttcttccacagaagtagcattattctcttcctccttttgtttcttttcctcttccttgattctcgaattcacaagagctacaaaattaaaatttttattgtaaaataaatattttaaataatttttttgtaatgaaatgttattcgcttttacatatatctaattttttaagaaataaattaaatttatttattaacaatatattgataattatatatttatatattatgaatataaaatatttatagggatgagctttgaactatgattttattaaaatttaatttttaaatagaaattacgattaaaaatttccatatgtacaaaatgatgctgcacaggtgaatgacaatggtgctgctgcagaaaacaatggtaatgctgacgccgcacaatctaatgacaacggagcagctgcagaaaataatactaatgctgatgctcaaaacggcgccgcacaaagtactgccaatgaagccaacgcagaaaataatgccaatgcagatgcccaaaatgatgctgcacaagctaatgataatggagccgctgcagaaaacactggtaatgctgaccctgcccaaggtaatgacaatggggctgctgcagaaaacagtggcaacgagaatggaacagcggcggagaataacgctaatgcagatgtacaaaatgatgctgcacaggtgaatgacaatggtgctgctgcagaaaacaatggtaatgctgacgccgcacaatctaatgacaacggagcagctgcagaaaataatactaatgctgatgctcaaaaccacgccgcacaaggtactgccaacgaagccaacgcagaaaataatgccaatgcagatgcccaaaatgatgctgcacaagctaatgaaaatggagctgctgcagaaaatagcggtaatgctgatgctgcccaaggtaccgacaatgaagctactgcagaaaacagtggtaatgctgaccctgcccaaggtaatgacaatggagctgctgcagaaaacaatggtaatgctaacgcagcccaatctaatgacagcgaagcagctgcagaaaataatggaaatgcagatgctcaaaatgacgccgcacaaggtactgccaatgaagccaacgcagaaaacaatgccaatgaaaatgcccaaaatgatgctgcacaagctaatgacaatgaagctgctgccgaaacaatggtaatgccgatcgacgctgcacagaataccggcaatgaagccaacgcagcaagtccgcccacgcgtccggttcaaaatgatgcagcacaaggtaacgaaagtcaagctgctgcagaaaacaacagtaatgctgatggtgcccaaaataataataatggacctgctgaagaaaataattctaatgcagatacccaaaatgatgctgcacaaggtaacgaaaatgggtctgctgcagaaaatactggtaacgctgatagccaaaacgacgcaggacaaggttccgctaatgcagccaacgcagataataatgctaatacagacgctcaaaatggtgctgatcaaggtaacgagaatggatctgccgcagaaaacaacggtggtgctgatggtcaaaacgaaaatggagctgctgcagcgagcagcggtaacgcagataaccaaaataataacaatagcaataatgatagcggaaacaatcaaaacaatggtagcaattccgtggaagaaaacagcaaagaagattcaggtaacgaaagtcaagaaaataaagataataatgacacgtcagaagataactctgaggaattagacagtagcgaaagggaagaggaagaaaggcgcaaggaagaggaaaagaaacaaaaggaggaagagaataataacaattctgtggaagaaaatagcaacgaagattcaaataatgaaagtcaagaagagaaagatagtaatgacacatctgaagatgactctgacgaattagatagtcgcgaacaaaaaaagaagaaggaagaagagaagaaacagcaaaaagaggaagaaaaaagacgaaagcaagaggaaaagagacagaaacaagaagagaagagacaaaaggagaaagaaaagagaaaacaaaaggaagaagaaaaaaggataaaagaacaacaaaagcgagaagaggagcgacagcgtagagaggaagaacgtctgcgacgggaagaagaaacgcaacaaagggaagaagaaagaaggaggaatcaagatcaatggatagatgcacttaagaagacaatcgagagaaaactagcatatttagactacattaagaaccagtatggaatcaatgttcaatgtgactctgaaatctgcagatgccggtgtcttcttaacaacaaccattccggttattgctcaagaacaaaagaatgtgtgtgcgtgtagaaactttaggaaaatacaaatttggcttgtatgtttttgtattatgtaaatagataattcatttagc

SEQ ID NO: 680 - DNA, 1159 bp, Diabrotica virgifera
cacgggctagcgagaaagcaccagtgggttggtacgctgtgacaagctcgattctttcgttcaatagtaccatcaacgagtactattaccagtatatttatcagtcaacgctattactcagtcagcgtggtttgagggtcgatatagtacgcgaatatcttcttaagtagaattgtgaccggtcgtgagttggttgtgcttgaagaaaatagctcatcaaaatgactataccagatcccttaaagtttaataactttgacaatgaaacaatacaaaaccaaggaacagaaaataaatcactcacccaaattcaagagttctacaagaacacaaacgtttttgttactggaggaacaggttttctaggtaaacttcttttagaaaaactactacggtcctgcaatgacctcaacagcatctacgtcctcatcagaaacaagaaaggcaaaaacgtaacaactagagtagaggaaatttttgaagacgtcgtttttgacaagatgaaagttgaatgtccaaagtttatgcacaaaattgttgctgttgctggagattgttccttgcctgatcttggactgtcgatacaagatagaaaaactttaatggaagagattaacatagtatttcatgctgcagctacagttcgttttgacgaaaaaatgaagacagcagttgccattaatgtacgagctacagaagagttgctgaatcttgcccaccaaatgccaaaacttaaaagctacatccacgtttccactgcctatgcaaattgcccagaaaaagtgatagatgaaaagttttatcctccagctttggattacaaaaaactgctagtgatgacagatacgttgtcggataaaatgatggataatttaactccaataatgcttgacaagtatcctaatacctatgcgtatacaaaacagattgctgaaggtgttgtccaagaagtgggagaaggacttccacttggtgttgcaagaccagcgatagttgttgccacctatagagaaccagttcgagcatggataaataatatgtatggtcctacagggatagttgcaggagcaggcgtaggtctaattagggtagtacattgtgatgaatatgcccatgcaaacatagtacccagagatatgtgtgtcaactctataatcgc

SEQ ID NO: 681 - DNA, 1299 bp, Diabrotica virgifera
gaccattcgactggacttgtaggtaccaaaaatagtacataataatatattaaaaatcgcgacaagtcttatcggtactgataagcaacacttgagatatttttatttatttcagaaacatgagtttagatgttagttgttgccttttgtgctattcggctgtggtcacagttattgctttactttatgtctttctggacgtgaactatttcataagaatcgcttttactataggattcagcaaattttttgagaaaaagaagaagcttgaggatggcactcatatatacggagtctgcacatcacaagatatggacatatttttctcgcatatgaacaatgccagatatattcgcgagctggattttgccagatttcatttttactttgtaacagggttatatgacctaataaaaaagaataagggccatgttttacaaacagcttcaaacattcggtacagaagaacaattccttggttcaacacttacaaagttactacaaaaattgtctattgggacgaaaaaacaatgtacattgaacaacaattcgtcactttgcacgacaacttcatcagggctgtaattcttagcaagcaaacgaccattggtttgaatgtgccagaacttatggccaaactgactggttgtgatgaaagttatagaccaccacttcccgaagagttacaagattggttgtcgtccatagaaaagagtagtaataagttgaggaagaaagaataaatggtttaataatatttataataaattattacatgttatcaaatgatatttattattgattaattaacgattttaaagtagttatgcatatagtgtagattttggaacaggcgtctcatattgacattttatgtaatggcttgttactggatttgtgctatatcaaatattttatgaaataccttatgtaacatgattacataatattttacagttacttcattctagttataaaaaattgcttgtcgataggatcgatccccatagaaagactgttgaatggtatattccaggataattttgagttcctacagtggttctagaatttttttgatgtcaatatcataggttcgtgatacgatgcgttggtagatcttgacggagaacaattggggcaaggaggatctaacgaccctagaggacaatctttgatgttacgtaggccgaacgcgacgccctctgagcacgcactccagacactacagacttcgccgtctaagccgcagccttgccattagggccatgccctttgtgtatgctgttaaatccacctgct

SEQ ID NO: 682 - DNA, 616 bp, Diabrotica virgifera
aataaaattatcatggcattcaaagttcttattttcgcatccgttttggctttcgccaacgctgggatttatggtgaagctccattagctcttcctgctactccggtagtatcagcttactcaagcccactattgacagctcctactttatccaaatctgttgttcaaacatacaccagccacgctgcccctgtagccgttgctgctccagttgtcgccaaagctgccccattggtgtccgcttattccgctccattggctctaccagcacatggacccgtactatcagcttactcatccccgttagcgtatgccgcacctgcaccagttgtttcagcatactcttctccagttgtttctgcttactcctctcccgttgtatctgcttattcagctccacttgtcgccaaaactgtaccccatgtagcttacgctgcacctggcccagtggtatccgcctactctgcaccaattgttgctaaaagtttagctccagcaccaattgcctatgccggacatgcagctccagtagtctctgcctattctgcgggaccaattgctcaaccttggtaattgacactttgatatatgtatttaatttatatatttataatat

SEQ ID NO: 683 - DNA, 1934 bp, Diabrotica virgifera
gtctgaagtctgaatctcttttctctttttttcgcttttaatcttttctgtttggttggtctggtacccgggtacccggtagagacggtgacggtagagcgaggattcaaataaaaatcataaatcattcagttttttgtgaagacatttgggaagaagttcagtacagtttaacagtcctttagaaataatttaccatggctaaacaatcatacaaagttgccgacatgagcttggccgaatggggccgcaaagaaatcactttggccgaaaatgaaatgcccggcctgatgagtctacgagcgaaatacaaggacaacaaaattttgaagggggccaaaatagctggatgtcttcacatgactgtacaaacagcagtattaattgaaaccctcgcagatcttggggctgaggtacaatggtccagttgcaacatcttcagtactcaagatcacgccgctgcagcaattgccaaaaggggaattccagtatatgcgtggaaaggggaaacagacgaagaatacgtttggtgtatcgaacagaccttagttttcccagacggaaaaccattcaacatgattcttgacgacggaggtgatctcacgaacttggtacacactaaatacccacaatatttgaccggatgtaaaggaattagcgaagaaaccaccactggagttcacaacttgtacaaaatgtacaaggaaggtacattgaaggttccagctatcaacgtcaacgattcagtcacaaagagtaaattcgacaatctgtacggctgtagggaatctctcatcgatggaatcaaaagagcaacagatgttatgctcgctggtaaggtctgtgtcgtagctggatacggagatgtaggcaaaggctgtgcacaatctttaagagcatttggtggacgagtattgatcacagaaattgaccctatcaatgctttgcaagcagctatggaaggttacgaagtcaccacgatggaagaagcctccaaagaagcccaaatctacgtcacgacaactggttgtaaggatatcatacggggtgaacatttcctcaatatgagagacgacagcatagtgtgtaacattggacattttgactgcgaaatcgacgtcgcttggttagaaaagaacgccaaggaaaaagtcactatcaagccacaagttgaccgttatctcctctccaccggtaaccacgtgattgtcttggccgaaggtcgattggtcaatctaggttgtgccacaggtcactcttcattcgtaatgtcaaattccttcaccaaccaagtcttggcccagatcgaattgtggacaaaaccaggagcatattccctaggagttcatatgttacccaaacatcttgacgaagaagtagcaagactccatttgaaacatttgggagttaaactgactaccttatcagctgatcaagcacaatatttgggtatatctgcccaaggacccttcaagtccgatcactacagatactaattttgtatggtaacagttaatattaagcagatctaagtgggacttttaaaactatttttaataaagtatgaagcaatttgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggagaaaaaatataaaaaaaaaaaaaataaaaaacaagaaaaaaaaaaaaaaatgggggggccagatagaaaaaaaaatttaatgtacggggggggggtacagaaaaatgttttttaaaaacccccgaaattaatccccttgggcccccgtttacaaaaatcccctttgggaaaaccccggggaaaccaaaaaatacggcccggatcgcccttctccccttctcctccggtggagaaaaaacaaaagagccccccc

SEQ ID NO: 684 - DNA, 1201 bp, Diabrotica virgifera
ccctctcgcgcgtccaacaaattgacacatgtttggcatgtttcgtcttttgggaataacaatataaataataataataaagttttataacagaaattttataatggggaagccccacgttcgctatttttccactgctggatcaaatgatcccaaagtaaaaactgaagaaaagcaaaatagtaaaggaaataaacaatttaaaggaaaggttaaaacggggaaggtaaaaacggaagcaaaacaaaataatgaaaataaaaaatttaagggaaaagctaaaccaccaaaagaattaatagaaaagtataccagaggtgaggaagttgatgtcaaaggtgttagaacatccacacaccaaaaaataattcaaagaaaagagaaaaatattaaatttgcgatagaggaatcagctaaaacagaagttttattgacagaagattcaggatatttggaagcagatagtggtgaaacaacaacccagttcacccaaaaacacttagttagggaagtagatatagctgctgcttcaaagcactttgatttaagattaaattttggtccatatagagcaaaatatacaaagaatggtaggcacttattaataggaggtaaagtgggccatgtagctgcatttgattggataacaaaaaaactacattgtgaaattaatgttatggaatctgttcatgatatttcttggttacacatagaaacgatgttcgctgttgctcagaaaaattgggtgtatatttacgacaatcaggggattgaactacattgtgtgaagagattaaataaagtatcaagaatggaatttttaccttaccattttcttttggcaagttgtagtgatgaagggtacttaggctggttagatatatccataggacaaatcgctggcctttacaataccggattaggtagattatctgtattatctcaaaatccgtggaatgctacattatgtacaggacatgctaaaggtgttgtgtcattttggtcacctacttctagagatcctttagccaaaatgctttgccacaaagcacctatcgttggacttcacgttgatcctacaggaacatatatggctacctcagcatcaaacagagaattaaaaatatgggatgtacgaaaattagaggggcctgttcaagagtataaactcattcaagcagcaaataatttaaatttttct

SEQ ID NO: 685 - DNA, 1326 bp, Diabrotica virgifera
ccttacgcggcgtgttataagattgaccaaaaaccaatattgaagttgaagacaagtaactagttgagctaagtgatcgtctacaccgttttaatgccacgatgagaagtgttgaggtccttgccattattggattggtgtcttcaattcactctggtaactagttgagctaagtgatcgtctacaccgttttaatgccacgatgagaagtgttgaggtccttgccattattggattggtgtcttcaattcactctggattatgtgccaaacccatagaaccttactacggaagaaaaataggaaacttagtcgaattcgcccacggtataaaagggactgcatacgcggtagatgagagtacgatattcatcaaaggattttattatgacggtactggtccagacgctttcttctggattggcaattctccaaggcctagtccagagggaacaatcataccatatccggaagactacaatggcagggatccaccggtattacgggcttacaacaacactgacataatcctccgactgccaatgggaaaaagaattagggatatccgatggctgtctgtctggtgtagacgattcacggtagattttggcgaagtatttattcctcccaacttagaagtgcccaaaccaagggtccttccagaattcaagcgtttagctcatggccttcgatctgacaatattagtattttagatgcaaagactttttatatacccaatttgcattatgacggagccggccctgatgcctatttttgggtaggaaatgggtcggaacccacctcgtttggaatcaaagtgcccaacgaaatgggatcgctagaacctttaaggggttatcaaggtgaagatatagaaattcaacttcccgggttattgacagtgtacgatatcgattggttaggaaatatggggggtccagtacagacacaatttttgggcccccgtttaacataacccaaaaaaattttggatggacccgccccgctttttggggcaaaactaaggggcttttaaaatatgcccggaaaacccccgaaggggagtttcccttcccaaacccggaaaggggaaaaaaattaaatttttatattttttttttggccctttttttttttctttttttttttaatttttgggttttttataaaaaaaattattttttatatgagagtttttattttttttcacaaaatttttttataatttttttttttaaacacccctctttttgtcggtccttttattttttcttttataaaaaaaaaaaaaaaaaaaaaaaccccacattaatatttatttttttt

SEQ ID NO: 686 - DNA, 1246 bp, Diabrotica virgifera
gaaaactgtaggaggttaggtcgttgaagtgagagcgtatcttgaataaaaatttattatttaattttaaaatgtttcctaacagattattattaagtgtgttcaaaagtagccagtgtactatttcaaaggtgcctcaaataaataatggctttcgattcgctgttaatatacaaaatgcaagacccttatattcaaaggtaacattaggaattgatatgtttttacaacaatgccaaacgacaggaaaacaaatggaaaatatatctgaaaagttcaaagaaaaaatgtttgagtttagtcaagatgaaggcaagcacatggtgtttacagaagatttaaaaaatatgatacatttatccaaagatgaaaaagatctggatttagtggtcaagatgataaaaaagttcaataaacaaaataaggaactcagatttggaagttttgtttttggtccagttgttctgcgtctattccatcattacaacagacctgatttagctttagaatgcttcaaatcagatgagctatcaggattttttgatcaaattatttcatatcaaatactcctagaccttctgtacgaaaaccagatgtatcaagaaattctcgactgcgcagattttatcaaagataaacaaatggaaggtatgaagtatccacgaaatgttgttgttcttgctatggctgcctgttacaaattaaattccaaagaaagcttggagtacgcattaaagttgtggcaagacctgaaagacattggccatttccctatgagacgggcatgtactttttgcgcaggtatagcatataatcagggaaatccaggaatagctttagaaatactcacatcagcaaaaattcaaaattataccactgtaagaaatttaaaggtcgcgtgtttggcctctgtgggtagggttgaaaatggcatttcaataatgaaaagcgttttgagcgaaaaccccccgggatctcaaaccccccttttataaaatatcctcaaaaaaagattatcaacttttttccaccttttgacaaccccaaaattagcgggggaaattaataagaaaacaaaaaagtacttttccaaaaaatgtgctctttttttctacaaaaacactagggtggtgaagaaggattttttcgccccaaaaaaattacccccccccccccccccttcttctctcctccccaaaaaaaaaaaaaacaaaaaaaaatttattccacccccccgcacttaatt

SEQ ID NO: 687 - DNA, 1027 bp, Diabrotica virgifera
  misc_feature (1011)..(1011): n is a, c, g, or t
cggacgcaaaggttcactaaacgttaaaatgataattgttaaagtcgcgattattttaacaagtttgtactctgttattgttaacagctatagaattcatagtgatccacagaatattcaaccagctgattctactgtgatattaacgcatgttctttttagacatggaaacagaaccgctgaactatctgaaacttaccctaaggatccctatcgcaactttacctactttccaataggaagaggacaattgacaaacgctggaaaactaagagagtaccaaattggcaaggatctgcgtagacgctatgataagtttttgggaccagtgtattatccagaggtcgtcgacgctgtcacgaccaacaagaatagaaccaaagcatcgcttgagttagtattagccagtttgttcaggccaaaatacacagatgtttggaattgggcacttggatggcaacctgttccctataattattatccagtagatcacgatccagtacttatgggtataaattgtccacgttaccaggcattatacaaggaactggtaaactcacccaaatggaaggctacatttaaaaaatatcaaaaagacttcgattatatctcgaaaaatacagggttgaacgtaacttcattcaaggaggtgtacgacatgtactttggtttatccactgaagaagaatacggacaagagttgccaccatggacgcattcagtttggcctaaagtgattgttgatttatccatcaaacaatattatgtggaaacgggtaccacagaaatggcgaaacttgcggaaggatttcatttgaagaaaattatagaagacactaaaactaaagcgaaaaaacgtgaaaagaatggagtaaaaatgtatttatattcagctcatgaaaataatgtaggagagatgatggtacttctcgatgtgttcaaaaatcctcatgttccctccttatggggcttacttgatctttggaagtcataacattaataacgttatangaaattaagtatacta

SEQ ID NO: 688 - DNA, 660 bp, Diabrotica virgifera
cttaaggaggctgtaggtactgttggcccaatatcagtatgtgtcaacgctaattgggactggcaactgtatagcgtctgactacaagtatcaaggattagacggtgactgcaaacagtgtaatccggttatcaaaaccatcaatggctatgcatctgtagatcaaaccgaagaagcacttaaggaggctgtaggtactgttggcccaatatcagtatgtgtcaacgctaattgggactggcaactgtatagcgggggtatccttgatagccaaagttgtccaggcgacattttaaaccatgcagttttagctgttggatatggttcagaaaatggtaaagacttttggcttatcaagaattcgtgggacacttattggggagaagcaggttatttgagattagtacgtggtacaaaccagtgcggtatcaataaagtggccgattatcctctcctataattttaaaaattgtcatgccttacagtttatataatgaaacatgaataaaaatattataacttttaacaaaaaaaaaaaaaaaaaaaaaaaaaaaaaaaaaaaaaaaaaaaaaaaaaaaaaaaaaaaaaaaacgggggggggggcccccccccaccacctctttggggggggttttaaaaaaaaccggggcgggtttttta

SEQ ID NO: 689 - DNA, 1642 bp, Diabrotica virgifera
atcattgtgaaattaggtgtgaaaggtgtttaaaaatgaggttccttattctacttgccgtattggctgtagctgagattgactattttatccttttacaaagaatatccattttgagcaacactgcaggtgatgcaggaaaaaactataatgatatactcgcaatccaacaaatataaaaattattaagagtaaaaaattatattgaacgagaagtaatttgattgatgcttactagattagtattcgatgtgcatattcaaatgaagctagtaatagctgaaaaaactggtctgatgatatcagcactattgtaaaagctgcattactagctaatctgaacgtctgtcgtaattttgtttcatttggagagtaatacatttaatgctagttaaagagccagttttggtgttatcttttttatttttacactaagaatgatatgcttttttgataccttgtgtgtcacggaaaattaatctaataattctaatatttattattttcgaatttaaagaagctaaatcttgtacatttctattgtaaaataaatattttaaataattttttggaaaagaaatgttattcgtttttaaatatctctaattttttaagaaatatactaaattaatttattaacagtatatttataattaaatatttttatattactaatattaaatatttctaaggatgagctttaaaataaaattttattaaaatttaatctttaaatcaaacattaagatcaaaaattctcatattttaaaatacgccattatttatttttatcatattattatccctattttatataaatgcccttattaaaccataaattcatattatttaactttagtaatgatgataatattagcattagaactctgcatacttagtaaaaagatataggtttcacaaaggaattcggcaagtatcaaggattagacggtgactgcaaacagtgtaatccggttctcaaaaccatcaatggctacgcatctgtagatcaaaccgaagaagcaggttatttgagattggtacgtggtacaaaccagtgcggtatcaatgaagttgccgattatcctctcctataattttaaaaattgtcataccttacagtttatataatgaaacatgaataaaaatattataactttaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaaaaaaaaaagggggggcccctttaaaggatccaaatttaaagacggggggttgggagggtaaaattttttttaaggggccccaaaatttaattccgggggccgttttttaaaacgggggggggggaaaaacccgggggttccccaatttaatccccttggaaaaattcccccttttccccgtgggggaaaaaaaaaaaaagcccccccccatcccccttccccaaatttgcccaccctaaaggggaaaggggaccccccctggaaggggcatttaaacggggggggggggggggttaccccaagggggaccctttactttggcggggccctagggcccctcctttttttttttttccttttctttttcccccagttccccggttttccc

SEQ ID NO: 690 - DNA, 987 bp, Diabrotica virgifera
gtcataaccattaacgattcaaacaaaatcttggaggaagacggagaaataacggcccgttttttcgttacactcacatgacaacgttcaaccaatcaaaactctgagaatcgggcgttggcactgcgttggctgctgacgtcatttgtcatataaatagcaaccgcgccaagaaaatcatcaagttcgtttggaaagctgcattactagctaatctgaacgtctgtcgtaattttgtttcatttgtggtgtaaaagttaaaactcatcaaccaaaatgcgtgaatgtatctcagtccatgttggccaagccggagtccaaatcggtaatgcctgctgggagttgtactgcctggaacatggcatccaacctgacggtcagatgccatcagacaagactgttggaggaggagatgacagtttcaacacattcttcagtgaaactggtgccggcaaacatgtacctagagcagtatttgtagatttggaaccaacagtagtagatgaagtacgtaccggcacataccgtcaattgttccacccagaacaactcatcactggcaaagaagatgccgccaataactatgctagaggtcactatacaattggtaaagaaatagttgacttggtattggacagaatccgtaaattggctgatcaatgtactggacttcaaggtttcttgattttccactccttcggtggtggtactggatctggtttcacttctttgttgatggaacgtctatctgttgactatggtaaaaaatcaaaactggaattcgccatctacccagctcctcaagtatctactgctgtagtagaaccatacaactccatcttgaccacccacaccactcttgaacactcagactgtgcctttatggtagataatgaagccatctatgacatctgcagacgtaatctagacatcgagcgcccaacctacaccaacttgaacagacttattggccaaatcgtatcctca

SEQ ID NO: 691 - DNA, 1120 bp, Diabrotica virgifera
agggtaaatgggatcccgggcagggtaaaaccgtgctttgggtgatttggccagggggggaggttgacccaaaggatgtaaaatcttattattgcaaccataaagagcaacgttgccattcaattggtaggcggggggtccgaattggtttcaaagtaggtatcaaccactcttgaacactcagactgtgcctttatggtagataatgaagccatctatgacatctgcagacgtaatctagacatcgagcgcccaacctacaccaacttgaacagacttattggccaaatcgtatcctcaatcacagcttctctaagattcgatggtgctctaaatgttgacttgacagaattccaaactaacttggttccttaccctcgtattcacttccctcttgtcacctatgccccagtaatttccgctgaaaaggcttaccatgaacaactttccgtagctgaaatcaccaatgcctgtttcgaacctgccaaccagatggtaaaatgtgatcccagacatggtaaatacatggcttgctgtatgttgtacagaggggatgttgtaccaaaggatgtaaatgctgctattgcaaccattaagaccaaacgtaccatccaattcgtagactggtgtccaactggtttcaaagtaggtatcaactaccaaccaccaactgttgtacctggaggtgatttggctaaagtacaacgtgccgtatgcatgttgtccaacactacagctattgctgaagcctgggcaagattggaccacaaattcgatcttatgtatgccaagagagctttcgtccactggtatgtaggagagggtatggaagaaggtgaattctctgaagctcgtgaagatttggctgctttggagaaagattatgaagaagttggtatggactccggagaaggtgagggtgaaggagctgaagaatattaaatttgattccaaacatgacaaatcacttgtttttaagacaaaaaattcctttcaatttttttacactttttcattacttttctgtgaaacgattatttaaagtctgatttaatttaatacagaattttttacgagcaaaaaaaaaaaaaagggcggccgtcgcgatctagaaccggac

SEQ ID NO: 692 - DNA, 2713 bp, Diabrotica virgifera
cggacgcgtgagcggacgcgtgggcggacgcgtgggcggacgcgtgggcggacgcgtgggcggacgcgtgggcggacgcgtgggtggcaacccacgcgtccgctagttagtgctcgccggcgagcgcccgcgcccccgccccgaaagctgcattactagctaatctgaacgtctgtcgtaattttgtttcatttgtggtgtaaaagttaaaactcatcaaccaaaatgcgtgaatgtatctcagtccatgttggccaagccggagtccaaatcggtaatgcctgctgggagttgtactgcctggaacatggcatccaacctgacggtcagatgccatcagacaagactgttggaggaggagatgacagtttcaacacattcttcagtgaaactggtgccggcaaacatgtacctagagcagtatttgtagatttggaaccaacagtagtagatgaagtacgtaccggcacataccgtcaattgttccacccagaacaactcatcactggcaaagaagatgccgccaataactatgctagaggtcactatacaattggtaaagaaatagttgacttggtattggacagaatccgtaaattggctgatcaatgtactggacttcaaggtttcttgattttccactccttcggtggtggtactggatctggtttcacttctttgttgatggaacgtctatctgttgactatggtaaaaaatcaaaactggaattcgccatctacccagctcctcaagtatctactgctgtagtagaaccatacaactccatcttgaccacccacaccactcttgaacactcagactgtgcctttatggtagataatgaagccatctatgacatctgcagacgtaatctagacatcgagcgcccaacctacaccaacttgaacagacttattggccaaatcgtatcctcaatcacagcttctctaagattcgatggtgctctaaatgttgacttgacagaattccaaactaacttggttccttaccctcgtattcacttccctcttgtcacctatgccccagtaatttccgctgaaaaggcttaccatgaacaactttccgtagctgaaatcaccaatgcctgtttcgaacctgccaaccagatggtaaaatgtgatcccagacatggtaaatacatggcttgctgtatgttgtacagaggggatgttgtaccaaaggatgtaaatgctgctattgcaaccattaagaccaaacgtaccatccaattcgtagactggtgtccaactggtttcaaagtaggtatcaactaccaaccaccaactgttgtacctggaggtgatttggctaaagtacaacgtgccgtatgcatgttgtccaacactacagctattgctgaagcctgggcaagattggaccacaaattcgatcttatgtatgccaagagagctttcgtccactggtatgtaggagagggtatggaagaaggtgaattctctgaagctcgtgaagatttggctgcttttcttatcatctctattttttttacgatccttaaccgcataacaccgtatctatcattgtgaaattaggtgtgaaaggtgtttaaaaatgaggttccttattctacttgccgtattggctgtagctgtgaatgctacatcaatccaccaacaatgggctacatttaaggtaaaccattccaagaagtacggacatcttaaagaagagcaagttcgcttccaagttttctctcaaaatctccgcaaaattgaagaacacaatgcaagataccagaatggtgaagtgtccttctacttgggggttaatcagttcgcagatatgacttcagaggaattcaaggctatgcttgactcccaactcattcacaagcctaagcgaaacattacatcccgctttgtagctgatcctcaattgactgttccagaatcaattgactggagagaaaagggggcagttgctcccataagggaccaagggcaatgcggatcatgttgggcatttagtgcagctggtgctcttgaaggacaaagatttttaaagcagaacgtactagaagtactgagtacccaacagttagtagattgttccggtgattacgacaatgaaggctgcaatggtggttggccccattgggcatataactacattaaagatcatggcctctgtctagagtctgattacaagtatcaaggattagacggtgactgcaaacagtgtaatccggttatcaaaaccatcaatggctatgcatctgtagatcaaactgaagaagcacttaaggaggctgtaggtactgctggcccaatatcagtatgtgtcaacgctaattgggactggcaactgtacagcgggggtatccttgatagccaaagttgtccaggcggcattttaaaccatgcagttttagctgttggatatggttcagaaaatggtaaagacttttggcttatcaagaattcatgggacacttattggggagaagcaggttatttgagattagtacgtggtacaaaccagtgcggtatcaatgaagtggccgattatcctctcctataattttaaaaattgtcatgccttacagtttatataatgaaacatgaataaaaatattataactttaaaaaaaaaaaaaaagggcggccgactttttttaaaaaaaaaaaaaaaaaaacaaaaaaaaataaaaaaaaaaaagggggggccccc

SEQ ID NO: 693 - DNA, 951 bp, Diabrotica virgifera
gaaaggtttggatttggaagactgaaaacagtgaaaactgcattttaaatgggatttagtagaaattagataacattatacatttaatgatggatttagaatcaatacaaaatatatttgacgcaacatgtgtccggtattccatagtatttcttctttggatcgagttcatctgggaaacatatttatcgttccggcaataccaaaaagcacaaagtgtaacagaggtcccagaaataattaagaaggtaatggatgcagatgaatttgagaaggcgaggcaatattcactagcgaaattaagatttggttttgtaagagacacatatggtattctgtatactaccgttgtaataacctacggtctcctcgcatttttttgggaccatgctgaatctatcaatcctgtaaaaggagaaatcacaactagctgcatatggctgtttagtgtctcccttatatcaacaattatcgatttaccattgacaatataccacacattcgtgttagaagaaaaatttggttttaataaacagtccgctggattctttatttgggataagattaaagcttttttcgttagccaactcattacattgattatttgttcagtgattataagtataattaaaagtggtgggcagtacttcttcatttggctatgggctgttgtttgtgtcatctcaatggttttactgacattatatccttctgtaattgcgcctctcttcgataagtatacaccattaccagaaggtgaattgagaacatctattgaaaatttggcttctgaattgaaatttcctttaacccaactgtatgtagtagaaggatccaaaagatcttctcatagtaacgcctatttttatggtttatttaaatcaaaaagaaattgtgttgttcgatacattattgcctaaggatgatggtacaggatgcaaaaatgatgaa

SEQ ID NO: 694 - DNA, 1157 bp, Diabrotica virgifera
  misc_feature (1089)..(1089): n is a, c, g, or t
  misc_feature (1095)..(1095): n is a, c, g, or t
  misc_feature (1122)..(1122): n is a, c, g, or t
gtagttttcatatctcaaccgcgtcttcggagcaataaaaaaattggcagtttgaagtaggaatttcaacaccctgtatctcggaagcgaagcatttgcggacatgcgtttgtggagcagactgccattgttttctcatgcagaattgccccttaaagtttttcatacttatttgctaacaccttgtataacctagtatttgaatttgcaatgatatttcatgaaaattgtcacagcataaactatcagttgatggtacttctcccattggataagttgggtcaacgaacatctgaactgtctgttgatggtactgatgtcgcgtaaagatacaggaaaggcaccttcactagatttttttggtattttcaagaagacatttacaaaaagagtagtaccaaagcgttgtctttaaatttggaatttcttgtaaggattttcatgaaaagggtccgaatttaagcttcccgttgaacattttggttgataaacgtgtgaactggatgtacacggtactattattgtggcaatcctcaagatagtagcaatccttaagattgtcattgtaattggttgcacttaggtcaaatgatcaatcattctctcagttgcagccaagatgtctttctcctaatggagcatttttgctacaaaatcggtagtaccaacggtagttttagtggaattaacaacttaatagagtcagttatttttctagatgctgccaggataagctttattttactaaagcactttttgctacaaaaacggtagtaccaacggtagtttcaatagaatttacaacttgatagagtcagttatttttctagatgctgccaaaataagcttcattttaccggagccctttttgctacgaaaagtgtagttaaagggcggattatttaaatttacaattatttatagtggtatttcatgagattagccttagttcaaacccattaacatttagtagtatatttgctaaacaaatctttttatattaaaaaaaaaccatctagcagttctatttcataaataattttttatactcatttgattatactcgaacattaccctcatacgtactanaactantaatctttattttattcttttgcattngtttgttttttatatattttttgattattatgtct

SEQ ID NO: 695 - DNA, 905 bp, Diabrotica virgifera
tgaattgatattgcttgatctccttaacaattttttacatctaatgtctccggtgttatctacaatttgttgttggtttcagtgtgtgtcgcagttgtgtctaaatcagtatttaatttaaaaaatggataatgaagaaagtgggctatttactggaacaaaaactcaacttttggctgctgtatttggtactctttttgcaatttccgatggaatgacttacggatggactgcccctattattccatacctcataagtccagagagtcacattaaaactacaaagtttgaagcagagtggttagagtcctgtttaatgatcggctcttttctaggattaccaatcaccatttatctggttgataaaataggaaggaaaaaatctttattacttgctgcagtattgtcacttatttcatggataataatagcttttgccggaaatatggtgcttttatttgtagctcgatttatttttggtgtgacggcgaatacatcttttgtagcagctccaatatatgttgcagaaatcgctgatcacaagatacgaggatttttgtccagtattatttatttaaatatgcttttcggactcatattagtttatagtgttggtccctatctacccttttttgttgcaccattaataggtgtcactgttttatttatcgagctattggtttttccttttatgccggagacaccatattatttgttacataccaatcaaaaagatgaaggtaaaaagtcattggagttttttaggccaggaaggaacatagatcgagagttggcagacataactaaagctgtagcacgtcaaactacagaaacaagaaagattacttgatctattttcagtaaaagcaaatcgaaaagcgattacgattatggcaattttggat

SEQ ID NO: 696 - DNA, 845 bp, Diabrotica virgifera
cggacgcgtgggctttcaacggattgtcaaaaatatcatttttaagtaatttcaagaataaaaagaaatgtaaaaaatgtctgtgcgttatttaacaaaagcaattaggtcggttagttgtaatctaggaagaggaaatttttacactcccttatgccgtcacaatttaactactttcgccccaggtatcaattccagtggaaccattggtgttggagaaaagcctaagaaaaagaaaacggtggaaatacctagtataactttaatacaaggcaaccacttgtccgttactactttggaggaagcacaaaaattatcgaagagaagagatttaaaacttgtaaagatagttgatctggatactaaaacacaaagacctatatacaaattaatgacaggtgcagaatatcatgctgaagacataaaacagcgcttacagaaaaaagaagagaagcagggagctattaaaggtgaaaaagttttaattctgaatcataaaatctttgagcaggacttgcagacccaaataaagaaaatcggtaaatggataaacaaaatgtacgaagttagagttgtgatcaatggagacagtagtaacatggaaaaagctgagtttctttatagtgctatagagaaatctttggagaaagacgtaaggattgtgcagaagagacagaaaggatctgatattaagtttcagatattacctcctaaaaaaaataaagaagattctaagggtttatgactagagaggggtaaaataatatgtatagttatttttattcttattgttaaatattatgtctattttagatattttaaaaataaaaggaaataagttttgt

SEQ ID NO: 697 - DNA, 951 bp, Diabrotica virgifera
  misc_feature (761)..(761): n is a, c, g, or t
  misc_feature (865)..(865): n is a, c, g, or t
  misc_feature (917)..(917): n is a, c, g, or t
  misc_feature (923)..(925): n is a, c, g, or t
cccacgcgtccggtgttaatttcgtaaaataaaatgaagagattagttacaatagcaacgatcatattttttgtgagtcaacaagctttttctatagtacttacagacttatgtacaagtaacgtgtactgcaaaggaaacttattagatgtagtccaaaaatctggagtatttaacgattccaagacatttgtagacctggtacagaagtatccggagaacgttactcttgacaggtttaacaaattaatggttagcactaaaaatcgtcctacaaagatcaacataacccgttttataaaagattgtttttcttccgaaggtgagttggtaaaatggactcctccagactacaaagacaatccaagtttcttaactaaaatcaacgatactggagtgaaaagttttgccaagaaactgaataatatttggccattactggctaggaaagttaatagcactgtttctaaacatccggcgcagcattcgttgatttcgttgccgaatggttttattatacctggtggaagattcaaagaaatttattactgggattcttactggatagttaaggggttactgatatgtggaatgaaagagactgctagaggaatgctggagaaccttatctcgctagttagaaaatatggttttgttccaaatggaagcagagtctattacctgaatagatcccaacctcctcttttatcgttaatagctgggctctattatgacgctacgaaaaatataacattcattanaaaaaatatagatatgcttgaccgagaagtaaattggtggttggaaaacagagcagtgagggttcgtaaggattctattatacacacactattacgttactcangtaaaagtggatttcctaggcctgaatcgtatgtagaagatcttcatacttngtgaannngttgacataatttctaaggtgattgc

SEQ ID NO: 698 - DNA, 868 bp, Diabrotica virgifera
  misc_feature (794)..(794): n is a, c, g, or t
  misc_feature (836)..(836): n is a, c, g, or t
caaaattattaattttttattcttcagatatgagtaataatacaactgaaagagctctcaatcttcttagatttttacctagagtatgcattgcgaatattagagataatcctggagctcgcaagtgtacgagaaggggtagggctcaacacggtggagattaccacgggcatggtaacaaaggatcgaaggcgaggcaaaactatacacgacttggttatgagacaggaaataatccattttatctgcgttttccatgggaaccatattacagaggacaccatttaaaacgccagtatccaccattatcaatgttggatctccaaaaactaatagacaccaatcgcatagacaccacaaagcccatcgatttagtagcaatcttaaacacaggcttgttcaaaatctacccagatcaacatcattttggagtacaattgacagacgaaggcgcagatatattcgatgccaaaattaacctcgaagtccagtggtgttcagaacatattatagcagcaatcgagagaaaaggtggtgttatcacttccgcttactacgatccacacagtctgcaggctatggttaacagcaagaagttttttgaaagaggtattccaataccccgcagaatgatgcctcccccagacgctatagaacactactcagatcctgcacagaggggatatttggcagatcccgagaagatatcccaagagcgtctagtcctagcccagaaatatggttacacgttaccaaaaatagaaaaagatcctgcatacgagatgttaatgganagggaagatcctaggcagatattctatggtctacatcccggnatgggtggtcaatttgacggataagactatac

SEQ ID NO: 699 - DNA, 966 bp, Diabrotica virgifera
ctctacgcgtccgggcattatgaaagtctatgttgttattgcttgtcttattgtgacaatcgctgccgaattgaacggttatgaccactgggtttctttcaaggctaaacattcaaagcaatataaaataacagaagataaactaagattccaaattttccaagacaaccttcgcgaaatagaagagcacaacgcaagatacgccaaaggagaagtaggatggtacaaaggtgtcactccattcgctgattggaccaaagaagaattcaaggctctgttgacacgtcaagctgcttccaggcctaagcttaacgagagtttgggggttcatgtcgccgatccaaatgttaagttggcatcctctgttgattggaggagcaaaggagcagtattgcctgtaagagaccaagctagctgtggatcatgctgggcattcagtaccgcagctgctttggagggacaactagcaatacacaaaaacgaaaaaattcctttgagtccacagaatcttgtggactgctctacacaaaatgacggttgtgatggtggagaccaagtgctggctttcaaattcattaaatcaagcggtattagctccgaagctgactacccatacgtaggagtcgaccagaagtgtcacaagaatgtccacaaaactgttagtaccatctccggctacaaacatctaagtgcaaatgaaaacgctttgatttctgctctttcttctattggaccaatctccgtttctgttgatgccagtgtttggtcactatacgcaggtggtcttttcgacgaaagagattgtggtactgatatcaaccatgcagtactcgctgcaggatacaccgacgaatacattttagtcaaaaaatcttggggcacagactggggtgaagaagggtatatcagactaccaagaggacataacatatggccaatcaacgaagaaaattcttaccccatttt

SEQ ID NO: 700 - DNA, 910 bp, Diabrotica virgifera
atttaactaaataatattattttttatttttaaaactagctcttacacatacacactgaaaatataaagattaaatgatatttaagtagtgcgctttaagtacgtgactgccatccaatgtttgctagaaataaactttttcctaaattttcaaaaagattattttgttcaaaaagtattaaaactgaaaccaagtaccaaaaacgcatattttctggaattcaacctacaggagctatacatttaggaaattacttaggagctattgcacaatgggtaaaattgcaagaccaaggagaacatgtcatacttgcaatagcagacctccattcgatgacattacctcacgaaccgaagatattgttgaggaacattcaagaaatagcagctacacttttggcttgtggcatagatccaaataagacaattttatttcagcaatcgaaggtggctgtgcatacccaattgtcttggtgcctaggatgtatttgcacaatgcctagattagcacatcttccccaatataaagaaaaatcaaaagatttgaaagacatacccctaggtctgtttgtatacccagttttgcaggcagcagatattttggcatacaaagctacacatgttccagtgggagaagatcaaatacaacagattcaacttagtcaagatctagctagaatgtttaataaaaaatttggcgaaactttccctattccgcatgcactaacaacaggttctgaatatgcaagattgagaagttaagagatccgtccaaaaaaatgtcgaaatctgatcctgatcctaaaagtagaaatttgtttaacagacaggccggatgatattgtaagaaatattaaaaaagctgaactgattcccttcagaggtcacttaaccatcccccaaagaaaac

SEQ ID NO: 701 - DNA, 674 bp, Diabrotica virgifera
  misc_feature (18)..(18): n is a, c, g, or t
  misc_feature (21)..(21): n is a, c, g, or t
  misc_feature (30)..(30): n is a, c, g, or t
  misc_feature (39)..(39): n is a, c, g, or t
ccgtcaaggcgtcgcggnggnttttacagntttgttaangcgtaatgagcaaaagaagctaaaactaattcaagtacaaatagtcacatttcatatcaccaaagataaattaaaaatggaatttcagccactcattttagtttttcttgcattagttttggctgcaaatgctcttaaacccaatgaatgtgaagtatgtatcaaaactttgaataagttctcagccactttagacgaaagtacgcgaaaagatcccaaaaagattgagactgagtttaagaagtattgtaaaggattaaaaaataaggaacatcgactttgttactatttgggaggactggaggagagtgcgactggaattctaggtgagatgtcaaagcctctttcatggtccatgccttcagacaaaatctgtgaaaaactcaaaaagaaagacgcacaaatctgtgaactccgatatgatgtagagatagatttaaagacagtagatctgaagaaacttaaggttagggacctcaagaaaattttgaatgattggggtgaagattgtgagggatgtatagaaaagagtgaatatttgaagaggatagaagacctaaaacccaaacacgtagacctgtgaaaaatgtgaaaaattaggaagattttaaattgtattagctcattggactgat

SEQ ID NO: 702 - DNA, 808 bp, Diabrotica virgifera
cgacttagtgtcagtgtgacactgtgacagttctaagtcccgtaattcaaaaatactcagattagggcagtgctccttaaattataaactttgtagttttaaatataaaacaacatggtaaaagcaggcctaagtccttgtgatcctagttcattttctagaccagatcaagtcattgttactgaattatttttgaatttggatgttaattttgaatcaaaaacattacatggacatgctattctttctataaataaaattgatgaaacagctacagaactgaattcatatcgagtatgaaactgcccccgacgccagtggtcttcaatggctccagccacaaacaaccgcaggaaaaatacacccatttttatttagccaatttcaaccaacacatgcaagatctgtgataccttgccaagatactccagctgttaaacatccttacagagctacaatttctgccccaaaggaattggaagtgttaatgtcggctatcaatgaaggatccaaggtgattggcgacaagaagcaatattctttttaccagcagattccagtgccttcttaccttatagcccttgctgtaggtgctcttgaatctaggcgtttgggacccagatcacacgtttgggcagaaaaagaactgatcgaggagagtgcctatgaatttgctgaaacagaacatcaacttaagactgctgaagatatttgtggaccatatgtgtggggtatatatgatcttctggtcttacctcccagttttccatatggaggaatggaaaacccttgtttaacttttgttacg

SEQ ID NO: 703 - DNA, 1778 bp, Diabrotica virgifera
  misc_feature (1681)..(1681): n is a, c, g, or t
tttcgaccacttagtgtcagtgtgacactgtgacagttctaagtcccgtaattcaaaaatactcagattagggcagtgctccttaaattataaactttgtagttttaaatataaaacaacatggtaaaagcaggcctaagtccttgtgatcctagttcattttctagaccagatcaagtcattgttactgaattatttttgaatttggatgttaattttgaatcaaaaacattacatggacatgctattctttctataaataaaattgatgaaacagctacagaactggtacttgacacatttaaattgaatataacgtcgatatttgacgctgataaaaattgtacagaaaaattagaatatacattatcagatcacttagaagattttggatcaaaattaacaattcagttgccccaaaaagaagttaaaaaaattcatatcgagtatgaaactgcccccgacgctagtggtcttcaatggctccagccacaaacaaccgcaggaaaaatacacccatttttatttagccaatttcaaccaacacatgcaagatctgtgataccttgccaagatactccagctgttaaacatccttacagagctacaatttctgccccaaaggaattggaagtgttaatgtcggctatcaatgaaggatccaaggtgattggcgacaagaagcaatattctttttaccagcagattccagtgccttcttaccttatagcccttgctgtaggtgctcttgaatctaggcgtttgggacccagatcacacgtttgggcagaaaaagaactgatcgaggagagtgcctatgaatttgctgaaacagaacatcaacttaagactgctgaagatatttgtggaccatatgtgtggggtatatatgatcttctggtcttacctcccagttttccatatggaggaatggaaaacccttgtttaacttttgttacgcccactttattggctggcgatagatctttagctaatgtaatagctcatgaaatatcacacagttggacaggaaatctggtaacgaacaaaaccttcgagcatttctggttaaatgagggttttacaatgttggttgagaggaaaattattagtagattggtatcaccacaaatgcaagactttgacgcctacacgggcataagtgatttaaaagaagctatagaagtgttgggtgctgatagtcctttaactcatcttatagtagatttaaaaggagtccatccagatgaagcattttcaacagtcccatatgaaaagggtcaaacattccttaggtatttagaaaaaactgttggtggtccagataagttcgagccgtttttaagatcctactttgataccttcaaatacaaatctattgacagcacagattttaaaaacttttttgaaaattactttgaaagtgaacctgaaatcaaaaatattgattgggacaaatggttgcataccccaggaatgcctttaaccattccagattacgatacttccttggctgaagcctgtgatcaactcttggagaaattttacaattggacgggagaaggttctttgccaatatctgctgaagaaaagcaacaacttataccagaacaactaatatactttttgcagaaactgtcagaagctgagtcgcaaccaattccaaaacttgttgctttanatgaactgtttggttttgatggtgttaaaaattcagaaattaaattccgttggctgaaaactggcattaaggccaatgggaagtacaaatcaaacgc

SEQ ID NO: 704 - DNA, 940 bp, Diabrotica virgifera
  misc_feature (877)..(877): n is a, c, g, or t
cgaattaccgaaagactcgttcctcgttctccaaaggtcgtctcgattcacgcgaaacatatgattttgctaaactgataattgaagttttaagttaactaggtgaccatgcatcaattatttacggtttttgtaacgggtgtttgcttttttaattgtgcgggaagtgaggagtatgttagtgaattaaaagatgcccaacataaaaggaatacggacacacacgaatcttactatcgtacaggaatagaatcttatcacaaccaagagggttatggcccaccacatcatcatcataatggatatcctcacccagatgctgaacctcggtcgtattctggatccaacgcagactcgtggaacgattaccaaacacgacacagaattccactacctaatccgttcaataccccccaggattatcaacctcgacagagaattccaggacataattcgttcaatcctcctcacgaatatgaaccaagacatagaattccagtacaactttcgttcaatccacctcacaatcatgatacatcaaattgtgaatcttgcgacgatgacagaaatgctagaaataatcggaagcctgaagtagcagttacaaaatacgctaataatagcgcaaaagagattcccagagattatttggaaaaattggatatgtatgacgtagatgatattttactaaactatcttgacggatatgaagatgacgacccagacgccattattttcaagtagattttggatctgacacaacacaagagagaaaagcgggttatattcctgctaaagcaggttgcaagccggaaaacactacagttcctctggtaaattcagacgatccttccattttgtacatttcccaatgtancagaatcgagagatgcaatgggtgctgttcacatcgactacttgcatgtcagcctattgaaat

SEQ ID NO: 705 - DNA, 946 bp, Diabrotica virgifera
gtaatatttgtaatttctttttttcttcataattaaaaatttacatttttaaagatgagtattttaatgtatatgcttcgtacaatgcgaaattctgcattttcacctttacattcaacatggaaagattctgtcatgaacctctcatccggcaaagatccagtttcgaagaacccgatttctccaagagtggaagaatttagaaagaaattgcaacagaaaacacctattggaaagttggatgaacaaatggggaaacatccatatgaagaagagcagcccttgcctccttggccaaataatactaatccacatacaggggaagtagggggccccagaggtcctgagcctacgcggtatggagattgggagagaaaaggaagagtatccgatttttaagatcttttggttggttattgactgatggttattatgtagcttgtttttcttttgtaaagatgttatatattttgattatagtttttatataaatgtagacttgttaatgaattgaagggcttaatgtgaaacaaagacaaaccacacatgagttcaaaaagagttagtgttattcttggttaaagtaaatagtataaccagcactaccaaattatctcagcccccttcgttaataaatggcccgataaaatctattgggtcccactatttgcatattgcctaaattttttctaatatctacctccaacaataatgaaaacccaccatccaaaaaatgggcgaaacaattggaaaaaaaccgtttccgttaattttatttcagctttccaacgatctcaaaaaaaaaacataagggaaaaaatgcccttacccatttcaaagaaacaggctccccctcgaacccccgactatactcaaaaccaacaacgaccccccaatctcttaataaacccgccaactcgcttttttttttctttaaaccgggggt

SEQ ID NO: 706 - DNA, 1248 bp, Diabrotica virgifera
ttcctttttgttcatatttatttccagtctcaccttcccgtattccttttctagatttcttaccatgtaactgatatcaaggacggattcaggacaggttttcgggaggggccatgaacttttttttgagagggtctgggaaattttttaaaaatttggtttacagtggtgagttttaaggcacttttcacaaacttttgagtgtcataaagacacaaaacttatcgttattaaagtattattaaagtcaggacacatttcttcggatctaagtgcagttctttcaacaagtttaatactgtttttgccaatgcttctcctgtcaggccttgttcttcccctttttctgattttcactaattatttttatattcttataagcgtcaatgagcttgacaaagtcttcacgaatgttgttattgtgcatgtatctgtatctcacatttagagaaaactgtttcacgtgggatccgtcggtcatttcgtcaaacatgacagagtaataatttgcactttgaacctgattcattatttattcaattatttcttcaccacaacatgttatatgttatcattgattttgactggtgctactaatgtatgttgctcgggaagatgcggtggataggtgttgtttgaatcttatctcctgatgcgattttaaaccttaacaattcccctcattgttaggtctagcatcttcgtccagaagcagaaggctatcatcacgatagcctcttagaggagtattttgtcgacttaagaacactatagactctactattagtcgtagtctttctctattttcttgtacctatttcgacctctgagagtatatctgtttaatgactgacttttgcaggttgcgataactttatagaaaatccagcccaacctgaacgcactccttgtggtatgatgttttttcatgggtttgtatggctccctctttgacgatgagtttggctaaacatgttaaaggtttcgtgacaagactttgagctgtcatccctttagtgtgaccatgtttttcgttagaaaaataaaacgcaatcttgataaacaatctcttttgactgtgtgaaagtaccaataaactcctttgttctaagtgctgatgacccaagtaatgcttaatttcttttctatgtgtatacagaatatggaaattgatacgattttgatgcctgccaaggtcgttctaaaaattgccactttgtaaaattatcaacattttgattttgcaaa

SEQ ID NO: 707 - DNA, 1953 bp, Diabrotica virgifera
  misc_feature (1796)..(1796): n is a, c, g, or t
  misc_feature (1907)..(1907): n is a, c, g, or t
  misc_feature (1918)..(1918): n is a, c, g, or t
gtgagagtgaaactgaacttcgtgtgtgtgtgagtgtcacaatcgtatggagtatcttcttcgcgagtgaagtgaatgtgacctggacctcgactttgataccgcgccgtagctatgaaggtccaactatggtttctgcttataattcatgtgagctgcttgttaggaattaccaatgctgtacgctcatctatatatgcccctttgcatttgatcagtttgaaggacataacagccgacgaaagaagacagattgcactcctggagcagaaactagatagagcaaaaagatcaggacacccaggatcaggatcaggatcatccgggtcaggatcaggagatatcttaaacgctataaaaaacgctattggtaatagcatcaagaaaaaagtaggacaattggcaatggcgtcagcatctgcttccggagccttcagcaaaactagtagcggtggtggcgatcatcattctcatcatgagtattacgaacatcatccgcatccaccgccacatcattatgagagtcacagctcccacagctcccacagctcatttgatttctgggatctcaagaaatcagtcctcaacacactacttcaggcggtcaaagctatcaaaggtggcgtaatagctgtcaaaggacagctaattaaaggaggaggcaagctggtgtcagcttctggtcatctagtaagctcacagggagacgctatcaccaatcttggaaagcaaatagcaactagtgctatattagtgccatggatggggtcttcagggaaagggcatcctcatgcagaatacgaatcagatcaccactacacagcaccaagtgctccagaggatatccactaccatcacggtcctcactcagatcatcacgaagactatcatgttccagaacactatccaccaccacatcgagcagatgcagctggattactggtcctaaagaaagtgacaaaccgtggcagccacaaccaccgagaggatatccactaccatcacggtcggacatcagcccccaccaagcatctcctagtttcggtactataattggtaaattactgtcagcatcctcatcactcgatcctcacaaacctgacttattcgggaatcggccacccgtagaacacgacacacacgatagctaccaggcgtatgtgataccaaatgataaggagaatgaggttattcatgcagcttctggtgtggttaatcatcaagtatcaacctctaatgttccaaaagtagttcataagaaacctacgtttgtagctcctgtcaaagatgactctattttcgaagatcctcctgaagatctgaacgaaaatttcgacataacatcccatcatagtcataaagtaccagtttcccatcagaataatgcgtatcttatcaattctgataacaatgacttcaatgcccatcataaggaaccagtttcgtatcaaaatagtgcatatctcatagattctgacaaccaagactttaatcttgatcctagaggacaatccagtccgacttcttttcagtctgtagcaaatcccttcgatgtaacgttagacgaagccaaagatcttgctccaactagtccatacttgtcaccccctaccaaaaatcaacagattgttacagattttaatcaagacgaaccagaacatgatgaaatgcaagcagcttctgatgctaagtacacccaaattaccgaagactctggtaaatcaaaaccttctccttatttagaaacaccaatagtcaagtactttctcccaacacccagtgatctactcccagtntaagtcaagtatgcccctatggctttttacaagaacccctccccaacatcttcttcttccagcagaagccctagctacaaaaaacattcgtcccacaaaacctccaaacancagcatcaaanccatgatctttgtcaatctatttcctatgaattag

SEQ ID NO: 708 - DNA, 1368 bp, Diabrotica virgifera
cccgccgcatgtatttcaaacttaaaacctcataaataaatattaaactatcacaaacacaatcaaatcccccagtcaggtagtagttgttgtcctttctttgctgtgaacggttacgggttgtctttcgatgtcggttttaaggagagtgctattcaaacggctttttttgccgaaatttaaccccaaagtgacgacaaatggtttcgcaactgactcgaattccagtgggtttattactacttctgataccgtggaagtaccgaagtgttctttgaatgaatatgtgtttcaaaatgtgcatctttgggaaaattgcatagctacagaatgtgctgtgactggaaggaattacacctactcacagcttaggacaaaatccaaaaattttggagcagctcttcggaagaagttcaaacttgagaaaaacgataccatcgccattttattgccaaacgttccagagttccccatcgtaacattgggtgcaataagggcaggactgatttgcaccactgtaaacccaatctacacagcagatgaaatcagtaggcaactgttggattcttcgaccaaagttattgtaaccctcaacgaattatggccgttagcagatgcagcgacaaaacaagcgaaaaagaacattccaatagtaactatcaaatcgcagcaaagtcaaagtgttccatcgggtgcagccaactttgcagaactggcggattgcaactcagacgtaccaagtgaagaatcttgggatagcgtagcatttttaccttattctagtgggacaactggattgcctaaaggtgtcatgctaacacatcacaatatagtagccaatgttgcccaaattgggcatccaaaattgcttatcagcagacaaaccacacctgatcaccaagatgtcgttcctgcggtgttgccaatgtttcatatttacggattgacgatccttagtatgttccaaattaaactgggggttaagatagtcaccttgccaaaatttaccccagaactgtacatcggtaccttgaagaaacataagccaaacgtattgtacttagctccacccatagctatatttttaggaaaagttccgcaagtacaggcggaagacttaaagtcagttagggcagtaattaacggtgcagctcctttagggcaattggatggtatgaggttaacggaaaaagctaataaagatcttccaatactccaaggttatggtttaactgaaacatcacctgcggtaataaccactcgactagcagagtacaacaaagaaagtgtgaagggttccctcggaaggccagttcccaacactttccggacgctagttaatccccgaggacccgtcaggagctccct

SEQ ID NO: 709 - DNA, 1326 bp, Diabrotica virgifera
tccttattatctggcaagatgaagacgtcgttaatagtgctgttattggcggtatcacaatcgtactctcagggcccctacaactaccaaagaccatccaacccttttgaccacagttcatcgcattcgaatcctttctctaggtttaataatggtccaggctttcacccttctacttcagtatcagtagtaccagcgttaagttatcctgtaaattcattattagatcagggatacaactatccacgcccaaatggtggttttgactccaatttaggttcaccgtcgtcgaattcacctaatttcaattcaggaggtaacggtggttacaactatcaatctccaaatcccggattccttctaccatctgctacaagaaatgtaaacttcaattcaggatttaacgatggacccagttctgggtcacaccattctggttcatttttatcttcttcgtcaaatggcgttaattcaggattgaatggtggatacaattatcctatcccaaatagcggatcgcacaattctggttccctattaccatcaggttctcaaaactctggatctttcttaaataatattccaagtatcaactacggcagccctagtctttctggatctctcttcccttcagcttcatctaacttaaactctgggtcacccttcaataatgtaccgagctctaattacggtagtcccaacctcttctcaggtgactcacgcccatcaccatcgtttagcaataacaatggtctatttcctggtgactcacactcttcaccatcatttggacccgtaccagagcaaaaacatgtgtatgtatacgttgctcctccagagccagaagcagaatccaaacaacttcatattcctgctgcaccagtaaaccacaaaatcatcttcatcaaggctccgtctcagtcagcatctaggacacatgtcgtgccattgggtgccgatcaagagaagacattggtttacgtattggtgaagaagccagaagatcctgaagtccatttgagaacgcctgctcctactctagcatccaaaccagaggtttacttcatcagatacaagaccgaaaaggatggaactggagcgcctagcaacgggttgccttctgtagaagataacagaaggggggcaaacattggaggttttgatcctagcagcagtggttctagtccaaacggcgtatcgcctgtatatggtccatcacgttagtgttgtaagatagtttatctatatttttttattgctcttctttgtgatatagcttatgcgtaataaaaaactcggtgacgaaaagaaaacaaagggcgccgc

SEQ ID NO: 710 - DNA, 1348 bp, Diabrotica virgifera
cccacgcatccagcaagatgaagacgtcgttaatagtgttgttactggcggtatcacaatcgtactctcaggggccctacaactaccaaagaccatccaactcattggaccacagtgcatcgaattcgcatcctttctcgggatttaataatggtctagactcaagctcttcccacaattcaggatcagtagtaggggcaggttttcttggaaattctggcttaaatcaaggatacaactatcctcgtccaggtggttctgacttaggtggttcatcatcgtcgaattcacttaatttcaattcaggaggtaacggtggttacaactaccaaaatccaaattctggatttaatctaccatctgcttcaagaaatgtaaacttcaattcaggatttaatgatggatccacttctagttcacacaattctggttcatttttatcttcttcgtcaaatggcgttaactcaggattgaacggtggatacaactaccctagtccaaatagcggatcccagatttctgggaacgggaacttcggactaggcaacaatggaggaaatttactttcatcaggttctcaaaactctggatctttcttaaataatattccaagtagcagctacggcacccctggcctttctggatctctcttcccttcggcctcatctaacttaaacaattttggtaacaatggacttaacaatttgggtaacaatggacttaacagtggctcccttaacaccggatcactcttcaataacgtacccagctctaattatggcagtcctagcaataacaacggtcaattttctgattcaaactcttcaccatcatttggacccgtaccacaacagaaacatgtatatgtatacgttgctcctccagatccagaagcagaatccaaacaactttatattcctgctgcaccagtaaaccacaaaatcatcttcatcaaggctccgtctcagtcagcatctaggacacatgttgtgccatcgggtgccggtcaagagaaaacattggtttacgtattggtgaagaaaccagaagatcctgagatccatttgaatgcgcctgctcctactctagcgtccaaaccagaggtttacttcatcaagtacaagaccaacaaggatggaactggagcgcccagcaacgggttcccttcagtagatagtaacagaaatggaggaaacaatcaaggttttgatcctagcagcagtggttccaataatgtaaatggcgtatcgccagtgtatggtccagcgcattagtgtagaatattgtatttatatttttttactgctcttttttgtatatagcttgtgcataataaaaaatcggtgac

SEQ ID NO: 711 - DNA, 805 bp, Diabrotica virgifera
  misc_feature (552)..(552): n is a, c, g, or t
  misc_feature (619)..(619): n is a, c, g, or t
gccggatagttcttaacgttagatttaaattaattttaagtttagtgtaagaagtcttaattataatggaagagtatgagtacggcaaactctttgtgggaggattatcctgggagacgacccaggataatttacaaagatacttctccagatatggggaagtaattgactgtgtggtcatgaagaatgcagaatctggaagatcgaggggatttggcttcgtcacattttcagatccagccaatgtaaatgttgttttacagaatggaccacatactctggatggaaggacaattgatcccaaaccatgtaacccaagaacactgcagaagccaaagaaaggtgggggttatcccaaagtatttttgggaggtttgccatcaaatgttactgagactgacctcagaagttttttcacaagatttggaaaggttatggaagtagttataatgtatgatcaagaaaagaaaaaatcaagaggatttggttttctgtccttcgaggatgaggaagcagttgatagatgtgtacaagagcattttgttaatttanatggaaagcaggtggagatcaagaaggctgaaccgcgcgatggatctggtggtacaaaatgggcggnagaccagcgtcagcgtggggacctccctcagctccaatggggatgatgcaaggcccccatggacagatgggtggccctccaatgaacatcggcgcgccgatgggtcccaatatgatgcaaagctacccagggtgggggcactcgccacagcaacaaagctatgcaagctatgggacaccatctgga

SEQ ID NO: 712 - DNA, 1504 bp, Diabrotica virgifera
atcaaccccaactctaaaatatcttttatttttttaatgatattgtggcttgtttcccattaaatggttaaaattgtaaaaatgacactacaacatactttcagaacatcattcattaatgttggataataaaaaagttacctactttgacaactggacatgctcttcagcaatgcacggggattttgaatatgtgcaactaacttcggacgcgtgggcggttccgataagttcgcgtaattcactacactgttctttggcttgtagatagcggacgtgatataaaatacaaaaatgtttgcctgtgctagactgattgcccctgccaccagaagcgcactcgttgccaacacaaaacaatacttgaggccactgagcagtgtagtaaaccaaagtcaaatacaggtacagaatgtgcaacaacacaagcaacctaccctcctccccgctatccgcagtttccaaactacaccagtcagcagagacattgactctgcagctaaattcattggtgctggtgctgccacagttggagtagctggatcaggagctggtattggaacagtgttcggttcactcatcatcggttacgccagaaaccctagcctaaaacaacaactcttctcatacgccatcttagggttcgccttgtccgaagctatgggtctcttctgtcttatgatggcgttcttgttattgttcgccttctaaataatcggcctttacgggcaacatcatcttattccaccgttcgttacgtcaacaccatgtaactcatatttttaacttaaataaaattcaataggacttttattaatttaatgtgcgcgctctggatgaatatgtgtccaattcttttcatttctactaacatcgagagaatttgggcttactttcaacgaagattggcatgtatttattagagtctgtcatgtgtgttttctaggaaaatggaagcagtaaacctattgtacattgttagaaattttattatacaatccttagtcctctataagcattattctttttttataaaactccgttatatatacgatcagagctgttatcaattatttttaaggataataaattgttttcattttatttatacctactttttactatactggatttcattaaaatagcaataaagaaagatacttaaaattttcaattttaaaaaaattccggccgaaagcgatctaaacataacccacccccccccctttaaagctactccgcgaataatggtcccccccctttttttttttttcctttaaacccccccccgtatcgcggcccattataaaaacgcgggggggggggggggggggggaaccccccccccggggggaccgaacacactttttttttcggggccccccctatgcccccccccctcccctttttttttttttttttttttctcttctctttttttttttttttctctcccccccccaatttttgtcgccgggggggttgttttttttccccccccccc

SEQ ID NO: 713 - DNA, 704 bp, Diabrotica virgifera
caatttccaataaagttgcatcatttaaaattaataaaatatttaaatattaattttatacgtagggaaaagactgtttttatttaaataatagaaaaatcaaacatgtcaggagagaataaagaaccgatatacacttctgatagccaagggagtgacgaaaatggggacggcagcgaacaaaagccctttaagactattctacaagcaatgcggaaagctggagctgaaccttttccagttatttatgcagatggaaaacaagagggagacaagtatgaaccagctgccaagatcacaattgatagaaaatacagaaaatttggataagggagagctataaacaggctgacaaatccaaaaaagaagaggaagatgcagaaaagaggtccaaaaactatggaggatgccaaaaagattgctctcagtgaggataaatctctgccagaagccaagaggataaagatttcagacggattgtaacagataaaacactttttttattaatatttatatttctttccttacttttttcttcttcctctttataagaaattctgcttgtttattgccagattgatacctctatggaaggttgtcactccatctttggtgtgtgtccaataattctacccattggtgatttatctcttgctcccaatgcagaatgaaggacgcacatgtctcccccattctgtgtatgt

SEQ ID NO: 714 - DNA, 1948 bp, Diabrotica virgifera
cccgttaacaaataaactgctgcgggcaaatatcaatttccaataaagttgcatcatttaaaattaataaaatatttaaatattaattttatacgtagtgaaaagactgtttttatttaaataatagaaaaatcaaacatgtcaggagagaataaagaaccgatatacacttctgatagccaagggagtgacgaaaatggggacggcagcgaacaaaagccctttaagactattctacaagcaatgcggaaagctggagctgaaccttttccagttatttatgtagatggaaaagaagagggagtcaagtatgaaccagctgccaagtcacaattgaagaaaatacagaaaatttgggtaagggagagctataaacaggctgacaaatccaaaaaagaagaggaagatgcagaaaagaggtccaaaaacttggaggatgccaaaaagattgctatcagtgaggataaatctctgccagaagccaagaggataaagatttcagacggaagcaaaaacagagataaaagggtaaaaatatatggctgggctcacaggattagaagacaaggaaaaaacctaatgtttgtaacattgagagatggtacaggcttcttgcagtgcatactcaatgacaaactttgccagacttacaatgcattggtcctacaaacagaatcttcgatagtgttatttggtaccatcaaggaagtgccggaaggaaaaatagctccaggcggacatgaacttcttgtggactattgggaattgataggtttagcccctccaggaggagcagactcaattttgaatgagcaagctttgcctgatgttcaagctgaaaacaggcatattatgattaggggagagaacacatccaaagtcttacgaatgagatctgtcttactacaggctttcagagaccactatcaagacagaggttactgtgagatcacaccaccctccatagtacagactcaggtggaaggaggatccactttgtttaaaatggactattttggagaagaggcgtatttgacacaaagttcgcagttgtaccttgaaacatgtcttccatctatgggagatgtctactgtatagctgagagctttagagcagaacaaagcagaaccagaagacatttagctgaatactcccatgtagaagcagagtgtccatttattacttttgatgaccttttgaacaggctcgaagatcttatttgtgatgtagttgatcgtgttttaaaatccccctatggcgagattgttcacgagctcaaccccaacttccaagtgccagaaagacccttcttgaggatgaactattcagatgctatcgaatatctcaaaaagaacaatatcaccaaggaggatggcacattttatgaatttggagaggacattccagagatgccggaaagaaagatgacagaccaaatcaacaagcctatcatgctctgtagattccctgccaacatcaaatctttctacatgagcaaatgtccagaggatgccagattgacggaaagtgttgatgttttgttgccaaatgtaggcgaaattgtgggaggatcaatgaggatatgggatctagatgaactgttagcgggatacaaacgtgaggaaatagatccagctccatatttctggtacacagaccaacgtaaatatggtacatgtccacatggaggttatggtttgggtttggagagatttgtatgttggctgctcaacagatatcatattagagaagtctgtttgtacccgcggtatctgcatcattgtaaaccttaaggtgattcagctaaatatacagacaactatgcatttaatattttgttatatttatatttttctttgatcttgctttaacaaaagtggcattacagttctcttccgaataaagattgctttattatccttaaaaaaaaaaaaaaaaagggggggc

SEQ ID NO: 715 - DNA, 1173 bp, Diabrotica virgifera
cattagtttaccttagataaaggtacctactggcaaataacacaaactcatttgtatatctatctaaactgataagacggcaaaaatacttcacctagtcatttcgatatcgttttcttaaaacaagtagatatataccatagaagacttatgatgtttgttaaagaagtgttagtgttgtttttatttgcgacattggacattgtttccggtgaaatatgtaccaattctagtgaaagtggatgcgactgtagacagtttaccaatcccaagacacaccttcctacctactacgcggattgtagaagtagaagcctacaagatgttccaggaaacatagaacatattatacatatattagatctgtcaatcaacaacatccaaacgctcgatccaaaaaaatacagcttaagtagtgaaaacctggaagaactaagtcttagttacaataatatcaccttcatagacgtcagcttctttcagaacctacgtaaactaaaaagacttgacttgagcaacaatttcatcaccagtttggataatgcaggtgtgtttcaaaaccttgtgcacctcgtgaagttggaccttagtttcaacaacttaaaatccttaccggactctattttcaatcctctaaataaactaacccacttagatttgagctacaactatctaaataaattcttaacccaatcaaaagaagtgttagcagataaattaggggttacttcaaatttaacccaccttcgcttgggtggtttggctctaaaagaactaccagctggatattttgataatcttactgcattgaaaggtctatcactagcagataatgaattcgaactcatccctacagttccttacaccttggaacatctggacttatccggtaatcaattcactttcatctcagctaaatatctgaactaccattctctaaaaagtctcaaattgaacagaatggcaagtttgacggatatacatcattacgctttttacatctcttcgctttggaaaattgattatcaatgactgtccaaatttacaccaatttagtgaactggcatttgatgtactttcctaaagatgttgaccatcttttttttaaaaaagtgggccccaccccccccccccaaaaacactccttttttttaaaaaaaaaggggtgggaag

SEQ ID NO: 716 - DNA, 867 bp, Diabrotica virgifera
catcactcttccgggttcttccgccgttattaacaaacataaaatggaaagtgtcacggttttgtttgttttatgttttgccggcatttccgtacaagctgctgatctaaaagttagcgtctactatgaatctttgtgtccagatagtatcaaatttatcaaagatcagttcaaccctgcttacagcactgtacttaaggacaaaataaacgtagactttgtgccttttggaaaagcaacggcgataaagagtaatggtacatggagctttacgtgccagcacaaagaacctgaatgctacggtaacaaagttcagtcatgtgcaattgacattgcttcgtataatacaagtatcgaatttgtcgtgtgtgctatgaagtcaggagatgctagcgatgatgaattacttaaacagtgtgctgaagacaaccaaatcaaatgggatgacatcgacaattgcttaaaatcaggtaaaggtgatgagcttcttgcaaagtacggcgaccgtaccaatgccgtaacaccaaaaattacttttatcccgacgatagtattcaatgacgtctacaccgacaaacttcaagaattggccctaaaagactttttaacagtatcagaggtgttgctggagaaaccagactgtagcaaatgttctagctctagaatagctttatctatagctgttttattgttgcctttgatatcaatgttaaaacttcgttgataactttgttttaatctttaatttataggtaaatatattttaaaaattgttaatttcaaagatgtcaggattgtctagtgtaaataccttttttacattgctatacactaattgaaactgacaaaaaaaaaaaaaggggcgcc

SEQ ID NO: 717 - DNA, 1449 bp, Diabrotica virgifera
atagaacgtgacatcatactttgcaggattcatttttatactctggtaaacaatgaactaaaatcctgcaataaatacggcgctttattgatcgtcttacggactgtttttaggttatattattttttaaacaatcctgctgaaaacctgaaactgaaaagtgctgataatttttttagtgtattgaaaatcaatcggtagttgtaaagtggatggttttgggaggtcatggagaagaaaaatacagaaaatgaagtcatcgagaagaaatcagcggaaagcactagcattattagcattttgtttagtgccgtgaaaaaggcctcagttgtaggagtcgtatacttggcagggtatatgcaatggtctgttgcgtggtttataggacccgtagttctttttgttattagagatcaatggaaaaagactagcgacagaaaaagagctattgctaaagcgaccgctttgtccagtgaacaggaagtagttttggccagacttgatgatctacctggcatgggttttcttccctgacatagaacgaggcgagtggataaatagaataattaaacaagtatggcccaatgttaaccaatacgttcgagagctcgttagggatgctattcaaccagctttgagggaaagtttggaaaaatacaaattaactggctttaaattcgaacgaattattttgggtactgtgccttttcggataggaggagtcaaggtctatgacaaaaacaccgatcgaaatgaaatagttatggatctagatatcttctacgcaggagattgtgatatcaccttccaccttaaaggtatgaaaggaggaatccgagattttcaattacatggtatgctaagagtagttatgaaaccactgattacctcgatacctttaataggcggattgcaggtgttctttttgaataatcctgacatcgattttgatttagtaggaattgctgatgtgctagacatgcctggcctaagtgatatcttgcgaaggattgttgttgaaacagtggcttctatgatggttttgcctaataaatttccaataaaacttagcgaagaagttgaggctgttgaattgaaggctccagaaccagagggagtccttagagtgcacgttttcgaagctagccatctgatgaagaaggacatcagtgtcctcggcaaaggaaaatccgatccttatgccgttgtcaccgttggagcgcaagagtttaaaacaaaagtcatcgacaatactgttgatcccaaatgggatttctggtgcgagtttcaaatactggagtcaaatggacaacaactttatgtacacttatgggacaaagatgatacgggtggtgatgaaaacttaggaagggctactatttgaaatttctaatattgtaaagaaaggtcatgatgatatgggggggactttcttttaaaacaagcaaa

SEQ ID NO: 718 - DNA, 685 bp, Diabrotica virgifera
tcgtcgtcattagagcttcaaattaccgtacacttctcgaagactctgccgataaggtagaatcgtgttacggaaaagtcgcgcgcccacatatttcgccctacatgcgccatctatcgccattatattttgttcaatgaaaacagttgcagtttgcattggtagtaaacaggtttatccgtgctcttgaaccgttttaccacattactatttttagtattctgtaaaaacaaatagtaagaaacgggtttaagtgcgcttgaaccattttaccacaaaactatttttagtattttgtaatgtgtaaacacatgttaatacaggatattttaagtaaataaatattagatttgtgaccaattttgaagactaattaagtattatgcaacgtgccagttgtagttacactgtggataacagctggaacaaaaatgattagtaatatgtagttaacatctgcaattgaaccgttttaccagtaacatttatcaacaccatgtaccgattcaagtacatttttttaataattgaaaaaagggaaggatatagtaagtgtaatacccttatatttttatcactttatagtacattgtacactagacaaaatttagtctaatgactcctagaatttataaaactcaaacaactttgaagatgattatctcagaactacaaaacctgcact

SEQ ID NO: 719 - DNA, 1038 bp, Diabrotica virgifera
tgtattttcaaaagaaaactctgaatttatttattagtgtatagtttatttattatacataattcgtttcctatttgacaaaagttacccaacgtttggttaacgaattagaataaagaattgcattttcactgcagaaagtaacacaaagacctaccggtttttagtttaattgtatcttaacgcgaagtttagttaaactacatcaagatgtcagctgctatgccaataaatccaaaaccattccttaatggtctcacaggaaaagcagtcatagtaaaactaaaatggggccacgaatataaaggatatcttgtttcggctgatggatatatgaatttacagttggctaacactgaagaatatattgaaggaaaacctacaggtaccttaggcgaagtacttgttaggtgtaataatattttatatatcagaggtgcagaggatgatgacgaagagggagaaatgagggaataatatgtagttttatttaatatttaattttttttgtgtctaagttatagttaaatattatgctcatcctttcatattgaagtgtcaaaacattttttttatttacaaatgtgtggatgaaacaaagaacttagtgtactgtgtatgtttattaactctgttcgtagctgtttttataatgtttaattttatagtttgatgtatgattaaagcttgttacgcacggggagctatactataattatatctcatatattgcatctcctatcgctcactatagtaatgggagagcgatatgagatgtaatatatattatagtatagccccctgtcagtaacaagctttattgttttgaaaatataaaatatgttcatgccttatcttaactaaaatgtcaaagttgttacataccacttttcttacctagtcttaagaagaagacatgttaatacagatatgtatttgtaatatcttattatgtagaataattttaggttaagtaagggtatattacattctttcaaatttgaagatttatttctgtattgaatatttttatagcat

SEQ ID NO: 720 - DNA, 1129 bp, Diabrotica virgifera
cataggtcgggtatatataaaaagaaagggatgaatatcaggaaacttaaaattcaaggctcaaataaaattaatggttattgtcctgcaagaattaatgttaaattaatggacaatgaaaaatatattgtcaacttttgtcaaactcatgtgggacacagtccagagcaagatttaggccatctctttctaagtaaatcagacaaacaaaatgtggcagcaaagatagctgccaaaattccatttcaaatcattttggatgaaataagagattctgtgtccaactctcgtttggaacggctgcatctcttaaaaaaaaaagatctctataatattgagaagtgtttcaatttatgcagttcatcagtacgccatgaaaatgatgcaataagtgtagatgcatgggttagtgagatgaaaagttcagaatgtgtgcttttctataaaccacaagaaactatatgccaagaaaatccagaactacaatatgaagattttttcttgattataatgtcagatggacagaaagacctattactacgatttggagaggattgcatttgtattgatgggacccatggtttaaatgcctatgggtttgaactacataccatcctagtactggatgatttgcgagagggctacccaacagcatttttgatatcaaatcgcagtgattccattggtatgaaaattttttttcaatgcattaaggaaagagttggcaaggctattaaaccaaaagtctttatgtccgatatggcagatttttattataaatcatggatgcaggttatgcagccagctgaatttagattgtattgcacctggcatgttgacaaggcatggagaaaaaatttagaaaaagtgctcaataaggaaaaaaaagttcaggtgtatcatatgctcaggacattattgcaagaaactgattccactgcttttaatcaattattattgaattttctgaaatatctgaaggaagattcagataccctggaatttgcgatgtatttcgagcagtattatgcatgtaaagcagagcagtgggcatactgttttaagttgcattgtggcctaaatactaatatgcatattgaaagaatgcaccgaacgaataaacacattt

SEQ ID NO: 721 - DNA, 940 bp, Diabrotica virgifera
caaacggtaaaaaatatttataacaatatggcccaaaatgcgaaagatacaggggaagcagatatcgaaactctatgttcgatgttcaaggaaggtctaaataactacaattccatacttaacagtgaccagcctacaaatagcaatgaattgcagactcaaatcaagaaaaccatgaaaacttttgaacaggcaacgagactggtatcattatcaagcatatttagcacaaacgaaggaatagaagagataccaacaaatgatctacagtacttactccttccagcattcttaggttcactaagtctaaaattaacgtcaggagaaaggaaagatattgtagatgtagcagaaatatattttaaggattttttaaagaggtgcaatgattatggtatgagtaattatcagtttaaagagaaacataaaaatgatgagaaagaacagagggagaggacggatttggagaaactagagtactctgtcaacactagagctaataaaatacaaagatttaaagaacaaaaagaactaaaatccaaattagaggacctaaagacaaacatggaaaacgaacatgttgatgatgaaatcaaaagaaagtactttctaactatgattaaactttttatctatgaatctattgatgaacttaacagtattgatatggaaaagcctattttagagcacatggctaatatgaagaaagaagaaaaacctcaaccaaagagaccacctcctccacctctaagacccattgttataacaaaggatgaagtacagaaagctgtgtttggtgctggatatccatctttacctgttatgacagttgaagaattttaccaaaaacgtgttgaagatggcatctttcctgatccaaataaacccagacaaggtcccatgtcttttacagacgcagccacttccggtgtgtctctaa

SEQ ID NO: 722 - DNA, 1099 bp, Diabrotica virgifera
  misc_feature (927)..(927): n is a, c, g, or t
  misc_feature (991)..(991): n is a, c, g, or t
  misc_feature (1038)..(1039): n is a, c, g, or t
  misc_feature (1047)..(1047): n is a, c, g, or t
  misc_feature (1059)..(1059): n is a, c, g, or t
  misc_feature (1068)..(1068): n is a, c, g, or t
gtgattaaagaatggctacgaataattattttggatttactcatggtggaacgcagtatggagcaaccactggagcctaccaagcgggtcaggctggttacgctgtagctactcctgcgactgcagctgctgcagctacgtacggtacccaaagacccaccagctatgacacagcctatcaggctgcagctgcagccagccaaggcacttatgctgctgtaggaaccactgcaactcccgcctatgagtatggatatggtcaaacagctgcaactggttacacaagtggttatgatcaaacagctgctgctgcagcagctgtagcagcagctgcaaaacctgcttcctatgccactacttatacacagagaactacctcacagcaggcacaacaagcagcagcatttcagtcagctgctgtcgctgctgcggccgtggtcaagcagcctgcacagtacacggccacataccagcccactgcaacagcttaccagactacctacccccaaccagctgctgcacagactacaatagctgctcaacctacaacacaagccaaacgatacgatgctgccctgtattcagcagctaccatgtatgtagcccaacagtcaggcactgcccaacataaagctgtcggctggcaaaactacaagaaaccaggtatcggtgcgaaaactgcaagaccaaaggcacccccaaaacctcaacagttgcactattgtgatgtttgtaaaatcagttgtgctggtccccagacttacagagaacatttagaaggacaaaaacacaagaaacgagaagcagccactaaaatggcagcctctgttgctgttactactcaaaaccgtgctgggactctctaagatgtcagttatgtgatgtaacttgcacaggttatgatgcttatgctgcccacatccgtgnggcgaaacatcagaaggtggtattgctacacaccaagctaggcaagcccatacctccacagaanccagaagttcttggagggatcaagaaatcagtttcttccactcctannaatcactntgtagcatcagngaggcttangtgtggctgctggggaatggagatgcatcaa

SEQ ID NO: 723 - DNA, 2891 bp, Diabrotica virgifera
agtgattaaagaatggctacgaataattattttggatttactcatggtggaacgcagtatggagcaaccactggagcctaccaagcgggtcaggctggttacgctgtagctactcctgcgactgcagctgctgcagctacgtacggtacccaaagacccaccagctatgacacagcctatcaggctgcagctgcagccagccaaggcacttatgctgctgtaggaaccactgcaactcccgcctatgagtatggatatggtcaaacagctgcaactggttacacaagtggttatgatcaaacagctgctgctgcagcagctgtagcagcagctgcaaaacctgcttcctatgccactacttatacacagagaactacctcacagcaggcacaacaagcagcagcatcagctgctgtcgctgctgcggccgtggtcaagcagcctgcacagtacacggccacataccagcccactgcaacagcttaccagactacctacccccaaccagctgctgcacagactacaatagctgctcaacctacaacacaagccaaacagactaattctaccacaacatattcaggatacgatgctgccctgtattcagcagctaccatgtatgtagcccaacagtcaggcactgcccaacataaagctgtcggctggcaaaactacaagaaaccaggtatcggtgcgaaaactgcaagaccaaaggcacccccaaaacctcaacagttgcactattgtgatgtttgtaaaatcagttgtgctggtccccagacttacagagaacatttagaaggacaaaaacacaagaaacgagaagcagccactaaaatggcagcctctgttgctgttactactcaaaaccgtgctgggaactctctaagatgtcagttatgtgatgtaacttgcacaggtaatgatgcttatgctgcccacatccgtggggcgaaacatcagaaggtggtattgctacacaccaagctaggcaagcccatacctccacacgaaccagaagttcttggaggatcaaagaaatcagtttcttccactcctaaaatcaactttgtagcatcaggaggcttaggtgtggctgctgggaatggagatgcatcaaaggatgaagacgatgatataatagaaccagatatacagcctgtaggacaagattatattgaggagatcaagagtgatgatggcaaagttataagcttcaactgcaaattgtgtgaatgtagatttaacgatccaaatgctaaggaaatgcacatgaagggcagaagacataggttgcagtacaaaaagaaggtcaatcctgaattagtagttgatgttaagccatcgttgagacaaagaagaatccaggaagagaaactgagaagagctcaactaagagaagaattctgggctcgtcgtcattatcctgatgtaaatgaaagtctctattgggaagaacaaagaagatatgaagatgaatatatgatgggccacggaaatatgcctttccaaagaggaagacccttccctggaggtcaaggtccacccggtgttttgagtcgtagagctgaatctagcgatgataaacatgtaatggcgagacatgctgaaatttatcccaaggaggaagagctacaggccatccaacgcatcgtttcccatacagagagggcactgaaggttgtatcagatcaaatgggtgacggcaagaataaagctccagaagcgaaaccagatgaaaaggcagaaccacaacaaaaagaggatggacgtgacaatcaactcttctctttccaacaaggcgatcagaaccgcattctaaaaggcgttatgcgtgtaggacatcttgctaaaggtcttctccttcgaggcgatacaaatgttgaattggtggtactatgtgctgataaacccaccctcactcttctcaagaaagtcgtcgaaatccttccatcagctctgaagcaagtggccccagagagcgcctacaccgtggccatcaacgcttccgaggcaggcttgatcatcgctggagacagtttgacggtgttggtacagttcaccagtcccgtaattcgggaacaaccagaagctgcaagcggtgggttcgaccgggatgttctgtcacgcggcaagtgtctccaggcgctggcagccctcagacataccaaatggttccaggcaagggctcttggtctgcattcctgtgtcatcatcattcgtatactgagagatttatgccagagagttcctacttggtcgccgttgtctccatgggccatggaactgcttgccgagaaagtgatctcgtcagtgcctggacaagcccagctgtcaccaggagatgccctacgacgcgtcatggaagcggtggctagcggtctgcttctcccgggcggtcccggtttggctgatccgtgcgaaaaggacaatcccgacgcttccggagcattgaacgctcaacagagggaagatctcacctgttccgcacaatacgcgcttagattaatagcttatagacaaatatacaaggtattaggtatggatcctttaccagcacctcagaaatcgttcaggagagttggaatcacgcggaaaagacgtctatcgggttcaggtcaagatggttcagaaagtgatacaggaaagatggtgaaaacacagaattagttagttaaattatatttttacatctcttgaagtattttactgtataggcatataagtaactaattatgtttatttaacttagttctttgtgattgattttttagttcttttttacttagtgttatatatctaatctggtctaaagtattactgaacattcagtaatgagttgaatgtatttctttctatttcattatggagttgaatgtattgacgagcga

SEQ ID NO: 724 - DNA, 1248 bp, Diabrotica virgifera
agacaatcttagtgttaacatctctggaaaacaatgatttttaagcagcttttgctgcttgtattttgtgtgctgggcgcacttggtcaagtagttatcgatagtggtccccctaatttgtacaattatggaaacattgatgatgtacagtttgacaatgaacctgaaccagaaccagtacaaaccaaggttggatgtgccggatgccctactgatatcgatcccaaagctgaaggcgttcaaaaattggtaaatgcagccttaagtcatatcgagtctgaacgtgacaccaagcatgtcgcagtcaaagtccttagagttcaaacacaggtagttgcgggtataaaatatatactttcggtcgaagtcgcttcaacaagttgccctaagaacaccgagaatttggattgttcagtccaagatagtcgtgtttgcgacgtagaatatttagagcaaccatggttgggagtctcaaaaatcatcagtaacacctgtacaaaatctcaagagttcgatcttaaagagccgatagatcctcctccaccgaagaaagtgcacagagagttagaacctgacttcttgtcagatttggagtctcaaattatcccagatagtcctaaatcagaaaaggaaaattcagtacagtttgacgacgtagttgaatcaaaaccatgtcttggatgtctgaccgaagtcgatgttaatgataaagttgtaccatttttggtgaacgccgctttgagtcatattgaatctgaagataaggtccagcaggctttaatccaagttcttagagttcaatcacaggtagtagcaggtataaaatacaaatttttggtggaagttgctccaaccgtttgccctgcggaacctggcgccaaaccgtgttatgttgatagaaggcaaaatagtcgtgtttgcgaagtagagtattgggaaaaagcatggttgggattcaaaaaaattgttagcaacaattgtacaaaatcccaagaatttgaacttttagatccagttacagttcctttatagccagtaccagtttcctttagatttggaaccgaactcagttcttacagtagaacatccattagaatcaaaattagagaatgctgcacagtttgaccatgaacctgaaccagaaccagtacaaaccaaggttggatgtgtcggatgccctactgatatcgatcccaaagctgaaggtgttcaaaaattggtaaatgcagccttacgtcatatcgagtc

SEQ ID NO: 725 - DNA, 716 bp, Diabrotica virgifera
ataaaatacaagtacaataatggtgaagatttcgaaagtagttgtgtgtggaatgaagggtataggtaaaagttcaattttagaacaagtcatatatggacatgctaatacaaaattggatttgcatcctacaatagaagatatttatgtcgcgaatatagaatctgataaaggtactagagaaaaactacgattttatgacacagctggaatagagttttcacaaatatctacttcaaatggaatgacaagtcaacaattacccaggcattatttacagatagcagatgggtatatcttagtctatgatacttcaaaaagtacttcactggatatacttgtagctttaaagaaggacattgataagaataaagataaaaaagaggtatccatagttgttattggtaatcattttaaagaagaagcaaatgaagaaatgaatcttatagtcagtaaagcaagtcagtggtgcatgagggaaaaagtgaaacatttcacagcatcggctctaaagagggcaagcctgtatgagccttttgtctacatcactagcaaattgatgccacctccgagtaaaagtagtttcaccccattatctatgggtcgaaaggtcataaaagattcttagattgatataaactaggtgaaagttttagatatatttaaataaggtattattagcatattaggtatttataaaaatatactattggtac

SEQ ID NO: 726 - DNA, 876 bp, Diabrotica virgifera
aaaccaattcgctggctgagtatattgtgtatagtagtgccgtaactactcccgttgattgatagttagtacgttttcgttgctccggacgtgccagtgtctaagtttgcaatggctccaaaattatacggtgatagtagaagcccttgtgttagagctgttttgttggctgccgaagcaatgaagattaaattggaatatgtcgctattgacgtggtgaaaaaggagcacttaacggatgaatatctaaagctaaactcacgtcacactgttcccactttggaagatgacggtttcgtaatgtgggacagccatgcaatcatgatgtatctgggagaaaaatatggaaatgacaatcccgtctacccaaaggatattaagaaacgggctcttatcaaccagaaacttttatttgatgcgggagatctattttcatttagcagatacattgcgggcttcttcctgtacaaacgccaacctaacttccctcaagacttagctgaagctttaaacaaagcttatggtttcttggagacatttttaactgaatcaaaatacgttgccggtgacgagatgaccatagctgatttcagtctgtggacttctacaagtaactccaattcttttgtaccgattgatgcagcgaaatatcccaaggttactgcttggtccaaaaaaatgggagaactgccctatagtcacctaaacttcgagggataccaggagtttaaaaagttattagaaatactaaaagctcaactaaaagctcaataatgattatgtatgtttaaatattatgtaataaataaaagtatttatgtaataaatacttttatatttcgttttcttaagattcgaataaaatataccgtacct

SEQ ID NO: 727 - DNA, 1606 bp, Diabrotica virgifera
ttgttcttactcaacagagatgtaggagatttagagcaatggatagcagatagagaggtagtagcgtcttcccacgaattaggccaagactacgatcacgtaactttactttgggaacgctttaaggagttcgcacatgacactgaagcaataggaagcgagagagtcgctgcagttaatgatgtcgccgatcagttaatagctgcaggtcattcggattctgcattgatagcagaatggaaggatggtttgaacgaagcttggcaagatctactcgagttgatcgaaactaggacacagatgttggctgcatctagagaattacacaagttcttccatgattgcaaggatgtactgagcagaatagtggaaaaacaggtatccatgtctgatgaattgggaagggacgcaggagctgtcaatgcccttcaacgcaaacaccagaacttcctccaagacctacaaacactccaatcgaacgtccaacaaatccaagaagaatcagctaaacttcaagctagctatgccggtgatagagctaaagaaatcaccaacagggagcaggaagtggtagcagcctgggcagccttgcagatcgcttgcgatcagagacacggaaaattgagcgatactggtgatctattcaaattctttaacttggtacgaacgttgatgcagtggatggacgaatggacgcggcagatgaacaccagcgagaaaccaagagatgttagtggtgttgaattgttgatgaacaaccatcagacactcaaggctgagatcgaagccagagaagacaactttacggcttgtatttctttaggaaaggaattgttgagccgtaatcactatgctagtgctgatattaaggataaattggtcgcgttgacgaatcaaaggaatgctgtactgcagaggtgggaagaaagatgggagaacttgcaactcatcctcgaggtataccaattcgccagagatgcggccgtcgccgaagcatggttgatcgcacaagaaccttacttgatgagccaagaactaggacacaccattgacgacgttgaaaacttgataaagaaacacgaagcgttcgaaaaatcggcagcggcgcaagaagagagattcagtgctttggagagactgacgacgttcgaattgagagaaataaagaggaaacaagaagctgcccaggccgaagaacgcgctagacaagaaaaggaagaagctgaacgattggcagcaatcgctgcctcgcaacctaaagaaatcgaaacaatggtaactgacagaccagatgctggatcccctgctgctgaagagagaccagtgcatgaagaacggcatacaagacctcagactttgcccctctacgcctgtgcaaacgaacacccgaagtcaggtaccacctcctcgttcacaaacacacccaagcagcgtaacgagatgacgaactagtcgaaggaactttggtgcgcaagcacgaatgcgagaacacccaacgaaaagccagcaacggttcctgggacaaggatacctggcgtcgagaaaggaaacccatttggcgtctaccatgacccccagcacgcaaaacccacacccgggaccaaag

SEQ ID NO: 728 - DNA, 1456 bp, Diabrotica virgifera
tgatgtcgcttttagattcctgcctggtacttcactgtcagtcatatcgaccaccaacaacacgcaagaggtgcttaaagactgtttcttcacggcgtttccaagtgcctccacacaatggtatggagggccagaaaggagggtccaaacgtggccgttacagcacatgaggatttctcaatcaagtccttatatcagcagaaaggacgacaatcatgctgtagctgagagatactggttaaattctttgggtatttatatttatttaagtgaagagaatccgttgtttgtgagtcaaaatgaggacgattcaaaagatcaagtgtgttttatatcaaaagttcaatcgccgtatatcaatagagatcagaacattttggaatatgtgatatattttagtgacgatcctgcggcagcccatttaaatgctgtaaatacttatttaggaaaaccaaatggctatccaaatccaaaaatgatcaaggaaccaatctggactacttgggctaaatataaagctccaatcacagatgacatagtgatcgagtttgcaaaaagcatcagagaaaatgggttcgaaaatggacagcttgagatagacgatgcatgggagaaatgttacggtgcccaagaattttcagaagaaaaattttccaaaatttctgacactgttaaacaactgaaagatatggactttagagtgacattatgggttcatccattcgttaacgaagactgcaagtatcgatctgatgagggcatccaaggcgatttcttcgttaaaggagttaacggtctaaacaatgctacttggtggaatggaaatgggaatggccaccaaatcgattttacaaatccaaaagctgctgagtggtacacagatagactaaaaaaattacaaaccaatcctggaattgatagttttaaatttgacgcaggtgaagcagactacgctgaacagccagctgttttcccctacgtatcacgagccgaacaaaatctcttgccaaatttactcaccactgaatacataaaaacttgtgctaattttggagatttgattgaagttagatcagcatttagaaatcaaaattcttccaattttgtgcggatgttggacaaggatagcagatgggacatgcagaatggtttaccaacgttggttaccactttgtttcagttgaacttaaatggttatccattggtactacctgatatgatacgaggcaatggatatggggggaacgtaccaactgctgaattaattgtaagatggactcaggccaatacgtttatgccatcaatgcagtttacttatttaccatgggagtttaattcagatgagttcaccacgttagaaatcgtgaaaaaatatgtaagccttcatgaacaatattccgatgttataatcaaagcaatggtaaggagcgtcagtgacagtagtcctgtaaatcct

SEQ ID NO: 729 - DNA, 953 bp, Diabrotica virgifera
  misc_feature (931)..(931): n is a, c, g, or t
ataataccagtggagatatcagccatggcgttggtgttaaggaaactgaaagatgtttatctatatagtgaagaaagatcggatcctaagaatgttggtatcgtcacgaatccactatttattgtttcattcgtcgttttatatgtattgttggtgaaaaaaattggtcccagttttatgaaaaataggcagccgtacaatattcgaagtattctaattgtatataatatatttcaaatattagtgaatgtatacttattagctaaggctctatacttttatgcacactcaccatattacatatgttttcaaagtacaaaggtgcatatacttgacttaggaagatgggagatattccttcttaaagcatttgactgcattgaaactattttctttgtactcaagaaaaattatcgacaagtaagctttctgcatgtataccatcatggtggtatggcattacttacatgggttggactcaaatatgactggggacaactagttgttattctaccactattaaattgcttcgtccatgctctaatgtttacttattatttattaaccagcattgatcccaaatggaagaagagagtagacataaagaaggcattaacgcaattacaactgattcaattcgctatgtttgtagtccaggctataggaaccatggtaatacctggatgcgacaatccttcttatttgggaaccgtagcatggataagtcaaaatttatttatgactctcttatttggagacttttatattaagacctattggagaaaaaagagcgaataaaaaaatttattaacgaatgagacatgttctaagagtccatttaagttgaatctcaagtatttttaatttttgtaaatatatagctacacaattgtataaaatattgtcagtgtagacagtgtaactttcatantatatccgatatatttatttct

SEQ ID NO: 730 - DNA, 950 bp, Diabrotica virgifera
  misc_feature (734)..(734): n is a, c, g, or t
  misc_feature (857)..(857): n is a, c, g, or t
  misc_feature (876)..(876): n is a, c, g, or t
  misc_feature (890)..(891): n is a, c, g, or t
  misc_feature (918)..(918): n is a, c, g, or t
tatatttaataattaatacagatttttaagtatggcaccaaaggaaaaagatgatgaaatcgtatcaataaataaatgggatggagtagccgtcaaaaatgcattagatgatgcagttaaagaggtacttacaaagaaatacaattatgctgaaaattttgctctcatggatggtaggttagttatatgtggcatagctgtaggtgttgcaatgtttgccttgatttgggattatttgtacccattcccacaatctaagcctattttaatattttctgttactacatatttttttatgatgggaattttaactttatatactacatacaaagagaaaggaatctttgctgtttgtattcagaaagatagttctaagaaggaaaatacttgggaagctagctcttatattcaaaagtatgatgataagtatactttgaatcttgcatatattgatggaaaaacacgccaaagaagagagcagagtattaaaaggagtattgccaggtacatagaccagcaaggaactgtagttaaagaaaatgttgaagatgaaatcaccaaaatgcacaattctctactaagtgagaggaaagaaaaatgatgtacacagagactacctactaaaagaagttgacgtgtaaattatttcattttttatatttttcaataagtttttttggtttgagacaaaaaaaattattttgagtgattctgtataaaatatacccgccttnaatatatctggttctatctattattcctgtacctgagaaatagactaacctaactcatttattgcgatttttgaaaagaaccggaacatattaatgttaagtttcaattttacgtcaatctgngggtgttttgatacaatanattttgcagatctnncaagtaattaatatattattcgaattntaatatgtgtacatatatggcttgcaaataaa

SEQ ID NO: 731 - DNA, 1336 bp, Diabrotica virgifera
  misc_feature (1154)..(1154): n is a, c, g, or t
cccttagaggcaggtgttgttcagtatttttactacactattatctttcagtgactgaataattctagaatggtacaggaggatttatttgaaattaagaaaaatgaaaaacttggaaggtatgcagtggccaaaaagaatttaaaggcaggatatgtcattttctcagaaaaaccttttgcgtacggccctaaatcagacagtccttgcatttgtttggggtgctacacctatttagaaagccagaatttatgttcaaaatgttcctggccagtatgctctcctgaatgtgaaaataaaccagtccataaatattttgaatgtgaagtattttctaaagctaaagtgaaatttcaactggtagatgacccgtctgaaacctgccttcagtatgaatgtattacaccattaagagttctgttgtccaaagagaaagatccaaaacgatgggaagaggagatccaacatatggaacctcataatgatatcagaaaacagaaaccaatttgggaattcaatcaacacaatgtagttgaatatctacgatcagtttgtaaacaggataggttttctgaagaattgatacatacagtatgtggaatattagatataaatgcatttgaggctagaacaccggaaggcagtgctgtaaggtgtctgtttcctaagctggcaataatgtcgcacaattgtatatcaaatattcatcatgctgttgatggtaaaggatctggagcttttgatgatttcagtgtcacggtgagagcagcagtggatgtgccttcaggaaaagagttacatagcagttacacgtattccttatggcccacgttggttcgaagagagtttttaagagaaagcaaattctttgattgtacttgtgagaggtgttccgataaatcagaattaggtactcacagtagcacacttaaatgtcagaaatgcgataatggaataatcatgtcaactgatccattagatgacaaatgtgaatggaaatgcactctttgtgaatttaaaacaagtgcaatagctgtaagaaaggtttgtgcagccatccaagcagatttagatactgtagaatatatatttggaccagaaggtaagtagactatgatcttttagtttataaacatctatatttgttgctttgntatttgttggcttattttgctaactttttaattgatatgctaacttttaattgggtctgatatattggtagaccgacggatgagcagtttacaagaaacatagtggaatggcgtccgaaacaagagggtacagaggcaggccacccagcagatccaccgatgatataaagagaattactgga

SEQ ID NO: 732 - DNA, 522 bp, Diabrotica virgifera
  misc_feature (445)..(445): n is a, c, g, or t
  misc_feature (454)..(454): n is a, c, g, or t
  misc_feature (492)..(492): n is a, c, g, or t
cccacgcgtccgcggacgcgtgggatttgtctgatcttgggtaaccaaaggacaaattaaatttcgtgttaaaaatttgccgatatgtaacgtaataaactttattggtcggatgtttttctttaaacaagttgaacatttttgtaatattcaaactctctggtaaatactagattcgtgtaaactgtaatgggataatctagttttaaaagactttgtggttataatatattgcttcacgcgattctggatgcaactttctatgctgggaactacgcttaccacgtttgtcttgtccaaaagttcctgcagcttttaaatttttttgtaggtattcagttttgcccttagttacaccatgtattgacatgaatactttaaaacacacattaatttcttgggaaactccattacgcttaactctaactttattggccgtgccgtntctaacatntcaagcttttgagctaaggttgtacaaaaggatcctgnaaaatacatgcaaagacaaagtcaccaatg

SEQ ID NO: 733 - DNA, 685 bp, Diabrotica virgifera
atttgaatatatttaattatggactgaagtttttaagtgaaatatctaaagttaatattttgatatatttcttctattggcaacaatgaaagtggtatctaaaattgcacagaaatagctccgatgtaaaaaggtcagggtaggcaagagatatgccatgcaagacggacttgcatagcatgagacttgcatagccttgatgtaaagctgcttttaggaataagaatatagattattatactattacattcgtgtttttgattataatatataatataaaacatggcatcagcagttccagaacattgtcctggagttgaaagcgaaaatgctggaagggcttcagcttgcgctggttgtccgaatcaaaatatttgtgccagctctgatccaaagaagccagatccaggtattgacttagtgaaggaaagattggcagatgtagataacaaaattttaattctttctggtaagggtggagttgggaaaagcacagttacagctatattaagtaggacaatagcaagtagtcatagcgagaagaatgtggctgtgttggacattgatatttgtggtccctcccaaccaaagagtgttaggagtccaagatgagagtgtgcatcagtcaggatcctggatggtctcctatatatggttgaagacaattttgtcagtaattgccaaa

SEQ ID NO: 734 - DNA, 1163 bp, Diabrotica virgifera
ggagacaacaaggctactgtaactcttgacgagcagttcgcattcagtaacagagatgacccaaagagtgttactttaaccactgataactaccagaaaaactttattataaaatttactgatggaaaatggactataaccgttgatcaaaatctagatgcagacacactaaactccaatgatatagttatgtctgtcatagctacagattccaccaccaaggatgtaggcgaatgtactctgctgatgacgctgccgaaaattaatagcaaagatgcacctagattcgataagccttattatcagtctgaatgcgatgatgctaccacaagtttggatgtagaaatagcgattaccaataaagatgatttatcggatattaatgtcagtatccttgaacaagattataaagacaacttcaacatcacttttgacgatgcagccaaagtttggaagatagcggtgctgtcagtaccaaagattaaaacatctacaaacgatttactcttaactttgatagctacagaaaaggggaacgaagaacttggacaagcagctctagtcttgaatttcctcgcagtgacagctcctaaattctcgtctatacaatatcgcggtagctacaaagctgcagaagtaagttctttcgaaataggtgacattaaaattaccaacaaagacaagcaagatgacattcaactcaaattgtctttagatagtgattcagatatttcaaaatacttcaagttcactctcacggacaacgtatggaaagtaactttaaaagatcctctccccgatgatgatatcaaaggaaaaactgagctggttttgactttgtcagcaactgaaaagaataacgacgaaataggctacgccactgtcataattgccttggaagataatgtgggtacgtctgacctaaccttctctgatgtctactacagtgctgattatatcaagtctagtcctctaccagatattgagttaaataaagaacatttattttgaaaaccaagtgaggaccctgaaaaatgctggttggttgaaatttgaaactaccggaggaatttaatgcccacaactatttttgggggttaaaccctacagggaactgccgggggttttaatacaattttctaaaataaaaacggaacctgccc

SEQ ID NO: 735 - DNA, 933 bp, Diabrotica virgifera
  misc_feature (889)..(889): n is a, c, g, or t
  misc_feature (903)..(903): n is a, c, g, or t
gtaaaatgaaaatattaaaattgtccccaattttattaacattcataactttttgtttggcccaagatttaccaacaaattatgaatatttcacagaatccggaattaaatcaggtataactaccaatgaaacacacttttttcttaatggaaaaccattctttatatacagtggatctgttcactactttcgaattccacgaacttactggagaacccgtctacgacaactgagagcagctggactgaatacagtcgaaacgtatttgccttggaacctccacgagccatacaatggaacatttgactttggatccagtggatctgatatgcaagactttctggaccttgaatccttccttaagttagcacaagaagaggatttatttgttattttaagacctgggccatttattagcgcagaatataatttcggcggatttccaagctggttgttaaggggaaaacctatgggtttccgaactgacgaagataattacaaccatcatatttctagatacttcaattatttcttgaaaaaactgttgccttacaagtttttaaaaggcgggcctataatagcctttcaagttgaaaacgaatatggatacactaactacaaagatttttttaaaccatctaaaagatacctaggacttcttcagcagctatatatagacaatgatttagcagacttcttagtaacgtccgataaccctattgcagaaggagattcgggaactttgccaggggttttatttcaaactactaattttggtgattcccctgaaaattatttaaagagattgtcagaattgcaacctaataaacctctaatggtaatggaattttggataggctggttcgaccactggacagataaccatcnaacgagagacccanagagatgagagatctttatgaaacgatctt

SEQ ID NO: 736 - DNA, 1740 bp, Diabrotica virgifera
gttctagatcgcgagcggccgccctttttttttttttttacagcgtgttatggtggagtagtcgattctctccataatgccgcagaacgagtatattgagcgccatcgcaagttgtatggtcgcagacttgattatgaagaaagaaaaagaaagaaggaggccagagagccccacaaaagagcgaaagtatcccgaagccttcacggtattaaagacaagatctttatacaaataacgcaaaaatgaagaaattgatgatgaacaacattatctaggctcatgattactgaaacttttcgtactaaatccgaaatcactagaattaactagagataaagaccctctcaaaatatttttttatctattctacaacaaaaaatataaaaactcaataattaatcagatctttctttttaatagataatttttttcaaaataaatgatcatgaatgcgattaaattactacagctatttttattagttgctaccatagaaaaaagtgcaacaagaagcttcaaagacgatggtaccatagtacatcttgacgaaggaaagattagaggacacatacttaaaagtgaaaatggtaatgattattacgcttttcaagaaatcccgtatgccgaaccacctgtaggggaaaacagatttcaactacccaaactaccgaagccttggactaatgttcttgatgccactagaaataccaaaatttgttatcaggatataccactatataagaaccttgaaataagtgaagattgtctatatatcaatgtttacacgccagaacaaccaggcagcaacaaccggcttcccgttttgctatggatccacggaggagcatttgccttgggaggcggcacatttgagtacgttggaccaaaatatgtaatggatgctggaattgtcgttgtgagcttcaactacaggcttggtcctttcggatttgttggcactaatgatggagttattcccttaaatcttggacttaaagatcagaggttggctatgcaatgggtgaataaaaatattcatttgtttggcggaagtcccgatcatgtaactatagctggtcaaagtgcaggatctatatcagttggatatcatcttacaggaccgggggagaatggcaaacaattgttccatgctgcaataatgcaaagcggaagcccagtctcaggttggctcacacaggaagatgaaaccagctcggccttagcacttggtaggcggggggattctcactttgctggtaaaagatacaaaggaattgttaaaagtgctaaaaaaaggagaaatcaaaaaatgagaaaaaaattgggggggaggaatggaaaccaaagttacgtcggaagggaggaagcctcggaaatttgaaagtcatcagaccaatggcccttagattcaagaaggcccatgtcacccatccagaacttaaagcaccttctgattacctatcattgataagaagaatcctacgccgatgttagttgagctggtattactaagggtacagagcttttatcgaagtctatatttcggaattgagtttggttacgcgagctggtaaaggaagttggggaaaatacgcccaggttaccaataatccagaagatgatggatgtattaatgctgtactgttagcttaaagtcagttcttgtagggttagggtggttctttataaataaaaaatttaatattttttgataaaaaaaaaaaaaaaggggcgggccg

SEQ ID NO: 737 - DNA, 1289 bp, Diabrotica virgifera
atttgaatttatcttaatttgtttaacattagtagttaaatattaaactatagttagaagttgttatatattttaccattaggtaattatttattagatttctgtattcgttttaaagccttttgcttctaaaaagtgcttagtaaatttgcacatggtttcacaatatgaacattttcgtgttttgagttttcgaaataacgcacctatatttagtgaaattgttataaactctatgaatatgactattgtagtcaatcattatggtggagtagtcgattctctccataatgccgcagaacgagtatattgagcgccatcgcaagttgtatggtcgcagacttgattatgaagaaagaaaaagaaagaaggaggccagagagccccacaaaagagcgcaagtagcccgaagccttcgcggtattaaagccaagatctttaacaaagaacgcagaaatgaaaagattcagatgaaaaagaaaatcaaggctcatgaagagaagaaaatcaagaaaacaacagaaaaggtttcggagggtgccttgcctgtttatctgttggatcgtgatgtacaatctagagctaaggttttgtctaatatgattaaacaaaaacgtaaagaaaaagctggtaaatgggatgtgccaattccaaaagtgagagctcaagccgatgctgaggtgctaaaagtcgtcaaatcaggaaaaactaaaaggaaagcttggaagagaatggtaaccaaagttacgtttgtcggagaaggattcacgaggaagcctccgaaatttgaaagattcatcagaccaatggcacttagattcaagaaggcccatgtcacccatccagaacttaaagcaaccttctgtttacctatcattgatgtcaagaagaatcctagttcgccgatgtttacaagtttaggtgttattactaagggtacagttatcgaagtcaatatttcggaattgggtttggttacgcaagctggtaaagtagtttggggaaaatacgcccaggttaccaataatccagaaaatgatggatgtattaatgctgtactgttagtttaagtctgttcttgtaggttaggtgttctttataataaaaatttatatttttgaaaaaaaaaaaaaaaaaacaaaatagaaaatttttaaaattaaaaataaaaaaataaaacaatctttggataataaaaaaaaaaaattaaaaaaaccaaaaaaagaaaaaaaaggaaatcctaaaaaaaacccaggttaataaaccggggggggggggggggcccccct

SEQ ID NO: 738 - DNA, 1214 bp, Diabrotica virgifera
ctcggctgtcagtgtcagtggcaatggctacagcaataatgaatacaattttaaagaaaaccgtggaattacttccatcaaaattatttttgaaaaatggagctgccctgatccacaccagccaaaaagtaaatgctggtaaatggtatccagatacagaatggataaaacaatttgatggccctgtgatgtatccagatgagataaccaagaactgggctctacagccttggaatgctactaaagcaccagtagagaaggaagttaaaaatgttacgttaaattttggtcctcaacatcctgctgctcacggtgtgttgcgtctagtgctagaattagatggggagactgtcaagagatcagatccccacattggtcttctacatagaggcacagaaaagctgattgaatacaaaacctacactcaagccttgccatactttgacagattagattacgtctctatgatgtgtaatgagcaatgctatagcttagcaattgagaaacttcttaatattgacgtacctttaagagctaaatacattagagttctatttggtgagttgactaggattttaaatcacattatgggcatcggaacccatgctcttgatgtaggagccttgacaccattcttctggctcttcgaagagcgtgaaaagatcatggagttttatgaaagagtttctggagctcgtatgcacgctgcatatgttaggccaggaggagtatctctggatcttcctttgggtctgatggatgatatttacgaatttgcttgcaaatacaatgaacgaattgatgaagtagaagatgtcctcacccataacagaaatttgggttcaagaaccaaaagatattggagtgatttctgctgaagatgcattgaactatggatttagcggtgtgatggtgcgagggttccggtatcaaaatgggatttttgcggtaaaacaaaaagcccttaacgaaagcataatgattcacctttgaaattttaacgtttccccctcgggacaccaaaggggggacctggttaccgaacccggttatttttttgccgccataaaaaaaaaaaagaaaaaaaaatctttttgaaaaaatacttaaaaaacaaaatgggctcttaaacaaaaaatggccctgccccggggggaaaagaaaaaaaacaccgcgaacacaaccccttaaaatttatatcgtcccccccctat

SEQ ID NO: 739 - DNA, 998 bp, Diabrotica virgifera
cggacgcgtgggcggacgcgtggggtcttacgtgataaacatcatgaagatcctggtctccctacttattgtggtagcatctacatatgctggagaatctaaagcaactgaaaaacggggagtgcttgaaggaaatgtccattccttaggctcaccactagtcctgtcatcaccagtcggattgcagactggcctaaacaacgctcattctctaggaggactacaatctcactcactgtttgcatctcccttcttgaacattagatcagtcccatcagatttaccgctaatcgatttaggacaatcttcccatacaactataactaagaaggtagctgttccagttcgtcaaccttatgctgtgccagtggataggccgatacctgtacctgtacctcatgctgtacaagttccagtagatcgtcccgtccccgttcatgttgctcaaccatatcctgtaccagttgaaaggcaagtgcccgttcccgtggaaaaggtagtgcctgtaccggtccaggttcctgttagagtagaagtaccagtaccttataaagtagcagtaccacagccctaccccgttgaagttgctagaccagtaccagttcatgtaccaaccccagtactagttaaacaacaagtgcatgtgccacagccttatatcgttaagcaacaggtgcatgtgccccaaccttatctcgttaaacaacaagttgctgtaccacaacctgtattggtaagacaacaagttgctgttcctcagcccgtacttgtcaaagaacaagtagctgtgcaacaacctgttctgctgaaacaacatgtaccagtggctgcccctgtgctgctgaaagaacatgatcttcatcgatactcttcactgttagtttaatttattttttattatgatattggcaaaaatgtaaatgatctatttattttatcaaataaattatttgcaattgtcaaaaaaaaaaaaaaaaacaggcccgcccgaacggatc

SEQ ID NO: 740 - DNA, 1048 bp, Diabrotica virgifera
atttgtcactaatatttgttttgtgatctcaccgtttatatacgttcaacatttaactacatagtacgaatttttaatcgtaagtatggcccctgttattgaaaaagtggtagatggattaacgtttgcagaatcgccttattgggatgcaaacaaccattgtctctattttgttgacctcatggaaagcacagtatataggtatgcaccgaggagtaagcggaaattaaggcaagttaaaatagaaaaccataaaatatcaatgataattccagtaatggagagaaaaaatcgttttataattggactgaacaattcgatagcagttatggactggaacagaaaagatagtgaagtaaaatcaatcaataaactttacgaagttgacatagattacgtaaacttttttactggcggaaaatttgacctaaccggaagattatgggcaggcactacgactgactatggtgtatctggaaattttagggggaagctttacagttttgatgaagaaggtgttgtcaagtgccatcgaattggaatcggtatttcgaatggtatagcttttgactataataacaagaaaatgtattttacagactcactaagccaaagaatagatcaatacgacattgattttaacaccggatcattgtctaacaggcaagttattttctcgttatacaaccatgcagaatttgatgaagatgccatatgtggtggcatgacgatagataaagaaggaaacctatgggtagcagtcttcgaatcttcaagagtgtacaaaattaatccacgaataccagatactgtcttgcagatattgcaatttccaaattcacaaataacttctatcacatttggaggaaaacatttagatgagctatatgtaacttcagcagggattcaaggaaatatggaagaaatccacggttgtgtctatcgggttactggattggacgttaaaggagtgccggcagacaaaggcgttgttctttaaaaccgagcaaaatagttaaacttttttatttattttgtaataacttct

SEQ ID NO: 741 - DNA, 1384 bp, Diabrotica virgifera
caattgccgtttgagttacacaatggcagaaaacggtatgagtattgatctcaatcaagtagtacaaacggctctctctgattttgagaacgtgcagctggtatcggagaaaaacgacaaagaagacgaccgtcaagtgctagctgacgtgaagacaagtggcgaaaatttaaatctggtgatcaaactaggaaagggtgtaaatgtagcggagggcttccaaagggaagcttacgtattaaacagagttactcccctatttaaggatatacaaaagtacttgaggatacagaatccagtgcaagagtttcaaaaatgctacaaagccttcaaccaggaaggtacagaaatcatcgtattagatgatattgaaaaaagaggattcgaagctgtgtctggtgatttgagtgagcacaacttcaaattaatactaaatacaattgccaaatttcatgctctatctttcgccttgcgtcatattcacaaagaaaagttcgatgaagtactctccaactgccaagtcgttacgaagactatgttagaagaagttgctcaattctttgatgctcgacttgagaaattgaagttcagtcttaagctccgtatgaggttagatctgttaaagaattttgaagatgcgttagaaaattttaacggaagaagcattattgatattctaaatcaaagtgtagagcattctgttttagttcatggagattaccatcagaacaacactttgttaaagtttgcgggacaagacaagacacatgccattgatgtagctcttaccggtttccaagcttccggactccattccccggtcatcgatctatcgtactacttcttcagcagtttaggatgcggattcttccccaacgtttccgaattcttgaaatattactacgaacaactgacgtcttttcttaaagagctcggttgtgacgttgcacaaatatatactttcgaaaaacttcaacaacactggcagcaatactccttttatggattttgcctttcgatcgcctatttggaactgggttcaataaacttcgaaaaacattttaggaaggaaaacgaagagagttctgaggtagaaaaacctgcagtaggtgctccaaatgttgcaagtgctaatgcttatagacaaaaacttgaaaagatcgtagagttctttttagaagctcaacaagaattttattaatatggtaaagtgttttatatactccgtctaatatacttacagctgcacgtcatccgcgtcatagcccgtgatgtcacatgataccaacacgaaataattaggcggtaggtgtgttccttttcagaatcattttgctgagtacactggaattacagccactagatatattttattatatacgcg

SEQ ID NO: 742 - DNA, 923 bp, Diabrotica virgifera
attattctaacatggccgcatgttagttactgaattttctttattgtttgccaacgtttgttaaagatttagtagtggtgtttgtttaaaatactttaagattgatctagaatacaggtagattgaagtagtggttagtggcaggtatttatacctattttttggataagttgtgccggttttggtcttgttgatctactcctccctattgaggtagttgggcaaagaatagggttttctgattttctctttttgattatttcaacctgaaaaatgttacaagaccatcatcacatgtctcaaaatgggatgcaaagaaatgcaagaatggggatgcaacaaatggggccaccccctaatcaacgaacaccaatgctcatgagtatgccagctactggtgttctagtctcaatgcctcctggtcctgggccaactttaataacaacaacatctatcccccaacaaccacaaccaaaagccaatatccagcaaccagtctatcactatgaaaacgctggtcaacctaccgaaccagatcagcacagtactgagcatcagaactgttcaaacactaatactttgtctacgcccaacgctactttggcaaacataaaagaaaaaacacccatgtgtttggttaatgaattagcaagatacaataagatccaacaccagtatagactcactggggagcaaggaccagcccacaagaaaatattcacagttaccttgaaactcggtaatgaagaatatgaagcagaggggcccagtattaaaaaggcacagcactcggctgccgctcaagcgttggctaaaactgaattcaaacatccaccaccaaaaacgaactacgtaactcagccgggttattatcccacgcataatttgtacaacgctcaaactcagccgcaaaggtacaccta

SEQ ID NO: 743 - DNA, 1154 bp, Diabrotica virgifera
ctaacactttatggactccaaaaatgtgatttcgataaactttaattgcaatttgcgccgtaattaatcataattaagagttggcgcaatgataagagttgaccgttgatttgaaacgaatctggtcgtataaattttattgaatttgagtgacattatattttccataagatgtgtgcgatgtcctttcattaggacgaacgtttgggcaattttctcgaacgcattgtatagctgcccgcgataaaggttgtgatatgagagtaccctttatcaaaaaaaaagtattgctatcagttaggccatgttttgatgatgcctcaatatcaattgatggttcagctgtggcctagatatatatcgcttgattttttaatacttttgtatgtgttaaaatgtagattgataccagtctacgatttgtgataataagtaagctctgacgtgcgattagaacgcacgatagactgtagacgccgtacctgctttcatttcagtgagatacggaacatttgaatgaaaggggctagaaagagcccttgggacccaagtaatacaccaaacaatagcatgtacccaaataagtaatgacataacatgctcactttaaagatggcggctttgacttcatgtgtcacttaaaatatgacagatgacatcagagcagtcattttgagggtgattgtgccaaattgttggcttattggtagagatattattattaggtggcttatgttgtggttcttctacgtactgacagtccatttgtatttaagagtcctatataagtttggatatttttttaagattttgtaatgctcaaggtaagaaatttccttatatgattggaatggtatccaaaccagggcgcgataaagcaaataccaaatcggtacataaacaacaaaaaacgctcgttgtactacaaaaaccaatcctcttaattcaaatcattaatatcatcaatcctacttaaataaaccgcgtattttgttgtttataccgactttaacattgttatcttcatgtttaaggtaaaccacgagataaatcttgtaattccatcttaacacgatttttacaacgttattttctcagtaaaaattggaagtttacaatgaacgtgaagaaagctaagtgtatcatcccagtga

SEQ ID NO: 744 - DNA, 970 bp, Diabrotica virgifera
cccacgcgtccgctttatttttgttcttataataattgtctaaaattaaacaatagattgatttactgaaaatgtatttgtgaagtaacaaaaatcattaaagaaaccaaaatgaccgttgccgaattttttggatgcacattcatggccttcgggcccccctttgcaatgtttatttttacaatcgcccatgatccaataagaataataatcctcatagctgcagcattcttctggttggtgtctttactgttatcatcaattatttggtctgcaataccattaaaaacacatctggaatttgctatattttatactgtcttgttccaagaaggttttagatttgcaatttacaaaatattgagaaaagctgaaaatggcttgaagaaaatcactgacaatagcacaactttaattgaaaacaaacaaatattagcatatgtcagtggcttaggatttggaattatgagtggtgccttttcattagttaacgttctagcagatgcagttggaccagggacaatgggtttgaaagctggcaaagaaacgttcttcataactagttcattaataggtttatgttttattttactgcatacgttttggagtgtgatattctttcatgcatgtgataatcggaattacttacatttggggtatgtcgtaatttcacatttagtcgcctcctatttaacgttattaaatagtcattatgaatattggggatcaattacaactttgtatgtaatactcatgtttacagggtgtgcagcttttaaagttgctgggtgggacagttgcttcattagtaaacggggcttaattttaaggctattgttaaaaaaatatgttattaataaatattttaaactactaatgtatttattacattttattttcccacttaccggaattatatttatttatatttggattaatatagaaataaaaaaaataaccaccccaacat

SEQ ID NO: 745 - DNA, 1311 bp, Diabrotica virgifera
  misc_feature (1066)..(1066): n is a, c, g, or t
  misc_feature (1077)..(1077): n is a, c, g, or t
  misc_feature (1111)..(1111): n is a, c, g, or t
  misc_feature (1207)..(1207): n is a, c, g, or t
ggtgaagcgttgtaaaccgctttaattatcgatttttattgtgtattaaacttttcggtagacaccatggagcccatatgtgcagttcctgataatgttctttcattgcttaagtgctcattatgtgagagctatttgtctgtcctgccaataacattaatttccgaagatggaagtcaatacaaatgtggacgttgtagtactgtcaaaaccattattaacactagagcccttatttatgaacatctcgctaaacttatgaccttttcgtgtaactacagcggatgtggaaagaaggttccctttactgatgttaaggatcatgaaaaagtttgtgaccaaaaaactgtagtttgtccaaaagacaagtgtaacgaagttgttaaggtatctaaatttggagctcattttaaagaaaagcatgctgacgctcaccatgtcaattcctttttgattaagaacatctacatcaattctaatgtagatgtattggaaaaaaatggaaagacatatttagctatcttcgattttgatgaggttaattttggattgagtgtttgtgctcttgatcctgcagacaatatccagtatgaagtaaaactcagaaatgagaagagcaactataccatcaatatagctagccaaaatgttatcgcttttaatgaacgtgaacactgtattaaatgtgtaggtggcacatgcaaggctaaatctcacatgtatcgagaaaatcgcagagatattttaaagcggatgactactcggataaaccgagactgcatcaagagaatgattggaactggaaacttgtcctataccatcaacgtttatgaggaaggtgagaaacccaaggatgactcgaagattgaggttaaggatgccataatcagaaaagccaagaaaatctttttgcaattgctggaatgtccgtgttgcaaggagtacatgtctccacctatctatcagtgtttggcagggcacacggtctgcaatgtgtgtaaaccaacctacgagaaatgcccatcttgtgaagagctcatccagaaaacccgtaacttcaccctgnaggaattgtcnaagaaagtggagctgccggctgatgataagaaangtcaatctgacacgagcttaaagagagctgccgaagaaaacgggcatgccgaaaatcaagcaaaagtttgcaagaattatttttcattgacctccnataggcaaggtgaattttttttattatttagtgttatggctggaataaatgtttttgtttatatgactacaagaaatgtgtacaacatttggcagatcgtttta

SEQ ID NO: 746 - DNA, 2434 bp, Diabrotica virgifera
aaaaaaagggcattggctggcagtgagacggcaatcatctgctattgttgaaaataattttaagtttttcttttgtaatcaacactatttattaactaaagtattcagggaatatcgaaacaatacattacatttgacgccagtaaaatttgctgagtccaccaaggagagtatctagaattttcgttgataaatagaagcgatcgaagatatttaacatgtcatttaacagacaaggaggcggtggtagcacattcagaagccgagaaaacctctcaaatggaggaggcaatgatagatttggaggtggtcgaagcggtggtgggggagggggtggtttcaaaggcggcagtggaggaggataccgtggcaatgacagcggcggcggcggcggaggattcagaagtggtggaggtggccgtggaggcggtggaggattcagaagtggaggcgggggaggaggtggatttcgaagtggcggaggcggcggaggaggtcgttttggcggcagaggcggaggcggcggtagaagtgggccccaaggtggccgcctttacagaccacaatgggacagtatcacactgcgtccatttaagaaagatttttacgttcctcatccagcagtagctaataggtcacattacgaagtagaacagttccgacgagccaaagaaattacgatagaaggtaaagttccaaaccccatacagcatttcgaggaagcctccttccctgattacgtaatgaaggaaattagcaaacaaggctacgaatatcctactccgattcaagctcaaggttggcctatagctttgagcggattagatttagtcggaattgcacaaactggttctggtaaaactcttgcttatatccttccagctatagtacatattaataaccaaccagctatagctaacggagatggacctatagcgctagttctagccccaacgagagaattagctcaacagatccaacaagtcgccagcgattttggaaattccacatacgttagaaatacctgcatattcggaggagcccccaaaggaccccaagcgcgtgacttagaaagaggagttgaaatttgtatagccactcccggtcgtttaatcgatttccttgaaaaaggaaccacaaacttagagagatgtacctacttggtactcgatgaagctgacagaatgttggacatgggtttcgagcctcaaatacgtaagattttggagcagatccggcctgacaggcagactttgatgtggtctgcaacgtggcccaaggaggtcaagaaactagctgcggatttcctgaaagattacgtccagatcaacattgggtccctacagctctctgccaatcacaatattcttcagatcatagacgtttgccaggagtatgagaaggaatttaaactgaaccaacttctccaagaaatagccaataacagtgaccccgactccaaaattctaattttcgtcgaaaccaaaaagaaagctgaagctgtatctagaacggtaagaagaaccggtttgcaagctgtgtgcatgcacggagacaagagccagcaagagagagactttgtactcaatgagttcagaaacggaaaatccacaattttagtcgctacagacgttgcagcaagaggattagatgtggaaggaataaaatatgtagtcaactatgattatcccaattcgtctgaagattacatccacagaataggaagaactggacgatcagatgcctctggtacttcttacgcctttttcacaccgtctaactcgagacaggctagagatcttctgtcggggctaaaagaagccaatcaggttatcatcccaaactaaccgacatagcaaacggctttcgccaagacgaaatccacgcgcccataaaaataccggttgaaaacatctcggcccaatggatcaacgtcggatcagggcctcaaggaatgtacggtatagaataatgaatatgcaaggaatcttttatttgcattgggtgggatcattaggaggagccatggaagtaactttacgcaagacattggatgagaagggctcaatcgacgctgcatactgtcataacatgtggcaaaatgatggcgaattgcttgagaacaaagatcaccggataagataccgctgaccttaacaattaaagagtaggtccaccatcggcgtactaggattctgcgcgttcgcaatatactgacccagctacgaaaatgaccatccttatctagttatatgtgcaataggaagggaaacagaacatttacgaatgacgtgaaattcgctgttgtattcaaattttcatattaacctagagaaagcagattgttttgtataccgcaaaattatcaaaaatttttttaaaaagtagtgttgatcttgttacgtattaagaaaattggaaaaaataatcttaa

SEQ ID NO: 747 - DNA, 640 bp, Diabrotica virgifera
ctcaatggtgttacgacaacttcgtcaactaccgttccctcaaatctgccgataacgtgcgacaacagctatccaggattatggataggttcaatctaaagaggacgtccaccgaatttacgagtaaagactactatataaatattaggaaagcacttgttaacgggtttttcatgcaggtcgctcatcttgaaagaactggacattatcttacaattaaggacaaccaaatagtacaactgcatccatccacttgtctagaccacaaacctgagtgggtaatttacaatgagtttgtgttaactacaaaaaattatattagaactgttactgatatctaacctgattggctgttgaaaatagccccacagtattacgatctgaacaacttcccacaatgcgaagcaaaacgacagttagaaattatccaaaatagattagagtccaagcaatttcaacaaggcttttaaggctacaaaatataggattatttgtatcgtaaccttgttcgcgtttatggcatcatattttgattatgtatttaattattataaagtgacacagaatgtattattaataatttcattccataataaatagaggtagctcttaatggagttactagacacttttgtgtttt

SEQ ID NO: 748 - DNA, 702 bp, Diabrotica virgifera
cacacgcgtccgcccacgcgtccgatcgtgtccttaccaagaataacatctaaaatgaaatacatctactttttgttcatttatttcttggttgccttagcaaaggcagaagaaactgttagcttagaaggaaaactcccaaaatgtgagtgtagggatataatcgatgagatcttgtgcaagctaacagaaaactcagaaaaggtcctcaaaattcaagccaaactagccaaagtagtgaaagaaaccaatgaaattctaacagaagctaaagaaaactcagcccaagtgaaagaaatcgtctctgttagcaccttgcttaaatctcaagtcaactctacggtcacagtcgttactgccaataccgcagctatcattcaaattaaaaatcaagtccacgaccatgtccttgacaatggtggcgacttggaacagaccttgattggaagcagctgtaaactgaatcagatcaaaagggtattgatcggtcttggaaactgccagtgtagaaaaccagatactgacgaagcaaacacagaaggttattagagtttttaaatatgatacaatacacctgtaaatataaatggactattccttaatacgaccttttcaataaacaccaaccacataaaaaaaaaaaaaaaaaaaaaaaaaaaaaaaaaaaagataaaaaaaaaagaaaaaaataaaagataaaaa

SEQ ID NO: 749 - DNA, 1217 bp, Diabrotica virgifera
  misc_feature (1190)..(1190): n is a, c, g, or t
ctagttctagatcgcgagcggccgccctttttttttttttttatttttttttttttttttttttttttttttttttttttttttttttttttttttttttttttttttttttttttttttttttttttttttttgcaccagaagatgttttatcacaacaacgtagaatgccccgcattcttatttttccagccgttgcacgaccccacaggggtacgacagtttctaccctctgtctccttctgaccgctcttacagtcggaggaataggtatcgtacgaggcaaaattctgtacgaccagtacatcatagtagcacataaacggtttgaaggatgggctcagattccaatagaaaatgaattgaaaagtgcatatgacgggacagaagtagatgatactgatgcgtttttagataaaatattaccaacagaaaattacaatgaaatgtggaacgatgacgatactgacttcaagcatattttcaaagattatttccaagaaaacttcgagattagcaacgacgaaaaatacgaaaaaatcgacgtgcctgatttcagagatggtcgcagcggccgtttcatccacgattttaataccaacacaactggcatcatcgacataactggacgtagatgcttcgtcatgccattgaaccgagacaatgttctaccaccaaagtcgttgtttgatttgattcacaagatgtgggaagggtattataaagtaaataccgatcttgttagaaaaaatatgagagttatcatcccaccaattacagataccaagaccattggtggatatattgcaagtgaatgtgatggattgcctatttataaattagaaaaatacgtcggtggagttgtaaagaggtctgccgataagcagtctgaacgattcgcccagtttgctggccaaggagtcacccagatagaaattaccaacatggatgaggtgtatgcctacgaaaaaagtttgattagccattaaattgtttaattatcgtattaacataaaattattatataaaaaattgaatagttgagaggcatcaccaaaatttctcttgcttttctcgtattttattgtttagttctatcgtaaaatacttgataacgatggttgtcttttttagttttgcatatagccataaagacaaaaaaatatagacctgaatttattgtcttttgnacagtgtgatcacttgcattgccttga

SEQ ID NO: 750 - DNA, 1410 bp, Diabrotica virgifera
tcgtatagggaacttctttttctgatctacatgttatgaggctctttgttttagttttaaatatagccataaagacaaaaaatatatagactttaagtactttattgcttttcaagtatgtctcgctaagatcgatactcttttgcatacgttcaaaccaattggtaaaacagttattccagtcttcagttgacagctgtaaaatcgctattttaaaggtatcgatggcttcttgtggcaactggaatcacttcctacgcattgaatcctttatctttgggaacgtgagtaaatcgttgagactgaggtcgaggatatacggtggatggtttaacaattcgatgttttgaagctccaaaaactctattgtcttttgggcagtgtgagcacttgcattgtcctgatgtaggatgattcgccgtcgtgtacttctggtaaacaaacggttatataccaatcagaaataaccgttctacgatcttctaaagcaattgttgccacatgaccagattttgacacaaaagttgcgaccattttctttaatacatttcgagaacgggtgacttttgttggtttttccccatcgcgaaataaccacacagcgaattggcgtttattttccggttcgtaggaataaacctaagatttatcgccactaaccatactagaaacgttttttgagcttctttcgttgactcgttccattttttttttacatcaattcacacgaaccgctttttgctcttctgtgagtaaatgagggatccaactgaaaaccaacttcgtaacacccagttgtagaatcttttgaatcgaggtctttgaaatgctcaaagatgcctctatctcccggtatattacacggcggtcatccttaatcagccgacgaaccccatcaacgtttttctgtgtgactactttttcgaatagaccagatctggattcgtcgccgagactgaagcaaccacgttgaaattagcaataccagcagtaaatagttgaccggtgtgatgcttcattcccaaacacagaaaccatttcagcgagacattgctgttgggataatcctctgcaaaaattgtaaaaaattattgctcgaaaatgttctcgattaagatccatttttcgaccgactggctaacttcaaaaaattcactgtatctacgcaacttgttttatcgcaataaaactcctgggtttgtgtcaacaaaagattgaggttacatttgtgtcgaaaggttttattggtactgagctgttataagcaaaactaaaaagacaaacctcgtattgcatgtacttacaacattcaagttctcgttagtcgataacatcagatctaccgcattctagtgctagacaattgatatttctctatacaaataataaaaatgaaaattgagattatgg

SEQ ID NO: 751 - DNA, 1242 bp, Diabrotica virgifera
atctttttaaaaatatatagactttgagtactttattgctttccaaaatatgtcccaacaagatcgatacacttttgcatacgttcaaaccaaatgctaaaacagttaatccagtctccaacaatggttgaacaattcgatgttttgaagctccaagctagtcttttgggcagtatggcacttacattgtcctgatgtaggatgattcgccattatgtgttgctttgtcggaatttcgcgataacttctggtaaacaaacggttatataccaatcagaagtaaccgttattcgatcttctaaagcaattgttgccacatgaccagattttgacacacaagttgagaccattttctttgatacatttcgagaacacttttgttcactttcattttgttcactggatcacttttgttgctttttcctcatcgtgaaacatccacactgcggattggcgtttattttccggttccttggagtaaatccaagattcatcgtggctaacaatattataaacgttttttgagcttcctttccaaccgttccaatgttttttgacgccaattgacgcgaaccgctttttgctcctctgagcaaatgagagatccaacgggaaaccaacttagtaacacccagttcttcatgtagaatcttttggatcgagatctttgaaatgcccaaagattttcctatttcccggtatgatacacggtggtcatccttaattagctgacgaaccgcatcaatgttttgctgtgtaatgtacctggcctggattcgtcgctgagactggagcgaccacgttgaaattcgcaataccagcgggaaatagttgactggtgtacttcatccagttgaaaatattctcggttaggatcattttttcgacagacttgctaattttaaaaattcattgtatctacacatcttgttgtatcgcaatggaactctcgatttatgtcaacaaaagattcaggttacatttttgttgaaggttttattggtggcgccgtctaagcggctatatgtgaaactaaaagacaaacctcgtataaaacaaatactgtttttacagtttatgctgaaagaaaacatgaaataagaatgcttttggaaatttggatattgtgcgccttaaacttctctccaggagtatcagagtataaatactatttcttatatttgttctccaatttttaaaactgtgttacttgttcatttagagattaagatggtacagttt

SEQ ID NO: 752 - DNA, 1358 bp, Diabrotica virgifera
tttgcgtccgaatgacagaggctgtgaggacacgacacacccaccgatcaggcgtctgggcttatcttgataatgaacgtcatatatataaaatccccagtacacaacgcacctgagcccgcatttttccgaaccaaatgatatagaaacacagtttacacacaatagacaagtaattgttgctttaatggggaaaatgtccacaacaactaacatttgctattatcttctagaaaaacgaataactttcacgtacattttatattataatgaggccacgttttaaaatcacaaacattaagtgatagtgaagtgaatgtcgactcgattctagttttctgttaacccagatatgaaaatatcaaaaggcaccgctaggaaaatattccaaaaatgcggttcagagaacctatatgaaacgagtctttgtactctcatacagagtatggcattagtaaaaattttttactaaaagtcgttgggacttaggtcggggctatacggtggatggtttaacaattatatcttttgaagctccaaaaactattgtcttttgggcagtctgagcacttgcattgtcgtgtgggatgattcgccgttgtgtgttgctttttcggagtttcgcgataacttctggtaaacaaacggttatcttccaatcagaagtaaccgttcttcgatcatctaaagcaattgttgccacatgactagattttgacataaaagttgcgaccattttctttgacacacttcgagaacggatcacttttgttagtttttcctcatcgtgaaagacccacacagtggattgccgtttattttccggttggtaggagtaaatccaagattcatcgccactaacaatactataaacgttttttgagcttcctttgttaaaccgttccaatgtttttggacaccaattgacgccaaccgctttttgctcttctctaagcaaatgaaggatccaacggcaaaccaacttcctaacacccagttttttatgaaggatcttttggatcaaggtttttgaaatgctaaaagatgcctctatctcccggtttgttacacggcggccatccttaattagctgacaaaccgcatcagtgttttgctgtgtgactgatgttttgggtgaatctggcctggattcgtcaatgagactggagccagcacgttgaaattcgcaataccagcgggaaatagctgactggtgtgatgctttattcccaaacacagaaaccatttcagcgtggcattgctgttgtgataaaatcctccccgaaaattgtaaaacattattgctctaaaatgttctcggctaagatccatttttcgaccgacttactaatttcaaa

SEQ ID NO: 753 - DNA, 1903 bp, Diabrotica virgifera
agacatttgtatagaaaaactgtcgttcaaatatatttcctaaagtccaaggtaaattctaattttcgtgtttcttattcatctaaattggacatccgagtgttgtctttttgttttccatataaccataaaaacaaaaaatatatagacttgaaagtactttattgcttttcaaaatatttcacaccaagatcgatacaattttgcatacgtttaagttattccagtcttcagttgacacctgcaaaatcgctgttttaaagacatcgatggcttcctttggtaactgggatactgttcacgcattgaattcttgatctttgggcacgtgaagaagttgtagggacttaaatcggggctatacggtggtaactattttaaactgtttaacaattcgatgtttgaagctcaaaactctatattgtcttctgggcagtgtcagcacttgcattgtcctgatgtaggatgattcgccgttgtgtgttgctttgttggaatttcgcgataacttctggtaaacaaacggttatataccagtaagaagtaaccgtttttcgaccttctaaagcaatttttaccacaggaccagattttgacacaaaagttgcgaccattttctttgagacacttcgagaacaggatcacttttgtttgttttcctcatcgtgaaacacccacacagcggattggcgtttattttccggttggtaggagtaaatctaagattcatggccactaacaataccataaacgttttttaagcttcctttgttgaaccgttccaatgattttcgacaccaattgacgcgaagcgttttttgctcttctgtaagcaaatgatggatccaacggcaaaccaactttctaacacccagttcttcatgtgggatcttttggatcgaggtctttgaaatgcccaaagatgcctctatctcccggtatgttacacggcggtcatccatgattagccgacgaaccgcatcaatgttttaggtggacgtggcctggattcgtcgctgagactggagcgaccacgttgaaattcgcaataccagcgtgaaatagttgaatggtatgatgcttcattcccaagcacagaaaccatttcagcgtgacattgctgttgggataatcctctccgaaaattgtaaaaaattattgctcgaaaatgttctccgccacgatccattttcgaccgacttgccaatttcaaaaattcactgtatctacacgacttgttgtaccgcaatgaaactctcgatttatgtcaacaaaagattgaggttacgtttgtgtcggaaggttttattggtggcgccctctaagcggctatatgcaaaactaaaaatatgcagttagttgagatattggtagactggtgtagtaaaatcacaaattactcaatttcttattgccaatgcttgtagctgctgttattaattgaatatattgatttagcatagcgatttgataaaggttagttattttttgttggagtgagactgacgcaacaaaaaaaatattgttgatcttgagataatcgttctaatcgttgaatgtaaaccatctatcataactctctattaatttttaatataatttgtaaatgtaaagttgtgaaaaaataattctgtagctgcaacattcagtaactgccatggtaaatatttaactttcgaaattcagtgtaaaataaatgtgtgtaataatactactactactattacaacaatttgcaagtttagtttttatcattgttaattatgtattatcagtttctcattattttttagtagctttttaaaatagttatttcaggcgttggccggataatttaagttgataacaaaagttcagttccgcatttgtaatttctaatgttacagtggggaatcgcaggaat

SEQ ID NO: 754 - DNA, 3349 bp, Diabrotica virgifera
  misc_feature (1194)..(1194): n is a, c, g, or t
ggaagtgcgcggtggctacctctttaaaccaaccaaatttaattttcaaagctcaactactggtcttagagcaataaataaattcgcggtttgaaagaaaaagtttcaacaccccttatcttggaaacgaagcatttgcggacatgcgtttatggagcaagctgtcattattttttcatgtagttttatacccttaaccccttaaagtttttcatacttatttactaacaccctgtgtatatagacttaaagtactttattgcttttcaaaatatgtcccaccaagatcgatacacttttgcatacgttcaaatcaattggtaaaacagttattccagtcttaagatgacacctgcaaaatcgctgttttaaagggatcgatgtcttcttctggcgactggaatcgctgtcaacgcactgaattcttgatctttgggaacgtgaagaagtcgttgggacttaggtcgaggctatacgctggatgatttaacaattcaatgttttgaagctccaaaaactctattgtcctttgggcagtgtggcacttacattgtcctgatgtaggatgattcgccattgtgtgttgctttgtcggagtttcgcgatatcttctggtaaacaaacggttatataccaatcagaagtaaccgttattcgatcttctaaagcaattgttgcaacataaccagattttgacacacaagttgagaccattttctttgacacacttcgagaacacttttgttcactttcattttgttcactgggtcacttttgttggtttttcctcatcgtgaaacacccacactgtggattggcgtttattttccggttccttggagtaaatccaagattcatcgtggctaacaatattataaacgttttttgagcttcctttccaaccgttccaatgtttttcgacgccaattgacgcgaaccgctttttgctcctctgagcaaatgagagatccaacgggaaaccaacttagtaacacccagttcttcatgtagaatcttttggatcgagatctttgaaatgcccaaagatgcctctatttcccggcatgatacacggtggtcatccttaattagctgacgaaccgcatcaatgttttgctgtgtaaagtacctctatttcccggtatgatacacggtggtcatccttaattagctgacaaaccgcatcaatgtttntgctgtgtaatgtacctctatttcccggtatgatacacggtggtcatcctaaagtcaagtcaaagtcgcaggcaggttcattatagttgcgaactagtgtattgattaccccaaatttgtgccagaaacatttttcaaaatgacgattttgactaaacctttctccgaaaagaaaggggagaaggacgtagctcctttggtgttcaacgaacaaaccgccccagccaatgctccagaagatgtcgaatcacaacaacgtagaatgccccgcattcttatttttccagccggtgcacgaccccacagggttacgacagttactaccctctgtctccttctgaccgctcttacagtcgtaggaataggtatcgtaggaggcaaaattctgtacgaccagtacatcagagtagcacataaacggtttgaaggatgggctcagattccaatgaacgatgacgatactgacttcaagcatattttcaaagattatttccaagaaaacttcgagattagcaacgacgaaaaatacgaaaaaatcgacgtgcctgatttcagagatggtcgcagcggccgtttcatccacgattttaataccaacacaactggcatcatcgacataactggacgtagatgcttcgtcatgccattgaaccgagacaatgttctaccaccaaagtcgttgtttgatttgattcacaagatgtgggaagggtattataaagtaaataccgatcttgttagaaaaaatatgagagttatcatcccaccaattacagataccaagaccattggtggatatattgcaagtgaatgtgatggattgcctatttataaattagaaaaatacgtcggtggagttgtaaagaggtctgccgataagcagtctgaacgattcgcccagtttgctggccaaggagtcacccagatagaaattaccaacatggatgaggtgtatgcctacgaaaaaagtttgattagccattaaattgtttaattatcgtattaacataaaattattatataaaaaattgaatagttgagaggcatcaccaaaatttctcttgcttttctcgtattttattgtttagttctatcgtaaaatacttgatacgatggttgtctttttagttttgcatatagccataaagacaaaaaaatatagacctgaatttattgtcttttggacagtgtgatcacttgcattgccttgaggtaggatgattcgccgttttgtgttgctttgtcggagtttcgcgataacttctggtaaacaagaggttatatacctatcagaagtaaccgttcttcgatcttctaaagcaattgttgccacatgaccagattttgacacaaaagttgcgaccgacactcttcgagaacggatcacttttgttggtttttcctcatcgtgaaacattcacacagcgaatttgcgttgattttacggttcgtaggagtaaatcaaagattcatcgctactaacaatactataaacgttttttgagcttcctttgttgaaccgttccaatgtttttcgacaccaatcgacgcgaacagctttttgctttttgaaattagcagtaccagcgggaaacagttgactggtgtgatgcttcattcccaaacaaagaaaccatttcatcgagacattgttgttgggatagtcctctcgaaaaattgtaagaacttattgctcgaaaatattctcggctaagatccatttttcgaccttgcgctaatttcaaaaattcactgtatctatacaactggttgtaacgcaatgaaactctggatttatgtcaacaaaagattgaggttacatttgtgtcggaaggttttattttgtggcgccctctatgtggcgctatatgcaaaactaaaaagacaaacgtcatattttagtgtgtacaaatgatgtattacaaaagccctatggcctacctcccctttttactttttactaataccccccccccccccccctcctctcccccccccttaattttccctaagggacgtaatatgttttaaaggaacttttgcaaacttaacctattttaaaaaaacaaaaattttgtaaaaaacattttttggtaaaagaaaggaaattttcccctaaaccaaccccgcgaaaaaattattgtttttccttttc

SEQ ID NO: 755 - DNA, 1516 bp, Diabrotica virgifera
acactacctcacgggtggcgcggaaacgtgtgcatattatgaagaatacaactttttcaacgttttgcatcgctgtgtcttcgaagtggtgattcttgggggggaatgtgtgggaacaatttttatagatggttgcatgatggatcgcttttggtcaagtcaaagtcgcaggcaggttcattatagttgcgaactagtgtattgattaccccaaatttgtgccagaaacatttttcaaaatgacgattttgactaaacctttctccgaaaagaaaggggagaaggacgtagctcctttggtgttcaacgaacaaaccgccccagccaatgctccagaagatgtcgaatcacaacaacgtagaatgccccgcattcttatttttccagccggtgcacgaccccacagggttacgacagttactaccctctgtctccttctgaccgctcttacagtcgtaggaataggtatcgtaggaggcaaaattctgtacgaccagtacatcagagtagcacataaacggtttgaaggatgggctcagattccaataaaaaatgaattgaaaagtgcatatgacgggacagaagtagatgatactgatgcgtttttagataaaatattaccaacagaaaattacaatgaaatgtggaacgatgacgatactgacttcaagcatattttcaaagattatttccaagaaaacttcgagattagcaacgacgaaaaatacgaaaaaatcgacgtgcctgatttcagagatggtcgcagcggccgtttcatccacgattttaataccaacacaactggcatcatcgacataactggacgtagatgcttcgtcatgccattgaaccgagacaatgttctaccaccaaagtcgttgtttgatttgattcacaagatgtgggaagggtattataaagtaaataccgatcttgttagaaaaaatatgagagttatcatcccaccaattacagataccaagaccattggtggatatattgcaagtgaatgtgatggattgcctatttataaattagaaaaatacgtcggtggagttgtaaagaggtctgccgataagcagtctgaacgattcgcccagtttgctggccaaggagtcacccagatagaaattaccaacatggatgaggtgtatgcctacgaaaaaagtttgattagccattaaattggttaattatcgtattaacataaaattattatataaaaaaaaataaagttaaatgggaaccccaaacccccttaaattttctccttttgtttttgtcccgaattttttgaaagattttttgaaacaaatatcgggaaaatttatcttggcaaaaaaccaaaagaaaaaaaaaaaaaattttttaccctttatcttattttttgggggagtccaccttggcatttcccccttcagcaggatcacttacagtatttcatgttaagactgcatagaagggtgtttttgacattatgaacactttataaagctaatacctcacattcaacatt

SEQ ID NO: 756 - DNA, 984 bp, Diabrotica virgifera
acttccttatcggggaaagctgggtacgccttgcagggtaccagagtccgagaatctcccagaggtcagacctcacgtcgtccaggcataggtcaaaatttgacagaaattcaacaggcatctgatgtaggtgacaatctgtcttttacccatgaaaaccaggaagaagataattcatttgctgatattttaattcctgaaaaaccattcgattttggtgacagctcacaatcttgtagcaaaacctagctaatgttaataattttgataaaaatgataaaccaacaattcaagaaaaactgcaaaattgggctgttaccaataatgtgtcacattctgcagttacagatctcttgcatatattacatgaagattatccaacgttgccattagatgcccgaacacttctgaaaactccaagatcgttaccaaaaatacaacttgataagggtgaactagtacactttaatttaaaaaatactttgctccaaattttggcatctaacgagtcatttagaaatgaagatacacttttgttgagtttcaatgtagatggtcttcctatttttcatagttcaaatacaaacttttggacaattttatgtttgattaaaaattttaatataccaccatttgttgtaagtatatattgcggatctgccaaaccaaatcctctaaatatatatttgaaaaattttattattgatcttaaagatttgcttgacaatggccttacatatgagagtttaacgtattccattcaaattcatagttttgtatgcgattctcctgctaaggcatatataaaatgtataaagtctcacggaggatactcttcatgtgataaatgtatagaagaaggtacatatgttaataagagagttattcttcaaaatcgcaaggctactaaacgaaatgatactacatttagactcttgcaggatgaaaatcatcatcatggtattttcactcttgctgaattgc

SEQ ID NO: 757 - DNA, 1301 bp, Diabrotica virgifera
cccacgcgtccgcacatttttaaaaatcagccgtttatttaaagtagccggtttgtttagtgatttgtttatatttatttatcgatcgctccgatttataaattaaaatgagttctacggactatctacgtttaaacgaattcaaaatatttaaagaattgcgcgaatcgttgccgaaaacgtgtaataaaactcagaatctgatcaccgttcacgacaatgttttgtttacttgggactttcaaaaccactgtgtgttaagtttaaatctaaaagctgctagagggaaagaaggcgacaatgttattcatcagaaacttcttcccctacatccaccactttttacaccagagtgtgttacagtcaaccaatcgggatccttgttagcaataagtggatcttctggtatcttggtgctggaactgccgtcaagatggccgccctttggatcgtttcaaaacaacaaagaagttgtgtattgcaaagcacacagtttggatgaacgtcttctctcatgcagtgagttggtacagctaagaaagctacagttccatccaggaagtccaaaccacagtcacatcgttgcactaacttcagacaatagtttaaggttataccaagtcgaaaatggtgaagtttgcaatttggcagtatattccgtcggagaaaaaccgtcgactttatttccgggaactacaactacttttttggatatatacggagaagtagccatagacttcgattttggacttccagaaattcaagaaattaaacaaatcaaatccgtgaaattcgatgagacaaaatcatttattaaaagtcagacacgtctggttgacacagaaacacaaacgtcaaacaaaatagtagcaactatgaaaacagagaagaaaaaagacaaggaagaaaacgatacagttgtttggcctgtttttattttaagaagcgacatgtctatctacaaagtgtcatttgatttaaaactgagatggaaaccgataatcggcgcacctctagctatgtcatacacggcagaagaacaaattgatgcatgttccataatatgtttaaacactgttccccaaataatctgcatatctttatgcgatggttccttgcttcatgcagtctgtttagaagttgaatcatcaaagtctggatcaaagaactattctggcgccgtttctgaacaagaattattcgtctttgaaaaagtacaattggaactaggactgacgacatgtgaggaagatcaggggaaacagtccaaatgtgcagtacaactgaggaaggacgaagtg

SEQ ID NO: 758 - DNA, 1363 bp, Diabrotica virgifera
cccacccgtcccgtggtcgagaaaagtactaatagtgatatctacgtttttcgtttgtttaaaatgtagtgacatttctgttaaagtcttcaaaaacggagacgtagttaatttaaatattaactcaatttctgagttaaagcaaaatgtagtccacagaggtgaactagacgacattgaaattgaggaccaaaatgttccagtagtaccaaacaatttgctgaatggaatcactgccacggaacttcacattattagatcccaagtaagagatgttgaacctggtgcattcgatggagcttctatggttaacctaatgttgtatgaaaaccaaattgcaagaataagaaaaggtatatttaacaaaaactcatttaatatacttgctttgcagaataacgttatatctaatatagaagatgaagcctttgacggtacaaccatcgcgatactggactttggttttaacaagatggaaaaattgacttcaaaaatgttcgctggttcaaatattacaaatcttaacttacaatcgaacctaataagtaacatagaagatggtacctttcagaaaatcgataatttgaataaattagacttaagcggtaaccaattggaagttattggacacgtctttagaaacctgacaaacctaaatgaattgcacttggatggaaaccgaatcaaaacacttgaacctggatgctttggtggttctgggatctactggctttattttgcaggtaaccaactgactcatattgtaaagggagtgttttataaagtaccagtatccttattggatttcactaataacaaaatttcaaaaattgataaaggagccttagctggtctttcaacgctaacatttgttcagttatctaataacaatataggagatttgaagctgtccactcttggcgatctcaatactgctttaaatggtctatctttgagtgataacggcatttcaaatatcgatattggagtgttcaaaaatactaaaatcgatatgttggacttaagcaaaaaccatataaaatcaattaaaaaaggactgttccagaatgttaaaatgtacactattaatttgagtgaaaatgaaattactgaaatagaggaagatgcttttggtgatatcgaggatttaagtcacatagatgtgagcttgaacaaacttacagaagttaagaagagaatgttcagtctaccattggatgaagttaattggaagataatgtaataactaaaatcgataatgatgcccctcgtgtccttccgctgtcacgtcttcagataaaaataatcctattggctgcaagaacaaagcttaaaataatggtgtatttaataataatggaat

SEQ ID NO: 759 - DNA, 1431 bp, Diabrotica virgifera
gattaaataacaaactccacgccggggttttaacgtaaaatatatttattataaagttaagaacttccactttctattcaaatatcgacttcaattatcgttgctagaactttagcaccagtggtgcaccgttcccttaaacagcttttttcaaaaggaactggtacaaaagtgaggaactactgtaaaacattacaactagcgacagttcaatacaaccaaaaacgattgtatgcagagaaaaaagtatttgaaagaaccaaaccacattgtaatgtgggtactataggacatgtagatcatggtaagaccacacttactgcagctattaccaaagttttagctgaacaaaagttagcccaagcaagaggatatgcggatattgacaatgctccagaggaaaaagctagaggtattactattaatgtcgctcatattgagtatcaaacagaaaacagacattatggccacacagactgtcctggccatgctgattacatcaaaaacatgatcacaggagcagctcaaatggatggtgccaccatggttgtagctgctactgatggtgtcatgccccaaaccagagaacatctattattagcaaaacaaattggtgtccatcacatcgtagtcttcatcaacaaagttgacgcagctgataaggaaatggttgagcttgtagaaatggaaattagggagttgttaacagaaatgggttttgatggagagaatattccaattattgctgggtctgccttatgtgctttagaaggaaagagtcctgaaataggctctgaagcaatcctaaaactattaaaagaagtagatgcctacatacctaccccagtaagagatttagacaaaccattcttgttacctgtagaacacacatattccatacctggaagaggcactgtagtaactggaagattggaaagaggcattttgaagaagggggctgaatgtgaatttgtaggatataacaaagttctgaaaagtacggttacaggtgtggagatgtttcatcaaattttggatgaagcccatgctggtgatcaacttggagctttagtgagaggattgaagagagatgacgttaaaagaggaatgattatggctaaacctggaacagtaaagagtcatgataatgttgaaactcaagtatatgttttaagtaaagaagaaggaggtcgtacaaaaccgttcacatctttcattcagctacagatgttctgcaggacctgggattgtcctgtgcaagtagttgtaccagacaaggaaatggtcatgccaggtgaagattccaagttagtttttgaaaatgttgcggcccatggtacttgagcaaggtcagagatttcacgttaagagatggttcacaaacctttaggaactggcgtagtaacgaaaaccttacctcgtctctcagat

SEQ ID NO: 760 - DNA, 984 bp, Diabrotica virgifera
catgaacagccttgaattcatttaagcaataatagtagtaggaatatcattgacatcaatagtaataacaactattttaaacttttaaacacaatatagtcaaagttcagagtcagtgtcatcacatccacggttaagcatgtcttgcacacaaataaaacagttagaaacattattaagcaaacaactagttaaaaaaactattaaaaatgttaatattagcaggcttacagctccaggtgaaaactttggtagtataatgtacaaattggatattgtcctgaataataacgataatgataccgaagaaatacttcgcgcagtggcaaaaacccttccagagactgaattttggaggcaaatatttaatattcaagtaacttacacaagtgaaatggctttttatgaggtagttctgcccacctttcaggaattccagcgcagtttagggattgataacgttatcgactgttttgctgagtgtttagcagtaagaaaaaacttgctagaaaatagtgacgttattgatgatgatgctgtgatagtccttgagaatctaatatctaaaggttataacaatattgataggttgaaaggattcgatttaaatacgtcaaaaattgttctaaaagacattgcccatttacatgccgttgctttagctctgaaattaatagatcctaagatgtttgaagaaagggtcaaaaagtactgccatgtctatgatccacccaaggagaatagtgaaaataatgttttagtagcagttgtgggagaaaatgaagagtgtcgtcagtatttatcaagaattcatggttggggtaaaatccccaagtctgcaccgagagaaccgtttgcgactgtagtacacgaagatttgtggaccataacactatgcagaagtcgaaatggacagccgtgggaacaactagtcgactacaatttatgagtaggatctcagcagctgatgtgtttttcttattt

SEQ ID NO: 761 - DNA, 1036 bp, Diabrotica virgifera
agacatcaatagtaagaacaactatatgaaacttttaaacacaagatagcctccattgacagtagttatcattaaagtcatagttaagcatgtcttgcacacaaataaaacagttagaaacattgttaagaaaacaactaactaaaaaaactattaaaaatgtgaatattagcaggcttactgagccaggtgaaaactttggtagtataatgtacaaacttgatattgtattaagtaataatgataatggtaccgaagagatactccaagcagtggcaaaaacccttccggatactgaactctggaggaaaatatttaatatacaagtgacttacacaaatgaaatggctttttatgagatagttttgcctacttttctggaatttcagcgaagtttggggattaatgacgttattaactgtttcgctgagtgtttagcagtaagaaaaaacctgctggaaaatagtgatattattgatgatgatgccgttattgttcttgagaatctaatacctaaaggttataacaatatcgataggttcaaaggattcgatttgaatactacaaaaattattctgaaagacattgcccatttacatgccgttgctttatctctgaaattaaaagatcctaaaacatttgacgaaaaagttaaaaagtactgccatgtgtatgaagttccaaaggagcataatacgaataatggatttttgaaagcactgatagcggaaaatgaagagtgtcgtcagtatgtatcaagaattcatggttggggagaaatcgctaagtctccacccagagaaccatttgcgactgtagtacacgaagatttgtggacgaatatactatgcagaagtttgaaaatggacagcccattggaaacaactagttgacttacaaatttatgagtatggatctccagcagctgacgtgtttttctttatttctctagtatccccttagaagtactaaacgacactttagacgatctacttcattttttatcacgaaagccctaccaagttttacttaaaaa

SEQ ID NO: 762 - DNA, 1061 bp, Diabrotica virgifera
  misc_feature (794)..(794): n is a, c, g, or t
agagaattggtcgaatactactggcctagaattttcacccactaaaacgaaagcaatgatcttcagtaaaactccaaagaaacaagtaaatccaccgaaactcttcctaaaaaatttaccaataaagtattcagaatcgatcaacttcttgggagtaaaactggatagccgactatcttggcaagaccacatccactctctccgtctgtcagttcaaaacggccttaacttaatgaaaagtatctctcataaacaatggggtgccgatttccaaactcttatgactgtatacaaaaccctaattcgttcaaaactagattatgctgctgttgcctacaactcagccaaaggttcactattgaaagtgctagacacagttcataattcagcaattagaattgcactgggagcacactacacaagctcagttgagtgtatgtatgttgaatcaggcgaaccatcccttcaactcaggagagaataccttagcctcatgtatgccttaagagtatcaactaacccacatgtacctgtttataaaaacacatttacagatagatttccatcgacatttaattgtgggaaaagattggatcctccgttttatcatcgagtgagagcaacgttacagagcttagacacaataattccacacacttacaatacttttaaagtcagccaacacatattaccatggacaattgctctccctgcttgtaatacaaacctatctgcattcaagaaaggtgacacaccagcaaaaatcttcaatcagagattattagagatattanatggttttaatgatcacatccatatttataccgatgcatccagatctgcaaatggagtaggagcggctttcacaacagataactataacagttcctaccagctccctccccaacctccatattctcagctgaactctttgctatcctccagtcattaaagtttgttaacacacatgacctccaatttctcataatcattagcgattccctaagtgcattaacgggccttgaggcgggtataccccaaacatcctatcctcctcttaa

SEQ ID NO: 763 - DNA, 1416 bp, Diabrotica virgifera
aaacagcatccgcgatatatagatcttaagtggtctcagtatacagtgtgtatgtactcttgtatagtctcttgtgcgtagtttcaagtgtatggtattaataatatttggctatggcaactaagtttgtaaccgtggagcagctggtagtagaagcgaaaaaaattttcaaagaacaatttggcgaagaagcagacatagctgtgtttgctccaggtagagtgaacttgatcggtgaacataccgactataacgatggatttgttatgcctatggcacttcctttggtgactgtaatggttggcaaaaaagttgagggatctgtagtaaccgtatatacaactagtaaattttgcgaccaaaaaacatcatttgatctgcctagtccatgtgctccaattagagccataactccagtgggacccaaatgggtaatgtacataaaaggggtgattgtaaactatataggcgatattcctcccgcttttaacgctgtagtacacactaacgtaccaataggcggcggtctttccagtagtgcatccttggaagtcgctacttacgtatttttagaccaattaactggaaccaaagcaataggactcactgataaggctttggcttgtcaaaaagcagagcacgattacgctggtatgccttgtggtattatggatcaatttatatcgtttatgggcaaacaagaccatgccctcttaatagactgcagacatttaacatctcatctgatcccattaacagagcagaatgtagtagtccttatcacaaattccaatgtaaaacacgaactgactggcagtgaatatcctactaggagaaaacaatgcgaggaagcagctcttttacttaaaaaagttagcttaagggatgccaatttggatgatattaaatatttagaatcgataaatacaaacaaagaaatcgttgcgagggcgaggcatgtgataacagaaatcaaaagaacatctgatgcagcggagatgttaaaacagaagaatttcttggtattcggcgaactgatgaatcaaagtcacgtctcgctcagagacgactaccaagtgtcttgcccagaattagacagcctcgtagagctagccctagaggtcgacggagtcataggaagtaggatgacgggaggtggatttggtggatgtactgtcactttggtttactcccatgctgttgacaaagttatagaaaacatccagaagaaatataaaggcaacgctaccttctacgtatgtaaaccaagtgctggtgcctcggtgatatcctgatcatatatactatgttagtttaaataatatgataaaggacaaataaaaaacattccttttttacttaaaaagattttaattgtacaaaatatttttgttacaaataatgaagataatattt

SEQ ID NO: 764 - DNA, 1652 bp, Diabrotica virgifera
  misc_feature (1451)..(1451): n is a, c, g, or t
  misc_feature (1477)..(1477): n is a, c, g, or t
  misc_feature (1496)..(1496): n is a, c, g, or t
  misc_feature (1564)..(1564): n is a, c, g, or t
cccacgcgtccgcacatttgttctttgtaagctttgttcttaaattttgttaaaaaatgtcagaaaatagagaagaaattttagctgattttcaagcttgcactggaattgaagatgttgctgaagctatttatcacctggatgaggccaactgggacttattgcgtgctgtgagtagagtaatgccaccagatactcaaagttttcgtccaccagctgtagagcctgtagatccagatgtcatgatagtagaagatgatgctgatataccaagtgcagcaactgcagacgcagcatcagatatggtagtagtaggcaacagtttgggccattcgtctacagtaacgaaaaaagcaaatacacctgatgacagctttccatccacttctgctggaaaaagtggatcacgaatgttaaaatttaatgtgcagtactgtgatagagttgtcaaagttgaattaccagagtctgcaaccgttaatgatctgaaactaaagttgcacagagaagtgaaagtaaatccttgcagacagcttctttccagttgggctcgattagcacagtatgaagatactccgttttcgaagctcatgttaccaggtgacaattcgcttcatttaacagtaaaaccaagcgatggagctttcacctcagacgaagaaaatgccgtatctgaaaaattaagaggtacttacactctaaacgtaaaatatgagaataagacatttaatttaaaatatcaaggaacaaaaactattttggaagtaaaaggtgacgtttacacgttaacgaatatacatgtgcgtaatcaagtatggagtgggtggcctcctaatatagacgacaatacagtactcgcactcagtggaataaactatcctgaacatgatctatcagtgcgacgaagcacacagagtgttagagagaaaaaaagtatgcccgtggttcaaattgacagtgacgatgacgaatttgaagatgcctccgaaagttttacagttgatgatgagtattttgttgacaatgaaggagcaaatgcaaaaagaacagacccattaaaggatgtagaagatgaaattgtaggctgtataacatttgcagaacagtttacgacaagatacggtcctgtccatcctgccttctatcagggaacattagacgatgctatcaaagaagcatgctcaaaacctgccaaagacgacctaaaccaaagtcatggcattattgggtctactatgcctagcattctcaaatccgcagtagaaattggtaaattctacaatggggagatatcccaaacaatcgagaagttagacgatattgcaaaaaatgctgatgtggataagccatatgatctgtttggcaactatgtagcaagtgaactccatcagctaccaaaaagagcagccatcttgctacagcaggatattcaaaattgtataactcgtgcncagttgaacttattgaacgctgcatncagtccaacagactccttnaatcatcgcttctgcgactgggtctttcaacgacgaagagacatcgtacaacagcgatgactaatatnatggtttcccagttaatgtaaaaagatcccatgaaaaaaatttctctgaaaaaacaaaaaaaaaaaaaaaattttttttgggttgggg

SEQ ID NO: 765 - DNA, 948 bp, Diabrotica virgifera
gcaaaagcgttaaaagcaaagcaaaaattctcgggcgagtggctcaattaatcagatatttcgtatatttttaacgcgctttgcacttttcgttaaaactaaaaataaaatattgatttaatcaataatttaaatccaccaagtgaaatgaaaagatggctagtcgaagtaacgttcagcgctctaagcataactacggaattcttgccaatgtatctactaccgaattggagtctatacgagtaggcatcaaaagaaaaacttttactggaactcaatcatcagcacccattgaaagaggcttgggtgatccaaaatccattattcctctggttcactttggaaaggggagaaggttaatggaattcaactttgtatctatatcttctaaaattacaatgttgtaattgtttagaaagaattttttaatgtaatattttcaattaaatgttgcttttcattcaattggcattttaggaaactattggcaatgttttacctaaatttaaattatttttttactcatttggcaagagtactgctcagaatttgagctgatcattcagaaatttatcgttataaatttacaagaaaattgaaaattcacccgaaaagcagaaattacaactatcaaacaataaagaagatctaatactaaagtattgtttatgttactgtttctttgtttaaatgtctaatgatgttttacagatgatatagtttaggtaaaagcaaactaacaaatcaattattggttaaaaaagcggttggttttagacgttagatggtaacttgattggtctaatatgcataagagagcagagccgaaagtggaactacaaaaataatgtggttctggcagctctgcaagattactttaaaggaaagaaattaaactatttttttctaaatttgataaaagactaatttaccgtattatgatacttt

SEQ ID NO: 766 - DNA, 1190 bp, Diabrotica virgifera
  misc_feature (1167)..(1167): n is a, c, g, or t
  misc_feature (1178)..(1178): n is a, c, g, or t
cccaacacccatcccgtcacgaaatgagattgaaattgtgtgtgaaccgagcgtcgtcgtttaggtactctcggtgaatattaatcacgaaaaaatggccaaattataataaaatagaagcgagtaccgtgtagcagcggaaagttgtggttccctcagctcagtacgcgagtacgcgttgaggagagtgagattagtattagtgtgtgcgacgtgcgtgtttgaaaaaaaccggaggaaatgtcagacaaagatcgagactacatcggttttgctactcttcctgaccaggtccaccgaaaatcagtcaagaagggctttgagttcacgctgatggtagtaggtgaatcggggttggggaaatctacgttgttaaacagcctcttcctagaagacttatatagaaatagaaaaattccagatgtcagtgaaagaatatccaaaactacaagcatcgagaagaaaacaatggagattgaagaaaggggtgttaagttaaggttgaccgtagttgacacacctggtttcggggacgccatcaactgtgaagaaagttggaaaacttgtgtcaattacatcgatgagcaattcaggcaatatttcacagacgaaagtgggctcaataggcggaatatgcaagataacagagtccactgttgtttatactttgtgccaccttggggtcacagtttgagacaaatggaccttgaagtaatgaagagactgcaccgtaaagttaacatagtagtagtaattgccaaagcagataccctcacatcatctgaagttgccaaattaaaagcaaatattcttaacgatattcgagacaacgatattcagatgtatgaatttccagaatgtgatagcgacgaagatgaagaatttaagcaacaagacaaagaactaaaagcaagcgttccatttgctgtggttggcagcaataccactttagaaatagctggaaagaaaatcagaggaaggcaatatccatggggtgttgttgacgtggaaaatccaaaacacagtgattttatcaaactcaggacaatgttgatctcaactcatatgcaagacttaaaggatgttacagaagacgtccattatgaaaatttcagggctgcgtgtatttcccaaatttctcagcatgcacgagaacgagggaactanaaagagactcnactccatatgat

SEQ ID NO: 767 - DNA, 915 bp, Diabrotica virgifera
cgacacacgcctctacagtgaatcgtactaacgcgtattactcctgtcaacgtatagtcgcaaatttttcaagatgtgtaagtttttagtggtagctgtttgttttatggtagctgaaacaaaaacagtcagaagattgagtgaggtgttagaagaagatcttcaaagtgtgcaaaatgctaaagacagatctttggatggttccaaacggtatttagaaccagatgtaagtaaacatagtgctgatcataatatagtcgggagatccctagatgatgatttaattgaacgagttgcaccgtatcctctgtttgaaagaatttcaaaaagagcagctatggaaccagatacagcatacaatacatatccacatcaacgctttagacgaggttctgttgttcgactaaggactctaatattaccagtaaatgaaagattatctaagagatctattccattgagctatgaagaagcagacgaatccggaaaaatagttccaagccacaaccttcttttgagacgagaaagaaatattccaaagcagaggatatatcgcagatttgcacaagatcgttatacgggtggaattgtttttgatccatggatgggtagattgtaaaattgtagtatctttttaagatgagttatgtgatatctaattttgactgaaagccttaagatagtgtaaagagtttaaaaatatattttaatgttatatcattgtagaaacaaagactgttagcaacccctaaaccgcattatgtaccttctaggagtttgcttattaaaatttatttaaccattcattatagcattcacatgtactattcattaataacatattcatattgtattgtatactttttgttttatttattatatttgtataaatttttataataaatatttctaatt

SEQ ID NO: 768 - DNA, 892 bp, Diabrotica virgifera
caaattcctgcttttgcattccactttgtcaggtacaaggtaacctgtatcatttaattggttttagtcaagatggcatcaattttagccatgaccactatcaaaacaaaactaggtaatattttaagcaaagcatttagtagtaaatacttgttattaaccaatcttgggctatctgtctccctatcagctgcaggagatataatagaacagaaatacgaaatcatggcaaaagagatagaagaaatgagcattgaaaggaccaaaaatttatctgtagcagggttaactgtaggttttgtttgtcactattggtacaaacatctagagaagtttttaccaggttacacgtttcggatagtatgtaaaaaagttatattagaccaaattattgcatcgcctgtatgtattgcaacattctttgcgaccatgggttacctggagggtaaaagtaaaacagaatttttagaagaaaccaaagagaaatcagtcaaattgtatgttgcagattggatgatctggcctccagcacagtttgtcaacttttacttattgccttatcagtatagaatcttgtttgacaatgccatatcattaggatttgatgtgtacacctcaagagttaaaaacatgacactctgaaacattcaaaatataatcttgcatttctgtaaaattcctatttatagttaactaagcacctgtgatatttctgaaaacattgtaacttagatatgatacataacatatgtttcgaccaaaaatttatctgtagcagggttaactgtaagttttgtttgtcactattggtacaaacatctagagaagtttttaccaggttacacgtttcggatagtatggtaaaaaattatattaaaccaaaatatttgca

SEQ ID NO: 769 - DNA, 1173 bp, Diabrotica virgifera
tgaaattattaggttaggaagtcagaaaagtagaaaaaaattaaattatataaaattttttgctgtgaacatgactatttatgacataaagactaattaaaaacatgaactatgaactctttattatggcgaaattacattacaaaatcttttacattcgtaagaagtcatcaaagacgtagagtgtccatttggtctcccctggctgaggcatttaactctagacccacttataagtttcagtatcataggaataatggaggtttatttggtgtttccgaattaacaactgctaatggttttaatataatagaagatatgtgtattcgcaaaacagataggcttatagaggaagctgtaaatcctcatagacagaaaaaaatggtagaaatctttgatgaaatgtcagattccctttgccaagttgctgatttggcagaatttattaggttagcccaccctgatgaaagttacaggctggcagcagaaaacgcttgttgtgcagtaagtggagtagtcgaaaaattaaatacaaatattgagttatacaaagcattaaaacaagctgttaaatctgatattgttaaaaacacacctttagataaacatgtaggagaattatttcttatagattttgagcaatgtggtatacatcttccagacaatgagagaaataaagttgtcaacctcactaacaatatatttagcttaggacagcattttgttactaattcttctacacctagggttataaagaaatctgttttgccaaaaaatgtcaggaacattttggatagtgatggtgattctattttagtatctggtttatacactgattctactgatcctcttgctagagaaatggcatatagaatatttttgcatccagatagggaccaagatcaaatattaaatgctttgttagaatccagaaatgaattagctcatatttgtggatttcaaacatatgcccacagagctttaagaggatccatctctgaacaccctgaacatatatcgactgtattaaaaatcctttctgaagatatttatctcttgtctcagggtgattttactttgatggggtatgactcctaacttgaaagtggaacattctgtaactgatggcatggcatgggacatagtttactctcgagggttatggatactatt

SEQ ID NO: 770 - DNA, 2031 bp, Diabrotica virgifera
tgcataacgccaacagtgaaaaagcggaagcaactaagataatagcacagctcaaagcagatctccagaaaaccaaggaagagctcaacggcctgggtgatataccggacagcaaaaacaaacacgaagtcgaaatcctcaatttaagtaacgaattatcttcaacccgtaacgaactgtcgtcgaagatcgaggaattacaacagaacgaacgaaagtacaagacagaattggaaacatcaaacaaaaaataccaattgatacaaaaagagttggaggaacagaaaacgaagaataatgagttgcgcacaaagaactggaaagtgatggaagcgttaaatgcagccgaaaacaagaataaagaaccgagcaaaaagccagatattgacgttaaacaattgtcttcggagatcataagtaaagagcaggattcccagaaacaattcatgcaacggctattccccgacatcgaagccttaaagacgctcaactctagcgactggcaggatcaatgtgctaaactgatcgagaagtacgtcagatctctcaaagaagaccaacaacacagttcgcaacattcttctcctcagaaatcttccgaagtgataaaattgcaggcgcaaattgagcactacaaaaatactatagacgacacggagggcttgttaaacgaactccaaaaacgtgtagagcaagaagaaatgacgtggaggggtcagttagctgcgaaagaagcagaactagagaatttaaaagctagtcatctatcgcagttgcaatcaaaacttgtaaatttagaaaacctcttatcgaaggaagtcgaagagaaaaagaagcttttagaagagtgccaactgcttaaaagtcaaaagacacaacgtagcacgcaagccgactcgacagctacaatagaaaaactgtcagaggaggtgaatcatttacgagaacaacttagattagaacaaactaaaaacggagacgtaggagtttgtattaaagcacaaaattgtaataattcttcaaatggaccttcttttcttgacgtatccaatgtaagaaacgccaacatttgttcaaatatggggtgtcagtttttgtactgtgatggtaacagctgcggcaacaatttataagccaacgaagtatttaaaaaggcggagagaaatcaagaataagttgttaaagattataaacgttgaaaaataacattagatttacactatttacttaacacataattttaacgaaataatttacataatagtatgcgttatcattccttttatgtttttgttgcgtgtgcaataacttattctatgtttatttgtatttttaagtttactttactagtatttcgcggcaatagtttcttagaaatgggttctacaaggtggttggtttccactcgggtaaaatcagttttatttttcaatccggtgctcaaatttatgttttgacaagtgtattttgcttaatcctcaaaatgaaaaaacaatctataaatttgtaaaatggtggaaactggggattaggtcaataactataagacagttgaagaaccatttggatatcttatccaataactccagaacagctgacaaaccatttgactacatttggtatgtcccttcaacctggtaccgtattagatatcttcagtacgtttgaagagctgtagtttttgggtacttctcgtttatcttatttcaacattaacaatctggcataaatcatctccaaagatactttcctactaggctacagctatttgaagatgataatatattattcaataactcaaaaacagttgacaaaccatttgactacatttggtatgtcccttcaacatggtaccgtatcaaatattttgagtacgtttgaagagctgtagtttttgggtacttccttcacattcatcttcttttaacattaacaatttggcataaatcatctccaaaaatgcttccatgttgggctacaccttttgaagatgatgatttttatccaataactccataacagtttgacaaa

SEQ ID NO: 771 - DNA, 892 bp, Diabrotica virgifera
cagaaacaaccgctttgacatgcaacgagctaacttaccaaggctgaaaattcctctttggaatacaactccaggtcaaaagaaacacagtgggtctgtatacagacctctttccgaagacctctcgggtcccaagactcctaaattgagtcgctatgaatttaatacaaccccagtagtgcatactgcttaaagttacttaaaattctgtggttcatagataaataagactattttgtttaatatgtatataatcaaattattgtctcttatgaaataagattagcgataaagtattcggctgactgcagtacggcagataacctagggaccaaatttccattacttctgtgaaccaaaaccatttttaagctttaatcgtcctggggactggagagttcgcattttgtgcactccgccatagataggtactgtcgaaaaatgttttgtgtatttttaaaataagacaatttgaaaattgatttttaccataccctttaaccgtttcctaacaattgcactaggtaaagatccattttcatgtactgaatttagactattgatttaaaatctacttaattttcaaattagaagcatgcactggtataccggtgcaatcgaactaagagctgaatattaatgactctcatagtttgattgcagaactatattgtcatgtcttagttctacgtaatttaactgtctataaatgttattgcgcttatagtatagaaaaatattgttaagccacagattaagcaggtattgtttgccatatgtacctaatatcagcagcattcagctcttcttaatatctgtaaactatctaatttctagttgtaatcaaaatgttttcaataaattttttatcggaaaaagcaacgacaataaa

SEQ ID NO: 772 - DNA, 939 bp, Diabrotica virgifera
attgagtcgctatgaatttaatacaaccccagtagtgcatactgcttaaagttacttaaaattctgtggttcatagataaataagactattttgtttaatatgtatataatcaaattattgtctcttatgaaataagattagcgataaagtattcggctgactgcagtacggcagataacctagggaccaaatttccattacttctgtgaaccaaaaccatttttaagctttaatcgtcctggggactggagagttcgcattttgtgcactccgccatagataggtactgtcgaaaaatgttttgtgtatttttaaaataagacaatttgaaaattgatttttaccataccctttaaccgtttcctaacaattgcactaggtaaagatccattttcatgtactgaatttagactattgatttaaaatctacttaattttcaaattagaagcatgcactggtataccggtgcaatcgaactaagagtcattcatattcagctcagcggggtgatattcttcaaggtgtgaaactttatcaacaagagatctacctgttttatggaatgatcccttgattatttaagtacacatttccaataatggtgtcccgctgagctgaatattaatgactctcatagtttgattgcagaactatattgtcatgtcttagttctacgtaatttaactgtctataaatgttattgcgcttatagtatagaaaaaatattgttaagccacagattaaagcaggtattgtttgccatatgtacctaatatcagcagcattcagctcttcttaatatctgtaaactatctaattttctatactataagcgctatgaattttaataacaaccccagtagtgcatactgcttaaaagttacttaaaattctgtggttcataaataaataaaactattttgttaatatgtatata

SEQ ID NO: 773 - DNA, 2562 bp, Diabrotica virgifera
cagacgaagtgattcagtagtacctttaagtgattaagttttgttagttagggattgtaaattaagatacctacatgaaattggttctaatgcttgtggccgtccaggccgcggcggtattaacgtcaccgccgtcgacaccatccacaccgtcggcgccaccgtcgcttccaaccaattcgaagacttgcattgaccactgcacgtgcagctttggaatgctgaccaataggctgcaggtaaccaaatgcgataggcctctagtacttaacgacgccacttttaagtacattagcaagacctcaacgaacgtcatcacccttgacaatttgatcatcaaccagatccaagttagtgcattcgccgggttcaagaatcttgacgatgtcatcattaccaacacgagaattgcgactatagatgtgaaagccttcgagaatgtgacgcgcctaaagttctccaaatgtgcctttgaagacagtcctgacctcttctctacaaagttggaggaggtgcattttggtgaatgcaaattagaagaaattcccaatctaaatggactgatcaatctaacgtttttaaatttatcgggaaattacattaaaaacattgaagttgaagctttcgctgaactgtttgatctaggagagcttcatctttccgacaataacatccacaaactcccacctactgcgtttattaataaccaagaattaatcacccttaacctcgacaacaacccccttaaacattttaacattaatacatccgacagtttagagatattgtcacttaagaattgccaattagagacatttgacgaagaatcaacaaaaaaattaacttctcttaatgaattaaacctaagtcacaacaatcttacagacatattcagtaaagcattgtcccacatgcaggatctttcagtaattgacctttcttacaataagttgactaaacttcaagataatattttctctggaaacggtaaactcatcaaagttatcttagatggaaacaatttcgacaccttaccatctttctaccgccaaaaccatgaaagtttctctacttacacgttctcttgtaaatcttgtaacttacgaattctttcagccaacgtcttccagaatatggatggtttgattaatctggaactgtcacacaataagttaatgaatgtggataatgtcttcgacaaaattaccagcttgaaacaattagatatttcttataatgaaatttcatacttgtcgccagcagcttttgtacataacggcaatttagaaattttaaacattgctggtaatcctttactggttcttaatccagaagtgtttgccgcaaatcatcttcttagagatattgacgccagaaatgctactctaacaaaattgtggtccaactacaacaaacctgttaaatctttgcataaactgcttctaagtggaaacttcttaggaactctaaccaacgatgatttcaacatcatgcccaaattagaggcaatagaattggaagacaatcctttagtgtttgatgagaagttatgtatgttattatactttttagatcttcaaggcattactcctatcgattatagcaagaatatatataccggagctgataaggcttttagggaagacattgatgattttgtaaccattgaatggaaagatgttcataaaggtaaatgtcctgaacatattactgagtctgctttacctgaactaactcgcatagataacaaaactacgtataaaactattgacaaaattgagaaagaagattatgaggaagacgatgacgacgacgatagcgattctgatgaatacgacgatgaatactacgacgaagaaacgactactaagttccaagacacatctcttgctagagccacttacatcttgtcagtaacttcagtatttgtattaagtgctttagtagtactgaccatagctgttaccttaactctatgcattctgcgcagaaacaaccgctttgacatgcaacgagctaacttaccaaggctgaaaattcctctttggaatacaactccaggtcaaaagaaacacagtgggtctgtatacagacctctttccgaagacctctcgggtcccaagactcctaaattgagtcgctatgaatttaatacaaccccagtagtgcatactgcttaaagttacttaaaattctgtggttcatagataaataagactattttgtttaatatgtatataatcaaattattgtctcttatgaaataagattagcgataaagtattcggctgactgcagtacggcagataacctagggaccaaatttccattacttctgtgaaccaaaaccatttttaagctttaatcgtcctgtggactggagagttcgcattttgtgcactccgccatagttaggtactgtcgaaaaatgttttgtgtatttttaaaataagacaatttgaaaattgatttttaccataccctttaaccgttaaactggcatgcttttttaaaaaatccatttttttgtactgagtttaagttttttaaacaccagaagac

SEQ ID NO: 774 - DNA, 1095 bp, Diabrotica virgifera
ttttaatttttagtaaataaattaatattcaaacaaacgacaatcgatcgaaaagccctatcgagtagtgaccgcatcatttaagccgtgagacaccgtatatcagtggtggcttcgctacatattaaaattgttttgttgatctttccttcctcgatttccttctttgctttctttagcgtgcatactaaacaagttatttatgtacagcagcttttgtagccaatggttactcttgtttgttttctagattttttctcatcaggacttctgattgctttttggtttgttactttctaccttctacaattcagagacagagtttggggcttattattcgtccaagtgttggaatgcttgtgggttttgatatatatgtaccaactacctactaggtttgggttgaaaggctaaggatttggttgtgataaatattgtgggataattgattgcatttgtgtggataaacctggcatatgttgattttgatcttggtagtccatcttgagctgtgccattagcactaggaaataactttgttgatatgacatatatcatttacttgatatccagtttaaaaatacagcacaccatttttaaatccctttttaacatcactgcactagtagtaggattgtttctggtttgttagtcgaaataaaacacttgttttatttttatttattttggccactcataatattaataaaactaattatattaattatcagtgtaataataattgtaaatcttcaaatatacaataaggtttaactaaaaacgcactaaaataatttacattttaaacttattcacagccgaatgttgctaactgcaccaatagctattaaaaaatctgaaattcaaatctgatatatttggatcatttcttcttatatctgcaataagaaattgaccatctgcataatataatacagcaaaaagtaatggctgtcagttcctttataattttctatagtatcccttctgagaggttgaaagttcaccatgtttccatccatagcttctagacaatgtgaaaactgccatttgctattaaattaatgctaatttagaaaattatatgcaattgtc

SEQ ID NO: 775 - DNA, 1178 bp, Diabrotica virgifera
  misc_feature (1090)..(1090): n is a, c, g, or t
gcaatattgctacatcgagattcttaatgaatggggctatatataacatactaaaaaaatcaataaaatcggacaacaggtttgggagagtcgagacatcaaaaatgaccaatttttgaggtgtcccgatttttttttggccaggagtgtattataacatagctccctgtgcgtgacaagcttaagtcttttaattcctccttactaccctcactgccactttatacttctatgccgagatgccacttctaaaccttcgatggggataatatggtgtttgtgtgggtgggaaatggtgtaaagattcttcacagctggaagcagccttggtggaagaaatggccgttgttttattgcgattaaggagaggtatccttgttaaagatacccgtttaccgtcatctcttttgttaagaaaatctggacgttttcctgatcaacgacttctcagataattcttggtatataaaaagcatgacaagagacgtactggaaatgagagtgttaaaagaaatattaaccaactgtcaacaggcatcatgttgcacgcatctagcacatcacgtattagtaaaaaatgaatgatcagtgccaacaaaaatctctaaatctccttgtgtgtgattatctactgtatcagataggggtatcattaaaataattcgaatatccaattttcttcctaaggtatacaaaagattaacagcatttaaaagatttcgaataaataaataaataatatacctaactaataaataattaaataataatatttattataccgctagtggggctttgggtttataattaacgggcctgcggtatataaataaatatataaccttaattttttcaatttattatttaataatgattttctggttagaataataaaaatgacgcggttgtgatgtggttgcggcagttttggtttgtgacgatatttgaaattgtaaaagtaaattttctacaacttttctacttagaatttggtgtttctctttctctcgcacaacatatttctcttttggttcggaagtagtagtctaaaaaaaatgtatatataaggttttgcagctaaataatattnttttgtaagtagataatggtacttaaaataaaataaaagtatacaagataaaaataaaacgggtatttttattttttctaaaatgatt

SEQ ID NO: 776 - DNA, 1161 bp, Diabrotica virgifera
agtactcttgtatctaaaaagaaatctcctcgcaccagatgtgaatatagtgaaagtagtgagttcaagaatcaacgacacggtatagtccagtcgacatgtgaatttggtagtagaaaggggtgaaagtaaattgcgcgtgcgtaaaccaaatccgtccgaaaattgttgggctatcaacaattgcaccgcgacccccatgcgtcccaaatagtttaaacaattcgcgggtattatcacatccagtgtattattttctatcggcgacaatggagaaggaaacaccaacaaatttctgccttcttaataaaattgccttagtatgtgcctttattgtcggaattcaagtaaccaggatggtgtttaaatttttgtacgataatttcttatctactttcctgcagattaacgccgtaaatttatcagaaacaggaaaatgggcagttataactggggccacagacggcatcggcaaagcatttgctgaagtcttagcaaagaaaggattaaatatagtgctaattagtaggactcaatccaagcttgaagatgtcgctaaagaattgggtcaaaagtataaagtggaattcatgattcttgtcgctgatttcacagacaccgatcagatttatagcgacatcgaaaagaaattgactggtctggatattggtgttctaatcaacaacgtcggcatgagctacaatcacccagaatactttttagatgtaaaagaaaaagacaaattctttgtaaaccttatcaactgcaacattttctctgttacaaacatgtgcaagattgtaatgcccggaatggtagaacgaagaagaggagtagttgtcaatatttcttccacggcagctcaaatccccaaccctttgctaactgtatacgctgcgtcaaaagcgtacgtggttaagttctctgaagaccttgcttcggagtacgctaaatttggcattactgtacagtgcttattgccaggttatgtggctaccaatatgtcaaagataaggagttcaacttggatggctccttctcccataggctatgttacagaagccgtaaaaactatcggagttaaagaaaaaacgactggatactttccccataccttattagtgtcattccttaatacctagactgcatatcaccaaacta

SEQ ID NO: 777 - DNA, 850 bp, Diabrotica virgifera
gataagtcataataaaaaaaaaggagtttgtctttggttggattaaaaaacaaatataaatagaaaaatgtcagcagaaaatcgccctgagctgtatgaggaagtcaagctatatcacaatgccagggaaagagagaagtacgataatttagcagatttgtatgctgtaataaacactttgcaacaattagagaaggcatatattcgagattgtgtagtggcaaaggaatatacaggagcttgtagtaaattattagttcagtataaggctgcgtttcgacaagtcaagagtgatgaatttcctacaccagacgcctttgttaagaagtacaggcttgactgtcctgcagctttagaacgtatcaaggaagataggccaatcactatcaaagacgacaaaggcaacactagtcgatgcattgctgatatcgtatcgctattcatcactataatggacaaactgcggttggacattcgttcgatggataacttacatcctgacgtgagggacttagtagatactatgaacagacttagcattctgccatcggatttcgatggaaaggtaaaagtggctgaatggttaaatactttaaatgaaatgcaggcctctgatgaattatccgaagctcaagtgaggcaactgttgtttgatcttgaaagtgcgtatgcgtcctttaataaagtccttcataattctgcctaaatgtacgagatagttgttatgattgttacacgtttatgtaaatattataagcaaaaaaaattgagctagatagttattggcaatgtatgcatttatcaattttaaccctaattggaataataaaataagtatattttaacaccc

SEQ ID NO: 778 - DNA, 1018 bp, Diabrotica virgifera
aatgtaaatcagtatcagtctataatctcgtcaaaatcgttttacctaaccttcaatcctccaaagttgaaaaatatttttatgaagtttttagcagtggatggacatgaagcaccctttaaatttacaacgtgaactaaaaaagtttatttacagcgatctagagcttcataggattcctcttggttatttcaacagggatgtacgtggtgtactaacacattgccttaaagatgctttaaatttaaaagtatcgtcagaaaagaggctattcgagatcaatgttattatagactatcttaacgacgaacttaatttgggacactggtgtaaagtacctctcaaagtaagacattgtttcacaatatgcagttatgtgaaatgcctcattcttctaaatagtggtagaaatagcagaccgaatttattgaaggaatgtctgaatactttggatatgggcctgttactaggagctccattggaagaaaatcccgatcttctaactggttcagcagagtatttaaggaaagaactgcaaatatataatgtggcagaaaataaggctgatattagagaaaatttatcgaaaagaaaaattgatgagcctaatgattttatgaacttaaaaggaaggatagtagagtctgttgaacgtccttccctgcaagaattcattgaacaatatttttttgcccagctgccagtaaaaattaaaggctgtttaaatcattggccagcttcgaagaagtggacagacttaaattatttattagaaatagcaggtgaccgcactgtaccgattgaagtaggttcccagtatactcatgaaaactggtctcaaaaattgatgacactcaaagattttgttaccaagcattatctatcagaagatggaacataggatatttagcccagcataatttatttgagcagatcccggagttgaagatgacatctgtattccggatattgcggtatgagtgtaatgatgctgaccctgatataaacgcttgggtcg

SEQ ID NO: 779 - DNA, 993 bp, Diabrotica virgifera
  misc_feature (922)..(922): n is a, c, g, or t
  misc_feature (949)..(949): n is a, c, g, or t
  misc_feature (958)..(959): n is a, c, g, or t
  misc_feature (980)..(980): n is a, c, g, or t
taactgtaagatcaccaagaagtacgccagcgcgaatccgcgagtgtgagtgtgaggtttcttcgccttccgttattaacatcttcattcttcttcagtacaaagagagcacaggttgtgaacgaaagtgtcgcatcattcgctgtaaatattacaattttaagttaccattaatagcagtaaaatgaaaacttccctgataatatttttatgttgcatgatagtgtctgtactatcagcaaaggatatgatgcggaaaagcatcgtttttgacaaaaatacaccagatgtgttctattgtcctattcacaaacccacaggttttgacaaaatgatcgttaaggcaaaaccgttgaaaaaattgtgcgaatttgaaggaaaacctctaccagaagattacaagagtgactgttaccaagatgttgatgaatcagattatgcgtgtaaagaaaaatacaggataatgaaacgactcaaaaaagattcagctgaagactaatatcgggatggagataaaataatcttaggattaggttaaccacagcttaaacactggcttatctcttacatactgtagaatttgaatgctttttaacttataatttattaaaaactactaaataacatgtgtacattatgctttactaacacagtaaagaagttacctagttaaccctattatttatgactatggtattcgcagatttatgtaaaacactttcataaatttttgtttaaaactaaaacaaattttttcttttcttgtactcgtatttcgtcagatttaatacatagacaaagtggcaacactgcaattaaaaaagcattttaaacaaatgaaaggagtatttcaaacagttgctgaatggacaagagaatctggtagtaaacttagatatcgagaaagtacacagtaaaatcncaatcatatcgacgagatacctcttanggaagaagnntaaatattagagaaagtctanaaaacaaatgttt

SEQ ID NO: 780 - DNA, 1343 bp, Diabrotica virgifera
agcgagtgtgagtgtgaggtttcttcgccttccgttattaacatcttcattcttcttcagtacaaagaatgcacaggttgtgaacgaaagtgtcgcatcattcgctgtaaatattacaattttaagttaccattaatagcagtaaaatgaaaacttccctgataatatttttatgttgcatgatagtgtctgtactatcagcaaaggatatgatgcggaaaagcatcgtttttgacaaaaatacaccagatgtgttctattgtcctattcacaaacccacaggttttgacaaaatgatcgttaaggcaaaaccgttgaaaaaattgtgcgaatttgaaggaaaacctctaccagaagattacaagagtgactgttaccaagatgttgatgaatcagattatgcgtgtaaagaaaaatacaggataatgatgaggatgcaccctccaggttcagacgaagcatttgacggcaaaagaatgtcccgttttatgaacgtcgacaaagagtactacatcatgaaaatggataacaaatacagaaacaaggaatggacaacaaatgcagaagcaaggaaagctagagagtcgaggaacagagttaagacacgtctaaggaagaggctcactacgaaatattaaagccactagtaattcagcgcaaaagaaagtacctaacatgcgaaattaattcgaattattataaatttgtaatttttatttaattgtctaaataattaattatattgttgcgatagcctttttctacgccaatggtgttgcaaacgaacagagacttaaacagagttggtacaggtcgacagaaatatccgaatccgtcaaggtcagaccgatcgaaaactttggttaggtacgcgacgttatcagtccaatcaggtttcaaaggtttttcggtttttttttatttgttacatgtttcacactaaaattgattgaaatattagacgtaataaggtcacagtgtatatccattggtgaaattcctgttccaaaaacgtttattaaatgtagaaagataaattgcttgcaaatttctacataattgattggagtatgcgatatataatcggaatatggaacaaattgatgtgttgtcaaaatgaaagcgtagaaaaagaataccgtatcattattaacaatttatttatgttaaatatcgaaaaacttgtttcgtaaattcaaattactaatgtgttcaatcttaccaataactaatagcactgaaaatttgttactaaattttaagactgaaaatgttcattatgcagcaaaaatcaaacactttgtttaaattatttctgattatagtatttatctaaataaaat

SEQ ID NO: 781 - DNA, 975 bp, Diabrotica virgifera
  misc_feature (855)..(855): n is a, c, g, or t
caacaattgggcggttgtggttacatacaccttattaacaaattattgctcttaataccgtttgacaacgatttccggagtggaaatgtcaaaggaggacaatcctgactacagtaagataaacacaggccttattcagttccaatccaagtttcactaatttgataattaagagtaactttatcaaagcagtggtaatcaaaagtgccagtgaagatcagacccgaaaaaatataaatcatggcttgcaacgaggttgttttgaaatttttagaagaacacaatcgtccattttctgcaaatgatatccagagtggtgtaaaaggcgatttcggaaaatctgcggttcaaaaagccttggatttcttagttaagaaagaacaggttagggagaaagcttatggaaagcaaaaggtatattgcattgttcaagaaacgggcgaatcagcatctactctcagagaaaagcttttagaaatggaccgatcaataaacgaaataaacattaaagtgaaaggtgtcgccgaacagtacaaaaccaaatcaaaacttatttcggacgctaaaggaaaaatcagccttagttccgctttgcaccaaaaggcaaatattgaacaacaaacggaagaaattaaaaataaactaaaccaatacagcagtaaggaattggtttgcccacaaaaaaagaatcaagtgttaaaaatatgagaaatacttaaaagagactaaaaagaggcgacgcataggtatggatatgttaaacgccattttggaaactatccaaaaacgaaaaaacatctatttgaagatataggtatcgaaactgatgaggatgttggtttttctttagagagntcccataatattttattttcttttagtccctttaggggttttgatatattgtttaaatgtaactactattatataatacaagatatgttacctacatgctttcttacttcatcacatata

SEQ ID NO: 782 - DNA, 1407 bp, Diabrotica virgifera
ccgtccgggtgcgtccgattgatgactcacctcattttataccgtagcaggtgaaaatacaccattgtagtgaaaattattattagttcgatttataataagttcgattttttacgaaaatgacaagtatcgagactgtggggaccattgtcctgaaattgctgaagttggtgatcaatttgatatgtctcatcttgtaccgaaccggatatcaaggctacttcttgggagtaggaggaacctggaatctaaacgaagaaaaaaatcccgatgcagaaattgtggcttccggcgtattcgtaggatttatgatttacacattcgtctcgctgatcagcctttgcttcgctagtggagatcacaaaacgacattcactgatattctgatgaatatagtagggatttttatgtggatagctgttggagctacagctcttcattattggcttgggtacttgtccgaatacaaatacacgacaatagattctgaacgacaagttggtttggcgttaggagcgatgtgtataataaatggagcggtctatcttgtagacggagtactttccgcaatctttatcctcaaagccaaaatgcaataactttcatcgtaatataaatatatttatttaggttatatactttactttaagcagctcaagtataccgtgacatcccactcatacatcaatgtctataattgtttcatgacaaatcatttaatagtattttaaagcattcattcgttcaacacctttttttacatttttcaagtattatatcaatctttttaaagaattgtttggctattaaccggattcaatccatatagttccgtaaaataattatgcgttttaataattaatgtaattaaaaatagttagtatatttttgaaataaaacaactgccgcaacaaattagggagaatacttttgtctcctgtagttttatctgttatccaaagttcgattaaattgtttcaatttaatgtatttttccatataacgcaccaaatagtcttaaaaaaatagtgcctgttactacctaatactttctacgtatgccttatggttagtagtggctccaataggtgcattttacatttttcatgaaaattcaattcacattattttcctcccgttctcttcatattatatttatttattctttaatatagttttgggcgtgaagcccagtaaatacctatatgaagtatattgatggaactgccatgcttgatgggttttgtctgcaattaaaataaaaccaaaacaaacatttgtacagtattgtaaaattcccaatatttaggtagatgtttaaaatttaatattttttaagagttggcatttatgttaatcgtaattaagtttttataaaaatttagtagtagtgagaaataaataagt

SEQ ID NO: 783 - DNA, 773 bp, Diabrotica virgifera
aggactaagcttacaagaaatacaaattttgctcactagtggtaagattacatataaagagagggttaatctatagttgcttactttcttctataatggttgttccaagactccattttctgcttttatatattttctgtattatgattatcaacatcatcttgacaatactatctttgtatatttatatctctttcttcaaaatttaaatcaaatgttttaaatttgtgtaactgttatttacgattattcatagtaacattgaaaatgaaaataaacgatggagaaatatcgtcttttggcgtgatgtgatagcttgaaatttttggaaatttgaagtgacgtgacaaagccagatgacaggtttcgtgcaggaatgaccaatgatataaaaaacatgataaaatcgttatttttaaaaacaatccatttcttaatgtgaagtgaggggagccacattcaataacttcttctgacttgagatcagatttgattatacacaatatcttctcttttaattaataggtaaactcgtgatctctaccactaattgctaaatactaatatctaagacccaattcaaggagtgtcatagattgtagtcctacgtagattgtccatcgtgatacgagaatgattctattttaagataattatatgttatcagtcttgattttaagaataaggataatgtatatgtaaatatgtacaaatgacttactttgtgagattttttattgagtatactactctgaaatatatgtatataattt

SEQ ID NO: 784 - DNA, 1050 bp, Diabrotica virgifera
atttatttaaattataagccgctaaacgatatagtaaagatagatatcaattaaaattatgtttgattaatgtctacaaaagatccttgcaaaccttacgcttgtagaattcaagcctgtttgaaagaaaatcgctttcaagaaaaaccttgccagacagtcattgaggatatgcgagattgttgcaggaagtggaaagataagagctttgtatgtggtggtattgacatatcaaaaaaacgagaaacagctaataatgaacaatagtcgtatgaataaccgactcagagccaaagaccgtggattgatttatagatatcccagaacgtttgttataaccacaacaaccctttcactcttagtattattctcgaaacccatatacgatagtttcttcagcccagtggagtacgattgggaagaaatcaaaagaaaccacaaatctagatttagtaaaaattaagtatggaatctgtaaaacgagccaaagaacgttatcgacagtatccactcctattagcaaagtgtagaaaagaagctacgagttatgccacatgtgttttgaaaagagacagtgttgctatgaatgattgtaaaaaggagtttgtagattttaaaacttgtttgcaaaaagctgcgaccagtttaaaaactagaatttaattagcagaatggtgtcgttgtggagtacatttgtaaatattcattataaaaaacatttgttaatatctataattcttagaatagtactagtagtttacggcattcatcatgatcagatttcgaaattaaaatacacagatattgactataaaggttttcactgatgcctcgaggcattatttagaaggtaactcgccctataataggcacacttatcgttacagccccgttagtagctatactcttaattccaaatatcacactccatcataactttcggtaaaatctctttttttattatttgatattattcgctctcccctttttaaaaaaaaataattgtttaaaaatatctttacaaatatgtatggactggtccccatcaaa

SEQ ID NO: 785 - DNA, 1119 bp, Diabrotica virgifera
gacagttgtcaattgaagaaaaacaaaacatcccttgcgtccgaaaaaagaaataatggtcgaagaagcaaaaaaatacctccaagatattttgggaagagtcaatggtttgcattgtatattaataacagacagagacggtgtccgaatgttgaaagtttccaatgacaaaacccctgaacaagccaacaaaccaaattttatatcaacttttggcttagccatagatcaaggaagtaagctaggactagggaagaccactacattgatctgcacatattctcagtaccaagtagtccagatgaataagttgcctttaatagtaacattcatagccagtgatagttgcaatacaggacatattttagctttggagaaacaaattgatggtatagtgtctgatttagcgttagctgtgactgaatcctaattaagaaacaaatttattctatatcgtcagcttactgtgaaaaatgcatgtccaaaatacccgattttacaggagagacaaaaaccaactgtgtataacttgacttgaatacaacaaaattcacggttttagtaataaatttagttaatcaccaaatgaagtgtcgatctaacctaggcatattgacctgtttgcaataaaaatattttttattttatgaacagcaaaaaagcagccatacatttgaacagtttggcctcacaagagaaaacttatgcagatatcatatggttgtcaaaattaacggacttattagaagaaaacagagtcatacctacgtagcttttggataatactaacaaatgccatcaaaagtctacaattaggacttacctaaatattttggactcacgcatttttcacagtaagccaactatatgtttgctttgaaaaagttaattttcccaacataaatttaatattatgaactttgtgtaagtttttctatattggattattatttaggggggccgggacttttggggccaaattaaggtatttcttataaaattgctttcctattaaaaaaaaaataaatacaatttttttaatttgaaagcatttaagggggaaaactttttattaattttttatttttgtttcctctttttctgggggccccccttttt

SEQ ID NO: 786 - DNA, 1218 bp, Diabrotica virgifera
ataatctcagctaaaaatgaataaaaagttgtttaaatacgttacagtaggttcgctaagtttcttggctggcatatatacagaaaaatataaattaatatatgacccaaatacgattattgtaaaaaatgttcctggtctcccgatttttggcactgtatcagccgcaactccttttacccctgtgccagtaccagatattgcagaacctcagaagaaattaagtagggtttctgagatcatgaagtatggatttccgagtttggatcaaataagatcctttgaaaactatgtattgagttacgatcgtagaaatagagtggcacactgggttttcgaacatattacgaaggaatctattcaacctaatgatcaagtcgatagatcgaagtgtgagtttaaagttgacgatagtatacacaaattcttcaggtccgaaaatactgattacaaaaagtctggttttgataggggacatttagctgctgctggtaatcataagtgtagtcagaagcaggtagaacaaactttctttttgtctaacatggctccacaagtaggtaagggttttaacagagattcgtggaaccggttggagaagcatgtaagaaaattgaccagggtatatgcaaatgtgtattgctgtacaggaccactatatttgccaaggaaagaaagtgatggaaaaaactatgtaagatttgaagtaataggagcaaaccatgtagcagttcctactcatttctttaaagtcgttgtaggagaaacagcagaaggaaagctggaaatggagacttatgtaatgcccaatcaggttatagatgataatgttcctttgaccagttttcaagttcccccagagagtatagaacgagcagctggcttgttatttttcgataatgtagctagaaacaaaataagtaaaataaatgggaagaaaaactagtttatactaatttagtgtttttagtccattttgacaattggcattggccatttatttgtttttattcaattctaacctaatttattgtaggtcagtacttgatatgatgttcttatcatttagaataatgtcataaaaaaattacaatatcctttagctacttttgtggacaaagttgtgtaatgtacaaattgaacaaaaattgtttgtatatatctttgatgttataaatatttggtgtatatattttatagaatgttattgattgtttt

SEQ ID NO: 787 - DNA, 851 bp, Diabrotica virgifera
ccaaggaagttatttgtttcgtctcattttttaacattaaagaaattttttttggggtttttttttctcatgcattggggaccccctgtaacccttccccccccgtaattttatccagttttagggtcttgtgcctagaaggtgggtcccgttatttttgctccttataattttttcttcttataccttaatgtcgccaagttgtttttttttactttattgggccccagtatcgtacggtaatacttttttttcaaacaccattttaaatccattgtcagatttttgtgttcaccacccatgtttcggcagtcataacttactatgggcgtgattattgttttatatacccggagttttgttttccggtgtacgtctcgcgattttgaatatgtggcccatcgcaaaataggctttatttgccagcacaagccttctatttatttccggttcttcttcattgcttgcaaccagatccattcctaggtacgtgaatctattcacatgttctatatcgtcaataaagtgttgttgcgccggtctatttgatctggtttgtataagtagttttgttttatttgtgtttattgctagccctactgcctatttcttccgctgcattcattgttctgctcattatgtttatatcatccgcgtatgctgctaattgggtagatttgtttgtaagtatgttatttccactcaccgtcaaccgtctaattacatattcaagaacaagattaaaaagcgttggagccagtctgtcgccttgtttcagtccttgcgttatcgtaaacgcatcagtgatctgtccttgaatacatacttgtgcttctgtttccggacgcaga

SEQ ID NO: 788 - DNA, 1374 bp, Diabrotica virgifera
tcttcatttcttgcgaccagatccattcctaggtacgtgaatctatgcacacgttctatatcgtcaataaagtgtttttgcgccggtctggtttgatctgaaatcccctcgtattttttctacccctactgcttctgcactaacgtagggttttttcccgccgccattccttttttcttctccattaagttttatatccatccgggtttgctgcttaaatggggtagatttgtttgtaagtatgttattttccctttccgtcaaccgttttattacattttcaagaacaagaataaaaagcgtgggagccagtccgtcgccttgtttcagtccttgcgttatggtaaacgcatcagtgatctgtccttgaatacatactggtgcttctgtttctgtcattgtcatttgcactagtcgtattaattttgatggtgtgccaaattcttccaatatattaggtagaattgttctatctattgaatcataggcttgtttaaaatccacaaagagattgtaaacatccatgtcatattcccatgctttggctagtatttgtttaactgtaaatagttggtcaatggtagatctattttgcctaaaccctgcttgatattccccgatgattttttccgtcagaggttgaagtcttcgattaaggatgtttgtgaatattttgtatttcatttacaagcttaaaaataaagctcatattaaagttaactcttctgataagaagagaattcagattcaagaaattgatcataccagattaagactatggcctacacaatttaaaagaacaagtacatcagaaatattcttttaactctctctaacttttcaatacatgcttgagtaatgggaaaccagatcacagttgaatttccaagttggggatgacaatttctgcatctgtaaacatgctagaatgtcacaaattttaatagttaaggagtgaatatggctgtgagtgattaagggtccatgactccactcgcctaggcagggaaaagaaggattatggacactgctgaagaaattggcaaaatcatcaacaattgattgtggtccactaaaaacaaaatcattaaacttcatgcaccatggcgtattaaaattatttctgttacaataattaacataattctaaaaagagtttatatcgtaattcagcaattcttcagtatctaatcttataaaactctaatgcaacaagtcactcagtgtgtccggtgcagtttcgatatgtaaaaattgcatgacatttaataaacttcattttattttgttatatattttttacaacagctccagaatgactgaactgaatatagctaatctcgcttttaaaacatttgtagaaatcggacgcaa

SEQ ID NO: 789 - DNA, 1182 bp, Diabrotica virgifera
cctccagggtccgcgcacgcgtgggtagaaatatggtgggacttaaagtttttgttttatttgcgctattagcaacaacctatggatttcatcaaataaaatttagaaatactcgcaatggcttaggtttggatggtgctacagaggctacagatggacaattcccttgggtagtttcacttcaatccagttatgagcgcattaatacacatgtttgtggaggtgtcatcttaactgaaaattgggttcttacatctgccgaatgtgaaggtgctgttaaggtagtggccggtgctgttaaaccgcgtttagccgatcctaataaacagactgttgatgttgaaagatgggtggttcatccagactataactcacaaatagttgggcccaacgatatcgctttagttaaactaaagcaaccattgaaatttaccgatgccgttaaagctgctaatttgcccgagcaaggagctgcagttactggattagctgatgttgttggatacggcaacagcgcaagacctgatttcaacaatttgacctacatatcggacttgccccttataagctacgacgattgcaatcaagctcttgaagatgtattgcaagaaaagagttctttggacgaaaagagcaacatttgcgcaggtgtattggcaaatggagctaataactgcgatggagataccggtagccctcttacccaagataattttgtcattggtatcaccagttggtttatctctccttgtcagggcatgggagcccctaatgtattcaccaatgtagccaactttgttgactggatcaatgaaaacatttcacaatagaattgaataatttttttaaaatatatatttaaattattattttttaatctttccgaaaaaaaaaaatacgaaaaatacgggttctcaaaaaaaccaacaaatataatataaggaaaagaaaaaaccacgaattacaaaaaagaggcccaaaatactcactgaccccacaaacgaaaaacataactggggggggggcccccccctaaaaaaaataccattttttcaacaggcgggggggggggaccccctttatttttttttttttaggtcccccccaaattttttttttgtgggggcggcttttttaaaaccgggcgggggggggggaaaaaaacccggggggcggcccccc

SEQ ID NO: 790 - DNA, 1284 bp, Diabrotica virgifera
gtttcaccaactagagaattgacaattcagatatttgaacaagcaaagaaatttgcccacaattcaattgtcaaagcagtagttgcgtacggcggtgctagcgttagttaccaaagaaatcacgttttggctgggtgtcatattttggtcgcaacaccgggaaggttaaacgactttgtcactagaggacatctctcatttgccagtgttcaatattttgtgttagatgaagctgataggatgttagatatgggtttcttaccaaccgtagaacaaatgttgggacacgccaccatgcctgccactggtgagcgccaaacgcttatgttttccgctactttccccgaagaaatccagcatcttgctggcaaatttttgcttaactacgttttcgtagcagttggcatcgttggtagtgcttccactgatgttgaacaagttttctatcaagttccaggcaaggagaaaataaggaaactaaaaggaatgttgagtgaaaatggtggtgagaggactgttgttttcgttgaacaaaagaggactgctgactttttaggaagtttcttatctgaaaatggaatgaaatccaccagtatccacggtgatcgtctacagcgtgaaagggaacaagctttgtgggatttcaagaaagggatctgtaatgtacttgttgcaacaggtgttgctgcgagaggattggatatagaaggtatagagcatgtcatcaactttgatttgccgaagtcaaaagatgaatatgttcatcgtatcggaagaacagggcgtgtcggaaataagggtaaagctaccagttttttcgactcttccagcgattctgctctggcacctgctctagctgttattctgaagcaagctggacaagaagttccggactggtttggtgacatgagttctcagtcatcgtatcatgacagtaattcgtttggaggaactgatatccgtgggggagaatttggaaaagctcaggtagcagaagaagcagatgaggagtggtaatctatctatatttgtttgcatgttagttatgaagcaacaacacaatgcaaaccagtgatttttatatttttttctatagtttgtatgtcttttataattgatattttccgtttaagagttaagatctaaagttttgtttttaaagagttatgacttagttgtattgatatgttacttgtatctgtgatacaacatttttttgtttgcggaataaaacttcttctaatttttttaaaaaaaaaaaaaaagggcggccggacgcgtggg

SEQ ID NO: 791 - DNA, 955 bp, Diabrotica virgifera
ttatgttgtaagtctacaaaaatattgttatttttcttgttaaaaatattatctatgctttgtagctttaatggctgataataaactggaatcaaaatcaactccgtataaaaagaatccaaaaaagtctttaaaagatcacacacgtcttccgagacccccaaagaaaacagagacaggagaaaacgttttatacgtttcttctaaaaccaatgtcaaggcacaacttgatagatgtaacaagttattaaacaacaagcatgacgaaattattatttattgcatgggagcagcaatacagagggggattttactagctctgcagttgtgcgaagaacatatcacctacaaagtctctactagcactctaactactgaacttttagatgacttagagccatctgtggatgatgccgattatgaaattcagaagagattcaactctgcattaagaattcgagtatataattcacagccaatgttatcctgaaatgttttttaccacagaagaactaatccgctggctgggacttaccgtctttgaactgtggatcaatttgatatcccttctgctgtttactattatctttgccttaaaatatgatcctacatcagacctagatagtatagactggtggttcatctttttccccttgttcgcaggagatgcactgaacgcgtatttcgttattataatttttattcggatgcttctcgagactaccttaaagtttgctcttatacgttttagttggtcaggtacagtgcttcttaatatgtttttgtttaaatacttattgtgcaagagacttttggggcaaactgcgttggattattccgaggtgtttgctccggtatatattcttctacaattaattgctgtgcgagcatgtcagcaaagtaataattgtgatgtatataagctaatatatcgttaataaaatatgtactttat

SEQ ID NO: 792 - DNA, 922 bp, Diabrotica virgifera
  misc_feature (910)..(910): n is a, c, g, or t
cagacgcatgggttctgtaccaattggtatctacagtcagttgcggacgcgtgggcttatgaatgttggacctacaaaagacggcataattgctcctattttccaacaacgtcttaaagatttgggtacttggttgtcaattaacggtgactctatttatagtacaagaccatggacatcacaaaacgattccttgacaaacggagtttggtataccagcaaaggctctgatgtatatgccattagtttgcgatggcctaaagataatatattggatctgggatctgctattgatctgttcaaaaatacaaatacttcagtgcatttgctcggccatgaaagtggtgaagcattaaaggtaattggaaattttttatgtttatattagaaatgctcgaatgtcataaaatcaaaatccaatgcacctccacattcatctccatgcatgtttgagctatcccatttaaagcaaatccctctggctcctattccgtttctgaatccaaactgactatcatctattccttctttcagttttttgagaagatgacttatttattaatgatattgttctgtattcactgcagtgtttagcgtttgtatttttagggatagaaattgctagggatagggaataattgtcaactagtttgctttaaatgtaaaatccaaaatctactctaattgcaatttttcttaacacctcttatctaatctatattttattatgttatagtggactttaggtgcatcctcagtaaccattaatttcccggataaagcacaagtaagcagtgaatgggcatatgtgttgaagattgttcctggagctagtgtagtatacgggcagaacaaaatttagacaataataagattttttagactaatagttataaggtttttgaataanaagatttttagg

SEQ ID NO: 793 - DNA, 861 bp, Diabrotica virgifera
cggacgcgtgggatcgtgcagtctataaacagatattattgttcatacaaaaatgccatcgtacagtagtgttccgtgattttatgtttagtttgaaactgtataatttgcctactatttaaaacaatgattggtgttaatgtagtactagctgttttgtgggtagtagtcaatggtgccgatagttctaactggttatgtgaaaatagtcattgtataaaagaaaatagtcaacccgaacgtgaaggatatgtttcactagaactatgtcgattagtgtgttccaagtacttgaatatttggcctcaacctactggaacagtgcaatctacacaggagaccatttttattaatagcaagagcatagtgttttctttcaatggaccagcaaatacaatcggccatctaaataagttcacacattatttcgaagaacagttaaaaaaggaagaaccattctcctgtgaagataatgcatacaatctcaaagtgtatttaactcctataaacgatgatttaaggttagacttacacactgatgaatcgtacaccataaaaatggattacaaaggtaccgacatctacgcgaatattactgcgccgacagtgtttggaataaggcatggtatggaaacgttactacaattactgatacctataaatgaggatggtacgaaatgtttagttaccgtaaacaatctagtactaactgacaaacccaaatttcatcacaggggcctcctaatcgatactgcaagaaattatttaagcgttaaaactatcaaaaaacagctggaaggcatggctgcttctaaactcaacgtattacactggcacgtgactgattcgcaagctttccat

SEQ ID NO: 794 - DNA, 1007 bp, Diabrotica virgifera
  misc_feature (911)..(912): n is a, c, g, or t
  misc_feature (982)..(983): n is a, c, g, or t
cggaaaattctcctagaaacaattattacatggatttaaaaactatatagcaaagaaaatatatccaaaatacaaacaatgacggactgtgagaaggaagaagcaacaaatttgcaaaaggaattcgaatgggtcttaaatcaagaggttcataaaggtctcgaacaaattcatcaaatacttgtggagtgtgctaggaggtttccagttgctttatatggacacgataattcttcgaaacaggacaaatttgttttgtcagtgcctgctgaccaattaaaatgtgttgtcacactaacaggagacagcattacacatgcagatattaattttaaagttgtaagacagacaaataccacaatggtacgcactaccattcaaagtgaatacccatggaaactgcaacaagtgcaagatgcagcaaatcatttgcaacaggccatatatcatatagatgatgtaggaaagaactacaaatttaaatcttcagacgaagtccttcacgtattaggaaatatattaggtagcttgcagagaggacgaacaagtttaatagtacctagaaagaagacaatatacgatctacttaagagtcgcaatatgaaatcgcttgccccgcctttagcagaagatctagcaataagtttttatatccaaagccacaaattggtatttgttatgtaccatttgatgaacaatcagggcgttatgacgcccgactctactcctgccgagtgttcagtaccttggttaaacgaagtattagtactctttactgttggattgcagctatgccaacaactaaaggataagatctgtgttttttctcagtataaagattttaccgtaggttccagacccgctagtcccgtaccaagttagactcacaaatcgaataatttattgagaannttataaatattataataattattgatattgtcatttctttgttgtggtttgacaaatgtatataatgtanngtggtataaatgtaagtattgttg

SEQ ID NO: 795 - DNA, 918 bp, Diabrotica virgifera
gggaaatggaaattagtggcttttttgctgtactgtctcctagtttttgctctgggctctggcttaatctcttgtttaaacaatttttaatttcaaaaacaaaattgtttcgtcaagtcaacgcagtgttacacgtatttttaaatatgtcacagattgagtttccactccatctagcctcacgattaggaaacctagatgcagtccaacagttgattgaaggaggagcagaaattaatgaagttgattcttctggtttgacggcactacatgtagctacattttcccaacacaaaaaagtagccaaatatttgttggcacacggagctgatttgaacgcaatcgaaacgtatcagcaggaaactcctttaaatatctcaactggtattaatgatcatgaaatggttcgattattgatagaagcgggagcaaatatgcagtgtttagatattagtggaaatatgccaattcatattgcggccaaaaaaggatatctaaatattgtagaatgttttttagaaaatgggataaatgtagatattctaaatgaaatcagcaaaatgacccctcttcatatggctgcctgtgggggttacatcgaagtagtagactatttgcttttaaataacgctaacgtgcatcttaaagattgtcgaagtcgaagttcaattcatcatggtgttttaggagggaaagctaaaattgttaaaatgcttatagaaaaaggagttgatgtaaatgttgaagacatcaattggactcctttacatttagcttgtagacacgggaatttagaaattgtcaagttacttttagaaaacggtgcagtgtatgataaccgacaagggaaatcacgaaactattctccactccttgttgctattgaaatgggtcatctagaaattataaaatatttta

SEQ ID NO: 796 - DNA, 896 bp, Diabrotica virgifera
ctcgcgggccgatacaagcctctacactgacgtcctacctaacgcgtccgcccacgcagaaacgaaaacgaatttttgtcggcatttggactttactattttattttttcatttgtaacggaatatgttcgggttcaggcaattagcaactgtaacaaggactacagcccgaagtgctgtcagagccaagcataccctacctgagcttccatacgaatatgccgctctcgaacctattatttcaagagatattatgagcttacatcattctaaacatcataacacttatgtaaccaatttaaatgctgctgaagaaaaattacaagctgctgcttctaagggagatattagtactgttatttccttggcacctgctttgaagtttaatggaggtggtcatttgaatcattctattttctggcaaaatttatctccttcgaagtcaaatcccagtgcagagttatgcgcagctataaatgaagcttttggaagtcttgacaacatgaaaaagcaactatcagctgtaactactgctattcaaggctctggctggggatggttaggatataatcccaatacaaaaaaagtccaaatagctacatgtgcaaatcaggatccacttcatgcaactactggtttggtcccccttttaggcattgatgtatgggaacatgcttattatttgcaatacaaaaacgtcagagcagattacgtaaatgctatttttgaaattgttaattggaaggatgtgtctgaaaggtacaaaaaggcatctggctgttaatttcttggtactcttggaactcgaaagacttttagttgatctaagcttagtgcgttaaaacacttgttttgttaactcaatttattttaaattttatataatacatagtttt

SEQ ID NO: 797 - DNA, 1415 bp, Diabrotica virgifera
  misc_feature (1322)..(1322): n is a, c, g, or t
  misc_feature (1361)..(1361): n is a, c, g, or t
ccggacgcgtgtggttttgataaaataaaatgtttctaaaatttctatcttttgtcctgctcgttaatgcctcgaatggggcattagtatatcgagatgatattgacacattggttgattatgtgaatgattacattaattatacaaattactatacactgcccaccgacaattctgattctgtaagtgttatagatgagactatttatgagcatggatcttatgacttcgttatcgtcggtggaggcacagcaggatcactcctggccagaagattaagcgaagtttcagactggaaggtactggtactagaagctggttcgaacggcaacgattttactgatattccttttatgaatctgtttacaagaaattctgaatttaattggggctacaaaacagtaccacaaagtaacagttgtttcggaatggtaaacaaacaatgcgtttatcctacaggaaaaggcttaggaggaacttcaatcataggagacagtgtatatgcaaggggaaacagagccgatcttgatgaatgggaatcattaggtttagatggatggggttacgaggaccttcttccatattataagaagactgaaaaaatcgaaatagaagactacgaaaaagactatcatggaactgacggattacttcgagtcaactacacatatcccaatcccttagactatgatgcatacttggaggcaagtcaattgtcaggtctaaagagcctggattataacggaaaaaatcaaataggtatctccaaattccaatggactgttgcttttaacacaaaagttacagcaggaaatgccttcctcacaccaattctagatacacagaccaacttagaagttgtgctgaatgcatttgttaccaatatcaatttttctgacttaaaagctacaggagtacaatttgttaaagatggaaaaaaatacagggctaccgctagtaaggaagtaatcctctcagctggaccaatcaacagtccccaacttcttatgcttagtggagtaggacctaaaaatgaattggaagaattgggaataaaagtggttaaggacttgcctgttggtgttgaattagtagatcatccagtctacgttggattgtatatcaggacaaatctcactgctgatcctggtactgtcaagtctaatttggagggatggacaaaaggtttaggatattacaccactgttttttcagctgataatattgctttcattaataccaaaaacccaggagttgaaccacccaatgctgaaatcctaactattaacaatccaactagtgtaccgccagctactttctancacctgaatgacgactacgccactgtatttctcacattntatacgctgactgatttcttagtgtactgcataaaacttgcaccaaaatccagg

SEQ ID NO: 798 - DNA, 908 bp, Diabrotica virgifera
agtgcatgtgctgttggttgggtatttcagatttcatttcagcaggattcatttgaggcaaaagtgcacaatcgcagatttaatctaatctgacctctcacattttattataacgcccaatataacaacggaagcactacttaaattaatctaattatttaattgtgattagaccaagatgaatggcaatagtaaatcagaagataaaaaggagtcgccaggcagtggctcatataagcctgtaccaaataaggaaatggaggttttaggagatacagttatacgatctaaagctggaagtaagtccaataataaagaaaccgatggagcagatgagagaatgttgcccaaagaagacaccaaagtgtccccaaaatcggaaatatccttaaaggatgtgaaaatcgtaatgggggagaaaaatggtgatgcaaaactcgacattgttgagcctaaggccacttttggtggtatgaccaaagaagaattgatgaagtacgccaacgatccgttttgggtacgtcttcgttggttcctcttcgtcactttttggttactatgggcggctatgttgattggagctattatgatcatctatgctgctcccaagtgtgatcctccaccaccgagaacctggtggcaagtgggacctttggcgacattagatcctgatgctaaacctgaaagtttaaattctcttaacaaagatattaaaggtgttataatcgtatggccagaggactcatataaaccatttgatgaaactcacaacaccatacaactgatcaaaaaaggtaaagaattaggcacgaagattattgtagatttggatccagcagctacagatctttggtatacagagagtgaaaattcgagtgaggccttcagtgattactatatttggcaac

SEQ ID NO: 799 - DNA, 1152 bp, Diabrotica virgifera
cggacgcgtgggtcaaactgatgaagatgctatgcaggctctgaaaggtatggcagctacatttagagtaacatcctcccaaataacgaaaacatcagctgaacgtcgtctgccatccacagacgcggtcttaacgatgttaaaatgggtggaaagacatctaggaagaaggaagccaagtttggacgggggctatgtaagaagaaactctgcacagattcagcacaccatacaaatggaattgcccttagggcagcagtctaacaattcgacaaaagaccattaaaatctagccaaattattgtgatgttatatgtaaatataaaaataggagttaagttttcgttgtgaaagtgttttcttgtattaaaggtacttgttaatataatagcccaatgaatgaccgttttggagtattattttcagggtcaactccgagttgcatcgaagtttggttttgggttctacttgccctccacttcaaagtttatcttgtgccgttggttgcttttacttgggggtgacagtcaacccttcttgggggtgaaaagagcacgtttaaaataggtccgcaaatggataagttgactaattctgggcagctttcattctacggatttttttatttaggtcaatacttttcaagttgttgttgtttatttttcgccagaaaaatcacgttttcaggcggtttttcgcaaataattcaaaaagtaaatattttatcgacaaaaattgtcttagaaaaatgtagcttataaaaaatcgaaaaaaatggagtattaataaattctataaacccagtaaaagttgtagctcatgaaatgtacattgtttttcgtcaaatttcacatcgaatacttgaacgtcaaataaccaaaaaagtttgaccggttcgaagtgcttatttttgaaaaaaaaaaaaatggttttatagttaaaaaaaattatagttttctaaaaattttggaaaatgttgttttttttttatcaaaataacttaaaagtattagtgatacgaaaaatgtaggttttacttttataaatatgctagtttcattccttcttttttttcaaataaaaatttgttaagatatggcctttcaaagtttgcattcactcgcgatctagaacactagttctagatcgcga

SEQ ID NO: 800 - DNA, 911 bp, Diabrotica virgifera
tttaaacctaaccaaccttacattttactgtcattctgagatttattattttaataagcttaaattatttcgatattatgtgggcacgaaagtctttaaataatagggtttatttaaaaagaataattaacacagacgtaagttattttggaaccacacatatcctccatcaacaagtacctgctgtaaaagacacacaagatgagaagtatgaaaagcagttaaaagacttccaaaccataactaatgtgacgaagaaagtacgaacgaaaaaaccacagaagcccccctttgtcaaaaatttccttttaggcaaattcgacactgatcttctcacttttcctgagctgaataaagaagatacaaaactcttagagcaagatgtaagtttagttagaaatttaatgaaacaaaatcatatggtagattctactcaaatgacaaggaaatttcgtcaaaatctttctgattttaaagctctaggactgcaagctgcccagttaatgaatggaagggaatgtaatgttacggaaacttctgtgtttttagaggctttatctgaacataatttgagaaattctatagtcaacaatgaacagtgggggatacagactctaaataggtttggaaatgatcaacaaaaagtaaaatatttaacgaagctaatgaatggtgatatgttatctgcaacatgtatatctgagcctcatgcagtagatttcaattcttttaagacaaaagctcaactatcttcagatgggaagtattggattttaaatggcatgaaatctgctgtggtaaacggactatctgcgaatattctctttgtttatgcagtaacaaaagttttaaagagggatactctagtggaaacatcattaaccgtttttgcaattgataaagatgcgcca

SEQ ID NO: 801 - DNA, 1101 bp, Diabrotica virgifera
gccgccctttttttttttttttggtttaggtgcatttattattgcagcaattttactatctgttttcttaaggccttcaatattaggcttgaaatgatgaatcaaattgtaagtaatagtaaaattctagatctaataaacagtttttcaaacgtatttactagtaagttaggaaactttaatcataaggaaatttcaattaaagttgtggaaaatgctaaaccagttttttgcaagcacagagctgttcctttagcctatgcgaaagaggtagagttagagttagataggttagagaaagagggagtaatagaattaatagacaattcagattggggaacacctttagtctttgttcaaaaatcaaatgggaaaatacgaatatgtggggattacaaaacaacaataaataaacatttagaagatgtgaaatatccacttccaaaaattgatgaattatggaataaactaaaaaaaggtcaacgtttttcaaaaattgatttacaactagcttatatgcagttctccttaaatattgaatcaagtaagttgttagcgtggaacactcacaggggtttgtacgcagttaaaagattaccattcggaataaaatcagcaagtagtatatttcaacgagaaattgaaaatctctttaagggcatgaaaaatgtaacaaactttttagatgatataatagtaacgggggaaacagcagaagaacatatgactaacttgagggaagttcttagcaaacttgaaaaggctgggctgacagtttgtaaagaaaaatgtgtattttttaaagaggaagttgaatacttggggtacaaaatatcaaaagaaggccttaagaaaacagatagtaaaattgctgcaataataaatgcacctaaaccagaaaatataacagaagttagagcttttacagggctagtaaattattaccataaatttatacctcgggctgcccagatcttgaaccaatatacaagcttttaaaaggtaatgtaaagtttttctggtcaaaagaatgtgaaagggcattcaatattataaaagatataatagcatcagataattgtttagtttaatttgaccctg

SEQ ID NO: 802 - DNA, 1865 bp, Diabrotica virgifera
  misc_feature (1796)..(1796): n is a, c, g, or t
cattacgcgtccggtataaggacaaacgtgagcttagtaaatattaatattctatgtctcactctgatggtgtaatcactatggaaatcgtgggatgcagaccttccgattctggaaaatactcctgcgttgctacaaacgaacacggcgtagacgaaacatcttgtgtagttattgtagaaggacaaaccagcacaccagaacaacaagaactagccaacaaattactctattcaggagacaggaagtacattgaacatcctataaagccagctccaattcctgtaactgtgcgaaaaccaataccctcatcaaatcctcaccctctacaaccgaaatctaacaatcctagcacaaatagtttagcgcattcttcatccacactcagtgttggagatggagacaagaggacgcctaggaaatatggtagattagattctactggaagtccaaatagatcaagaagcgcaactaaagaattagcactgcctgatgactcaacaatgtacgccccacaatttaccaaaaatctcacagacttaaccatcaatgatggtgaaagtctaaccttgactgcacacgtaaagggagatccagatcctcaaattgtttggaccaaaaatggaaaagccttgagttcctctgaagttgttgacctcaaatacaagaacggaatagcgaaattacacataaatgaagtataccctgaagatgaaggagaatatgtgtgcagagcaaccaactctgtaggaacctctgagaccaaatgcaaactaaccattaaaccaatggccaatgccaccaacggcaagaaaaaatcctcagaagacaaacccccaagaatagtagaccatttgaaatcagcatttgtagaagacggcaagccagtaaccctatcttgccgcataataggagctaacaaatttgatgtagtctggttacacaacaataaagaaatcaaaccatccaaagatttccaatataccaacgaagcaaacatttacaaattaatcattgcagaaattttccctgaagattctggtgcatacacttgtgaagcattcaacgacgctggagaaagcttcagcagttgtacactaaatgttgttgtttcaggggaacagcccaagagtcccgttttcaaaacattcccgatttccgccacggtatctgaaggtgaatcagcaaccttcgtagctgagaccgaagacgaaccattacagataaactggttgaaagatggaaaagccataaaagaaagcagcgccaaatataactttaccgctgacggaaaacgctacacattacaaatcttgtcttgtaattccaacgatattggacaataccaagctaaagcaattggaaagaagggagaaacattcgcggccttctcactcaacgtagtaccacctagtgaagtctagaaatactttgaccgcgccatcaaaacgctgactaacgaacgacttgctccaaaattgtattgacgtatataaactagtatatgtaaaattatatatttttaattaagtgttttatatgaatctttggttgttaattactccgttttgtacattcattaccatcggcatcctctacttgtaacatctacccttttggtaaagactttacaaatgagtaattaccaacaacttcttgcaacatcaagcgatatattatttcaagcgacaaatctcatgcgacatattttatttcatgttgtttattttcgataggagcagaattattatcgattttttattttactggtatgatatgagaacatttattttatntagtgtgaaagagcttagccattttttcatcaaaacatctttattaattattttagtctcataaaaacg

SEQ ID NO: 803 - DNA, 915 bp, Diabrotica virgifera
  misc_feature (858)..(858): n is a, c, g, or t
  misc_feature (868)..(868): n is a, c, g, or t
  misc_feature (889)..(889): n is a, c, g, or t
ctctacgcgtccgctaaaatattttttgaaaaatattgtttaagtgcgattcataaattaaaaatgagtttagcggaaatatgcggcttgtcagactacggctcacacgagagtaggttgtataaacatgatttacaacaattttgcactaatttcaatagtaacatgaatctagaagtgcccccctttgaaagtcctgccaccaacttatctagatttacaaaagatgatactggaaaggctctaaaaattaattttgatcatggtaccacaaccttgggattcatgtatcagggaggagttgtacttgcagtagattccagagctactggaggccagtttattggttcacaaacaatgaagaaaattgtagaaatcaatgattttctgttaggtactctggctggaggcgcagcagattgtgtctattgggacagagttttggccaagcagtgtagaatgtatgaactcagaaatagagaacggatttcagtagcggctgcttctaaattaatggcaaatatggtttacaattataaaggaatgggattgtcaatgggtatgatgttagctggatgggacaaaaggggaccacaattgtattacgtggactcagaaggtctgagaacagcaggaaaagttttcagtgttggttccggttccatatatgcttttggtgtactagactctgggtacaaatgggatcttacggacgaagaagcatatgatttgggccgtagatcgatttatcacgctacccacagagatgcttactctgggggatttgttagagtttaccatatgaaggaaactggatgggtacatatcgataataacgattgtaatgacttgcactancagtatttgnatgaaaagaaagctttggcgngacagtaattttaagtcatttttgaa

SEQ ID NO: 804 - DNA, 1027 bp, Diabrotica virgifera
  misc_feature (912)..(912): n is a, c, g, or t
atttttgcttttaatctcgtgaatgtaattctttattctttatcaattaagaaataatggttaatgctcaaaggaaattaaaataaataccagaaaataagcttatactataattatctagatttgtgcacctaaaattttttaaagatgtgtcctatatccggcttggttcagtttctgatagttcttgtaacagtgttgctggtatgtcatgcggtaatagtaaagagttgcaaggtcactttcaagcctaattctaccaaaatacacatgtatgattctgttcaagtcgcatacaacgtagataaagatcaaggaggcgagtatattcttttttccgaagatgataatatagcatcacttgacaaagaatatcttatatcgacaatatacgataattggaaaggaagttttaatataactggtaactttttgggtaaaactagagtgtcctgtagaaaaaaaatagaaggaactaaaacgccaaacagcagcatggatgttatagttataagaaaaaagcggtttattgataaaatgtttaccggatctgtggctacattaatcagtattttgtatattaattttggttgtgctttagactggaaagaacttaagacaattcttaagagaccaattggaccagcaataggattattcggccattttgtcataatgcctctgctgagttataccttaggagtattattgtttccaactagccccgaaatgcagttgggtctctttttcacgggtgtatcaccagctggaggtgcgtcaaatgtttgggccgtacttcttgaaggaaacataagtttatcaatcacaatgacagctgctagtaccatagcagctttcgctttcatgccattatggattttccactaggcagagtaattttccagaacgccnaatttgaagtaccatatgtagagataatgacttatgtttgcattagtggtacctttggcgattgggtatttaatacaaagatattttgaaaagggtctcctacttttttataaaa

SEQ ID NO: 805 - DNA, 938 bp, Diabrotica virgifera
  misc_feature (844)..(844): n is a, c, g, or t
  misc_feature (857)..(857): n is a, c, g, or t
  misc_feature (871)..(871): n is a, c, g, or t
  misc_feature (873)..(873): n is a, c, g, or t
agatctcaaataaatcttaaaaatccgctttaattttaagtcatcgttgttttactttattaaaaaatagtgttttagtgatcttgattaatctacaatgggtcgtgtaattcgtgcacaacgtaaaggtgcgggatctgtattcaaatcccacacaaaaaagaggaaaggagcacccaaactacgttatttagatttctcagaaagacatggttacattaagggtgttgtaaaagatatcatacatgaccctggccgtggtgctccattggcagtagtacatttcagagatccctacaagttccaaactaggaaggaattgtttattgcccccgaaggaatgtacactggacaatttttgtactgtggaaagaaagctaaccttcaaattggaaatgtattgcctgtaggaactatgcctgaaggtaccattgtatgcaacttagaagaaaaaactggtgaccgtggtcggctagctcgtgcatctggaaactatgctaccgtaattgcccataatcacgacacaaagaaaaccagagttaagttaccttctggagccaagaaagttattccatcaaacaacagggccatggtgggtatcgttgctggaggtggtcgtattgacaaaccaatcttaaaagcaggtcgtgcttaccacaaatacaaagttaaacgtaactgctggcctaaggtacgtggtgttgctatgaaccctgttgaacatcctcacggaggtggtaaccatcaacacattggtaaagcatccacagttaagagaggaacatctgctggtcgtaaagtcggtcttatcgctgccaggagaactggtaggattaggggaggncaagttgatgccnagaaagaggattangntatacgagttaaaagtttttgtacaatttgtatcagtgtatttcttgtggattatatttatactt

SEQ ID NO: 806 - DNA, 1498 bp, Diabrotica virgifera
  misc_feature (1064)..(1106): n is a, c, g, or t
taataagtagttaaagtgatttattattttttgtagtgaaaatatgtgatgtctagaagttaggttatggttattctaaattgttttacttcattattcccgtccgcgtagattaatctacaatgggtcgtgtaattcgtgcacaacgtaaaggtgcgggatctgtattcaaatcccacacaaaaaaagaggaaaggagcacccaaactacgttatttagatttctcagaaagacatggttacattaagggtgttgtaaaagatatcatacatgaccctggccgtggtgctccattggcagtagtacatttcagagatccctacaagttccaaactaggaaggaattgtttattgcccccgaaggaatgtacactggacaatttttgtactgtggaaagaaagctaaccttcaaattggaaatgtattgcctgtaggaactatgcctgaaggtaccattgtatgcaacttagaagaaaaaactggtgaccgtggtcggctagctcgtgcatctggaaactatgctaccgtaattgcccataatcacgacacaaagaaaaccagagttaagttaccttctggagccaagaaagttattccatcaaacaacagggccatggtgggtatcgttgctggaggtggtcgtattgacaaaccaatcttaaaagcaggtcgtgcttaccacaaatacaaagttaaacgtaactgctggcctaaggtacgtggtgttgctatgaaccctgttgaacatcctcacggaggtggtaaccatcaacacattggtaaagcatccacagttaagagaggaacatctgctggtcgtaaagtcggtcttatcgctgccaggagaactggtaggattaggggaggcaaagttgatgccaagaaagaggattaggttatacgagttaaaagtttttgtacaatttgtatcagtgtatttcttgtggattatatttatacttagatattgttaattcattgggaatatattggtttcacagtttaaaaaaaaaaaaaaaaaggggaacccaaataaaagaattaaaaaaatacttggggaannnnnnnnnnnnnnnnnnnnnnnnnnnnnnnnnnnnnnnnnnncggatacattagaggtgatgacataaaagttttattgtaatattatcattttaaataatttttttgaaatgagatgttattcgtgtttagatatatctaattttttacgaaataaatgaaatttatttattaacaatatatttataattaattattttaatattattaaaacaatatattttaagggatgagattaaaaataaaattttattaagacaacttctcaaaagaaggaatagggttaaaaattttcatattttaaaatgtgatattatacatgaaaatatattattattattatcatattataaactttgtattaaaaaataaatataaattatttaaatttagcacggtagatgatataagaattactaaattgtatctttaga

SEQ ID NO: 807 - DNA, 1573 bp, Diabrotica virgifera
acccccctatacaggaaaaatctagtctagacgagcggccgctcgcgacccacgcgtccggagccgttcacgatgaagagtttcctcagtattagcttcggacttttcctgtttttaggaatagaatcaaagtctttaaatgacaatattgttaaaaagcgagtatttgcggatctctatggaaaacttaacccaacggtaagaggagatcccggagaacccctcattttaacggacttgattgaagcaggaaaactggatgaagctcaagataaagctcgtgttcaaggattggacacggatattgaaagttactctgggtatttgactgttgataaagaacatgattctaatttgttcttctggttctttccttcacaaggcaatgcaagttttgacccggtagttctgtggctccaaggaggaccaggatctacatctatgtttggactttttaaagaaaatggaccggttctattaaaagacggcaagcttgatattagagagacaacttggaataagaacaactcacttatatacattgaccagccagctggaactggatggagttttaccactgatggatatgcttccaatcaaactaaagtagctgctgatttatatgaagccttacatcagtttttcaccctattttatcagtaccaacatcaagacttttacgttacaggagaatcttatgcaggaaaatatgttcctgctataagttataaaattcatcaagcaaatacggaagcagagctgaagattaacctcaagggtttagctattggtaatggtcatactgatcctattgaacagattcattatgctgagtatgcgtatcaaattggagtcattgatttgaatgcaagaaatatactacaaggtacacagcagagagttgtggaacttataaaatcagaagattatgctgaagcgtacgacctttggagtgatatcatacaaactatacaggaattttcagcattaaacatatataactatttaacaattaaagatactgttaatgatgaaacagaaatgaataaatttttaagtacagaagaggtcagaaaggcaattcatgttggaaatgctactttcaatccaccggacgaagtattacgctaatctccaagaagattttcctaaatcagaggcactgcacgtcgctgaacttttgaaatactatagagttttaaatttacagcggacaaacagatctcatgatcccttatgttttgacagagagctatttacagaatcttaaatttcctggatccgatgattatgcaaaagcagaaaggattgtatggcatgacgaaaatgatccagatgtggttgctgggtacgcgaagacagctggaaatttaaccgaaattttggttagaaacgctggtcatctggtaccgacagatcaaccagaatgggcgctacaacttattaataagtttacaagaaacgtaacttttatctaattgacaataattaaataacattaacaaaaatttgcaaaattgtgtgattctataaataaagaatacaacatacaagaaacaaacaaaaaaaccca

SEQ ID NO: 808 - DNA, 851 bp, Diabrotica virgifera
  misc_feature (780)..(780): n is a, c, g, or t
agtatgaaagtttccttaatctttaatatactctaattaaatagataaatgattttatgatgagtgctgcgctagttcgaaaaagtttacaaattgtagacccacaatatggtagtaaaattggtaaaagaaaaagcaaatctgatgtctttgcactagctcaccagagccaaaaacttataggtaaagcacaaaggaaaggaaaaacagaaaaagtcaatcttctatcgacagaaaagaaactgacagtaacagaagcaagaaaatataataaatcaaaggaacagatccttaaagacaatctaaagaaactagaattgattaaaagagctagcaaagtagaattggacgaaaaactagtaaaacagattattaatcgagatgtatctagaagaccaattaagaaaatcaaacccaaacaacaaaagaaaacggcatttacagaagaagatttcaagaagtttgaagaggaatattttgatgaataatggcactctcagacagtgcgtggggatatattcaacttacattaggttcagcaatgttgctctgtatgttttttcagttaattatatggccaatactaccagttgatcacaatcctctggacgagtatatacctacgacagtaatactttcaatttgtgggattttcggtttactttttattggttctttatcaatatttacacttatagtaatgcacaaatctgttacaaaataaactaaaaatatcttaataaggtcctcttcctataccagctccccaccatggcctanaaaataattcaatagattagacatattaattttataatacattttaagtacaatatattttttatttatca

SEQ ID NO: 809 - DNA, 922 bp, Diabrotica virgifera
  misc_feature (826)..(826): n is a, c, g, or t
gccgccctttttttttttttgtgtttgtcagtggctgtttgtaggttaaaaagtgcggcgtgttaatcgtaatggtgctctagtgttattgatcgttaagtttttgtagcacagaaaaaatgtcatttaacagagacgaacatcagcacctcagatacaatccactcaaatcagaatggatcttagtatctccacatagagctcttcgaccttggagtggccaagttgagactccgcaagtagaagtagttccacaatttgatcccactaatccactatgtcctggtgttactagagcttctggattagtgactcccaaatacacctctacatatgtatttaccaatgattttccagctttactggaagaaggtccagaaccggagcccagtgatgatcccctgtttcaaactaaggcggctaaagggacttgtagggtgatctgctatcatccacattccaatgtatatcttacaaatttgaagttggatgaagtagtcgcggtaataaatgaatggattaaccaacttaatgacttgggtaaaacgtataaatgggtacaaatttttgaaaatcggggtgcgatgatgggctgttccaatccccatccccactgtcaaatatgggcatccacttttcttccaaatgaagccagagttaaggatgaaaacttacgcgaatattttgcaaaatataatagaccaatgctagctgattatgtccaaaaagaaatacagaagaaagaaagagttgtatacgaaaatgatgaatgggtagtggtcgtaccttattgggctctatggccatttgagacaatggttcttcncaaacgaaatatagctaggttttcagaggtagatactaagcagaaagaggcacttgcattaactttacagtctatagttgctaagtatgacaattt

SEQ ID NO: 810 - DNA, 958 bp, Diabrotica virgifera
  misc_feature (802)..(802): n is a, c, g, or t
  misc_feature (826)..(826): n is a, c, g, or t
  misc_feature (830)..(830): n is a, c, g, or t
  misc_feature (834)..(834): n is a, c, g, or t
  misc_feature (864)..(864): n is a, c, g, or t
  misc_feature (915)..(916): n is a, c, g, or t
gtgccatgcacttaagtgcattaacatccatgtaaaattacaaccttttatcaaatagaaatgtgaaataaagttttttattttcaatttttttttactaatagcagtcgatcgctggacgcttgcagtttacgtggtagatcccatgcagtgtaagtctgagcacaaatggtataaaccaataaacttaaaatttaccacgcgatcaacagctcgatcgtggcagaacaaactattttgttccggcatcgacatcgctgtaaaccgcgatgataggtcgcgagaatgaataggtaaaccgtgaaccgtccttggtatatgcgatctcataagaaaatgaacgtttgttttgacatcgatgaaaccaccatgaccgcgacctcaaccgcgcacatcaatgtatcttggtttaccaagatatccacgtacgcgtacccttagttttaggaggctgtatgtggtattgtcgacttaaacccattaaagaatttaaagaaggtacaatcgaatttaaaaagtcagaacagaaaataaaagatgaaatagaaaatacaaagcaatgtctgaatgaggtggaaaatagtaactggattaaacattaatatagatgaagaggaaataaaagaagatatgacaacctttataagaatatacctaaactaggaagtagtagaaggagaagaatgaagataggaaaagaaagaatgcaaaaaaaaaaaaaaagggcggccgctcgcgatctagaacgaaatataagtcgaaaaacggtgactatttgtgacaacaaataaggaatatgtantataaaggcaaactggcaaacccntggnatantaaatcaaataaagaaaagcataaattggntatataggcacataagtaaggaaaaaatgagcatatcatttggaatattgnnagatagaacataaagagaaatggtaaaaaaaacttttagatg

SEQ ID NO: 811 - DNA, 1325 bp, Diabrotica virgifera
cccacgcgtccgcggacgcgtgggttggattattggatgtccaaaagtttgtaaaagatgtgggcagatacccttttaatagtatttatttctatatgcacggcattcttaggtgaaggtttaacatgggtgatggtataccgcaccgaaaaatatcaaaaattaaagactgaagttgaaaagcaaagtaaaaagttagaaaaacgaaaagaaattcatggagattcgttagataaacaacataagaagaaaatagaacgtgaagaagaaaggcttaaaaacaataacagagacttgtcttttgtcaaaatgaaatcaatgtttgcaataggttttgcatttacagctttattgagcatgttcaatagcatattcgatggaagagtggttgccagattacctttccaacccctgacttggatccaaggattgagtcacaggaaccttcctggagaagattactacgattgctcatttatcttcctttacattttatgtacaatgtccatcagacagaatattcaaaagttgcttggatttgcaccttccagagcagcttccaaacaaggaaacagcctatttgggcctactccaggacaatttaaataggatatgtggtaattgtttactgtctccactactgaggaaaaatgcatattttttaccacaatgctggatttggtttagatttctttttattagtaatggggttctcaaataccaaaaatcaactaatatttggttccttaaagttcttgagatgtctcttaaagaaagaacttaaaggaaagtatttgaatcctagctgatgattggtattttagaaacatgttggctgcgttacgagacaaatagacttcatattacagtaacagcaagcagagaacaggctccataattggagatttgtatctgcgaaaattatggtattataaggagtttgaatttctgtacaatcagactcgctacttgatcaacaccaatgagtcatgagtaaaatcgtcgttgttaaaaccggagtcatgagtaaaatcgtcgttgttaaaaccgcagcattatagtgcgtatgttaatcacccactttagcacttactagagaaagtatcctaataatacatgttagccatttagcagaatactcatacacacataaaaagtatcattttatcttagttagaacggaaagtaaacaattacaacataaaatgttgactcatttgttaaattctgaaatttgtttattatttattagctttatctttagtataataacatatccaatacagtaatgtaattgaaagacattcaataaagacttctgtagt

SEQ ID NO: 812 - DNA, 993 bp, Diabrotica virgifera
ccttaggcgccatggccgccgaacaggagcaattttaccaaatcttaacaacacttttatctacggataacgtgattcgaactcaggctgaggatgcttattccaatttaccagtcgaaacaaaagtaagtcatctgttgggagctatccacaacaccagtttgagccatgaagctcgccagatgtctgccgtgttgctgcgtagggtgttttccaacgatttcatggaattctatccaaaactaccagttgaaagtcaaaatcagttaaaagaacaagttctcttggctgtacaacaagttgagactgaacaattaaggcataaggtatgtgaagtagtagccgaagttgcaagaaatttgatcgatgatgatggaaacaatcagtggccagaatttttacagttccttttccattgtgccaatgaccaaaatccggttctaaaggaggctgctcttcagatgtttacgagtgttcctggtgtgtttggtagccagcaaaataactacttggacttaatcaagcaaatgatattgcaaagcttgcagcctaccgaagaatatgaagtacggtttcaagctgttagggccgtaggtgccttcatgctaatcaatgacaaagaaacgcagattctaaaacacttcgccgatctgttaactccgatgttgcatgttattgcggagagtattcagcaacaagaagacgacactttgttaaaagttttaatcgatttagctgaaaatgttcccaaatttttaaggccacaactgctgcctatttacgagatgtgtatgaagatcttcagtgactctggagcactagacagttggagacagcttgcattggaggttatggttactctagcagaaatggcaccagcaatgggtcgtaagaatgcagctaaatacatggaacaacttattcctctaattttacaatttatgggccgaccttgaagaagaaatctggatggggccgagtcagatgaacttt

SEQ ID NO: 813 - DNA, 1522 bp, Diabrotica virgifera
  misc_feature (1482)..(1482): n is a, c, g, or t
acagaatatggcaaaaagcgtaatttttcttgtgttatgtgtactactagttgcggcagataagacaaaagatgtgacaagagaactagaggcatttaagagcaataaagtatcccccgatgtcgtatcagccattccagacaaactattacaagtcacttacaaggcagataagaaagttgagctgggaaatgaactcacaccgactcaagtacttgaacagccccaattatcgtacgaaggagataataaatctttttatacattaattcttactgatccagacgcacccagcagaagcaatccaaaatctagagaatggaatcattggctagtagtcaacatccctggatccaaaatatctcaaggcgaaaccataagcgactatgttggatcagcgccacccaaaggctcgggactccacagatacgtgtttctactatacaaacaacccgaaaaactgaaatttgatgagcccaaacacagccctaccgacggaaatcgcggaaaattcaacaccgaaaactttgcgaagaaatataaattgggtaaccccatcgctggaaacttcttccaagctcagtgggatgattctgtgccagctagtcacaaaaagcttgggttttagttcaatttgaatatattggtcggttttacaaaattccacaattaaataacggagaagtgtaaaaataaagttaattaggcagcttacgaaattacgaaatacttacctgttaaagtcacaattaataaaaatctatttttttaaatagtcgacaaattagttctattacataaaaatataataaattaattataaacaaacactacttccctatggatcaacactaacgaagtctaatatcttagaaaataatacactactgcactgaacatatatcgatacagataacagaacagataagagaatcgtgctattacacttagaaagctgatgcaggtttgtcaaactaacagtgactagttctctatgttgcctaatcagttattagttataatattttcgatttcttgttatagataacaaattttagtagttccaatgtgacacaaaatctaatcatgggataaaaaagtttatttgaagaaagtgtattattttgttcttcttgatgatggtacaggcccgttattgtaatattttatttaattatagagtaatttccacatactaacatatttctcgaattgggctctgtaccgccattctgtaccataataaatattcaaaattaaaactgcaatcttaaaacacttttccgttccgatgacgcactgatgtagcctcttaacaattgaccaataaatttttaacatattataatataacataattactgtagttgcaattgacgaaactttgtgaaactggccataaatagttttatagatttggctacaaattatgaagtaccttgaagtaaatggcttaatttatattttgttctgattatattncggtgtagtgtaaatgtaggtaaataaatatttttatgat

SEQ ID NO: 814 - DNA, 1025 bp, Diabrotica virgifera
aacaatctctttaagttttcgcgtttcagtacaatcgaacagtgtcataacgggttctaaaacataagtgcatttggttatgttttagtaattgtgcgaccgatgtaggtaagcagtgggtaccttcaaggtacctccatctttaaaacaaagtaattcgccatgttaatccaatttgtaccgctagctttgctaacggcatccctgttcttgctaatagacacaggagaaagctgcaatgaggccgtttgtggtagtgtcgtcagcaaatgtttgctaacgaaatcctgcaactgcgacttgaagaactgtacgtgctgcaaagaatgtattaattgtctaagttatctctacagcgaatgctgttcttgtgttgatatatgccccaaaccaaacgatactgcgacggatttgagccgaaaatcgcacgtagaagaattcgatgaaggagtccctcaactattttccctcttaacagactttccggatacttacaaaagatgggattcgaagtcgtttccaatagacatggaactgaattattacgaacccaagaaggaaatcaaaatatcgatgttaagcgtggagcaagaagtggacccagcaaagcagaacaccataacggtcaattgtacagtcgctttttgggcgcagtgtatgagctggaggaagtgtaagactagttgccagtcgatgggcgcctctagctaccgatggttccacgatggatgttgtgaatgtgtgggtgaatactgtatcaagtacggtatcaacgaaagcagatgctctgaatgtcctcaaagcgaagaaagtaaacaggacagcgatgataacgaagacgactacgattacggcgagcacgatgaagatgacgaagacgatgattttcacaacagtccaaatctctgataatttgtagaatagtttaactttttaagctatatttattttcgtgtttgtagccaacattgtgatttagaatatttaaacctattaaatgcaggtattattctaaatgataatga

SEQ ID NO: 815 - DNA, 955 bp, Diabrotica virgifera
gatcgctcatacgaactagacgtgtttttagtgaaatacattgttattattgtgcctttgttgacattgtcagttgttcaaaagtgattaagatttttcttcgggacgttgaaaaaaattttgccaccacgtcagccaatacagcggatgttataaaacaacatataatggttgccgaattcgtgggccgtggtcaaagtgggtccccagtaaatggtgaaataccacatctcaattcaaatttgccgtcttctcaccaacttgaaatgatggccagcacatctacatcaggagacgagtttcctcccggaagctatggaatgtcctctgtcaaacataaggagttgttctcccaacgcaagcaaagagaatttactccagataataagaaagacgatagttattgggatcgtagaagaagaaataatgaagctgccaagaggtccagggaaaagagacgattcaatgatatggttttggaacagcgcgtcgttgaactgactaaggaaaatgctattttaaaagctcaattggaagctatcaaggaagagtatgggatctgtggcgaaaacgttgtatgtgtagaaaaagttttagcaaacttaccatctagtgaacaagttttaagtttgtccaaaagacagaagctcgctcatcctgcaactcctattttatataatccacagacacctatccctaccccagtaatacatcaacctgttatgggatctcctccaccacaaccaattcctcactcccacagtgtccttcatgctcctccctcttcacatttggaaccagcatacagagaacccgattaccaccatcctcactaccaactagcttaccacacaggtatctcctacgactctaataatgctctgaatctctctcgctcccgctcacgagtacaatcgcctttttgaagtctcaagtaactcaggcgatgaaagcg

SEQ ID NO: 816 - DNA, 1415 bp, Diabrotica virgifera
cgaattatggatagatggcgctgtaatcgtaaaaaacgattgttggaaatggaaaattaaatacaaaatggaaagtccccactaaaatggaaaacttggcttaactttttttggttttagaacctactcttcaacccaataggtccccaaagcgctcgaatgactgcacatttagcatagtttcctcccctactattatacgagtttaaaacaatatttttcctaaataataaagctcaaactttagctactaaaaacaatgtaacattgttgtaacaagggctgttatacatttttacaaagttgatatctctttacactagatctagaacaatatttttaaatagacaatcaaaatgtgggtcaactgctttaatcttatgtcttttagtatgtaaataaatgtatatattgccagttggtggtgtaagttacctttttgtttgtgtttcacaatttaacgacaacatcgtttgataagcttatctttttactttaggtaggttagatagtggcatttttgttaaacaatagaaacaatgttgcaacagataaaactgcttcaattaagttctattgtatgcgataaacaatgcttatataagtttttgatactgtcttataaatacatttattaaacgagccttaagcgagctctacaatctcccgaagttactcgtctaagtactagggaaacttgtccgaaatgcatcgctacatacttgttcaacttcgaggaacacattcgcgcggggagaaactaactttgactcgatcgcaaaaacggacatagaatggaagtagcccgagtcgaagcgaagtcgcatgaagtacctctctacactctcgtgctcgctgaacttcgatcaacttcgcgagtagtatattgggcgctttgattttaagccgaacggacaaagaggggagacgagttgtctatttcttatggtaggaaaggaatacggccatgaaatgtcaacataacgtgtcatatatcctgaaatttaaaaatatcaaggaatatcaatcaaaagaagaaactgtgataaaaaatattgcaaaagggagacgaacaaataaaataaaatgtaatgacttaaatagagaggtaaaacgagaagtaatcactaagaaattaggcctgggaaaaagtgcaaatttatagacaaccaactagcaggatcaattatctaggaggcacaaagggttcagatcaagcccaaaaattgaggaagcagaagaagctttagggaaacaagatccaagaacaagcaaatcttatcggtgagaccaaaaagtcgaaagaaggccaagaaatagaagaaactgtattaaaacgtattgccagaggaagacgggcaaataaacatacagcatagagacttgaagatagaggggaaacaaaaaataataaa

SEQ ID NO: 817 - DNA, 948 bp, Diabrotica virgifera
agagtagcagaatagtgatgtctttcctgtattcatcatgggcattaaactatgtaatattctgcattactatatttttccttctatacaaatacttcactagacaatttgattactggaacaagcgaggggtatatacctcaaaaccggttccgttttttggcaacgtttttgacgttgtaatatttaaacgaaacttgtcagaacatataaaaaagctctacgatgaaactgacgaaccatattttgggatttttgtttttgacaaaccagtcttggtgctaaaatctcctaaattaattaaagacatcttgattaaagatttccacatgttttgtaatagaagtttagcagacggtagccatgataaaacaatctccaacttcgtattttttcaaaaaaacccaaaatggaatctcacgaggaaaaagttaacttctttttttacttcttcgatgtcaaaagcattttttacaaatatagaattaatcaaccagaagtttatcgaacatttagaaaatatttctgaacccgttgatgcaaaagctatagcgggacatttcagcacggaaatgattgcacgttgttttttcgcaactgatccacgctgttttgaaaaagaaccatccaagttccgacactgtgttcacaggatatttcaatttagtgtaagaaacggactgatacaaactttctattttttaaaaccgagtttgataaaattattcaaattaaacttccttgaaacttctgtcatggaatatttccataaaatatttttggaagccatggaatgtaggaaggattatgatggcaaacctgttaatgcggttgatgtagtgaaacaagtgcaaaaaaagcataatggagagtttcctgatcagtatctttacatctcgaataccatgtttttattagtggctggacacgaaacaaactagtctgcat

SEQ ID NO: 818 - DNA, 948 bp, Diabrotica virgifera
cccacgcgtccgatctaaaatgccagctgtgcaggcatatccaaaaggatgaaattgaaaatagaccatgtaaacaaaattattgagtaaattactactagtaaaatagttgtgccattgtttagtacaaagaattttcagataaggtaaaaatggcgagaatacgttggttaacaaggacctctaggatagtagcactatgcagttttgcaaattttataaacagtgcagatagagtgataatgcccatagctattgtacccatgaccgatatttttggctggtctttacatgctcaagggtggattctgtcagcatttgcatttgggtactttactagtcagttattgggaagtttttgggcaactcaggtgggagcaaagaatgtattaatttgcagcgtgctgttatggagtattgcaacattcacaacaccatttctagctggaagtcttgtatctcttattgcttgtaggataatacttggatttgcagaagggttaggattacccacaatattccatctgtttgctcataacataccggtagaagaacgatcgagagccttttcatacctcctggcatctggatctgtcggccaaacagttgcttctatagtttgtccacacttatcgtgggaagcatgtttttactggtttggctccttcggattcctctggctcgttctatggcactgtttctatcacgaagacggctttagcagtgaagaaactttaccgttacatagccaaaaggtgatatcgcacaacatccgctgggcagatttcatattcagcaaaccgttgtgggcgatatacactgctcactttgcaatgaactggtcatcgtacattataatgcagtggttaccgacatatttatctagatacttagggggcatgctcatagttaagtttaaccgcggtacatacattgtgactctatatt

SEQ ID NO: 819 - DNA, 1012 bp, Diabrotica virgifera
cggacgcgtgggttcgcgggttcgtcgaaaaggtcgaaaatgacagattgcgtcagtgccaatccgtgataaatataaaagacgtcaaaaataaaataaaaaaacattaattacggtaattaccatgacgtattatagtttcagatagttaataaaaatatactattaatttgtctcgaatattacattatattttatttagaatatagtaaagttttagaaacaactgcaaaaacttaacctagaaggagagagtggtgtgcacatttttctggatttactcaattattttaacagaatacttaaaattttattaaacatggaaggagatttcatcaaaaacaatttattgataggtatgggaaatcctcttttagacatctcggccgtagtagaaaaagacctactccaaaaatacgaactcaaagaagataatgccattttggcggaagaaaaacataagcctatatatgatgaacttacagccaaataccctgttagttacattgccggaggaagtgttcaaaattctttgagagtagcacaatggttgctagaaaaaccaaatgtagttacgttttttggatgtgtaggacgagataaatattcaaaaatattgtatgaagaagctacttcaagtggtgttaatgttaaataccaatacagtagtgcatcacccacaggtacctgtgctgtgttgataacaggctacaatcgctctctgtgtgcaaacttaggtgctgcaaatgattttacaattgaccatctgtctgatccagaaaataaaaagctgatagaaagtgcacagttttattatgtggtccggatttttcttaacagtaaatccagcagctcaaatggaaatggccaagtatgctgtaagcaaaacccgtccttttgtgatgaacttaagtgcccctttcatttgttccattttttttcaagcatttgctgatgctttactactaaacacctgttggtttggaatggatctgaagccgaaactttatca

SEQ ID NO: 820 - DNA, 1108 bp, Diabrotica virgifera
cattcttacagtttactttagtttggttgcagtttcgttagtgcacagatttttagtgttgaaaatgagagttcttaacgaaactggacccgtaaacatcatcgatccctctgaattactcaggcccgagccaaaattcgccaaaaaacctgttggtcagttcagagactactccatcgacgaaaatgatcctattaaagaacgtgtcaggaaaacatacgagctgatgcacactaatcaaacagttgactttgttaaagaaaaaaattgagaaatggaccaaattcgatcacctgaaatactcaatgaaagaagctctcataaaattaaacgatttggtagacgaaagtgatcccgatgttgacattcctaatatagttcacgcttttcaaacagcagaaagaatcaggaaagattacccagacgatgattggtttcatcttacaggattaattcacgatgccggaaaagttttggccttttttgacgagccccaatggtgtgttgttggagatactttcgtagtcggagctgaatggagcgataatattgtttatagagaaacctcttttaaaaacaatgtagatggtaaaaatccgaaatacaacactaaatatggcatgtacaaacccaactgcggacttgaaaatgtgatgatgtcttggggtcacgacgaatacttatacagagtgttggttcataacaagaccaaacttcctccacaagctttagctatgatcagataccacagtttttacccctggcatacctctggcgactataaacatctaacaactgaaaaggatgaagaaactaaacaatgggtgctcaaatttaaccaatacgatctctacacgaagagtaccgaagtccctgatatagaaaaactctggccttactatgaaaaacttattgataaatatattcctggtacattggaatggtaattaaattgcaaatatagtttttactagaacaaatttacacatgaagataatattatatttttttatttctaaaagattttgttaaacttttttacttcaataatcgttatagtttttctaaatctaaatattaatatttaattaattacatagtatttaat

SEQ ID NO: 821 - DNA, 952 bp, Diabrotica virgifera
gtccttgctggtttcgtttattatgctgtgtcaatatcaacataacctctaaccaatgccaactgccaacatcccaactcccaactgatgccaactattagccaacttgtctaagatgccaacagtattattgaattattaattattattattgttgcaaaataaaaccacagaatataaaactataaataatcaaaaataaaggcttgcttttaccatgggagacactaaaaatgaacttataggacgtatagaaacggaagaattttatgtaaattttttgaatccaaattccgataatatattaaatgagtccattggtattaaagaacaagtaaaaaaattggcagagggtatagaattaataaatcaagaacttcacagacaaatactggaaaaacatgaagatttgttgcaacaagcaaataatgctacaaaattggaaactgtcctaaattccatgaacagtcatgtaaaaacattatttattgatgctgaacgacttaaaactcagataacaataccctataatgaattagaaaaacacacaaaagtgttaggtcgccttcatttagctagccatatcttacgacaagtcaacagattgcaacaattgagtaaaaggttaacaaataccaatgatccagttcagaaagctattcttttgcaggaattagaacaactcgcctctgatccagagttaaaggatatagatagtgttaagaatgaactgaggaatattagagtacaccagcaaaaagttgtacaattggccacaggttctttgaatcaaggagccaaaaacgaaaatattacacaaacaactacagctttacagatcttcataaatattggcacaatagaatcagtagcaaatagttttgtggacaacaatttacatgaatgtcgagaaagtttgaaattagccctctctgtcagttcatttgcctct

SEQ ID NO: 822 - DNA, 861 bp, Diabrotica virgifera
gatagaattacgtaaatattcctaaagccttttaaaactaccaattttacttgtatcttggtaacaattaataacaaagatgctacgcagtgcgctcgttccttgcaaagatgccctcacgaatccaaatatattaaggaatctaaccggtagttttggcgttgtgcagctacaaaaaagaggtcaatctacacaacctgtaccagcccagagaccctactctccattcaaaccagacaagaacaatttaggagaatatgcatttgcccgtttggacgatcttctaaactggggaaggaagggttctatgtggcccctcaccttcggtcttgcatgttgtgctgtggagatgatgcacatggctgctcctagatatgatatggacaggtatggtgtagtattcagagcctctccacgtcaagctgatgtgataattgtagctgggactttgacaaacaaaatggcaccggctttgagaaaagtatatgaccagatgcctgacccaagatgggtcatttctatgggaagctgtgctaatggtggtggatattaccattattcatactcagttgtaaggggttgtgatagaattattcctgtggatatatatgtaccaggatgtccgcctacagctgaagccctcttgtacggaattctacagttacaaaagaaagttaaaagaatgaatactttgcaaatgtggtatagaaaataaatagtttaaatgtaattaggaaattaagatcaatttataagaaaatacttccctgtaaataaccgtttcttgtgaattttaatttgttgtaatttattttacattaaagtattcaaacatgaaaaaaaaaaaaaaagggcggccgc

SEQ ID NO: 823 - DNA, 1088 bp, Diabrotica virgifera
  misc_feature (833)..(833): n is a, c, g, or t
  misc_feature (972)..(972): n is a, c, g, or t
  misc_feature (1060)..(1060): n is a, c, g, or t
ctcattcaaccctccattctaactttcaataaaatctactaatgattatgctactgtagcacggtcaaaatacggcgcaggcccagggaaacgaatcaggatcaaccatataagtgactgcatcgcgaatatcatatttatttaatattctaactgggtaataagccacaatgataagatcttcttcttcttcttaaagtgcctatccgttccggatgttggcgatcagcataaatattctaactttgcttgctgctattctgaatagtccggttgtcgatgtattaaaccactttttcaggttttcaagccaagatattcttcttctccctggtcctctctttccaaataccttgccttgaagaatgagttgcaacaagccttatctctgttcattcctcataacatggccaagatattctagtttgcgctctttgattatgttaataatctcgcattccttgcctattctacgtagaacttcaacattagtcacacgatccatccacgaaattctcaaaatgcgcctgtaacaccacatctcgaatacctcgagttttctcaaagaagcctcggaaagtgtccaggactctactccgtataataacttagaaaatatgatgatagaggtaccaagtggtaaatcgtgacttctgaaaagagactttatcattatgaacgctgatctcgcttttcctatgcgttattttatttcacttgggttttcccactaaaaaaaaaaaaaaaggccaaggtatgtgtagctgtcgaccctgtcaattagttgttggttaaccaaaagctgtgtatttaatatttcgcggttactgacntaccatgtactttgtttttttcttattgagaatcaagtccgtattctctacttatatctgatatgcgcgacattattctttgcaaccatctagactgtctgcaaaactacaagcgtcgtcggatatccttaatgggtgntcagacgcactccattgactatacgcctttcctgtagtctcccagcgcttgctcgagatacattcagagtatatattaacagcaccgngggacaggatgcatcctttcctcactct

SEQ ID NO: 824 - DNA, 1705 bp, Diabrotica virgifera
  misc_feature (836)..(836): n is a, c, g, or t
  misc_feature (1062)..(1062): n is a, c, g, or t
gtttactgcgcaggagtaaacaaggaaaagataagtcgtaagtgatacttaagtagaaaaagattatattttatacttgaataagtaagtgttatagcttacaatcccatgtaaatgataaatatcaataaaacgatttttttttgtttcacattattttcaattctcgattacattcgagtgtgaaaaattatagtaaaataaagtacaacgccgcttgaattatctcgagtgtgcacaatttggcaagtttagcgcactcgattcgaattaagatggtggctaaggcaacgacggaattaagtcgcgattttaaatttacaccagtattagatccctctaaagaataataaaatttcgggtaggccgccatgcaatgttagtcctttaatctacggctgtctaatctaatctagtcctgtaatctaaggctttccttcttcttcttcttaaggtgcctatccgttccggatgttggcgaccagcatggctatcctaactttgcttgctgctattctgaatagtccggttgtcgatgtattaaaccactttctcaggttttgaagccaagatattcttcttctccctggtcctctctttccaaataccttgccttgaagaatgagttgcaacaagccatatctctgttcattcctcataacatggccaagatattctagtttgcgctctttgattatgttaataatctcgcattccttgcctattctacgtagaacctcaatattagtcacacgatccacccacgaaattctcaaaatgcgcctgtaacaccacatctcaaatgcctcgagttttctcaaagaagcctcggaaangtgtcaggcctctactccgtataataacgtagaaatacttggcatctgatgatagagaattttgtagcaggtagtaaatcgtggcttctgaaaagagacttcatcaatatgaacgctgatctcgcttttcctatgcgttgttttatttcacttaagtggtcccattggctgtttatctgggtacccaggaatgtgtcaattgtggttattagttaaccaacagctngtgtctttaatatttcgctcgtactgaatacgcatgtacttggttttttcctattgagatcaagtccgtgttttttacttacatctcatatgagcgacatccttacttggaaaccatctagaatatctgcaaaaactactgcgtcgtcggcatatctaatattgtttagacgcacaccattagctaatacaccttcctgtagttctcccagcggttgctcaaatatatatttagagtatatataaaacaataccggggacagaatgcatcctttcgtcaatcctctacctatggaaactgcctctgtcaattggtcatccactttaatattggcagtttgattttaatataaattatacatctaatgctgcttccttcaagatgattatgagtttcctatgttttacaccatcaaatgcccttttgtagtcgataaaacaaatatacacgtcacagtcaacatccctgcatctctgcaaaagcacttggactgcgaatagagcctctccatgcccaaggcatcacggaatataaacagtgtccacaacatccgttcttcgcattttttgtttattatgccgtgtattactttcaaaaatgtttgaagtcagtggctcattaggctaatagtcttggcatgttt

SEQ ID NO: 825 - DNA, 3132 bp, Diabrotica virgifera
atcagaagcacgtgaacctcctgtctaaaagctggtcgcaggaaaaagtttctgcagtacgtccaccactctctaccatcagtggttctcttgtcagtacccacgtcgctcttggtcgtcgaagatacccaaagcacccacagtacgttgcgaaaaggtggatctcgtttcggtatacttcgtcgcgatttttaagtaaacctgggtttacacttgtcaaaaacggcatttgctcgtgattcgtgtgtgacatttagctggtatcagggaaaattctctaaaagttattcgcctggaagaaaacggtgattctgacgacacacagcctaattaagggctgggagcaggttacatctttatagttttatatcgaggagggtgatcgcggcccatcagagatgaccgcgtccctcggagtaggtggcgacagcggcggtgacaatgccagccatggccatgacggaaccaacaaccacaacgatgtctacacagtctcagtcactggagcctacgacaacaaagctttcaaaggagacgccaacaatggagaaccaaagaaacccccacgagaaatatccgacgaagaggccttccagcaaggcaaattcaaaatgtccaccagggagaaatggaggatcctcaagaacgtttccgctatatcgtgcgccttcatgatccagttcacagctttccaaggaacagcaaatcttcaaagtagtattaatgctaaagacggtctcggtactgtttctctcagtgcaatatacgcggcgcttgtagtttcgtgcattttcgtgcctacgttcgctatcaaaaaactcacagttaagtggactctttgtttctcgttgttgtgttatgctccttatattgccgctcagttttatcctaggttttacactttaattcctgcgggaatactcgttggtattggcgcggcgcctatgtgggcgtcgaaggctacgtacctcactcaagttgcaggagtttacgcgaaacttacagaccaagcagtcgacggcatcatcgtgaggttctttgggttcttcttcttggcctggcagaccgcagaattgtggggaaatcttatatcttcattagttctcagcaacccacatggtagtgccagcaatcacgctaacgcaactcccaactacgatgtctgcggtgcaagtttttgtgttagtaccatcaacaataatggaaatttagagaggccagatgataaagaaatctatgaaatatctataatttatttagcgtgcatattatgtgccgctgttgttattgcattggttgttgatccacttacaaggtatggtgaaaaacagggacgaagagctagtcaggtagaactctcaggaatccaactgttgtcagctacagcctaccaactaaagaaaccctaccaacaactattaatcccgattacagtatggattggtatggaacaagcctttataggagcagacttcacgcaagcgtacgtttcatgtgcgcttggtattccttccgtgggttacgtcatgatttgcttcggctgtgtcaacgctatttgcagtcttctctttggatccattatgaagtacattggtagagcacctatcatgggtctcggacttttggttcacgcaggtttgcaaacttggatgttgatctggaaacctcatcccgatactccttatcagttctttatggctgctggtctttggggagttggagatgctgtatggcaaactcaagtcaatggtttatacggtacgcttttccgtcgtaacaaggaagctgctttctccaactaccgtctttgggagagtgtaggcttcgtcatcgcctacgcctactcaacgcacatctgcgctcgtatgaagctgtacgtacaactgaccatcctcttgtcaggattcttactctatgtcatcgtcgaaattcaccatctgcacaagattcgaagacagaaggagaaggagaggaaagcagctgaagcagctaagaacaaggaaattcttcctccagaaccggaagaaactgacgacgaaaaagacgatattgatgacgagattattgttacgcacttgtaaattaagcattccagttttgcaagaggttggtcagcaatgcgagaaggaaccattccggatatacttattgcctcattttttatacaatgaagaaaacaacaggaaccagccagtaacttatcagtatttgttgaacaagaaaggatctccaccgcggaaccttgaatcgatagttagaaagttgttgtatattgtagaatatcagtatcttgtttagagttcaaagtgtgttgttacaaatcataaaagatgaagcaatgaaaactgttaattgtatgaatgatgattatgaagttagtatattatatccaaaaccagtttcatctcagttttaatttgacttattaatcgttttatgcctttgtgtttagtctttactcatgaacacataagtattgtagccatttttcgaacaatccgtctactttcccattagttaaaagttcctagtcttactacgtttattagatcacagataatagtaatacatcactttagaaacatgcaccacacttctttaacaaccatacatgtctgtcatctgatagtcctttaaaatatttttgaactcaaccatattggtgaagatctacactgctcattgccttataggtagatataatgatattttggaagttaacagggttatttcttaatgcgttgtatgcttaaattccatgttaataatatttacctataaacttaacttcgaaatgagatatagaaacgctaaccagagtgccattttaaacaaaaagttcttgagtaaagaaagtatttgcaccaatatttttttcaaatatctattaatcttccgtagagtatatgagacttctacaaagtattttggagtctcaaccagtaactttatgttgttattcaaatattatttatatatattttatttttctgataattttagaaaatgtgtacagtaaatataaatagatatttgttagattgtacaatatagaaactaagtattcaaattgtaaagtaatcagtattttaaatgcaatactgtagaaataaatttcttttaaattactaa

SEQ ID NO: 826 - DNA, 974 bp, Diabrotica virgifera
agacatacaaacaaattccttaaagtgtgaagtaaacatggtgatcttgtgcattctaagtgtcttcttcctttgtacaactgatgcacttcccagcaaaagaggtttatggagacatgtagaaccttctcagtcgggatacatgatagggggatactacaagaatccgtccccgaaccaggattattatccctcaatgactgcttttgttactaaagatgttgtcgctaccaatacttttgcgggcctccctcaagaacagggatggaactccgattctagagaagaatttacagagagggtaccggcaacccaagatattccaaatagaactccggaaatagcaatagaaaacggtgattctgcagagggttcagctgcaaataacaacaatattaacaaaactaacagaaaaggaagaaaaccatctaggcctcaacaagaagaagaagaggaatctccgtggtgggcctctaaaagtggtggtccatcatttacgtcatttttccccattaacatcagcggcggaggaggaggaaactggaaacggcgttcagcaggttctggtgcccaggatgacaacgatataccatattctccatcatcaggttctgctacagctattgccaattcattctccactggtagaggtggtgtagcaacgtcacatgcgacatcatttggagacccatatttagcagcgatgtttttgagaaacggttataacctcaaaggacatggtcaacaaagaggaggagctacgaattattaatatttattcggaaataaagtccagtttaacgtagaattatttgccaaatacatatttaaagcacaaaaaaatatgaagagaatgtttatcatgttagttgaaagaagacgtaccgccatattactcttgtatactgaagcaatattttttgtaaactattttttactctaccatttctatttattaaatataatatttaaag

SEQ ID NO: 827 - DNA, 961 bp, Diabrotica virgifera
aatttcaatttcagtactaaatttagcatagtggcaagcggacctaagaaccgtgggtgagaataggcctttatttatcaatcggaactcgtcaacagtgaattgttcggaattcggaacttactctaggaagcacatgtttatttttatagtttgattgacggccacctttcccgtttgagcgctctttttgtgaagtggtctcggtatatgatagccaaaatgacggaaggtacagctactattcgaaccagaaagttcatgaccaacagacttttggctagaaaacaaatggttgttgatgttttacatcctggtcaaccatcagttaagaaaactgaaataagggaaaagttagccaaaatttataaagtactcccagatgtagtattcgtctttggctttaggacaaacttcggaggtggtaaatccactggatttgctttaatttatgatacattagatttcgccaaaaaattcgaacctaaacataggttagcaaggcatggtctctatgagaagaaacaacaaacaagaaaacaacgtaaagaacgtaaaaacagaatgaagaaagttaggggcaccaaaaaaagtaaagttggtgcttctgctaaaaagtaatctgttaatggacgcgcatcattgtgtggcacttatctacagtacatttcaagttctatatgtgttattcaacaaacagacgatgtgcaggtttgatttttatgttaaacaagatcatttcaacaaatatatttaagtttctaagtataaaaaaaaaaaaaaaaatgaaaaaaaaaaaaaaaaaaaaaaaaaaaaaaaaaaaaaaaaaaaaaaaaaaaaaaaaaaaaaaaaaaaaaaaaaggaaaaaaaaaaaaaaagggggaaaaaaaaaaaaaggttcgggattaaagaagaaggggggggcgccctaaaaaattaaaaaagggcccccaacgggggg

SEQ ID NO: 828 - DNA, 1630 bp, Diabrotica virgifera
atacgatcggcatgatttcgagcgttttccttgttttattttatcttacaaacccatcattttgcgatgaacgaggtccaagagtaaagagaatagtcggaggaattccagcagaagaaccaccagcagatgatcctactatatttacaaattttgcgggtagatcagcccgagtacaagggattctggattatccgcattatgtctttagaggtatcaaatttgcttatccgcctataggaaaaaatcggttcttgagaccgagggagaaattgttggatggtttaatcaacgctacatattatgcgcctccttgtatacagccacgacctggaacaaatcaagtcattggcagtgaagattgtttagctcttaatgtgtttactcctgaactgccaacaggaacagagggacttccggtagttgtatggatacatggtggtggttttagatatggctcagcctctcaatatggggtgagacacctggtagggaaaagattggtggtcgtcaccattcagtatcgtttaggctctttgggctttataagttctggtactaaacatttgccagggaatgttgcgctatgggacatggcactagctgttcaatgggtcagaaattacataggcttttttggaggtaatccctaccgaattaacgtcatgggtcatggtactggagcaagcagcgtgttgatgattgctttatctaatattgcaaaaggtattccagctggtgtaatagcaatgtctggaacagcagtatccagttgggctgtagacaatactccccaacatacagcttataatatagctagacaaaatggatgccccacagctgatcctttgacgatggtgaagtgtctacagacattaccaccagattctattattcggggagattcccaaatagaattcacacagatcagcaatagaggctttatggctggtttgtcgggaggactcggtagtgctccggttactgagggtcgagacgatggccggtctttaccaggtattattctggaagattctatggatgaaatgcaagcaggaaaaactaagggaataccactcttaactggaatatgcaaggatgaaacaaagagggcggtaaaaggtccattcaaagatgacgttttaaacaaactaaatactatacccaattttttaaacacgcacttgattcagaatttgagaaaactgattcctctaaaaattcaaattaacctaaaagaaattaaagcgaagttcgaggaaaatttccagaagggtttagagagtatcgaaaacattcttggtcaactagttcctcccaatttcagcaactatgtgaagttgaaaactggaaagctccatgaagctttggataaagtagctgatataacaaatgatgctttattcaacgtgccagcctttttgacagctgatacatggagtatccatggagcacctacatatctgtacagcttcgaccactttggtaaaaataaaaaaggacacaccttccttaaaggttctccactagttggtaatgacactcacttcgtagaattaaatgatacgagtggccatggtgacgacttagcttatctcttcgacgcgtatgatgtatgaagaaatccctt

SEQ ID NO: 829 - DNA, 856 bp, Diabrotica virgifera
cccacgcgtccgagaacatccgctctgatacgtgagctgctgctatttgtagacgaactctgggaaaataatggactgaaattaaatatattacataccaccagtaaactaaacatcaggaaactcaacagacaatctccaaagtaacaaaaaaacaagaattcaagaaattataacaaattataccacgtggtcacgtatcagagatcccagggttcgttttacattctacatcatatttccattccacccacaatatggatacttagctggatttttttatggttaaatataccttatataactaatttggatacttaattggatttttttttatggataaataaatggataaacatactttatataactaatagtaggacatcataaaccattaccgacccgtttcaccaaatacatccacagaacctctcaacttcagaccgctccacacagatgttatagtgcccagagatttcccaaatctagtggaccttcctatgaatatacccaggagttgcaaaagataagagtttttttttctttatttcaattcatacctataaatattttggtttttactctacagtaataaatttgtgtaaactgtttatatgcatataacaggtacctatactacactatatacataggtttttgaagtaggattttaaataaagctaggtaatggtaaataataaataaatattcaaataaaataaattaattgataagggaaaggggaattaagacatatataaagattgtcgataggttttaaataatatttctggataagtctttaccaaactcatttttgttagttttatatagcttccagcatctatgtttactt

SEQ ID NO: 830 - DNA, 820 bp, Diabrotica virgifera
  misc_feature (813)..(813): n is a, c, g, or t
acccacgcgtccgcgaaacgaaaatgtcacatacacataacctaacagttgattaaaagaaaagaacattaaaaagtatttgtattgaattttgttgattgttgtaaatagaaccaagtacaggacatagcctttaattcaaaatggcaatgttggtgcctgccataaataaaagttttatgttattaggtcaatgtgtaccatgccttaaacaaggagcatccaaatttaaagtgaagcgcttagagcttgataccaatttaaatatgtttttcccaaaacatgagttcgtgtatgcacacgatcctgaaaagaaatgtaagtctggtgatatagtcatagttgaacttctgccagaaagacttactagattgattacgcacagagtgaaagaagtcttgtacccatatggtgacataacagaccctgttactaacaaaaaagttgttgctggtaaatacagagatcatattgaagacataaacaaggtatatggtgagaagaaatcatcgtttaactataaaaatgctccaagtagaggttggcaagaagataagaaagattttacacatttggaaacatatattaagtaccatgagtcaggagaagatgatcctaaagcggtgtagaaagtgtttttataaaaaaattgtacaattaaactttcgttaatagttcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggaaaaaaaaatnggggggg

SEQ ID NO: 831 - DNA, 702 bp, Diabrotica virgifera
cccccctcgaagcttttttttatttttttgttctctttaccattagctgtaaataaaatattttacacaagatgaaatcagtattcgttattgtattcttcgcttgttttggtattatattatcagcaaaacttccaactccagcaccaagtccaacaccagaaccagatgacttagtctgtggagtttgttttatgattgggaatatcatggaagctttcaagaaagaagatattcctaaggaaacagcaacatcgcaaaagacttttgtttgtgaagtagtgtttgcaactgaagaaacaaggcaactatgcttggactcatatctagaggaggttgattccttttatgacgaagttgacactgacacagtaatggacaaatgcatccaattgaaaaagtgtccagctagtggaagttattaacgctattatttttctaaataaaaatatattgttattctaaataaaaagtgctgatgctaatagaacataaatgcattttataacaaaaaataaaccaatctggaatacataaaaaaaaaaaactattcaactaggggaagcccacgagatctccatgaagaggttcagggattcactccaacatgatgagtgcggcagtcaactgcggactcttcatagcgaggacataagacatttcgttactgtaaacgtcgaaatgagcgtttgctgtcgccga

SEQ ID NO: 832 - DNA, 1264 bp, Diabrotica virgifera
cgaccttcttgtgacctcctctgctactaagcatctactaaggtcccacaatttttaaataatattaaattttaaatcctgaaaaccagatatattaagcatcaaaaatggcttcccgacgatttgtagtaggtggtaactggaaaatgaatggaactaagaagcaaattgaggaaatttgtaattttcttcaagctggacccctagatcccaacactgaagttgtagtcggagtacctgcagtgtatttagaacatgttcgtagcaaactcccagcaaccataggagtagctgctcaaaattgttataaagaagaaaaaggtgcattcactggagaattatcccctcttatgctgaaagacattggtattgactgggttattattggccattcagaaaggagacaaatcttcaaagaaactgatgctttaatcgcagaaaaagtcaagttcgctttagaaaagggactcaaagtcatcgcttgcattggtgagaccttagaacagcgtgaaagtggcaaaactgaagaagtcgtattctcccaaactcaaaccatcgcctgcttggtaaaagactggacaaatgtagtgattgcctatgagcctgtgtgggccattggtacaggcaaaacagcaacaccacaacaagctcaagatgttcacaaagcactcagagaatacattgctaaaaatattggtgaagatgttgcaaagagtgttaggattcaatatggaggatccgttactggaggaaactgcaaggaactggcagctatgcctgatattgatggatttttagttggtggagcctctctaaaacccgagtttgtcagtattgtaaatgcaaggcagtaagtgttgttttctgtgaagtgtagaagtgaacgatcaattcatatttgttatattaaaatagacacttacaaattgtattttattgttaaatatttcgaaagtatgcaagatgaaatgtactggaaaattatgtactcttgaaaggttaatgtgttgatgttcagatgagtattgcgttgaaataaacagtaaatattccttatatgacgaagttgacactgacacagtaatggacaaatgcatccaattgaaaaagtgtccagctagtggaagttattaacgctattatttttctaaataaaaatatattgttattctaaataaaaagtgctgatgctaataaaacataaatgcattttataacaaaaaataaaccaatctgaaacacaaaaaaaaaaaagaaaaactcg

SEQ ID NO: 833 - DNA, 951 bp, Diabrotica virgifera
ggtaatcagtcattttcatagtgataatatcagcggcgaaatgagggaaatagtggtattgttgttgttagttttgtttcagctgtgcttaggaaaaccggtggaaaataacggtgatgagcttgttggagtagctgtgtgttatagacatggagatcgagcacctgtatcgtctttccctaatgatccctatattgacgctaagtattggccagacggcatcggagaattggtgaataaaggaaaagtgcatcaatttcaattgggtcaatggcttcgacgtcgttacaagaacttcctgtctactcggtattaccctatagagctatatgttcgctctacagacgtagatagaaccctcaattctgcagcatccaacttagctgggttgtattatcccgatggaagcccatatcctgttgaatggcctcaagagttaccttggaacccggtacctatccatacagtagaatacaaaaaagatgctgtgctcgctatgaaaaaagaatgtaagaattttgagaagctgtaccaagagaccctagactctgagtactttaagaatgtaatgaagaaccacacagagctcaaagaatttgtcgaaagtaaaactggttggaacgttactttggacctatttcgaaatctttggactgtattgtatatctacaacgaaacaaattcttcctatgttccagattgggccaatgaaatagaccaagcagagcttgctcaattggcaggactttctttcagtaccgaaacgttcacgaccaaactgcaacgctttaaagttggacctttttttgattatcttaacaactattttgaccggattttgaatggtacgaatcctaaatttctgatgctctctgcgcacgatggtactattgcgtccattttgaatacccttcggagattataatacaacccccctcagttttgtcgacg

SEQ ID NO: 834 - DNA, 931 bp, Diabrotica virgifera
  misc_feature (874)..(874): n is a, c, g, or t
gcagaagatgctattgaaagcgcttatttgtttttgtgcattatggtccgtggcctctgcccgacctaaggcccaatattcaaatgatggacaatatgacaacggaaaccaatatgacaatggaaaccaatatgacaatggaaaccagtatgacaacaacaatggattcgctcccagtgctggtggacataatcaagcataccaagactcaagaagtgccgtaataacgagatatgattctgacaatgatggagctggtacatacaactataacatcacccagagtgacggcatctacaacgaacaatacggcacaatagaaaacgaagggaccgaggatgaatcttcaagagtatacggttattacgcataccctggtccaaatggagaattttactatgttgaatatgtagcagacaaagatgggttcaagcctgccggaaagcacatacctcaatctgctggtgttggtagagttggccagctcggcattccttcggcagccattgcctctctcgctggtggcggattgggctaattttaatatagctagatctttatttaagaattataataagagccacttaaaagtatttagatgtcttaatatatttaagtgttcactaacctattttgaaattgctatatgatctatttcttcaaattttgaatttgcagtagctgtatataaagatggtatacccatagagtaggtgatcctcctaaagttttcttcagcttgaattagttaggacttgatcattttttcaatgggtaattgttcaattttttgcgtaactttaattgaacttaaagtgaaagagtatgagtatgtaagaaatgattaaatattagtgtgtttgaattagatagnatcattgataagcatactttatttagactagtcagctagagcttgatatcaaacgat

SEQ ID NO: 835 - DNA, 1377 bp, Diabrotica virgifera
cattaatattacttaaatatttaatacccaaacgagtgatatatatgagaaagtgatcatgtctattttcgaagttttaattattctggcaggttatacaacggtgctatttttagaccaggaagtagatattaataaaaataactgtaatatcattggtggatcaggtactttttctaaattgactcaattgcaacataacctatcacattgtgtagatgaacattctaaaggaattcccataaataaaataaatgtagccaaaattccaatttaccatacttcttgtttgggacgccaggctattagtggttgttatgaaccactaatatctgcttcaaaacaatgtctaaatataacagaatcatatttagtagatatttggcagaatatagataaagaattaatagcgtacacgtgtaaaaacgaagataaagtacaaaaatataccaaggaatatacggcggaatgtatgaacgaagggatattaaaaattcaagaaaaatgcttaggcttgagtagcaatccgatgtctccaatgcgtgaaatgtcacaaattacatgcaaaaaattcgaagacgccgaggattgtattatggaaactctcagcaaccattgctctcagaacatcacagatgttgttgtgtctgtaataaaaattttaaaaaccaacgcatgcagttatgcacctaaacataggagtcgaagaagtttgcatagagttgtaaggcaattggcaatgtctgataagatggacagaattgaggagcatttgaaaactaagtgtatcaaaaatggattggactctaaaaaattggaagacagcgtaacaaagatgaaaagttgtataaaggaaaaacccctttttttaactccaaaacacatttacatcaagcatgttgacggatgtaccaaagaagttattaaaacgttaaaggcttgtttaccagaaaaatataaatatcttcctcaactgatttttgatgtttttgattcgatgataagcttcatgtacgatgattttatccttataagttcggaacttactccttgcctaccaaaacttaaaagtgaggaaagcacaaccgaatacaatgagtgtaatagaaaagtaacagatatcgttgaagatgaacttgttgaaagcaaagaaaaattttgcgagagatatatacatctaaatgagtgttttattgcccaagtgaagaaacagtgcgcaccatcagcggaactaaccaaatttgagaaggattatatgaatgctgttaaaaaaccctgtgaataaattaacacacattttgatgaaatatagtgcatatgttatgatatggtatattattatgatatatacctagtttaaaataaagttgtatctct

SEQ ID NO: 836 - DNA, 1146 bp, Diabrotica virgifera
cccacgcgtccggtgttcttctggtacaactggtttacctaaaggagtcatgtgtacacatgacaatatgacggcttatgtagatatatctcgtgcaattatgggtgatatggttgaaagacatgatccagatcgcgagcggccgccccttattccatttttccattcgtttggatttatgctaatgtttctgaacctgttacggggtaaatgcatggtggttttaggcagatttaagccaaagatattcctagagtccgtagttaaatataaagtagctaggatgattgtaccaccacctgtgctactatttttattaaaaagtcctatgactcaaaattatgacctatcttgcataaaagaaatgcgtagcggagctgctcctatgggtaaagatatggaaaaagaattaaaagaaagatttaatgttaaacatgtttctcaagcgtatggaatgacagaaacaaccttaggagtgcttgtttctccacatggaaaaggcaagattggatcatgtgggaaaatagtaccaggaatgatggctaaagtaatagacgacaatggtgtccctctacctgcttatggagaaggtgaagtgtgctttaaaggtcctttgataatgaaagggtatataggagatccaaaatctactcatagcaccatagataaagatgggtggttgcatacaggtgatgtagcatattatgatagtgatggttatttcttcatagttgataggataaaagaacttattaaatataaagccttccaagttgctcctgcagaattagaggctttattgttaacaaattctgctattcaggatgctgcagttattggtttaccaaatgaagaagctggtgagttacctatggcttttattgtgaagaaggtaggtaaagacataacagaacgggaagttgaaaagttcatagaggataatgtgtcacctcaaaagaggttacggggaggggttatcttcttaaatgaaattccaagaaatccatcaggaaaaattcttagaagagttttgagagagcgagctgtgaaatatacatcaaaactgtaaattgtttcattacgtagtatgtagattttatataccatatatgtgatgaataatgaaggaaataaaaaatggttttt

SEQ ID NO: 837 - DNA, 1397 bp, Diabrotica virgifera
cccacgcgtccgatcgcacttaggcttaagtcgcccataacccttgggtgttataaggaaaaattgatacatcaatattttaatttcacttaaactttgagcttttctatagaatgttgaaaggttcatttctacgtcgttatcaaaatatatcacgagcattatttcaaacaaagtgtattattaccatactcatctactctagtctaaagtgttatccagtagtaaagtattgatttttacagtattattttatacttaaagtgaaaaatggcactggagagtttaaaaaatatagtggttggacctgaattagaaagaataatagatacatcccttggagaattattactattagttctaaaaacttttgaagataatgtgattcaggtagatggagaaaccggagaagaattaccagccaatttgttgttaaaaagaagtattagattgtcaaaatggttaacaagccaaggcattaaagtaggtgataacatttcaataaatagtgaaaatcgattagaattttgtatagttccagttggcactctattatctggagccacatttgctcctcttaatccagattatactccacttgaacttaaacatgtacttagtctctcgaaaccaaaattcatattctgctccaataaaactattgacaaaatggtatctgtgttgcccgagcatccatacattcaaaaattaatattatttggcaatgaagcgtgtaaataccaaaatgttataagatatgccgatattgtaagaggagtagagtccgaagaattagatgacgattttcacagtgttcccttagatccagtagatagtgtggcaactattttgtgttcttctggtacaactggtttacctaaaggtgtcatgtgtacacatgacaatatgacggcttatgtagatatatctcgtgcaattatgggtgatatggttgaaaatgatgatccaagtgatgccatgatggggcttattccatttttccattcgtttggatttatgctaatgtttctgaacccgctacccgggggaaggcggcgggggttggggtttaagggaaccaaataaacccaaaaaaaacttgcgctaaaaaaactgggaaattgaaattgggaccccccccccccggccccattgtttttcccccccaacgagctaaatctttttttttataaaaaaaggcccttaaaaaaaggggaaaggggggcggccccctttgggttgaaataaggaaaaaaaaaaaaaaagaaaaaagaatggaaagtttaaaaaatttgtttggtgttgcgtttggaaagggaaaaaaaacaaacctcacaaaaggtgcttttttttttccccctttgaaaaagagaaaaaaagaaatatatttggggggg

SEQ ID NO: 838 - DNA, 1627 bp, Diabrotica virgifera
ccggagaagggattgagaaaaattccagaatattgtagtttgccccatttttacaacaaatatttgtttattgattacaacacagtgaaagatgtctcagtggaataaggagcaatatcctccacctcctggcggacaaggatactatggcggtcaaccgggatatggtcaaccaggctaccctcctccacaagccggctaccccccacagggcggttacccaccgcaaggcggctatccaccacaaggcggcggctaccctacggctccacagccgggctaccctccagcgggacctcaacctggatttcagccacctcctccgcagtacggagcagattacgcagcagataactatggaactggttacaatggtggtgaagatcccgaggtgaaaggattcgacttcaacgacgcttcgattcgaagaggattcatacgaaaagtttattcgatactctcagtacagctgttaataaccttggccttcatctgttggttcgtctatcacgcgccgactagaaaatacgtccaaactcaccacgctttgttctacatttctttagtgatggttatagtggctttgatcgctttggcttgctgcggagagctgcgcaggaaagcccccgccaactacatcttcctgctgatattcactctggcggacgcgtggggtctagcctgcgcctcctccacctacaaagccgacgcagtagccatagcagtgggcataacggctgctgtatgtctgggcctgacactctttgcctttcagaccaggtgggattttaccatgatgggtggcatactttttgttgccgttttgatacttttcctcttcggaatcgtcgctatcttcgttcataataagatcgttcaattggtatatgcctccttaggcgcattgatcttctcggtgtatctggtttacgacacgcagctgatgatgggaggaaaacacaaatattccatatctcccgaagagtacatttttgccgctattaacctctacgtagacgttatcaacatatttatgtatattttggccatagtgggacgcgctcgagattaatcaagtttttattttttttttgttttatttttatttgtttgttaacgttacttaattgttaatgataaaagcggtaaactaagaaccagcgttaggccttttgtttatataataaccaaagaactctggtgtgagaaatgtatatcgcgtctcgagataagtcctttgttgcacataattaacaagaaataccaactcatttaaaaatcttccagataacatttaaggatatttttgattatttcagttatttgctcgacagctgtcaatatcgtcaggtgtcaaaatttgacgcctactacaatttgacgtatgccaatattcacagaagtcaaaacccctcagccatgaacacttaatagctgtcaaaacagttcacagtctcgatttttatcataatttctgtcacgaaattaatttttatcaaccaaattgagattcttttgtttaaatcttaaaaattaatgttcctaatcaaatggaatggaaccgatgagcagatcttagtgcccgcttaaacgggttaatattaaggggggcccccagggtggccct

SEQ ID NO: 839 - DNA, 1153 bp, Diabrotica virgifera
  misc_feature (1100)..(1100): n is a, c, g, or t
cagaatattatatttcttcaattatttataaagttataaaattatggtaggacatggaagaaagaaaaaacccctggcaaaggaagaagttaaagaaaaacttctagcaaagaagaaagaagcaaaacagttattaaaagaaaaaagagctcgcttagtagtaaagaacatatcatttaaagtaaccccagaaaagttaaagaagcattttgaaaaatatggagaggtcaaatctgttgaattacttaggaaaccagatggaaaacttactggatgtgcctttgtacaattcagtcttgtacaaaaggctgccaaagctaggcattacacaaatgaccaagagtttttgggaagaaaaatcgtagttgattttgcaaaagctaagaataaatatcaaaaggaacagcagttaaagaaagttgaaataaaaaatgaagatggtactaaagaaattattgaaataaaagaagatgatgatgatgtgtcagtaaaaagtgagaatgtagacgatcaagaaattaaagatgagcctgaaaatagtgattctgattcagaaaaatttgataatgaagatgccaattctgatgacagtgatgacaaagatgaagatataaaggaagagaaacaactggacagcgtaaagaagccatacttgagtcatgatgtggcagaagggaaaacagtgtttgtgaaaaatgtaccatttgatgctactaatgatgatttgaaacagtgtatgaagcagtttggccgtgtttattatgctcttgtttgttttgataaacttacagagcattccaaaggaactgcatttgttaaatttgttaatgccgaagatgcccaaaaagctttaagtgctggcactgagttaaaattgttggggaatatattagattgtcatccagcattggataaaggtgatgttaataaaaaagttactcaagagaaagaaagtaagaatgtgccaaaagattctagaaatctatatcttgtcaaagaaggagtgatcttggcaggcagcaaagcagccgaaggagtgtcagcgacagacatggcaaaacgtttacagatagaacagtataagactcagatgttacganacctcaacatgttcgtttctaaggaacggatagtagtccacaacttaccatct

SEQ ID NO: 840 - DNA, 963 bp, Diabrotica virgifera
  misc_feature (850)..(850): n is a, c, g, or t
atccattcttttacggttaagttaaacatcgcgtttctctacaaatattccaaaagtcccgatatgagagtttaaaatacagccaagtgtgttaaagtgcgtgttgaatgcattaaaatcatagtttgcacgatatacctgttgttttcgccgtttttgaatcgatacatccaacaagtttggatagaaacgcagtagccttgacgacgatgcaccgaggttttgttgttgttcgcttctctttttaatgaggatggcgcccgtttcctcacacgtatcgcagttgtacaaggggtgagatctgacagagacggaaatatctaatgtgttcgagtccaaacaatagtacaacatgacaacgatataattctaacgaaaggataccaggaaacagaagtttaaaatgtttacgtgctgtataaaatatttactatgtgccttcaactttataatattcctctcagggacagccatattaggcgttggtctatggctaaaaatagacaaaaactcctttataggactactaaaaatagttccttatgatcaagtccaagacttcacaaaacccggcgtaatagagcacctgtcgtaccttctgatgggcattgggggtataatgtttatcgtatcctttttaggatattgcggagccatgagagagtcccaatgtatgttaaccacttacgggttgcttcttctcgtcattttaattttagagataacagctggatgcttagctatcatatacaaaggcacagccgagactgaagttaaaaacgtcctgaaaacatctttatcgaaatactactcaaattctgaaaacggcagtgcagccaacctcgcctgngacggggtacaaatttcattgaagtgttgcggtgtagacgattacgcagactaccagaagaacgagaactgggcccaaggggataaaagtattccccgatcgtgctgtgtggt

SEQ ID NO: 841 - DNA, 447 bp, Diabrotica virgifera
ggggccacccacgcgtccgcaaacgcgtccgaattgtggtgtaaattgtaaattttctcttttctcgcatttttaaaatatattatcaatttcacaatgactaacacaagcagcaaaggcaactttcaaccagattcagatgttcatattacctacgaagaccagcagaaaattaacagattcgctagattaaacgctaaattagaagacctcaaagatgaaataaagcgcaaagaaaatgacctaaagagtattgaagacgcatgtgacgaaattgctctttttgacgatgacgagcacatcccttatttggtaggcgaagcatttatataccaaaatgtagaaaaaacccaaaagtgcttagaagacaccaaaaataaaatcgaggaagggattaaagaactgaaagtgaaatccaatgaagtcaaagatacaatgagtgacctg

SEQ ID NO: 842 - DNA, 908 bp, Diabrotica virgifera
gatttttgctttgctgtcagtgtcagtgggaaaatagcagcttttcttatccttaagattaacaaaatcaagaatgtctggatttggagacaattttggagttgccgacgaagacccagcggcagaattcttggcacgcgagcaagacgaactagcaggccttgaagatgaagtgaaaccggccgcagttattgctccagttcttaatggtgatgacccaaccaattctgcgagcagttttgaaatggtagaaaacaatggtccagatggttttttggaagagccaaagtttaatgatatcccagccgattttgatccagataaagaatacagggaaagagtgtccccacttacaataagacaagaagatagagtagaaccagaaaagatcaggttatggagggaagagcaaatcaagaggttggaggaaaaagatcaggaagaagagaaaaagaagcaagaattgagggaagtagcaaagaaagaattagaagattggtacaagaatcacgaagaagctatagccaagacaaaagctgctaataggaacgctgaaaagcagttcgtagccgaagatgacgaactagaaccgggaaccgaatgggaaagaatagcaaaattgtgtgatttcaatcctaaagcaaaacaaggcagcaaagacgtttctcgaatgcgttccatcgttctgcaaatgaaacaaaacccagttccaatcaagaacaaggcttaatgtgtaaattaataaataatgtttatgtgtactatgtttcagaaaattggcagtttggctaatatttttgaaatgtaggtgtaaacatttctggacattctgcaatttttgtatgtaataatagaaatattatgatttaacataatttgtaaggcagcaatttatggatatcttgaaa

SEQ ID NO: 843 - DNA, 914 bp, Diabrotica virgifera
agatcggcgctagaacaactcccttgactgttggcgtctatgccgctatcaccttcctctttatcgtttgaatctccgttgcgaatagtaggattgacttccgggacactactttcctcctcttccaccttctcttcatctttcgaatcacctttatcgtcgtagttctcgttcttcttgttctcttctaatagttttcttctttcctctttcttctctaacttcttcttcttctttctttcccgccttctagcagctgcaagccgcttagattcctccctagttttctcagactctagttcttctaataagatcgatgcattcttattggctttggctgcttgggtttccttagcggcgcgtatgatcttcacgcattcctggcatttctctaaaagctctttatcactgactgtagcgttgtaccgcatcatctcttgatcactggggaactgcgtgacgtggtgtaccatccatttcactactttaaaatggccttttctaaatgcggccatcagacacgatactttgcggttatcttgagaatcgatgtcagccttgacattataaagtagttctacgacgggcaaatggccaccgttggcagctagccaaagcggagagttccctttcttattctttacttcgacttgcgctcctctacagagcaacagttcgacgaatcggacgtggcctttgtcggcagcgatcgttagcgcggtatctcgagaagagggtacaggggtagcgttcacgtcggctcccttatctaaaagaaccctacctacgtctacgtaaccgccactagcggcctccatgagcggggtaagtccagtcttagctctatgttcgatattcgccttcctatcaagcagaagactgaccacttcgtggctttcttgaaaaaaagccaa

SEQ ID NO: 844 - DNA, 905 bp, Diabrotica virgifera
  misc_feature (772)..(772): n is a, c, g, or t
  misc_feature (826)..(826): n is a, c, g, or t
  misc_feature (864)..(864): n is a, c, g, or t
aagactgaagatgattcacttaaaatggaatcagggatggtcgcgtgaaaaaaagtttttttattgttactgtaaccatttaacgaagattgtcccattgaaaatttgctctggtttgattaacttggatcatacttattatccagtaccttagtattgttaatattggacattttaatacccattacagctacttgttataagaaacatctgctcaattttttcaacttcggtgagaagagaactggttattgatggtactctgttgaaaaataccacccaatattcaacggtgggtctttaccatagtagacttcttgaaatgttacctttggttagaagattcatattgttaaaagctgttctcaattaaattaatattgctgtaacgaaattggctaataatattacattcatattttgtactcatcttgagaaaaaaacacaggcagaacctttaagacagtcaatgcaaaatgaaaaattaaattacatacattagatacctacttcttcgctgttttagaagactcttttacaacaattttaaggaacacagtcgaatatcattaatattggcgttacatatgcaaaaatgttaacaaagtaatgctctttttttctgaagtgtttctaagtgagttgtttctgaaagcctcaaaaaaaggatagatataacatccctctttgattttttaacatcataatagcatttgttttgatattgaactgatgtttgttgacagtttacaatatagtgcgatgttattanaaaaattgtaattgctttagatacaaacggacattatactgtatacttacaaantaaattcaagttgtccccatgaaacattgataatctcnaatggaacatctatacgaattgttgacagtatgtttatact

SEQ ID NO: 845 - DNA, 1329 bp, Diabrotica virgifera
atcatttccgccaccatgaaagcaatagcagtatttttgttagtaaaattgttaaatttatgccatggaatcgctataaattcagagatcaaaactgatgtgtcaaggtcaatatacgatgagaaggtacatgcagcatttttaaatagagatcacataagaagaaaacgatatctaggtttaagtaagaaatttaagttaaataaaaggtatcaagaatgtataggtccaggagacgtaaaaggtcattgtaaacacattgcttattgcccgacaagtatttttcaacagctgaatacgctagattatctatgtgtaatagagcaaagtttcgttggtgtatgttgtccagatgacatcgctagtgctggagttgttggatctcagctgatcatagatctaccggctggtggagatgattacgatgtaggtgacaaatacacaggatgtggactcgcagtagaaggaagaaccaaggtggagactaaaacaaccagtactcaagagtggccttggatggctgctttatatcggtacagacagcatatgatactgcatatcgaaaatcagttttgcggaggtgttttgataacagatacgcacattttaactgctgcacattgcactcaaggtttagtggcgtcggaaatccgtgtcagattaggagaatacgatttcaatagaccagatgaatcccgttccaaagattacgaagtagctgaaatcatcgatcacgaatacttcgtcttgccaacatacgaaaacgacatgtcgattctcagattaaaaaccgccacaagctttaattcgtacatttggccaatttgtatgcccccacgtgatggtgattacacgaatgaaaccgtagtggtggcagggtgggggcagacggtttttgcaggatcggtaagtcctatattgctacaggtggctatgccagtttggccattggacaaatgcatggacgccttcgttcagaaaattacagacgataatatttgtgcagctgattatgaaggtggaaaagattcatgtttgggtgattctggaggccccttaatgtacaaactgaaaaatggacgatggatcaccattggaatagtatcttggggcattggttgcggaaataaaggcactcctggaatatatactaaagtagggaactacttgccttggatcataaaacatacaatggcgaagaagattgcaacgtaattacattattgttgatatttgaatttattgtatggttttaggtttctataatattgcacgcatgttacaatgttataataaaattaagcaactaaaaatataattttattgtac

SEQ ID NO: 846 - DNA, 1075 bp, Diabrotica virgifera
gtatattaatagaagaaagatataaacccgttttgtaaaaatttgtaggtatttaagcgattgttaccaatatttatttgtaatattcgccaaagcgtggtcaagatcgttggtcagttttggtattgtaacacttgttctgcacttacattgtgtacaaggactcaaagatgactgcgataaactgggcatcctcctctacgaagacgtaggttgcaccccagtcctggcaccaggtaaaagttgtccaatcaaatacgaatgcgacttggcaatcaggaacaatacctgtttgtttagaggtacagaaattagcactacaactcgcccaacagacgtcgatttcggtagctgcaacgtcggatgcttctgcaataaagatcttccctacgatcccgctgagattgataaaatgttcaataatcaaccatataatataccgggaaaattcacatgcgccattttagattgtccagaatggttgggagcatttccccttcaaaaagattgttacagaaaatacaagttggaccaatgttgcgctgatggacaaatgtgccctcaagacaagcctggcaattgcgaagttgacggaaagacagtgttagaaggtcagcggttctacccaaaagacacgtgtacccattgtgtttgtcctaaaaactttaacggaaagttagaggctcctcactgcaggaggcaattttgtaatgtccaagtgaggaaacaaagagaagtttccagctattgtgcaccttactattcagaattcgaaggagagactctttgttgtcctagcagttggatttgcccctctgatgagcaaaaaattattactgtgaatcccaaagcagaaaagtctgcagatttgacatgccaatacggaaagaaaaaagtacaattgggagaaggttttgaaactacagtaaaaggatatgacaacgttgaaagagcagctaaatgtgaatgcgttattccgccatttttaacttgcagacaagtaaaaaaataatctttcaagtattgttggttaagatttctaatgttttaataaatatcattactattctacgtc

SEQ ID NO: 847 - DNA, 961 bp, Diabrotica virgifera
aaattcatatttttgacatatattatattatttcgtataatatagataaaatttgatatctgatgatcgaatcttataatataatatataatacataataatattatagtataatacttatcattgggtagacagctcaaatacaaaaagatagtaagctatcctagtaaggttttcctcagaaaatacatatgttgcgatctgtaaaccaaactgaaataatcagatgactagcgtcatattccaactaaagaaatactctaggtgtcatatcgacatctgctagaaaaatttcaagttttcaacttattaaaatataaaataaaataaaattaaaaactttattgggaccattttttggttacacctccgtggcttctaaaaatgcaaaccaatcggatgctggagcaaggaatatgagggaattctatgatttgcgattcacgtctcatctgcccagcgcggaaaaatgccaacgaaactggaaaaaaaattaatctaaataaatttaaataaatctaaaatttatttattcgacatttcgatctggcgtttatttgtgtcagccgaaacaaagacttacatctccggacagcaatttagggtcttgatcacaagcgtttatagccgaagtcacgcgttagtttggcatacatatgacattttcatttgcatttttgctgtcccgagattgaagataattcgagatatcgaaatgccgttttcagatttggattcaggatgcaaaatcacatggcgatccatcggtagatcggctccaagtatttacagcagcggtaacgcacaaacgaagagactttgcgaatttataaacaaaacaaaattttcgttgaaaagatcgaaccggtcgaattagtcagctgcctgtttttatcgcacaagatttttatactagaagacagaatgacaaaagccttgctcgtgtgacacgaatactata

SEQ ID NO: 848 - DNA, 1608 bp, Diabrotica virgifera
  misc_feature (1472)..(1472): n is a, c, g, or t
attaaacgttgtttgtgaatatgaagatttcgtttgtggtcatttggtttcgctttcgtcaaagctcagtatgaggtacccgatgcggtagtagaagtgtacgagcctaaaggcttcacagtgtcaataccagatgaggaaggtataaagctatttgcgttccacggaaagataaatgaagactttgatggcctagaagctggaacattcgcaagggatatcttaaaaccaaggaatggatcttggacatttagggacagagagaccagactaaagaagggtgatataatatactactggttgtatgttgattataataatggaagaaatactttgggttatcgtaaaacagatcagcaatacgaagttagagaattttctaataatcccaatgcgcctgtaaatagagtaaagccaacaactgagccaacatctacggctaaactcatattatttgatgacttttcgactaaaagagatgatttttggacagtggaacagagatacgcagatgcaccggattatgagtttgtgttatatgtcaacaaaccagaagtttttcaaataaaagacagcaatttacacataaggccagttccatcggaggatatctttggtaatggatttttaacatcggaatacgatcttggcaacagctgcacggctcctataggtaccacagattgtaaaagaaaatatgatgcaggctttattttaccaccgatcgcatcagcacaattaacaactaaaaacaaagttgcatttaaatatggaaaaattgaggtgcgtgctaagcttcctaaaggagactggatttatccagagatttacttgactccagctaatgaaaagtatggattgaaaagtcaatcaggtcaaataagaatagcttttacacctggaaatagtgatttgaatcacgttcttcacggaggactcactattggtcgtagcgttgcagctacgaactactttgataaaaccatagaaagtaagatgtcttcatggtcagatgactttcatacatttagggtagactggaaaccaaatgaaataagtttcagtgtagatggtacagtctacggaaacatatatcctccagccagaggtcttgcatcactaggaccaacattaaatctaaatactgataaatggaaagaaggaactctaatggcacctttcgaccaggaaatgtacctaacgctaggagttggagtcggtggatttgtatttaaagagagtccatcaaagccttggagaaatggggagaggaatagttttcaagtatttaattctgctcgacagcaatggcagcgaacatggtcagatgacagaaaattagaagttgaatatgttcaaattacttctctttaagtttagctctctaataaatcaaaccagtgctataaaatttagataatgaatatggtacaacttagtatgtacgattttctcccaaataaattgaactngaatctgtatccttaaataatagcaaaattagggtgggcgtaattttttttaactcataatctatcaaatattaaggaattttttttatttatttgaccttcttttattaaaccctttataaataaaattttaagg

SEQ ID NO: 849 - DNA, 914 bp, Diabrotica virgifera
  misc_feature (851)..(851): n is a, c, g, or t
  misc_feature (885)..(885): n is a, c, g, or t
gaacgccattttacaatacaaaaggcattgattatcaaaattagagtggaaacacaaagaaggatttggttctcgctgaactttttgtaaatagatacagcaatgccaaatataaaattgcagtcgtctgatggcgagaccttcgaaattgatgttgaaattgctaaatgctccgtcactatcaaaactatgttagaagacttgggaatggacgaagaagaagaagaagtggttcctttaccaaacgtaaattccgccatactcaggaaagtcatccaatgggcgacttaccacaaagatgatccaccaccaccagaagatgacgataacaaagaaaaaagaacagatgatatttcctcatgggacgcagacttccttaaagtcgaccaaggaaccctcttcgagttgattttggctgctaactatctggatatcaaggggctcttagatgtcacatgtaagactgttgctaatatgatcaaaggtaaagctcctgaagaaatcagaaagactttcaacatcaagaatgacttcacggcatctgaagaagaacaagtgagaaaagagaatgagtggtgcgaggaaaagtaatttaagggactgttcagtatttactgtgaatatttttgtgtttattataatttagatatactacttatgatgctttaaattttatgtgaaatatgctcgattttcaactttgagatctgcatttcatgtcatttaaataaataagtgattttgataaagttatgtatgtaggagtgtttcatttttgctactgttagaataaagtcttaatatttcttttaatataatagtattttttaataagtttaatggatacattnaaaacgtcttctgtctaagctatctggaccctgntgactgtcgcttctgccctactgcattca

SEQ ID NO: 850 - DNA, 933 bp, Diabrotica virgifera
ggcttgttgttagatctttgacaggtctaattgattatcgagtgctttctttgaaaagctcgacatggagtcccaaaacatgaccatgatgcactcggccggaccgattcagcccccaccaagggaagggggcggcccccatcccaacagaaggggtaaccgcaaggggcacggaccacttcacggaaatctaccgacagagaggttatccttgggggaagaagccaaattgctctactctcaagaaatggcctccatgccgagcaagactcccgtcagcgtcctccaggagttgctgagccgtcgcggcatcactcccaaatacgaactggtccaaatcgagggcgccatccacgagccaatcttccgctaccgcgtgttccttaacaacgatctggtggccaccggaaccggaagatcgaagaaagacgccaaacattcggcagccaagaacttgctggatctcttggtcggaaaagtgactcccgaacaagccaatcagaccaacggaacgcccggagcggctgatatcaccaatcaggtggtgacatcgttcgatgacaaagtgatgggcaatcccattggctggctccaagagatgtgcatgtcccgcagatggccaccaccattctatgaaatggaacacgaagagggactaccacacgaaaggcagttcaccatcgcttgtcatgtgttgaaattccgcgaaattggcactggcaagtcaaagaagctagccaagagaatggcggctcacaagatgtggcaatccttgcaggatttaccccgtggagggtaacaatctgccttctacatttgcgagtgacgaagagttggccactaaacttggcagctcggctgagtgtcgggttcgggactgaaagtaactaaaatgaccaaggtttgaaaccagcagtcctttaaagtttcact

SEQ ID NO: 851 - DNA, 1131 bp, Diabrotica virgifera
taaactttgaaacacgaatgaagctacaatatttgtcattactagtattagtggctgtttttacggcaacaaattgttccacttacttaccagaaagacttttgggagatatcacatcaccagtaaacttcgatgatgccaatttaaacgaaactgaagtagtgttcgatgcatacaaagtattagaccgcggaacgaacaaaaacggcataaagggctcgcatttcgacatataccccactagattcttcatacacgggtacagccaaaacggtcaaagctattgggtactaacggcaagaaatgcttacttagaaaaaaaagttcctcacaatgttgttattgtagattgggcaaaaggtgctgccaacttcgagaaagctgcggcgaatacaaaaaaacttggagaactgattggaaagtatattatcgacaatgaaattgagctagaagatttacaacttgttggatttgatataggcgcccacgctgcagggcaggcaggaaaatatattgctaatttaactggtcattatgtaagtagaataactggtcttgacccagctgctcctaaatttgaattggattctgtgccaccagaaaacaaattacaaaaaactgatgctattttcgtagatgttatacatacaaacgttcaaaagttgggatataaggttccgattgggcacgtagattggtacgttaacggtggaaatgaacaaccgggatgtcctaccttaatgatgccagaaacagatgtgtgcagtcacttacgtgtctgcgacctatatgttgaattcaatcattaccaggcaactccctacgaatgtacggtaaccatcgagaatgggacatctacagtaaccaaaaggccgtctggaaaaccctaatatttggagaaaaagggaaaatatctgaaagaggaagttacacaatagataccaaatagcgttcctaagtaattttgccccgttaatattggttattaaaagcttgaatatcattaaaactttgggccttttttaaaccttttttttgaaaagaaaaaaataaaaaaaaaaaatgaaaaggttaaatttttaaaccctttaaaaaaaaagggaaaaaattttttttaccccttttttttcc

SEQ ID NO: 852 - DNA, 1426 bp, Diabrotica virgifera
aactcaaatatgaattttatgaaaaatggcattgagtgacagtaacgagaggctggacagtctttttgtgagaattgtaaaaagggtagtattttacggacttctatattcaattggatatgcaaactggtcaatgacatgggtgttaatacctgcattaatcgtgactctatcggaggaatatgcacatacaaagaagaaaaaaagaactttcgccaaagaagcagcttcgggaaaggaaaaggaaattatcgaaaattggggggaacttccattttgggtcgtgtttccggatgtagaacgagcagagtggttaaataaggccgtgaagcaatgttggccctttataaatttttatgctcgtgacctcattaaaacgtacgtagaaaataagctcaagaaaaatctggagaaatatagtctgaaaggattccattttgagagaatcatattgggcagtacgcccttacgaacaggtggcattgtagtatatgacaatgtttctagagaagaaatagtcatggatgttgatgtttcatacgctggcgactgtgatattaaatttcgtcttagaggacttctaggcggaattaaaaatttccagatgtatggaaaattaagaatagtgctcaaacctcttattcgccactttccattgataggcggtgtacagctgtttttccttaataatcccgatatagatttcgagctagacggaattgctggtattctggatgtgcctggaataaacgaatccttgagaaagtgtgtgtgcgctacggttgcgtcgttgatggtattaccaaacaaatttccagttaaatttactcctgaagtaagcagtgaacaactaaatacaccaaatccagcgggagttcttagagtccatgtaatagaagcaaaagacctggtaaagaaagatattacttttaccggtaaaagcaaatcagacccgtatgctcagctagtagtaggagaacaaagtttcaagactgagactatacaatccaacgttaatccaaaatgggattattggtgtgagtttgtcatcctagaatctactggacaagaaattttaataacagtatgggatgaagatgcgaccgatgatgaatttttaggaagggtatccgtggacatagcatctttaattaaagcagaattaagcgatatgtggttggttctagaagacgttaaacacggagatattcacattaggacaaattggttaacactgtcgacggattactctaacctaaaagctgccttatatgaaagccagcagttgcaactctcccatatgagttcggctttattaatcgtgtacatagattctgcaacgaatttaaagcaagtcagggcgtcaacaaaaccgggatccttacgtccagcttcaattaggtagacaaattaaaactaccaattc

SEQ ID NO: 853 - DNA, 1504 bp, Diabrotica virgifera
gtttaataaaggaattcggcaacatttttttcacctgtttattaaaaacatgtctttttgtattaaatataaagtctcgcctgcccactgattaatttgaatggccgcggtattttgaccgtgctaaggtagcataatcattagtttttttattgaaagctggaatgaagggttggatgaaaaaaaaactgtctttatttaatttataaagaattttatttttaagttaaaaagcttaaatttttttaaaagacgagaagaccctatagagttttataaaattattaataagtttttttagtattaaatttatttatataataaatttatttaattggggtgattaaaaaataaatttaactttttttatattattatattaattaataattttttgatccaatttttttgattataagaataaattaccttagggataacagcgtaattttattggagagttcaaatcgataataaagattgcgacctcgatgttggattaaagtttataattggtgtagcagctatattattaagtctgttcgacttttaaaattttacatgatctgagtttaaaccggtgtgagccaggttggtttctatctttaatttattaatatattttagtacgaaaggaccaaatatataaaataatttttatatttagataaatattaaatgaagaatgtaaaaatgttccaagaatgcagtgttttggttttatgttttgcgattgtgcaagctagaatgtataatcagtctgatatagatctttctaaatgcaagactcactattcccgctctggaagtgtctacaaagatttctacagcatcactgaaactcccagcgcaaacgacactcttctcctggactttcacttctcagtcctagctcccagtgatgcacatattctcctagcaacatccgacaaggttcaaaaaactgatccggcttatgagattgttatcggtgccggagggaacacattttgcgatataagaagaaagcagaagtctgatgtcaagtcttcgataagggttaaggggttgttgaatgcgctggatcctcagtctttttggctgcatatcacaaaagatggagacatagctgttggtaaagaaggagaagaattgcccttcatttcgtgggtagatccagatcctcttcctttaaaagtaatcagttttagtacatggtccggtgtggaggctaaatggtattttgattgccaatttaaacatgaaacagaggagatacaaaaacctttgacacatcttgataggctccgaagagattacctctaccactataatccatacgttaggcctgttacagaacataacactactaccacagtttcagtagctattaatatcaaccatgtagcattagatgaaaagcgatcagtatttgaaagttttgggagtacaaaaatggggtggcaagatgaaaaacttatatgggacccacatgattatagtgggatacaagttatgcacattt

SEQ ID NO: 854 - DNA, 1230 bp, Diabrotica virgifera
cggacgcgccgcaccgtattaagggtactgattatatattatcttcagccgacttaaaatatcggccagtgctcttgaagtttctaaaagtgtatcattgtaaaagtgttttatataaagtgaagaatgggcgaggtattgaacaaagatgcactgcattcttggattcagcgtgcgataggtacagaaaacttcaattttactgtggaaaacaccacccaaaaaggagagggttacgtaggggacttatttttcgttaaaattgatttacaacaaccgattaacggactcaacgttctttatctggtcgtaaaaaccaacaagagggatcctggatcgattcgtctcatgcaggatttttgcaagagagaagtattcttttacggcacagtttttaaagaataccaggaatttctaaataacaagaagcttccagttcttttagacatggtacccaaatgttataaaactttttcagaaaatggcaatgaggttattattttagaaaatttaaagaaagggggttttatgctacatgcaagagaagagcccatgaatattgctcatctgaaaatgggcttaaaatcttatgcaaagttacatgccatgtctttagctctgaaagaccaaaagagagaaatttttgaaaatatgtcaaagacctgtacttccttagtgaatcagctgttttcaacgtctaaaaaagtgtttaatacaaagacacccatgttagtagaaactctaaaagaagctggtcgacctgatttgtcgatcttgtttaataagtacatacatgacaaaagtatgtatactagatttatggaaataggtaatactatttctaaagatcaagcaatagtacatggtgattgtcacaacgggaatatgatgtttcaatataaggatgacgataaatctgttccacttcgcatggttttgatagatttccaagcgtcttttattcattcaccagtactcgatctctcctattttctatggatgaatttatcaccaactgaagctccgaaaaaataaaaaaattttgtggagtatactatactgggttttgctcatatctaaaacaaaaataaaggaaggggcccccggccaccagaatttccccgaaaagaattttttttgaaaaaacttttaaaaaacaaaaactcaccccttatggatttttttttttgtttatcaaccaatttaattaaaaatcattttttttctctt

SEQ ID NO: 855 - DNA, 381 bp, Diabrotica virgifera
  misc_feature (319)..(319): n is a, c, g, or t
  misc_feature (356)..(356): n is a, c, g, or t
ctactgttaaaatgggtaacacccaaaagaagagttacaacctagaggcttcgcccaattcgaaatacagcctgccgcagagtcaacagattccaccagtaaaggaggaaacacccattgaggtgaccggagaggtgcaggacgaaaagctaaggtcagtagtagacggccctgttcggactaatgcagttgttgatggagctgataagggaacatagctattattaggttttatatttgaatgtaaatttgtactcactatgccagtattatggttacagacactgtaaatagaagtatcgaatatattgtttgtganatttatttaataaaccatattttgttttataaaaaanaaaaaaaaaaaaaaccccagggggg

SEQ ID NO: 856 - DNA, 965 bp, Diabrotica virgifera
  misc_feature (955)..(955): n is a, c, g, or t
tgtaaagtggtggtatatcgtgtttaggatttgaagaacgctcagttttgattttgagtggggattatccacatatttgaatacgagtattttggcaacaattactctgcataagttcgaagtttccagaaaatggagacatcagaaatttcaaaatggtatcggaaccagcacgtctttataactggagccactggtttcatgggtaaaattttgatagagaagttattaagatcatgtccagatgttgctgctatatatgtaattatcagaagtaagaaaggaaagaatgcaacacaaagattggaagagcttttaaattcagtggttttcgacaatatcagacaattaccagacgccaaatcaatatttgaaaaagtcaaatgcatcaccggcgatgtaacggaagaaaactgcggaatctctcctaaagatcaagaattattggaaaaatcagtaaccagtgtatttcatatggcagctaacgtaaaatttgacttaacagttaaaacggcggtacttttgaacaccggaggtacctttaatgttctggaatgggcttgcaagttacaaaatttaaaaatcttcgtacacgtttcaacgtcttattgtcactgtgatgttacagagttagaagaaaagttatatgatgctcctcaggatcctagaaaaatgcttgacatggtaaaatggatgagtgatgatttattggagacactaactcccaaacttttaagtaaatatccaaacagctatgcatatacaaaaggtctaactgaacaacttgtttctgaatatagtaccaaattgccaattgttatcactagaccttccatagtatttgctgcatacaaagaacctattcctggatggatttgacaacttgaatggttctactggtatcctttgtggagcaggcaaaggagttataagaacgatgcattgcaatgctgangtaatactga

SEQ ID NO: 857 - DNA, 1656 bp, Diabrotica virgifera
cccacgcgtccgcggcgaccggtgaaaaacacctgaggaatacttaaccgctttgcgcaacttttacttacctcttttaagtagtataccgagtgatttcgaaaagttcttgcgtcatggagaaggaaccgcaaccagaatccatggcgacggttaccatcaagccggagtacaccccttcggagtattcggcctccgaaccaccaccggcatacatgaaaatgcgtagtacttcagtccaaatagccaagattatagcagtaaccgtcgtagcttgttctgtaattttgggaggattcttgctagcttctgcctacgtctcagctaatgcttcatgcaggcagttggagcatgaacttgagctcctcagcgaagctgcagacaggtttcagtccccattgcaacccgaagcgcttatccaagacccaccatcatccgtcaacgccaaacgtcaagtagaaactctcaatgttgaagagcaatcacctaccacaaaagaactaaccaaccatatcgacgacgactcctcctcttcttcatcggagagcgagtcgaccgattccgaagatcttcctaccaaagaacccaagggtgccaaagttccagtccagatggatatggaagagctgatctctcatttactcgagaaaaaccaaaaatcaaaaatgaactgcgtagtggaaaagaagagagcagaagaatttgtggatcatcaacctaaaacggtgaggttgccattcggaatcaaccttaccacgaatcctaggttcgagaaattgaccggagaacgtatggttattgtttgtgaaagtggaaccatgcaaggtgctgaatcacctatgagaccaaaggaagaaagagaagacgattccgatgaagaagaccaagaaacgattatgattcaaccagtaatgatccccattccccaaagcccattcaacacccatatgccccagcaaatggcaccaatggctccacaacgactaatgggagaacaaatgcgtccaatgggagctccagtatttcatattgaaaacatgagaccacccatgatgcaccagcaaccaccttctcaaatgccagtacgccctccaatgcaaccacagatccaaatccaaatgcagccacaacaaccccaacaaggcgatttcccaccaaacccaatcttgcaacacatcgtacaacagattgttgcacagaaaatcatggaaagccaaaagctacgtgagcaacaaatgagagaacagcaacaacaacaacagcaacaacagcaacaaaaagaagtcagacctgaaccaacacaagaaattgaagaacgcccacgatttcttcagattgaacaaattgggcaaccagtcaatggacaaagattaccaattccagaagaagttttgactcaactgaacagattacccaaccgtgatgttatcgtagctgtatcagaaactgattctgaagatgctccccaagaggttcagtacgttcaagagcaaagacaaagtgccaacgaaatgaacggtagacaaacttatactagagctcttcccattaaccttcctgtacacgtagctcctcaagatcaagaatctcaggaacaggagcaacaacaagacgaactcagacctcattttgttcaacccagatcagtctgaagtc

SEQ ID NO: 858 - DNA, 918 bp, Diabrotica virgifera
gtgtggcgggcgcagccatattgatagtaagaaaagtgtacagtattggaattttgtgttaggtgctgtgaataagaaatctgaaatcatctcaaaaatgtccgagcgggaggataatgtatataaggcaaaattagccgaacaagcagagagatacgatgaaatggtggaagccatgaagaaggtagcgaagctggacttggaactgactgtagaagaaaggaatctcctctccgtagcttataaaaatgtcattggtgcaaggagagcatcgtggcgtataatttcctccatagaacagaaagaagaatcaaaaggtactgatgataagctagaaatgatccgccagtatcgttcccaagtagaaaaagaacttagagatatttgctcagacattcttggagtactagacaaacatttgatacctgccgcctcctccggagaatccaaggtcttctattataaaatgaagggcgattaccacagatacttggcagaatttgccactggaaacgatcgcaaggacgctgccgaacattctctagttgcttacaaatcggccagtgacatcgccatgacagagttagcgccaacacatcccatcagactgggtcttgcgctcaacttctccgtcttctattacgagattctgaacagcccagatcgggcatgtcgtttggccaaagctgctttcgatgacgcaatcgccgagttggataccctttccgaggagagttacaaggatagtacgttaataatgcagcttttgagggacaatctcaccctctggaccagtgatatgcaattagagtctgaagaaggcaacaaagagcaattacaagacgtagaagaccaagatgtatcataacttggaaatgtcacatgaggcaatatatcgaactgttgagtgctgtgtag

SEQ ID NO: 859 - DNA, 941 bp, Diabrotica virgifera
  misc_feature (749)..(749): n is a, c, g, or t
  misc_feature (871)..(871): n is a, c, g, or t
  misc_feature (901)..(901): n is a, c, g, or t
gcaaacagctgatctagctcacatttagctgatttgttcaatttagttcaatgagagagttacattttttaacagacaaatagataggattaaaatgtttttcaaagtatttgtaaaaaatttcacattagttttctatcaaagagaacagaagctatcaaaattgctgaaatatggaacagtattcacgggctcagcagcatttttgtctaacaaatctaagtcagttgatacaaatgaatttatggctttaccaataacgcctttgcagaaactatcttccaacccagatgatatgaagactagaatggaacttatgattatgaaggtacaaaaagagttttgcaaagctctagagactgaagaagactgcaataagtttatcgtcgacagatgggagcgacaagagggaggtggtggcgtaacttgtgtgttacaagacggaagagttttcgagaaagctggagttaacatttctgtagtttcgggaaatttacctgcaggtgctgtggctcaaatgcgctccagaggtaaaaaacttgacagtaatggacctttacctttctttgctgctggtataagtgctgttatacatccagttaatcctatggtaccaacaatacattttaattatagatattttgaggttaaaagcggtgacgaaactcaatggtggtttggaggtggcactgacttaactccatactatttgaattcagcagatgcagtccattttcatcagacgttanaagatgcctgtgataaacatgacaaaacctactatccaaagtacaagaaatggtgcgatgactactttaacataccacacagaggagaaagaagaggaattggtggtatcttctttgatganttggatactcctagtcaggaaaaatgtttnccagtttgtgaaagttgtgccaatgctgtgataccttcta

SEQ ID NO: 860 - DNA, 1016 bp, Diabrotica virgifera
aatttatctatttcagaaaccttatctaaacaaatattcacaaagtcctggataaattcattaagatcaatcacattcaatataacagaatttcttcattggtttgaactctttgtagatatctcttggaaacattaatatgctgattggaattctttaattattttatgaaaatattatggttgatttatggcacctgactgatttcagatctccaaatacacattaggaaatcatgaggagagaccatttttatttttccatatgaacttttctatagaaatattagcttgctaatatccactaactagtagaagattgtaatgtcacatttatttaaagtgataaattgcatacctttgaagaagacaaaatattactcctatacatttcatcaaacaataaaaaagaagaaaccacgataccagatgaggaaaaacatggaattcagttcatttagaattgattgttttgaaaagcttaaactaattgatttttgcaagttgacagctgacaaggaatgctcctatacaaactgaaagatcgacgattaggatattttttaaaggttttgtaatgagtaacatattcctaggagtatatcttgagacataatgtgaaagatctaaaatatcctatggggcagattcctgttgtatttaaaaaaagggctgcaaattaatagccactaaagctgactttgctgtttttgaaacaaaaagtctgcgaattaataaccactgaggctgactttgctttttttaaagaaaaggttgttaattaataaccggtgagactaaccctgctgtttttgaaagaaaggggttgctaattcataatccatggcgcaaactctactgtttttgaaataagagatttttgagaaattgtactgaaaatgtgcctgtttgtattaatatgaactgaaaaacacaaaggcaaatcagggatctaacctaccgatctttaaaaggctgttccaaaataatgaattctgatggttcatgggcttatga

SEQ ID NO: 861 - DNA, 1254 bp, Diabrotica virgifera
caagaaatggctagttctttatggaatatttgttgtaaaaatataaatggaagcattaactctgcggtaaatatatctgtaagacatggtcaccatttaagaggtttagctccaggcgttgctaaatcgttggaaaccaaattagcagaggctaattataaagatcctgctattcattatcgtgtagatattggattgcctcctcctaagatttccagatcaaaagttttacaagaaagattaaagattttaaaagagcagaaaaagaatccaaccttagaaaaattagccagagataaaaagttgttaataaacttagaagaaacaaataaagaatggttaaaaacgcaagcccctgttgatataaaaaaggtcgctgaccactatggtgtatttgaacatttatatggcgatgcgtattttcatccacgagttcctttaaacattctttatgaaacagagaacggaagtttgcctgtatattatggaaatgttataaaaccttctgaatcaaaaaatgcccctactgtttcttatgatagtgatagtgatacactatggacattaacgttggtcaatccagatggacattttactgaaacatcaagtgaatatattcattggtttattggcaacattccaggaaatgacttgcaaaaaggagagaagttggtggagtatttgcaaccttttccgccaaagggcattggatttcacaggttgatatttgttttgtataaacaagataagaaattagatttttcatcatataagaaagaaggatcttgtttaaccctgtcagatagaacctttaatacatatgatttttacaaaaaattccaagatactatgactccagctggtctggcattctttcagtcagattgggatgcgtctttaaaagaattttatcataataaattaaatatgaaggaaccaatatttgagtacgactttgcacctccatatattaaaaaacaagcttggtttccaattaaagaaccatttaacttgtatatggacaaataccgagatccaaaacaaatcaacaaagagtttttaatgaggaagttgaaagacgtacatccatttaaggctcctccacctccattaaaatatcctaatgctgtgtactttgagggttatgtcccatcttggttgaaactagaaattaagaaatctagacttaaatggggcagaattaatgatattgaatagattagtatgttttgttttaataaatactttataatt

SEQ ID NO: 862 - DNA, 609 bp, Diabrotica virgifera
cggacgcgtgggtccggccgcccttttgcgtgttttcgctcgcttcttgttgtgcgagaacttcactatctattcaacatgcagttgtgtttaagaggaaccgcaactcatttccttgaatgccaaggatctgagactgttggagaaattaaggaccgtattgcatctttggaatcgcttaaagcatccgaaatcagtctttatgctgctggagttccagtttctgaggaaaggttggtagccgattttgagaacacagacattgaattgactgttggcttgcctggtggtaaagttcacggatctttagctcgtgcaggtaaagtaaagggacaaactccaaaagtagaaaagcaagaaaagaaaaagaagaagactggtagagctaagaggcgtattcaatataacagaagatttgttaatgtagttgcatctttcggacgcaggaggggaccaaactccaactcagccccagcctcataaattcctttaatctttatatattgagcaacatgtattgcattaaaaaataaaaatctttttcagttcatcaaaagatagatacaaattatatccaggaacatttactggaggaacaaaaataaaaac

SEQ ID NO: 863 - DNA, 1413 bp, Diabrotica virgifera
ctagtctagatcgcgagcggccgccctttttttttttttttgtagtttcttgttgtgcgagaacttcactatctattcaacatgcagttgtgtttaagaggaaccgcaactcatttccttgaatgccaaggatctgagactgttggagaaattaaggaccgtattgcatctttggaatcgcttaaagcatccgaaatcagtctttatgctgctggagttccagtttctgaggaaaggttggtagccgattttgagaacacagacattgaattgactgttggcttgcctggtggtaaagttcacggatctttagctcgtgcaggtaaagtaaagggacaaactccaaaagtagaaaagcaagaaaagaaaaagaagaagactggtagagctaagaggcgtattcaatataacagaagatttgttaatgtagttgcatctttcggacgcaggaggggaccaaactccaactcagccccagcctcacagattccgcttaacccttgataaagacatacatttgttgagttcatttttcatatcaaaagtggcgagccattggtttttgaaattcttgtgtgagcatgttcgaccgtgaattagagaaaagagcaagtagaagcattatagaagatcccaaggtagatatttggagggttgaagcttcttctgctgcaaagaacaccagaaatttcataagggaaattgttgataatttagatttgcagccaaatccagataaacctgtcattgctttatctataggagatccaacggtctacggtaatcttaaagctgcagatgaaactatcgatgcagtaaaggctgttgtggaggaaggattattcaatggttatgtaccaagtactgggcatcaggatgctaaagaagctgtggcagaatatctttcaaatgacggtgttgaagttagtcccaaagacgtaatcttatgcagcggttgctcgtcttcgttagagcattgtattactgccctagccgatggctcaaagaatcataacattctaattcctcggccaggatttcctatttacagaaccttggctgaacatatcggagttgaagcaagatattataacctcataccagaaaataattgggaagctgatattgaccaccttgaatcccaaattgataagaatacagctgcgatcgtactgaacaatccatccaatccatgtggatccagctttagcaaagaacatcttcgaaatattctagaagtggcttacaataaccgaatacccgtgatcgctgatgaaatttatgaaaatttagtttttcctggtgaacagttcacatccacagcttctttaaattcaggagtacctatattaatttgtggtggacttgcaaaaagatttttgataccctggtggagactaggatggatatagt

SEQ ID NO: 864 - DNA, 905 bp, Diabrotica virgifera
gaatttttattttattgtgaattttgattgataattcttgcggttctttagtaacacaccgatactttttatttaattacttaataattcctattacattaattgtgtgataaatatttatgtaatgcttttgcagttctttggttatatttactcttcaagaatgttgaaaacatgtttttgaggttatatttatattttttccctaaataaataaacaaaacaagaaaattagctaattagcatggaatctaaaatgtcagcctataaagccaacatttcagaataccagacaatatcaattttggggcaatgcttcgataataaagctgtggttcaacttgcaaaacaccttccttcaggtgttatggttgccgtcaagaaatttaatgttgacaaaattcccggggatataaaattgttagagagagaaattatattaacgagacaacttagccacccaaatattcttccatatattacagcttttgtgtcaggtcctgaagtttgtgttgttagtccacttatggcttatggatcttgcagagatttgttaactagacattttaatgaaggactactggagtctgctataatattaattataaaagatgtattatctgcattagtatacattcataaaaaaggttatattcacagagccataagagctagtcacattttagtttcagttacaggacaaatttgtttaactggtatgcggtatgcatgtcccattgtaaaaaatggtagatggcagagaacgatccattctttccctaggtctatagaaaaaacttaaactggttaagtcctgaactgcttgaacaaaatttacagggttacaatgaaaagtccgatatttacagtcttggcattttaacatgcgatttagctaacgatca

SEQ ID NO: 865 - DNA, 987 bp, Diabrotica virgifera
actagttctagatcgctccgatcctgcccatcttccgagaagcgatcctcaacggagacggcgacgaaaaagaagctgcagctcaaggtcttggtgagatcatcaaagtcaccagcgccgcagctttgcagcccagcgtggtcgccatcactggacctctgattaggattttgggtgataggttcagtgctaatgtcaagactgctgttctagatgcgctagctactttattagccaaggttggaataatgctaaaacaattcttgccacaattacaaacgacgttcgtgaaagctctgaacgaccccaatcgagctgttcgattgaaatctgcgacggctttaggatatctcatagtaatccatcaaagggcagacccactcttcatggagctgcacaatactattaagaataccgaggatatctctattagagaaacgaccatgcacgcactgagaggtataataactcctgcaggcgacaaaatatcagagcctttgaagaagcagatccatgctactctagtttcatatctgggagtaccagacgacactgtgaggaagtgtgctgccggttgcttaggtgccctctgcaagtatctaccaccggatcagttggagtccactctattcgaacatattttatgtgatgatagttcagctaacaataccctgaaagaaggcagaggttcagcactaacggtggctttaaaagaagctgctgtaagtttatgggacgagcaatacagagcaaagttgattcaaacgttactaagtcaattatcttctcaatcagtcgttatcaatcaaatcgccatacgatcctgtggttatctcttacagtttttgttgatgagcgaagaacccattcccagcaacctactggtaccattcgttagggctatgaacaacaatagcaacgacgtaaaacaacttctagcgagggtatcattccacttggccaaaataattcccccagaaaagatgt

SEQ ID NO: 866 - DNA, 1113 bp, Diabrotica virgifera
gtggaaggaagtggaaaataggttagagctggaaaatgttttctattccctttttgcgacagaatttaagtttaacgaaatcaaatttacctcgaaatttatttacatcagtcgtttatcaacaatcaaaggaagatcaacgagttatagagaccagagaaatcactaaagaccgtacccagcaaattccagtagaaactagcatcagatatcttaaaagtgcggcataccaacaaacctacgaagggcaaccagtgtgggttttatacagaagaaatcacaaaggacttttccctcctagaaagacaaggaaaacgtgcgtaagaggtggccaaatttccacaggtaacccatgtccaatctgtagagatgaatatctgatattacatgaacaaaatgtggacctgttaaagcagtttgtttcaccccagacaggaagtattttaagttatagtaaaactggattgtgtcagaagaaacatcaacagttaatagttgctattacaagagcgtatgacagaggtctccttacatttgatgtgcctttcagaaaatacgattactcagagtattattcagaaaagtaaataatggaggccacatttgttattgtaggaggagggatagctggtgttagttgcgcagagactttagctttcttcgaaccagaaaaatctattgtacttcttagtgaatcatccttaattaagacagtgattaatcttcatgctattacaagaacattaactgagtttaatattcaagagatggcgtcttctgaattttcgtcaaagcatccaaatattaaagttattcatgatactcttgctgaaatccatgacagtgagaaatacatcataactacagaaaataaaatgattaagtatcaatatttatgtttgtgtactggagctaagcccaagcttataccacaagctcaacagtttgaagaaatccttggtataagagatacagattccgtagaaacgtttttgaaaaaaaaaataaaggaaataatgtcatagttgcagggtaggggggtattgcgggggatctggtttacgaaaagggtttaaaaaaaaaaaaaaaaggggcggggggaatgggggacaa

SEQ ID NO: 867 - DNA, 990 bp, Diabrotica virgifera
  misc_feature (26)..(26): n is a, c, g, or t
gttttatggctaaatctgagaaacanagtataaataacatagcgttctattggttaaataaatcatgagaacttcctcaattataacctcaaaaaattcatgaaagtcagatgacgataaccaaggagctgtcatgcgtctgcccacgcgtccgaaatgtttgacgcgccgtcaccaaaatggaacatggagaacaaaggattttcgcggagtgaccctactgattatttagcattatactaatctcaaatacattaggtttgttctagcatcagtttcaagcggtttgaaatcatcagaagcatgcgcatttgtttgatggcgtttaagcacacaaattactagtttgaaactactagtccagcgttctaactttgatttggaaactagctttaaacggtcaaaagggtttgcggattttgttctgagtcaatttgtgacttgcgaggtggaattattgtttgaggtttataaattttaaatgaaaatgatatgttttgactgtttgttacttaccattatttacgtttataacattaattttctcacaatggagcactgaggaacgtttgtttttctatacttccacaaaattttgtggaagtatggaaaaacaaacgtttttcagtgttttattgtgagataaaatgaacttccatcaagtaacggtcgaatccatcaattacattgattttcaatatttaacgtaaatcttgaaaatttggataacacaagaaaaatatatttctaatctaacctcaaaattataaataaaaacaaacatgaaccagtctcatttgacgttagtattttctccgaaaaaaaagcgttctagcaaaaaacagtttgctaccagtttgtggattgaacatgcgcagtaaagcagtacaatatctggtgtcaaaccatacaaaactacatgctagaacaaacctattagctatttagtcagattccgtttagtcgagttatccagtcaaacagattccg

SEQ ID NO: 868 - DNA, 849 bp, Diabrotica virgifera
  misc_feature (846)..(846): n is a, c, g, or t
aaccatcaatacaacacggcttttaaagtaatcatctttgccgcatttttggctttcgccaacgccggtagctgggatagtacattagcagtccccgcagctccagtagtatcagcttaccactcggctccagtattggctgctcctgctgtttccaaatcgattgttcaaacctacaccagccacccagcgcctgtagccgttgctgctccagttttagccaaatcagtagctccagtagtatccgcctactccgctccattggctctaccagctcacggacctgttgtatctgcctactccgctccattatctctaccagcccatgggccagttttatcttcatactcagctccattgtctctaccagcccatggccctgttgtatcggcgtactcatctccattatctctaccagcccatggccccgttgtatcagcgtactcagctccattgtctctaccatcccatgggcccgttgtatcagcgtactcagctccattagtagctaaaagccctctttcatatgctgcacattcaccagttgtctctgcatactcttccccacttctctcagcctactctgcaccagttgtagccaagagcgtatttcctctagcttatgctgcaccatctccagttgtatctgcctactcttctccagttgtctctgcttactcttcaccaatcttaggtaagagtttggctcctgcaccagttgcctatgcaggacacgctgctccagttctatccgcttactctgctggacccgttgttcaaccgtggtaattgcaaatgggataaaattttttaagttatttatttatgaataaaaaacattagtanagc

SEQ ID NO: 869 - DNA, 1049 bp, Diabrotica virgifera
  misc_feature (956)..(956): n is a, c, g, or t
  misc_feature (986)..(986): n is a, c, g, or t
  misc_feature (996)..(996): n is a, c, g, or t
  misc_feature (1006)..(1006): n is a, c, g, or t
cggacgcgtgggctggaattgttcgtaacagttaagtgaactctggcttttcaacaatttgttgtttattttactgtgtataaaacattatcaatcatgattttcttcatacttgtatcggttcttattgcatctgcaaccgcccaaaacagaccatcgttcgcaggactcagtggaaaaggcgttcctgatgtagcagcacgatttaagccaggaggcgccttgtataatccacctcaagacgtcgtcaatagatttggaccagccgatacccccacagaaagaattcctgttgacgccaatgttgatcttaaaaaccgaattaatacctggccagaagaaaacaaaccattttggtatgtcaacgctgaagccattcaaaaacatatcggagcttctccaaaccgtgaaaccaacttaaatggaaaccaacctttatttgatagcggaaaccaagtgtttgaaagcagatttggaagtggtagtagtcagtcaggaccggaagttgctggaaactcttttagtattgtcatgaataaccaatggaaaacgtacgtttacgacccaatcacagatgcttggtatgccagaagaaattagtttcatacaaattatgattggactagctgtgatatcatatcaataaaccataagacttagtaataaaccatatttggccacataatccaccaagagctataaagacaatttgggattatttccatttaaaatcactaaaaatgtaacggcaaaaacgctttagaggaaaaacagcaaaatcgtgattatgaataggcaggttgatatgaaaaattgagaatatttaaaaatgtcttatacaaatagtacctatatgcttaaaaccaaatttacacattgaaacttcacccagtgagataatgattctattcaagtattgacaaacgataaaaaagaatctacacctacgactcccnaatgagcttggtatccacgctccttctaantaatttattngtatatagtnagtatacactgatctaatttgtatatatggtcctagtaataat

SEQ ID NO: 870 - DNA, 504 bp, Diabrotica virgifera
tttgtttatcctgtcacattgaaataatgtgcttcatttaaatgatcaacttttggttttatagatggatttaacacgattcagttgtttcgctgggacttctagaggctttttacttactctaggtgagaaaccaaaagatataaaacatgtgaaaccagaggcttcatctgaagtgactgcccttgcctttagcaaagatcagaacacaatatttgttggttttaagaatgatgccatacagccttatgatcctttactaaatgaattcaaagagacaatatccgatctgtctggaaaagggagtgttgtaggtgtaggatttacggaaaatgggctacttgctggaacagcagatggcactgtaagtatttggagtgggaggaacaatgagcattttaatactcataattggaactgagggaacacttgattgtcttgatactaaatgaaaatagtaatctgttttaggatctgggtgggataagatgatgagaaactctg

SEQ ID NO: 871 - DNA, 1678 bp, Diabrotica virgifera
  misc_feature (1627)..(1627): n is a, c, g, or t
gcgaacaagcagaccatagccacatctccaaagtagtttacaatcaattggtttttgtttttgaaggaagtgatatattaaatgacatgaaataataccacctctcaggttagttgacatgatagaaatagttttgattgtgaccgccttggcggttctaatgtattatgtgggatacaaacctatgcagtattggaaggatcgaggaataaaacaagggaaaccagcctggttttttggcgataacctcggtatgacattaaaaacggaaagttttgctgatatggtagtcaaagtatataacgcagtaccaggagtacgatattctggagcataccaatttactgcaccaactctcgttataaaagatctagaattgatcaagcagaccggcgtcaaagactttgatcactttaccgaccacagaacagtcatatctgaagatgctgatccactatgggcaaaaaatctgtttgccttaacaggacaaaaatggcgggacatgaggccaattctaagcccatcttttaccagcagcaaaatgagagcgatgttcgttttgatatccgaaacagcacaagctttgacccaacactttttagaactcgatcaagatgttatcgagatcgaaatgaaagacacgtttacgcgttttaccaatgacgttattgctacaaccgcttttggtattaaagttgattctatgaagaataaagaaaacgaattttttgtcatgggtaaagatatcaccagcttcaagggattttggaaaaatcttaagtttttgggtataatattttttccaagattgtttggatatttaaaacttggtatgttcactcgacgtgtcagaaaatttttcactgatcttattgatcatacaatcaaagtgagagaagaaaagggaatagtacgtccagatatgatccatcttttaatggaagcaagaaaaggagttcatcaacatgaagaaaaagttatagatacaggatttgcagttgtcgaagaggcagatttaggtaaaggagtcgtcaaagagatgaccaacttggacatcgctgctcaggcgatgatcttcttcttcgctggttttgattcggtatcttcgttaatgtgtttcctatcctatgagttggcaatcaatcctgacattcagaacagccttagaacagaaatagaggacacgttagagcagtataatggcaatgtaccatatgaagcgatattaaaaatgagatatttagatatggtggtgtcagaggcgcttcgaaaatggccaacagctgtagcagtagacagaatttgcaccaaaccatacacaattgaacctgccacaccagatgagaaacctgtctacctcgagaaaggcacgacaatatggtttccaatctatggtttacaccgtgatcctcagtactatccagaccctgagaagtttgaccctgagagatttaacgatgaaaacaaatcaaagattcaaacttactcttacatcccgttcggtgttggacctaggaactgcatcggatctagatttgcacttttggagactaaggtcgtgttcttccatttattggccaactatgagattgagccttcggctaaaacacaaataccgctgaaactntctaagaaagcagttcatttggctggcgaaggggggcttttggggtcatct

SEQ ID NO: 872 - DNA, 999 bp, Diabrotica virgifera
ggtcgacaattcccgggactcattggaaatatagcaacatggccgtcaagattaccttcagcatccttatagcagttctattagccagaaacagggtcgatgcctcaggagttgcacctttatttgctccagcaccagtattagccccagcaccagttctagctccagctccagttttggccaaagtttctgatgccacaattgaccccaatcctgcatattcatttgcgtatgacgtgcaggatgccctaacaggagattcaaaaggacaagttgaaagcagagccaacggcgttgtaagaggacaatatcaagtagcagatccagacggtaccagaagaattgtagattattacgccgatcctgtgcatggattcaatgctgtggtcagaagagttcctctaggtgttgcagttgctcctgtcgtagccaaagctgtagctcctgttgctccaatcgctcccgtcgctagatcattagtccttcctgctccagggcttccagttgctgccgctcctgtaccagtagctccagcattacctttcgccgcaccagcagtagcaccagctcttccatttgccgctgctccagctgtagcaccagctcttccattcgcagctccagctgtagcaccagcattgccgtatgctgcagctccagctatttctccatacttaaccagagctggattcttcccagctccagctccagccgtagttcctgctgctccaggtcctgcatacttgcctgctgctccatcaagattggtttcaccctattcggtagccgcacccttgccttcaggtttgaggagtttagtgacccccttctcagcgggtcctgctccactagccgttggatcaggggtagcggcgccgtattggtaaaccccggccgtgtactaaatattgactgactatatattttttaagtagtttacatttgttttattgtttctagtatttttattgtaaataaatatcctatatttttatcttc

SEQ ID NO: 873 - DNA, 469 bp, Diabrotica virgifera
actcgcgggtcgatacaagcctctaaacagacgtcctggtaaaatatgacaaaaaataaagtgattttagtaacaggagggacgggattagttggcagtgctataaaagaaataattcaattagaaaaacggacagatgaaacctgggtatttttaagcagtaaagatggagatttatgtgattataatgagactaaaaaaatatttgaaaaacaccagccaacacatgtcattcacttagctgctatggttggaggactctttcataatatgtcacataatttggattttttaagaaagaatttaaaaatgaatgacaacgtactgcaaattagttttgaaagtggcgttcaaaaggtggtgtcatgcctttctacctgtatatttccggataaaacagagtatcctattgatgaaactatggtgcacaatggaccaccacacccctccaatttccgatacagttatg

SEQ ID NO: 874 - DNA, 927 bp, Diabrotica virgifera
  misc_feature (838)..(838): n is a, c, g, or t
  misc_feature (909)..(909): n is a, c, g, or t
gacaagtatgttcttggtattactagtgcttgtaataactttgttggctgttttaatacagcggagatatagctattggtctaaacatggtataccgggaccaaggcctttaccacttgtgggtaattttgggaaaagcttcattggaaagaagtcggcaggggaaattgtaactgaaacttacagaaagtatgcagactatccttttgttggtttataccgaacaataacaccaatattattaatcagagatccagactttattaaacatattttggtaagggattttaaacactttcaagataacgacattgaagtagatttagaagtagacaaaattctgggaagaaatcccttcctgatgaaaggcgccagctggaagcaaaaacgatctcaattgacagcatgctttacttcaggaaagataaaaggcatgtaccagtttcttgaaaaatcgagtcaacgcatggtccaatatgtagcaaacgaaataagaaattccaaacctcttgaggcaagggaaatatttgtaaggttcacacttgacaatgttgctgcttgtgcctttggcttagagggcaaaaactttgagcaaccattttcaaattttagagaactggctgaaaattttatgtcaccgcaaagtctcaagtccaaaataaaatgggcaccgttctttttatgtccggaagtttttaaatatttaaaatggaaattaatacctgaagaagttgaagacagattaattgaaattattaggggatctttgaactacagaaaagaaataaagtagtaaggaatgacttttctggatgtgattagtaatttaccaactgantacggtttgttcactgagatagatatagttgctcacgctgccagtttctttagcgatggatacgaaactangtcccagggtaatgtctt

SEQ ID NO: 875 - DNA, 937 bp, Diabrotica virgifera
  misc_feature (934)..(934): n is a, c, g, or t
cggacgcgtggggttgatttcagcgataaaaatggttctagcactaacagttttctctgccatcttggctttaacatctgcatctggtgtagtagccccagcaccagtagcccttgctgccgccccagtagtagctgctgcacctgtcgttgccgcccgacttgcagatgacacctttgatccaaatccatcatactccttcgcctacgacgttcaggatgccctaactggagattccaaaggccacatcgaaagcagagccaacggaatagtccaaggacaatacaacgtcgccgaacctgatggtaccagaagaattgtcgactacactgctgatgatatcaacggcttcaatgcggtagtcagaaaaacaccccaagctgttgttgccgccccagtagtcgctgcacctgctgcccaagtaatcgccgcccgagctgcaacagttgttgctgcacgtgctgcaccagttgttgctgctccagctgctcaagtaatagctgcccgcgctgcgcctttagtttctgcacgtgctgctcctgttgtatccgctccagtactggctgctcgtagtgctccactacttgcccaacctgccccttacatagctcaagctgcacctttagttgctcaacctgccccttacatagcacaagcagctcctttagtagcccaatccgctccattgttggcagctagggcgtctccttattttgctccctccgctcctttgttagctgctaggtcgtacggtttagcgtctgctccgttgacgtatgccgttttgtaaggagaagtgtcttagcttaggtaaatgctgaatcagaatactgatgcaccgacttgctcaattagtaattgttgtaattaaatgatatttgtacataattttttatacctttgtataccaattttgaataaattgatataatanaat

SEQ ID NO: 876 - DNA, 1021 bp, Diabrotica virgifera
cggacgcgtgggcgtcggctttgttgtgttgacattaatgacactgacgaatagacgtagacaaataaatattagaaattgatcagaataatgttttaataattaataacagtttataaaaagataaaacttgcaaacgtcagtaaaacacatcagaaaaatgtcgcaaacagtgtccctaattctgaacgaagatgtcgaacatggtggaaaagaatacgacgaggatgatatcgaaaatgattttgcctacagaaacaatgtattgaacgctacaaaacaaataaggttagcatttattcgcaaagtttatggccttttgtccatgcaaatattactaacctttattatagccagcatatgtttgtttacaccacctataaaaagctttgttcacacaaatgactggatgatgatgttttcttttattgctagcattgcactgttagtacctctacacatcaaaaggaaggaatctcctaccaattttatccttctaatagcctttacagttgttcaagcttacacaatcggagtcatagtgacattctattcaaaagtagtcgtgttacaagcattagtattaacccttgttgtattggtcgctctgactgcattcacattccaaactaagcgtgacttctctgccactcattccgcgttattcgctggactctgcattctcatcgtaggaggatttatgcagatattcattcaatcgtctatattggaacttggtattggactcggtggagcatttttgtttctgccttttcatcgtagtggatacccaaatgataatgaagactttgtcaccagaagaatacattttagctacaataaacttgtacatggatataatcaacttattcgtttatattctgcgtattttacaggagtaaataggcaataattcacttatttttatgtagcaatgaataaataaccttatccactttttagaagtaaaatattttgtaaatattattggctcttaccgaatttttatttgaaggttact

SEQ ID NO: 877 - DNA, 1318 bp, Diabrotica virgifera
  misc_feature (1166)..(1166): n is a, c, g, or t
  misc_feature (1271)..(1271): n is a, c, g, or t
  misc_feature (1276)..(1276): n is a, c, g, or t
  misc_feature (1303)..(1303): n is a, c, g, or t
ggaagaggcttttcagttgatattactaaggatggttacggagaagaaaaaatgagaatccatagtgtgacgccaacatctagtttagtggaatcatccagcagtgacgattcagacagttctgataatactcagcacaatctaaacaaaaaagttcacaaggacaaaattattatttattggttatgctatcgagaaggcttgcagagaaccttactactaactcaagaattgagaatttataataaagtcttggagatgtttctagaaaagtgtcaaattgaaggtttaattgctctctcaggcgttggattatcgatattcacctccgaaaatgatacgaaagagcacatatatgcaactatcagtgacaaccctgccatctgggaggtaaacgttggtcaaaagtggaaaactctaacgctagaattggcttcatgggtcgaagataaatacaggcttcactacaaaaaatgtcagttaaaagaatatgttcacatagatttcgaaaagatgtacatgttaaaaccattctttgctgagttacgacgaagctattgccctgcggtgtatttccacttcaggaaatcccagaactaccagtattacaatttaagattacaatccctacagatagacaataagcaaacgaataacatagtttttcatcccttgccagctcaaaatatcaaagataatactccattcgccgaaatttgtgtatccaagctatcctctaaaacagctagcgtctacagatatattaaatttaacataggtagtttctttttgaacatagaaaatgatttatttttgcaaatttgtaatcttcttaagaaaacaagaaaattcaccgatgaagattctggaatctacgtcaatgaaattaaagccatacacaaatccatcacggccagaaataacgaaacaccacctataaacaaatcttacatagaatatttaatacttaatagcttcggtgttcaactcaatatttccaataaacttcagatgagtttgtcaggatccaaaggcccattatatagagttctggattatttgttcccatataacttatcgccttatatgccaatggagggtgttcaccacaagatttcgtcagtagaacaggtggatatttgcgacacgctgaataacgcagtatncaatttatttgaccaaatatacacacagtttttacaacaatactactcgcatgtgcttggactccaggtgctagtcaatacatttgcaatacaaccgggctattngaagntggtgatttccagtcagaacaaatggncaacattctcttcta

SEQ ID NO: 878 - DNA, 1554 bp, Diabrotica virgifera
cggacgcgtgggcaaaattatagtttggattaccatgaagccaattccaatatttctatacattattagttttgcttgtttaagtaagtcagctactattggtgaagacaacttagtgcaagttccaagcgtcgtcatgccagttaggaattatgaagatcctaagccaaaagaaatagttgctgtcgttgtggagccatgtccatgtgcaaaaggatcaactttagatgaaaaagttcaaccgatcgtaccacaggtagacgaaattgagccaataccaaacaaaggaggtgttttttcacttcttaatgtgaaaggaaattgtccggaaggctttttggccgataaactaggaaattgcagggaactatattggtagtttgcttaatgccaagaaagtagatcttgttgttttgacagttattttcaataaattactaaaaatttagtgcacaagtgcggttgtcatcagtgaaaatgagaaaaattgtgttagtgctgttttttgtgatatgtgcttatgcacaggacagttttgaaaatactggtgttaaattagcgctgaaaatatacgacgactgttcgaaaggcgatggattatcaccatgtttaaagaaaaaagctatcactttcatcgaccgactgggccgtatggataaattctcattagttgatggtgttactgtgcaaaaagctgctgatgcccctgctgaagcaccagccatgactgagcaacaactggatgaaactctacccagatcatctgatgccaaagatgaagctcttaccactatgctgtttgaaaaggttggcaacttcattggatctagatcaatcgaaatagctcttcccaagattcaagcatcagacttgattgaagaaggtcgcaaaggaagctttggtgacagcggtggaaagagaaagggaggcaaaggtggcaaaggaggaaagaaaggaatgatgggaatgatgatgatgggaattggtgtcaaattagcagctatgattcccttagcgatcgctggtctcttcctattagctaaaaaggctctcattatttccaagatcgcgctcctgatctctggtatcatagccgtcaagaaattccttgcacaaaaacagggaggaggtggcggcagtggatggcaatcaggaggcggtagcagtggctggtcatccggtggtggacatggaggcggcggtggtggctggcaatcaagcggcggtggatgggacaaaaggtcttatgaagcgtcggatcttgcatacagcgcttacaacccaaaatagtgtaagacgaagtgagaagaaccgtcactaggtgatagtttgtgtataaatgtttgacccatttttgggatgactatttttattggcagtttcctgtactgccacgggggagttttttgttactgctaaaatatttaatttattacttgtattttattttattttattttttgaataaataatacccttccaaaaaaatacttttttccccaaaaaaattattttttttttgtgttaaaatttaaaaggggtttattttttttc

SEQ ID NO: 879 - DNA, 972 bp, Diabrotica virgifera
  misc_feature (956)..(956): n is a, c, g, or t
aaccggtcaggacagaaccaacatttgacagaacctaaaaaatctaaaattttagaatattttagtacttttgactttgttgatttatattaaaatgataaaatgaatattaacgttttgttcagaaatgtgcgaaattatagtaatttaaatttgtgtaaatttaatagtacaataacaaatcatttcttatgtaaacatgcaagtttttgtaccaagcagccttcatattttttaaataacaaatccttaaattcaggccttaatcaaagaagatggtattcagatgatccaagttctccttcaaacaaattacctccactactgccagactctcccatatttgtttggccttctttatttaaaactataagaaattttattcttgctacctttatcattaggccctatttagatcaagaatttaatcttccagattttgtaagtgcttctaaaaaagcagtggaggtagtatcacataaattgtctgaaggtgatattaaatcattagacggtctagtaacaaatgacattatcggtagtctacaaaaagcaatatctatgatgtccatgagtcaaagggagcagatagcaactagtgtagatgacatatatttttcatttccatatcaggttggtgttatatttaacgaagaagaaggcaaagaacaaaaacgattcgtcgaaataaccatggtttaccattctttgaaaggtttagctggaatgagatctagaggtgaagaacctcccttaaatatgggaatgctacctgaatatcaacaaaaaatttcgatttgcaactatagatttatcagagaatttacaaaaggggttgaaggagattggaccgtaaatttactaaatcactttaagcccattgatgagcaaaaatagaaatttgttttgtaatttgactgataataataagaaaattagtaaatatttgtaattanagcaattttttaatcg

SEQ ID NO: 880 - DNA, 1454 bp, Diabrotica virgifera
cttgtggaattatctacatatttataaacaaaaataaaaacctcaggaactttacagatttatttacgtttaagaaaaaaatgagcaaatactctgaaaatgaggatgatccttacgaaagctcgggtgatgagtggaaagaggaagaagaggtgaagaaaaacagcagaagatcctctcaacgtttaagtaaaaagccccgaatgacagtggttgaatatggtagtagtgacgattctgatagtgaacctgcaagaaaaaagtcaaaaaatggtgttactaaaaaggcaaaagttcaagaagaagatgaagatgatgacgattattcagctgaagaagacgaggatgaagagataaaagaagaaacagaaaaagtaaaaaattctgggacaaaagcaacttcaggtactactggtagtccagtacctgctgtgagacaaatgggaaatcgcaagtttataccaaaaactttgtattcagaagactacactactggctcctttgtcattcttaaaaaagatgctgagggtgatgcttccaaacacccatgtatatggaggattgacgggaaagcacttttacaaaaatatgaagcatatgatgaagatggcaaagttagacataaaaatacatccatatacactgggtggtctccaatggacaaagatctgtatgcacctgtgactgttgatgtgattcaacataacaatcaaaaccttagggtcgaactccactgggacaaattgaaagacattaatgctgacagtgattaattttaggtcctagtttttgggatccattttcattctttgcaaggagttaatatttaaaaattatctgtatgtagttgttccattgtatctttgcacaaacgtcatgattcatttgcaaacaagttaaatcaaaacattaagtgaaacgtacattgatatgtactgtcaatgtaataattaggaaaggctattattggtggatgtattttataaagttatattgtacatttatatttaactatatattatataataatataactacattagaaccccgattatccgtgtgcggattatccgtgctatgattttctattactcaaattacatttttgaggttttatcaaaatagcgtcactgtaaatcattcgacgaaactctatacgctgagagggagactcataatgaaagatttatttttttctgtcatcttttatggtaggtacatacgtatgtataaacgtacatacgtattatgtataagaaataaatgcttttcaattatccctgccacgtccggtaccgaggagcacggataaccgggattctacagtatatataaaatgttataatatatatttaacacaatgtaacttaatgcaataaacacaatataaatgtaaataaattccaataaacataacaaatgcgctaatatcactgtttttgaaaataataaac

SEQ ID NO: 881 - DNA, 893 bp, Diabrotica virgifera
ttaaattgcaggtttgttcgatttgtttatcacctaaaagtattttacttatttattgtaagttgatattttaaaggtttgtattttagctttagtaaagttctcagtgtattatataatattttcctttagagatttttaggctactaatcaaatatgtatctgcattttgtaaactataagataaataaagaataaagaagagcggggacatgcatgcattttgtgttgatctgtgttttacatcattatttcaaaacaattttactgcatagatttccctattttgttttatcagcactccatacatgcatgcggtaagtgggggtccccgtgaggattaataaaaataaaatgtatgaagttgttttgtcagtgtttatatattttatcctatttttctaaaaagttctgagggaactacaacagttagttgatattttaaaggcttttattttagctttagtaaagttctgtttgtattgtataattttttttcttaagatttttttaggctactagtcaaatttgtaatatgtatctgcattttgtaaaagataagataattaaagaataaagagcggggacatgcatgcattttgtgttaatctgtgttttacatcattatttcaaaacaattttactgcatagattttcttattttgttttatcagcactccatacatgcatgcggtaagtggggggtccccgtgaggattaataaaaataaaatatatgtagtttttttcccagtgtttatattattttctatttttctgaaagttctgaaaaaaaatatttttctttagatatttttaggctactaatcaaactagtaatatctgcattttgtaaaatataagatgaataaagaggtcgctgtgaagattaat

SEQ ID NO: 882 - DNA, 1050 bp, Diabrotica virgifera
  misc_feature (1028)..(1028): n is a, c, g, or t
cggacgcgtgggtacagttttagtttcattgaacaaaaataaaacttatcttacagttgtctgcctcttatcagctatgagtagtgaaggtacagattctccaaagatttaaataaattacttcttcgtccgaagtgttatgggtaacttgaagtcccagtgagtttgtgttttacgtgtacctaatgtttgtcacgctagaggtggagctattattgtgaaatgtccaatgcaaatcagtccaccagcaaaccaaaggaccacttatacaaaatcttggtaataggagaccttggtacaggaaaaacttcaataataaaacgctacgttcatcgatttttcacgcagcattacagagctaccatcggagtagatttcgcgttaaaagtactcaactgggatgaaaatactctcataaggcttcaattatgggatatagcaggccaggaacgttatggaaacatgacaagagtatattacaaagaagctgtaggagctttcatagtttttgatgtgacacgtaagcccacttttgaatctgtagcaaattggaaggcagatctcgacagcaaagtccagttacctgatggatcaaagattccctgcgttcttttagcaaataagtgtgaacagccaaaggaaggaattgctagcagtccaaccaagatggaggaatattgcagagaaaatggtttccatgcttggttcgagacttcagctaaagataatattaatatagatgaagcagctagctgtcttgtagaaaaaatattagcctatgattcagtcataaacagtgactcaaagcgttcctcagatcaattttctttaagacgagatagtgatggaaactcatcatccagaagaagttgttcctgctaaaaaaagagctaaaccacattgtgtaatattactttatttttaatagcaaatactattgttcaattcacttcttaaacagatcttctcatatgtaaatagtacccactaatcgcaaaacaagtactgttacacctatctcataatgnaaccaacataattcttagaaag

SEQ ID NO: 883 - DNA, 1700 bp, Diabrotica virgifera
cgcttagtaagaatttgtctgtcggatatttcatttttcgtcaacttgtgtcaatgaaaaccattgcctggttgtcaaagatgaattttgtaacagttactgtctaagtcatacatgaatgtgtacttgaatgtctaaaggaatcctggatctgagaaaatgtcctatagttgtttacactataaaagtttcattttcacttcgtgtttaatttttttgttcactttttcttctaaataacaaacaaaaatccaaactaaagagtttgttctctacatgctcgaaagtttttttgacagtggttttgggaacttcattggtacatgccattttcctgatgcagttatcgaggtttattgaaagttttgttttcctcgatgaagtcgttgcagtgtaacaaacacacaaacttattcgctgtgagccgatgagtagaggggatttgacagttttcgccagcgctgttagtggcagttttgtgcattgaatttgaacaattttatcagaaaagtacaagtttcacaccgcgagagagcgctaccgacgaaactcacagccagtaaaaacaggtaacctctaaatttcacataatcttcttctttttctcaatggcctcttgcttaaacagtcatccagtcgaacgaatgtttatattaaatattaaaattataatgaataaaaaaaatataattacttttactattaattctgtgtattcgttcagtaatcagattaaaaaaatatttcagttcgtaaattttgtgtttttctagataaatatctatttttctcgttttatatatttcacatccaccaattttatcagaagtttcaaaccgtgaggagcgctaccgtcgaaactcacagccaattgactcggcacaatgtatagtagagggaatttgatacctcattcgtacttttggtctgtatatcttctaaaatctttaaagaaaccatatattcagtatgcacgaacttgctcaattcaccaatgtcttaattagcactattatcctgtaacgatttaaactgactacgtgttttctcatatgcagtcgaccttaacaatttataggcaatcgactcaaaactacagctataatttgttgcttcgttattttttggaacgtatacatgaagtatctggctacaaaaactgagatcaaagacatagcggtggtgtttgtctttgtcctgcgttttgcaatctactcttatcctctctatcaagtaatgtttgaagagttaattgcttgcacgtaataaagcatatatttattaaggtgcgtgcagaaaatgcaacaatttattgaaccaagactaatgtgtaatttggcaatgtattataacgtcgtaagaacagaccgtatcgttgattgtttgttttctattaaactttgctttaaagcaaaaaaattttaatgttgcttcaaagcaacattaaaattaagatgccgtaagaacagagagtatcgtttattgttggttttctgttgaacagtgtcaaaactttgctttcaagcagaaaacttttaatgttgcctcaaagcaacataaaaattaggacaccgtaagaacaaatcgtattgttgcttgtcgattttctgttgaacagtggcaacacattggtttaaagcaccgaactttcactgttgctttaaagcaacattaaaagtccgacagtaaatacaacgcac

SEQ ID NO: 884 - DNA, 1266 bp, Diabrotica virgifera
  misc_feature (1221)..(1221): n is a, c, g, or t
gattgggaaaaaatatttcctccaattaaacccaaagctaagaaataagccacaagaggtgttgtacggtatacttttatacaatacgtttagtttttgattaggtataggcaactggaggaaacgctaaaatcggcaacattgcttagtccactatcgttgtttttgacgaataacaaccgacaaccgttaaaccttgattacacgtaacgagtgttgtagcgagacagtattctcggctgagtgctcgtttggtatagacatactaacgactacttggccgagcacccggctgtcatatggcgagacagtcactcggatcttattctatttactaggccgagtcttcgacctcccgcccttcaatcgtatatatacccaccaatccactcggtatgtgcaaacaacactcgccgtgtaactgtgcagattaccacttcatcagaggagacgacttgtgttaatcaatgtgatatgggattctcaaaaatagctaacagatggaactcagataggacaataaagtttagttcagttgtacctataagtcacacccgtgcttatgaaatttcaaatctttggaatataaaaataaacaagaaagtgatgcagcatatgtatcgattgtagaagaaataaatattgttggttttaaaactcaagaagtcaaataaaataaaaaatttaaattcgacatatagacaagaaataaaaaatcaatgaatcgaagaaatcgggagcagcgagagtttttcttcttaaaatccattgtctatagtctatagtccaaagatgcatattttatctccttctcataatttatccgtcaattcttgtattcgctgtgagccgataagtagaggggatttgacaattttcgtcagcgttgttagtggcagttttgtgtgcagtgaatttgaacaattttatcaaaaaagtacaagtttcaaaccgcgagagtgcgctaccgacgaaactcacagccaaaaaaaaacagaggtaacctctaaatgtcacataaacttcttctttttctcaacggcctcttgcgtaagcagtcatccagtcgcacgaatttatatacctattaaatattaaagttataatgactaaaataaaaaacataattaattttactattaattctgtgtattcgttcagtaatcaggttacaataatatttcagttcataatttgcgtttttctagataaatatctatntttctcgtttcgtatatttcacatacaccaattttatcagaaaag

SEQ ID NO: 885 - DNA, 2484 bp, Diabrotica virgifera
caatacgtttagtttttgattaggtataggcaactggaggaaacgctaaaatcggcaacattgcttagtccactatcgttgtttttgacgaataacaaccgacaaccgttaaaccttgattacacgtaacgagtgttgtagcgagacagtattctcggctgagtgctcgtttggtatagacatactaacgactacttggccgagcacccggctgtcatatggcgagacagtcactcggatcttattctatttactaggccgagtcttcgacctcccacccttcaatcgtatatatacccaccaatccactcggtatgtgcaaacaacactcgccgtgtaactgtgcagattaccacttcatcagaggagacgacttgtgttaatcaatgtgatatgggattctcaaaaatagctaacagatggaactcagataggacaataaagtttagttcagttgtacctataagtcacacccgtgcttatgaaatttcaaatctttggaatataaaaataaacaagaaagtgatgcagcatatgtatcgattgtagaagaaataaatattgttggttttaaaactcaagaagtcaaataaaataaaaaatttaaattcgacatatagacaagaaataaaaaatcaatgaatcgaagaaatcgggagcagcgagagtttttcttcttaaaatccattgtctatagtctatagtccaaagatgcatattttatctccttctcataatttatccgtcaattcttgtaggaaaaatcacttttcttatctgccatttctttcacatctctgtctgcttttggtcgacctctactgggaaaggtcaaagtttttccaaatttgaagaggttaaaagttaaactataaattcaaaaatgttttccagaattgtaagaccaactgtagtagcaactagaagcttcagcacatcaaaacagaacaacttcaaagtagcagtatgtggagcctctggcggtattggtcaacccctttctttgctcttgaagatcaaccctttggtcagccagttgtctctgtacgatcttgtacacactcctggagtagctgctgatttgtctcacattgagaccgcagctaaagtaaagggattcaatggtcctgaatgtcttaaggatgctttgaaaggcgccgacgtaattattattccagctggtgtacccaggaaacctggtatgaccagagacgatctgttcaacacaaacgccggaattgtaaaagcgttggccgaatgcgcagctgaagtagcgccatgtgcgcttattggtatcattaccaaccctgtcaactccgctgtccctattgcctgtgaagtactcaaaaaggctggtaaacttgaccccaaacgtgtgtttggtatctccaccttggacatcgtccgtgccaacaccttcatcgcagaagccaaaggacttaaccccaaagacgttaacattcccgtcatcggaggtcactctggcgtcaccatcattcccctaatctccagagccactccttcagtatcattccccgctgaccaacttcaagctttgaccgtaaggatacaagaagctggtactgaggtagtaaaagccaaagctggagcaggatccgcaaccctctccatggcatacgccggtgccagattcgccaactccctcctcagaggtctcaaaggagaaccaaacgtcatcgaaccagcctacgtccaatcagacgttaccgaagcctcttatttctccacacctctagtcttaggcaagaacggactcgagaagaacttgggtcttggaaaactcagcgatttcgaacaagatttgctcaagaaagcacttccagaacttaagaagaacatcgaagctggtgtcaagttcgccaaccaatagaataacatctaatgttaaatttatgtttattttttgttctttttgtattattttttcagtaaagtaaagggttttctagtcgttcgtgtaacggacaattttttatagccaaaattaacaactgtataagaagtagaaatctgtcatctgcatttctgaaataaataattgtttttaaaaaaaaacccacaaaaaagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggccccttaaaaaaaaaactgtttttcgggggggggggggggggattattttttttttggggggccccaaaaaattttttgggggggggtttttttaaacggggggggggggaaaacccggggggccccccattttttccctttgggaaccccccccctttttcccggggggagaaaaaaaaaaaggccccccccccccccccccccccaaagggggcgcaccttaaagggaaaaggggccccccc

SEQ ID NO: 886 - DNA, 830 bp, Diabrotica virgifera
tattccagtgcgagtaagtgaattattattaaaaagtttgaagtttctttctcgtttgtgcactttggaagaagtttcgaaaacagcaagtattaaaaatggcttttattccacgtatgtttcacgacaacttttggggacctaactgtcccagacgtagaccatgttctggaaatgtagcaggaaacatttcagaagatatcttaaactccatcgcaatagcacaagccatgtttggtccagaatatggcagaaataatcaagaagtgaatacaaattctcaacatagatcctctgttactgttgacaagaataaattccaagccaacttcgatgtacagcattttaaacccgaagaaatcactgtcaaggtaaatgatgacaaatctattactatagaagccaaacatgaagagaaaccagatgagcatggtgcaattttcagacatttcatcagaaagtatgtattgccagataattgtgatgttgacagggtagaatctaggttgtccagcgacggagtgttgacgatcattgcccccataatcaatgacaatgcagtaggacatagaacgatcccaattataagaacaggagaaccagttaatctccaagaaagcatatcaaatgaaggaaagaagcaagtagaagacaaagaagtaatggaaagttaaaagtagaattttgttaaatatttttatacacattaccacattataaactactaggatatgggattttatatctattttttatatacctacttcttatcaaagtttttgagtaatagtttttataagtttttttaataaatatttataatttagctt

SEQ ID NO: 887 - DNA, 1286 bp, Diabrotica virgifera
  misc_feature (1275)..(1275): n is a, c, g, or t
ctctacgcgtccgaaaagtttcaactcctgaggatcataagctcttttatacacttattaatggatctgataattgtaagaaaactggagtaacttataaagtaaacaaaggttgtaaaaacaaaaagaatccaaaaacttctattgaaagattagaagctccagaaaaaatgccacaaagtataataaaagaacttaaagttacagtagctctcgatatgattaataaacaacaaaatattgaaccacctagtacctcgcctagtaccaaacctaatatggtttctaacactaagaaaatagtagaaaataaaaagagtatgaaaatgaatgacacaaaacagagtcccagtcacgatgatttgcttgttcccaattcccttattccaccaggtattacaataacgaagatggatagttcaggtcgaagagaacaaaatgccttgctgaaaaatgacatcgggtcaatggtaacagttgctgaaactgaaaagcttcttcgtaaggggcaaggtaataattctccttaccgggaacctgtagattcaaagagaaaaacgaaaaagaaaattaaaataccacaggatactcagttatctaccttaccaccagtgaaagaaaaaaccgtatctctgactccagaaaagaatatgatatttgatcctttgaaatctaagtttggacaatttgatgtaaatgcgaaaagttgtaatcctgctataatttttactaacgaaaatggtactgttacggttacaagaaattctcgtttacaacaatcaagttcagatagagaccgtgtagtgtcggtccctttgagaacaatctcaagccagatcaagtatccagaaatacagaagttgccaatatcagcagtatttactaattcccaaacacaagacccagcaggtcttcttcaggctcaagaaattctttctggtttgcaggaaattcaaattaccaaggtcgataagaaaaatattaagcctgaactaaaagagaacatatattgcccaagggatcagataactatcataccagtgtcaaaaaatggaagagaagcgtttcatttcgatgaaaatgattggttatgtgatagcgtggtttcacccgaaagtaaacctaaaaaagtaggacaatgggacccgagagcattagagcttgagccttttatgctttttcatccataacccatactttctcacaaccaaacagggagatacctaactattgccaatagtacccctagtgtaaataatgtagatttttataagntactttgtatt

SEQ ID NO: 888 - DNA, 1453 bp, Diabrotica virgifera
cggacgcgtgggtttaaaataaggttaaaaattattttttacacaagttcaaaatattttgccaattccttcgttccacattttctttaaaaacaatgggacggagaaataatcgatttagaaagaatcatcacttcaatcatggtaaaaagggagaagagtccaataaacaggcacatgtagatactcgcaaaccctacaatgacattataagagaaaatgaaaagttttgtcagtattacaagagagttggagtttgtaaagaaaatgaatttgatcagtttatttcctgtttaaaaactgacctgccagccacttttagaataaccggttccaaaggtgttgcaaataagcttctaggaatcgtagaagaacaactaattaaacattgtgttaatcaagtagatgggactgaacaaccaagtatttttcctatcccttggtatcctaataagctggcatggcagatggaattgacaagaaaagatattagaagatgcgaagcctactacaagcttcataattttttaatatcagaaactgaaaatggtactatttccagacaagaaactgttagcatgatacccccactggttttagatgtacaacctcatcacaaggttttggatatgtgtgctgctccaggttcaaagacagctcaattattagaacttctccacgccaatgaagatccaataccatctggatatgttattgctaatgacattgacaacaaacgttgttatatgttagttcatcaagccaaacgcttgaattctccatgtgtagctgttataaatcatgacagtgctattttgcctaatttaactacaactgcaagtgatggatctgtggaacaggttcaatttgacagaattttatgtgacgtaccatgttctggtgatggaaccttgagaaaaaaccccgacatatggatgaaatggactgcagcaaatggtttaaacttgcatggagtgcaaaccagaatactaagaagaggagttgagctactgaacgttggtggaaaacttgtgtactcaacttgttcgataaatcctattgagaatgaatcagtgattcacaggcttttggctgagcacgaaggagttttagagttggtagatgtatctgaagttttaccaggcttaaagtattcaccaggcatggaagactggttagtgtcgagtagaaacttggaattttatgaaacgtttgaagacgttgatgaaaaatggaggaccacaatcagacctcagatgtttcctccaaaagccgaagatagagaaaaatttagattaaataggtgcataagaattttaccccatcaacatatacccgatgcgttattttgtagccgtcttacgaaaacttaaaccgtaaactgcgaaggacaaatcaacagtacgagaacaggaggaccaggacgtacaggaaatctaaaaacgtgaaaatg

SEQ ID NO: 889 - DNA, 1363 bp, Diabrotica virgifera
cttagaaggagcagatctaggactacttcgaacttcagaaagccttggagaagtatttgtgagaacggatcaactggatggagaaacagattggaaattgagattggccgtaccagtcactcagaaattagcttcagatcgtcaattatttgaaattaatgcaagtatatatgccgaaaaaccacagagagatatacattcatttatcggaacattcagtaggcttgattctcttaatggcgatgaaagtttagatctaaacaacactctatggacaaactgtgttattgcttcaggacaagctacaggagttgtcatttatacaggacccgaaacaagatctgtaatgaacaattccgcgcccagatctaaagttgggctattggatatcgaagtcaataccattactaaactactattcgcagcagtgataggtcttgctttaattatgatggctttgaaaggatttagcggtccatggtacagatacatgttcagattcatattattgttttcatacatccatttccaattaccttgcgagtgaatttggacatgggcaaatcgttttattcatgggcaataggaaaggatcctgctatgaaagggactgcagtacgttgcaccacaatcccagaagagttgggtagaatctcttaccttctttccgacaaaactggtactctaacacaaaattctatggttctaaaaaggctacacatgggaaccgtcagttttgcaactgacagcttcgacgaggtcggcacattattacgcagttcttataataacgaaaatgtaaaagtaaactctgacaaatttagacgaagtgaaaatacaagaatcaaagatgcagtacaggcgttggccttatgtcacaatgttactcctatgtatgaaaccaatgaaaagaaggatactgattctggatcttttacttctgaaactgaagcagatcaacatttacaaatgccagataaggatgtcacgtaccaagcttccagtccagacgaagtagctttggtccattggactcatcaagttggacttacattgagcaacagagatttgaactcgatgcaacttagaacccctaatggtagatttatgaactatgccattttacagatatttccttttaccagcgaaactaaaagaatgggaattattgttaagagcttgtatacgggagaaattattttctacctgaaaggtgccgatatggtcatgtccgcaatcgtccaatatacagattggctagacgaagaagttggaaatatggctaggggatggtttgagaccattagttgttgctaagaaaatcttacagaagagcatattggggatttgaggcccgttatat

SEQ ID NO: 890 - DNA, 990 bp, Diabrotica virgifera
attatataatctaaaaaaacattaatactgtacaattaaatttgacttaaaaaatactgggttccaatgcaaactctaaataatacttgctagacttcgacttatccaagcaataattattatcttcaaatcagacaatcacttaagtttgtaagggtttatcgtatgtattaattaatatatagtaaaaattatgatacacgatacatctttttcttgaattacaaacggatcctgaatgcacttaaaaaatcagacgatttatcagttatatgttcaaattctgcgaacgaaagagacctatcgtcgtcaaagtcagcttcttccaaaatattttcaatcaacgtgtcgatttccgcatcagtaagtttatattcaccagttaatgttctaatcacttcttgtaaatccgatttacccaacatatcgtcaccatcaaaatcaaatatacgaaaagcatgttcagcttttacagatttcggagctgtttcgctaaacactgacatcatatccaaaaaatcttcaaaagtgcaatggccatcatgatttgagctgaaaactttacatatgcgctctccaaatggattcacactcagttcgggatataataaaattttttccatgggtagtttggcatttttattatggcctactttctctggggccagagctttaaacttctgatgagcatgcaagacttcctttttggtaaaatatgttagatcttggtaattctgcagttcatcatcagtgaattggctttttgcttgtcccatttttttgttagtctagtctaaactctgtctttacagtctagtattatctacatgtactatgtactgtcatgtatattaaatttaataatcgtgtaaattctttttattgctcgataaaactgatatgaatttataatttaaataaagctgttaaatgaacaaacaaggaataagaataaatattgagcaagataggtttaacaaaaattaacag

SEQ ID NO: 891 - DNA, 885 bp, Diabrotica virgifera
aggccgcccttttttttttttttgatttagttcctctgcaagctctaaacctaagaaagaatcttcaaaaatgtctttcgtatcatatatttctgaaacacctgttaaaaggtcagctgaagaacacgaagaggtggtactgtctcctaaaaagaagtccaaaaagaataaacagaaaaatgaagaaagtacagtagttggcatttcaaatcctagttttaatcccatgggcacaccagttaaggttgaaagacattctttaaatcccattgaagaagtctcaactgaaattgaggatagtttaaagaaaaaaagtaaaaaggaagataatttagaatgctccttagataatttagaggacagctcaagaaaaaagaagaaaaagaaaaagaatacctcgatagacactagtgaaggtgctagtgaagtcgtaacaaagaaatctaagaaggttgaacaaaatttggaaggtattgcaaatccagcctttgctcccatgggcacacctgtgaaaatacaaaggcattctttggatgtaattgaagaaagtatcacagaaatagatgacagtatgaataattccaatagcaaaaagaaaaataatttatctactaacatagaacaattaaatgatgaatctgtagaaagtgttaaaaaatcaaaaagaaaaaagaatacgaatgatgtttgtgagttcaataatcctacattttgtgaaatagatgaaaatacccaggcagcagataccgaaaacaattcctatgaggtatcaacaaagaaactaaaaaaagaaaagaaaaagaaaaaaatattggtaatacagatgaaacaattaataccgctggagaaattttcataaataatccaaactttgatgcaactgaa

SEQ ID NO: 892 - DNA, 1026 bp, Diabrotica virgifera
  misc_feature (861)..(861): n is a, c, g, or t
cagcaagccaattataggttagatatatgtgtatctgtatgtgtatgtaataagtctgtaaaatcacattctataaaaaataataatctgtttaatatctttcataaataatggctgcattaaaactgaaaaagaaagaaatgaaacaaaaaaaggtcgcaaaagatcccaaaacaaagaaatctaccaagaaagtgatagggtactcaaagaaatcaaaagagaagttaaaaattaaacagaaaccatctaaacatgttgaaaaaaatatagatgtagaggttgaagaagactcagacgattgcaacatttgggaaatggatgaaacattaaatgacagtgatcaagatgcaactgtaaatgatgatcaggagaacatagaagaaagtgatgaagaagattcagcagaaaagcacaagagggatttagaaaaattaaaagaaagtgacccagaattttacaagttcctgcaagagaatgacaagaaattgctagaatttaatttatcagacgaggaagatggggaagcaggtgaagaaaaagtaggtgatgatgatgaggatgatgatattcataagcctagtgataaactgtcagtagcaagtgatgagagtgattttgaggatgaagataatgataagccaaaagattcaagagtgataactcttaaattattaaaacattggcaaacagaaattcagacagataagagtaacaaaacaataattgcagtgacacatgccttccatgctgctctaagaacagttgtaagcgaagaagaagatcaagaaccagctgaatataaagttgaaggttctgctgttttcaatggagttatccaactctgtgtgctagaattgngcccagcagtacgaagatttttaggtctacaagctaaatcaaagcaacctccacataaatgcaagaagtttataaagataaaaaagtatttgaaggcatactttacagatatattaaagcttctacaaagcgtacatcgtcaatatacaaacagtgcttttaaag

SEQ ID NO: 893 - DNA, 840 bp, Diabrotica virgifera
actagaatacacaatgcggttgtttttgttcatccctacactactgtccctcgcccttgacactgttcaaggtggagggctgggtggtgttcataacgacctaattcccccagttccatcagccgtatatggagttggatttggtccaggaggaggaggaggaggaggtattcatggaggaatatccgttggtcatggctcgggaggaataggaggaggaattagtattggcggaggatttggtacaggaggtggacctggttttggaggaagtggatttggaggaggtccaggatttggtggtggtcacggatttggtggtggtcccggacttggaggtggccatggatttgatggaggatctggatttggtggtggccctggatttggaggtggcgctggatttggtggaccaggactaggaggttttggtggagctattgaccctggatttggtggtgctggtcctgactttggaggaggaccaggattaggaggaggttcaggaggtcctccaactataatagaacatactgaacatattaatatcgcagtaccgaagccagtacccattccagtagatcgcccagttccagtcccagtagcagttccccacccagtaccagttcctcgtccagtcagagtgtaggtcccgcaacttgtaaaagtaattcgttcctagaccagtaccagtaccaatccccaaaccatatccagaaccagttacagtcaaggaaaacatcaaaatacctactcccgtaacacagtgtcctgtaccaactgatccatccagtgtttttaaacatagtaaaggtcaagtaacccctacccccataaaag

SEQ ID NO: 894 - DNA, 944 bp, Diabrotica virgifera
ataattttttggtcagcaatagtgccaacagtgactatgctaagaaaaagttttttggtgctagttgtaataattgttataagtgatgtggaagcatataggatcttgggagtttttcctcacacaagcaaaagccacgctaccatatttttggcggtaatgaaaggattggtcgaaaaagggcataacgtaacagtggtcagtactcgaacatttgacacggatcgtaacaactacgtgcatgttgacttaagtaaggatataagagtaacaatgggcactgtaaacataagtatcgtcaataacgataaggctcttactagataccttacagcataccacttatttaatagaaatatagacaagtgcgaaaaaggtttgtcctcgcccacttttcagaaattcctaaaaacgagaggagaaaaatatgatgtagttatattcgaatattttgctgtggattgttttcttggagtcatctcaaagataaatgcacctattataggattaagttcaagtacattgatgccctgggttgctgagcgtatgggcaatcccagcaacacagcttatgttccgaacaacttactcgcgttttcagataaaatgtcattctggcaaagaatggaaaatactgtgatatccattggtcataaattattatttcaattttataagctacctagagataagaaattggcaagaaaatatattggaaaaaaaggatcgaagttggagaaatttttgtataattctagcttgttgctgtccaatacacattttagtttgaatcttcctcgtccacttgtacctaatgttatagagatcggaggtattcatattgaaaaaccacatccattaccagagtatctgggaagatggatagaaagctcaccaagtggtgtgatctactttagtctgggcagcctttatcatggtcagtc

SEQ ID NO: 895 - DNA, 910 bp, Diabrotica virgifera
  misc_feature (843)..(843): n is a, c, g, or t
cggacgcgtggggctcaaaatacttatatcctccttcctcctcgtgggaatctcccaagcaactcttttaggaagacaaggaatcctagcacaaactgctaataaacttggcatcggcaacatcattagcgtcaacgctgacgccgaagctaaccttttaggaaacaaagtaggagttgatggtgcagttggcgttggtggccaaggaattggggcccacctctcaggagatgctgatgttttgggacagaaggttaatgtccatggtgatgtgcttgagggacacgctattgaccaacacaaccacgaagtctttagagacaacagaggccgtcaatacacccttcaacgtcagtacatcggttccaactccgtcttggtcagaaaatacttggacaatggacaaatttacgtcgatggtgcagaccaagataatgtattgcaacattctcagtccggtagggttgtaattagcggaaacagtggctccaatggtggatatatgcaacaaggaggacttcttattaatcgagtaccaaatataaatgttattgctacatctagagatagggacgcaacagttcgtataccacttacaggtcatttaccaaatggtattttagaactagatcccggtttctctggaccatggggaaatatgaaactagatcccggtttcgcaggtccatggagaaatatgcttttgaatattaagagagtatcacctctagagtggcaagaatggctgcttgaacaaaaacaaaggaacagaaaccttgatttaactcttattgaacaatggattaatcaacaacatttattattgaaggtagacactacagntatagaaggatggatcatgcagcaacaaaaatctaacccctaacttctttgtataactggatcatta

SEQ ID NO: 896 - DNA, 1198 bp, Diabrotica virgifera
gcacaggttgattaattaaattgttacaatatgaagcttttagtgatatcggttctcctcctcgtgggagtctccaatgcatctcttctaggaaaaaatggaatcctagcaaacacagctaatcaacttggcatcggcaatatcattaacgtcggtgcggacgctgaagctaatcttttaggaaacaaagttggtgttgatggtgcagttggcgttggtggccaaggaattggggcccatctcgcaggagatgctgatgttttgggacagaaggttaatgtccatggtgatgtgcttgagggacacgctattgaccaacagaaccacgaagtctttagagacaacacagggcgtcaatacacccttcaacgtcagtacatcggttccaactccgtcttggtaagaaaatacttggacaatggacaaatttacctcgatggcgcaaaccagaataatgtattgcaacattctcaaagcggtagccttgttattaacggaaacagtggctccagtggtgtagtgatcatcggcggaaatcaaggacagcaaggaggactcatcattaacggaggatcaggttggccaaccacaaatataggagtagagaccggtctcgctggtctactaaggaatattaagagagtatcaccgctagagtggcaagaatggctgcttgcacaaaaacaaaggaataaatacattgatctaacgattattgaaaactggatcaatcagcaacatcaattattgaaggtagatactgcagttatagagggatggatcattcagcaacaaaacttaaaccccaacttcttgtataactggatcattaatcatcaggttcctaatattttaggcaacgtaaggcctccaattgatcaaggttggaatgggacattgagacccgccaaaagcattctccaaaagttgggcaaaatggggaattccacaaaaaataaaaaacaacccttgttttaatggtggttcaaaattggattctacccaccaaaaaaagggatttgaattttgaagggtggacttttttgggggggagggggtcttttccaaaaaaaaaaatttggaaaccctaaattttttttttaaaaattgtggaataaaccgggaaaaaaaggggttccccataaatttttttttcgggcgggggggatttccccccccccccacaaaaatattttcc

SEQ ID NO: 897 - DNA, 713 bp, Diabrotica virgifera
gggtcggccacgcgtccgcccgcgcgaccacacaaaaatgaagattgttttattagttttgttcgctgcttgtttgtcacaagccaaaataaatcaagatatacatttcgattgggtgcagtataccggagaaataccagagaatgctataataggcggatcaactgctgatggtgatccaacgtatgtagcccgttccttcctcagtgcagatgaagatgatgaaaattactctggaagtgactacaatggttatgtagctggtggtgtgttacctggaaaattgtcgatcgacctttgtactccgcagagtatatacacgctcacaaagaacattgagatactgactgtggtcaatggaacaaaaatcgaatggattaaatcttaccagcacacattcatggacctcttcaactcagacgactatcgtcctgtaaggatcggctggctagcaaacggggaaacgtggaactccactctttatttgggcagctctttaggcgccggtgtcgaaaccattggacacataatgacatcggcaattccaacatacaataatcaacagaattggtatccattttacggaagtcaattcggggaccttatgtataaagtattagtttattatatttaaatacttaaaaagtactctttttaataaacaatatgaaattatgtaaaaaaaaaaaaaaaaaaaccccaagggggggccc

SEQ ID NO: 898 - DNA, 1092 bp, Diabrotica virgifera
tccacacccgggccgaataatttctattttggttttatttttaatacactcagctaccagtgctaaaattttaagtgtcataccatccgcctccaggtctcaccatttaccattccaaccattatggcgagaattagctctgagaggtcacgaagttacagttgtaacaacagatccacaacgaaatgcctctatagagaatttaaaggagatagataccagcttctgctacaagatatacgaaaaacataatgtggtaaatgccatagccaatgaaagcctgagttctttggagaaagctggtgttctacgtagagcatttttagaatgtgaagattaccatttttccttaccgccaatcagagaaatgataatcaataagaaaatccactttgaccttttgatcgtggaagctcagttaccaagtatgctagcattcagctggagattcaagtgtccagtcatcgctgtggcctctatggaacctgctcttcagtaccacgattcattaggtaacccagtccacccggttatcaacccagactacaatttggacgtgatagattctgaaaatttgacttttaaggaaaggatgttgagttttcttccagtcgtgatatataaataccatatctacaacagggcatttccggcgtaccacgagcacgtaaagaaatactttggaaaggatttgccgcatttgaaagaactgcaggaaagtattaagcctaatgtttattgggtctcatcccttggtcccaaataataaaaccttaaaacttaaaaaccgaaaccaattggagggaggaagggtaataaaagctccccaaaaaacttccaaatgaccctcaaaaaatcctggatagaagaaaaacggggggcctctattttcagcctaggaaaaaaacgtaaattctaatttccgggcaacaaaatttcaaaaaagcggggaaaaaaagacctttggccaaaagtctctcctaaacggggcggggaaaaaaaaggcgggggggaaaaaaaaagggatgggtcccaaaaaaagggtgtggggacaaaaaaaagggggtggccccagccaaacaaattttttgg

SEQ ID NO: 899 - DNA, 821 bp, Diabrotica virgifera
ccccccgggtccgaaagaaacgtcattttttagagtctaaagtagacttccacatgtaatattttgattaattttgtgagagtgagagttatcaaagttcaagtagttacaaagatggcatttagacccctaactgaagcagaatgtggccaagcgaaccccttaacaaaattaacttcgcacattacccgtgatcacacattttctgataatcatgggcaagtttttcaaagtagttcagaccaattggttgaacaatttctccaggaaaccagagccattcctcaaagttataggatggacgatttgatgagggaaatgcacgaaattgaatctcaaaggtcagctttacctcccattcctgcttcaacagtcaaagatcagctgcatgacaatgcctgggctcttcagtatattgaagacggaaaacgatttaatgaagtttataataatgaaaatgtctgggcggaaataatgtcacaggaacagagacaacatgagtttcaaagattagctgacacatgggcaagtcaaggtttagagggcccattagatgcttcagaactattttcacaggaagataatttagaagattcaaaatatgtttattcaaagtttatgaaatttatgaaagaagaaggcaatgactccaagattgaagaaggaaaactgacagaacaagaagctgctcagtggaccaaggaatattttgacacagatgaaaaaccagccaccaaagttgaaacagttgctcaagagtggtctgaggaactcgaaagaaggtttgtagatgaccgggaatttacagtgcgttttgggat

SEQ ID NO: 900 - DNA, 995 bp, Diabrotica virgifera
cataacctacctttgattcgttgatatttagaatgcgcgttttttctagccaatcaaatacacgtattacgaacatttgacaaaagcttcgtccattttggccattttttagaagtgtcaaagagtcaagtgacggttattattcaggtcagtattttgtgtacctgtcattttgaaatttcgaattcgacttcacttgtgtttcacaacgtctttgtgcattattttgtgttttggtttagaatttagttcgttaaaagttagtcattggcgtgaggagactagagacattcgatttgtaccgaagagtgctaaatatctcatgagtagatagaatagccaacgtggaggtaatgagacttacgcataaggaacgagaactaacaaataagaagaaaactgagatatatgggacatgtgatgagagatgaatatctaatattccaggtcattatgcaagagaaagatccatagtaaggagacgtaactcatggctgaagaaccttaggaactggtttggatgtaataacaatgaattatttagagccgctgtttcagaaataaagatctctctgatgattgctaactttggaagcggagacagcacctagagaagaagataaaaacacagtttatggacagttttgtgtcattttttaatgtttccatatttataaatttaattaacaatattgtttactttttaattttattcccctttataaaaatacctacatgttaacatattgtgtaaaaatcaaatctactaaattactaattagtttaattccacaagcttttcacctatggcttaagtacgattgtggcatctgtcagattcgtcaataattacatgaaataagtctcgagacaaccactcaattatatgacgttggacggtcaatattcaatggaccccccgggaaggggggtcctggagaacaaaaaatacttctccgaaaaaacgggggtttgtcacctggctaacaaaaata

SEQ ID NO: 901 - DNA, 453 bp, Diabrotica virgifera
ctataatcacgggtcatagtatcaggtaacgacaacagcgccttttaaaatgcgttcttggtacaaattgtgacgttattgatacagacaacaaatttgcgtgagcctgcaatgacagctggagttgaatgtgaaaagcagtgttgtcgttattgacggaagttcttgaaactaaagacttttcacataatttgtacagtctcagtgcagctgtcagtgtagtcacgtttatttctaacgtacgctatgagaattatttaaacgtatgtcgtgtatgttttttacggatcatttccacatcaaactggaggttggttgtcggtatttgagtgtcagtgtatagcgacattgatggttctgacaaatgaagcgaaagatgaaaatagcgattggtgacttaatgtagttgacgtagcttgtgattaaagatagagaaagttaacggggatatat

SEQ ID NO: 902 - DNA, 1595 bp, Diabrotica virgifera
tgcttatacagaggaacccagtaaacataatgaaacggaatcctagtcgtaattcataaacaaattatattcctgataatgtgtaatcaaagagataagagataagtgtactacagtaagtatagctattgatcatgctgtgtctaaaacctttaataataatcacctatgtggaagtttaagaaaaaaatgtcatttttttaataaatgataggagtgcgagaaaggcgagatgcatagaagtgtcactttatcggaaattgtttcgtccacttttacgaacaacgcggaagacaacagcaaaaacagaaaggaaaaatttgttacgaagatcgggataggactaactgagcttttaacctcatccttgtaccagtgttatggaataatctttgcacaattggttgatgtgggccattattcgatagagaaagcatcatggacaacgttttttatatatagcagcttggaatctgacagcaccatggtcaaaattcttaataaatcaactggaaaaaaggcagtgcttcccatacaaaataataatatcagtatgtactctattactggcagctggagtcgttattcctcctcattttattatatatggaatatttggtggcaccttttccaatataatctacactcatctcaaacatatagcaagaagaagatacaagagtacagaaagatccttcgaaggtaacatacagtctgccagagcgataagcttgttggtcatgccgcatgttgttctacttcttattggtaattacaaaatacagtatgtttctttgattcacgcagccatcattctaaacattattcctgctactctgattataagactgccgaaagttgatcctgagaatatgcctggatatagccgttaccaaacccttccaatattttctcaacaaatgaaagaaatgaaagtcttcacttcttccagtcatacttcggacatcaagcgtagcgaatctttttctgtgaaagaagaaagttcttgtgatgaaacggaaagcgaagaagaaactgaggaatcggatgatttactgatgcaagaagaaatatggcttttaccgatagagttactgagggatatttaccagttttaacaccaattattgtccagttgtactataacaatggttggcgttagtatctttaccgaaatacctgaagaaatggatgattttgaaaaaacaacattaacgttatagaatccaagcgattaagcaagataagaactgcgttggaaagaaataaatagaacagaaaagaaaaaaaaggggtaaaagaaacttgaagttttggactgaaataagttcttaaaccctgaacccattaataataatggaagattttcctaatttataatggaaaaaccgaacaaatttttaaaaaacgttgactttgggcaaaaaaaaacccgggcttgggtttgttcctccttcacaaaaatttttttgggggggaaaaaattcgggggccttaaaaaaatttttttttttagaattttttttttttaaaccccttattttaaaaacacccccccgaattttttatttttttcccccccctttttttttttt

SEQ ID NO: 903 - DNA, 453 bp, Diabrotica virgifera
cggacgcgtgggcagtagtagtttcgtgagtacctctacctagcaggagctgcaggaatatttaaaaatgcccaactgtccaaagtgtgagaaaccggtttacttcgccgaacgtaaaacatcccttggtaaggattggcacgcagcatgccttcgctgtgagaaatgcaacaagaccttaacccccggtagccacgcagagcacgaaggaaagccttactgcaacaacccctgctactcagccatgttcggacccggaggttttggacgtggaggagctgaaagttatgtctacaagaagtaaatcgggagtatcaggagttctagattttaagaccatttttgtaataaaagtattatatttttttcttatataaatttctgaacaggtacaatatgttgacaaagcattccatgtttttgtattcttgttttcgggaataaagttttatt

SEQ ID NO: 904 - DNA, 513 bp, Diabrotica virgifera
  misc_feature (503)..(503): n is a, c, g, or t
  misc_feature (507)..(507): n is a, c, g, or t
ccaaacgtccgttcaacgacttgaacaagtttccaacatgaactctttggtaattcttgctttcgcctgcatggcagccaccgcctctgcctccgtcgtcggcttgggctggggagcaggattaggaggtttgggatggggccatggtgccggtatcatcaacccccacgctcttagcccaattggaccctctggaatcgtcactggagctggagctgccggtccatccggagtagtaactggagctggagccgttggaccctctggagtagtcaacggacacggagctgtaggaccaactggacccaatggtgttggtgtttggggagctcccgctttagctttgggacatgccggtttaggtgttggcggatggggacatggatggggtgccggacactggtaaacgaaaataattacaaaaaagaagttgttttgttgtgttttgtataaatagaactgaaaaatacaaaaatttaaataaacgttgtacatacattaanaaangaaaaa

SEQ ID NO: 905 - DNA, 956 bp, Diabrotica virgifera
gccaacaggtggacttagtattagtgcagtcgtcttatttgggagaattttcgcaaaaatggctgacgagcatactcgactcactgagcctgtttataggagccttagcatagacagacgggacaatctaaaaaatggaaactcacaagagaaaagaagtcgctggtttttgtacatgtctgctattgtagtgaacctactaagcttcaccgtagccagcggcttcagttggacctcctccgccctacaaaagatctcctccgacgacatgtcaataaacccactaggcaaaccagcaaccccaacacaagaatcatgggtggcgtcgctataccccttgggcgcagccgtggggccattaatagcaggcaaattatgtgacactttgggaaggaagaagaccatgttagcaattgcagtcccaaaattaatttgcttggtcgcggtatgctttgcgaatgatgttaggatctattatgccgctaggtttattatgggtatggttttagggacctcctttgctatccttcctttatatttggccgaaatttccgagatacataatagaggcaccatctcatcaattttcagcgtggctctaaactgtgggattctctattgtcttctcataggtcccctttgttcgataaaacttctaactctcctttgtactgtccccttgattatgtttatatttatcttcggcttatttatacctgagtctccggtttttctagtagctgtaggtaagcataaagaagccttgaaagtactacagagggttagaaacacagatgatgtcaaggaagaactacaagagataacaaaatctttggaatacacgcagaagaaaagaaaggagtcttggatctgtttaaagaccaacatctaaggaaaggttttgatcataataagttggggtgggaaaatgcttttgcaggtcccttgggaatcaa

SEQ ID NO: 906 - DNA, 958 bp, Diabrotica virgifera
  misc_feature (763)..(763): n is a, c, g, or t
  misc_feature (814)..(814): n is a, c, g, or t
  misc_feature (863)..(863): n is a, c, g, or t
ctcattcaaaagtcaaaaagtcaaaacagtgtgcgaatttatttaaaggactttcaaaaaatgaaagaatgctgcgcaatttttccagtttgttaactaacagaccaatcatcctacataatcgaaattttacttccatagaagtttctactgctttgaggcccttttattttgctgttcatcccgatttatttggaaagtatcctagcgaaagggctacaaatgaatcatcattacagcagttgagttccattttagagaaaattcaaaaatcgaaatctgttcctcctgtcagcttaagtttctatgttaaagacaaagcaaagaaaacagacaaatttcgtttcattaacatcaacatacagggtaacgatattcgaacaacattgtgcacaattctaaaaagctgtgatttaccaactgattatgtagatagtattatccctccaccaccaccatccgcagataataatcctaacagcccaaattttaaattcagatacaaaaatgagattgatcttacgaaagtcaaccaaaatcatcccatttatgcacatatcaagatgcagatggacatgaaaagggcacaagaactgttaagactgagaaactatttaaagaaatatgctccggaagctttgaagaagtctagaaagggagatatccatagggaagaagttaaaaggcttcaagaaataattacaaatgagcttcaggtggaagaattgcgttgggattgtagttggaatgaagaacatcgtanaggatgtttactcagttttatgtctctagtaaaccaacatgccagtattanagatgtcttaagaggtagagtgctgatattttcctcattttttactggntgtagtcttgatggacacatcatgctgtacgagtggagaaagtcgtcataactgggtagatttttttaagaacattgacagatatgatgcagctt

SEQ ID NO: 907 - DNA, 1044 bp, Diabrotica virgifera
gtcattcgtaccaaaaaatttcaaaacattttggcaaaaataaatatacctattatattattaaaaccatataagtaacaggaaaaacgccaccttctcatattcgtattccaaatgtacaatactcttcgaaaaatcattttgtaaaaatagaaataaattattttcagtattggcaattgaagatgtaaaatggacatagtctcaataacacttcgttgcaatgttattccagtcgtttctagattacttgtagcacgtagaaattacgcaagattggcagaagttggtaggttagaaacaccaaaggtctctgggaagtatgaaacaggacagctgattttgcatagggtcttcggttatagaggcgttgtactatttccatggttagctcgagtttatgatagagatttaccaagtcggaatgaaggagatgaagaggcgtctgcagcagtgggtaaagaagtcagaggaagaacacataccttttatcaagtgctgattgatcagagggactgtccctacattagagcccaaacagaggctgtaacattcttaggtaatcaagattcgtccaggagtttatatgcaatcccaggcttagactatgttgcccacgaagatattatcccctatgctagtgcagaaaagacccccttgaaccatgaactttttgataaattcttaatggcaaatccaaaaggtgatcctccgtttgttgcccaagaaacattaaaagcatggcagaacaaaaatcatccttggttagaactttcagatgtacacaaagaaactactgagaatattagagtaactgttatacctttctatatgggttccagggattcccacgcaagttcagtatactggtggagatattgcatccgattagaaaacctaggctcccttagcgtgcaattgagagaaagacattggaggatattttctttatctggaaccttacagacagtaagaggccgtggtgttgttggacaacaaacggcttttacaagagcgccttccagcttttcacgatagcaacca

SEQ ID NO: 908 - DNA, 1395 bp, Diabrotica virgifera
  misc_feature (1099)..(1099): n is a, c, g, or t
  misc_feature (1177)..(1177): n is a, c, g, or t
  misc_feature (1337)..(1337): n is a, c, g, or t
ctcatagagcaaaagttgaattatctggtcaatacattggcaaatttcagtgcaaaattggatacggaaaagctactccaactacaaaaatatgggttggtggtttaggaccttggacatctattacacagttggaaagagaatttgatagatttggtgcaattaagaaaattgattatgttaaaggtgataaccaggctctgattctttatgatagcattgatgctgccacagcagctgtgaaggaaatgagaggttttcctctaggtggaccagagagaagattaagaacagattttgctgatgtaacacctggagttacatacagaccaaaacctccattgcttctgcagaagattatagagctagagaagtagaatatgattatgattatgaaagagatccatatagaatgagaccttatcccgaaaaaagaggaaccagtagagatccttacaggtacccagaaggaagagaggacgagtggggtagaagtagagatcctgaatttgaaagaagacgttctggatcaagaggatttgatagatctaggtctagatctccaagaagatccccagattcagattctgatggtggttctcgtagagcaggtctactagcatctagtcgtactttaccagaagtagctagaaaatgcgctactgtatggcaaggagctttaatactgaaaaattcactatttcctgcaaaattccacttatttgacggagatactgatatagtagatagcctaatgaaagatgaagatggtaaacaccaattacgaatcacccaaagactgagactggatcaacccaaattagaagatgttcaaaagagaatatccagtgctagttcacatgcaattttcttgggactagcagggtccactgcatcagtcactaatgatgatgctacagttcaaacaagacctttgagaaatttagtatcgtatctaaaacaaaaagaagctgctggtgttatttccttactcaacaaagagactgaagctactggggtcctttattccttccctccctgtcagttttctacagagttattaaacgtacttgtcctaatttatcagatgaagcgatanagggagatcatcttataatagttgtggtacgtggtggcactgctttagtatttttatcaacacactaattttaccttntgaacatgtaagaaagatagtctcatattttgagtaatatgctatagtttcaaatgtttgtattccagtattgatatacctcaatataatatttagaaacacaacggttacactgaagtgtctgtatgatacttgatgtatagatatctactttgatatntactcatttttgtattattattttgatgaatgtactcgttgtgtctaattttagtaca

SEQ ID NO: 909 - DNA, 1292 bp, Diabrotica virgifera
gttaacacgaatatgttgtctttgaaaatagcagttgctattttgtcacttgcgggcgttactatcgcacaggatttaactcctatacctggtggcaaaagtgaacagactgtttcagagaaaacaccacgtattatttgtgttgttggttgttgcatcttttatcttcgatttcactcggttctggttcaactgtcatttgtaaggttatctttaagactgaaacatcgccatgcttgccagaaacagaatcgcatttttgatacaaaactcgccaaacggaatcatcgcactccttccaaactctttaggaaataagagaacatacagtgtccaattgaataatcctagaaagagaaacgtagtccgaagtaatgaaagagttgggcagtttgtgagaaacctcggaagtggaattgtcaagtctcccctgggagacagtgagccggtaccaaactcaaatttagtggagtatgtgtttgaaaaaagtgacgaatggggcgacgaaatagctgcaacatgtgcggtatcgggcagaaactataccttcagtatgttgaggtttctcgtcaacagattcgctcaagcggctctatctcattgcgcaatgaaaccaagagaggttgttggactgttattaccaaatatacctgaatttgtgatagtatgtcatggagccatggaggccggactagtagtgactttcgttaatcctttgtacacacctgatgaaataaaaaggcagttccagaacgctggcgtaaaaatgattatcacagtaccattattattagaagtagcgacaacgatagcaccttcattaacaggttatagaactacagtttgtattgggggagaagacgatatatcaaagaatgtaaatggattagaaagtttacttagagctggacacgaaagcgaattgccaggaataaaccctagggaattggcgctgcttccatattccagcgggaccacaggattgcctaaaggtgtaatgttgtcccattataatttagtggccaatttagtacaaggagacagagatgacttaatagcgagaaaaacaaaagctggagggcgtcacacggtcctttctgtactgcccttcttccacatcttcggatttaacggaattttaaacatagttcttagaaccggcaatcacatgattactattccgaggtttactccggaagactacgctaaagcattgaaaaataccgtcctacattcctcttcgttgttccttcgttacttcagttcctggcgtcgcatcctgccatcaccaa

SEQ ID NO: 910 - DNA, 814 bp, Diabrotica virgifera
gcgagcggccgcccgcgatcaatagttaacacgaatatgttgtctttgaaaatagcagttgctattttgtcacttgcgggcgttactatcgcacaggatttaactcctatacctggtggcaaaagtggtgatggtgtaactacaagatactgggactgctgcgctccatcatgcgcttggtacccaagaatccacacgcaaaacggtgttcccatccaaacgtgtaaagccgatggtgttactccaagtgataaagacttaaacgcacaatctggttgcgaggttggtggagtagcatacacctgcactaaccaatcgcccaagatcattaacgagactttggcttacactttcgtagcagcctcattcgctggtggtcttgactacgccgactgctgcatatgtctggtcatggacttcaaaggtaagctcgccggaaaacgtttgttggctcaggttaccaatacaggtgaagctcttggccaaaaccatttcgatatccaaatgcccggaggtggagtaggcatctacaatctgggatgcaagactcagtggaacgctccagatgatggttggggtgagaggtatggaggagtaactgatatcaagggatgcaaacaacttccggaacaattacaagagggatgcagattcagatttacatggatgaagggagttcctaatccaccagtttcgttctaccaaatcaaatgcccagaatattttgtcggagtcagtaaatgtggagatttgtttgtaaaagaactaacaaattagcacaaaaaaacaataaaaaggggcggcccttctttca

SEQ ID NO: 911 - DNA, 1109 bp, Diabrotica virgifera
gacatcacacacgtgccattccatccattccaatattttataaaaaatgaagtatattttagtaacgggaggtgttattagtggtgtagggaaaggtgttatatctagttcatttggagctatattaaaatgttgtgggattgaagtgacatccataaaaatcgacccttacatcaatttggatgctggaacattttcaccttatgaacatggtgaagtatatgtccttgatgatggtggagaagtagatctagatttaggaaattatgatctacttctccaccatcaatttggatgctggaacattttcaccttatgaacatggtgaagtatatgtccttgatgatggtggagaagtagatctagattcaaaaaacgttcataatttcctaaatcaatgcaggcaccaacgacaaagccaaaaagagatccaatccactctgtccaagtttttggcagaaagaaatcagctacagccgtagcttattgcaaaagaggtagaggagtcttgagggtaaatggcagacctctcagccaagtggagcctaaaatgctccaagacaaacttcaagaacccattcttcttcttggaaaggacaaattctctgctgttgacatcagagttagagtaaatggtggtggacatgtttcccaaatttatgctattagacaagctatctcaaaggctttggtagcttattaccaaaaatatgttgatgaagcatcaaagaaggaattgaaggatatccttatccaatatgaccgtaccttgttggtagccgatcccagacgctgcgaacccaagaaattcggtggtccaggtgctcgtgcccgctaccaaaaatcttaccgttaagttcttttttagatttaatgttgtgtttcttgtatgtattaagatatcaacaataaacacaattttttcctacagatctcattgggacgaaaaaagcttattgattccttcatgaatgctctatgaaaaaaaaaaaaaaaaaaaaaaaaaaaaaaaatgaaaaagaatcaaaataaattctccatacgaaaaaagaaatactataaaaacccctaaaggagttaaaccctgaaaaacttcttgccagaaaaat

SEQ ID NO: 912 - DNA, 1183 bp, Diabrotica virgifera
gtagtgcggtagagacatcacacacgtgccattccatccattccaatattttataaaaaatgaagtatattttagtaacgggaggtgttattagtggtgtagggaaaggtgttatatctagttcatttggagctatattaaaatgttgtgggattgaagtgacatccataaaaatcgacccttacatcaatttggatgctggaacattttcaccttatgaacatggtgaagtatatgtccttgatgatggtggagaagtagatctagatttaggaaattatgaacgttttttgaatgtaaccctacatagagaaaataatattaccactggaaaaatttataagcatgtgatagacaaggaaagacatggtgattatcttggaaaaactgttcaagttgttcctcatataactgacgcgatacaggaatgggtggagcgtgtggcacaaaaaccagtttcagaatctggaaaaaccccagaagtgtgtataatagaactgggtggtatagtaggtgatatcgaaagtatggcattcgtagaagcttttagacaattccaatttagagtaaagcgagagaatttctgtgtggcacatgtatctctcattccacaacccagaactacaggggaacataaaactaaaccaactcaatcatctgttagggaactcagaggactgggattgtctcctgacattatcgtttgtaggtcagagaagcccattggacatagtgttaaagagaaaatttcaaatttctgccatgtagcacctgaacagatcattagtattccagacttaaaatcagtatacgaagttccagtttttatggaaaatcacggtatggcagaatatctatgtagaagactacagttaggaattacccccttgcctccattaaaaaagtatatgaaaccgtggatagaccttggagatagaatgaccaaccttaagaaccaagttacgataggaattgtggggaaaatacccccgattagaagattcgtatacccccattactaaagctttaaacatgctggaataaagctggttttaaagtaatctgaagtttattaagctttctactttggaaactactatagttgaatgaccaatccgctttttaccaccgctagccatatttatgcgttgccatggagcagtttcacactggagtctaaaaa

SEQ ID NO: 913 - DNA, 1411 bp, Diabrotica virgifera
  misc_feature (1376)..(1377): n is a, c, g, or t
  misc_feature (1395)..(1395): n is a, c, g, or t
cacttcgctatggctaccgaaagtgacagttcccaaatttctgataattttaacaaaatagccttagaaaatggaaatacgacaacaagcaataaaagtactgccacactagaaacagcagaatatggcctgcccctgaaagaagtgtataaattaggttttaacttttataaagaaaaagaaggtaaagcggtacactatagctatgaagacaaattgcaattagtagcgttctcccagcaagtgcttcacggcccctatgctgatgcagtacataaattgccccccttggggactttggatgttgtgggtagagataggagagtagcgtggcaaaaattgggccaactttcggccgatcaagctagggcaggttttgtagaattacttagtaggaaatgtcctttattttcgacgtacatagaggcacacaggagagaaaagaaggagcaagagaggcgagctcatcaagaagaggaaaggcaaaaggtggaagaggaagaaaggctgaagaaattggaagaagaaaaggtactgcaagaggaaatgtggagacaggaggcaattaagagacagatccaattagctttaaatcaacagacctatgaacagtttaggaagtatgcagagtaacaatatccaggcgaccctgaaaaacaaggttctttgataaaacaactacaagaacaacactacattcagtatatgcaacaattacaggcgacacaaagagaaaaagaaaaccataaggatgctcattcggataaagaagatgctgttgatgttgcagagcaggcagacgaaaaatcgatttccaactcccaaaacaatgattcggaagagatgaacatcgtaactgccagtatgtggaccagagcagaagtggacgctttcaaacaaagtgtctcgcaaggagaaggtgacggtgtcgtgagagtaggacacggagaaaccgttaccgtcagagtaccgacacatccgcacgggtcgaggttattttgggagttcgccactgatcattatgatataggtttcggcgtatacttcgaattcggaactcccaagactgaagaagtctctgtacacgtctcagaaagcgacgacgaagatctcgatgaactagacgatgacgacgaagtatttgacgaagaaacgatacgaactagcgatttagaatcaggttccgtcaccttgaacggcatctccaaacctctacttcacgagatcgtgccagtctaccgaagagattgccaaaacgaagtctatgccgggtcccatccctatcccggcaagggagtgtatttattgaaattcgacaactcgtattccctttggaggtccaaacgctttactatagagtctattatacccgctannggttatgtattaaatatnagttttttattttgct

SEQ ID NO: 914 - DNA, 950 bp, Diabrotica virgifera
  misc_feature (874)..(874): n is a, c, g, or t
  misc_feature (887)..(887): n is a, c, g, or t
  misc_feature (936)..(936): n is a, c, g, or t
cggacgcgtgggtttttttattaaagagatttctagcccagtgagaagaaattcaagaaagtggcgaggttcgagggaaaatttttttctgccgtcaataattttttttctagttcacccttggtgaaccaaattaaggacttagttactaaacaggtaggttcgtcagataccgaaatgtcacagaaagaaagtgaatctgtggatgctacatcacatcctccaatgctaattgaaaccactgagaaatctgatggagtcccttccagatcaccatctgatgaacttagtaaactaagaccagaggaccgttcaagaaatcagagcttttctatcagaaatatgcaggtgtccagaagccaaatgaaggaatacagagaagcctttagactgttcaaagacggtgatggcagtataacaaaagaagaattaggcaaggtgatgaggtcgttaggacaattcgctcgcactgaagagcttaaacaaatgcttcaagaaatagatatcgacggtgatggtaatgttagttttgaagaattcgtagatatagcttggtcagcaagctcagggcgtgatcccgatcacactatgtctttggaggaagaagaaaaagagctaagagatgccttccgtgtatttgataaacacaacagaggatatattgtctcgtcagatctccgagccgttttgcattgtcttggagaagacttatctgatgaagaaattgaagaaatgattaaagaagttgatgtagacggagatggacgaatagacttttatgaattcgttaatgctttgggtgaaccaggcaatgaggatagctacgatgatgacgacgatgattacttatcattttataactagaaaacattangatatatgggttntttatgtactgtgtttccagagaacttcatcccatatcaaataagctgnctaataaataatta

SEQ ID NO: 915 - DNA, 885 bp, Diabrotica virgifera
ggtacagaagaatgttttgtgcctaacttttcttccttttcaaattttgtagacaagatggctacgaaaattataaaatccggtggggctgagcccgatgcctttgaaacacaagttgcccaatctttgcttgagctggaaatgaattctgatttaaaagctcagcttagagaattgcatattacaaaagctagagaaatagaattaaataataagaagagcgtaattatctacgttccaatgccaaaattgaaacagttccaaaaaattcaaactaggctagtacgtgaattggaaaagaagttcagtggcaaacacgtagtatttgtaggtgaacgtaaaattttacctaaaccaacaaggaaaacccgtgctgccaacaaacaaaaaagaccaaggtctcgtactttgacttcagtatatgatgctatcttagaagatcttgtatttcctgcagaaatcgttggcaagaggattcgtgtaaggttagatggatcacaactcatcaaagtacatttggacaaaaaccaacaaactactattgaacataaggttgatacttttgcttcagtttacaagaagcttactggtagagaggtaaccttcgaatttccagagccctatttgtaaatgatcagttaataaataattgaaaattttaacaacaggaaaatgagagacgacaaaaaaaaaggaaaaaaaaattttaagaaaaaaaaaagtaaaactataaatactagaaaaaaaactaaatataaataacggggggccccctttgtattataaataaggactcgcctgccctctgcctaatttgaatggtagcgctatattagtcgagctaaggtaagataatcaatagttttattatcgaaagcagaaatg

SEQ ID NO: 916 - DNA, 1310 bp, Diabrotica virgifera
  misc_feature (108)..(108): n is a, c, g, or t
  misc_feature (1220)..(1220): n is a, c, g, or t
ggttaaatctggtttctcctgtaaactatcctcgtccaacgggggagtcatataattgatgtttcttctagatcttaaatggatgacctgttatatcgctgccagtgngagagagaggagaaggattaactctgtcaaacatgaccgacgctgcccgcgttcggcgcatactgcgcttcttgtgaataggtgagaaatcatcgagggaggtttcatgtacacctatagcgtcaataccatttaaattcaaaaatggaatactgttgttttgcagaaaaccattcagagatccgtttaatgctatgtaattggcatcttcccctattaacttttggtgtttctttgattggatatgatcttccacgttattatatgcctttttttttttttttagttataaatttttatttactcaagcattttaatataaaaaatacacgtcaaatcctgaaataaaatcagaacaattgtcttttataatataaagcaatctatgtgcattactgatactagatctcttacaattcatcctttttggtaaacaatctttcgttttcttcaattggtaagctatcccaaaactttttgtttccaatgtgatctttttcttctaagaaagtcttcctgggaccagcaatgtgcagttgcacccatggatcacttgccttcttcgaaagaggtttccagtctgcactaacatttggttttccagtgtccatgaatgatgtgagcatatctaacattagtttcgtcatttgtctatcatcttctgtggataaggtgtccattttcgccgccttaagtgtgtacgcagtatcgtctgcatgagatacacctatatcgacactagagtgtgtcttgtactccgacgaactgtgtgcgcctctataattaaagtaataggaatatacagacgattttgtagcttccgattgcaatcgtgcagctgtttctatatcttttataaataacctgtcgctcagtatcttaacaaatttagcataatcgcgtctactgactggcgttttcttaagatattcctgtctgattttttgactgactttatccatttgatattttggcaccgattcatggtaatgtaaaattaagggcattatgctatcccagtttttatccaagtactcagtatattcgtcaaagtaaaaatcagatgctggatataatccttcagaagaagtgtacgaaatcatccaaggcanatcttgagttagacctttttgtaacagcaagaaaggatgctctggaaaaactggatcttcggcccagctgtctactaccaaacccgatgg

SEQ ID NO: 917 - DNA, 1562 bp, Diabrotica virgifera
agttcttctcctcaaaagcaagaaagcgaactagggtcaggagcaactagcgaacctttaaattcagatcaactatatgaccctgaacaaatatttgacgaacctgaggagaacggagaccagttgtctcagaaaatggacgagatgtcagtacaacaaactaatgagaatcccgaagaaagtgactcacacttacctcaagaactatcacaaatttacgaccctgaaaaagacactgcttctccgattcatgattcttctcaagctggagattcttcagttctagatcatacttacgatcctgagaactgcatccgttcagaagagacgttaaatacagatgccgaaaaaacgcttgatctcgatcaaggttatgatcctgagaatatttatgaagaaaacagtaattccaatgaaaaagatgttgatattgaaaaagcaatttatcagtttaattcacaaaatgctgatactagtggaattagtacaggggatcggtacgacccagcccttcctttcgatgatgatgcagatgcagattcaaagcgagatagtgataatgacacacaaaatgaaggaaatacaactgttatcccaaataatgagatagtaacaaatcagcctcaaagcgataagaaatctaaaagtgctaagtccaaaaggaaaagcaagtcaaaaggtaatacgctttatagtgattctgaagatgacgaaaacattgttaagaaaggagctaactcgtttggcgtgacagatataaatgaaatgactgaagatatttgtgaggaagaaagaagttacacaccttgtttggatgaaaaatctcaaaaacaaggtttggaaggattagagacagaattaatttcagatgaagatagaaatgattttgatgaagctcaggaattaaaaactgtgtccgatggtgatgctttggaaattaacgctaaagaatcggagttggatttagctcgaccagaagattatgaagaaggggaaatagtagataaaaataaagataaagatgttcccaatgaagaaccggaagtagagagcgaggcagaaaaatccccgaaagaagctactccagagttaaagacaactgaaagaaaaaagaaagatgcaagcaaatcgcctgcagttgacaaggggggaaataaagaaaacgaggaaagcggtaaagatgcgtcatttaaaagattaagtaaaagcagtaaggggcgtaattatagagataaagaaaaacggccttctgattcgaggaacagatcgcgaacgcccgatcgtgaatacaacaaaaaggaaaagaggagagaaaagcgcaaggaacttgaaagatacaatgttagagctataatagcggataaacctcgtcctttgatagcgaaagatcaatttggaagggatattcgaaacactcctagcaggtcaagaagtagatcctatactccgcccccgcgaagtgcttcacgaccagtcagatcaccttcaaagacgatacgcagatcaccttcgagatcacgtcgatcattatctaagcgcaagtcgccgtccggacgcgtggg

SEQ ID NO: 918 - DNA, 962 bp, Diabrotica virgifera
attaaaatagtgtgcttatctagatctagtatgttgtaaataaatatgtccataaatatggtcatgcactttgaatataagtacttaaataaaaaggattgaggcatttttcaaaactccaccagtaatcgatcttgatagtcatagtccaccacgtccatccgtcgcggtccatcatccatcacaacaagaaaaaattattctataaatagtaaaatacacgtcgtgtcgtcggtcgtcgtgtacaattacaaacttcactttcattgaagtatacttacatttttatctccttatctaggaatccgataaagagtatctctatacctaccttttaataatagtgatatttttatttctattaagatccacaaaatgagttcgcaaaaagttgctgtggtaactggtgggaataaaggaataggatatgctattgtcaaaggcctctgtgaacgatttgatggcctcgtttatctgacagctcgagatgtagaaagaggtcaagctgctgtagctcagctagaaaaagaaaatctaaaagcagtatttcaccaactggatatcaatagccaaaccagcgtagacgaattaagggattttattcaaaaagaacatggcggtttggatctgctaatcaataatgcggcaattgcatttggtagagcagctacagaatctccatttgtccaagcatcaaaaactatagaagccaactactttggaaccctaagagtttgtgaagctttgtttcctttgttgaggaataacgcaaaagttgtaaatgtttccagctctgaaggacatctgtccaaaataccgacggagaatctcagaaatgaactttcgagaaatgatttaaccataccagaactcagtaaattacttgaaaagtttgtaaagctacagaaaaacacacacacgttaaaagacgggtggggaaactccacctatgccggtttcaa

SEQ ID NO: 919 - DNA, 1075 bp, Diabrotica virgifera
gattgtatgatgtaaataaatatgtccatatatgttgattcactttaaatttgaatttataagtatataaaaaggaaaatacaagatgagttcgcaaaaagttgctgtggtaaccggtgggaataaaggaataggatatgccattgtcaaaggcctctgtgaacgatttgatggactcgtttatctgacagctcgagatgtagaaagaggtcaagccgctgtagctcagctagaaaaagaaaataagaaagcagtgtttcaccaactggatattaataaccaagccagtgtagacgaattaagggattttattaaagatagacatggcggattggatctgctaatcaataatgcagcaatagcctttggtagagcagctacagaatctccatttgtccaagcatcaaaaactatagaagccaattactttggaaccctaagagtttgtgaagctttgtttcctttgttaaggaataacgcaaaagttgtaaatctttccagcgctgcaggacatctgtctaaaataccgacagagaagctcagaaatgaattttcgagaaaggatttaaccataccagaactcagtaaattacttgaaaagtttgtaaaagctacagaaaataacacacacgtagaagatggctggggaaactccacctacgctgtttccaaagtgggtgtaactgcactgaccattatccaacagagactattcgatgaagaacagcccaatcgtaatatttcgatcaatgcagttcatccgggatacgtcaaaactgatatgacaagccataacggtcttttaagtatcgaggaaggagccaaaagctccttgtttgctgcattggatgctgatttgaaggggaagtatatctggaaagattgtacattagttgattggtacagcaaggaaatgccaaatccaccatactaaattcgtcacactatacacaatgatattcactgtagtacctattattaaaacaaattgtactagattgcatttaatattttctaataaaaatatattttgaagacaaaaaaaaaaaaaaagggcggccgctcgcgatctaga

SEQ ID NO: 920 - DNA, 1210 bp, Diabrotica virgifera
gttgctctcttacttgattatttccggtaattatttattgttaatgagaccagtaatattttaaaacatacaaattgtcgttatactacatgagtctggctatagttatatcgaacggaagcttatttgcttatgttcgagattactgtttaactttttgtttttgtttatttattaccgttctatatttatatttatgttattaatagtcggtatgatgttcaagctgtttaatgttgctgtaatcaatctcctcaatactggaaagacttcaataaaatttacatttttaaactttataaaatacgtccaccgcgataatagctatttcctaataataacattgacagtacatgctgccgtacgtttcacttaatattttgatttattatcaatataagtcaatcattacgtttgcgcaaacatcccttggaacaactgtatgtatctaaccgtaggcagatattagattagattagattagattatgtgaggtcgttaaggctatggagcctctcagcacttcgacctatagagatcttttgtgcataccttaatctagttaaactctaggatgccaatacttttgatgaaattgattagcatcctaggtgacttgtttcctatgtcagagggcgttagggtgacctcttctaggaattttagtcgtgtgcagaacaacgctacgcaattgcataggatgtgttctgccgtttctttttcattgtcacagaaacgacagttctcactatcggatttgcccatttttttgagatgatatctcagagggcagtgcccagtgagaaggccagtgacccatttttatatcttttttactcatttcgagaaaggcggtgtgttgcactagggcgacacctttatgagccttttttgcttgcctttgtccctggtggtgttgggacccagtataatttttagttggatttggagttccccgggcccggagttccctctctgatgggggtttttgggtagcccccaaaaagggttctggacctttggaaagggggtggggcccccctctttttgcagggttaaaaactttcccttttagcagaaattataaaaccattgtatttttttcccccgaatgggtcctgggctttccccccccccccctttccccccaaaaaaggccccccctgcatctttttccccaaaaaaaaaatataaaataattttttttttt

SEQ ID NO: 921 - DNA, 967 bp, Diabrotica virgifera
  misc_feature (951)..(952): n is a, c, g, or t
agtagtagtagtgcatgtatttcggcatagaaaagcgcgtgttgtttccttttgatttaaataaaaatgggtggaaaatatacaaaattagatcctatggaagttgaagttcccgaaatagatgcgttactgaacagagatggttatttgaggccctacgaaagagaaattagaagaagatatgcctgctttaaagatatagaagagaacattgaacaaaatggaggaggtttagataaatttacacagggatataagtattatggaattaatgtccaacaggataatacaattatatgtagggaatgggcaccaggagcacaacaattgtttttaactggggattttaatggttggaatagagatagtcacccatacaaaaaattagaatatggaaaatgggagttaatattgccacccaatcaagatggttcaccagcaataccacatttatcagagctgaaggttgtagttcagacatgggaaggccacaaagtggataggctgtcaccatacgcaacatatgcagtagagcctcccaagcatgaaggaactatttataaacaaaagttttggaatcctcctcagactcaaagatacatatttagacacaagaaagtgcctcgtcctaaaagcctgagaatttacgaatgccacgttggaatagcaactcaagaaccaaaggttggaacttatgataactttactgataatgttcttcctagaatcgttaaacaagggtacaactgtattcagttaatggctgtcatggaacacgcttactatgctagttttggatatcaggttaccagtttttatgcggcatctagtagatatggtacacccgaagaactcagcgtttggtggacagagcacatgagttggggattaatggtattattggatcttgtacattctcatgccagtaagaacgtaatggacggtcttaanntcattgatggaactg

SEQ ID NO: 922 - DNA, 447 bp, Diabrotica virgifera
ctttatagtttatttttcaaagaattaacatgggtaaagttaagtgtgccgatcttaggactaaagataaaaaagagctaactaaacagctcgatgagttaaaaacagaacttaccagcctccgggttgcgaaagttaccggtggagctccatcaaaactttcaaaaatccgtgtggtacggaaagctattgcccgtgtatacattgttatgcaccagaaacaaaaagaaaacttgaggaagttgtacaaaaataagaaatacaagcctctcgaccttagacctaagaagacccgttctatccgccgtgctctatccacacatgaacagaggatcaagacacctaaagaaatccgtaagcgctctgcattccctgcaaggaagttcgcattgaaagcttaggttgtattgtgttaaataaatactttattataaaaaaaaaagaaaa

SEQ ID NO: 923 - DNA, 1006 bp, Diabrotica virgifera
aatgttgcgcgacgattcattcagaatatttttcgcggttattattaagttatttccattaagagtattttagattaggccaaaagatgcttcagttaattctcttaggattagtagtagtgctgttttattggtatgccataaaacccatgagctattggaggaaaagaggagttcttcagcaaaagccgatgtggttgtttggagatagttggagaatatttcttaggttagaatcgtttgcatcgatgttccagagagcctatgatctagatcctaacagcagaattgtgggtatatatcaatttactacacctgtattactgataaaagatccacagctattgaaaaaagtaacgttaaaagatgcggaatattttatgaatagaaggcaggttcttcctgaaaacggagacccactatttactaaaaacttaataggactaaaagatcaaaaatggaggaacatgcgccatattcttaccccgtccttcaccagtagcaaaatgaaaactatgtttgcgctgatagacgaatgttgtatcaagtttgtaaaacatataagccaaaaggaccaagaagtagtgaaagtaacgatgatggatattgttggacgatttgcgtgcgacgtcattgcttctactgcatttggtttccgcagtaacgctatggaggatccgaataatgatttttatgtaatgagtgaagatcttacaaattttactactgcaagaaagtctttcaagattatcgggtttatgttagttcctaaattattagagctattcaacgttttcttatttgatggatattcgagacaatatttcttggatctcatatctaaaacaataaaagacagagaagaaaaaaatatcgttcgagccgatatgattcatttattaatggaaaagcaagaagaaatctgaaagtcctcttcggctatacaagagatcaacgtagaagacattactgcacatgctatcattttctttctttgctggttttg

SEQ ID NO: 924 - DNA, 934 bp, Diabrotica virgifera
  misc_feature (899)..(899): n is a, c, g, or t
agctattttttatgtttattttttgttattataatttacaattaatttccgttgcagtattcaaagttttattaaaacatttatcgtaaatttagtgttattgttcctcaagcagaatttttatagaagaaaacatggaaactcccggcgccagcagagccccttccaaactggagcagacccagcaacaggtgaatgaagttgtgggtattatgagagtaaacgtcgagaaagttctagagagggaccagaaactttcagagctcgatagtcgagctgatgcccttcaagaaggcggcaaaaggttcgagcagcaagcacaaaagttgaaacgaaagtattggtggaaaaatataaagatgatgattattatgggggttataggcctcattattttaattatcattataatttccattgctaatgcagttaagggcgacgacaccacatcctcaagcgtaacgtcggctcctccaaaatgaaattaaatgtttacggatctttctgtatttgattatatattctgtatttgattatatatatttattgttgcattatacttaaaaataagaacaaaatattttacaattctatgtttgctttatgtcattattttaaatatattattccatagaatatggtgtttctgtttaaaaagtgaacacctatcagttgtgtaagtattgagaatttgtttttcattattatgggcataggcgcaaaatgtcgcctgtcaaaatgttcaatgtgttttaaatgtattcattttttttttcgaatcctgagaaaactaataaatatttttgaaaaatataaacgcagaatgaaagattgcattattactgagggccgaaagtcccttaaaacttctataatgttgattttaataagttacaggngtgaaaataaattagaaaaatttagtgtgattttt

SEQ ID NO: 925 - DNA, 1420 bp, Diabrotica virgifera
gcagttatttgaatagaatgtgtgaatagatgttttgcgtatctaaattgaataacaaaaaatgaaacttttaatattcttattgtcgtgtacttttggccacagtgcaaaaattttggggttttttgccattccttctattagccatcagataatttttcagccagtttggaaggaactttcactgagaggccatgacgtcacagtaataactactgaccctctcaaagatccaaatttgacaaatttgacagagatagacacttcgcgtatgtacggcaggctttttgatatgggttggcctcataaggcctcttcagccaatagtatctttggcagagtcgcgtttttgtgtgatataacatcaggcgttgtcgaggaacaacttggagaggtactaagtcttctgaacaaaggagagaagtttgatttggttctggttcaaatatcttacaacctcaatttggctttagcagcggctcatgcttttggagaacctcctgttgttggaatctcctcactgggactattcctccactctcacgatgccctcggcaacccaactcatccaatcgtatcacccgacatgatgctcaacttctccggcaaattatcattcttcgacaaggtccagagtttcctgtacaacatttggtacaggatgttctattactggtacgcgcttcctaaggcagataagatcgctaggaagtattttggagacgacatgccttacttgggagatctggagaaaaatattagtttattgttattaaatgtgaatcccattatacataatgtaaggccgaatgttccgaatgtgattgagattaatcaaatgcatataaaaaagaggaaaccggtacctaaagatatacaagactacctaaactccgctcccacaggagtagttttacttcagtttgggatctaacgtgaagagtgccaatttggatgaacaaataaggaaagaaattgttgctgggttggggagcactacctttacaagttttttggaaaaggggaaaatggctatccttcctaaaaaacctggtaaagggaaggatcaaaaaaggggggccccccaaagggaaattctctccctccacccaaaaataaagggggttcgttttggcgggggggatgggaactttaataaaagaattaaaacccttaaaaaaaaccctcaaaagaggaaaggcctttgttttctgcccccccccccaaactcaaaaaaaaaaaaaaaaaaaaagggcgggggggtggaaaggcccccccaacccctccttggcggggggttttttttttaaggggttttttttggtgtgggcgcccccccaaacaccccacataaggaaagaaaaaagaaaaaaaaagaggagaaagaatatttcttctttggccgccccccccccccccc

SEQ ID NO: 926 - DNA, 2286 bp, Diabrotica virgifera
caaatgatatggcaacgctgaataaataatttcctttttctagaacattgctggaacttgtaggaagcccgttttcgccggcattcattgaaagaaaatcaaaccagagtgttaagtgcaagttattatataaagatgtaccgtctacctaacactgttcgctctgtggcactccgcaaggcccacataaataatcaagttcaaagatggtacgccaaagatgtaaggtttggatcagaggtcagagccctgatgctccagggggtagatgtacttgcagatgcagtggcagtgacaatgggtccaaagggtcgtaatgtaattattgagcaatcatggggatcaccaaaaattaccaaggatggtgttacagtagccaaaggagtagagctcaaagacaaattccagaatattggagctagactagtacaggatgtagcaaataacacaaatgaaaaagctggagatggaacaacaacagccacagtattagccaggtcgattgcaaaggaaggatttgataacttaggcaaaggtgccaatcctgttgaaattcgcaaaggtattatctcggctgttgaagaaatcgttaaatcccttaagtcactttctaaacctgtcaccacaccagaagaaattcgtcaagttgccaccatttctgcaaatggtgacgaatcagttggtaatttaattgcagatgccatgaagaaagttggaaaggaaggtgttatcactgtcaaagatggtaaaacccttcatgatgaattagacattattgaaggtatgaagttcgacagaggatatatctcaccatattttgttaatacacctaaaggagccaaagtcgaatatcaagatgctttgcttttgctcagtgaaaagaaaatttcttcggtacaaagcattgttccagctttagagttagcaaatgcccaaagaaaacccttgataataattgctgaagatgttgatggagaagcactgaccacacttgtagtgaacagactccgtattggtctacaaattgctgccgttaaagcacctggtttcggtgacaatagaaaagctaccctgcaagatatcgccattgccactggtggtctggtatttggtgacgacgccaatattgttaaactagaagatgtaaaattatcagatctaggtaacactggagaaatcgttattacaaaagatgatactctcattcttaaaggtaaaggtaaaaaggaagacattgacagaagagccgatcatctccgtgaccaaatcgaaaccacaacttcagagtatgaaaaggaaaagcttcaagaacgtcttgccaggttagcatcaggtgtagcagtattaaaagtcggcggaagcagcgaagtagaagtaaacgagaaaaaagacagagtaacagatgctttaaatgcaacaagagcagctatcgaagaaggtattgttcccggaggtggtactgcacttttaagatgcagtcctagtttggatgcactcaaacctgcaaataaggaccaagaagtcggtatacagattgtaaagagagctttaagagtaccttgcatgaccattgctcgtaatgcaggagtagatggagcgtctgtggtagctaaagtagaacaacaacaaggagattacggttatgatgcgctcaacaatgaatatgtaaacatgtatgaaaggggagttattgatcctaccaaggttgtccgaactgccattgtagatgcctccggtgttgcctctctcttgaccacagctgaagcagtcatcacagaaattccaaaggaagaaccagccatgcccgccggcggcatggggggaatgggaggaatgggcggcatggggggaatgatgtaaacccatcttaaacgtactttcaatagactgttctaacttaagtcgagtgtttgccgcgaaagtggcaagttggacagtatctgtcaaaaggttccattttcgtatttggcagaccctttaaatacttttttatactgtttgttgtgctacataaattcgtgtgaagttttcttatgtgtaccacgaattaaattgcgtgaatgagaaagtaagagccaattattttagtctcgtatagtgatcagaagtggttttagggggttgtgagattatgtacgtggctccttaaaatcaattgtgattgctgaactgatctgcatttaaatccgatagaatgatcgatatagtttatatgacctcagatgtacctatattgttgtaaatatattgttactttttaaaaacagaaaaaaaaaaaaagggcgg

SEQ ID NO: 927 - DNA, 820 bp, Diabrotica virgifera
gacgaattgacgaatgtaaaatcaataacagaaacaaacaattttcgtttcatagttattgaatataggagtttacaaaaacttagaaatataaggagaaatatggctgatcagagtgaactaagatcaaatgaactccttttgcccctacaaacaaaacaagcagcaatagcgctaggaaaacttatgtttttcagtgttttgatgtttacattgccttttgtggcattttttggaactaagtacatactgcaagagcattttgatgttataggttttactaatactgtttggtcagttctcttcagcgttgtaactgtaaacttgattattgtagcctatgcatatattgcttacttagagccagattatgatgaaaaaggaaatgtaaaagaagaaagtcgaaataaaaaacaaatgtaatcttatttagtagaaacagcatcataccttttgaaataatgtggcaaatattgttaggtggtaattatatcattatgaataaatgttatcaaatgtagttctttacggaattacaacagcattacaatcattggtttaaataaatcaaaatgtgatgtagtttatattaacagttaatttaccatatatgtttacgtcacatttatctgactatcagatttaatattaatgtattaattttcaccacttctaagagttaaacaaaaaatttgtaacttttcttttttgtaaattaaaaaacaagtttacaaactagccaaacatataattctaaagaaactgcaaataacgaacgataaaatgaaaaaacacaaaaaaaaactataaccgtaaaagg

SEQ ID NO: 928 - DNA, 516 bp, Diabrotica virgifera
cccacgcgtctgaataccaatatttattcatctaaataagagatcaacttaagtatatattatagtgttaccatgaaagcagtgttcatattttccatggttatattcgtaactatggttgcaacagaaattcgtgaggatcatgattgtatctgtcctgactactgggaacctgtatgcggaacagacaacaaaacctattctaatctttgcttcatcaactgcgaagctcaatataatcctggactggaaattgcctaccttggatgttgcgtggatgatccagacccatgtgcttaggataatatgtaaacttacattgtagcttaaatttttttttaaattattttgtagtttaaatttttttaaattattttcatttattttcattgtattttttccattttagtgttttttgttgttgttagaatatccttttttctttcacgcatggaaaagttggcctcatgatccattatataaatttgtattagtaaaaataaatatattatactt

SEQ ID NO: 929 - DNA, 885 bp, Diabrotica virgifera
gatgtaggcttatgtaaagttaacacatctcatttcacaggtcactaaagcttgaaggtaatggatttgtaacaatatggagctctgacctcaacaaagatcatgaacctccaactaatttagttatgaagagtcagaaatgggttgtaggtgataacatggtcaccacattattgaataataacggagatgaagtagctgtctccgaaagagttaaaaggcaattaacaagctcccatctaagacacagagaactagcagctggctacctctcagaagaactccaccatcaacagggtgatccacaagtagatgaaagatgtaggcttatgtaaagttaacacatctcatttaatttttttatttacagttaaggttggaatgttacagaagtaggttgtgctccttacttacgctttttaaactattttttaagtgatgttcttaatattataagattctaggacagaaggaacacaacttatactgttattgacaaaaaacttactgaaaattgcaattagacaacagtagtaagtttaatactaagaatacaggatgaggtaataattattattctttatataaactgtctttttaggagttttatatatattttttaaatatcttgcatataagtcttgaattacagttgtcatttttataaatttaaacctgaaaaatacattatttcgcattaatacctcatcctgttcgatagtttcttaagatagataacaaactgccagttcgataagttttcttttaactaacacaattgtttattagtataatataattttgaaaaattactgtactgttgtccccaaaacattaaagtgttctgcatttatttaaagaataataaactttttatattaatgg

SEQ ID NO: 930 - DNA, 1592 bp, Diabrotica virgifera
acaggtccaatattcaagtaataattttgtaaggtagaacaatgactccactttcgtttctctctgtcctactagtttttctgcctttcgtttaccttcaagaatatcgtttaccaaaaactgtagtaccgtcacattatgcattgtccttcacgtttaatcgacaagtatttgctggaactatattcgagttcagtggatcgacagttattacaataaaaacgtcagaaagtgtagccaacattcaattgcatgcagatccgtcgtttcttcgtattggagccataagtttggaccagggtggcgaaattgatagctacaatgtggatgccgttactcaaattttaacaataactactaaagcagctctaaatcccgaaatcgaatataagctaaccataacctatagagcggacataagtaccaaagaaatgataggactttatcaaagtacctatcaagatgccaatcaagctacaaattatctagtggctacccaactggagcctacctacgctagaagagtctttccttgttttgatgagccgtcgtttaaagcaacttttcaagtcagtttcacccttggacctaatatcaccccaaggacaaatactaagcttgaatcatccaatcagatgacaccaagcatccttcaatatacctttgtaactactccagtcatgtcaacatacttgctgtcttttgttatatcaaatttagactgcaccgatgctgctaccatcaacggagtacagaattctgtttgctctagaccaggtactgagaacttaagagactgggctgtgaatattgctccaaaaattcttgcaagtcttggagagtacactaagttggattataacttgtcgatgaacaaaatggattatgtagcgattcctgatttttctgttgaagctatggagaattgggggctttccacttatagggaacaaagtttactatacgatcctgaacattcaaccaatatcgacaaacaaaatgtagctacactcctcgcccatgaaatagctcatcagtggtttggcaacctggtaacttgcaactggtggtcagaaacattcttaaatgaagcttttggtgactactttgagtactttgctgcacatatgatcctacctgcttggcaactggacaaacagcatgttgtcaacaacgtccagaaggcactgagggccgatgaagggaacctaccagcgctccagagcactgtatcctctcctgtagagattttaggaagatttaatgtgggttcctatactaaaggaagcagtattctgcgaatggtagaacatattttgggttcaaaaaacttcaaggatgggatataccattatctcaacagtcacaaatttaaaagtactacgtcaagcgattttgtggagagggttcccacgcgtatttaaaacaattcctaatccatttttacccaactattgtaaattttggggagccgggaggaacaaattgggttaatacaaacagggaatttcccgttaacgggcgggtgacagtgcacacgaggcgaaatggtgccagaaaaaaaaaaacgaagaattttggcggataacccc

SEQ ID NO: 931 - DNA, 1295 bp, Diabrotica virgifera
cggctaatgccgaatataggtggcccaaaccaaaacagaagaatgttactgtcgtcagtaataacatcagtattaacctatggaatatccatttgggctgacgccctcggaactcaaaaatcacggaggaagattgcatcagtgtatcgcttaagcgcattgagagttgccagcgcattccgcacagtatcagatgatgcaatacacgtcatagccggaatgttacccattggaatattagctgaagaaaggaagaccctttatcgacaaagagatgagagaggtgaacatagaagaacagaacgccaaaacagcattagacgatggcaaatacagtgggattccacaacaaaaggcagatggacacatcgtcttataccacagctaaatctctggctgaatcgcaaacatggtgaggtcaattactatttgacgcagatgctctcagggcatggctgctttcgagcatacttataccgctttaaacatgacgactctccagagtgcccatcctgtctcggaataagtgaagacgtggaacacgtgttcttcgtgtgtcctcgtttcaacttgctgcgaaattatcatcaaccaacaaataagaccagagactttagtaggaacgatgcttttatcgacagcagcttgggatgccataagcacctttgcgatgcaagtgctccaggaacttcgtcgaattgaaagaacacgagcagaaaatagagacgattagaagaaaactttgacaccatgaagaaagattaataaaaaaaaaatctagaccctccccccgcgcagtaatacctcacggtaggtccgcgggggaaacagaggcagaagaaaggggacgggttttagtcggtattgtaactcacgagtccgacataccaggctggtcacctagtcctgatgatacgtaaatgtatttcctacctctataaaaaaaaaaaaaaaaaaaaaacacacacacacacacatacacacacatacacacacatacatacacatacacacacacacacacacacacacacacacacacacacacacacacacacacacattagggtaatttgcgcctagtcaccaaattgggctaagcctagagcgtggactcggcgcccgggcaagtaacaaatcgatgatacgtcagttaagacgtagctggactaaagtgcctcacacggttcagcattattcggtaaatatttcatatgaggggtctttatgccggaactctcatctagcaatcattttgatgaaagtagccttccatagcgcatcagcgggctatg

SEQ ID NO: 932 - DNA, 1279 bp, Diabrotica virgifera
  misc_feature (1200)..(1200): n is a, c, g, or t
  misc_feature (1240)..(1240): n is a, c, g, or t
  misc_feature (1244)..(1245): n is a, c, g, or t
ctaccttatactcgacacagatgttaagtataccttgaaggggaaatcaattaatatcaactcaggaaacacttctgcaaaagaattttccagtcctggtcattggtcaataaatgtaggaaagaaacaatttaacaaaactgtaaacttggaacttggtggaacatatgccgtaatgcttaataaaaaccaaatggaaatggcttatacgatagtgacaaaacctaattcagtccatatagcttggttacttcctcaatattttattataactgctgcagagattatgttttccatcactggattagagttttcgtactctcaagccccggcatcaatgaagtctttactgcaagcttgctttttattgaccactgcatttggaaacttaattattgttattatagaatccatggaaatttttgagaagaagagtaacgactttttcctatattgtggactgatggtggccgatatgttgatcttttcgttcatggcaatgaggtacaagtatatcaaaaaagaagaatcacctccaatatcagaaatcgagcctatagcaactaaggaaaatcaaaacgggggtatcgacaatccatccttcgtaaaaagttccaataatgttaatgcttaagaaaaacaactcgaattttcaattgagaaaatttaatttgtttgggggccacattaacaacaagtgtactgatcttttaataatcaagaaatcaagatttagataacataccgttaacataaaattggagtgatcttgtacaagataacagattatctagcttaccctctttatagtacctatcccacttaatttttcttgtagttatttattttatttattagttaaaagcatttgactataaaatatagaacaccttagtacatattgtataaatatcagtttacactacccccagtattgaaagaaatagagaaatgtaaatatgttgactgactttatttatttattgacgttaatgcaactaaatgactatctttaaaaaatccaaaaatgtttatttctttttaagatgtgtaattttggtatactgttggtacctactttatttcttaaaagaccttaaaagactgtatataggttccaattggagattttctatatttatataatattccagattgaaaacatttgtaaattctgaacaatagcattatgtgcattanagaaagtgtacctatataaaaaattatagaatttaagaanattnnttgtaaatatatataaaaatagattttataatac

SEQ ID NO: 933 - DNA, 1004 bp, Diabrotica virgifera
gctgtcacaagttctattgtcacgcagattgcatggacgaaaaactttagatttttgtgaaagtgttttcgactttacttatacaaattaaagatcggtaactatttctaccgtcgtataatcgtatttgcagtccaatttctaatttccccaattgttatgatgagtgatgatgatagggacatagatgtggagagtgatgaaggtgatgactcggattcgcgtcaagcaacaagcaggcaaaatgcaggaggccagtattattcacaggcagaaaagagagcccaccataatgctttagagagaaagcgtcgagatcatataaaagacagttttagtagtttaagagattctgtacctgcattgaacggagaaaaggctagccgagctcaaatattaaaaaaggctgcagagtatattctttttatgaggaaaaagaatagttcacatcaacaggacattgaagatctaaagaggcaaaacaatttgttagaggctcaaatacgcaccttagaaaaggcgaaaacaacaggggatattaaagatgatgtatttattgaaacagagtcagatacctcagattttgaaggttctattcagcaaaggaggcccaagaagatgaaagttgtatcataccattcaattaataaggaatgacaaatgaaccatcaagagttgcaataatttctggaaatgaagttgtcacaaataagattgtcaaaggaaatatcactctttagaaatgttgagccgaatcaacatattggctgtcatctatttaagtgttatttaattttaataactagattttttatactttacaatgttcgtcagaacctctaacatggttatatacatataattatattgttttgggtaatgtgtctctagttttatcacaaactatcattaagacttagcttatagtgaacattttttaataaaaatgagactgggatttgtcagttgtaaaaatgatgtgtataataaatttatttcttacc

SEQ ID NO: 934 - DNA, 1625 bp, Diabrotica virgifera
  misc_feature (807)..(807): n is a, c, g, or t
aatccgcagatctgcatttttatttcaatacgaaggacagttgattggagtttctccatgatatattgttatatcttgcggatccccacagttggattgagtaactccatacagcctaatgttgtgatttatatatcaaaatttcgttatagatttaatattttattgggaaataagccacactttaacttaaaaatccttattgacgtttcgttttcgacttcagaaatggttatcgaaataaaatatggaagtggaaatcgaaacgtcaataaatttcattttttacttaagttgtggcttatttcccaaataaaataatgaattttataagatgtcacaaagaaacagcttgagaacaatattagttttgtttccaatattttgtttcctatcataagcaaatataatttatttacccaaaatataactcttttgacttgtgtatgtttttttatgttagttcaagggccaaatacatattttatgttttacattactttttttcgtagctttagtttacttattgaaaatgtaacaaaactatttattttacgtttctttaaaggggctatagtacatcttttaattacctacctgtttatcagcctgctacaatttagtgttttaaaaactacaaaaaccctttcaaagcaagctgtatttaaaatattcaaaaatggctttgaaatcagccaaggggctagatccttaaggtatagaagaagggcaatttaagatttagtttcgatacagagcccaccaccatttgcttatgcacatttagtcatctaggactcctcaganagactcgtggtgtgctctctataagtatttgtaactatttataactaattgtctcatcaccaagctgaaactgataagcgtaggcactgccgtccgtgatatattagagaataaattgtttattttacgatgaggatacatcagcagttatctcagaaagctatagagacgaagtttttgtaagccatccgtcgtatcgtcacatagcagaatgcctaggtatgccttacctacaatgagttctcaaccagcagctcaccaaccatatcagagacaccctgcccagtttgaaagataaactacaatagcaactgttacaacgggaaaaaggtatggaccgttctcttaagactaaggctatgtatgtaacatattatgatccagcaagtgaacctcggcagaatcatcgaaagttccgtttggcacaaatcaactcgagcgaactgtctggcggagctcaaatcattacgttattccacgaaaagttctcctttgaaattgtcaagctggaattcgatgtgaagaagcttcgtagggagatcgccttcccaggtatggcttttgaggctattgtaataaataactctgctgagggaaccttccctgaagtccgtcgatctagtcgtgcaggagctgtcaaacgttggaagaatgtgcagctataggatggttccgttatccacgattaaaaccaaccacgaagatctggcccatagctttatttctcttctatagcgtttctactgagcataagatcaaaatactatatgtataatgcaggctgcagtggctacttcgattagagagatggaacattt

SEQ ID NO: 935 - DNA, 457 bp, Diabrotica virgifera
cacacgcgtccgcggaaaaacaaaccagtttttagtaaactagggaagtaaatacttccgtccaaaatgtgtaaaggtataaaaatgaaatattttgtgataattttaattgcaatttttgttacgattgaagctttaacagataaagaacaatggatgcaatataagaaaaagtacaacaaaaactacaaatttagatcggtagacaacgaaagatttataatatttcaacaaaacttacgccaaatagaagaacacaatgccagagcagaaagtggtctctccacatttgaaatgggcattactaagtttgccgacatgacagcagaggaattttctcgatgggttagtcgctcccaaagcgaccacaacagatttttttcaaaaggtcaacagtcgctacatacggatctaagcatcaaagcaaatccaccttctgaagtggattggagaaaag

SEQ ID NO: 936 - DNA, 1423 bp, Diabrotica virgifera
ggatgcggtgaaataactggttgtcaactttaggactgcatgacattctgatccagatttaaaatttattaatgtttctataattcttccgctttaaattgtagccgtaacaactactattgtatttaaccttaaccacctagttgatttttagaagaattttagctctgcaaagatgcctccgaaaccaaaaccaggtgctcccagcaaaaaaactgagcaaaaaaagaaggaaaaagttatagaagataaaacttttggtttgaaaaataaaaaaggagcaaaacagcaaaaatttatccaacaagtggaaaaacaagtcaagtccggtggtattcatccgctaggaacagcagtagatcaaaagaaattagagaaggagaaaaagctcaaagaacagaaagaacttgctgctctatttaaaccagtccagatacaaaaaatagataaaggtgctgatcctaagtctgtggtatgtgccttctttaaacaaggacaatgtggcaaaggtgacaaatgcaaattctctcatgatttagcagtagaaagaaaggcagaaaagcgttcattgtattttgatatgagaaatgatgaagatgacaatgacactatggaaaattgggatgaagctaaattaaaggaagtgatagaaaagaaacatggagagaaaggaaagatgccaactactgatattatttgcaaacactttttggaagcagtagaaaagtcaaagtatggatggttctggacatgtcccacaggagaagggtgcatttacagacatgcgttgccacctggatttgtccttaaaaaggataaaaagaaactagaagataaagcaaatgaaattactctagaagatcttatagaaaaggagagggcagctttaggtcccaatcaaacaagaattacattggaaacatttttggcttggaagaaacggaagatacaggaaaagaaagatcaactcaagaaagatgaagataagaaaagaaatgaattcaaggctggcagacaagttggactttctggaagggaaatgttcagtttcaatccagatctggctactgaatatgacatggaagatggagatgagctatttgattctacggcttatcctactgaagaagaagatgccattgtttataaggaaatagatttgagcataataggagatgacgtacaagaggttgatggaacaggtaccgtggcaacagaagacaggtttaaagatgtaaaaccaacaacatctgatgaaaaaccagccgaaggtgcaacagcggtggctattaacgaaaaccttttcctcgagtcagatttggaagacttagatgaagaattacaagaactcgacctagaggaataaaaaataagggttatttttttattaaccctttcggattactttttaattttaaagccc

SEQ ID NO: 937 - DNA, 1137 bp, Diabrotica virgifera
atctaaatataaaaattattttatatatttggtcctttcgtactaaaatatattaataaattaaagatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttataatcaaaaaaattggatcaaaaaattattaattaatataataatataaaaaaagttaaatttattttttaatcaccccaattaaataaatttattatataaataaatttaatactaaaaaaacttattaataattttataaaactctatagggtcttctcgtcttttaaaaaaatttaagctttttaacttaaaaataaaattctttataaattaaataaagacagtttttttttcatccaacccttcattccagctttcaataaaaaaactaatgattatgctaccagccccagccatgaaagccaaaggagagttgaaggagtatgaagttatcgggcgtaaattgcctaccgagaaggagaagaccactcctttgtataaaatgagaatcttctctccagacaaaatcgtagcgaagtcccgcttttggtatttcttgaggcaacttaggaagttcaagaaaactactggagaaatcgtgtcagttagacaaattccagaaagatctcccgttaaaattaagaactttggtatttggttgaggtatgactcccgttctggtacacacaacatgtacagggaataccgtgaccttagtgtatcaggtgcagtaacagcctgttacagggatatgggggcccgccacagagctagagctcattctattcaggttattaaagttgaagaagtaaaggctagcaacaccagaaggccacaagttaaacaattccacgattcaaagatcagtttcccattacctaaacgtatccaacacaaatcaatgaaccgtttctcagtccgcaaacccagaacatactttttgtaatatgttattatggttagttgtggataaataaattcgtttatatatatttaagat

SEQ ID NO: 938 - DNA, 898 bp, Diabrotica virgifera
  misc_feature (682)..(682): n is a, c, g, or t
  misc_feature (806)..(806): n is a, c, g, or t
  misc_feature (821)..(821): n is a, c, g, or t
  misc_feature (871)..(871): n is a, c, g, or t
ttcgggaacgcaatacagcgaataagatattaaacagtgatctcataatatattaaatatgaagatgctgataaaagtttctgatctgttaattttgtgttgtgtgttattgctcattgcttgtatacacgactctgatgcaaagcgaggtggaggatcaagaggaggaggatctagatctaaaagtacatcaggtggatctagttggtggtggagtagcaataagaaatcatcttcatcatcctcaaagacctcttcggtggctactggagctcacgctcccgcaccagcccctaaagcaccagctcctcaacatgatacgatcaagaaacaaacttcccacgtgagtcatcaacaaccggtaagcaatcctaactatggaaataaccaacaaaatcctattggatggaatgtaccaggaaacaaacaagctggccatcaccaaactcatagctatcctacaggaaaccaaccacatggttcttggccaaattccggtcagtatcctcaacaacatggaagttggggtacacaacacggcagttatggcaatcaacatggaggatggggtaatcaacaacatggtggttggggaggtcaccaacaaagcggttggggaggacaacatggcggctggggaggacagcacggaggttacggtggtcaaaattacggaggttgngggtggtgggttattccaatcccggatattctggttatggaggaatgcaacgaggtggatttatgggtggcggctatggtggaggtatgggaggatatggcatgggaaatgggaatgggcatgngaatgggtggtatgngtggttatggaggctacggtatgcaaaggaaatccggcttctttagtggncgtagcacctttggcaacattttaact

SEQ ID NO: 939 - DNA, 935 bp, Diabrotica virgifera
gatcatgggagatcagacacacctgcattattgtttgttttagtgttataagtaaagaaaaatgagctccgagacaagtgtagtgcgtataattcacttggatgactactactgaatatctttgaaggaatttctgttatcatcgacattagtgttaggtgccattaataacgtttttatcggtatagaaaatgagctacaaatagtttttgcgtatgttacatttgaatatggcgatgatgcaaggagagttgtgaacagactaaatggtttttattttcaaaataaagttttggaggttgagttaataggtccgaatttaccttacaaacgatataagcagactagaaaatcaagtgccactgtttccaccaatacaagatttaaaaccacaaatataacatctccaacgaaaagtctacatagtcagtctaacgagttagatattgattcatccaactgcttagatgttagggtaaataggggtttttctcctattaaaattctccctggagaatatagaaatattttaacacctgcatctaaaataataaatactacccaaccagcagggaatactgcaagatttagcaataaaaacaataacgaaccatctgcagcaataagaaattctgtaaaagctggaaacagtacgccacaagctgggacatacacatcaacagtatttcgttcatggtcatctaatccacacttaagtcaaaagacaaactcatttaatagaatgcctagtaaagcgacacataataaaatacaaccatcatctagaacaggggtttacaacaggcggcccgcgaggcatatgtttgcgtcccgcgagagtatttacacaagtacagaattcttagatgattattattaattgcattcatgtaagctaatttaaataaataatattaaaagcaaaaaaaagaaaa

SEQ ID NO: 940 - DNA, 955 bp, Diabrotica virgifera
actagttctagatcgcgagcggccgccctttttttttttttttaacaggtaaatttttaattcagcaacgacacgttttaaataaatattatataaatatgtttacaacggacgcaaaaataaataaaaatacaatcctattgaatataaaaaacatccagaagtcaagttcgaagagaaatatttggacacagtatgtctgaacatggtacaagatcccacccaatatgatgtattggtaatgcctaatctgtatggtgatatcttgtctgatatgtgcgcaggtcttgttggaggattaggtcttactccttctggtaacatcggccttaacggtgctctatttgagtcggtgcatggtacagctcccgacatagctggtcaagacaaagccaaccccaccgccttgctcctttcagccgtcatgatgctgaggtatatgggccttaacaaccacgcgaccaaaatcgaaaacgcctgcttcgagaccatcaaggaagccaaatacctaacaggcgatcttggaggcaaagccaaatgttcagagttcacgaacagcatctgcgagaaaatagcataagtccctaaaggaaaaaacgtcgcagtgaccctcgttaaagaagatagacgttagtgtgttgattttaataatatttgtacataataagcaaaacatttttttgtagtaggctagcgagcgagggtgtcttttttgtaacatgctcagtatttatcaatgaaataaagtttctcattacgtttaggtccaacctagtatttctttattactgtgaaacttgaaacttgaagttaccccctggatattttttatattcaataggattgtatttttatttatttttgcgtccgttgtaaacatatttatataatatttatttaaaacgtgtcgttgctgaattaaaaatttacctgttcaaaaaaaaaaaaaaaagaa

SEQ ID NO: 941 - DNA, 1514 bp, Diabrotica virgifera
ctttccgcgtccgcacttgtcaagggggacacgggacgggcctaaaattctgataatatttaaaaataatttaaaatggcaaatattttaaggaaaatttctacatcacaagctttgggtagcagattatttagtagtgaagttaaaaaatgtacacttattcctggtgatgggattggtcctgaaatttcagcggctgtgcagaaaatcttccaaactgccagcgtgcctattgaatgggaaagtgtagatgtgacacccgttaggggcccagatggaaagtttggtattcctcaagctgctattgactcagtcaacaaaaacaaaatcggtctgaaaggtcctctcatgacccccgttggaaaaggacacagatctttaaatcttgctctcaggaaagaattcaatctttatgccaacgttaggccctgcagaagtttagagggatataaaactttgtacgatcatgtagatgttgtgaccattcgtgaaaacactgaaggtgaatattctggtattgaacacgaaattgttgacggagttgtacagagtattaaattgataacagaggacgcatccaggagggtagctgaattcgcttttcaatatgccaaagagaacaatagaaagaaagttactgcagtacacaaagctaacattatgcgcatgtccgacggtcttttcttgagatgctgtagggaaatggcaaaaaaacatccagaagtcaagttcgaagagaaatatttggacacagtatgtctgaacatggtacaagatcccacccaatatgatgtattggtaatgcctaatctgtatggtgatatcttgtctgatatgtgcgcaggtcttgttggaggattaggtcttactccttctggtaacatcggccttaacggtgctctatttgagtcggtgcatggtacagctcccgacatagctggtcaagacaaagccaaccccaccgccttgctcctttcagccgtcatgatgctgaggtatatgggccttaacaaccacgcgaccaaaatcgaaaacgcctgcttcgagaccatcaaggaagccaaatacctaacaagcgatcgggtaggcaaaggggaatgttcagagttcacgaatagcatctgaaaacttataccataaaaaaaaaaaaaaattccccccaaaaaaaaaaaaaaacccgcgcatagatgttcgtgtgatgataataaaaaaaaaaaaacttaataagcagaacgtttttttgtagtagaaatttttttttgattgtgtttaaaaaaaaatgataagtatttatcatttttataaagtttctcattacgtttaggtccaacttagtatgtctttaatattgtgaaacttgaaacttgaagttaccccctggatatgttttatattcattaggattgtattttgatatattattgcgtccgttgtaaacatatttatataatatttatttaaaacgtgtcgttgctgaattaaaaatttacctgttaaaaaaacccacgcgtccg

SEQ ID NO: 942 - DNA, 2048 bp, Diabrotica virgifera
tgaaaattgtgtacttattttagtttacattaagtaatgttatttttagtttacaaaagagctcttaaaagttacttaatctttaaaagtcttatgactcttttttgtttcgtatagatgtcgctgctagcgtggttaggcctgttatgttacagcggccaaataaattgcattttatttgagtttgtccatcagagttgagggggacacggtgacctctatttggcgcctagactatgaaataccacagatgctcctgacgagagttcgtccgctcgaaacacgtgtggaccaatggtgatgttttaactgaaaggaaatgcaattatgtacttttataatatattacaataaaaaaatatttactcttatattttaataataatagttttgctgtaaaacgaaaactagagacgtcttttagttcaattcattctgaaaccgctctctgaatgaattgaaatattattatgatgtctctaattttcgattcacagcggaactattatttatttctattagtatatgtactaatagaaagttttattttaatattatttttaattttattgaggtaaaattaatgcattttttatagtttacttttttctgtgaacattgatttttcttctttttgaagatgattttgaaacaagcagctcaattgaattatgtttagaataaaactagagcacatactatgaatatttgattaatataaatgttgacttcaacttagattattaattgatttactatctacttacattgtgcgaataacctaccttttcagatctgcatgttatcttttatcatataattttgtggtaattaattttctgttagttggtagaatatttttcctatacaaacatttaacagaagcatgatttgtgcctaagtgatatattttaaatgtaggtgctagctactttcttcaagtaaagtacacatctcacaaaagacagttccattgatgaaatcaataaatcaatatgtattgaaatttattataaaacaaatcgatactattcagcttagtcattcgaatcataggcaattaagagtaaagaatcgaatcattaaaagaaacggttcatcttacctctaatataattttttaaatctagacactgactcagttcgaatatttttaaaattaggtgttttcaaatgaactaatcaaagctctgctaaatgtttgtatgcgaatatgacagagtagtctaaaaatgtttgatgcatgcttggcatggttaagttgtttttaaccgaattattgtttaatgtatcaaactattgggttttttacaccttaacatttattaacaacatttttgattttttcgaagtaaataatatctgtttcggttaataaattacacagatttgtaaaattttaataatcaaaaacttacgtgttaacttattatgttttgcatgttatgtatgttaagtaacagctgtttacctattcaatatattttttactataaatatgatcgactacaagccacaacataaatatacatttaataaccccagaggccaaaattcaatgatctactttttaatcaccaatagaaaactgcacccaaaccacatcgcatacttgaagaaagaaagaagaaaataaacaaattcacacaaacattataagatctgaaacgtggacagaatacttcaataaatctgtaaaatgacaccgatgtatacaccgaagaataagaccaaagtaacgcagatattcaaagtaatcaaagtatcaataaaataaaagacagaaaactgccaggaactgatggtgtcaataaggagcttattaagtactgtagctcagaaatcgtgacagaattaacaaagatatttatttctattagtatatgtactaatagaaagttttattttaataatatttttaattttattgaggtaaaattaatgcattttttatagtttacttttttctgtgaacattgatttttcttctttttgaagatgattttgaaacaagcagctcaattgaattatgtttaaaataaaactaa

SEQ ID NO: 943 - DNA, 1168 bp, Diabrotica virgifera
caactgcttaaaaatcacacatattccttcggtgttttagtgtttgttcttaaacaatattaataaaaagttttagtttttttcaatcatgtcagcaggggatgcactagcccccggtgcgggggcggcgggtagcggcggcgacgatggcattgtgggcggtccgcgaacgccacaacaaatcgcggcccaacgacggcttcaacaaacacaggcgcaagtcgacgaagtcgtggatatcatgaaaacgaatgtagaaaaagtattggaaagagatcagaaactatcagaattagatgatagagcagatgctttacaacaaggtgcttcacaatttgaacagcaagcgggaaaactaaagagaaaattttggttacagaatttaaagatgatgataataatgggtgttattggtcttgtaatcttaataatcatagtcatgaacttcatgtaactcatgggccaaaaattcggtaattctgaatgaaatttgtgttttggtgtaaaggctttctgtctgtctttctgtcgtagaaaccttcgaaacaataactgtcttccctcatcaccaaactttaattgtaatataactatttctttgtcgcataatgtaagtagcagaaagaagtcatccgttgaagaacttatctccaaaatgtcttaaatccataaaataatgaaactcagaacagaattataacaaaagtaattaagattaagatacaacttttatttgggaataggtctaatgtttcataaattatattgtaaatctttatacagatgtgtaaaaatcttgaggctttggaagtgctaaaattcaaatcatatgacctgaatataagacattttgggaacgaaaaagtacttatttaatatgattaatatcggttaaattttaataaataaactgaaatattggataattaatgaaaattgtgtacttattttagttacaataagtaatgttatttttagtttacaaaagagctcttaaaagttacttaatctttaaaagtcttatgactcttttttgtttcgtatagatgtcgctgctagcgtggttaggcctgttatgttacagcggccaaataaattgcattttatttgagtttgatattctaggtgacctctatttggcgcctagactatgaaataccacagatgc

SEQ ID NO: 944 - DNA, 1170 bp, Diabrotica virgifera
cgaagagaaaaacaacaggcaggatctctatactttgtccgttagttacttgggattgctcaagcagaggaattctgctggccagatgatgaaggaggtcgagtttcatattccagtggaaaaggagaagggcaacaaaaaccacgagttcaaaaacgacaacaacaacaagcataacggcgaagcaaaagaagaatctacaaaagagaagaaatcgaaacagacttcagacgaacccaaggctagttccaaacaacagattatttctgttgatataacaggttctggttccaaggatcgatcagagaaatcaaccaaagaggaacagagtaaagacagacatagatctgagaggagtagcgaagataaagagagggaaaaggagaaacgtagagaaagaagggaggagaagtctaacagagatgataaatacgaaaagcaatacagtcgatctcaagaagaaagatacattgaaatgttgaatcgtccgtcggaagagggtcggtactcatcagaaaaacaagacaggtattacgattatcgaaatgacagtagagaagaaagggagctgaacgtaagcggcaacggcagtctaggaaggagccaggacccagagcctgaaagagaatcatccaaacgaaggaaagtcgacaactcctcgaaggttagtatccagaattccaaacatgaagaaaggaaatctaattccgagcaatttcaagaaaagactgagaaacgagaaagatcaagcaaacttaaagataaaagggataagatgagcgaagaagaaaaagagatgaggaaagaaaggaagctcggaaggaagagggatcgaatggaagaagctcttcagcaattcgaaatgaaacgaagaagagacgaagataaagcttccaaaatggtatctccaaacagaagttcgaatggtgaaatcgttgaaccttccatccatgttagagagaagcaccacagaagtacaagggatatctcaccataccagcgagatcgatcgaacgagaaatcagagccacgagaaaacataggcggggttcagaaaacaaagaagatagccaacaatgcacgagcataaaagaagacgcatgtctcttatggggggggggaaaaattttttttaatagttggtccaaaaaaaaaaaaaaagggggtaaa

SEQ ID NO: 945 - DNA, 2060 bp, Diabrotica virgifera
  misc_feature (1956)..(1956): n is a, c, g, or t
  misc_feature (1974)..(1974): n is a, c, g, or t
  misc_feature (1976)..(1976): n is a, c, g, or t
  misc_feature (2020)..(2020): n is a, c, g, or t
  misc_feature (2046)..(2047): n is a, c, g, or t
caacggtacagtattaatgaagttttgtaaataaaaaaaaaacaataagaaagtgcaagttacatagcccgatatattagtgcttcaagatagctcaacaaattaatgcttcaacatatttcacacagatcttgctcagattaattaagcaataatggctacagcttcatttgcagaaaatgatacactgctcaacaactcaatgggccaagtgagcatatataggcccgaaaccaacgatgaactctggaaggaatgcacaacttggcttacgcgatgggaagtgcttagatctgatcacaaggccaactggccgaccgcttctattgtagatttggcgaatatactaagagatggtgtattgctttgtaaattacttagtaaaatagatcctgtttgtatagatatgaaagatgtcaacttaaaacctactttagcgcaatttttgtgtctaagaaatatcaatctatttttaaaaatatgtgagaaaaattttgcactgaaacagtctgacttatttgaagataccatgttatttgatctgacgaatttccataaagtattatgtacattatcaaagctttcttcgtgttcaaaagccaggtttcaagtaccgggatttgccgcccaaaaactgaaaagagaggaggaaatgatatttcagagtctcaggagtgtagagatgccagtcagaccgaggagtcttgccgacaaccatgcttttaatgtagctagtgaagaaatatatcaagatttatgtcttgacagaacgacgatcgagttaaaatacgtgatgggagttcttattggtggttttacacatagttactgtgtctgtgtacacttggacataataattagtttgaaatattttagttttagttcatcagtgtaagtgtagatttgatattgttgtgtccggtgcagctccactattttagtttctactacaatgatattatttatatttgatttgttgtgtttcctcgttgttattgccaagaagattattttcttagtgttctcatggatgttctcgtggatgtggtgtgatcctacgttttctgccttactgattgttctgtttggagcatatctatttgtaaatgaacatcctcaaccgactgaaaaaagggattttgtgatcaaggaactattagatactgaaaaaaattacgttgatgttttggagaaattaaggaaaaattttatgctaccattaattaatcaaatgaagccagaacatcacacacttgtattttttaacattaaggatttaaaagatgtacatgcagaatttcttgaggaattatttcgcatccgtacacatccaagtaccagaattagtaatatttttatgagatttagggaaaagtttttaatttatggaatgtattgtgccaatctgacgaaagctacgcaaatattacaagaattatgtgactctgacgaatattttaatcaaactgttatcaaatatgaaaaagaagttaataatggtaggtttaagttaagggatgtattatctgtgccaatgcaacgaattctcaaatatcacctgttgttggacaaacttattgaacatactagtgagtctcacgaagagtacaatgatctgaaaagagccagagaaacgatgatagatgtagcaggctatatcaacgaagtagcaagagacagcgaacatttagaagtgataaataatttgcaagaaacaataacggaatggaatctcgcgcctaatcaaaaattatcagactatggtcgacttggtgaaaggacgcgagccttagaattaaggctcacgacgaccagaagaataaaatagatatgtgtttatttttgacaagtggtattttgatctgtaacaattgaagggtaaccagtttgccctttcgtgatctcataaatatagcagattatcacgttgacgaaatcccaataggcctgtcttanataaagaagcccgatcantntaaacagttttgtcttgtaaaaaacgacaacccaaacgctatancatatctttgcgaaccgcagagctcnnagcacaaataatc

SEQ ID NO: 946 - DNA, 445 bp, Diabrotica virgifera
gcggccgccctttttatttttatatttgtgccggtttaataaaacttataaataactgtttatttaatgaataaagtaaatatacatattcaatatattttcttcatccatagtcacaaacattggaattagaagttctttgctaagattccatcttttttcgttaacctaacaatgcagtcatctgattcacccattctcctaatagcgccacacaatgcatagcttttagagctttcggtcattctgccggtttggggatctacatcagcaatgctaagttggatggaggcatgatctttagcgtggataattctgttgctggcagagcatttccttgggcagtacaagtcaacggtttcacctgcgtcgttttccatcttttataattttattttattataaactccagaaaatggattcgttcgcgaacgtcaaatttgtc

SEQ ID NO: 947 - DNA, 961 bp, Diabrotica virgifera
ataagtatataaacatttacaatagttttttatcaaatatattataatgttaaggaataagatgttttttatagtgattccaggtattttcattcactaaaatatgcctacaaataaataacccattggagaaatagcgtataaaaatgcataggatataaagctttcagtcatttctatagtttggggatctacatcagcactaaaaagttggatggaggcatgatctttagcgttgataattctgttgctaatagagcatttccttgggcagtacaagtcaacggtttcacctgcgtcgttttccatcttttataattttattttattataaactagacaaagtagatacgttcgattgcaagaggaataagttagcagtgtttgttctattgtttgctattgctctccagcaaacatcagccattttttggcccagacagaggagagatgttcaagatatacagaatttagttccagtagaagagatgccaccgtccagaaatcttaggattattgccccacctgaaagaaaatatggcacatattcattggatgctggcaacgcagaaatgactgaagaagtgaaccttctagaacaagtattagctgacaaagttgaagaaatccaacaactttgggctcgaattcaaagtgaattgaacgagttttctaaggagtacgaacagctcattgaagaggaagttgcagaaaaagttatggaagatgaagaagaaccggctcaaagacaaaaaagaatgatgagccgacacaaaagaatgattatgtctgatgcccaaatacaaaaaagagcgatcaagaaatagtgataatgtctttgccccaaagacaaagattgatgtcatttttgaaatttactcttataactgtttccatataaatataaagagttaaagctttttaacagaattgtctcatattattaaaataaacacagttg

SEQ ID NO: 948 - DNA, 1188 bp, Diabrotica virgifera
  misc_feature (1024)..(1024): n is a, c, g, or t
  misc_feature (1028)..(1028): n is a, c, g, or t
  misc_feature (1102)..(1102): n is a, c, g, or t
cgaaataaatgaaacatttaagcaaaaaagttactgcacgactgctttcttagatgtgagtcaagcctttgataaggtttggcatggtggtctactgtttaaatttaaaaaatcactcctccaaacactgtacattattatggaatcctacctaaaagaaagatattttactgtgaggtacagacagacaacatcagaaatcacattgataaaggcaggggtaccacagggcagtgttcttggtccacttctctattttatgtacacagctgaacttccagtaagcaacccaacaatcacagcttcctttgcagatgataaagcgataaatgtcaaacacaaagacccagtcatagctgcaagaattctacaacaacatctagtgaaaattcaggattggacaagaaactggagaatcaaagtcacccaagtaaaatcagtgcaggttacatttaccaaatgcagaggtacaatggtcttttacactaaatgaacaaaatctgcctcaatctgacagcgtcaagtatttagagatgcacttagacaaaggacctggagaaaacaccttttcaacaaaaaaaaacaacttggcttgaaactcagcaaattctattggctactgagacgacagtaaaaacttggtttgaaaaacaaattattggtttataaagtagccttaaaaccaatatggacctatggtgtataactatggggtacggccgcaaactcaaacatagaggtattggaacgctttcagtcaaagctactacggactataacaaatgcaccttggtttataccaaacagagaagtcctagacgatcttcaagtagccacaattaaggaaatagtaagtgaatacagcagccgctatttggtaaaattggaaaaccacccaaacaatcttgcactaaacctgctagataatagtgagcagactcggagactgaagaggcacaaaccattggagctaccacataagttctaagcagcagtgaagtgaaatgaagtgaagtacctagcngtanaggcacatttcaacaatcaaagagactagtgaagttttttgtttcgctggataacaaatcaaatttatacatanaccccttttgtacaacaaaaacatgcttatattttttatgtattgattgcatgtagtaaataaacttttataaaaaaaagctgcta

SEQ ID NO: 949 - DNA, 1268 bp, Diabrotica virgifera
atagaaacggaaaacaatatgaaatgaactaatgaaatggcagaagataaattatttgtgtcttttgcatgccaaagatgttctcaatcattaagattagatgaatcactgaactcttttagtgaacatacctcagcagaattaaatttgcccatatattccaaccctgaagttgatttggagtcgcaggctaccagttttgatcattatgtacctccatgtaggttatcagactctggcaatggagccaatgggtttatgctaatatctgatgaaaatgaggtagatttgatcagtcaccaattcaaggtacaggcagctctgtttgatacactttctggaaattccaatattgatcatcctctgtgtgatgagtgtactgataacctcatcgaaattttggatcaacaacttcaaattgcacaagaggattatgatgattacagtagatattacaaaatgttgcaaagtgataaagacgaaccaaaactatctgatttagaaaaagaattaagtgatttaaaagctgaagaagtgagattattggacgagttgagcgccctagaacacgaggaggaagaaaccaaaaaagctattcaagaacaagaagccattgcacagaaaataactcaagaagaggataggtattggaaagagtatactagacatagaagagattttttggtgttagaagaagaagctaaaagtttggaatgccagctcaactacacatcaaatcaattagacaaactacaacgaaccaatgttttcaacgcaacgttccacatatggcataacggccattttgggacaataaataacttcagattgggacgattgccatccgctcctgtcgattggtcagaaattaacgcggcctggggtcaaacggcgttgttgctctcatctttagcccgaaaaatcaatctcacttttgaaaggtttcgattagtcccatttggaaaccattcacatattgtgtctctagaagatgacaaagaatttccattgtacggatctggagggtttaaatttttatgggatacgaaatttgacagtggaatggtagcgtttttggactgccttcaacaatttcaggagaaggtagaaaaccttagagaagggaagtaaagctttttgctttccatatcgaaccaacaagggtaggatagcagataaagatgccaggtattccataaaaatctaattatatttcattggaaactgggaacaaaggcttttgaaatttatggtcgctcatcctaaaa

SEQ ID NO: 950 - DNA, 1881 bp, Diabrotica virgifera
  misc_feature (1783)..(1783): n is a, c, g, or t
acaaaatttgaagttatccaagatgagaatactgtgccaaatatttttgatacttgtattttggttagggctaagtgtaccctcagatataagtatttttcctgcacttccggtgactgtaacaaacacaagcaacttattatgcaacaaacacagcagagagtacttggagaatttgaaaaattttacgttatgggcttatgaaatgagagatgcatcagctcagtcaatctcaagtgtgttaacaggaagttcctacagtttaggaaatcaagccgagtgtcttacagctcatgctccttttccaactcaatattgcttggctattattattggtaacattcctaataccactataaagagagatccgttatctctggagttcaactctaatgaaaatgtgctcgacaaactttatccgtatcaggatgaaacaaaattcccaagaaatattgcaaaaatgggttggtgttttccagcatcttgttcacccaacgatgcaaaagaaagtctcgataattatctacaacacgttgactactctctgaagaaagacaatattaccttcagcgctcaagtcccatcaattctttgccaatgctcagataagcagctaaagatggatacagtagattttgtattttgtggacttgttatagtgttggtcattcttgtttcatcaagttcctatttagataatcccgatgaagacgattcaaaaaacaaacagtataaactcctgcaagcattttctatgaagagaaatattaaagatttaagtaagattgaggcaactgaaaaaccactacgaatcttttatggaatgaaagcgttttcactcattatgatcctaacgggtcatagatctgctttgtttacagctgcaccacaaataacattagattatgttgaagagctgtaccgaacattatgggccgctatcatctttcatgcagatctctttgtagatacattctttcttataagtgggttattagttacttacggccttctaaataacttaaatacaggcaagaaatttaatccagtttttatggtggtagccagatatttaaggttaacacccttatatgcattttgtatattttaccaagctactctgttatatcatatgggaaatgggcctttatgggaaccagtattaggacaagaaagacaagactgtagaaagaactggtggactggaatactatacgtatcaaatttgattgattctgagcacatgtgcatggttcaatcatggtacttggcatgcgatttccacttcttcttgttagcattggtattaatatatattctacataaaaataccagatgtggtatactagtgaccattttgtgtatgttagctacaatatacacaacatttagtataatatatgtttaccaacgaccagcgtttctacggttcttgcccaaatttctagaaaatccgaaaggaagttacgattataatttatcgtatatcaagagttatacaagaggattaccgtattttataggaataattgctggttatatttatattaaatacaagactaaggattatgaaatatcgcaggggcgctattacggtatcctggtaattgcttccagtttgatagctatacttatattttctggtaaagtattctacaatccataccacaaatataatgtcttggaagcgtcgatatacggatcagttcatagattactatgggccgttggaaatttagcatttttatacggaataagctttggacagaaggacttctgtatnaattttttcatggacaattttgtacctctaagcagctcacatatggagcatttctagtacaaattcctttcaataaaagaataggactatcagaaaat

SEQ ID NO: 951 - DNA, 1002 bp, Diabrotica virgifera
gttcgctgaagttcatcatatgttagaaacgaaaactggggatggattatacactggaaaaagtaaaaaacgataaagataatgaagggaaaacggatcagttaaaacataaagctgactttgaagaagctgtggtagctaccggatttggaaagtttaacatttacttgttaatgctactaattccatcttcatttgcacaagcatttgagcagatgggattgtcttatgcagtaccaatagcagaatgtgatcttaatttgacattggaacgaaagggacttctaaccgcagtctcttttggaggtatgattactagcggcatatttatgggaattctctctgatatatttggtagaagaaaactaatcttatggggatattttttaaacggacttgctaacattgtagcagcaatgtcacaaaactttttaatgttaatgatagcaaaatttttttgtggacttatatttaatggtccattctctgctagtactacccttctcacggaatatcatgcttcacaatacaggtcaaaagtacaactattcaggggtgttacatttgcgcttggatttttcatactgccacttgttgcttgggctattttaccgctccatattgagtacgaaatgtttggatttataaaaatacattcctggaatatatttatcttatgtagttccatgggaacattcttgtctgctattggattttggtttatacctgagagtccaaagtatttgatggcttacggcaagaacacagaagcacttgcggtttttcaaaaggtatatagatggaacactggcaaaacaaataaagactatccggtaaaggcgcttaaggaagagttggaagctacgattagaggaacccaaaaacggagggcatctgtccaaatagctggtaataaattttttgttcatttgaagccctttattaacctccctgtgtcttcatctgatttagcatgactatgtcatatatggtatgatgagc

SEQ ID NO: 952 - DNA, 1363 bp, Diabrotica virgifera
  misc_feature (1194)..(1194): n is a, c, g, or t
  misc_feature (1265)..(1265): n is a, c, g, or t
  misc_feature (1279)..(1279): n is a, c, g, or t
  misc_feature (1285)..(1285): n is a, c, g, or t
  misc_feature (1352)..(1352): n is a, c, g, or t
gtcgtaggttatgtacgaatctttaaacatgtttatttagaactcccgtaaaaatggcgtaggcgtgaatacaggaacaaattatgagtagtttagaataaagtcacaataggaaatacctttaacctttacaatactatcagcggtttttctaataattcagaaatcattccaaaatggaaattcagtacttaactaaggaccatttaattgggtttgataattacaagtataactgcatagactctggcatattgagtatatatgttatgcaccccttctggaactgggtagtaaaatactgtccacgtttcatagctccaaatttactcacatttactggatttctgtttacggtgatcagttacctaatttttgcgctactcgattataacttttatgcttcggactcggatcgtcctgatatagaaccacttgggaactggacgttctgggcagctgccatactactatttgtagcttacactttagatggtatagacggaaagcaagcgaggagaacgggtaccagtggtcctctaggcgaattattcgaccatggtttagactcctacacagctggtctaattcctgcagccatgtactccattttcggtcgtggcgaaagatatagtttagttccttttagaatgttttttaccatgtggaatgtgatgatgaatttttatatgacacatttcgaaaagtacaataccggggtgatgttcttgccctggggatatgatttctctatgtgggggacaataataacattccttatagctgggatatttggatcagaaatctggcaattccgatttggcagtgtaacagctggcaacatatttgagctgactctctatatttcttcactcatatcgaatgtacctgtaatatcttataatatttatctatcttacaagaataaaactggcaagatgagaccattttcagacgccatcagaccactcttgcctgtgggatcattctttctaatatcactagtgtggatcctctactcccctggtaacattgtggaaagagatccaagagccttgtttttcctcttggggacagtgttctcgaatatttcgtgtcgattgatcgtggctcaaatgagcaatacaacctgtgatgcatttaatttactgctgatccctacgtcgttcgtagtggcagcgtctcttttaaccncatgggcaactctggagttgatgcttctatatttattatgtatatttacttcccgtgctcatatacattancgaacttgtgtggntagacnaatgtgtcgacatttcaaaggtaactgcttcacccatcagaaacaagtagattgactatgggtcgancacgcgtgatg

SEQ ID NO: 953 - DNA, 957 bp, Diabrotica virgifera
tgctatttcgtgataccgccaagaaaaccaacagtgccaaagtgcgcgagtttcttctgtttgtgcacattgcaggaatagcacttctaggatacacttctaggattaaacgggggatgagagaatagaagcaaataaaaatgtcgcaagttgaacggaaagagtaccaagaatcgaaagtaatgaggacagtgtcacctgctcgaagaaactatagctcaaatcaaaatttatcccaattcgatagcaacttagattacctccttgaagaccttcaaaactcagtatctcgtccaggaagttcgttaggatacaacagtagtggaagtcatacacacagggaaacttcccgtgttgtggatacaggcagaagtaactcgttgaatagaatcgcccaattaaaaccttcaaatccagtagaatattcttcggatgatgcttacaattatacaagtccagatggaaaccaaaaagttagtggttataaaaaagaaaaatacatttacaaaactaccagtgaggatataactccagacaagataagaactcaaaatagtataaatcaactagataatttattagatgatctacaacaagtgaagaaatcctcgtttttggactcagagacttataatagccctggatccgatccaaagtatcaaagctccatatcgaagaaatctattaatagagaactccactacggagatactcctcgaagcagttccagaagccgaacccttgaaagagacggtacgctacagagggacgtggagtacatcagcgaaggtacttacagtgatacccgcacgaaccgtccagtctccccagccgtcacctccagaacctcaacgctagcaagcagaccaaagtcaacaacatccacgagtaccctgtcgaggtcatcgaaacagtcactccagaaatagatccctgagtgctggcccacttggacct

SEQ ID NO: 954 - DNA, 1117 bp, Diabrotica virgifera
  misc_feature (1062)..(1062): n is a, c, g, or t
aacgaaacaaaatggaaacggcaccatgataggagctaatggaatcaatgtaacagctgataatgttctgagtagagtaatgcacgctgctgaaaattcaatgtcgtatcatacagatggagatgttatcagaggtataggaggtcatccgttagttggaccagaattgttgtcaaagaaatacaaagaacgagatatacttcaaggtgaattaccccgaccacaacgaccagatattattgaaagagaagtgatgaacaagggtcctcctataagagatgaacatcaccctcctatgccacctacctcaaaccataatcatgatcatgttcctaacgatttaaattcggaattgcccgaacactacgacttagaaaatgctagttcaatagctccctcagatatagatatagtttatcattataaaggctacagagaagccggaggtgtaagaaaatacaaagctactcctcctcccgttgcaggttaccaccataaaggtccaggccaaggccagcatcggcattcgcctcaccatccagcaggttttcccccgagggcaccacccgttactagtcctaatgtccgacctcaccaaagtacgcccttagcaagacttagtcctagcagtgaaatgagtgctcaacaacctagaatattgactttacacgatattagtggtaaacctttacaaagtgccttattagcaactacctccagttcgggaggagtcggtaaagacgttctgcatagtaatagtgaacgaagtttgaacagtcccgttatgtcccaactaagcggacaaagttctagtagtagaaaagcggctgcgccccctcccgttacctcatcttcgcctggaatggggctcaccgccgaagaaatagaaagactgaattctcgccctcgcacctctagtttagtatccaccctcgacgcggtgtcgagttccagcgaagcacctcgcgggggtggtaataatcacttgaaccatttacgccattcaccaataccagaagcgatccttagatctttggattgggacgctgctcatcccgatangtttacgtgttcagaaatagagtacgataatgccagcttgactggcgacaaatac

SEQ ID NO: 955 - DNA, 1180 bp, Diabrotica virgifera
cagtttcattttcatttgtgttggaaaattttaatgtcacaaaaatccaataaaaatatacttcttacagaaaaatacatatagaaacatcaacagcattaatggaaaatttttcaaacgtaacataacgtaagaaaaattccaaatacattcaaatctccgacaatgttagcaattttaagagctcctcacattaaaagtgcccgttccaggtttgcggaaagatgtcggagacaacagtatcaaacacgttgtatttgttacatggatgttttgtcatcaaatagtatagtagaaaggaaaagacaatattctataagctcccatgtgattattagtaattttaaccaaaatctattagtcagtcataatccaaaatggaatcacgatttttatagacaattctcaatatccagtgctagatttgacaaggaacctttaaaaccctcctccaaggtggaagaaactgttcaagaactaaaaaagaaacaagaggaagagcaaaaagtaaagaccaaggaagttacaccagttgtagttaagaaaccattgacaacaagagtttgggaggaattggtccattactatcatggttttagacttctgtttatcgatgtgaaaatttcctctgggttagtatggcgtgtattaaatggaaaatccctctcaagaagagagtacaggctgttaacgagaacagtaggagatctcttccgtttagtaccattttcagttttcatcatagtaccatttatggagatccttttaccatttttcataaaatttttccctggaatgctgccgtctacattccaaacagcgacagaaaaggaagataaaactaaacagcgattaaaggtgcaattagaaatggcgaagtttttacaagggactctagacaatatggctgtacagcataaagaaaggtactctactgaggctaaacaatttgttgactggtttcataaagttagaacttcaggcgaatattaaaatctgaagatataatgaagttttcaaaattgtttcaagatgaaatcacactagactcattaagtagaagtcaacttattgctctctgtagggtattggaagtccaaactttaggcaccaataactttcttcgtttttcattgaggatgaaaattgaggtcatttggctgctgatgataagatgata

SEQ ID NO: 956 - DNA, 858 bp, Diabrotica virgifera
gaaagaagaagactaatgaacataaaattgaagtgtaaaaatataaaaataatgcagtaatttttcaaaattccatattattaatcaaatctgattttagattatttccgttcgtgtacaagttagttgtccgtatttttaatttatctatataatggcgaatattgctgctcagagaattaaacgagaattcaaagaagtaataaaaagcgaagaggttgcaaaatgtgctattagagtagaactattgaatgacagttacactgaattacgaggtgaaatagcagggcctccagataccccctatgaaggaggcaattttgtattagaaattagggttccagaaacttatccattcaatcccccaaaggttaggtttattacacgaatatggcatccaaatatatcctctgttacaggagctatatgtttagatattttaaaagaccaatgggctgctgccatgaccttacgcaccgttctgttgtctttacaagctctactatctgccgccgaaccggacgatcctcaagatgctgtggtcgctaggcaatataaggagaatctcgaaatgttcaccttaacagcaaaacattggacacacgcttatgcgggaggtccttgtgtaattagcgattgtgatgaaaaaattagacgacttatagatatgggaatagaagaacacaaagccagagtgtcgttgtcatcttataattgggatttagaaatggccacggaacagttattcaattagtaaatcaccttaatttgcgttaattacggtcagcgataattattagtttttaaatttttcaatttattttcattttctttgtaatatattctaatttgtctctg

SEQ ID NO: 957 - DNA, 814 bp, Diabrotica virgifera
ccccacgcgtccgattacctaagacaactaagtaaaatggcttcacaaaaaatgatcgttgctctcctagtagcaatcgcagtctcaggctgtttgggaggcccttcagttcccgcagtcccagcagccatagctgctgtaccagcagcttactctgtcccatacgcctcatcttacaccgccagtgttgttaaccatggtatcgccgctcccgttgttgctgcccccgtcgccgctcctttggtcgccgcccccgctccagtcgttgccgctcctgcgagagttgcagctcctcttgtagctcctgcagctcttccatacgccgcccttccagctgcttacagcgctcttcctgctgcttacagcgcatatcctgctgcttacagcgctctcccagctgcatacagcgctcttccagctgcatacagcgctcttccagctgcatacagcgctttgcccgcagctgctcctttagtagtcaggaagtaagcggattgaaggaaatgtgaccaaatacaacaaaccaactattacaaaaatatctcttgctacggtggcatatagttaatgtattaagaagaaacgttgctgccttatcaggggtgaatgacctgtcgtgtatatagtgtatatttgtgaagctttaggtaatttttaaataaataattttgtattcattacgaaaaaaaaaaaaaagaaaaaaaaaaaaaaaaaaaaaaaaaaaaaaaaaaaaaaaaaaaaaaaataaaaaaaaataaaaaaaaaaaaaaaaataaaaaaaaaattgggaaaaaaaaatatggggggggcccct

SEQ ID NO: 958 - DNA, 910 bp, Diabrotica virgifera
  misc_feature (873)..(873): n is a, c, g, or t
ggcgtgcggaatgaaaatttgcgtgaggttaaaaattaataaaacacatttccttttatataaagtttagtttaagaaaacataaaaatactgacatgcatagattccttaaacttcagggaacgtctttctataagtattcacgcgagtcattcagtacacttaacaccagtgcaaactcctgcctcttatgtaaactaaacaatatatgcaaaggtacatttaggtataattcttcaaacccaaacccaaacttaaaaattaggaaacctagaaaacgaaataaaaaggagtatgccgagcttctaatagttacagataattcatcatgtcagcgtagagcaaatgtaaaaaagttaacctttagtgaattagaattactagcaagcacaaatttaaatttaagcgaacttcacaaactcaaggaaatcttacaaaatccaacagtagccaatgaatatagttacaataatttgaacattatcgataaccttccatcaacaagtgcgagcaacattgattttgtcaatatcaattcaggagaaatgaatgagaagactgttaatctgactgttcctgaacacatggtctctcaaaatgtaccacctaaagatattctgaaagatacaacatctacgaatgaaacaacaactactttttttcaacagccattaccagcggtagatatagtagataaaatgaatgagagtgatacagctgagtgtccagcagaagaggaggaacttgaaagcataaaggctgttaatacattatttcaaccagaagtaacagatgaacagatatcagaagtagaagaagtaaaagatcctcccggataacgttttgtaagagtaggcatagatcgtaatcgcnaaaaagaaatagctacaaaatctggtgctgcttacat

SEQ ID NO: 959 - DNA, 938 bp, Diabrotica virgifera
tgtagattctcatttttgtggattattcggattttggtgtcaataagaccttctgctttggtggcctatagattgttgtactggatataaaaaaatcaaaatgaaatatctcctaacagcatgggatttggcaattgcagcatgtactgcggcagaaattgattttgaatgtcctacacctggaaatgaagcaaccttctatccagatccagttaattgcgctgagtatattgagtgttttgctggaaaggcaaatattatggaatgcccagcagatctatggtggaaccaagagaaacaatattgtgactttaaatccaatgttgattgcaaaatcgatccctcagctggaacagagcctccacgtacaacagtgacagatccaactcggccaacagattttactccagatcctcattgtccatacccttctaatgaaattacgtatgatttcgttcctggtaattgctcagaatattacgaatgtgaccacggactcagatatcttgaaacttgtcctcacaatagattatggaatcatatcaaaaactattgtgattttcctgaagaagttgactgcagtcgtgctccagttacaactaccacatctggaccttctactaccccaaattcaatttgcgatggccaaaaagacggaacctttttcgcagatgaagatgattgtgctaaatattacgaatgtgtacgaggacaggctattgaatttacatgcccacctggtactttgtgggacgaagaagaacttacttgcgactttcctgatagagttgattgtaaagtaacaccaaagagtttttaaatttgtatttactgtttttagcaaaactcagcaacttttgtcgaaaatttatttttgtatacagtcaaataaataaataaatatattaaatcgaaaaaaaacaaaggggcggcccgtt

SEQ ID NO: 960 - DNA, 1228 bp, Diabrotica virgifera
actggacttactatttaaaattttatcaaatatcgttgttttacgtacagaaaccacttagtattttatagttaattattcagaatggccgctctacaacgtttaacaggaagaattgcagttgtcacagcttccactgatggtattggttttgccattgctcaaagactagctcaagaaggagctaaagttattataagcagtaggaaggaaaagaatgtagaaaaagccacggcagcactcaagaatgaaggacttgatgtcactggtctagtgtgccatgtatcaaaacctagtgataggagaagattatttgaggaagcaaaaaaagttggaggtcttgatactttggtctcgaatgctgcaattagtcccgccgtagggggtgttctggactgtacagaagaacactgggacaaattatttgatgtgaatgttaagtcttcttttcttttggctcaagaagctctgccactcttgagaaacagtaaggcagggagaatagtttttatatcttcaattgctggtcttcaaccttccgagtttttgggagcctattctgtaactaaaacagccttactgggacttaccaaggctgcagctgtacacttagctagggagaacataactgtcaattcagtgtgtcctggtttgatagagacaaagttttctgaggccataacaaaagatgaagaggcagctaagatggctgtgccagcaataccaatgaatagatttggtcaaccaaaagaaatatctggtatagtggcttacttagcatctgatgatgcatcctatgtaactggggagaactatgtgatagcaggaggaatggcatcgcgattataatttctaaagaaaaaaatttacatgtacactattggggggtggtcgggggaataatatatccccaagggaaatgtgggaacagggggaaatatttgtttataaaaaaaattattatgttttttttttaaattttttttttttttgttttaacaaaaaaaaaaaaaaaaaaaaaaaaaaaaaaaaaaaaaaagggggggggccccttctaaaggattccaattttatcctacgggggggaatgcgaaacccataattttttctaataggcccaccataattttaaattccccggcgccctctttttttaaaagggtggggggcgagggaaaaaccctggggtttaccccaatttttattctccctttgggccccccctccc

SEQ ID NO: 961 - DNA, 1161 bp, Diabrotica virgifera
atctgacctaaccctacttttggcatttgatttcaaaatgttagcattaaaacattttgaaaacacttaactgacttatatgctacgaaaacagtaaatagtttaatttattttgtgatgtaatgtaaccaaataaagtataatatgtacaaaggtgtaattttaaatattaggttacataaaagtctaaccacacataccactagtttactaaagcaatacaaatgtggagtaaacttcgttgttcccagcactacttatgttaataaaacaaactcaaaatcttcacctccacttcttgtagatatagcagacaatggtgcgttacctttgtcagagctattacctcacaagccgaaggtggccccagcttggcaggttactccatccaccgacagttccaacttagtaaagcattatatgaaactatcaaaaatcaggcttacatctctcgtggtgataacatctatggctggttatgcagtagcaccagccccttttgaaatcacaacattcttgttgtgtactgctggtactggattattatctgcagctgcaaatgcaacaaaccaattccatgaagtgccatttgatgcacagatgtcaagaacaaaaaacagagtattagtttgtggaaaattaacgcttacacattcaatgttgtttgctgctactacaagtattactgggttaggaatattgtattatggggtaaatggtctcactgccagtttaggactaacaaatttaattctatacacatcagtttatacaccattaaaaaggataagtattttaaacacatgggttggatctatagttggtgccatacctcctttaaatgggttgggctgcttgtgcagattcattaggacctggtgcatggctcatggccgccctcctttacagttgccaattttcacattttatgcttttatcttggatctacgaccagattattccagagcacggtataggatgatggctgtgactgatctttttccccccactccgccgccccctcactccccccacccccccatttccccctcccgcctagccttgttttctttcccccctccctctccctatttcccccctgcgggttctttttttgttatctctccctcttttttttttctctcttcttttttctccccc

SEQ ID NO: 962 - DNA, 502 bp, Diabrotica virgifera
gtgtttaatgaaggtgtagtgttcatcggtaaacacgaaataattcctagccatggtgcgtatgaatgtattgagcgatgctctaaaatccataaacaatgctgaaaagcgcggtaaaaggcaggtccttatcaggccttcatcaaaagtagttgttaagtttttaactgtaatgatgaagcatggttacattggcgaatttgaaattgtagacgatcacagaagtggaaagatagtagtaaatttgacaggaaggttaaacaaatgtggagtaatttcccctaggtttgatgtaccaattacacatattgaaaaatggacaaataatcttttaccttcccgtcagtttggatatgttgtgcttaccacaagtggaggtatcatggatcacgaagaagctagaaggaaacacctgggaggaaaaattttgggatttttcttctaagatagatttataatttaataaaaattgtttgtaaaaaactagttctagatcgcgaca

SEQ ID NO: 963 - DNA, 1077 bp, Diabrotica virgifera
gtgaattatgtgaaggaagagtgcgttaaaaaagttgtagatatgacgtggaaaaggttcaataaatattttaatgattactgcgaacattctagtattattggatgcaattatgtggcagagaaacggtctaggactgaacgagtactatggatcgtccttattgccatagcaatagctctatcagtttactttattttggaacaatacgaaaaatatgatgaaaatccatttatagttagtttggcaacgagggagaggcccatatataccataccatttccagctataaccatttgtccgttcacaaaagcagacaagaataaatttaactacacaagtgttcttaatagactttgggacaatgaaacagtttctccatttgaaatgcaaaccgcccaatatatgtcattggtttgtgaagacaatagcattgatgatgaggataccattaacactcatttgttaaaaaacgaaacttttacaaatcatttctatgaaagacttgatgagattgaaaccttagaagaactggtagatgactttaactgtgacttcatgggcgacaatgtagcttcttttaattgcactaatatttttactccaataatcttggatggaggtatatgctatacctttaatatgttaaacagagaagaaatcttcagacctaaagtgtaccagtatatgcatacccacgaagtaagcttggaacctaaaagtagttggagtgtcgacgatggatattctgaaggtagtggaaaaaatgcttatccaagacgagcgctacaatcaggtgcagataatgcattgctagtgatgttgttagcaaaatctcaagataatgattatatatgcaataccgatgttggatatagtatatcggtccatttaccgagtaccattccacagacaaaaaaggatttctatattcttccactagacacaaattcacaaatccattcttcagccaaatttagtcacaacatccaacgctgtccaaaaatacaagatagaggatagacaatgctttttttagtgacgacacgaatcttggaatcattccctaacctaccc

SEQ ID NO: 964 - DNA, 935 bp, Diabrotica virgifera
acaaggtcgacgaggagattgaagttagtgctagttaaaatggttcagcaatatattattgcgggttttgcgttgttttttgtgtttgtttgttgtgtgcatgcagattacagaattgactgtatatccccaaataaagaaaacacaaaatgtgagtcaatatataagtgcaaaacatttacagatgctcttaaaggcactgtaacgcaatctcaaaaagatttcatgaaagaatccttatgtggatattatgataatatacctatagtgtgttgcggaactaagtctgactatacttcaaaacgaactagaaggagcacagagtccaaaacaaattccgtaattgcggacactcaatgtggagtactggtgaatgatcatcttacaagtggacaaccccaagattatccatgggctgtaaaacttatctataaccaaactttacaccgttgtgaggggacattaattcataaaagatacatcttaacatccgctcagtgtgtcaacaaatttattgccaactaccacggaaagttagctaaagctacactaggtctttcaagttgttcggagggaaaatcttgtgtaaaatctgccctcgacgttggcattgagagcgttaccatacataaggactacggtacattgcgaggtgcaccgcacgataatattgcattaattcgactagatcaggatatctcctttaatgaaaacattctcccagtctgtttaccccaacaagaagaagagcctgaagttggtgataaggtaattgcagttggatggtataaaaggagttcaacaaaactgaatgcggaacttacaatagttgacaataaagtatgtcaggaacattacaaaaagcaaattatgatccaacagtagtcactgagagaaatatatgcgcagcgggatacgcgtccaaaatttgtgct

SEQ ID NO: 965 - DNA, 1576 bp, Diabrotica virgifera
ttaagttatttgagttaacttatcacaatgttattacatttaatttattttttatttatctgtgtgtataccaatgcacaaattattgttgatacaccaaatggtcaagttcaaggaagtgaggaagctggtactcagggtgaaccattctataggtttcaacaaataccgttcgctaaacctccaacgggatcgttgagatttagggaaccacaaccagtcgataaatgggagggtgtctttgacgctactcgtaatgacaaagtttgttaccaacaaattgccgacccagtttcgggagaaaatgaagattgtttatttgtcaacgtttacacaccgctgtatccattgccaaaccaaggattgccagttatggtctggttttacggagggggatttattggcggtaccgctaacttttacacttacgggcctcattattatatggaacaaggcattattgttgtaacagtttcatacagaattggtatattaggatttctttctactggagatacggttataccaggaaactacggtttgaaagaccaacagcttgctttgaagtgggttcaacaaaatattcaatcctttggaggagacccagataaagtgacgatatttggacaaagcgcaggaggagcgtccgtgactcatcatctgctaaatcaaaaatcgacaggtttatttagagctgcaatatcacaaagtggatctgcactttgtccatggggatatcaatggaaacacaaagctatcgcttacaagatagcatcaatcataaatccaaagttcaacccaaattcaacttctgaggaattgatgagttttttgcaaagtgttgccccggagaacctagtaaatgcatctcttacacttctagacgtctgggataaaaacgaccccattaccggatttcttttcacgccagtccttgaacaagaacatgagactgccttcttaacggaaaggatgtataccataattgaaagtggtaacgcacagcgagttcctctgatcatgggaatcaattcagaagagatgctttggaatggaatggatcctgagagtatgtatcggaccgctgttgggctagacaatgacctgaccaagctggtcgaagaagatatgcagatacatgatgcaaaccaaaaacaaattgtaggtgctaaggttaaaaaggtttatacaaatggacaattccaagatcatctcggggatgccgttgaatttttcagcgatacttcatttggaagacctattattcaacatgccaagctacaatcccagtttagtgacgtatatttttaccacttttcctaccaaggaactatcccaggggttcgtccatactaccaaggagcatataaagtatcacatggtgatagaacttctaattaccaacgagaaacatgctaataaccaccaaattgaataacatttccaccagtagatcgatctaaccagccaaagatccccaaaccctcactaagacctttgcccaaagctggaccgcacattcggcaattccagcacatttcttaacaaacttactggcccaactcttctacccaat

SEQ ID NO: 966 - DNA, 1011 bp, Diabrotica virgifera
gaggaaaatatttttgagattgtatatttttattttctttcaacaataaaaaattaaaatggacaatgaaaattctgttatttatggtttagaattccaggccagagccttaacacctcaacaagcagaaactgaaaaaataaggtttataatcggaacccaatttctaaaacagactaataatcaaatccatttgatagagtttaatgaagaaatatccacaataaaaacttcagtattccatcattcagcgggagaaatatggaaattaacgtctagcccaactgatgcctccaagatctcgacttgctacaactctctagtaggagaaaacagctgcaccatgaaaagtgcaattttaaaattacctgaaaacgaaaatcatgataccatagaaaatctagaaatcgtgacaaaactggatacctcttcttttggcaatgatattaaaactacggaattccatcccactgacgcaaatacagcagttacattgacggacagccatgttgttctttgggatatttctgagactgaaggtagagctgttagtaacatagccttagaaggaaagaataatcccaagtttacaaatggaaaatggaatccacatcaaaattgtaatcagttcagtacagcaactgagacacatataaagacttacgatattagatctggagaattagcatggagtatcgatcaagcacattgtcaatttatacgtgatatggattataatatgaacaaactataccatctagctacatgtggagacgatgggtttttgaagatttgggatttcaggcaaaccagtgctccagtattttcaagaagtgatcattcccattggatttggtgtgtgagatttaatccattccatgacccagtgatgttaacagctagttcagatgcacgagtattatttatcagtgctgcaagtgtcagttcagaaaatctcagtgagacacttattactgacgataaggaaggcctagacacaaaacaaaatta

SEQ ID NO: 967 - DNA, 1104 bp, Diabrotica virgifera
agaagtgtcaaaaaaacatgtaaacataaccaatgagatagtgacgacgtttcttatcgagggattattatagaagattaaactgttttttgttgacgtgttatgttataaattaaattattcatctatttgtattgaacttgtgaattatacaaaacatatgtgccagtgactattagtgtctaaaagaaattgtaaagttagaagtatcaacattgtaagaagagttataattctctgtacatagtagtatcaatctaagaaaatatgccagaagaaggaaaaagggcattaattttggttggaggttatggtaccagattgagacctttaactttgagtagacccaaacctcttgtagaatttgcaaataaacccattctccttcatcaaatagaagcacttgtagatgctggagttactgaagttatattagcagtatcatatcgtgctaagcaaatggaagaagagttgacagtggaagccaaaaaactgggaattaatataatattttcccatgaaacagaacctttaggtacagcgggaccaattgcattagccagggatcatctttctaaaagcactaaaccattctttgtgttaaattccgatattatttgcgacttcccatttaaagcattggctgaattccataaaaaccacggaaaggaaggtacaatagtggttactaaagtggaagaaccgtcaaaatatggtgtagtagtatatgataaagacaacagcatccaaagttttgtagaaaaacctcaagaattcatttctaataaaattaatgctggtttgtacattctaaatccaagcgtcattaataggatagaattaaaaccaacttctattgagaaagaagtatttccttacatggctgctgataaacagttgtatgcatttgaattggaaggtttttggatggatgttggtcaaccaaaagattttctgacaggaatgtgtttatatctcaaacatttaaggcagacaaatgaagacaaaacttataaaggaccaggtgtcgttggcaatgtattagtagatcctactgctaaaatggaaaccatttgtcaatcgggtctaatgttacaataggac

SEQ ID NO: 968 - DNA, 449 bp, Diabrotica virgifera
atttctattggatgtttaagttttatgcattacgtttcaaaatgcattaagtttcaaaagcaacttaatgcattaagtttcaaaagcaacgtggaccgtataaagaaaaaattttcataccattattaaacaaaggtaaaattttctgaggtggctctaataatatgatcacccactgcatacctgtaaatttattataacggaatcaattttgcttaaaatttggaattagacttattttacccccctcttcataagttatatatatgtgcagctgagatttttatttgtaaggaatgaaaacaacctcatattgaaaaaataaatattaaagcgttttatagatttaaatcaaattagattatgttattgaaatattttcaattgtagtaatgattgttttatacattgtcgaaccttgaacaatctaaaaaacttccccctttaat

SEQ ID NO: 969 - DNA, 1207 bp, Diabrotica virgifera
tgatgatgatgatgataatgatgatgatgatgatgagctattaacttcctatagagggttatgttaaaatgtataaatggtactaccctttggtttaccgcttttaatttgcaactcaggtttttccatggggtaactagaacatccaatagacaataggctcctcgtttcataaactttcttctgacaccaattatagcacaccttaggggcggaaatactaatctaatcatttttttagtagtatgtatttgtttaaacttaagaaatattcacttaagcaataatacatgttgagtcgtttaggtatttttgcccaacagaagaggcacaaaagatgtcggtcgtcttgaacgttattcttcaatattattgatgttactagttcacgtttttggcagaagagttgaatgtagacatagtttacgtgtcacattgtttaaaaaaatattgacgttaagaaataataaaaatttgttgataaagtccgttaaaagtttgttcgtttacatttgtgtaaataagatgcattgtaagtaagtgtatatatacgatagtgtactagtaacattacattcgtcttgaaattaattcttgatgattgtacgtggttaataccgccatttgaagcgtccacaccaaattacttatttcaagtgggggtaataatttgtttttcccatgttttggcacaaatcatcgattagtatatttctgatgtatattaagtatattttcatgattgaataagaataatactaagactaccatataaaatatgagctaataaaacaatgtgtgacgatgaaccttacgaatattcaaacgaatcttatttttttttaaatataaaaaattgataataaataataaaagttgataatgaaaagtgatataatagtatattatgcacgcgacatttaagatggccatttatgaagcaagtatgagggaaacgaaaacgagccggcctagcggcgaagtttcgtatagagtacccggtttcataatgataattaaatggcaaggtctttttacttatttttaaaaaatggggccttttctccaacaaaaaattcgccatattcccaaacaaaaacctttatttgtataaacccaaaaaaaaggacaagtttatttggcacagaaaattcccggaccgggtaaaaaggtaaaaaaaaaaattcgcctattttttttttttaaa

SEQ ID NO: 970 - DNA, 2013 bp, Diabrotica virgifera
atatttgtctccattcttgaaagaggtgaagattcttctatagctccgtttgctgcatgttcaatgccgtaaaacgatacaaaaataaaacaatgtatgactacattggacggaatgtgatattttctaattaagactgaaataactatattttttttatactgaccgaccgtgttgttgattattcggtcaatatggaatcctcaaacctaaccatttgtttgtaggtggtatagttttgttcgtttagaaacaaaaaaaatacaaaatagaagagcgattctctaaaatcgggaaatgcgtgcagaagtactaaaaggaaaagatgcacaaaagaaagttatttcattattctacgatgttatcaaaaagttgcgccattgcattgtaacgtacgacgattttatataagatttttgatattttttaattttttcagtacctaaatgaaatttattctggaatgtaaaaatctcgaaaacaagtacctagtatttattaggtcccgaccagaactgctttcaaatcgaatgtgatttatctatgcgagttttggtcattagtacatagtgtataaataagtagaaccacagcagattgcaaacaaatatgttaacattgttcgtttcatctcaaaatggcaaatatgggtcgataagtcaaaaaaaacatcaataaacggtcttcattttgaataacttatccaaaaattcccaatcctcactgtttcttccccctcttcttttcttaatacccctctgtctttctcagagaattcactccttgtgagaccttggtttgtttcttttaatttactctgaagagactcttgcagtctctgtttatttgtgaaacatttctctcagtgtgagacggtttacctttgtctttcttccactgttatcattttcccccgtttgtttatatgttcctccgttctctgttcccttctccttcccaatttgaaacaaagagaggataactaaaaatattaccgtaactattttccattttgaataactggtaatgttcaacgtttattgccttcgttccacatatatgtaaacgtcactatttttttaatctaatctccctttttatttgtttcttccctcccttcttttttcattgcccctctctctgttaattttttcagatatactggcaaagtctctttatttctgagaaaagtttctctgtctgactgtctttcttcccttgtctttacttccctctttatttcttcatttgtctctttcattttttcaccccatttatctcttctacgctttccactcgcctctctttacaacctgtgggagaattctgtcacacgtgagaaaagacggaaacaaaaagagaataacttctgtttgtttctcctgttgtttcctctgtgtgacacactgtctcgatttctctctatctctttgtcctttttttctccatttatgtctttcccttccccgttcttgactaccctttctttcccccacgcattctcacacacgggccaaatcgagaacaaagagggagattgcctcctttcctctatatcttacattctctccctaggaagctttataaatttttgggaaaaatcctctatgtgggaattcctctacaaaaagtttctgaagggggaaaaatttcttccccttttgtcaaaatttattattctggccctttttcctatttctctttctttttgtttctggttttcccccccccgggttttcccaagggccaaaaaaaaaaaaaaaaaaacttttccccccaaaaaaaaaacaaaaataatataattttgtcttggttttttaaaaaaaacaaaaacttgagggaactcctctgggggggtttttccccctccttttttcgcttcccccccctctcctttttccccccttttttttttttttcttctttttttggtttgggaaaaaataaaaagaacaaaaaaaaatcacccccccccaattttcctctgggggtcctcccccccccctcccccgc

SEQ ID NO: 971 - DNA, 1082 bp, Diabrotica virgifera
  misc_feature (984)..(984): n is a, c, g, or t
atcaagtgtagagggatggcctgtttgggaccttagtaaggggagaccggtataatattcttcaacttattatgatgggtaaaatcgaaggacgcagaggaattggtagaaagcaggcctcttggttgaagaatatcagggagtggacaggaataaagaaagcagaacaactatttagaatagctcgagacagagacagtttcgccatattaatcgccaacgtcaaggggacttgatagagcacgttaagaagaagattatgtatcgatttcctctaagaacatgtcctaggtatgaaatttttcttattttaatagttttcagtaactctcgaacgacatttgctcttccaggccagcttcgttggtctcaatggttgtccagggtatttgcagtattttctatgcacagggccgctttatccattaggcaatataggcagctgcctagggcggcaaattatgagagggcggcaaaaatactgtacaaaaaaatatttgtatatgtgtaaaaattaaaattgaataacatttaagtacatccatcagtggaatagaagtgggcattcatttctagaaaacaaatttcaatttctctttaatactattcgttcaaaaaagacggaagtcgtaaatttagagattattgggccgccgcgcgccggcagaactgcaaaggccattgaacacttcaatgtaaatgtattttgcacattaggcagaaactaaagacttgatttggttggatttatactgaaacttggtgaaactaggtggttcacaagggcggacgcaactgaagcgttatacactggcttcagaaataaaaaatgctctttttaatatctctaacgacgaatatcaaactgcagctgttaaacatcaaactctatatctatatttgaaaaaaatggactttattagctgtgatttggcaacatattttagaaagagtgaacctatccaataaatatgtccagaatcnctgcaatggatctgggttctgtcgttaaagagtatgaagctctttcaaattactttatctcaatcagaaataattttgccatttatgaagaggaagcc

SEQ ID NO: 972 - DNA, 2294 bp, Diabrotica virgifera
gttaaacagtttcaattgtcgctgatgctcatgttaacatttgttcatgatgccatttttcaatttgcattttttattacgaaaacattaattaaattgaattactctaatatttttttttatttttttttatttatttaataatttaaactattttcctcagatgatgaattagattcttccccagatgataataaagctaaaactactcaatatggatctggcgacagtgacgggggtatggatgataactctgatttagatatgaactttagtaagtagaagaataagaaaaccaagaagactaagaatttagacgaacttattgcagaaactgaggagaaggatgatgatcaggagaatgtagatgaaaattcatcacaatgggtcaattccgatcgggactacacatatgacgaattactaaaccgtgcctttgaaataatgagagataaaaatccagatatggctgccggtaagaaacagaagttcgtcatgagacctcctcaagtagtcaaaatcggcgccaaaaagacgtcatttgcgaatttcacagagatatgcaaaatgcttcatcgtcaacccaagcatcttttagattttttactagctgaattgggtaccagcgggtctgtggacggtaataatcagctcatcattaaaggaaggattcaacagaaacaaattgaaaatgtactcaggagatacatcaaggaatacgtcacttgtcatacatgtagatccccagatacaattcttcatctttacctgataagtccgaaaccgtcgaaactgtagcgattatagaatgataagccttatgagtcacgcaaaatctttctacgtatcatccacagtagaatcagagataaatgtgaaaaagaccaggatgaaacacaatttggcttcagaaatggactgggaacccgggacgcactctttgcactaaatgtgttattgcagaaatgccgagatcaaaggaaagacgtctttgctgtatttattgactatgagaaggcctttgattgagtacatcacaaattaattaaaatattaaaggataaaggagttgatagtcaagatgtgcgaatcatagaaaaattatactggcgtcaaacagcgacagcttgcataaatggaaaatcaacagaaatatgcaaaatacaaagaggtgtcagacagggttgtatactgtccccactgttgttcaatttgtattcagatagaatatttaaggaagcgctgcataatttggaatggggtgtgaaggttaatggaattctgataaatacaatcagatatgcagacgatacaattattttaagtgatgatatgaatggattacaacaccttttaaatgccattgacacagtgggaagagagtttggcctaaatataaactgttcaaaaacaaaatacatggtatttagccgtttggcccatcaagattcacggttatatgttgatggtcatataattcaaagagtacccagttttaaatatcttggttgccgtattactgaacaactagatccagataaagagataaaatgtagaatcgagatagcccgcacgacatttttaaaaatgaggtcattcttctgtaatgagaccttgcaacttcaacttcgaaagcgcatgattaaatgctacagttggtcagtcctcttgtatggtgtcgaagcatggacattaaaaatatccaccattaaccgtttggaggcctttgaaatgtggctgcacagacgtattctgaaaataccatggacggctatgctgacaaatgtggcagtccttaagagagcaaatgctacccgcgagctgcttgataacatcaaatatagaaagatggcctattttggacacgtagtaaggggagaccggtataatattcttcaacttattatgatgggtaaaatcgaaggacgcagaggaattggtagaaagcaggcctcttggttgaagaatatccgggagtggacaggaataaagaaagcagaacacctatttagaatagctcgagacagagacagtttcgccatgttaatcgccaacgtcaaggggacttgatagggcacgttaagaagaagaagaatacaaccttgtatataggtgcaactgacgccatagtaagccaaaggtcgtccacctgcgatgtgttcttatcttgacatttagttatctgattcatcggtttctaagatgtcctgttgctagaaataaatcaggctttcccgggctgccctctccccaccggccttgcaattcaagccaggacagcatatgaaaccttt

SEQ ID NO: 973 - DNA, 1348 bp, Diabrotica virgifera
cctttagcggtttgacaacctggctgatgcaatagatttggtaaaagggttttctacctataaatttacaatatattattataaatagactaaactcatcaataaaaaagtttaagcaaatagccatatagctacaatggccgaagacgatgcaatctttgatccaaccctcaaaaaaaagaaaaagaagaagaagaccactttcgacattgatgctgctctagctgaaggtaacattgaaaatgattcagggaatgccccagctgcagaagctgataatattgaatcaaaacctgacgatgatcaggatgatggaaatgtggacattgatttagatttcactaaaaagaaaaagaagaagaaaaagcctttctcagctgatgatttagattcttccccagctgataataaagctgaaactactcaagatggagctggggacaatgatgggggtatggatgataactttgatttagatatggactttagtaaaaagaagaagaagaaaaccaagaaacctaagaatttagacgaacttattgcagaaactgaggagaaggatgatgatcaggagaatgtagatgaaaattcaacacaatgggtcaattccgatcgggactacacatatgacgaattactaaaccgtgcctttgaaataatgagagataaaaatccagatatggctgccggtaagaaacagaagttcgtcatgagacctcctcaagtagtcaaaatcggcgccaaaaagacgtcatttgcgaatttcacagagatatgcaaaatgcttcatcgtcaacccaagcatcttttagattttttactagctgaattgggtaccagcgggtctgtggacggtaataatcagctcatcattaaaggaaggtttcaacagaaacaaattgaaaatgtactcaggagatacatcaaggaatacgtcacttgtcatacatgtagatccccagatacaattcttcaaaaagacactagattgttcttcttacaatgtgaaacgtgtggttctaggtgttctgttgctagtattaaatcaggtttccaggctgtcacttccaagcgtgctgcaattcgagccaagacagcataggaaccttagatattgcaatacaataataaatagactctgttacagaagaaatttctaagtgctaaagaataggtgttgtatgtgttatatagtttgtactataaatctagctgaatagttaaatggaagtatcaatcatattaatatcaccaattctaattatataacttatctattgattattaaattttaataaacagtaaataattaaaaaacttccacgcgtccgcgggcgcgtgagagggg

SEQ ID NO: 974 - DNA, 1104 bp, Diabrotica virgifera
gaaaagggttttgggattttttttagaacaaaaggggattcaaaaaaaattttcatttttttaatttccaatttttgaatttttacaaaaacattccaattatttttaactaaaaataaaaaatttgtatttgaaattgataattatttattataaacttccactgttttactgggaaaagggttgttgctgtagaaactctgtcgtttggtgaaaggacttatgggcagtaactttcagctatagtttaccatcacaataaaatctgaatgtgattaactaattaacattgctgatataacattttcagatttttcaaacattaatttgcattacaccatttttcatatcgcttgtgtcacttgactcactctttgataggttaaacttttcgcttttagctcaaaaaattgcaatgtttttgatatattagatacagaaaaaagtttaattcaacatggtatgtcggtcataaatattttttctttgctctttgacttgtcgtttccatttgtcttgttgatgtccaactctgttcaagacgtttcctcttacgctcatgttgtgggacattggaccagcagatacgtcatcctcttcatttgtatgctcttggtagtttcctttaatcctcttgttcagcagcgggtccagtatgatcaagaatgccatgtatatgaccaaaatcgaaataacccaaattactataatcaccactactttaattatagtagtgtttctattttcatatttgcattcacatcttggacaaaattcttgttcttttcctataatatcttgactaatcctaggtagtataacttcatcacaattgcatttatttggtggtacattggtaatgtataaaatcctagatgtgtggttcttagattccgtcttattcgttactactgaggatatactggggcatatacacttacatctcttgtcttcataggattgtgccgtagataatgtaagtgtagttgctatacagaacactagcaagtaatatttcatttttacacttgtgtttaaatcttaacagtacataatataaatttaattaattctctaaaatcggacgccagagatttgttgcga

SEQ ID NO: 975 - DNA, 2012 bp, Diabrotica virgifera
cgtgttggtagacaaaagcatctcttggacatcgagattcaattcaatgacagtgtacgcagaggtggtggacgcggaagaggacaaagatctgggggcccaagaggtggtggaaatcgcggtggtggtactggtggtagtggtggcggcggtggcaatcgagctagagaaagtgatggaggaagaccagaaagacgttaccataatgatgctgttgatgagagaaacgatgcccgccaagctcctaaggtagatgacgaacgtgatttcccctctcttggctaatggttagcccccagacagtcgttcactaagtattatcagctattttagtggattactacaatggggcgactatcatcacaataaaactgtatattattacaatttaactactttgttatgtcggattccgacataaacaggtctttagaatttcttagcaagtttttcaaatattctataggaatttctttcgaaaatatctcattttgagctattgcaacacgtggactgccgcgcctttgacgccataatataaacaaaagtacagcagacaccgtttctaatgcggtatttttttgaggaataaactatattcagtgtagactggaacactctgaaaggtggtgactactagtcagtgttatgctgtattgttaaacagtttcaattgtcgctgatgctcatgttaacatttgttcatgatgccatttttcaatttgcattttttattacgaagttttaattatttagttataggtttaaaaaaatcgacaggaaaaatttggacatggatgatagtaacgccagtctcgatatattcatattataattaatttatcatattgtaaatgtattttttgggttgctttgtcgcttttctgtatccttaaatatagcatcagctgtatcattttgtcaatgtattgctgtcattaattcaatgagaggaagagtactcattatatcagttcagaaaggcttggaccattttgctcaaggggatattcatgtaccaatcgaacaaaaacctagagttattcattttacagtacgggtatacaagaattaatacaaaatgcaaaaggttaagtgtacaattttttcggataggatataccggatatcctacaaaagacagacaccttccaaagcatttaacgaatcgggcctaagtggatgtgatatctgtaggtttgagtcaacgtttctgacttacgaaatgcttcagtcgaaactgctgtatctatcttcctctttaccaactatttataatcccatcctatttgctcgcattgatcatgtacatacacagggccgctgtatccattaggcaatataggcagttgcctagggcggcaaattatgagagggcggcaaaagcaaaaatacgcaaaaatggtacatgtttgaagggcggctactagagaattacctagggcgtcaattcacctaaatgcggctctgtacatacatacatacttacataatcgatgttcctcttataccggaaggtgtcgaggattgatcatgtttttgacataattttcaacaaaaagaacaacacgaattatgcaaggaaagaataacacaaaaataaaatattaatcagttgcaaaagtacgagagtattgaaaagcgacaacgttcgtatcgacaatagtttattttttgttaaaagcttttttaattatagacttgtaattaattgtattttatagctattggctcatgttgctggtattacgaaccaattgtattgccagtaacatgttaattttgaaagataacacaaaaatggactccgatctgtgaaatgaacaatttctgtccttatggtgacatatgttcactttcgcagaaactggaaaggtgtgtgttgcgggcaggcgcatccgtttagttttactgaagttgtctgcgaaattaacactttcagctctgggccaatatcagatattggtctcatgtgccactttttatacagtccatgggaaaattgttgaaac

SEQ ID NO: 976 - DNA, 1060 bp, Diabrotica virgifera
cgaccggccatattgtagtgaatgattgactgagtgacgtacggctaaagtagccataaataaatcttccaacatctgaaagttgcgaagagctttccaataattaaccatcatggaaaatacgtatggaattggcattgccaataggtacgctctttttttggatgatgaatccgatccattggaaacgcttactttaaaagagcaggaaaaagaactgaaaaagaaaagcaaagtggccgagaaagaaaacaaagtgaaaacaccgaccataccaaagggaaaaccgaccccagctcaaaaaaaaccggttaaagatgtaaatcataagccccaggaaaataaacgcgacgaaactaaacctgccccaagaaacaatgttgacggaaaaccagaacggtcctttaatagattcaataatgaaaatcgtgaagaaagaaataataggcgaaaccgtgaggatagaccatataatggaccatctgaaaatagggatcgtgaagaaaggcctaggagagaacctgcgactggagattttgaaaaccgcaacaatcgtgatcgaggagaacgacgtgaaggacgtgagggacgcgcaattggaaacagacccggagcaccacgtggccaacgtaggaattttgatggagacaggcgaggcaaaagggaattcgataggcaaagcggatcagacaagacaggagttaagccgatcgacaagcgtgacggagctggggcacacaattggggatctcacaaggatgttattgaggaagcagacaggcctaataccgatgctaacgaaagttggggagacgaagttaaaattgaacctattgaaacggaaaagaaagaggaaggaagaccagaggaaggaagaggaggagaggaacagacaccagtagaagaagaaccaaaagaattgaccctagatgaatggaaggctcacgcgctggacgtgctaacccccatttcatattaggaaagctggtgaaggagaggaccccagccatgggaaaaaatgtttgaactttaggaaaaaagaaaggatgaggaaactgat

SEQ ID NO: 977 - DNA, 2223 bp, Diabrotica virgifera
gattgactgagtgacgtacggctaaagtagccataaataaatcttccaacatctgaaagttgcgaagagctttccaataattaaccatcatggaaaatacgtatggaattggcattgccaataggtacgctctttttttggatgatgaatccgatccattggaaacgcttactttaaaagagcaggaaaaagaactgaaaaagaaaagcaaagtggccgagaaagaaaacaaagtgaaaacaccgaccataccaaagggaaaaccgaccccagctcaaaaaaaaaccggttaaagatgtaaatcataagccccaggaaaataaacgcgacgaaactaaacctgccccaagaaacaatgttgacggaaaaccagaacggtcctttaatagattcaataatgaaaatcgtgaagaaagaaataataggcgaaaccgtgaggatagaccatataatggaccatctgaaaatagggatcgtgaagaaaggcctaggagagaacctgcgactggagattttgaaaaccgcaacaatcgtgatcgaggagaacgacgtgaaggacgtgagggacgcgcaattggaaacagacccggagcaccacgtggccaacgtaggaattttgatggagacaggcgaggcaaaagggaattcgataggcaaagcggatcagacaagacggaagcagacaggcctaataccgatgctaacgaaagttggggagacgaagttaaaattgaacctattgaaacggaaaagaaagaggaaggaagaccagaggaaggaagaggaggagaggaacagacaccagtagaagaagaaccaaaagaattgaccctagatgaatggaaggctcaacgcgctggacgtgctaaaccccaattcaatattaggaaagctggtgaaggagaggacccaagccaatggaaaaaaatgtttgaacttaggaaaaaagaaaaggatgaggaaactgatgaagaagaatatgatgtctcagaatatccccaacgtgttggtagacaaaagcatctcttggacatcgagattcaattcaatgacagtgtacgcagaggtggtggacgcggaagaggacaaagatctgggggcccaagaggtggtggaaatcgcggtggtggtactggtggtagtggtggcggcggtggcaatcgagctagagaaagtgatagagatagaccagaaagacgttaccataatgatgctgttgatgagagaaacgatgcccgccaagctcctaaggtagatgacgaacgtgatttcccctctcttggctaatggttagcccccagacagtcgttcactaagtattatcagctattttagtggattactacaatggggcgactatcatcacaataaaactgtatattattacaatttaactactttgttatgtcggattccgacataaacaggtctttagaatttcttagcaagtttttcaaatattctataggaatttctttcgaaaatatctcattttgagctattgcaacacgtggactgccgcgcctttgacgccataatataaacaaaagtacagcagacaccgtttctaatgcggtatttttttgaggaataaactatattcagtgtagactggaacactctgaaaggtggtgactactagtcagtgttatgctgtattgttaaacagtttcaattgtcgctgatgctcatgttaacatttgtgcatgatgtcatttttcaatttgcatttaatattaccaacggtgtattatgtagtgattaatttgaatgatttcaacctgtttaatcgggctaagattttaatttcaaaacttgttgttatagagggccactaagaaagcaaagtgtgggggaaataagaggcggggaaaacgcaaaaaaggatccctattgttttttgggccacgattaaattttttttttttatttataccccccaaaaaagacaatttttttttttttttttgtttttttttgtggccacaataaatttaatttgtggctgctcccccccccaaaaacccccgggaaaatttatttaaaaaatttttttttatggggggcaaaactttttttttttatcatattgtgggggggggggaggtttttttttttcccacaaaaaaaaaaagaacgtgcggggattttttctaattttattttaaatccccccgccccgccgcggcacactatattttttgttgttttttttttttcttt

SEQ ID NO: 978 - DNA, 1217 bp, Diabrotica virgifera
atccacgggtcagaaaatgtataacctattatatattattgtgctaatattattcacaatagcgcttaaatcagtgaatacatcagggcataaggacttttttaaaaagcccccattcaaagatttctacggaaaactagacgcgaatatcagggttggcgacgcaggtgagccgctcatattgacagatcttatcaaaaatggcgatattatatgggccaaggaaaaagctaaagtgacagattttatgccagaagttagcagttatgctggatatttcagggttgacgaaacttataattcaaatttgttcttctggttctttccgtctcagaacgatcctgcaaatgatccagttatcctttggttacagggaggcccaggtgccacttctatgtttgggttgtttcaggaacatggcccgtttgagtttaatgaaaaaggtgagcttggcctaagaaatacatcttggaaccttcaacattcggtcatttacatcgatcaaccagctggtaccggctggagctttactaataaaggatacgcccaaaaccaaaccaaagtaggcgatgatctctactcagctcttgttcaattcttcactttatttgacgaataccagagtcatcccttcataatcactggggaatcctatgctggcaagtacattccagccattgcccatgctattgacaaatataatccttcagcttcagtacgcattaaccttcaaggattggcaattggcaatggtttgactgatcccaagtatcaagtcaagtatgcggattatttgtataaacatggcctggtggatttgaatacgaagaataatctggagaagacagaaaatcaaataattgattacatacttcaggaggaataccatctagctgcaaattatatgacttttgatttggatgacattggagtagcatgtggcttggatatttacaactatcttactctagtatcagatgacagagcgcaagaatatatggaacagttatttcagagagaagacttacgaaaagctattcacgtgggtaatactgaatttgatgacaaaaacgtttactcgaatttgtccaatgatatcccagtctctcaagcccatttagtagctgaccttcttagcaaatacaaagtcttaatatataatggacagctagatattatagttgcttatccaatgactattgactatttgcaaaatc

SEQ ID NO: 979 - DNA, 1449 bp, Diabrotica virgifera
atttcttagttatatatttttttgtttctatagaagtcattatctttatgtatgcgaaaaaagtgatttgttttgacaaaaatgggtaagcagttgtacaacgttgaaaaaaatggagaagaattgcaggaagttacatacgtgggtcttgaaactgaatgggcacattcgttgaaagttaacgatgaagttcgaagaactgatactccttttttatatttaactgtttttatgatacaaatccccatactgttaagtggagcacatacggtatggacttcgccaacaatacctaccataatgtcaaatgacactacaataaatcctttaagtcaaccagcgacaaccgtggacatatcgatgatagtaggagtaccacatctacctggactcgtatcaacccttacactgccgaagctcgctgactttctgggacgaaaaagatttttacaacttatgatattgaatgttttattgggatcgatattgctaacatttagcacctctgtgactatgatcattatctctaaatgtatcattggcatatttttaggtggttcatttgcaattgtgccaatttatattacagaactctgtgaagatcataacagagcaaaattcggttgttttctaggtctatttcaccaaattggtcatttttatagcttcataataggtcccttgtttagttataaagtatacaatcttttaataacattccttaccgttccatttttattattttttatatttttcccggaaagtccggtttatttgttttccaaaggtagaaaagatgaatgcaggactgccttaagcagactaagatctaataaaactactaatgaaattaatagagatatcaaggttttagaggcacacgtcaaatcagaacaaaacactaagaggaacgttactatatttaccctatttaaaaccaaagaaactagaatagggctactgctggcaattttaccccttgcagtacagcatctttcaggggtttcagtaattatgagtttcttagctccattttttaattcagctggtaccagcatctctgggcataaggtagctgtgattgtttctatagtaaaaatttcttcgtttacatttacttcaagtgtagtagaaagagtaggacgaaagagaatgttattaatttctagtgttggaataggaataccactctttttcttaggctgcttcttctatttaaaacacgtaaattctccattaattcaccaattccagtggttaccaatcgtgcttatgctatcaaatgttttaatgtattctatgggattaggtcccatacctatggcaataatacatgagatctttactccggaaaaccgagcagctgctgggagtgttatcatgactgtagtcggcctaatagtactttctttaacgtccagctatcctatggttgctgctaccatcgga

SEQ ID NO: 980 - DNA, 2088 bp, Diabrotica virgifera
caattttataaccaaacttatccttatcggccttatccatgtttggaaaatgtatttaaaaagaaagttttaaatgattatcttgttaatctaaattgagttttattgtacatttatgttatacaaactgtaaacatgcaaaatgttttaagcctttatagatagtgatttttggttgtgtagatatattttttataagtataacaaaactaaaagaaacatgttttccaggacgttttcaagaacaaatatatgtcggacagcatatcaatacttctgttattctacaataggtagtcaaaaacacaattttcataaagacgatagctctacatttaaagtaaaaaaccttttaataggtggattggtaactggctgtattggatactactttgtaggtaataaaaaagttgtactagctaaagaaagtccaaaagtagataaaagtgatgcagttcctggaaattatagatcaaacttgccagtgtatagtttggacgaaatcgcatctcacaattcaaaagaaacaggaatatgggtaacctataaagaaggggtttacaacatcacagagttcgttgaaggacatcccggtggagatcaaattttgatggcagcaggtagttcagtggaacctttttggatgttgtatggtatacacgaaaatccacatgtttatgagattttagaaacttatcgaataggaaatttaaaaccagatgacaggaattattttacttcagatatgtcggacccatattctacagaccctaaaaggcatatagcattgaaaccagcctgtgtcaaaccattcaatgctgaattaccgccagagctgctagtggaaagctttttaacaccaaatgaactattctacgttaggaatcatttacctgttccagaaattaatccagatagttacgaattggaaatagacattgaaggaaaaaataaagtaaccgtttttacgttggagcaattgaaaaaaatgccaaagcataccattactgctactatcatgtgcgccggtaatagacgaagtgaaatgatacaggttagacctgtcaaaggtttaaattggggagcagcagctatcggcaacgctacttggagtggtgtatatttacgtgatgttttgttacttgctggtatggacgagaatgatcaaaaatataaacatgttcagtttgaaggatatgacagtgatgcaacaggtaaaacttatggtgcatcaataccaatctggaaagctctagatcaaaggggagacgtattgctagcttatgaaatgaacggtgtgcccattcctagagatcacggttttcccgtgagagttattgtcccaggcatagtgggtgcgagaaatgtgaaatggcttggaaaaataatagtttctgagaacgagagtgattcccattggcaacagaatgattataaaggattttcaccatcggtcgactgggacacagttgactttaccaaatctcccgctattcacgaattaccagtgatatctgctatctgtcaacctacagcgaatggtgccattaaagtagaggatggaaaaataacggtgaaaggatatgcctggtcatgaggaggacagaaaattgttagagttgacgttacgatagatggaggaaaaacgtggcacgttgctaaattcgatcatcaagataaaacaccttctcctaagcattggtcttggacattgtgttcgattaaaattcccgatgatgcaaatttaaaaaagtgtagaagtttgagcgaaagcagtagattcttcctacaatactccacccggaaaaccgttgaaaatattttgaaatttaagaggagtgtttaaccaacgcctatcccaaaggttagggcggaatcttaaaaaatgaaccatcttacttttaagtcacttcctttttttttgtatttgaagagtatttaacaaaatatgctttataaattattttgagaatttaaatattatttgttttaaagggggaacaaaaaagatccaaataaattttttttgggtttgttgggaaatttggtgtttttttgggaaaagaaaaatttttatttttatttttt

SEQ ID NO: 981 - DNA, 1546 bp, Diabrotica virgifera
gaaacattatagaaaaagatctatatcaaatgaaattctaagtcgttttaccatttcatggatctcatgttcgattcaagtatgttaattaataattccttcttgtcagattcgaagaggaaacaagatagataacaggagagaatgcccataccgtcgatggcagccagataattgttagataatgttaattttcgaagagtagcaaaagaagctagtccattatggagttacaaaataaagaaaaacccacaacagatgccacaactttcgaagatgccatagctgccacaaaatttggaaaatataacataatgttaattgtcgtcatagctcttccttgtgtgacacaattattgaacacagtcgaattatcgtacatattaccggtcgcacaatgtgatttggggctgactttagaggataaaggtcttataaatgctattatgtttgcaggaatgatatccacaggtgtctattggggttacttatgcgacgctttaggtagaaagaggattatcgtgtatggcttcctgctgtctggattttttgctgcagttgcagctttatctactagcaaatatgtacttttagcagctaaatttatgtctggagcaattatcaatggtccattttccgctacgactagtcacatcaccgaatttcattcttcagaatatagaggaagagttaacatggcaagaggcatgtttctcagttttggaagtttgctgttaccaatattgtcgtgggccatattaccaaggaaaatggatatatttctttttgggatagtagaactacattcatggaacatatttcttctggtgtgcgccctatcaacaatattctgcggagtcgtatatatctttataccagaaagccccaaatacctcatgtcaacaggacgaaatgaacaagcaatgaaggttttgcaaaaaatatattcactgaatacaggaaacgcgatggaggattttccagttaaaaagttagtagaagaagtggaaaacagtgccgaaaaagtaaatgttgtggtcgccttaaagaaatgtttcagggagatgaaataccttttacataaaccttatgtaaaccatctacttttggcatgttttaatgtgttttctttactgataagcgtcaacactgtgaaattatggttgcctggaatatttcaggccataagtgactatcaaaatgctcataatggtacaagcactaatctatgcacaatgttggagcaaatggtaccgaaagaaactccaacatctgaaaattgtacagtggatatgaacaatctgtcggtgtatataaatacattcatagtatcactggcaagaattgttgccttcgcattttctactgtctttataagaatgctaggaataaaaaggtaaacattatattatgttttgctactgcagccctacaattctgtatatactttgcaagagattcggcaactgtgacaatattatctgctacaggaactgcgattggaagtgtagcagaaaatttgctgatatctttgactttgggacta

SEQ ID NO: 982 - DNA, 739 bp, Diabrotica virgifera
cccacgcgtccggaagaatgtccggcaagggaacaatggaacgtataaaacaaaatgcccaacttgctaaacaaacaatagaggaattaaaaaatgaactgaatataataaacaacgaatataacaccctgttaagcaggcagttacaagaagaaaatgctaagcttttagcagctgtggaagatgcgaaaaaaaagttaataaaattggaggtccagaatggagtgaaacaagtgccagttccaaatcaaactgtcaatgtatcagcagttgaagccccccaagctgacataaataaggatgaacctaaagccccagctgaagcacccaagcccaagaaagaaaagaaagcaccaaaagaacaaaaggttgctgaagaactaccgatagatgtgggaagattagatttgcgcattggtaaaatagaggacattaaaaggcatcctgatgcagatactttgtatgtgctgcatatctatgttggtgaaagaaaaacctaggactgtttgttcaagatttaactaaaacatattcctatggaagaacttagggataaaacagagggtgctctttgtattttgaaaccagttaagatgacgggaataacttcccaggctatggacatgtgtgcgagcagagaagctggagtaaaaaccctaatacccccctgccaacagtggaccaggagaattagttccttttgaaaagctacacaagaaaggcccatttagagataaaa

SEQ ID NO: 983 - DNA, 1329 bp, Diabrotica virgifera
gcccttttggattgagataaagaaagaaaatcaagaaacatccccttcgtagtgaaatattaaagcgaaatctactagaattggaatacaaagtgtgcaatagacttatttcagataatattttcgtgccagttacggaacaagtgaagttgatagttttgttttgattagttagcaaccaaactaaaaatggcgtgtgcaacattgaaaagatctttggattgggagcccgttttgggcggacggcctgcgaaacggaggcgatgtgtacctttctgttcgagccccacacaaagcggaattggatctccaggaccttcgagcagtccaacgggatcttcgtcacccaagagctcagtatttcctgacgttttgagcaaaactttgactccagaaaacttaatcgacaatctaaaaacagaaatcaaaagattgcagaagagaaaacaactacagtacaactgcatggaaacatcagatggaagcagttcaggtggagaatcatctgaatctccgtctagatcagagaagccattatttacttttagacaggtgggcatgatatgcgagcgtatgcttagagaacgtgaagtagaaattagagaagaatatgacaatgttttaacagccaagctatccgagcagtatgatgccttcgttaaatttacctatgatcaaatccatagaaattataccaatacagcagtaccaagttacctatcgtaagacgtgacgaagttttccaagtccgtatagcactaatgctctagccactctatacatttatttaaatatcgtttatacacatacgttcacattacattaatgacgaatacaagaaaaccgtatatatttgccagtcgcaagatgccttagaaatttatatatgtatgtatgaacataattataatccttacattcttgcagacagacaaattttggatatatatacttaatttaccatcctttttttttatactttactttagggttgaaaacgcatactaggttattttttcttttttcttgaaaaaaaggttctttcgtattggctcgaaagggctttcgtagcatttgtgattcggtttaaaagctccgcttaaaagcgcctaagtccaaaaaaaagggaaaaaaaaaaaaattttttccgggacaccttttttcgccgagaaaatttttttcttcctaaacccctaaaggacattaagggggggggggcgatggggccacccacgggggggggccttttatttttttgtatttttgtgtttttttttttattttttttttttaaaataaaaaaatattttggtttttcccccccaccac

SEQ ID NO: 984 - DNA, 1175 bp, Diabrotica virgifera
  misc_feature (371)..(371): n is a, c, g, or t
gaatacgggccagaaagaaacaggtctgtatgtacgttgaaatcgatcgcgcggtcaacgtaaactgaatgattgtccatcacagactgccaaaccgcctgacttgttttcaagcggcgtaggagatactggcgtgctttaggtccacatggcttgcaagcagcttcaaaacacgcaaatgtacatcgagacgagcaatattccaagattattatacatgtgtcaaagaaaactcttattgtacgacattcgagaaacaactaatgtgtgaatttggtttggaaaaatctacttgacacagtaagtatgaagaattattcaagaatggcatatatacaaaactaattcataggaaacatttttcaacagtntagtatgtaagattaacttaaactataaggcaatcagtgggattgtttaaatttcggaacataaaaagtacttgacgcacttttaagttattacttgaacggtaggtagattgaatattcaaaagagggcatagttgataaactacgaaacaaaaaacagcaaatgttcagttttcgagacatacattgctttcaactaacctaacacaatatacagtagaaccccgcaaatccgaactaattggggggacaccctgttcggattccgaaaagttcggattatccgaaagttagcctaaccaagcataactagtaataaataataaattcaaagctttcgttgtcgcaaaacgatctcgcaagagcgtggataatatttttggacttaagttgactgcaagggaaccgacgtacgtttataatatgtaacctttataagtactacgtataaagtacatattcgttttgaagaaattttaaatgtcaaagtcctattaatcctacattgttcaattttctggttttactctgtatgataaacatgttttcaagtttttgtcgtgaatttttcaattttttttctctttctgttggttcggattagcggggttcggattatcggggttctactgtattaactttaatttactaaacaatgactgaatttccaaaataaaccaaaatgtctcttccacgactaacattagtaatataaattaataatattctaagagaaataacaatagataaatacgaaaatttagttttcctaagatataaaataaggagattaaacgcagaaac

SEQ ID NO: 985 - DNA, 970 bp, Diabrotica virgifera
tttcactttcgctaatttgcgctgtaaattacagcgtggtatagttatttcaattagttaaattgtttactagtacatcaagatcgtcaagatactcaaaatacgcaagtaaatatctttcactattttatagtagtgtgaatccatttctcatgtaaataattagtcgagaattctattcgacacgttgcttaacctaaaaagtgaccggtgggcttggagggaaatatttcaaaatggctccatctaatgccattggaaaggtatgatataattagtacatatagttttttttgtatacaggtacgaaggactgtggctgcgttgatagcattagcacaaggtaaaatttcgcttagcgacataaagttaatgctagaggttccttcacggcattcttggtgtccacaaataaaaacattgccggcgcacggactatatctttgcgaagtggaatactcgaagggagacctggacacttttagagcagagctggatttggataaaaaggttgtagtttaagtatggtagggtctagggtttatgtaggtggtctgccctatggtgcctcggagcgggacctggagcgattctttcgaggatacggccgtatgagagatgttttaattaaaaatggatatgggtttgttgagtttgacgattatagagatgctgatgatgctgtatatgaattaaatggtaaaaaacttttaggggagcgagttacagttgagagggcaagaggcactcctagaggtcgagaccagtatgcatcaggtggcagcagaagcagtagaaataatgacgatcgtcgctcctcaaataatgacagatatggacccccctacccgcactaactacagggtgctcgtggaaaaacctttctcccgcatccagtggcaagatttaaaggattacatgcgacgagctggggaaagtacctacgcagatgcccataaacaacatcgca

SEQ ID NO: 986 - DNA, 1622 bp, Diabrotica virgifera
cctcacaggcgtgcgagcgaagtatcttttcactttcgctaatttgcgctgtaaattacagcgtggtatagttatttcaattagttaaattgtttactagtacatcaagatcgtcaagatactcaaaatacgcaagtacgaaggactgtggctgcgttgatagcattagcacaaggtaaaatttcgcttagcgacataaagttaatgctagaggttccttcacggcattcttggtgtccacaaataaaaacattgccggcgcacggactatatctttgcgaagtggaatactcgaagggagacctggacacttttagagcagagctggatttggataaaaaggttgtagtttaagtatggtagggtctagggtttatgtaggtggtctgccctatggtgcctcggagcgggacctggagcgattctttcgaggatacggccgtatgagagatgttttaattaaaaatggatatgggtttgttgagtttgacgattatagagatgctgatgatgctgtatatgaattaaatggtaaaaaacttttaggggagcgagttacagttgagagggcaagaggcactcctagaggtcgagaccagtatgcatcaggtggcagcagaagcagtagaaataatgacgatcgtcgctcctcaaataatgacagatatggaccccctacccgcactaactacagggtgctcgtggaaaacctttcctcccgcatcagttggcaagatttaaaggattacatgcgacaagctggggaagttacctacgcagatgcccataaacaacatcgcaatgaaggagtggtcgagtttgcttcatattctgatatgaaaaatgctatagaaaagctagatgacactgagcttaatggtagaaaactccgcctggtcgaagacaaaaagaacaaatcccggcgctcagcatctgacagcagccgtagcagatcccgaagtcgtagccgttcagcaagacgttccaggtcacgtagtcgcagttcccgctccaagtctaagagtaagtcaagatccaggtcacggtcgctaagtaataaagacgaccgagaaaaatccaagtctaggtctcgttcgaggtccaactctcgcaaaaagtctgacagatccaggtccaattcacgaaagaagtctgtaggaagtgatcattcccgttctagatcacgttctagaaccccagataagcgttccaaatctcgtgaagcctccaaagaaaggtccaggtcaagatccaggtccagatcagaaagcaaggaaagaagtaaatcaagaagtagatccagatcaccaaactaacactgttacgagtttgcaaccacagtaaggtttatatttgtaattaatttttaataacaaaaacaaagtaaattttaattaagtaaataaaccagaacaactgttagcagtagaaattgttaaataattttactcattggaaagataagtagattcatttgtacagggttgtgtcacatttgaattttaaaaggggtataattttccatagtaatttatcaagaattttttacatgatacaaattgtagaacttggatgttcaaactgttggattatatttttaaactgcagtttattctgtgaat

SEQ ID NO: 987 - DNA, 1133 bp, Diabrotica virgifera
cggacgcgtgggctcagaagttcacgtttaaaacattagatataataaataattaaaccaagtcaaccaagttaaagattaatcgccaatatgaagccgattatgctccaggggcacgaacgtgccatcacacaaattaaatataatcgagaaggggacctcttgttctcagcatctaaaggtaacaaaccagacgtatggtatgctctcaatggggaacgtctgggtacattcaatggacaccagggagtaatctggtgtatcgacatagactggacctcaaccaggttcatgtcgggtgctggtgacaacacatgcaaaatctgggattgcgaaacaggtaaagaaatcggaaacattaattctgcgtctgcggttaggacatgcatgttcagctactcggctaacatggctgtatacactaccgatcaagctatgaagcagccttgcgagatattcgtagtagatactaggtgtgtagatgatagcacaggtagccagaagcctatattgagagtgcccataaatggatccagagtatcgtctattttgtgggatagtttagatgaaagttttattacaggacatgagaatggagagcttattcattgggatcttaagactggtaaacaactaaacaaagtcagagaacacgatcttctcatcaatgacatgcaatggaacaaggaccaaaccatgtttatcacagcttctaaagatcatacagctaaacttttcgataaaaatgatttactgcttcttaaaacatacaaaactgagagacctgtaaattcagcagccatcagtcccatttttgaccacgtagtgcttggtggtggtcaggatgctatggatgtaacaaccacctcagctaaagctggaaagttcgattcaaggttcttccatatgattttcgaagaagaattcggcagagtgaagggtcatttcggtcccatcaacagtgtagcattccatcctgatggaaagggttatagttctggaggagaagacggtttcgttagagttcatacttttgatacatcatattttgaatacaactttgattattaagagcatattgttacaagatgaggttatgtaagataattgatataataaaacttttatatcct

SEQ ID NO: 988 - DNA, 1258 bp, Diabrotica virgifera
caggggggtcagaactgaatgggagagtatctcggggcatataatgggaggtagcagatactagatactgcagttaatactcaacgaaaaaagtggaaaaaatacgaatttaaatactgatttacaacaaatttttattttatagtatttttatttacttgttatgttacaaatattatttctagcaattattgaagctaattggctctccccaaagccataaattccacaaaaagaagaaaaaaataaataaaaaattcctacgcattactacaccattgctcgaggcacttacgaaattttttcaaaattgcaacatgtttcatcaagttatcgcaaaaaaggataaaatgtgagattctatctaacagcgcgactactcgcgggttaaagaagaagaagcaaaaaatacaaataaaataaatatttctataatcgaaaaataattgtaggaaaaaagatattaaaaaaaatcaacctcgaataagctcttctggcatatttttaacatgattatcttttcagacaagtacctaaattgaaaggaaaaatatgtcaattttttggtattgatcaaccattttcttggggctataaaatgacgtgaattgagatatgacatattacatttatacagactattacatcattttctgaataaataaataaaaattttcactgcatcgttgtacagcctaccatacatacataatattcatgctttagtaccttttttataattttagtgataatgcctgctataatgtcttattagttgtagataattatttatatacttctgctgtaattattttttatatcgttaaatattttggtctgagtaattgttgatgaaacatttcagctgacttagtaattattgttatatatttaatatcgtccaatgttcatgattggaaagtgatatgttcaattcaaagcgacttttcaggtaacattaataaagatactgaattccaagtttcagctactaataatttgaaaattatgcgaaaaagtccaataatttatcgtatttataaattgtaattacaattacttatggtgatgtacaacctgttactgtacaaaacaataaactcctccatagaatattttgtgaaatgaaccaaaaattaatatcctttaatttactgtttataattaattttttcgaaacaaggtgttaaatcatttattagataacaaatctttagatacttacttttaataactgatcaataaattgttaagttcc

SEQ ID NO: 989 - DNA, 895 bp, Diabrotica virgifera
tgtcgtctaacaagttaatttattcgctactttttgtagttatcagtgctgctgcaaaaagcctaaacgaagactgctgcaccattaccgagtactctcaagtgcctgatgtagtcgaaacttgtaaaaatatcgtaatttctaacctcagagttcctgctaacaagactttaaacctaaatcttcaggacggctctgaactaacctttgaaggaagaacgtattttgattatttcgaatggaaaggacctcttgttaatatcacgggagatgatctaatcgtgcgtggtgcaccaggacacgtcttggatggtcaaggagaattgtattgggatcacttaggaggaaagggtatcaagaaaccgaaattcattagattacaaggcaacaactcaagatacgaaaacatttatttgaaaaactgtcctgttcattgcgcttctgtcgcagtttcaaattccatcattgatggatggctcatcgatgtatctgagggagacaaaaacaactttacaggccacaacacagatggatttgacctgagcagtactaatttgattttgcaaaacagtatagtcaaaaatcaagatgattgtgtcgtcgtaaatgtaggtgccaacatcctagtcagaaatatggcttgttatggaggccacggtctcagtatttctgctggattctccaaagacgattttactaagaattccgtttataacgttatttttgaagacagtcttgttcatcgctctcccaatggaattcacgttaagacacatgcagatagtggaccaggaattattcaaaacgttatttatcgaaacattcgattcgaagatatcaacaatttcgcactgaatatcccacaagattatgtgaatggtgaggctacgggaat

SEQ ID NO: 990 - DNA, 1152 bp, Diabrotica virgifera
  misc_feature (1004)..(1004): n is a, c, g, or t
gcggtttaatttacccaaacacgccgaaggagaagagggagcagaaaaagatgaatctgaatatcgacaggcgggtggcagaccagcaccagttatccgaagagatgaaagaactactcaaagaactagagaaagaaagcaagcaataaacaagccaaatcaaatatgaaacttaataatattgacatatccctaaatcctcgaaataattccaaatgtgacaaataagtgttaaacttatcttaatattcgacaaaactaaaccttgcaatttgacttatgcttctaagcttttgcttatttgatttgcaaaacgacgcgacgtctaaaaaaatttggtccgttcagcactttcctttttaggaaaaaattgccatttttcagacaagattaatattactacaattcgtaactagcattaactcaaattcaatgttatatatttttaaagcaatgtatatttttaatttttatttatgtatttatttataagttatttttggaggaattcttcaaaattggaaaatgttatagtcaaatatttttgcttgctaggttttacaactcaaagctttaaatacgaacaattttgaaggattttacagagtttcgatcaagagcgactgttgttagaaaaagggcacgatttctcttttagttttcaggatgtaataaaaaaaaagttgctaaaggggggggctgtctccggaaacgtgccatctagcgccgctcttgaacacgacgtacttatagaaagataatgttaagttagtaacgctaacttacaataattttgagagtatttatgctgataattatttgtttttgttatagctgttatttttatatatatgtatatgctttattgtaagttaaggttacatgtttgtataaaatgaacgaaagcaagaatgacgattttttagatttaaataatgttatttagcttctatggataacgtttttttttgtagaatacttcccttcagtttgtttttggtatntgcaaaaatcaggttagtggtttttcctgttgctcgtatttagtaaataagtgaatggaagtaatcatttctatatttatctcatcaatgtgaatacctgaatattacctgtgtatcagaatattaagataaataagctttcatatat

SEQ ID NO: 991 - DNA, 950 bp, Diabrotica virgifera
cttgtccgacaaaatgaaggtgtccttactactccttcttgtggtttcaagtgtatattctacaccagattccttaccgtttcctgaaggatttttgtttggtgtatcaactgccgcatatcaagtagaaggaggctggaatcaagatggaaagggggaaaacatctgggatcatcagcttcacacaaactcgaatatcactattgatcattcaaatggtgatgttgcctgtgactcttacaatcgtattaaacgagatgtggacattttaaacaacttagatgtggatcactacagattttccatttcgtggtcacgaattttacccacaggtttggatgacaatatcaacgaagctggtgttaactattataaaaaattaatcaacgaacttaaaatagtaggtatccaacctatggtgactctcttgcattttgatcttccccagaaacttcaagatatgggagggttcctaaacgaatctatagtcgactggtttggaaactattcaagggttgcctatagactttttggagatgatgttaagttttggatcacgataaatgaacctctgacaatatgttattatggttatggtacaggagccgtcccaccttttattcagtcagaaggtattttggagtatcagtgtttaacccaccttcttaaagctcatgctagagcttaccatgtctacgctgaagagtttataaataaacaacaaggaaaaactatctatggtcttttatacaaacgccctttctacctggaagtgacaatcccaaagatatcaaagccacggaaaaaagttagcaattttatctttggaatctatgctccccccaatttttcttggaactggccccgaaaaataaaaaaccccaacgaaccttccccaggaaaattaaaaaggaaaaaaagaatccccccttttccacatttcctacccc

SEQ ID NO: 992 - DNA, 1169 bp, Diabrotica virgifera
cccacgcgtccggattttgaaacggtgtttgaaaattatcattaaatatttaaaatctctatcagtctgatataacagcagcaaattatcacatcattttataatttcatcaatatcatggctggattaattaaaaatctggttaccagggttccacaaattctcaaaacagttccactgaaacaaataactcacagaaattttggtgtcacgtcatcgttatttattccaaaagtacaagaaccagctccaaatttttgtggaacagcagttgtgaatggttgcttcaaagacattaaattagctgactttaaggaaagatttgttgttctatttttctatcctttagatttcacatttgtttgccccacagaactagttgctttagaagacaaacttgaagatttcaaagcattaggcgcagaagtaataggatgttcaattgattctcattattcacatttggcatggatcaacgccaagagaagtgagggtggtttaggcagcattagatatcctttattatcagatattaacaaggatattgctagagattatggtgttttattagaaaaagaaggtattgctcttagaggaatgttcattatagatactaaaggtattctgaggcacataactgtaaacgatttgcccattggcaggaacgttaatgaagcattgaggattattgaagccattaaatttactgatgaacacggagaagtgtgcccagccaattggcaaaaaggaggaaaaactataaaaccagaccccaaaggttcccaggagtatttcagttcatcaaattagatgtgtcaaatgttttatttaagaaagataataaaaaatgtccaacgttacatatttattactcagtttatttagatcaattttatggttattatcattttatggctattacaaatagccttatgatactttaaatgtaactacagggtgaaataatctgagaaaaaaagaaataaagattttttatgtttaaaaaaaaaaaaaaagggcggccgctcgcgaaaggaacccagcgcttacccacccccgggctggccaccccccaaacctccttcctaaagtggccccccaaaatttcaaactcccctgggccccccccttttaacaaccccgcggggcgcgggggaaaaccccccggg

SEQ ID NO: 993 - DNA, 1273 bp, Diabrotica virgifera
ggttgaaatgcaagtaatcttattcaaagaaaacagtttaatttaaataatcttattctgattgtagccaacgatatattttgtaaaatggaatgtctagacccggaaaataaaaacggagaagaaaagcacttaaatagtgttgaagtaacaaatactaaagaagaagatgatagactaacagagccgtctgaatctaaaattcctaaaactgatgtcaaagaaaatactgtagcaaatcccgtagaggctgtggaaagtaaggagaacgatttggtagaaaaaagtgatcctgttgaaattaaagtgatatataacaaaaaaaagtatgatatcacaacaacttccaataccacaatcttagaactaaaaaagcatttacaagatttattaggcgttccagatgcaatgcagaaacttatgtataaaggacttttgcaagatactcaaactatttctaattctggtatcacaaaaggctcaaaaattatgttggtaggttctactttaaatgatgtcttagctgtttcatctgtcaccaaacaggatgtagtcgaacttgaaaaggccactacatcaaaggagcccctaagtaaacaaaaaattcaccgtaaagtgttagacaaaggattaccagaagacgtcatgcctggattaaaaaatattaaggagggattaccgccagtacctttatcgggaatgcttaataagcacgggggaaaagttaggttaacatttaaattagaaagtgaccagttatggttaagtactaaagagaggactgaaaaattacctatggggtcaattaaaagtgtgatatccgaaccaattgaagaacatgatgaatatcatatactgggtttacagctaggacctacagaagcatctatgtactgggctggtacccaatatatccaataccgtgatgctatcaaggacgccgtactcggaaaatggcagtacttctgattcacaagtgaaacaattaagtgtgagaaatcgtatgtccaagtggtattcgaaaaatacttgcaatgtgaatatattgagtgtctctgaaaccaacaaatttcgttctactacaaattattgtaactagattttataattttatacatttataatttgcttgatatcgataaagttgtgttcggtttttccctttctgtgtttctccaattctcgagacaaaaattacttgtaggtatttatctcttacattgtgttgattctttgttaagcatctattttaataaattgttttgtcatacat

SEQ ID NO: 994 - DNA, 843 bp, Diabrotica virgifera
taccaatttactttagttgaatttaggtgcagtcgacattactccaaacatttattttaaatcagcagatatttcattttaaattagaagccactatcaacaggtacccaagaacacaagaaaatgagtaatgaaggatttgacccttgccagatagttcgaggattatgggaacatgaaatgtctatgagaaggctcctggatgtgttgaggaactcccagtcctactgtactgataatgaatgtctagatgttggaactagttcctcgaccgccaacccagattacatggtgctggtagtactcgctatgttcactgcagtatttttgtactatttccgtccaggctcccaaactgtccacggagactcaaaaccacgcaacaatggcaacaattctgatggtgccccaccaagttccacctccaattaaacttcttagaaggtaaactaattaggcaaaaaactatccttatctttggggtacggtattttggtttaaatatacacataaaaatattcttttgctttgttttctttacataattttagtagatctgaatttattggtcgggagattgttgtattactttttagtttataatggcaattgcctgtgcactgattgcataaactggggtctttcggtttaaaattaattcatatttcacagtatttaacacaagctgatattaaaattataggaaattatatttttggtgaaaattaaaacagtttttaacatggcgaccggaaatattggttttcttttttgtttaaaatggtttagagctaatctccaaaaagtgctgactttcggcgtacactgttgcgcttgaatttt

SEQ ID NO: 995 - DNA, 628 bp, Diabrotica virgifera
ggattttgcaatttgtccgctttagggagtatttaaggcaaattttgcggctgtttaggttagcccctgaagtgtaattattttactataagctattttataccaccaattgagaaatggaatctttaaatcccgaggatgttttaaagtttttagacctcattaatacactaaagcacagtagtcgtagaggttgggaactttgtcatgttaataatcatgaacaaattgctggacatatgtatgccatgggaataatgacctttctactgggaaatgaatcaaagttggatagatttaaatgcctacaactagctttggtgcatgatttatccgaatggatagtaagtcatattaccccccactattgtatcacaattgccaaaaagaatcatttttgttaaaagaaagttataaacgtacaagtgtatgacaactatagaagagatagaaagacactgtcggcatatggtacgagaagtagttataaatccactataagctgaagccctcacgaggaaataacctccatattcctaatacattccgaatagagagtggaagatatagctgggccgaacggagataaaaaagatctctgtaaaccaggatatgataatatcaggaa

SEQ ID NO: 996 - DNA, 880 bp, Diabrotica virgifera
  misc_feature (879)..(879): n is a, c, g, or t
cgtttttaaaaaaatatccttcctgggaagaagttaattggtttcattttcaaattccccaatcgtccgggactttaaaaatgtctatctattttagcggtggttttactaggtcagccgggataataagtgccataaataaacaactaaaattagttaacttaaaacctgttaaaaagattcaggttcaatttgatccattccatgccaatgcggtaaccgctcgagatttccttttccatatatcaacaccaaaagtaatagaaacaaacttaaattgtgtgataaaaccaaatgttgtatgtgacaggagtgaaccagagataaagattgacttgggagatgcaggcacagtgaaatttttagccaacaacttgacagtcttagaaatactgcagcagttcaataaacacatcagctccaaagttccagtagagccagtttcatcacctattacaacaaaattagaggctaaaaggaagggcaagaggtgaaatgggcaacaaaaagaaggacttccatctcaaacttatcgaacacgtttatgataatattcccgcttttacagatatttttactgaagatacattttatatatttgccataaccattgtgattagtactattgtaatcgtgtttattatttctaggtttgttaccttaaaagaagttgatatataagttctgttagataggttatgtatgatgtgattaggctgaaatacattttgaatgtattatcttgtttctattatccatttgagacatggtttcattaagtatgcacaatatttggcatattgttatgttattagtgatgtaaaattactagatggtctgagtaaccttttttgaaataaaaaacatgttttctagaana

SEQ ID NO: 997 - DNA, 2045 bp, Diabrotica virgifera
cgggcgagtgggaaacacatggatttcgtcgtctcgtcataagttgaaatacaagtgaaaatatttgtgatatttagttttagtgtgccaaaataaaaatggatgacgaccaacaattttgtttacggtggaacaaccatcaatcgacattggtagccgtttttgacacgttattggagaacggcacattagtagactgtactttggcagcagaaggaaaatgcctaaacgcacacaaagtagttttgtctgcatgtagtccatacttcgaggcgctgctgtcaaagcactttgacaagcatcccattcttattcttaaggacgttaagttccaagaactaaaagccatgatggactatatgtacaggggggaagtgaacatatctcaagatcaattaggcgcgcttttaaaagccgctgaatctttgcaaattaagggtttatcagacaataggaaaggggaaactgaacgaaaacccactcctgctcctccaccaaagagcccacagccaacgaccctgccgaaggtccagggtttgacaattgagcaaagagctcgggaggattccagggagggaagcatgtcaccagggcctcgaaaaaagaaaaggttaaggcggaaaagtgaggaattagacaaccacgatgcctctaattcttcagaatctcacagtctacccgcccaaagcattcctacgttacctgctatttcaaaaatgaacatgaacgccgatgtgcctgaacaaatagaaactaaatcagagatactcacaaggcataaacagacagatgacatgccccaagttcctattataaaagaaaagattgaaacccacacagaactgatgttggaaccaaagtctgaatatgtagaagaaatgaatgaagatagtattgaggatttgacactggatgatgacgatttaagtaatatggaacaggtagatgatcaagcaggacctagtcatggagcaggagaaggatcaagtcaaggttttggaggttggcatatgggtaaccaaagtcaagatgaagtatttctggccgcgcaagaggccgtaggtgcacatcgagactcacaaggtaagatttttgttttcaattgtaaaggcttgtctactgttctgcaactgacttgttaaaggagtgtatacttcaaccactcctttggtcatgagacctgttagtacttacaaactacaatggtagttgttgaagttctttacagtagacaagtttcattcacttgcaagtggtatggcaaaatttaacaccctgacttccagtctctggtttaacattttattttattttacctaacgggtagtccttggtttctcctgttgcttaacacttagctttttattttactagatgtagtagtagttatttttggttttacccatcacctttctccctccctcaagattgacagcactccttcatcaatttttcatttggaggtaccagccagccctacaggtcaacccaaaaccactagtattttaaatctaaattgttttgagagaagtttcatagatgataccttactattaataattgttaatgattagtttccttttttgttttaaaatttgcttttgcgtttatactgtaaaacgtttttttaacattatattagatataaagtttttaagttcaatcaggcgtttatactgcaaagcgctttgtttattatgttattaatatttcaacattttccggttttggggcctaatgaagacatccaaacccaagaaggggggagaatggagtggaaaacaacacctggagatcctattcatatttcttttcttataatgcactgaaaaaaaatagaaaaatttggccaaaaatagaaaaaccatttttttttcaataaacataacaataaaaaaaaattgaaaatttgaaataataaaacactcctccagagaaaaaagacaacaaaaaagaaaattttaccttttaaaattttgggggggggaaaaggccttttggggtttctttaaaaaaaaaaacagggggggtgccccccgcggttt

SEQ ID NO: 998 - DNA, 1617 bp, Diabrotica virgifera
tggcgcccacaacacccccccaaaaaaatatttttttttttttttttttttttttttggtattaacaccccctttttttttgggggggggggggggggagtttttttctccatttttaatataatgcggcccccccccgcccccccggggaaaaagcgaaggaaggggggggtttttttctcacacccccccctttttttcccaaaaccaatttcctattcaccaggaaaaacccccccccaaaaaaggaaatccccctcccctcttagttccaaaaagtgcccctttttggtatttttttaaccccccccctttttttttccccggggggtgaatttcacattttttccttagcgggtttctccaatcccgggggggttttcccccatgtttggggggcccaaaaaaatttggggacgctctttttcggtttcagtggaagcatgacaggttttagtgaaaaagccatcctaatcgatggcagaggccatttattgggccgtttagcggctatcgtgtccaaagcactcctagaaggtaacaaagtcacagtagtaagatgtgaacagttaaatatctccggaaatttttacagaaataaattgaagtttatgtcattcctccgaaagaggtgtaatgttaacccagctaggggaccattccacttcagagctccctcaaggatcttctggaaaactgtaagaggaatgttgccacacaaatcagaaaggggaaagcaagctcttcgtagactaaaggcatacgaaggtatccctcccccatatgatcgcaggaagcgtgttgttgtgcctggtgcacttagagtaatttgccttaaaccaggccgtaaattctgtcatgtaggccgtctttcacatgaagttggatggaaataccaatctgttgtacgtacattggaaagcaaacgtaaagttaaggctgtattggctatccgcaaacgtgacaaacttaagaagctcacacagcaagcttctgagaaggttgccaagcaaacaaaaccattcacaagtcttatcaattcttatggttataattaaagtttttattaataaatgacttataatttaaaaaaaaaaaaaaaaaaaaaaagaaaaaaaaaaaaaaaaaaaaaaaaaaaaaaaaaaaaaaaaaaaaaaaaaaaaaaaaaggggaaaaaaaaatgaggggggggccctctaaaagagaatcaactttttaacacgggggggtgcgacccttatacttttttttataggggcccccaaaaattttttcctgggggggcttttaaaccgcgggggggggggaaaacccggggggttcccacatttatttgcccttgggaaaaacccccccttttcccggggggggaaaaaaaaaaaaaaggcccccccccaccccccctcccccccttttgggcaacccggaaggggaaggggggaggcccccccggggagggggcctttaaacagggggggggggggggggggggtattaaaaacagggagtaacatcttttttttttgacgcccctctattgcccccctcttctttttttttttttttttttttctttcttttttttccccccccgtggtgcgggcgcgttttttcccc

SEQ ID NO: 999 - DNA, 1268 bp, Diabrotica virgifera
cataacttcatcttcttcagttttgtataacggtagttgctttcctatcagttgctctattcgctgatacaattcaacatcgtactgagtaacaaaagtcacagccctaccagatcttccagctcgtgctgttcttcccactctgtgaatataatccttactgtgtgttggtatgtcaaagttgataactacatctacgtgtggtatatctaatcccctgctggccacatccgtagatatcaaaatagatcgatttttcgccttgaactttgttaacgcagccaatcttttattctgggacatttgaccatgcagagggacagcagttaatcccagatttcttaacattagtgctgttctgatggtattattacaggtagaacagaaaatcataaaactattaccggccaactcattcaaaatgttcaccaagtagacgtccttaaatttgacaggaatgaaaatataatactgctgcagcttctctacagtttgatatttagtggagacctcaactctaacaggatcctgcagacaggccctctgtaatttcttaaccttttgtgtcattgtagccgaaaacaaaaacgttctcctctccctgggaattacttttaaaatcttatccacttcaacttcgaaatccatgttcaaaattctgtcagcctcgtccatcacgaggaattttagggctctgagactgaacccttttgtgttttccaaatggtcgagcagtcggccaggagttgctattagaatgtgaggttttttggctaggatcagtgcttgggacatcatgtccattcctccaactataactgcacattttacacctatgcttgagcctaaggcttcaaactgttcagatatttgaaatgctaattccctggtaggtgttaaaatcagtgcaaaatatctctgggggttctccaaaagcgcctgaagtatgggtaaagcaaaggcagccgttttgcccgaacctgtctcagctaatccaatgatatcttttccttgcaacgctacaggtatcgcctccttttgtatattcgatggttctttccattttaactgttcacatgctttacaaagcgcatcaaatctttccaagccacttgggcctgctcaggttgttctacagcttctttagtagctaccgctttcattgtcattttctggacttgatgaatcgctgtctgacattattttttaataagatatatcaattaactcattaaaactgtaacaccacgtgcaacatttcgtcattt

SEQ ID NO: 1000 - DNA, 1006 bp, Diabrotica virgifera
gttacttccgatggaacatatgctacccaatcagctttcaacactgtcagccaaaccactaaagaagcacgacctcctctaagacaatacctcatggatggtgattttttcatcggagcctctttggcatctacattaaccaaactgtctttgcggtatgaggacctcacctctcctgctgctagcaatggattcaatgccaaaattatgcttattatggctggaattcttcacttgggaaaatcaggacttcccacaaaatcaataaccaacgacgataaagaccacattctgttctgtttacgagtcctatctgatcgttctccaatcattgttgaaattttcaaaaaattgtgccgctcggcactaaatgagatgcttctagctaaggaatcggtagaagcgatctcgcaaaagagcaaagaaaaaaacaagcgtacgattcaaactgacgacgctataagcttcctgcaattagagacagataaaagtggagagctaggagaaaacgtattcgagatgtcgctgtcacaagctttagtaggaggtcgaacgggaggtggcgaatcagtattaagttccaataaattagataaaatcacacaactgactggtttttccgatccagtttattccgaagcatacgttcacgtgaatcagtacgatatcgtgcttgatgtcttaatcgtaaaccaaactaatgatactttacaaaactgcacgctagagctggctactttaggcgatttgaagttggtagagaagccacaacctgtcgtattggcgcccaaagacttttgcaacattaaagctaacgtgaaagtggcctcaactgaaaacggaattatatttggcaacattgtgtatgatgtcataggagcggggtcagataggaatgttgtagttttgaatgatatacacatagatataatggactatatagtacctgctagttgtacagatagcgagtttatgagaatgtgggcggaatttgaatgggaaataa

SEQ ID NO: 1001 - DNA, 871 bp, Diabrotica virgifera
tacaaaacaaaacgaccttgatgttgcttttgatcttttgcagccaattaaatatgacatagttaatgaagaaactccttttggaaaagaaattgattttaattggttagatgttccattggaagcaaatccaaatggaggggcactgccaaaaagtagagctgatagaaagtgtgaacagttagaaaacttagctaaggcagtaatgaagatagctgctcaaaaaagatatagcatagtagacttttgtagtggtagtggacacttgggaatacttctagcgactttactcccgaattgtgaaattgtccttgtcgaaaataaagaaagatctttattacgagccaaggaaaggattgaaaaattgggattaacgaatgtatgtattgtgcagtcaaatttggattattttcaaggcaacttcgacataggtgttgctcttcacgcctgtggagtagccactgatttagtaatccagaactgtataaataagaaggctcatttagtagtttgtccttgctgttatggtggagttagaaactgccatcatttgacctatcctagaagcaaccaatttaaaaaattagatttaggattacaaaactatttgaatcttgctcgatgcggctgaccaaactcatgataaagaaaacgccgaaaacgagaacgggggtatttttgtatgaatgctgtagatacggatcggcggttgtacgttgagagttttggatataaggtgcgtttaggaaaattgtatccgacgagttgtacgagataaaagtaatttattggttggtttaacgagaagactctttctagattatataattttatgttgattttataccgaaatataagaagatgagtttgt

SEQ ID NO: 1002 - DNA, 1095 bp, Diabrotica virgifera
ttgcggccgaaccttcatgaactttaaagactagttctttcggtattttttttaatcgaaaacaatatcaacagtcatgaaatcaactaaattatttaactacactaacatttccaatgtatataaaagattttcgagtacaacgtcatctaagctgatttattttgaatatggagatccactgaaggtagtaaatttagaagaggaacgtataccagaccccaacgagcagcaggtacttattaaaatgttagcagcacccgtgaacccagcagacattaacaccattcaagggaaatacccctccaagccagaactacctgcagtgcccgggaatgaaggagttggagtcgtggaaaaagtcggttctggggttgttggtatcagtcaaggagaccatgtagtgcctcttacaaataacttgggtacttggcgtacccacattgtgttaaattcgaataatgtgttgaaagttccgaaaaaattgggattagtcgaagcagctaccttaactgtgaatccttgtacagcatataggatgttaagagattttacagcattgaaacctggagacactgttattcaaaacggagcaaattcagcttgtgggcagaatgtgatacaactatgtaagtcctggggtgtacgaacagttaacgtagtaagaaacagaccagaaatagacgaactaaggaagtttttgcagaatttaggggctacatatgttcttacagaggaggaaataaggagtacagatatatttagaggagccgttgataagccgaagttggctctgaactgtgtaggaggaaaaagtgccttggacattatgagatacttacagaatggtagtcctatagttacctacggagggcatgtctagagagcctgttacagtcccaaacgtctgcactaatcttcacagataattaaagttaggggcttctggatgaccagattggagcaaagaaccatggaactaatgcggaaagactctaaggatgttagaaaaaactgattttgctttaattgacgcaaaaaagaatttccctggacctttcccaccaaaaaggggtgaggggtaaatctctacca

SEQ ID NO: 1003 - DNA, 809 bp, Diabrotica virgifera
agaaatcagtctttttatgttcagaggttgaaaataaaacctcaaaatggtaaacggtaggataccgtcggttcattctaaaacctatgtaacgcctaggcgtccatatgagaaggcccgtttagatcaagaattgaaaatcatcggagcctttggtctccgaaacaaacgtgaagtatggagagtaaaatacactctagccaaaatccgtaaggccgccagagaactgcttactctagaagagaaagaacccaaaaggttgtttgaaggtaatgcactcctacgtccatatgagaaggcccgtttagatcaagaattgaaaatcatcggagcctttggtctccgaaacaaacgtgaagtatggagagtaaaatacactctagccaaaatccgtaaggccgccagagaactgcttactctagaagagaaagaacccaaaaggttgtttgaaggtaatgcactcctacgtcgtttggttcgtattggagtactagacgagaacagaatgaagctcgattacgtattgggtctcaagattgaagatttcttggaaagacgtctgcaaacacaagtctttcaaatctgtcctacctaagtcaatccatcatgctagggtattgatcagacaacgacacattccgggtcccccaaacaagttgggaacatttccctccttcatcgtccgttggatttcacaaaaaaccttcaacttcctttctgaaatccctttgggaggggggccccccgggaggggttaaaaaagaaaaacctccccaaaaaaaaagggggggggggggggggggacttag

SEQ ID NO: 1004 - DNA, 808 bp, Diabrotica virgifera
gccacccactttaatctagaaatcagtctttttatgttcagaggttgaaaataaaacctcaaaatggtaaacggtaggataccgtcggttcattctaaaacctatgtaacgcctaggcgtccatatgagaaggcccgtttagatcaagaattgaaaatcatcggagcctttggtctccgaaacaaacgtgaagtatggagagtaaaatacactctagccaaaatccgtaaggccgccagagaactgcttactctagaagagaaagaacccaaaaggttgtttgaaggtaatgcactcctacgtcgtttggttcgtattggagtactagacgagaacagaatgaagctcgattacgtattgggtctcaagattgaagatttcttggaaagacgtctgcaaacacaagtcttcaaatctggtctagctaagtcaatccatcatgctagggtattgatcagacaacgacacattcgggtccgcaaacaagttgtgaacattccctccttcatcgtccgtttggattcacaaaaacacatcgacttctctctgaaatcacctttgggaggcggtcgtccaggacgtgttaagaggaagaacctcaccaagaagagcggtggtggaggtgcagctgaagaagaggaagactaagctgtatgtcgtgctagttgtactagtacttacatattaatatacttatgtattaagggttaaaaaaaaaagtcccaataaaaaaaaactcaggggggacaaataaaaaaatataaaaaaaaaataaaaaaaaaataaagggaaaaaaaaaaaagggggg

SEQ ID NO: 1005 - DNA, 1360 bp, Diabrotica virgifera
ctctaaaatagatgacgactttagcgaacatagtttgctggacacattcggcagcttcggacttccattcctaaaacaactaaagtgtcccaagtgtaacaaatttaaatcaaaacgtatatctgatttcattttccatatgttcaaagagaaagaaattaacagatacgcttgcaaaatatgttctgatgtgagtgttacatacaaatatatgtataaacacgtattgcagcaccaacaacaattcgatattaataatataatttctttaccgaaaaatccaagattagaaatatggttacaaaatttaattagaatgcagtgtaatataattgttcgtagcttagcggctcctaaagaaatttcacctaatagtacaccacacaaagtcttgtgcagatattgtaacaaatggtaccgatctgagcaagaaagaaatgagcatgcaatatttcattggaaatgtataccatttaaatgtagcgaatgcagttttgaagcgtatacgcgcactcacatgactctacatattactttaccacatggtagaggaaaaactccttttataattgcagctggtccaacagtggccggagagcttcagtactctgatttcttacatatgaaagaagctgaagaggaaaaggaaaaatccaaattgacaacatcacttaatcctccaacaaaggtaaatcaaacggctattgcacaagttctagtaccagaagtggttcgtcctgatatgattgatgaatctgagcaagacgggacagtccaaggaatggtttttctggatgaaagtaacgataaagtgtctgtagaagtcgctgatgatcaccacgagccctcagatgctttagatatatcagatttgttaatagtctccaaaactgataccaacgttcccaacgatggcgacgtattttgttgtgagtattgcccgtacatgtcccattctgaaatgcaaataaggtcacatatatctggccaacacgatcacatgcacattaaattcaaggtactgaatagaccccagtgcgagagtaaaaaggatgattatgtggcttgcaccatttgtaatgaagttggttctgaaataactattagagaacatcatttggatgttcatgaaggagaaacattctttatatataggtatatctgttgttgctgccaaaaacggtttaccaaatctcatgggataaggattcatttcaatcgaagacatccaggagttcaattgaaatgtagagatatattcaacaagatacactatttcgaacccgtgatcacgaaagtatcagaaccgagtatacgcaagaatgttgcaccgctttccttatcaggttcgaaaagagaa

SEQ ID NO: 1006 - DNA, 2081 bp, Diabrotica virgifera
aattttaataggatctaattcaaacatatgttaaagaatttatttaaataacaagatgagtcaagaagctttgttagctcaaataaaagatttaaaagaaaaattagaagctgctacacagaagaatgttcggcaaaagattaaagaaatgtcatctgaagtcatagattcaaatccctacagtcgcctcatggctcttaaacgtatgggcatagtcaacaactacgaaaagatcagagattatacagtagctgttgtgggtgttggaggtgtaggcagtgttacagctgaaatgcttaccagatgtggaattggaagactgattttatttgattatgataaagttgaacttgccaacatgaatagactatttttccagccacatcagtctggattaagtaaagtggaagctgctgcggaaactttaagaaacatcaacccagatgtagacattcatacttacaactacaatattactactgtagaaaactttgataattttactgaagttttgaggacaagcagtttgactgggggccctatagatgtggtattaagttgtgtggataattttgaagctagatttgctattaatactgcttgtaatgaatttaatttgacttggtttgaatctggagtgtcagagaatgctgtatctggacatattcaatttattgtgcctggagaaacagcttgttttgcttgtgctccacccttgattgttgcatcaaacatagatgagagcacattaaaaagagatggggtatgtgctgctagtcttccaaccactatgggcataatagcagggtttctggtccaaaataccttgaaatatcttcttcagttcggccaagtcacaaattatttaggatacagtgcattaacagatttcttcccaacaatgagtctaaaacctaatccaaactgtgaagattcacactgtaggtcaagacaacgagattttgccttaaaacccaaaccagaaatagctgttgaggctaaagaagaaaagcctgtgcatgaagataatgagtggggtattagcttagtagatgagagtttagatgttaaagaagaggtcgatattgcacaaggagttcaattggcttatacattacctaaccagaatgttgttgaagaatgtgaagaagctacagcagccaatgaaattagtttagatgagcttatgtcaaaattgaaagatatttaatagttagttgttaaaaaaatatcattccactatttattaacgaaaaattttttggtctaattatacagaatgagtcagaatggctagaataatttacttaataataattgtacagtgctgaaagctgcaaaaattaaataaatatttatttataaatcagtcactccggatggagagagaatgagcattatgctagagctattttatataaacatccattatgacaagtcaatttaaaaaaacgtaccaggtggtgcgaattttcatcccagtgtttttttgtataattactgttaaaattatataaaaacagtaatattttaagatgttataacgttgaagacattttaccaatgactattactagaaataagttaaacattaaaaaatataattttattcaaaaatttttgagttaacaaatcaactttcacattaattacatattattttcatgctgtgagatggaaatacaatattattacatttgctttgatacttgcaatctttcttgggcaaatatggcaccttcctcttcttttcagttgttgtgaattcggttcttccacaggttcttcaccttccagatgtgctacgaggacgacctcgtaagtacactaaaaataatagaaatatgcaagccagggcgaaaattcgcccccctggtattataaaagtaaaattgcgggcacttgcagatgtcctacattgaatggaagagctcaacagtcttctgttacttataatttgtcccattactcgtgactcactctgtatttttattgaattactaactggtggtcgttttattaaatttttttagtttttgttatataattaaaaaaatattaatatttcaattgggaactgt

SEQ ID NO: 1007 - DNA, 1053 bp, Diabrotica virgifera
ctttcgcggttcttgatcgagttttgtaaaagctcagttttgtcaacgaggttacgttttaacgtttttggctccttttttgtgtattttgtgtcgtttgtgttaaaaacgaaacgattttggaatggagaaacgcatagaattggaaaaacggggcagagatcctgcggaaattaaagacctaatcttagataactcaagaagcaccagtatagttggattaacagacgaattcacaaacctgagaaacctgtctctcatcaatgttgggctcacttctcttaaaggcttccctaagctcccaaatctaaagaaacttgaattaagtgacaacaggatagcaaatggactaaatctgcttgaaactagtccaaaattaacaactctcaacctcagtggcaataaaatcaaagatctggagacattagagccacttaagaatttgaagaacctcaagaatttggacctgttcaactgtgaagcaacatcagtagaaaactacagagacaaagttttcaaaatgattcctagccttaaatatttagatggttatgatcaacatgatggagaggcagaagaagatgaagaggaggagaatgaagaggaccttaatcgaaatggaaatgacagtgatatgtcttcagatgatgaagaagaagatgtccgtctttcatcagtgtatgatgattttgaagaggaagatgaggatgatgatgagtatgaatttggtgaggagcaagagggtgaggattacgtcattgaagaggaacttgatgatgaacaggactctgatgaggaagatgtggctctagctgtagctacagatgcatcaaggggaacgaagagaaaattggaggaaggggatggtgagaactaaacccaatctgtgtgcatcatcaatatgtagtgatatataaaaacatttttattaccgaccaatgaagtgtctccaacttggtgagaagagactttttgttaaagtcgtcaccccctggctgtggtttcatactttacagaagaaaaattaaaaaaaatttaataaataaaaatact

SEQ ID NO: 1008 - DNA, 1461 bp, Diabrotica virgifera
  misc_feature (1271)..(1271): n is a, c, g, or t
  misc_feature (1324)..(1324): n is a, c, g, or t
aggaaacattgtagcttacaatacatttgaaaagcttaattttttcgtataatatagcgttccttaatacaacataaacagaatatcgttaacgtcatttaattctgaaattataatccggctcaaaggaccaaaaaaaatcgaacgattttctttttccacgtagattatatataacaaaattaggtaaagaacacgtctcaacatcgtatcaagattgtgatgtcttaaaatttcaagattttcataaatcacattttaaattatgaagttttaaaaatatctgaaatatatgtttttatgtggctaataattagtctgtaatatgtattgatcagtaagaatctacactttactttcttcattttttttaacaatgattttgatataccctattccacgaatatacgactggttttggatgatcgcgacaacgattatttaacttttcgaaatatgaagaacgaaagtacattgcaaattacattgttgtttattagaataattagtagagcaatttacattcgtacttcttatgttgcacactaaaatgttctttgtcgcgataacccaaaacagtcgtttattcgtggaatagactatgcatgattatcttattccatagtaaaattatgtgaaaattaattttttaattttatatttctccttttgttataatagtgcgaacgataggttatttagttgatccatgctttgtttttaaaccaagaggagtaaactaaaaagacagattcacacccaagaaagtcaccagaaaaatcaccaaatacatcttttttgttgatcttatcggccttcgacggtaatccataaatatattatactaatacgccgctaaaaagttctaaaaacaacaactgtgttttatataaaagcagactaaaattctaaaaattaaaggaataacgcagaaaacaaaaaaatcgctgatataacttaattaacttataaaatactgtcaaaatttcgtaaatgtcattagtgtcaaaattgcataacagtggagtaaacttgcctgaggttggaccatttgcaaacaagtattacggcgcggtaaatttaaattactcctcctgttttaaacacagactatagaccttgattgcataatttttaaaaattgtgaataatctcagttatgacaaaaaatgtcgtttccttttatttgaatgtatattcccgtcttcattggtctagaactcatatactattataataaactcaccattttttgtagttatcaatgttanactgcctcatatagacacatatagtttatttttctcgctgtattataatagangtatatagttacgtttaaatatttagctttttgtattccttaagtagaaatatgtatatgaatattggacctaaacgtaaaccatatttatgcacaccaaagattcttgggttttgtgatttatctgtgccagatat

SEQ ID NO: 1009 - DNA, 1084 bp, Diabrotica virgifera
cacaaaacgaagaaaagaccttggtctacgttttggtcaagaaaccagaagaaggccccgaaatcactattcctactgctgcaccaacacaacccagcaaaccagaagtatacttcatcagatacaagacccagaaaaccgccggaggtggaactggattcggaggtggaagcggtattggaggtggcattggaggcggtattggaggtggtattggaggtggtattggaggaggaatcggcggaggaatcggaggaggtgatggcattggaggaggcatcggaggtggtatcggaggcggtcacggaggcggaattggaggcggcatcggaggaggcggtatcggaggtggaatcggaggtggaatcggcggtggatccggcggtggtatttcatccagctacggcccacctggcaaatccggtccatactaattttcttactaagttacctctgcagtggttgccttccagtaactgctgcactacagtttgctgcaaaccacttcatccgctatttgtattttacccaacatagtattgtagattttaggacctaaactgagatgcgttcattggaaagatccgaggtaatcgttgtcgaaagctgaccatccaccccccaaaaaatatggcaattggttacgaggtgacacctaaaggcgcgcaaagtttggaaaaaagacgaaatacagtcaagtggagaatttgtattgtagcaatctgtagctattacctccaaaaagtgaatggtgatgctggtatgtctgctgtttgatacaaaaaccaaactcgtatgacgagttgcctttttgtaccatccggtagcgctataatatcgatttggcttttggtcaaatcgaatcttatggtgctgtttttggtcgagctgcgaaattcttgtgtaaagactctaaattgttcgccgtattaatgaggattttctagttttatcaaaaacggttccatgttgtaaatatcgtgcaatataagtgtatgttatatattttatatatttttgtatatttttttatgaatacggtgacaaataaatgtatttttagtataaaataaaaaagataaaa

SEQ ID NO: 1010 - DNA, 816 bp, Diabrotica virgifera
ccttgtttgtgtgaaaacaacacctattaggatattaacatgaattatttatcagtattaggagtgacgttaagtttactgttgtcttgccaatgtcagcgacaatatcaacaccaacagcccgccgtccagtacaaccaagaagatagttatagttaccaaagcacgcagccacccccacaaatcctatcacacaaacaggcactgaaccacgatggtaattttaaatatcttttcacgtctgaaaatggactggcacaaggagaaagtattgcaccagacggatcaagaaacggcggatacagttatgtcgatcccaacggcaagaagatctcagtaaagtacacagctgggaaagaaggcttcagaatcctcgaagctgatcatttaccaaaagcgccacagcctgtagttccattaccggtacctgttcagcagcccgcataccaacctcaataccaaccacaacctcaacaataccaaccaagagcatatcctcagtacaacaaacaggaagatgatggccaatacaggccagagctgtatgaaagacctcaacaacagttaatccaactaccctcccaccaaagagcttcctacccagcacctttggcagtctctcccactccaagttcgaatgctttagaagaaaaggactacttcgacgagcctggtaaggcacacagtttcggaagtggatatatatttgaattcggagggtagaaattatttatatttaggatattagtattatttttacaatttgtgtgatcgtagtgaggtgtatgttactattacgaaataaattttttgtac

SEQ ID NO: 1011 - DNA, 1325 bp, Diabrotica virgifera
accacaaaagggcggagaatgtggcaaaaaatctccctttttaaaaaaaaaaaaaaaaatccccagaaaaagggggtggggttttttttcccttttggaaaaaaagcccccttttttaaaaggggggggctcccactttaaaggggggaaaaacctgttttttatggggggggggcgcccccccccgggacccccccccccaaaaaaattttttggggggggggggggcccaaacccccaaaattgggccccaaaagggacccccctttttaactttccggggaaaacccgccaaactgcgcgaaaaaaaaagaaaaaaaaaaaaaaaaggaggggccctagggccccgccaaaatttgaggtcccccttgccgtacccccccccccccccccgcttaaatggccgcgccagggggggtcccctttccccttcaggtttggcaaattttggggagggggattggggggggctttttttttttttccccccggggggaaagggggggttggtccaaggggattaaattggggtccccccgggtttttcccccccgccggttttaaaacggccccccgggaatttaattttggggcccctttaaaaagaattttgcctcccccccccccgtatttaaatttggttccttttaaagggcccccccttttttttttttttttttttttttttttttttttttttttttttttttttttttttttttttttttttttttttttttttttttttttttttttttttttttttttttttttttttttttttatgtttttaattattttattaaaactaactaaaaaatattctaaactcacatatatgaatatccttcgtttataatctccaaatgtggtttgaaattaatagacctaagggggttataatctggtagcctgatttccatgtttgcaattctcattgtccaggttactacgaagaaggtgacggcatttactggaaaagcccgaattaatgttggtgtcattccacgaaaaaggcttcgatatccttctgtgttgacggatttccatgtttgcaattctcattgtccaggtcgaaaattgatttgaggtgtagctgtgagtttttgtaggtcatcccctcgacacagtcaaggtaaatttacaaacactatgtgtagggaatcctctgcatcgaggaactgttcactgcataattatccttaatggctaaggatggaattaaaggaataatatagaggaggatctaatccagctctgtgtagaacaatttttattgtacatgagttatttgtttatgcacaagatcaaaaattttcgacata

SEQ ID NO: 1012 - DNA, 1036 bp, Diabrotica virgifera
  misc_feature (875)..(875): n is a, c, g, or t
  misc_feature (900)..(901): n is a, c, g, or t
  misc_feature (942)..(942): n is a, c, g, or t
  misc_feature (1011)..(1011): n is a, c, g, or t
tcccccgggtccgaatatgtaaaccacaaacaagagttatgtactcgtatatacatttttgaataattagtgataagcgccttttaaataaaaaccatttggaaatagtcaaaggtttaagtataacgatggcttcagttccaaaagggataaacatcgatgaaccaagatatgatcagaagacctacgtaggaagagctaaacattttttcattacgaccaatccattaaacatatttgcctcgtcgaaaagcctagatgaagctaaatcaatagtggacagatatagacgaaacgaacgtatcgaaggcctaaccgaagacaaactatggagagccaaaaatttatacgattcggcgtttcatcccgacaccggcgaaaagatgttcgtcctaggaagaatgtcggctcaagttccttccaatatgcttatcacaggaggaatgataacattctacaggagtataccagcggttgtgttctggcagtggctgaatcagtcatttaacgctctagtcaattatagcaacagaagtggagatatagtacaaacagatcagcaaatattaacttcttatttatgtgctaccacgggagctgtaggtacagcgttaggattaaatagtttaacgaagtccatgcccagtataattggccgaatggtaccatttgtcgctgtagcagctgccaactgtataaacattccaatgatgagggcacaagaattgcggcaaggaaccccagtatacgatgaaaataacaacaaattaggatactcaaaaagggcagctcaaagtggaattgcccaggttgttttcagtagagtatgtatggcactacctggcatggtctgcactcccattataatgaactcngtggaaagaaaaggattcctacgannatatccaaagatgaacttacccgtctcgattggtattctangatttctgctaactttcgctacaccccctagcctgcgcagtgttcaaacaaaaagctacccatacattncaaaaaattggagcctgagctacag

SEQ ID NO: 1013 - DNA, 1837 bp, Diabrotica virgifera
gctttggataagaaacacgcaaaaatgaagactacgtggatatttttaggcctttttttaatttgtgccaatgtcaaaattattttgggattcgattcgacaactggtctctactcttcttttataacgaatcagtggccagaagaagtaattgaaaaatttagggaacataagacactctttgcggtactgactggaaaatatttaaaggatgatatgctttcttgtgttgcatgcaatttattattcaccggaatacttttagaaaagaactatgatatgactagtattcaattatcatctgaagctgaatatttctgtgagatattaggcttagaatctacaaatgtctgtgacggtgttatataccctcatgtagatgttcttagctatataatcgacaacaaaaaggaagttaatagtcagcaaatatgtagtctcataatgaaatgcgaccagggcaacgaaacgtttaattggaccatagatattcccgatggtacaccggccgaaaaagttccagatggtaacactacctttaaagttggtcatataacggatatacattttgatcctttatatacggagggtaaagttgcagactgtcatgaacccttatgttgtcaaaatgatcaagcagatgccacaaaaggagaggatgcttgcggacattttggtacatataaacaagctgatgcgccccaagtattgcttgaggaggctttagaccaacttgcacaacagaaaccagaattcgtttactttactggagatttagtgagtcatcgtgtttggggaaccagtcctgaatttaatgggaatataattaaaaaggcaatgggtttatttgctgaaaaacttggaaatattcctgtgtatcccatactaggaaaccatgaagctcatcctgttaatctgtatgctccattggatacatcggaagatgaaatatcttcagactggttatacgatgtgattttagatacctggaccgaacatgactggttagataaagaagctgtaaagaaaactattcttgcaggtggttactatacagtcaagaccgccagaggtctacgacttattgttttgaacaataacgtttgctcgagagaaaattggtggaatttatataatagcgaagatccttacgggcaactcaaatggttagctgataccttgctggaagctgaaaaaaataaggagattgttcatattttatatcacattcaaacatcctcttgtattggaagttggggacgagcatacaatcaaatcttaaaaagattccagaacacaatcgcagcccaattcaatggtcatactcacagggaccaattcttcatacattatgataatgacactaatgagaacaatatgagtacaccgattggggttacgtttaatggtggatccctaatgcccgatgaagctaatcccaactacaagatattatcaatcgatgctaacagctttaacgtcaaagatttcgaaacctacacatttgatttagatgaagcaaacaagaaccaaaaaatagactggataaagctctattcatttaaagattctttccacgttgatagtttatcaccagcagatcttagcgatttggtaataaataaaatgaaaaatgacacagtagtggatctatacaacagatttttctaccgtggcagttcaaaggctaaccagacatatgtcggtcgggatttaagatgtcagattttattgactgtggagggagaagctgatatgtgcaaccacttgtaataattttttattaaaatattattcattacttcttatgcagtcagaataaaaaaagttattaatt

SEQ ID NO: 1014 - DNA, 771 bp, Diabrotica virgifera
ggttgtataggctcgtattaccggttgtggttgtacataggcctaattaatttatgtgatttagtattggtgtgaattggtccataaatcttcctggtcgtccttctgtggatatgctttatgaatctggtgtccattgatagtccgactttggattaagtgtccgattccacatttattttgattaatgagtttttggataactttgatatgcttactatttgtattatttggcactggtgagaattgttccataaatattcctgattgttcttctctggatatgctattacgaatctggtgtccattggtagttcaattttggatgaagtgttccattcttcacttatttcagttgttgatttcttttgtcttactttagtatatttacttgtgttatggtgcgaattggctcatacctttgcctgattgttcgtccttggatataccctttataaatttgatgtccatggattgttcaattttgcatttagtgccaattcgacatttatttgtcattatgaactttagtacattatttagcttatgttttggtttgcagacaaaatgtcgatgacattttaatatgacttcgagtcatcttttccgattcatagttttggtgtagtgatcatccttctttccctgatccttaatttgtggttacttgtaatcttgcgggtcaacgtagaatgatagattattaccacttggttattaatattttgaattaaaaaaaaaaaaaaaaattttttgcttaaaaattttttt

SEQ ID NO: 1015 - DNA, 908 bp, Diabrotica virgifera
  misc_feature (898)..(898): n is a, c, g, or t
gcgaatgaccgaactgtcaataatcttgttgaaatcataagatcaaaataagatttatttttgattgataacaattaaaacaaaatttttgtaaatttaaaccctatgtggattaatttaatagttcacattgatcaaaaatatatgttgaaaattaacaatcagttgaaacaatgaaatgattagggaggtatcagtataaagtgctctaggatttagaaaaaaatgtcaacaatttggaaagtgctaactaggaaaaaggaaattgatactgaatctgtggaagagacaagactgtccagagttttgggcacttttgatttaacagccttaggtgtgggcagtactttaggtgtgggcatatatgttttggcaggaaaagttgctctcactgcgggcccctcagtgattttatcgtttttgatagctgctatagcgtctgtttttgcaggcctttgctatgcagaatttggagctagaactccaaagacaggatcagcgtatgtctatacctatgtgtgtgtaggagaatttgtggcgtttgttataggatggaatcttatattggaatatgtcattggttcagcaagcgtggcaagagggctttgtttatatttggacacgttattgaacaatacgctcgagaatacgtttaaggaaatcgcacccataaatgtttcttttatgtcagagtacttcgattttatggctttcggaatatcaattgttttagcgattgcactagcatttggtttgaaggaaagcagcttggttaacaatatttttacttcattgaacataggaatcgtactatttgtgataatagcaggatcacttaaagctgatttcaaaaactggaacatacaaccgagtaatacaacgaaacgcacaaacattnggcgaggcgg

SEQ ID NO: 1016 - DNA, 404 bp, Diabrotica virgifera
agtcgtattatttgcggagaccggtggttgcaagattatattcaactttaagcaaaagtatggaaaaacacggtgttgtgcccgatgttatcgatgttgcccccgaacaacaagtggaagtgtcgtatcctagtggtgtaaaggtagactttggtaacgaattaactccaacacaagtcaaagatatcccggcagtaaaatggccggccgataaagattccctttacacactttgcatgaccgatcctgatgccccaagtcgattaagaacccaatttccgtgaatggcaccattggctcgttggaaatatcccaggaggagaggtctcaaaaggcgaagttctttctgaatatgttgggtctggaccaccaagaaatacaggtcttcatagggatgttttcct

SEQ ID NO: 1017 - DNA, 1268 bp, Diabrotica virgifera
  misc_feature (538)..(538): n is a, c, g, or t
cagagaaagaggcttgaacgaagacatgtgctacgatcgagagcaatggcgattgggaatcggaagacgttgtagaacgttatgaaccgattatatatatgtatatatgtgtatatatatatatatatatatatatgtatatatatatactaaaacaactcgacatagatcaaaaagacattcgctgcatagaagctctttactggaatcaaacagctgtcgtcaaggtggataatgaaacaacgcaagctcaaaaaattctcagaggtgtaagacagggatgcattatctctccactactgttcaatctatattcagaaagtatcttccaggaagctcttgagatatgcgaaagcggcatcaaagtaaatggtacctgggtcaatactatatgatatgcggatgattcggtcttaatagcagacaatatagaagacctccaaaaccttcttaataaaattgaagaacatagcgagaacatgggacttagcatcaatataaaaaagacgaagttccttataattgctactgagtattngaattatttaatgctaaggcgtgagttaggaagaaacttcaaattttgacttgtatacacgtgcaatagtaagcaaattagtaggtacctttccaaatgacgggacttctatgaagatggctttgtaagctgaaggcgctcagttgtgaattaatggattttacacacttcaaaattacttttcttttcctagtcattcaaattaaaatatattaaaattttaaaatgctaaaaacatgtttaaacaaacaaaaaattgcaaattaaaaactcaatgtcaactggagttgccaaagccctacttcatatacattaaagaaattctgtaattcgttaacaatcggataaatatgacttctttgtcatgatactttgtgttcaagaaaaatgttagtttgctgatttattttctacaattagtatattgttactaatacacttccagataacgatataccttctatttagagcaaccatttaaataacttgttaacagcacctaatagattcaaatagcagtttgcttaaatttacagttccacgtaaaaatatcaataacatggataagtttttgaaaatatccttaacgttggggtgtattagcgatggcttaaggattggcatacactagactacaataagtggtctataagtgagacagtagatctggatctgtgataacagaaaccgttgagacgaacctattagtagacatgagtttcgttattct

SEQ ID NO: 1018 - DNA, 1517 bp, Diabrotica virgifera
cgtccagtgacagctggatttccagaaaaatagaagttggcaaattttgtgtcattatcaagtccttatcttgtttttggataagaatctgaatcttcgaattattgaattagtcttcgaaggttttatatgtgcaataaaacaagtcgcgaagtgtgctgatactttgttatcgaaataatagtgccggcgtcaccatgtcggacgagagtcatccaaaaacactttatgtaggtaatctggacgtgtcagtgtcagaggacctgttatgtaccttgttttcacaaataggcctagtgaaaggatgtaaaataattagggagcctggaaatgatccatatgcttttatcgaatttactaatcaccaatctgcatccactgctttagcagcaatgaataaacgactatttctagataaggaaatgaaggtaaattgggcaactagtccaggaaatcaaccaaaacaagatacatctaatcatcatcacatctttgttggtgacttatctcctgaaattgagactgaaacactcagagaggcctttgctccctttggagaaatttcaaactgcagaatagtaagagatccccaaacacttaagtctaaagggtatgcctttgtgtcttttgttaaaaaagctgaagcagaaaatgccatacaagccatgaatggtcagtggcttggatcaagatcaattcgcactaattggtcaactagaaagccaccaccaccaagaacagaaaaacccgctcagaggcagaaacaacctcaatttgaagagatatacaatcaaacttctccaactaacacaacagtatattgtggaggttttgcgagtggtctcactgacgatttagttcacagaactttttccaccgtttggtacaatacaagatattagagtgttcaaagataaagggtatgcttttataaaatttctaacaaaagaaagtgcaactcatgctattgaaaatattcataattcagatattaatggtgcaactgttaagtgtttctggggcaaggagaatggaggttttggcccagatccatcaatgcagtcaggagctgtgccccaatcatcagcccctccatattcttatggatatggcagttattggtacccgcaaggctatactgctggaggtggttacatgcaaggataccagtcctaccagcaatatcaacaatatccaggtggtcagcaatactgtgttatgccacaacaggggcagtggtcaggtcagccaggacaacaaccaaatgtacccgttatgtatggtcaaaagtatccatctcagtgaaatattccatagccattaacttgggttacgtttttgcagtaagtttgagcaaaggacaaattataaacaaaataactataaataatattaggaatatgaacttaacctttataaccattttctttgcttccggtagcaaaaacaccagttgttttataactttttccatttgatttattaggtttggttttcgaaataaaatgacctttggt

SEQ ID NO: 1019 - DNA, 908 bp, Diabrotica virgifera
cccacgcgtccggtcttattgggaatattagaaaatcacaatgttcgtaattttaccctagaagctctttcaaatgaagtacataagaagtttgaatcttcacatttctttaaagtgggatcttgtattgttacattattacagaataatttattaacagacccagaacaacgtttagcagcaattactctgttatatgaactatatcgtggagaacccattgggaatactccttttgctaatgtatttattcatctactgaatcctccagaacaacaaagcagtgtaggagctccaaagttagaatatcctggacagttgcctagaataactgccccagaaaaacattttatagttcaacttttggctgataaacctaaagatgctctactaaaaaagactgctgcacaaattgttaactcagatgtgccatcacaagtgaatgcagatttttcagctattcagttgactctagcagaaaaacaatcagaattacctcaaacttgtaagacaggaatcccagttgttttatcattaccagagaaaaattataatagctacactgttgacaccacgaaagatgatactataattaaaaaaatagtaacatctgataacgcacccgtcaacaaagtatacaaaccagagtttgtaacattagctccacctttactaaattgtaaagacgaacctgtctggttaaatccaacgacaccaaaagaacatactgttgcctacgatataaccatgtgtgtccctgatacagttggctatgaagcccgacaactcatgaacaaagcttataagtcagctctatcaaattcacaacagcaacagttgcttggtgagctagaagatgatccaaactagtttaccatatgggtttacacccagaaagttgcctgatc

SEQ ID NO: 1020 - DNA, 308 bp, Diabrotica virgifera
agcccacgcgtccgataacataatggcaaaacttacgtttgttcttctggccctagtagccatcgttgtcttatcaaccactgaagtcaactcattggtccaagaaccaggtaccctcaaagcgtccaaagcacttggtttcaagcttagtgatgatgatacctgtacatgtgccaaatgctccgattcttgtatagcagtggataaagatcataacgttggtggtatttgccacttaggtgattgtttatgtgtttatcattaataatgttttattagttaataaataaagttttaggttttaaaaa

SEQ ID NO: 1021 - DNA, 969 bp, Diabrotica virgifera
  misc_feature (925)..(925): n is a, c, g, or t
gaagaatttgtaggttaagaataaactgcatgtttttgttttaatttaaatttttgaaagatcagtaatacaaaatggaaacacattcatctgaaagttcacaaaaaagaaataacagaaaaaggaagaagtcttttctaaaaaatgcaagaaaatatgccaaaaaaggacattttggaagaggttcccaattggattctgatacatatcattatttcgtaaaaatattagaaacatataaagaaggttttgatacagatgaagataaacaagtttttgctaataatgtgtttgcacaaaccgaagatcaagaagtgaattgttcttgtaaccaagtaggatgcagagttgtggaaatgctattaccttttgccaatgatgacatattgaagaaattcatggttgcctttagtgaagatatgaggcctctaatcagtgatagatttgcaagccatgtattagaatgtcttgtttcggaaagttgtaaaaggactttaaataacaaagtgccagaagaatcaagaacagagtatcagaaatttgctattaaagttagtaagttcttgttaaacaatctagaggattatatttgggatacttacgggaatcatgttatacgaagttgtcttacacatttaatacagatgcctgttgataaaaagaacgaaacagtggtaaaagttgaagttccagatgaattttctgagattgtgaaagaatgtggtcaaagaattattagttggcctcaatttaaagaaatgtgtatgtctgatttaacgtcaggattcttacaagtcttgatgaaatgcttaaaaagagtggattccaaaatgttaaaattatatttaaaaaagttaactaccgaagtttttattaatagtgaacaaacagaagaatcaactaaatattaccacctgcatttggntcacaatctattatcatgcttatagaaactgctttactactatc

SEQ ID NO: 1022 - DNA, 425 bp, Diabrotica virgifera
agacaacatgcctcccaagaaggactctaagtcatcggcgaagcaaccccaaaagacccagaagaagaaagaggggtctggaggtggcaaagccaaaaagaagaagtggtcaaaaggaaaagtccgtgacaagttgaacaaccaagttctttttgacaaagctacatatgataaactgtacaaggaagtaccctcctacaaattgattaccccatcagtagtctctgaacgtttgaaggtccgtggatccctcgcaaggagggcacttattgaattacaacagaaaggtcttattaaacaagttgtacaacacagagcacaacttatttacactaggaccacaaagggagatgatccagcggcatagataataagatacacatatatctttataaaaaaataaattttaaaatttatacctccaa

SEQ ID NO: 1023 - DNA, 1159 bp, Diabrotica virgifera
  misc_feature (960)..(960): n is a, c, g, or t
agtgcctcttggtataaggattctgtcggattatcctaacattcttttactgtttttgttctttaatctactgggatggatgattaatgaaatataccagtcagtaatcttcaagtttgcatatcattggttataccacagtccggactctaagcgaaaagatagcatcagcagcaacgagagttatgaacccttagataagatccaacgatgctcgataagtttgatagaatgtagcctatttttaccaagagacgatctcgcttttgaaatccaaagagtgcgaagagaaattcaagaacgacaaagcaagttactggctctgaggaaaccgaagaacatgtttgtccaaacgctgaaatgtatgcttacaataaacaagaaacttaaacaaaggcgtcgaagatcagaatccgaaagttctgacaataccgaagatatccaagaagacctactggcagacgaaagagaaatgttatcagaaagtttgtctgattctgacgactttgacgacacttcatccgataaagacagcggtgggtttaaaatccgtagatctgaagagctgttgtatattccaaaggttgaagaagagagtgatgaaaaagatgaagtaaaaactgacgacgatgttgacacagttaaaaatgagtctgaagcatctgatgacaatgaaactgtagattcagaatcggatgtcatcgtgcatcgatcatagatttgtttaggtattagtttctgctagcatgatgctaggagtaaaacattgtattttttctacgaccatatttattttgtctgttagtaaataaggagtatttttgctattaacatagacacctacacatcctatcaacgtttataagatctatcatgtatacgctttttaaagagttttaagtagaacactactatatccagcacatcttaaggaaaaactattttttatatgggtctagngaaaaactttttaatgtacctgtatcagttcccttttttgtgttttgtggatggtttctggtagaaaatttttgttggttaaataattaacgaatacgccccatccctagccccaaaaaagacatcctttttagattggaaaaattttcaaacgggccccctttaccgttcccaaagggggttttaaaagggggctttt

SEQ ID NO: 1024 - DNA, 908 bp, Diabrotica virgifera
gaaaaataaaatattgatgtgggattgaactgcaattgattgtaataaaaattacattttatacaatatatttttttgatgtttcgatatcgaattaaattatttcaacatgtagatgtgtattggcgctttgtagcagccaatttgacagctgacttgcttggcctcgatctcaccctcaaaatttcaactaaaaaacatggctatttgcctacaagataattaagtcaagttggtaaactaatttggctgctacaaagcgttaattaataaacgtttccagattgatataattttataattttcttgaaaatgtatctctggattggaagtcgacatgtcataaacaaatgtatgtaatttttgttacaatcggttgtgatttggtcccatatgaataaaataataaattaaatacttgcagtttcaaataaagttggaattaaaaaacgacttctctaaataatgaaattttatatggttccaatttatgtagatacacatgtataatcaggtctcgcaagttcagttttaaaaatggaaaccctacaaaacatacaaataggtatcctgaagcatgcaccctgtgcccatttagcaagattcaatcgtcgatccggagatggcgtcggttagcaaacatggacaattggaaggtagattctcaacaccgtgtctgatgaccatgccgagatgaccatgccgagatgaccatgccgagatgaccatgccgagatgaccatgccgagatgaccatgccgagatgaccttgccgagatgaccattgataatattttcaataaatatatttattagaaaaaaaaaaaaaaaaaaaaaaaaaaaagaaaaaaaaaaaaaaaaaaaaaaaaaaaaaaaaaaaaaaaaaaaagaaaaaaaaaatataaaaa

SEQ ID NO: 1025 - DNA, 544 bp, Diabrotica virgifera
cacacgcgtcagcaggtttttagcgcggatcttttatccgattgtttagagttgggttaatgtttctaatattttatttctagatttttttataaattacttctatagttcaagtcacagtttagtactggtacagaatgttggggctatttcgttgctgtttaatcattatcttgttgtactaataccatataggcctaatactcaattcaaatctgacgtgagctaaggcagccttcaatcttgtttggttttgtacctaaattgattctaaaagaaaaggctagcgctccttgtcgcatgtacaaaaggaaagaagttgagtttgtaaacgccattttactatataactaaactatgtatgttgttatcccgcatttattaaagtattgtataatagcagtaaccacttatatgtatatataaatattcaatactagcttatattgattatttttgttgagatgaaggcgtgtatatttcaataaaaacatcgttacaacgaaaaaaaaaaaaaaaaaaaaaaagggaggacgcacaaaaa

SEQ ID NO: 1026 - DNA, 1715 bp, Diabrotica virgifera
cccacgcgacatttttcaacacgtgtgaattaaaacaaattcaaaaacaaaaatgtccatccaagaaaaagttttaatgaaaaaaataaaaaagagggaaaagcagaaattaaaatttgttcaaaagaaagagtctgaaaagagcaaagaagttttagaaacagatctaccagagaaggcaaaagtgggaaatggcttgaaacgcttgcagagcaacgatgaaggaccttctaaaaaaaaaaagaagaaaaataaaaagaagaaagagaaaatagtcgaagaggaagatacagacgaagaacaaccagaggaagatgaaattgagtctgacattgaagatcaagagattgacaatggtgaagaagatacagatgaaaaatctgatttaggaaacaaattaccaggatccagtgctacattagaaattctcagtaaaagtacatttgactcattgacggataaagtatgtgaaaatactttgaaagccattgcagatatgggttttactactatgactgaaattcaagcaaaatctatacctccacttctggaaggtagagatttggttggggctgcaaaaacaggatctggaaaaactcttgcttttctcattcccgctgttgaacttatttataagttaaagtttatgccaagaaatggtactggtatcattatcatttcccccacacgagaattatcaatgcagacttttggagtattaaaagaactaatgaaatatcatcaccatacatacggtttggttatgggtggaactgcaagacaaacagaagcacaaaagctttccaaaggtattaatatcttagtagcaacgcctggtaggcttctggatcatcttcagaatactcctgacttcttgtataagaatttacaatgtttagtcattgacgaggctgacagaatattagaagtaggttttgaagaggaaatgaagcaaataattaatcttttgcctaaacgtagacaaaccatgttgttcagtgcgactcaaaacaagaaaacggacgcattgacgtcgttggcattgaagaaggaaccagtacacattgatgtagatgactccaaacttgaggcaactgtatctggtcttgaacagggttatgtagtctgcccatctgacaaaagattgttggtgctgtttacattccttaaaaagaacagaaagaagaaggttatggtgtttttcagttcctgcatgtctgtgaaataccaccatgagttgtttaattatatcgatttacctgttatgtgcattcatggcaaacaaaagcaaaccaagcgaacgactacatttttccaattctgtaacgccgaaactggaacgctgctatgcacagatgttgctgccagaggtcttgatatcccagcagtagattggattgtgcagtacgatcctccagatgacccaaaagaatatattcacagagtaggaagaacagcaagaggcgaaggaagtagtggtcatgctttacttattttaagacctgaggaattaggatttttaaggtatttgaaacaagctaaggtgccgttgaatgaattcgaattcagttggagtaaaattgctgatattcaggcacagctcgaaaatctaataggcaaaaattattttttgaacatgtcagcgaaggaagcatttaaagcgtacgtcagagcttatgattcgcaccacttaaaaactatattcgacgttagca

SEQ ID NO: 1027 - DNA, 1773 bp, Diabrotica virgifera
cccggtattaacccttgaaaattaaaactttcctactataggttgcttgtaacttttaactttactactgaaatagaaagcagataataaataatttatgatggtgcagaaggagagtgcaaactctggtgatgagagggagagttcagtgccagttgttcctgaaaatccagcaaagggtattcctactggaaaatacaagcttgtaggatggggtatagatactactggccgcagactaattgatgaaatcattcaaatagctgcgtttacacctgaatcacagttttcacagtatgtcatgccatttggagatttgaatcctacctacagcagaagacatggtatcagagtagtaaacacaatccgctacagaaggttgaaagatgtcaacacccaggaattcttgaagaccaagagtgaaatttctgctctccaagacttcttgaaatggttggagactgttaaaggaaatgacgttgatggaattatattgatttattatgaacttcgcaaagcctcaccggggatgctgttagaatcattaagaagacataatatgattgaaaggttccaaaaggtggtaaaaggctttgctaatggcttcaatatagcccaagcaaaatgtggcaacaccacgaaatctttcaatctccatataatgtctaaggtattgttaaacaggggtgcagagcacttcaacagtgcagtagatagagcaagggcttcatttgatattgctgctcatttagctcaaggggaaagagaggaattaaagggagaggcagccagtaaagattgtactggaacagaaagtcatctcatggaagtggtatgtccatatgtcaatcctatagatgctgaggaagaggaaatagctctttttaaggtattattagaaagacaaaatacattccggccagtgtttggagcactgttacgggccagtcgaactgagaggcagcacgcgagccatttaaggagacttttggcagagaacaacattaattatgacaaacttaaaatcgcttatgattctgacgccaaggatggtttggaaaaagttattaagagtgaggtagcaaatgcgaaggataaagatctggaagagctgttggatatcttagatcatttctttgatcctgaaaagaaagcaattcagccaaaacctaaacctagcccccaacgttatccgtatggtcggaggccaaaattcgtgaggaacaaaaacaattcacagagcaagaacccaaaaacaaactcgactgcaaacgacaatccaaccgccagcgacgattcttctcctcgaagcgaatctgaacaacctgcacaagacgggccagaagtcacttcgcccaaggaagagaagccggtggaggctcaatgagtgccttgaagcatgtggtgaaaacctcatgaagattttttgttcatttcaaggccagattagttctcacagttactgactcagcaacagtgaattctcggtgtctttaacatttttatttacccttcacacactgaaagctgttattttgacataattaatttaatgttaaatagcattttcaacttttctttacagtttaaatttctttgtacaattttttgaggcaatttttcaagtgtgattggtttattttttattatatcgaagcatgtttaattttttttgtgatagtaataggattatgtattgtgtaacattcattcaggattgtttgttacatacctgttattaatatttgagtttaataaagtttaatactactt

SEQ ID NO: 1028 - DNA, 1275 bp, Diabrotica virgifera
accgcacgtgcgaaatgcatttttctgttccgacataaacctaatttattttcaatttataatcgaagctaaccggtgtacagaacaaaatccatagatttattttctagtcttttctactgatcggatagtctgaagattttaacattgtgataataaataatttatgatggtgcagaaggagagtgcaaactctggtgatgagagggagagttcagtgccagttgttcctgaaaatccagcaaagggtattcctactggaaaatacaagcttgtaggatggggtatagatactactggccgcagactaattgatgaaatcattcaaatagctgcgtttacacctgaatcacagttttcacagtacgtcatgccatttggagatttgaatcctacctacagcagaagacatggtatcagagtagtaaacacaatccgctacagaaggttgaaagatgtcaacacccaggaattcttgaagaccaagagtgaaatttctgctctccaagacttcttgaaatggttggagactgttaaaggaaatgacgttgatggaattatattgatttattatgaacttcgcaaagcctcaccggggatgctgttagaatcattaagaagacataatatgattgaaaggttccaaaaggtggtaaaaggctttgctaatggcttcaatatagcccaagcaaaatgtggcaacaccacgaaatctttcaatctccatataatgtctaaggtattgttaaacaggggtgcagagcacttcaacagtgcagtagatagagcaagggcttcatttgatattgctgctcatttagctcaaggggaaagagaggaattaaagggagaggcagccagtaaagattgtactggaacagaaagtcatctcatggaagtggtatgtccatatgtcaatcctatagatgctgaggaagaggaaatagctctttttaaggtattattagaaagacaaaatacattccggccagtgtttggagcactgttacgggccagtcgaactgagaggcagcacgcgagccatttaaggagacttttggcagagaacaacattaattatgacaaacttaaaatcgcttatgattctgacgcccaggatggtttggaaaaagtattaaaagtgagggagcaaataaaaaggatgaagatctggaaagtgctaaaaaatatcttggatcgttttttatattttttttttttttttcccgaaaaacaaaaaaaaatttcccaccccaacaccccaaaaccccccgc

SEQ ID NO: 1029 - DNA, 1229 bp, Diabrotica virgifera
caatacgaacgtaactatacaatgtgtgtttagtgtcaaatatccatcgattgaggatttttttgtcgaaaaaatcgggacactggctgaagaatgtgatatttttgttattgcaaatccgtcgccatgacaactgtaaagataactgtcgtcggagatggtatagtgggaaagacatgtttgctcagtacttacaccaccggacattttcctgccgaatatgtacccaccgtttttgagcattacggacaaaaactcgtagtcgacgatgtagaatatgatatgaccctatgggacactgccggacaagaagattatgaaagacttaggccattgtcttatccacacacaaattgtttcctggtgtgcttttctgtcgataaaaatttggcatcctatgacaacgttattctaaaatgggtaccagaagttagacatttcagcccaaatgttccaatccttctagtagcgacaaaaaaagacttacggacagatcccagcttggcttgctacacgcccgaagaaggcaaaaagctgaaacgaagggtcaaagcgcagggctacatggaatgctctgcgttaatgaacgaagggttggaagaagtcttcatcgaagctatacgggtgttcaaaaagagcaaaaacaaaaaaccagttgctaggcactgtactgttttgtaattttcttccaaataaggactttttaaatatatgccatttaaaattgtgtataatacgataattgcacgttttgttattgctgcttttctaaaatcactttcaattaaaatacagtgtataatactgatgatgttccatttatattgcccgaacgttggatattaacgccttaaaactaaaaataattcgactgacattgtaggtggttgaaaaggttataaaaattgtttttgtattgtttttttgaactccattctttcttcgggggaatctgaaaaaaaaaaaaaaaattaactggaaaaaatgcgaaaaatatctacctaaaaataatggaaaaaaaaaatgatatccggccctaaaaaaaacttaatgggggggatccgtttttaaaaattttttaattggaaaagtaagtaagcgggaatgtgtaccgcgtataactttttggcaaatttttttaatcggtaattttaaaatttttttttgtgggtttttaaaaaaaaaaataaaatatttttttttataaaaaaaaagtgttgttttttttt

SEQ ID NO: 1030 - DNA, 967 bp, Diabrotica virgifera
accgaacataacgtaaactcccacagatgccaaaacgttggaaagattacaagagcgtagttatgttagagattggcagcgattgggtatatgtaataatggtggttctgctaacaataaagtggctgaacagtttagaataacttctgttaattatttgtatatggtatgtagaagttatcccgcgttactagtggtacctgcatctgttactgacgaaagcattcgaagattctgtcgatgttaccgtcaaggtcgcattcctagcattacttggcgtcatccacgaaccaaagcgttactgctcagaggggctggtcatcatggtaaaagtgttatgggtatgttgaagagtcacccaacaccggctgcatctacagaaacaacgtcttcatttgaacaggaaaaatacctttctgcgattgtttgcgcaactcctacattttcgcatagatcatggggcatgtcagacagttcgttgagtatcgattctcttctcttagctgctgacgatccactagcttgtgcgacaatgacacctgaagttgcgaggagatcgaatgctttcaacaaaaccattggaactttgggagcgttccctcgttcgtccggtggcaaaggaccgaagaattttggccgatggggctctctgaaagatcgccgccaaccctctcaagcttcactagctcctggccaatctggaaaggtaaacttacggcacagtgctgacgtcgaagctggtgtggacggagttcatacattgcaaaaagctgctctctatattctcggtgaaaaagctcaaatgaaaggcataaagattgaatcggcgccgaaaactgaatttattccagttgaatattatgatattagacataccaaaacggcgtttaagagttaatgcgcgcgtgtattcctagttctccaaatgctgagcctgaacatagttttcataggtttattgaaaaat

SEQ ID NO: 1031 - DNA, 1044 bp, Diabrotica virgifera
attattttctttagttatcatgatgagtgaccaacgattggacctcttgttgttcggtgcgagtggatttacgggaaataagtgcattccgtatctttatacgataactaaggaaaatggacggaacttgacctggggaattagtgggcgatcggaggagaagctgaggaaagtattagaaacgaatggacagaaacttggtgctgatttgtcaaatataccaataatagtgacagatgttaaagaccaagaatcggtcaaacaaatggcaaagaaagcaagagtcgtaataaattgtgttggcccatataaatatttagggaagcctgtagtggaagcatgtatagctgctggcactcatcacgtcgatgttacggctgaaccagaatttgtagacatactttctacggattgccatgaagctgctaaggaaaaaggtgtttatgtggtaaccacatgcggcatggactgcattcctacagatttgggactatcttacctcgaagaaaaattcgatggtgtccttaattcattaacagcatatttggaagcctggcaagaagataaaagtagtaggttggcagtaggttatggcacttgggccagtcttgtgcatggaatgaagcatggtacacagttcagaaggttaaaggaacgaatgtttcctggcagaaaacctgctccgtttcaaccggagctgagagtaaactatttccctcatcatgccaaagtaatagacgggtggtcactagtatatcctgcagtggataagcaagtcatgagaaagtcacaaacttatttatatgaacatgagaacaaacgtccggtacaagttgaaaccctcattaatattaaaagtacacttcatttgataggaatctctataggattttttatatggatgtgttttgctcaatgtgggtgtggcagatatcttctacttaattaccctagactattcacaaccggtctattcagcaaatacaaatggcccgaagataagatcgtaaaacaggctatgttccagataacttggtacggtga

SEQ ID NO: 1032 - DNA, 1175 bp, Diabrotica virgifera
actacctacttacctatttcataattttatccagggcgcgcttaggtacgtgccttgctactgtttgcagatcagcgttcggcagattgatttctgcagtacttgccattcaaataaatacgggaaatgtataattggttgtctatcggctaatattccatagcaaatcttcaatctggggacggcttgtcgaaaacacacaatcgcaatcgggtgcatggctataggatcatttttgaaaagtctcttaagcacagcgcacagggatcacttaacgtatgggatcgatcgaattcttttaaaaacaaggaataaaatttagtctgtattacctcacagatatttttttatttcacagaaacgaatatcatcaactctgattaaattaaatatttaaaaaaatctataatgtgtccataaatgtgtggggctgcactgccgaccctgacaagccgccactggtgttacgacagttccgtagactgatcctacatagaaaaattcccttgacgagaaagaagaagtagtcacttaccagaatgttctagatgtcatggaataacccagaaaggtctgatgacgtctagaacgtcagaaaatctatataaacatatgtgttttgacgtttttgaacagttataattcagatttgaaagattacaattgtcagttttgtaaaagttaagagttattgtaatttctgttggagtttaataaattaatttttaaaacaagtgtaacaatattatcgttacatttttcttaggaccgatttctcatgactaaattaatttatagtttaattgactgaggttcatccttgaacttcggatatgctggaaaattcttactgacagttcacgttctacgccttaatgtttgttgggaatgcaaaaatccctaacttctagtagcttaaggcctttattttgaatatgaagaatttgacactggtcattaaaagaatgattattatctaaaaaggtgaagtggggatgtaaaaatccggggttggaattggttaaaggtcttttatgatctgctatccgcttggcaaaagttcttccaagtttgaccaaggaaagattttgaagcacgtccaccacctggtcaattcccaaaaaaccagcctggaaattggctttctctttatttaaattcttttttccgaatcc

SEQ ID NO: 1033 - DNA, 1031 bp, Diabrotica virgifera
gtgctaaaaacttgattttcgtacctgtttaatatgagtgtggcttatacggctttagatcaaggacgcggtgcaagccaaccaagtgatgaccattctgcgaacagtgcacccatggcgaaggccgaggtagacgacatcgatggtactaccacagatgcgatcaacggaagaaataatgttgacccagtttcacatacaacggtaccggacatctccatcaccgacaccaacgaactcaaactgaacaccgaagaccacattgatggtcttcatttgggagatgatctcaataatcacgaaatcgatggagtgcaccatctgagggacttccgaatcggtaccccgcactcatccatggctcgcacagggttgaattttgacacagagttaggaagtatcgcaggggaaactattcctgatatcaacgtttaccaacacaaaaagactttggcgcaagggatgatggatttggcgctgttttctgccaatgccaatcagcttcgttacgtgctggacagttattctagacacccttacttctggggtagttgcatctgcatcattttgagtttgggattacaggtggcaataggcatcggtttaatatggaatgcgttgtacgacgtaaaagacgaaaaagaaatatgcgtagctaacaaaattaacaatttcactgtaattgggatattcttagtggtcgtagttaacgtttttatatccgcatttggagttgcagaccccctaccagccactgtagtagcagcgacaggagtttaactgatcattttttgtaaacttaatagattgctcaatgagtaattgtataatttcgaatataatgcaaattagattggcctatgtgaaaagttctcgatcgaggatgtgaaataatcctcgaagtgttagagtagatgatttattggtagtctataagaataattacctcagtcaagttgcgtacgtcgcccacgttgggcgcctcaataaaccattttactcaaatcaaatcactccaacacttccagaat

SEQ ID NO: 1034 - DNA, 1091 bp, Diabrotica virgifera
  misc_feature (1047)..(1047): n is a, c, g, or t
aataaattaagaggctacaatgaatttcttgggagctctctgtatactacacctgattgcctttggttcagctggagtcatcagccctgtatcagagataatagaaggcccaagttccaaaaccactgtggttggtcctgatggcagcgttataactgcggttgcccaaggtgcaaaaattgtagcaaatggagaaacagctgttgtagccggacctgacactgcagctctcctgaaatcagcagatgaaccggctgtgctcgaatctaacattcaaccaattgcgttggttaagtcacccatcgctgtgcctgttgttgcatccaaaagtggtattttagagcatggacaattggtagctcatgaaaacaacattttggtaaaccatcatattgcatccgtagcagctcacagttctccaatattgaatgcaactccttctttagtcagtggacatctacaaccagtagtggttgcacctgtggtgaaatctcagccaattatagctcaccaagctgcaattattgcttcaaagactacggaatctgagcattcacaatctattgtacatcctccaacattacaaaaaacgacttacgtagaatcaacagtgcctattcacgttccacttgtagagacaaatgacgccatagttagagcagaacctattatcgctggtcatgtttcacctttagtaagtgctcaccttgctcctgctctccattataacttagaaccagtagctaaagttgctccattagtccacgagaaggcagcactcttccaccacctagaaccagctattgttcctgctattcctctagttgaaaccaaagcagcagttatagctaaagaggtattacccgttgcatctgttgttggcaccaaaactactattacaggacaagaacaatccattattcaccctggaactgtactaaaatctcaaccaattgtagctgtgaaatcactacctgtattaactgaccacattcactctattcctgtagtagcacaacatgtccctgttcctgttataggaacaanaaccactctttcagaaaatgctcaaacagtagtatcacattctt

SEQ ID NO: 1035 - DNA, 1071 bp, Diabrotica virgifera
  misc_feature (1060)..(1060): n is a, c, g, or t
attgttttgtagtttttattcgtatcggtagcttcttattgtttaaatataaatgcgtgcgccacaatcaagttcaagtgggtttccaaattagttttaatcaatcctttattaatgtcgcagctagacaaaatttctggctatggcaaacaaaattgagggcagtattttttctggaacattaacacaattattggcttcagtgagcggttcattatttgcaatatctgatggaatgacttatggatggacggcgcctatgttgccatatcttgtaagcaaagaaagtcacataaaaaccacaaaatcagaggtagaatggctagaaactatactaatggtgggctcattttgcggtttaccaactactatttatttagtcgacaaaataggaagacgaaaatcactactattggctgcagctacatccctgattggttggatagttatagccttggctaataatatgatttatttatatattactcgttttattttcggtattattggaaatatgtcatttgttagtatgccgatgtatatagcggaaatagctgaaagtaaaataagaggctttttagcatcaattgtataccttcaaatgctagttggatttgtaatagtttacagtgttggaccatatttgccgttttatacgaccccaattgtggcaggagtagtattagtatccgaattgttaatattttggtggatgccggagagtccatattatctactttttaaaaataaatctgaagaagctagacagtctttacagtattttagaccagggagagatgtcgcattggaactaagagaaataaccaaagccatcgatagacaaaaaaacagaaaaaggacggtttcaagacataattttagttaaaagcaatcgaaaggccatgcttataatgactgtttttaacgcaggacagcatattgttgccatcagcgtaatactaatgaatttgcatgatattctaaattcagctggttcaatttatatggattctgctcatgctggaattttattttctgtgataatgcttatatctgctancacagcttctc

SEQ ID NO: 1036 - DNA, 644 bp, Diabrotica virgifera
atcgtgccttccttacaaatttcattttttttatacgatcgtactaaaattggtgctactatagtatgcggtctacctgtgcatgtgtatagagcctacaaacagttttctgcctttcattattgtatacaaacccttctgagaagagattatggtgttgttctgtagaccgcaagctatagcagaaacgcgacggtagaccgcataccatagtggtaccctaaaattatctcgcccgtaccacctcgatgcggaccacgcgtccgcccacgcgtccgctctcgtccgttcctgtgtccagattatattttcatacattgggaaagcgggtctaggatggctcctcggggtacacagattgttaacggaagtttttggaacggaggcgaggcgaacggtactaccgcagcttcttttttcctttgttactggatcatctgtcctgagaggtaacagaatttgtattttataattttttttatttaattatattttaggtatgttaaaactgaacgtatatgatgaaaataatgactgattgtgtattgttgaatccgattcggcagtacttaatacatttgtttgtaaaattttgagttttgctgttaatcattgtatatatgataaatatattattttacaga

SEQ ID NO: 1037 - DNA, 1036 bp, Diabrotica virgifera
  misc_feature (955)..(955): n is a, c, g, or t
ggaacatgggaacaggaaaatgtcaatatgaataatttcgcatgttagtaaatattgatgtttttgtatctgtgctgtgtaactcgaaaatgtaagatgtatacttcgttaaattagcttgaagtctatttgcatgcttcaaaaaatttaatattctaaaattgttacaaacatttatggtaatacctatttacctcattgtgtttaatagcatatttatcttcaacttcaaataaaatatttacagagcatcagttattgaaatagtttgtatttgtatatttgcaactttcaacgtacagatcaaagaaaagaacaaaaccaaaatgtttaaatcatgacaaaggcccaacagaccctaatatgcccaagaagaatatgatagcaaagatatgtccaacctgcaaacaacaggtacctgtggcatgtaagtcttgcccctgtggccattttttctacaatgctagacgcatagctagagagtttgccatagaggcagactataggaggagaactgctagagttcggagagaaaagcctaattattatgatgcccttgagtatgagaagcatatcaaaaagatgaaacaacgtttaagtgaatgtgataatgatgaagaggaagataacagaaaggataatggtaagagcaagaaaaagaaaatgaaaaaggaagatgaagaagaagatgaagtactaacaaaaatcactcctgaattacaacaacattgtcagtttattctggaacaactcaattttaagctttcaatggttacttggaagcctacatgactttgtggtagctaatgagttgttaaatccaaaacacttccatatttctaacatgctatgtactaagaatgtaagtcataaatagacctgtcaggattctctatattttgaatttataattaataaggtattatcaaaataaaaagtaaaataattaatttanaaaaaaaaaataacaaaaaaaaaaaaaatagaaacaaaagaaggagggcccctttaacaaaaaaaaaaggtatttttgggg

SEQ ID NO: 1038 - DNA, 1037 bp, Diabrotica virgifera
  misc_feature (864)..(864): n is a, c, g, or t
gtctgtagacgatttacgtacctggcagggtgttttacctaatagagcagtttccacgttgctatctatttagaatcagctctaagattaggtattcgccttttcccaaaaaaggatgtattttaatcaaactctgtttactctgattggagtacgaaggcaaccattctcgttggaactttaccgcgctgagcagatgcgacgtgaattataaattgtaaaattcctttatcttccttagtctcagcatccgttatggcttgcaaattgtagaagcctcggaggtgtaaccagagaaggttccaattgttttcagtccggtaggatgtagagtaacattttttgatgttgttttatgtgctattagattgaaaacttacgtcttttattaaatactttattactttgttatcagcaccaattcgacacttcttcgaaacatccacaggccataaagtacttttccataaagtacattgcccgttaataaattgttagaaacagttaacttggaattaatagagttaatttagaattcagccagagacctacgtgtttgcaagggcatcatggcatcattcgaagaaaaatgatctcactttaaaagaaaaggttaatatagtcgaatatgcaaaacagtcaaaatgcaatcaaatcgaagtttctaaaaaagtttggaatttcactagcacaggtgagcaaacttttaaaaaacaagagagtttcatcaacgaatgacgagtaattcaagatcaacccaaaaatgaaaacacagtatgaaagattcagatgcccaacagtcattatccgagtggaatattgagcagagggctgtcatggggcctatcagcggtccagttttanaagaaaaagttgaagaaatagctgaaaatttggataatgtgaactttaaagcggcaaatggatgggtctgcagatggaaaaatctgccgaaaatactgggattgactcactagcacgacaactataacgtaaaaatattacagctaaaaattgacaggaaacatcttcatgac

SEQ ID NO: 1039 - DNA, 935 bp, Diabrotica virgifera
ttaattcaaaaagacatgtttttaataaacaggtgaaaaaaatgttctcgaattccttttttgaccctatatattttttctaaatatccaattttttaattctaatattatcatcattattaaatttaaataatttaaatttatattttaataaaaaatttataaaaaataaaaataataatatataaaaataaataataacatattttaaaatatgaaaatttttaatcctaatttttatttaaaaattaaattttaataaaatgttatgtttaagttccaattataattaaaaatattcagtattcggatatgaactgtcgcgtttcgagatgtctggtcacggttttaacaattaattgaaacacttttgacaaaaatgtatcactatcaagaatgtttccaaaaattttaaagccactttttaacaagaatagaggcattttgatatataaactgtgaccgagtttttatactttcacaacaggaataatgaactcattatacgcacatcacattataataggcattttgatatataaactgtaaccgagtttttatactttcacaacaggaataatgaactcattatacgcactatcacattataattcataaaactgtcaccagtgacaattgttactcactagttattaaaactagtgacattgtgctacgtaacttgccacgtgaccttttggtaagctatcaaatgtgatttgtacgcgttatatttcaatgtgagcatttttctcatccaaatgtggatatgaagactaaactacaacaataccaagataagctgagctagctatcactccatcggtgggtatgtcgtgacatcacgacacgcccaccgatgggcgtgacctcgagctaatattggttttgaatgtagtatagaaatataatgttgttctgaagctatttccttg

SEQ ID NO: 1040 - DNA, 1092 bp, Diabrotica virgifera
agaacaacttattggaatgaacgtggttcacatgataaaaggacctcatggaagtttagttgcagctcccgtggaagccaaactacagatagactcggacgctttacaaccaaacagtgaaggtgttgttatagactatggagcaccagacagtaaaacgcataataaagttgcagaactatttgaaaactaagataatatataagacagaggggcatgtactcaaatctcttaaatgatattaatatttaatatttcacttaaaaggttttcactgttaaagtaaaatgaaacttagaactaagaatagtataatcatacaaacaccagttttggcttttacaatcatcagctttggccctacaatcctaggtggatcctgacctgcctggagaccaacatatgtgcctcccgatgagagactaataagttttgaaaccggtagaggggcttgctgcactctctgattgaactggaataatgatgcggctgtatcgtgttgcaacgaaattgaaaatggttattcattttttatttacatgtttactctgattagagtacgaagggaaccattctcgttggaactttaccgcgctgagcagatgggacgtgaattataaattgtaaaattctcccatcttccttagtctcagcatccgttatggcttgcaaattgtagaagcctcgtaggtgttaccagaataggttcccattgttttcagtctggtaggatgtagagtaacatttttggatgttgttttatgtgctattagattgaaaacttagttttttttaagtaaacaattgatcaacttgctcaagtttattactatttacatacacagacgattttatattgtcttgtttacttattacgagtattttggttttccgtatgttcagatccagacttgcttctttataactctcaacgacactgtcaagtaatgtttgcttatcttcttgagtagaagctccgcatatcgcaaattattgatgacttcaccgttcataataattatttcttcttgtttttcagaaagtgcatgtgtgaaaattcttgggagtaaacttttgataacaggggtgaca

SEQ ID NO: 1041 - DNA, 775 bp, Diabrotica virgifera
ggttgtgaaagttgttgtaaaacttaaaattaaaatggcgcacacttataaagtaagatactttaactttaccgcaagaggtgaacctattcgaatgcttttaagctatggagaaattccattcgaagacgaacgtattgccagggaagattggcctaaaataaaaccaactactcctcttggccagcttccggtactggaaatcgatggaaaacaaattcctcacagtatctccatttgcagatatttggcttcgatagtgaaacttgatggaaaagatgctaaagaaaatcttagaattgatgttgctgtggaaacccttctagacttgcaaaaacttgcattcgaatatgtgtttgaaaccgatgctgccaagaaagatgagaaaaataaaaaagtgaaagaatctgtaccactcttccttggaaaattagaagaacatgcaaagcagaatggtggctataccgctcttgataggttgtcatgggccgacatcattttcatttgtatctacgaaggacttatgaacatactaggaaaaaatacctttgactcgtatccaagtctacaaaaaattaagaaaaacgtcctagatgttaaaagtattagaaattggatcaaaaacagacccgaaacaccttccaccatgggacctttgaaattcgaatatgacttaaaacaggaagtttaagtgtgattaggttatttctatacattgtaaatataaatattataaaatgattatgttttgttaaaaataaaaatatataagcac

SEQ ID NO: 1042 - DNA, 995 bp, Diabrotica virgifera
cgtcaggttggtcaattcagtattcagaatagtagaattttgaattttctgtacgtgtacgtgagtcgtgagtgaatcgtatcgtatcgtggtatcgtatccggtccggttagctaagaatgtgtcaaacagggaagtttttaaattgttaatttagaagttaattttttgattaagttatacctaagtgcgaaattttcaaaaatgggccaacacgtatctagaacagatttcgaatgggtatataccgaggaacctcacgctagccgcaggaagcaaatcttagaaaaatatccccaaatcaagaaactctttggatacgatccgaacttcaaatgggtcgtaacgagcatggtacttacacaattcgtactgctgtacttactcaaagataggtcatggccagtgctaattttagtagcgtattgcttaggaggtgtcatcaatcactcgttaatgttggctatacatgaaatttcacacaatttggcatttggacacgcacggccgctgcacaacaaattatttggattttttgccaatttgccaataggattaccgattactataagctttaaaaaataccacttggaacaccacagatatcaaggtgacgaacagaaagatacggacatcccaacgtacatagaggccaaactattttgcacgacctttggaaaattcatttgggtgatactgcaaccgtttttctactctttccgcccactcgtagtttatccgaagccgcccacgcttttggaattcgtaaacctggtaattcaactcgccttcgatgctctcgttgtttattttttcggaggaagaatgttgggatatctccttattggatctgtcatggctatgggtcttcatccggtagcgggacacttcatcagtgaacattacatgttcaaaaagggctacgaaacgtacagctactatggtccctttgactggattacattttaacgtggggtaccataacgaacatcacg

SEQ ID NO: 1043 - DNA, 949 bp, Diabrotica virgifera
ttccctcgtccgcaacacaatgctcaggcaactttcaatttgggttatatgcatgaacaaggtttgggaatggtacgggatatgcatttggccaaacgttattacgatagagcagcagagctcagtccggatgccaaagttccagttgcactagctctaatcaagcttaacgtgctgtttagtttcgaaagtattgaagagggtccattacatcatttgctagacttcaacgcaacagttggatccaactgggacttatatttaataacaaccttgactgtcatgttagcagcaattgtgtattttaggaggcctcaggtggctgtctaaagatccaaccgaaagaagccatgtaggtcgtgatatttttatatttattttgtaaatattagaatgaataagtaattcaaatatcgtgtataatattgcttatagatcattttctaaaaatgttgaatatcattatcagtaaaacctttacaaataaatatttagaataatattactttatgagtccatttattatatacagtaactaaatatactgaatacgttaagaacataagtgtacattgaaacaatcaaaatccacataatagggaaatatagtaaaaggaaatggaggaaattaaatcaattaaaattagacaaaaacgtacaaacatggtgaacagagtatgcacaaataagtacacaagaaagtactccaaatacgtttaacacgtttggtgcccatcttgaacaagtgccacttagcggtaccacgtacttaatccttcatttagtagcacagtactactgacgccacttaccgatgcgtcatcggtacctttgataaaaccttcgtgacgctatttgtgcgtcatgggcaccgaacgtcatattaaaattgtgaacgggagaaggatttttcgtcgattgtcatttgcaacagtttggacaatgacat

SEQ ID NO: 1044 - DNA, 1295 bp, Diabrotica virgifera
tttcgtccgtgcttggcaaaatttgttttgtgagaggggtatttggtttttgctaattattgtaattatctgaattctgaatccagaatctttggtaggtggaaattgaatgtggaatctggatggtgcataaaaaagactgctgaaaattttctactccaagaactgaatatatttgaatgtaaaattgctgtgttaaaaatgatacaaatactttttttaggtctttttttccaatcatctctagctctctaccctagtagtggaagtgtagttgaattaacaccaagcaattttgacaaattggtgatcaaaggagatgaagtgtgggttgttgaattttttgctccttggtgtggccattgtaagaatttagtaccagaatataccaaagcagccaatgcattaaaaggtattgtgaaagttggagccgtagatgtagaccagcacaaagaaatcggaggtcagtatggaattagaggatttcctactataaaaatttttggggcagataaacgtaaacctgaagattttaatggtggtagaactgccaaagatatcgttgaaggtgctctcaaggcagctaaagcaaaagctaaagcaaatcttggtttaggaggtggatcacagtctgatgattctgataatagccacgtagtagaactgactgatagcaattttgaaaagctagtactgaaatctgatgatatgtggctagtagaattctttgctccgtggtgtgggcactgtaaaaacctcgcacctcattgggctaaagctgcagctgaacttaaagggcaggtcaaacttggagcattggatgcaactgttcatccagcaagagcatcactatatggagtacaaggatatccaacaatcaaattctttgggccacgtgcaaaaaattctcccacaaatatgatggggggcgtacatcaagtgacattgttacttgggctttaaataagttataaaagaacattccagcacccagaagtaactcaacttttaaatgacaagccttttaaaaaattgtggggagacaaacctccgtgtggggtaaacgttcttcctcacactttattttttaaatctgaatgtagttacagttatattaagatgttaaattaaaaaatgtttttttggttattttggaaaaaacattttaaaaaaaaaaaaaaggggggggaaagggggtcgggggcccctagaacccgggaaacccctccacttttttattttataaaaaaaaaaaatcccccccttccattaatttattcgggggggggatgttt

SEQ ID NO: 1045 - DNA, 1151 bp, Diabrotica virgifera
cggacgcgtgggcaaaaacaaaggtgttactgaaggatgtgattatccttggaggtcgaactattgcgacgggaagcaacaagcaaatccaccaatcggaaccgaacattgcggatggctgtatggtattttcggacacgaaacgtcctgtaccagatactggacgtctttttatcttatgacaattgtaagcgataaagggcaacggtatgtaatcaaaatttagtattaaatatttgtgctaaaatgaatactactgttatattacttatactaggaatatcaaccgttgttgcatacgatattgcgcaaaatgtaagaagttttggttacacttttgataagtttgaagtaaccactgaagatggttacatattggaaatccatcgcattagtgaaagtccaaatggaattaagaataaaaagagacctcctgtattagtcatgcatggtctcctgggttgctcagctgattttattcacattggtcctggaaaagcattaccgttaagattatctgatgaagggtacgatgtgtggcttggaaacaacaggggaaatacttactctcaaaaacacagttccactacaatcaaaaatgcgtcgttttgggactttagctttcacgagattggtataagtgacacaccagcagtcattgacttcattttagacaaaacaggagagaagaccttatcctacgttgctcactctactggagttgcccaatttttaattgccacatctatgaaaccagaatatcaaaataaggtgaagatcgcagctgcactagctccagtagtttaccttgaccactcaactaattttcttctgaaaatggtaactaaagatgattatgcacaaattttggctgcagaagaaagtgcaaaagcaacagttattttagaccacaactctataatatgggatttaggtttgggtgccatatgtggtatgtttaaggaactgtgtgctgatttaatatttttactgactggattcgatactgatcaattagataggtcctctattataccattcttctcatcatttcctgctggtatatctgttaaggaacttaatcacgttttacaatggaaaaatgaacggtctattcagccaatatgactatggaatgataaaaaataaac

SEQ ID NO: 1046 - DNA, 742 bp, Diabrotica virgifera
cttctaaggccccacgcgtccgtgtatgtaccagaaatacaaaaatttatatttactgctttatttttgtaaaatgtggaagattgtgttgtaatttcgaaaatggcacctacaatacagcaaaacaaccagaacggaacagccaatggcgttgaaaaaagaccagtaaaaactgtagaaaaaaggtcggatttaatatgtaaagtgaagtactgtaacactttacctgatattcctttcgatttgaagtttatagcatatccttttgaacccataaggtttattcaatacaacccaacatccctagagcgtaattacaaatatgaagtgctaacagagcatgatttaggtgttagtattgatcttataaacaaagatatatatgctattgagccaggagctactctagatcctgccgatgaaaaattactataagaagacattttaacacctcaggactcaaaaagatctcgccatcatgccaagtcagtatcctggttgcgaataactgagtacatttcaacggaacagagcagattcccgccttagactatggacaatgttgaatctacagccctttataggacttaagaattctcttaacactggaaaggtgtacatggaaagaacatctccaaataaaggctttggaaaaaacctttatagactcttaaaaacttgttttttctgtatttctaacaaaacaatcgtcttacctggggtatttttttattgggtcagc

SEQ ID NO: 1047 - DNA, 883 bp, Diabrotica virgifera
catctcgcgtccggcacaagaaatcaagacaatattttatgtgatagtgtgaatcagctacctagggaagatcatgaaatgatacttaataaccttataccaaattataatattgactttaataccatggaacaaattcaggtatactttttaagggacccgacagttcacaaatgttcaaagattgttgtatggtatatacagatgcaatcaaaaaatattgaaggtgtggggtgtgcctattgggatagcagtaataaaattagtaaaacgttcaaactaaattctattatgagtatatacacagctgaattaatagcgataatagaagcactaaaatatttatctaatataaatcattcaaagtttataatttatagtgacagtaaaagttctctaagtaaaattagtgctataaatcctaaatcaaaagtgaactacattgaattatttataataaataaaattaaagaacttcagcaacaaggaaagtctgttaagttagcatgggttaaaagccactgtggaataactggaaatgaaatggtagatgaattgttcgtagggggatttttccacattctctatttcatctgtttaatttcgtacgagtggtcgtcaaaccattaaccttggatcttttgatcactgagtgtgtttcaaggatctacatctcatgtttttaaatatatatatatatatatatatatatatttaaacttaatatagctgatagccctcaatgtatttgtggtcagtttggtaacctacaacacaaaattttgacctgttctcttatttctaataaagttaatatgtttttaaatccactgtattctttgactgatgtccaccatcccattaatttaaattatttattaac

SEQ ID NO: 1048 - DNA, 738 bp, Diabrotica virgifera
aaacaattgcggctaatcgaagaatattttataggaaatactagttacttgcccgtgggcttaaatggagagttcttcagggatatcatttgacaagcacgttctacgatggtacttcgtttgctgttgttttctaattttgaagatgtcgtttatgtcgattttcacggcagtaaaaagagttatacacaaggcgtttgcaaatcccgaagattcaaaacaaatgaaagtagatccacaagtaaatgaaaatgtggagagggtaagaagggcacatttaaatgacctggaaaacatcccactctttttcgtcgctggattaatatacacttttgccaatcctggagcagcaggagccaaggcgatatttgtaatatatgtagtcacgagatatttacatactttcgtatacacagttgttcctcttcctcaaccagctagagctctatcgtggagtaccggatatattattaatatatacatggcgatgtacagcttgatacattttctaaaatcaagttcagtttgatctttttaatcttgattaactttactagtccaataagagtatcgtgattgttacagaaaaaataacttatataaatatattacgctaatttaatttaaattttatagataaatatttgttgtgaaatattgactgtattttaatttgttataaatgtttttaaatataataattaaggattaactaaataaacgaaaatacttgtttct

SEQ ID NO: 1049 - DNA, 1774 bp, Diabrotica virgifera
gtgttttggaataacctgaagttgtagaaacaaaaatatcttgatggtataaatattggtggtttgagttgttttcttgagtatctttttttgtcaccgacgaacacgacgaagacaagtttttatttagttattaatatgaaatataagattttatgtttttgccttttggctttattaaatataaaactaggacaatgcgctacaggagatgtgagcttcataatattctcagataatgaaaacaggggacatttaatagaaaaacgggatgccgaggagaaaccgccaattatatacgagatgaacgtcaactcaaacgtttctaatcgtttcgcgacgacagtcatcgaaagcagagtcaagaatgcacacactacggctcgggaagctgtcttttctgtgattcttccagaacaagcatttatttctgagttcgtaatgataataggcggaaaaagttacaaggcgtacgtcaaaggaaaggaagaagctaaaaatatttatgacaaggcagtatctagcggccagagtgcagcccatgtagctgtcagtgctagggattcacacaggtttacagtatctgtaaatgtagaacccgaggccaaagctacctttttgttgacctatgaagaattactggaaagaagaaataaccagtacgagctggtattaaatattaacccgggacagcttgtaaaagatttaagtgtgaaggttaacatcagcgaaagcagaccactagtgttcgtaaaaactcctgctctacgttctggtaacgaggttagtaaaaatgaaaacaaattgtcaccttctgcaaacatagaaaagattagtcccacaaacacaatagttacattccaaccagacgttgaaaaacaaaaggtatacggaaaagaattcggcaggtaaggagtcagatgtacacttactggacaatttatcgttcaatatgaaattgaaagggatccatccggaggagagatcctattaaaagacggctactttattcacttcttcgcaccaaaagatatagaatctctacccaaaaacgtttactttattttggataccagtgggagtatgggtgggattaaaatacaacaactaaggaatgccatgaatagtattttagatgaaattaaaccagaagacacgcttaatattgtagagtttaacagtgaaacttttgtatggaatattgaagcagaaacgtccgtaaatgttaaatttagtaattatactcatccttatgaacaacttaaggaaaatgacatgcctggacctcttccagcttcacaaccaaatattgctaaagcaaagaaacttatttctaatatggctgcaacaggaggtacctatatgattggtgggttagaaactgctctatatcttatcaaatctgaaatggaaagatcagtaagcactgataatactagacagcctattgtgatctttttaacagatggacaaccgaatggtgggttatattcccccagatgaaatcacccaaacaaagtaacacatttggaattccgacggtataaatgggccccatttttctctttggcgtttgggacaaggaggggacaaagcctttttaaggaaggttttactccgagaaattccgggtttttcccgacccatttatgtagcaagggatgctggtccgagggtggcccggccctttgttacaataattggggtccccctccaatggacaacgtaagcttaaaaaatgacccgtaagcccgggggagtggggtaggaagcc

SEQ ID NO: 1050 - DNA, 788 bp, Diabrotica virgifera
actagctctagaattagtattagcttaacctcatatgaaacaaacaaaatttgcttaatcttcagtacgtttcagtcattctcaagatagtttttgacgacatagtatttctttatattcatacaaaactattgatcactagataaaaaaaatgggtctaaaatcgctactttttataatttgtttgggaatctgcattggtttaagtgttgctgagaagctgaactcatcagaccaacaatatttggatgatctcttcaaagatatacccgatggagatagaaaacgtgtcctttaccaccatctgtttttgggatacctgaagaagaatccacagctaaatccaactgattacaatttggatgataaggatgcagaaaagctatacgacatatttataacaaaattcaaaacaaattctctaatgtcggatccaatctgcttctctaatggagaatgtatagatccttctgattccggcttgtatcccagctaaacgtcagatatatttgtatagttagatgtaggtatagataattcgttagatattagatttaaaaactgtattcatttatatacatattatgttatattagctttaaataaatccatggtgtattgttcaaaaaaaaaaaaaaaaaaaaaaaaaaaaaaaaaaaaaaaaaaaaaaaaaagaaaaaaataaaaaaaaaaaaaaaaaaataaaaaaaaaaaaaaaaaaaaaaaaaaaaaaaaaaaaaaaaaaaaaaaaaaaaaaaaaaaaaggggaaaaatttttaggggggggg

SEQ ID NO: 1051 - DNA, 2151 bp, Diabrotica virgifera
tttgagttattcctggctgaaaatcgtccaatttcactgaatcagtccccccatagcaagcggctgtaagacaatactttttacgctactagttctagatcgcgagcggccgccctttttcatttagtgtaaagcatgcctttccaaaggtttgtagaaaccggccgcgtggccgttgtatcggaaggcccacataagggcaaacttgttagtattgtagacgtaatcgaccaaacaagggttttggttgatggccccaacagcaatgtacccagaggacagcttaggttaaacgaattgcatttaacaaagttccgcattaggtatccattttcagctccaactcgtgttgtaagaaaagcatggactgatgctaagattgatgaaaaatggaatgaatctgtctgggccaaaaaagtagctgccaaggaaaagagatcacaactcacagatcttgaccggttcaaacttcgtagggctcgttcacgaagaaaccacatccgtacagcaactttccttgctttaaggaaggccgcatcaagaaacggtttcctctatggtaaaaagaagatggctaaaggaggtgacaaacctaaaccaagcaagaaggcgaagaaagaaaagcctgcacccaagaagaaataatttttagattaaatgacaatatatttgtcatttatgcgcgtagtaccggtttttcattttgtagagtttttaataaagtgtttacttttattataacatatttgactcgaatgtggcataattcaagtgattttttattatttaactcatttataaacatacagtcgtatttaactacttgaaaacagtacaaaaagattaaccatgagttctggcagcatttgttataagtgcaatcaacccggtcactttgctagggagtgctcacagccaggaggcggtagagattctggaagaggctctttcagtagaagtcgcgacaaatgccacaagtgcaacaaaatgggtcactatgcacgtgactgtaaggaggaagctgctcgttgttatcgttgctatggtgaagggcactttgctaaggattgtatgcaaagtccagatatgccgtcctgctacaattgtagaaaaccaggacatattgctcgcagttgtccagaagcaggtggggacaggtcctcaggtaatgacacttgccacaactgtcaaagaccagggcatatttcaagaaattgccctgagagcacaaaaacatgctacttgtgtcacaaaccaggtcatctgaaaagagattgccgagaaaatgactacagaaagtagtaccacatgtttattattttgttgtacctattttatatatttaaacatttgagaatgtctgttttcctaatttcttgttggaactaatgtttcttatattctttttatattaagctgtaggctaaaactcaattctcatttgtccaatttccaaagtgatattgtacttacttgttatttctaatagtaaagacgttcttatcagttttatcgaaaaacgaaatgtatgcctgttctaacttatttaaaatttttatcaacatttgaagagtggccgagctaagtgatctaagtgccaaaattaaaaattgccagaaatcaaagaaaatttgaccaaccaaaaaataaaacaattgaggtctggactgagatattctttttcacattatgatcgacgatagtggctcttatccctcgggaagctattggtgtgctcttttactatttatcatgaagagtgtacttaaacattgacagttggtgacagtgattaagtatttgatagtgatcatttttgattagcgttcgaacaaccggcccttacaggcggctcatctttgggttttgtttgcaaccactagaatgaagttggcatacaaatatcatagggggacattggcatagcaacatagatcatattaattgggaaaataaacaaaatttatattttgacacttagatcacttacctcggccactcttcatttatgaattatgaaaataaccagacatttaatatgttgaaattgtttaaatggtacaaaaaataaggttttgatttttctgtttcttaagctgacattttggttataaaaacgttaaattatataaataaagatttaagtttgta

SEQ ID NO: 1052 - DNA, 1142 bp, Diabrotica virgifera
  misc_feature (1110)..(1110): n is a, c, g, or t
  misc_feature (1112)..(1112): n is a, c, g, or t
  misc_feature (1115)..(1115): n is a, c, g, or t
gctaacttcagactggtattacgtaaagtgtcaaaaaattgtatattttttcttagtagcttcctaaaagtgcttaaattctatcaaactagctttctatcacctaaatacttcatgttactctaatctaagggtacgaggggtacaaaataaatttcacataacctatctgcatagtttttgacatcaccctttaggcaacatggctgcaacaataggacgaatttgtggagctggtcttttaaaaccaacaaacttatcctctgtgggccagttaagttcgtattccacaacaaaagaatggacccgtggaagaaaagcacttttgggaagcttagggcttattgctggtggtactggtgccttgctgtttgctttggaccaatcagttaaagcatctgatcttgaattgcatcctccaaagaatgtttggagtcattctggaactttcaattccttggatcatgctagtgtaagaagaggttatgaagtatacaaacaagtgtgtgctgcctgccactcaatgcgcttcattgcttaccgtaacttaattggagtttcccacactgaagcagaagccaaagctgaagctgaagaacaaatgattgaagatggtcccgatgacacgggtaactttttcaaaagaccaggaaagttatctgactacttccccagtccataccccaatgaagaagcagctcgtgctgccaacaatggttcctaccctccagatttgagctatattgtatctgccagacatggaggcgaagattacatatttgcccttttgacgggttactgcgacgcgccagcgggcgtggtcctcagagacggacaatacttcaacccctatttccccggtggtgccatttcgatggcacaagccctatataatgaaaccatagaatacagtgacggaacaccagcaactgccagtcaactcgccaaagacgtcgctgtgttcctaaaatggacgtcagagccagagcatgatgacagaaagaaaatgttaatcaaagtgatcggcatcttttctcttcttattggtatcacttactatgctaagaaactcaaattctcttcactgaaatcgagaaagattgaatttangnccnagagtaaataaataagtattgtagatg

SEQ ID NO: 1053 - DNA, 1284 bp, Diabrotica virgifera
tcccctgggccgcaaagtcttcgactcacgcacagctgttttgaacgtcaaccttgaaatagactatagtaacacgcatcttttttccctgagacttatatcataaaaataatgttattctaatatttgtcttatcgctaagatagatgctacgctacataaaaactcacttctattgttaaattatttctagttgtcgttacgttaagtattattttataaataataccagacgaactatgggttctaaagtggctgcaatatttagtttcgtgttagttttttgtagtgtgaattatgtgagttccttgaaggttttggggttgtttccctacggagctcctagccactactttttaggaaacgagctcctaaaaggtatcgcagaagctggccatgatgtgactatgataacagtttttgaagaaaagaatcctcctaagaatgggaagtttcggcagcttgttttaaaggaagtgttaaatgtacaatacgaattgttcgcaaacatgtcaaacctcaatgacgaagattcgtacgcagcgaaaaatcctcttggtatgatgaaaattttcaatatggttggcttaactgtaacagaagcaacattatcccatcctacagtacaagcgttgattaagtcaggagaaaagtttgatgtcatgatactcacacaatatgcagtagaagcaacaaaggcattagctacacattttggcgctcatttagttctgtataatgacaacgctgcaacgtgctgggtaaatcattttgtaggaaactcgggcctaccttcattgaatcctgaactaatattcgattatccacaattgatgagttttaaacagagactagctaacactttgtatacgatagcaacttatgtgaaccataatttggtacaatatccagctcatgctgagctaataaagaaatacgtttcaaaagatatggacttgaccaaaattcaatatgatgtcgcattggtactctcaaattcgcatcctagcttaaacaatccagcaccatcagttccatgcatgaaagaaatagcagggtaccacgtccaggaacctaaacattgcctgctgatcttaaaaatacttggatgaaaaaaaaacgtggcattgaattctgaataggtccaatacttatagtaacagaaaaattggggtttcccaattattttaaacagaaaaaaaacgctttttttccccaaaaaaaaaaaaaaagggggagaaaaaaaaatttttggagaaaaagacctttttttttctttctaat

SEQ ID NO: 1054 - DNA, 993 bp, Diabrotica virgifera
  misc_feature (881)..(881): n is a, c, g, or t
  misc_feature (895)..(895): n is a, c, g, or t
  misc_feature (902)..(902): n is a, c, g, or t
aaagatagaaaaaacaaatcagaaaaaatgtctagttcaaaaacaaacagatctattactccaaaatcccccaagcagtcctcgagatctcagaaaaacgttaaagataataaatacgaaaaatttaacaaatatgaaagaaagaggtcgccagaaagaagaagaaaatctagatctcgttcaaatggaagacgaggtcggtccagatctatagaaaatcgtaggagctccagatctatagaaaagcataggagctccagatctaccgaacgatccaaatggtccctacctacggcaaagaaaaaatcgagttcggtcgatcaaagaaaaagatctaggtcaaaatcgcaagaatccaagtataagtcaaagagacctggagggaaacaacaacgttccagatctaggtcgaaaagatctcgccataatgatagatctagaagcagatctttatctatttccactaaacgaaaactcaaacatgataatgtgaagagatccagaagcaaatccacatctgtatctagtacaagaaaatcccgttcaccttcagtagacaaggaacgcaaacgaaaatctagcacggattttaataagaagaaaagaagggacaggtctgcatctgttgacaaaagaaagatacttcgatcgaaaactccagataaagaaagaaaaaagtcaaggtctgattcaagagaaaaagttagaaaaaggccgaagtccgaatctgaggacgaggaactagctgaaattagaagaagaaagcaaaggtatgaagaggagtatgctgaaatagctaggaaattgagattagctgaagaagaagaaaaaagaagaagggaacggtcactttccaaagataggaaaaggagaaataggtncaattctcgcgaanagagatncagatcattagataggagatcaaaaagactgataggcgtgaaataagaacttcacgaagtagatcaccaatccatggtcgaagcagatcga

SEQ ID NO: 1055 - DNA, 435 bp, Diabrotica virgifera
accacgcgtccgaaaatataatataattttatcttctgcaaaggagaaaacaatattattatactctttactgtaatccgaacataatagtaatattaaaatgatacgataaacaacacaatatatacaataacaatctcgttacgtcaaatccacatagccatgcattcagacccggagacaccgtatttcaattcaatgcggccaggttgaacagcgacacgcagtcactcgttcatcgttactaccgcccactgcggtaacggtctcggtaagacgccacgtcactactgatgcgcccacctaggcaaagtaccggatcaaagaacgccgcatatttgccatccagctattgctaattcaatacgttgcaacaactgattttctcattctcctggctcgtcttaaatatgctctcgatgccctctccttcgg

SEQ ID NO: 1056 - DNA, 981 bp, Diabrotica virgifera
  misc_feature (868)..(868): n is a, c, g, or t
tttacttttatgttaatgtttttagccactgatgcaccggacctaacctgccctcccagtaactctggcacaacttacgttaagttaaaggatgcagtcctttgcaattatgacagctcagtaaggcccgtggtcaatcatcaaaactcaacatctgtatcgtttaagcttattttaaagttctttgattttgacatcctttcgagcacctttaaggtggatgcttggttgtcattgttttggcgtgatcaacacttaacgtggaaaccaagtgaccatgataatattaaaaatatttatttatatacctatcaaatatggacaccagacttatctgtttataatttagctaatcaaggagaagatccggaattgatttcgactataagatgcatggttaattataatggcgtcgtcctttgcgtccctcccattcatatggatgtattgtgtgttcctaatttgtcaaaatatcctttcgataaacaagattgcaaattacggataggttcgtggatgcataagggagaagaaatagatattgtagctgaaaagaatgttgtaaatgtagacgacttgatacctaacggagaatgggagattttgtcccattcgaccgttaaacataagggtgtttatgcatgctgtcctaacaatacgtacccttcggttgatattaacttcaccataagaaggttagctggaagtcatgctgccagtatggttattcctgtaattgtatgcgtcattttaaccttaatggttttgacactatcacctgtaaataaagaaagactgattatgagttatgtcaatattttatgccacttcacctccgtgcagtatgtggcatgtcaacttcccttanaggagataatatgccccttataattatattttcaagagatgcattgttgatgtcgctctttgcattgtaattactctaatattagaacatcatgcaaaggaaaacatgccacc

SEQ ID NO: 1057 - DNA, 1527 bp, Diabrotica virgifera
ccccggacgcgtcggcaacgttccagtgcttgattttagttctcgtagctactttagcattcgatagtgcgattgcaaatgatgtagcaaaaccgtgtgagtctgattcttgtacgatcggcaacaattgtagatgttctagtcaagtgtcacctctaggtggagatctcacagagtatcctcagctgattagtttaacatttgatgaagctgttacacaacacatctacgacaacagttggattacattgctcggaaatatatataatccagatgataagccaattagtggaacattctttgtaccacatgagtatacgagctatcaaagagttaatgatttgtacaactttggatttgaaattggtgtgcactcaattacgaaggattttagacaaaattactggagatatgcaactctagacacactaacaaaagaatttaaaggccaaaagcaaattataagtacttatgccaacataccagctgaagctattattggagtcagaactccccaactacaacttgcaggaaacacttccattgaggcctatatagcatcagaattggcatatgatagttcatggccctctttgccatcaagaagattatttccctatacattggattatcaatcaacagaacaatgtcttttgggcgcagaatgtcctaacgaagctttcccaggttattggattctgccaataaacgatttaacttcaccaaatggtacagaatgcaattcactggctacttgtggaatagaaggtagtgttgatgaaatcgccaaatatttggatgatcaaattgaaggaattagaagtaaatctagaactcccataaatttgatgatcaactcatactggtttgaacaaactgacaccagcttcgatgggcttcgaaaattcttggaaaacacagttgcacgtgaagcaaaagataccttcttcgtctcacaaaaacaggtcctagattttataaaaaatcccgttaaaattagcgattttaaaactgctgacgcgcccgatggagccagttgtgagccttacacctgcagacttaaaaaaggaacagaggatagaaacatggacgcgtgtgttccttgtccagacgaatacccatggattaataacgttaatgtataaataatcgtattttgaatctaaataaataaaagtttgatagatttaaaaaaaaaaaaaaaaaaaaaaaaaaaaaaaaaaaaaaatattaggggggcctcgccccccccttaaaaaaaaaaaaaaaaacccatggtgctcctatatttttttttttttttttttttttttttaaaggcaccccccccccccctttttttttttataaaaaaaaaaaaaaaaaaaaaaaaaaaacccaccccccccccccccacaacaaaaaaaaaaaaaaaaaaaaaaaaaaaaataccccccccgcccccgccccccgcgccgcccggccccaaaaaaaaaaaaaaaaaaaaaagaaaaaaaaaaaagacgcccgacgccccccccccccccc

SEQ ID NO: 1058 - DNA, 725 bp, Diabrotica virgifera
agtttagctgcttgagtttagcacacgttttgtttaaatatctgcagaaaaccaaatttactaaaaatgactaaaccaaaatcgaataagagaaacttcggtgataaaggtaagttttcccaaaaacgtaaacaagggattggaaagagaaaccagaaatttaaaaacaacaagaaaaataaaggggggccgaatgttcataagaattttccaaaaaagcaggttcaggatgtcaaaccggatgtagagaaaaatgaaattaaaaatgatgtggtacaagctggctcatttataggaaatcctgacaagaatccaaagaaagatccattttttatcatcaaacaaaaagtaaattcttcagacaaccacgagaaggaaaaaattatcaaagaattggaaaataaaatcaatgctatcgaaagcaggggtcaattgactaacacagcaacaagaaaattgagacaattaaagaaatataaaaaattggcggaagggggtcaactgaattctccaccagaaaaaacaaaacatggtaaaacaaaaacagagaagagacgggaaaggagagttgcagcagcagcaacaaagaaagaaacagtggcactaaacaaaacaaaagtaactaagtcagtaaggaagaaatctgctgaacccgaaagtacagcggaaaaatccgatgatgaagttgagggagctgaagaagatcttctgagggcgcatcaaat

SEQ ID NO: 1059 - DNA, 310 bp, Diabrotica virgifera
cgttcaaaatggcaaaacttacactcgttctcttggcagccgtctttgtagccgttttggctacccaagaagtcagcgccggtgctgtcaaaggtgcagaagctcctcgtgctgctggacttggagcagactgcgaatgtaacgcatgcagtaaagaatgcatatccgagagctccgactacattggaggtatttgttaccaaggccaatgtgtttgtgcctcccttggctaaactaaataatgtgataaagtttaattaataaagtgttaaattgaaaaaaataacactccagcaaaaaatcctttttt

SEQ ID NO: 1060 - DNA, 946 bp, Diabrotica virgifera
  misc_feature (875)..(875): n is a, c, g, or t
ggaatttatccaaggcaaaaaataaattacgttttaaatacttctcaataaccaataaattttgtcaattggaaaaccaaaatcccaacgtttataaaacaactgatgacagaacagccactttggatgaagaggatgacactgtagtggatgaatttgatcaaagagaaatatttgatttaatcagagatatcaacgacccagaacatccactatctttagaacaattgcatgttgtccaggaaaatctcatcagcattgataatggaaagaattcaatccttatcaactttactccaactattccgcactgtagtatggccacactgataggtctgtccataagagtgaaattacttcggtgcctgccttcgagattcaaagtaagagttgaagttaccccaggaacgcacaacgctgaacatcaagtcaacaaacagttggccgataaagaacgagtagcagcagctttagaaaattctcatcttattaaagttattaatcagtgtatcgcttcaagaaatagaggctaaaatgagtaattctaacatatacctcacttctccatgtaacatggcatctgcctatagtaaatgtgctagatacatgagaaaaatattcaaatttgaccaaatggactttcagtttgccatgtggcaaatgttttatttatttgttaatccccaaaaactaataaaattatttagggctaggaagcaagcgaagtcacaatacgcaagagacgatcctgcatttctagttctatttgcaggagcgcttagtataacaacgatagcattctcgatagttctccagttatcgtttttccaatttatcagaatttactggttgtaatttttgtagactgtatcggnagtaggtgtagtgatagccacatttttatggtacataacaaataccttttttaaaaccaaactaaccctga

SEQ ID NO: 1061 - DNA, 1067 bp, Diabrotica virgifera
catctcaatcatcttcatcctaattctacagaaaattaacccagtcaggctagctctgcgtagatacaatctgctggtgctacaagatttttctttagtaaaactgttattaggaaaatgaatttcgttagagcctaaaggctttttagacactccctcaccactaatcagttgataaaaaaatcagtgacattagtgacatgcagctggtcttcacacaatattcatactggagattgtagattcattggagattcatattggagattggtattattcatcggttcatctagttggtgaccgtcctcgacttcttttatagtttatgggcctccattccatgattggtcttgtcctccgtccatcttgtgttctagctaagtgtcctatccagttttacttaagtgtcgtgattctttccatgatgccttgaacgcctgatctttgcctgatttgttctcgaaggatcacgcccaggattgcacgttccatggctcttcaaaaagtatctgcttcataagttcatagggagaaaacacattggtatgtaaaccatatcagacccattgttttgtatttcatgtgtttgattgtctgcttattatataagtgtatgttaatatctcttaatacttcgctattattggtacctacctacttcaaacattgcaaaaactgattgatccaattattaaaaaaaaacaataataaaaactctaaaaagtcaaaaataaaccataacatcacagcattcaaaacgattgttatttttagatacatcaaaatgcgtttattaccaaacttattaatcctatagtataaaacaccattaaaactacaaaagttttagtttttcattttcagaaacgtgaaattctctgttttctgttagtgttatatttaaaaataggttttgagaacataaattcattgcccacacatatcggttgattctgtgcatgactacactttttttattattaaataacttttttccggagttaaaatggtggtggaaaaacgtctttttcctttttttttttgtggtttaaattaattttttcccc

SEQ ID NO: 1062 - DNA, 880 bp, Diabrotica virgifera
gaagaaacatgttacaatacgcgtgcttcatttgtgttacattgttagcaagtattcattgcatatcatgcctagaagctagtgtcgaagtagaagtaccaatatctgtgaaagtaggtaacagtgcaactcttgtttgtaacttgaaaccaaaaaacgagaaagatcatctcagtaatgtacgctggtgtaaagaaaatgaagaattctatcgtttttccccagatgacacaccgcaaaaaacaacgtctaatattcctggtatagttgttaatgtagaagaaagctcagataaaaaggtagtgttaagtaatttgcaaaaggaacttacaggaaactatacctgtgaggccagttggacgacaccaagcaccgtgactgctaaggattcgaaagaaatgtatgtaatggacgaattaaaaggtgatattctcctagaaggtacatctccccttcgtagtacggataagttgtttggagtatgtgttagtcctgcatctcaagttaccccaaaatttacatggcttttaaatggagaacaggtttctagtgaggagtctcaaccagccaccaaaaataataaagatccgaaccgttttatcgcttacctaaaatggacgaatggagtttcgttcgtagatggtaaggccaacctaacttgtgttgttgaagtagatggcgtttataacgctcaaaaaacggttatattgaaaagcttttagtaagcgtaggacagtttgatgactatatccaatgacatgtggaagtccaataacaatcaatatgagtatggcaacatatccctttcaaaaattattatgggtacctacctactcttttaaacatttatgtatttaataatattagtaaattacatagg

SEQ ID NO: 1063 - DNA, 1384 bp, Diabrotica virgifera
cacgtgtatacgaactactttaaacttatgttgaccattttcgttttagattattactaagtactttattagaaatggagtacactataggaagtctcgctgacttaatatctggtaaaaatacaccaaacaaacctaaggtagtaaaagttgcagttaaacaagaaattaaatctgaagaagaggatgcaccaaaatcaataaagaaggaaaagaaaaagctcaaaccgtcagttactgttttgaaacaagaagtagtctcctctagtgatcctgttaaaaagaaccagaaaaagaagaaaaggaagatatcaaatagtcaagatgatgacaatattcctgaaaaactagttgtaaagaagaaaaagcgtaaatcttctactagtcaggacgaagaacaaattacagaaggttcatcaattaaaaaacaaaaacataagaaacggaaaacatctttaagtacagttagtatagaagatacagaatcactagtagagaagacgagtagtaaaacacgtaaaaataagtccaatttaaatgggagcagtttagctgatagtgatgatgaggagaatcttgatgaaaaagtaagtagtgaacagaatggtcaagaaaaagaaactgcaaaaaagaaagtaaaagtagaacatgatccggaggaacaagagaggacaatatttgtaggtaatgttccaatcaagattaaaaagaaaaagataaaacaatttttcaaaaagtacggaacaattgaaactttgaggattagaggaattcctgtggctgatccaaagatacctaaaaaggtggctgcaattaaaaatgaatttcatcctgatagaaatagtgtttactgttatataagatttactactaaggaagaagctcaaaaagcattacaagcaaatggtagtgtatttgaagaacatcatctaagagtacataattgttctaccacagaaaaacctgatgaatctaaagcaatattcataggaaacttaagttttaatgctgaagaagaacaattgtggaagttgtttgaaccttgcggtccgatatcttcagtaagaattataagagactcctatacaggtatgggcaagggctttgcctatgtcaactttcaagattctgatgcagtacaattagcacttgaaatggaaaatgtaaagcttggtgatagagaactgagaattaaattgtccagtgtaaacactgctaagaaaaacaaaaagaaggacaataaacggaatgcaacaagacgcaagatgggaaaagaaagaaaaagtggacaggcacaagataccgaagctgatggtaaactttctagaaagacaaaagacgcatggtatttaataacaagggtttttcaggttccaaggttaat

SEQ ID NO: 1064 - DNA, 1353 bp, Diabrotica virgifera
  misc_feature (1251)..(1251): n is a, c, g, or t
  misc_feature (1266)..(1266): n is a, c, g, or t
  misc_feature (1287)..(1287): n is a, c, g, or t
  misc_feature (1296)..(1296): n is a, c, g, or t
ctctatgtcaatatatacctctatgtctaatactaatctaaataatgcgaacacacctctagtaaatttgacatttgataaaaaaacatcaatgttggagaagctgtatttttgttaaaagtacaaaaatgtgaattgaattatattatgtgaatatgtgtgaaatacagtgtgacgttttagctgagttctcgttaaagaatatcgaagatacatttaaaattacatgtataactagtaggagtttcattcgcacaaaattttcgtctaaacaatttgtatcatctgagcagagtgcatctgaggaagataaccagtttgatgaagaattaagcaaaatatatgaagacttatccattcagaacattactgctaaatcagaaaacgaccaggaaggtgccagctgttactgcagtgcatctcacacagacaatctttcgaccgatgaacacgaaagtttgcgtgaaatacataatcctccgccaccgaaaggtattcagcaaagtgacagcggtaccgatctgactgaacaactaattcatgacgtcgattcggattggcaaaaattttggtcattgaacggggaaaagctcatatgggaatcctggattgacaaatacagccaatacattaaccctgaatacctgccttatgctcagaaaaaggtgggagagaattataatctgttagttgaaaacgttgctgacgacactttcgtatataatcccaaaaagttcacatttaacgagaaagaacttcaaaattttagttcagaattgcaacaagcctgtttgaaacccatagacaagtgtcaagaaccgtcgaaaaaagaaagtaactccaagaatcacatgcttttgcgtaccttgtcgggtagtgacgagaaaatttctggagaaatatccgaaggttggaatccgctctctccttccagtgtagatgaagaaacagaagcggaacgactgttaacgtcaaggtgttgctcacgaacgagcagctccctgagaaccatcgattcgatcactaatgttactcgcatgaccgtttcttccatagacctaagcaacagtactcctagttcagatagtttttcctccgttagttccgtcaatagctcagtaagttcggaagaatccgaagaagactaccaacaccagtggaaccatttatggaaaaaacactacgaagatcaatacttagaacattacaataagtttatacagtctgtgatcgggattgtcaccgtagatnaacctaaggaccttnacagaactgataaaactttangaccatttnccagatataaaaatttcaacaaaatgtcgacagaatcaaaatccgtagaaactgatg

SEQ ID NO: 1065 - DNA, 1562 bp, Diabrotica virgifera
  misc_feature (1416)..(1416): n is a, c, g, or t
  misc_feature (1478)..(1478): n is a, c, g, or t
aaacgacataccatgtctcatccgcccgagcacataccggatattgataatcaaacaccggcaactgtgaaatctcccaaggagaaaaaagaaaaggaaaaggacaacataccagaaggaatagtacaaacggaaagtattgtttaccgtggagatccgaccattattcactctacgacgaacgtcccagtagtagctaccgaagcgcgtaaggtcaacttgacctcagacgatggatcttacagcgccactggcgaaatcgtcagctcacagactatcagttctaaaactagaactgtagaaacgataacgtataaaactgaacgagacggggttgtcgaaacgagagtggaacaaaagataacgatccaatcagatggagatccaatcgatcatgacaaagctctggccgaagctattcaagaagcaacagctatgaatcccgatatgaccgtagaaaagatcgagattcaacaacagaccacacagtaacatgtctgggattattttttatatataaatagtgtacactttacatattttttattccagagcgattagcacaagtaaaggtgttacactggttagctccccacaaactaaatgttaggcatacccccctttgcaaagcttaaatgtaaattatttaacaggtatgttttaacacgtgacaagacatctcgtaacgcgacacttcgtaaccccacaaatggtaaccgaaaattcgtaatatcgtcagttcgtaacggcgaaaattcataacggcagaattcgtacgtcaatatggaattattctgtttatttttgttaactggaaactaacttttattacagttacagttgaaattacgtttatcaatttaacgaaccatcatcaggataaacacttttgacatatttcatggagaaataaatatatttttaaaattatgtctttaaataaatataaactacctgaaacagaacatataagtaaatataaatatcgaggttagtaatgtaggtaaattgtattaatttattgtagtaaatacattattattaaactgtttttatttgtttcattgctcttcagacttagttttactacttcaagtcaagtggtaattcataataataattaaaaaaaattcttttgttgtcatatgagtgcaaaaagacgtggtcttaaaaaaaagtaccattacgctgttactatttgtggggttacgaactgtcgccttacgaggtgccatggaaccgttataacaatatcgaaagtgtttattgatgtaaaaaatcgtgcttgggacacaaagtttatcctctcaaaagaaaatccgctttgtatgtatatttaatgtaatatttgttaaaaaaaagttggtatgcgtttttggcagttctacatgtagaaaaatactttagtgttgccgngagctgacctaatcacgataattttgaacataaagcatctgcttttggtatgtcttttttanataaccttcacatctaagcttttaaaatattttatttctacatttatcacagggttgtcttttattttatgtatattttgattt

SEQ ID NO: 1066 - DNA, 1052 bp, Diabrotica virgifera
ctgaaagaaccggagcattattttcagtgctcaacagattatgtaaaacagtttgagttaggatggtttgcgctgctaagctacgtgctgctggaccgcttcgtgttctcatttaagctgggtatcagtctctgtcattccacaagatatcgtattatttccaacaactggacgcactttcaccattataactaggctctccattgttccatcttgtgtattccacagtttttcctgtgctcatccagacgaagtttctattgtccaggaagttggcagcagaagtccagtattcggtaccactggccttattcaaaatcattttcttgatagcatcattttcctcttgtgactcaatggtcaatagtttcatgtaaaggacgtcacagaactgaagagcctcttggaagtttgccttgtagttaactccaagaaagtagctcttgttgccatgtttcaccaatggaacattgggtacgctagcccaacctttcaaccaacccacctcgagtcttatacaaaatgaccaactctaaaggttaccgccgaggaaccagggatctatttgcccgcaagtttaaaaaacgtggtgtaattccactttccacatatttgagagtctacaaagttggagatattgtagatatcaagggtaatggtgcagttcaaaagggtatgccccacaaagtgtaccatggtaagacaggacgtgttttcaatgttactgcacatgcattaggtgtaattgtaaacaaaagggttcgaggaagaatcatccccaaaagaatcaatctccgtattgaacatgtaaaccactccaagtgtcgtcaagacttcttgcaaagagtaaaatccaacgaaaagctacgtaaagaagctaaagaaaagaacgttaaagtagaacttaggagacaacctgcccaacctaggccagcacatattgttagcggaaaggttccagcacaggtgcttgctcctatcccatatgaattcattgcttaggtttgtttatcttaaaataaaatcctatatatactaacaaaaaaataaaa

SEQ ID NO: 1067 - DNA, 830 bp, Diabrotica virgifera
ctccacacgcgagcgtccgaggatttggtccgcggacgcgtgggtttactgtgtttcaggatttggaaggtacaaaatgaccaactctaaaggttaccgccgaggaaccagggatctatttgcccgcaagtttaaaaaacgtggtgtaattccactttccacatatttgagagtctacaaagttggagatattgtagatatcaagggtaatggtgcagttcaaaagggtatgccccacaaagtgtaccatggtaagacaggacgtgttttcaatgttactgcacatgcattaggtgtaattgtaaacaaaagggttcgaggaagaatcatccccaaaagaatcaatctccgtattgaacatgtaaaccactccaagtgtcgtcaagacttcttgcaaagagtaaaatccaacgaaaagctacgtaaagaagctaaagaaaagaacgttaaagtagaacttaggagacaacctgcccaacctaggccagcacatattgttagcggaaaggttccagcacaggtgcttgctcctatcccatatgaattcattgcttaggtttgtttatcttaaaataaaatcctttatataattaaaatcctttatataataaaaaaaaaaaaaaagggcggccgccctttttttttattaataaatgacttataatttaaaaaaaaaaaaaaaaaaaaaaaaaaaaaaaaaaaaaaaaaaaaaaaaaaaaaaaaaaaaagaaagtaaaaaaacgagaggggggggggccggttaaaagatcccaagtttacctccgcggggttgaaacctcatattttttttaaagggaccccaaaattca

SEQ ID NO: 1068 - DNA, 2597 bp, Diabrotica virgifera
ttggattccctttgaagggcgcaccccccaatttttttttttttttttggtaaaatttatttataaagcttgctttttaatttttttattttttgggcacatggttttaagctgttgttaatgttaacggaataagtgccttgattcttgtgaccttcatctgctccaggtgctacactaacaccagaagacaccaagttgttgttaatgtatacattaacaatgggtttaaccaaacagttctttttataaacaggtgctgcaggaggtgtgacctctgtctcatccttaactttaccaactgtaccaacgacgtcatcagctgggacagttccaccgggaaccgcactttcttggttctcgcagatgaagggtctgacctttccacacttttctagtctccagataccgcttaataaaatagtcatgcaggttctgtcgtctacgaataaggtttcattgggttctaatttttggtagataattgggcgattgatccttaaccatctccagtctgagagtggccttcttccggagatccagaatggaccgtcttcaccgacgtcttcaagtacctttttggtactttcagtttcttgttcattttcaatggctagcaactgaagaccgtggtactcgcagaaaacttgagcttgtttttgtgtacccaacatttccgtttcaatgtgatattttttaccagcgttgtaggtataagttaaaaatccgggtggagtttcctctatagctgcttgccagtcttcatcgcttgcaggttccagttcctcgtcctctccttcgtttgttgctgcagtggaagtttgaattttttcttcattatcctcgtcgacaattgcggcatatatagcgttaacaaattcatctgcgtctgggtcaacttcttcttcgtccacgtctcttttgacacgtccaaggtgttcattggtaactttctcgcagatgaagggaagttggtctgtgcaggtgagatcgttccagaacaatccgttctcgtttgtgtgttgaaggttgatgcacttttcgtttacgttgtctggctggtttttgtcccatcttgtgtattcgattggttggccgtttgtgaaccaggtccaggtgtcgtctaagagtctagtaccagcagtccaccatcttgatccaagattgttatctctgacatatttctctatagctttgttttcttcttcggattcgatagttacaagactcatatggagcattctgcaataaaatgctgcttgtgtgaatctacctgtaaaatcccttgagaaataatagtttttgccattaaaattcaacatgttgatgtttggagagtaggatggtttggcaacggctgctggtgaagctaccaccgaggctgctgctggaacagcttcgtgattttccctttggcaaataaagttaagctgggtattgcagtctctgtcattccacaagatctcgttattattttccaacaactggacgcacttttcaccattataactaggctctccattgttccatcttgtgtattccacagtttttcctgtgctcatccagacgaagtttctattgtccaggaagttggcagcagaagtccagtattcggtaccactggccttattatccaaaatcattttcttgatagcatcattttcctcttgtgactcaatggtcaatagtttcatgtaaaggacgtcacagaattgaagagcctcttggaagtttgccttgtagttaactccaagaaagtagctcttgtttccatgtttcaccagtggaacattgggtacgctagcccaacctttcaaccaacccttttgcgctggtgctccctgtgcatatactgctacggcaaaaatcagtaacaaaacccctctacttaacattttgacaaaaattggtgttaataaattatttttttctatattatattaatttatatttcgaggttatcttttaggtagcagttatctcttgttgttcaaaatactagtacaaaatgaccaactctaaaggttaccccgaggaaccagggatctatttgcccgcaagtttaaaaaacgtggtgtaattccactttccacatatttgagagtctacaaagttggagatattgtagatatcaagggtaatggtgcagttcaaaagggtatgccccacaaagtgtaccatggtaagaccggacgtgttttcaatgttactgcacatgcattaggtgtaattgtaaacaaaagggttcgaggaagaatcatccccaaaagaatcaatctccgtattgaacatgtaaaccactccaagtgtcgtcaagacttcttgcaaagagtaaaatccaatgaaaagctacgtaaagaagctaaagaaaagaacattaaagtagaacttaggagacaacctgcccaacctaggccagcacatattgttagcggaaaggttccagcacaggtgcttgctcctatcccatatgaattcattgcttaggtttgtttatcttaaaataaaatcctttatataataaaattaaaaaagaagataaaataaaaaataaaaaaattgtatatttagaaaaaaattggaaaaattaataaaag

SEQ ID NO: 1069 - DNA, 1030 bp, Diabrotica virgifera
  misc_feature (951)..(951): n is a, c, g, or t
  misc_feature (978)..(978): n is a, c, g, or t
aaaaagtcgactattttcgtctggtagcacacagtcctaaactttaacagaattgaatagctgaaacataaatctaaacatactatacaacacgtgcaagccattaaaaattctgcgaaagcgaaatagtcatataaagaaataataagtctctcaaatctataccataccattccatttatgaatttcatatcaaataacattctatataggtaataattgttttattttctttaatatacattaacaaaatattttagaatcagttttctttgactgacttaatagaaagtcgtcctttttagtctacggatatttgacattccgtatatgagtttcgcaccggataaagttccaaatactataattattgttttgtttttatttgataatacattgacaagtgttttaatcaatctccttttgactgactctaatgaaagggtttttttcggtctacgaatatttaacattccgtatattgaatttcgcaccgaataacattccgtatatgcgtttggcacctcgccgcgtattgattgaaatatgaccgcgtgctgcaaagaaccaatagaaaactcctaggtgccaaatacatatacggaacgtttagatgcgtacgggagacggcaaagtcatatggcttccttggaaactacgcataagcgaatttcaccaccctccctcgcgttcagcgtgcattatccagtaacacggccagctatctagtccgtatggtagtcgaaacgcacgattgccggtttttcgtgcgtttagtcgttgtatttcgagtgaaatggcagagaacgttagcgataagtttacgttataactagtttttattataacagttttactgtcagcatcgcgattaggacgctcgattatgctaaactatcattttcctgaatggattggaagacatggaagcgaaccgtggcctccaagttngcagactttactcctatgggatccggntgaatatcgtcgataaagatctcgcgatgcttgctcgcattattaattcatc

SEQ ID NO: 1070 - DNA, 1236 bp, Diabrotica virgifera
ccttagatgtataaagatgaagaataaaatgaagattctgatcctatcatgtttagtcgccacttgtttggctaaacctggcctctttggagatgacggagctctgaaaaaagccgctgaaaggctccacgaagccaaccaaaaattcgctgctgacacttcaaacgcctttcaaaacgctcgtgagaatatcaaaaacaacaacgaaagaatcgccagccaaacggccgaagcgttggagaaagcaaaagaggatttgaaaaacaccggagagaacatttctcgtaagacaaatgcagctgtggagcaagcaaaagagaatcttcggaaagctggtgaggatatccataacgctggagagaaatttgctgagaacactgacaaagcacttcagaaagctgggcaagatattcatgaaactggagaaaggattaaggataaagctgtaaaaattgccaagggagaagagcccatagtggatgtaaaggtcaattccaaagtaaaagtcctggataatgaagtaggagtacaaggtcagttgaccattggaggacacagaacaggcttccatggttcagcaaatgctaacattctaggacaaaaagcaaacattcatgctgatgttttgaatgcacatagaaatcctaacgacactcatcaccaacatcagaatgcgattaacaaattaaaggaattgataaataaggccaagaaccaaaatgcagaagtaaatggacaacagtttattgaaaatcagtatcctaatggaggtcaaaatgtttattatttacctcaagaacagaattatccacaatatcctgcagtatatcaacccaatgttgtcaatagtgtacaaaatggacaacagaattatcaacaatatcctggaatataccaacccaacgttattaatgatgtacaaaatgttgctaatggagggggttccccggtttatatccctgcaggaaatgtgcaagacctaacagattataatagatatggatcacctggatctcctgctgtgtatgctggtaacgagggcaggtatgttagaggagctgaattctggcaactagaagatgattatgaaaacaacccgaaatatcgtgttgcagtagaagatggggattatagtggtttaattgatgtgagatattaataattgatcaaataaataacttttctttgttacttcattaataaataacgtttttggaaaaaaaacccacgcgtccg

SEQ ID NO: 1071 - DNA, 1508 bp, Diabrotica virgifera
agtagctctaatattaactcaaaaagaaagagaccaacttgatgaatgtcaggattaataattgatccaatgctttcctttctcaatcggtatacatataagaattgaatagcataatcgctgtgagataaaatatgcagggtacaacaaaaaggcaggtcataaattacattacatattctgggaccaaaaatagttcgattgaatctaacttaccttagtacaaaacaagaatctacaggtcgagcaagtctcgtaaatttcacgattgcgagccacgcttcacgcaaccgtgtttgcgtacttgtatttcgagttgcgtggtcgtgcggagctatatttaccaaattaatcgtttctactgattcataataattaaatcaatatgtcaatatggctactgggtgtaaaagataaatttattctatctgttcttaatgagttttagataattttagttgtatttctttgtaattttgtgttgtacaaagattaatttaacattttctctggaagtattaatttagaaagataatattatgcttcattggtgttgtgttttgaagtgtgaaatgcaaagtatgtaattgtgataaagtcaagataaagttcacttttaaactgaactaaataaggtatctgagagacaacaatggttaaatgcaatacaatgtacaggttttactagcgaaatgaaaattttcctgtcctgtctgctgtaatcattttatatctggtaagttacaattacaacagtaacgatttttgaagatgttaacattttaatcttatagaaaaaccagccgacttaatcgataataacaatctccagattgggttccttcaataaatatgggctataaacacaatgaaataagttgcccaaaatctaaaatggagtggtatcaaaggagaattaaaggaaaaaatattcatattgaaattatttataaggcactggactgtcttaaattctacaataatactaggtgggtaaatgattttagacatttttcattaagagtagattaagattaagtagattttcattcagtagatttaagacttgtttacacaggcagagtaatgatgcaagtacttgatagagtagagtaactctacctgtaaaaatgctcagcacagtagaatagctggtagagtgtatagttggagttaaagtagagtgactagcaacctatggcaaagtaactactctatgaccaccactactgccaaaatgtctactcggctgcacactctacccatggaacatgctcaattatggcagaatagagtaggtaggagagtacatgggggcgctgtcattctggctggaattgtgttttgtgtaaatagtgaaaatgaagttcaccgaagatgaaactttaaaacttgtagagctataatacggcgaataccagtgtttatggaatttaggtagtgtatagtacagaaataaaagtttgcagcaagctgcggaggatgaaatcgtcgaaagaatggcaaag

SEQ ID NO: 1072 - DNA, 1298 bp, Diabrotica virgifera
  misc_feature (1277)..(1277): n is a, c, g, or t
ctggtgtatagacatacgtgcatattgacataatgaatttattgtttaatggacgtctaaaatataaagctcatatctaactgcacgcgataaatcgaacgaaaacaaaaacaagatttgacaacacatgacatatcataaatcttccaaatatggcagtagtactagctctttttgttggtgctatagtagctgcgatttcatattggtggatgggtatataccgaatcagatctaaactacactggataccagagatacctcgactacctttaattggtaatgccttggaattaaaaaaaacaacagaaattcttggcaaatttgaagattacttaagtaaacataatggactgtgtaccatagaattggccacttataagtttatagttacatcggatcccacatttttggaattcctattgggcaaaacagatattttgaataaaagtgacgaataccagtttttgggtaattggttaggtaaaggacttttaacagctgcagctccaaaatggaaaagaagtagaaaaatgctgactccttcgtttcatttttcaattcttgatgtctttgtcgatacgtttgattccaatgctgcaattttagtggatctattggataaagaaactaacaaagatagttttgatatatttccgtatgttaaaaactgtacgatggacgttatctgtgaaacgtcaatgggagtatcaatacatgcccaaaaaaatccaaaatcggactatgttcgagcagtagcagagttatgccgattgctgatactcagaacgtactcacctttaaaaaccttcgattttttttatcgccttacttctgactataaattagaaatggaacaggttaaaatacttcattctcacaccatgcaagtaatcacttcaagaaaagaggaattaaagaaaaaacataaagacgatcaaaaagaagaaaccgatgatgttgggattaagaagaggaaagcatttttagatttactgttagaaacaactattgatggaagaccacttaccgatacagaaattcgggaagaagttgatacatttttatttgctggacatgacactaccgcagctgctataagtttctgtttatattgtttgtcagttaacaaggatgtacaggacaagattgctcgagaacaaaagcaaatttttggagaaaataaaaacagaaatgagacaatccgcgatattcaagaaatgaagtatctagaactggctcttaaggagtctctaaggatgtatcctccagttccnttatgtggtcgaaagccgaca

SEQ ID NO: 1073 - DNA, 987 bp, Diabrotica virgifera
  misc_feature (905)..(905): n is a, c, g, or t
  misc_feature (926)..(926): n is a, c, g, or t
tgtatatagtttatttattcggatgtattcttcggattaattaaacaaaatacccgtgaactgtttgttttctatgaaaagttgctataatatgattattgataagctatcgctgggaaagaggactgaagatccagtaatcatggcatatcgaaacggttattcgggagacgatagggagctcgatcgcgaagacagaatgaccgaaggcgtaggcaaaccagttcacgttatcgaacatttagctacttttacggtaaacaaagaaacaggtatcatttacccagccgatggaatgaggaggctgctgcagttggagaaaagtaatggaatatggtcgcagaagatgcagctgtgtttagacaataactgggtgctgattatggattatgaaacagggagtgtgatggaacgatttcctgccagctcaatacaagaaccgagcgccttcatgagtcaagaccccatggacatgtataataatatactagtctttatcgtaacaaattcaaaccaatcccaccccacagaaatgcacatatttcagtgccagagtatatctgctcaagatttggtcgaagacttaaaagaactccgaatgggtaaagcaccgactagaagccgtaaaagtagcattccacctcccagccacaaaccaccccaaaacgtaataagcccatccagagatgtaactagagactactacggatcagactcagaactcacagctaacaatgacgactccagctctacaacaagtgaaaagtatgaaagagatgtcactatcctcaaccactgtttcgacgacatagaaaagtttatagccagattacaacacgcagctgctgctgcacgagaacttgagcgcagacgaaaaacaaggaaaactaaaaaacgcgatatgngtgacggaatggtaccatgangacaaagcaccccagaaaaggagtcgtcgaaattttcagaaagttaatatcctttaccttt

SEQ ID NO: 1074 - DNA, 1790 bp, Diabrotica virgifera
gaaacattcaatttagatataaaactcacacaatagcgcgagcggtcgctcgcgtagaatcgtccgcaattttgtctattttggagtaaaatattggttgttgaagaaaatataaagggacaatttaagttcatgtttaatcctggttctgtggttttcccattaaccaaattaatgtccatttggaatttttataatattaagatttgtcagaatccagaactttcttcatagtgagaggtggaggagtctgtcaagatatagtacttcccttatttatctttaatttgagagacttagtagttgggttttaaatatgaataaacttcttaaaagtgtacgtttaacaaataataaggatgacctcataaaaaagtcaataaccagacaactgtcagatagctgcaaagaaatacattatgctggagttgaagaaaacaaatctcctaacttttcagagttttccactacagaagcagcaaccacattgtgtacagcaattgaagccatcttcctacatgggttaagagatactttgattcataaatttaagaaagctctagctgatgtagacgaacagtcagaaccaagcttttgggcacctctattgattatttctcatagacaaatcattgaacagattacaaatttatctcaaattacaacagaggtcggccaatgcagggtctggatacgactggctttgaacgattgcctgctttcatcgtacttaatgagcattcgacaagattcttcttccttaaaatcatactacaaagttaacgcatatgtgagagatggagagcttttagatgtagcacagcggttaatagaaggcgtggaagcatttaaaagtttcactttgccatttaactccagtttactaaatacatggccactaccgagcttaatcttatcaggtatctggtctccgacgttaaaatcctgtccagttgcaccctgtgatgatgtagctcagagcatatccataacagagtcaatgaaaactcagtctaacttcgaaaacagttctgatacagcttccatatgttctgtgatgtcttataattctcagagttcagggttgcgacaaattgtgtccttatcagaagatgaagttctaaaaataattttagctaaagataaggatcagacaagcaattctcaatcctatgatgatttgaggtctgtgtctggttccgatcatgacagaaacagtgactcgaataatataaattatactgttggtaattctttaagtaaaagaactgggtggtcatttgatgagacacagctgcctgaaagtactgaacctcaagaaacaaatgatgaatctgaagaaaaacttgttaaagaagaaccaaagtctatggagactagttttaatgctcttattgaaagttacaacatgccttagcggtgccttcattaagacgcctgattttcgtgacgtttggcagaaattgggcgataaaactgaagtgccaaaagaaaattacggtgaaccgaaagagctactgttataacattccatccgctgaccaagaccagaagtaaagtctcgcttttgcaaagtaagaaaaattgcccaagaaaaaggggactggatttaacgaaattccaaatgggggcgaatggggaaaaaaccgggagcattaatactaaacccacaaaggtgggccttttccccggggggatatttttttgaaaaaaatttttagggaaaaaacaaaatataaattccaaacctcccggaaaaaaaaaaaacctcgtaaaggggcaccccccca

SEQ ID NO: 1075 - DNA, 510 bp, Diabrotica virgifera
ggaaggggggacccccgcgtggaccggggccggattcctaagtttcgatttcaagatgaagctaatactttttggtattgttgtattgttatattttatatactgtactgaagagggtagtgcactaaactgctatcagtgccaagcgaaggttggaaatgggtctgactgcgaaagtgggaaaagtgattctaatactacttgccagtcttctccagacagcaatgagacacttgcttgtttctctatagtagtaaatggcttttttataagaggttgcgacaaaactactttatgcaatgatgaaccaccacctggatatgatataaaatggtgtaaaagttgtactactgacttatgtaacactcacacttcttcttcctctattattacaccagctttattcactccaatcattatttttaccgctgtactaagttacttttaattataatttttaagcatatttgtacaattttttgagtcaaagattaaaacatttttttttgt

SEQ ID NO: 1076 - DNA, 1175 bp, Diabrotica virgifera
gacaataaaaaacgaacctctcctcgaagaagtgaaatatattccatcacctatcaaggaagatggatacaatttgggccttaaagctgaaaataaaattaaaggtgttcaatactttgcagatctacatcatgaaggtcttggtatgtgcactgtttttatcggtattagtgtatggagaggaaacaaaaaagtctgacaagcgtggagtacctgaaggcaacgtagtttccctagattccttaggatcaggaataaatcttaggtccttaggatcaccgctttctctttcaccttatgtaggatcaccttccttaggacttccacttaatttaagatcagtttctggatactctccatccatatatggatctccattgtcagcacattctgtaggacattctgtaggatcaccttccttaggacttccacttaatttaagatcactttctggatattctccatccatatatggatctccattgtcagcccattctgttggcgtgcaaggtttagatttaagatcattggcatctgtccttaatgttggaccttcaactcataccgttaatactattacaaaacacttcccgttcgctgtgccacaaccatacgcagttccagtagatagacaggtaccagtaccagtacctcacccagtaccagttgccgtagatcgcccttatgaagtaaaagtaccacagccatacccagttacagtcgataaacatgtaccctacactgtagaaagaccagtacctgtagaggtaaaagttccagttagagtagaagtacctgtacctgttaaagtaggagtaccacagccttatactgtggaggtaccaaaacccgtagcagttccagtaccatcaccagttgttgtgaaagaacatgttccagtgccatctcctgtagttgttaaggaacaagttccagtgccatccccagtagtagtaaaagaacaggtaccagtaccatctcccgttgttgttaacgaacatgtacctgtaacacaacctatctatgtgaaaaaaggtaatgtacctccaccctatctttttgaaaaacatgttcccggtgaatctcccgggtccttttttaacataaaaaggggtgcaccctcaaacccccatattattttttttaaaaaaaaaaaactatgttttttttttttt

SEQ ID NO: 1077 - DNA, 1535 bp, Diabrotica virgifera
cgtctccgttgcgtctacgtctacgctacgtcaaaatataaatccaacttaatttttgccactttgaaccagctgattggttgcgatgtgacagtgacaagtgacagtgacagccattcttgacgtggtggaaagttgaatggtggataggtgtgaaaagtattcattttcaaaaatgaatttattcttgatattattttccgctatagttgtatgtaatgcccaaggtccaactttagtgttactcgacaatcaagttattaaggaaacccattcaatattcttcagatcattacaagaaagaggctacactctcacctttaaaatagctgatgattcctccttactcttatcaaagtatggagaatacttgtacaagaatttaatcatatttgccccttcagtagaggaattcggtggcaatttaaatgtagaaacaattactcaatttgttgatgatgggggtaatgttctggtaacaggaagtagcacaactggtgatgtcttgagggaactggcctctgagtttggatttgaggttgatgaagatggagcatttgtaatcgatcacctaaactatgatgttaccgatgaaggtcagcataccaaactagtcgtctcatctgaaaatctcatagatgccccagtaatagttggaccaaaaagaggagtagctcctttattatatcagggtacaggaattctagttgactcggaaaatcctctggttttgcctttgttgacagctgatagcacagcttacagttttaatccaaaccaacagatcaaagagtatcctcatgcggtaggcagagatgcagttcttattgctggtctacaagcaagaaacaatgccagagtagtgttctgcggttctctggctttcttttctgatgaatttttcacctcttctcctagtaaggctcaggtgcaagaatcatctcccaaatctggtaatgaagatgtagcaactgcagtaagtcagtgggtatttaaagaacacggccagctaagagtgagatccgtcaaacaccacaaagccggtcaaaaggaagctcctcaagactatactatcatggacaacgttgtttacaccatcgaaattgacattctcgaaaaaggacaatggaaaccgttcaccgctaatgacatccaacttgaattcgtccgtatcgaccccttcgtccgcaccactctcgaaagaaaaccctccggccaatacgaagccagatttaggattccggacgtatatggcgtgtatcagttcaaagtcgattacgatagggttggatacactcgcttgtttagtaccactcaggtgtccgttcgtcctctgcagcacactcagtacgagaggttcatcaccagcgcttatccttactacactggcgcgttttcgatgatggtggggagtttttgttttctcgtttgtgttcttgcatttaaaagacgatgagaagaagtcgaagagtgagtgaaactctttaatattttgttttttacaagacttaattatttagtaaatattatgatac

SEQ ID NO: 1078 - DNA, 781 bp, Diabrotica virgifera
agcagcaaatctcactaataaatccagtttttttcttaaaagatatgcaaccaatcgaacttcgaagtatattccttcggaacctagtacatctggctataatagtttagagaggaataaatttaacgaatctgagaacatacaacccttacaatctactggaagcttaaataggtttggtacattaaggaaagctgcttctttaaataaaacagaaccaacaattgttcagaattcagatacgtctagattcagcacacctcctagagttattaaaccaagaagtcaacaagaagtgcagaacatcgcaaatagaaattcagctgcaaaggagtctacttcatttaatagattcagtaccccaaatcgatcaataaaaacgaaaagtcctgtagaaactgaaagttttggatctcgaactttagaagctcaagaatacagtacaaccaagggtaaatcgccaaacaaattcctaaaaagtagagaagctgaaaacctgaataaatccttagaaaggggctcaactggtaatagcaacaagtcaagtaaatccagtaaaaatagttcaagttcttctaaatctgtaggtgctattaagacgaaacaaagcgcagaatcaaaagaactactttcaagaccacgtactttttctgagacagcaaattcccctagtgcagagcccaagaagaaactaactaatagtaattcctttaggtcctttcttaagccttccgcgttgaccaaagaaaaagttccagaacctccagtgagacctgaacgc

SEQ ID NO: 1079 - DNA, 625 bp, Diabrotica virgifera
cggtctctcctagttctagatcgcgagcggcgccctttttttttttttttgcaaacttggtaacacttcttttacatcaaaaatttctttagctgttgtcggttaaggaacagcttacaaaatgaaattcaacaaattagtaaccgcttcaagaagcaaaaataggaaaaggcatttcacagccccatcccacatcagaagaacccttatgtccgcacccttgtctaaagaacttagacaaaagtacaatgttagcactatgccaatccgcaaggacgatgaagtacaagttgtaagggggcactacaaaggccagcaagtaggtaaagttgtacaagtatacaggaagaaattcgttatctacattgaaaggatccagagagaaaaagccaatggagctagtgtatatgtaggaatccacccttcaaaagttgttattgttaaacttaaaatggacaaggacaggaagaagatcattgacagaagagccaaaggacgtttggctgctttgggcaaagacaaaggaaaatacactgaagaatccgctgcctcagctgtagaaacatcttaggtgtataagtaatttttaataataaaataataagttgtgaatgaaagaaataaa

SEQ ID NO: 1080 - DNA, 819 bp, Diabrotica virgifera
tttttgttgagtaaagtaacatacctcctcgcatctcagtaggcagtggttagtggggtcttgcttttagttgtgtgattacggttgtgcccttcgtggccttttaataaggaaacatgaattacgatagttcagatgaatcgattagaattataactggaggagttagaaggcatcgtatcacagatggtagcaccgcatcctcgctagacgctctttgggacctccatcctaacgctttatacgaagctggattaagccgacacaaagattccagcactattctgacggaagacactgacagttttattattggacagaaagtttgggtttccggaacgaaacctggacatattgcctttattggtgaaacacagtttgctcctggagagtgggctggtatcgcactagaagagccaattggtaaaaatgatggatctgttaatggtataagatattttcaatgtgaacccaagaaaggcgtgttttcgcgattaactcgactaacaaaagaacctttagaaggtgttagctatgctactactccatcacccgaaaacgttataaggaattcgatttctcccactggtagtacccatggtcttctaaaatcaccagtatctgtatgtggatcaaacttaagtcttatatcatcggcttcccatgtgatcgatttcaaaataggagatcgcgttattatcaaaagtagccaaggctctaaagtgggtactgtaagatatatgggtattaccgaatttgcagctggagaatgggttggggtagagctagatgatcctaagggtaaaaatgatggttctg

SEQ ID NO: 1081 - DNA, 1254 bp, Diabrotica virgifera
  misc_feature (1104)..(1104): n is a, c, g, or t
catacctacttctcgcatctcagtaggcagtggttagtggggtcttgcttttagttgtgtgattatagttgtgcccttcgtggccttttaataaggaaacatgaattacgatagttcagatgaatcgattagaattataactggaggagttagaaggcatcgtatcacagattccagcactattctgacggaagacactgacagttttattattggacagaaagtttgggtttccggaacgaaacctggacatattgcctttattggtgaaacacagtttgctcctggagagtgggctggtatcgcactagaagagccaattggtaaaaatgatggatctgttaatggtataagatattttcaatgtgaacccaagaaaggcgtgttttcgcgattaactcgactaacaaaagaacctttagaaggtgttagctatgctactactccatcacccgaaaacgttataaggaattcgatttctcccactggtagtacccatggtcttctaaaatcaccagtatctgtatgtggatcaaacttaagtcttatatcatcggcttcccatgtgatcgatttcaaaataggagatcgcgttattatcaaaagtagccaaggctctaaagtgggtactgtaagatatatgggtattaccgaatttgcagctggagaatgggtgggtagagctagatgatcctaggggtaaaaatgatggttctgttaacggaaaaaggtacttcgaatgtcgaccaaatttcggtctgttcgcacccattacgaaagtaagcaagtctccttcaaaataaagcccggtacttgccaagtacacggtaccggattaccgcctagcggcataaagcgtatgggttctaaagaatctctaatgtcgagtatgtcaactaccagtgctgcatctaacgccagaagggtaagactaggattggcatcgttaagtccaaagaaaactacccctaagacgtccagcacgcccattccaacaaggacagctctacaggtaacaacttattaactcacgatgaagttactgtccgacaaagatagcttaatctatcactgttaccaacttctattaactataaccatggngtttggtttaagagataatgctttttaatccaaataaagtttatttatttgttatcattgaaataaaatttacttacattgttgttaaattattttcctttttatccaatattgtattataattattaataaacgaactgactgtgtttt

SEQ ID NO: 1082 - DNA, 1270 bp, Diabrotica virgifera
ctgagtccttgttgactgctcacattttccatcgttgagaccagaacaactaaaacacttccaacatggcggacgatgagagaaagaaactggaggaggaaaagaagaggaaacaggccgaaattgaacgcaaaagggccgaggtcagggctcgtatggaagaggcctcaaaagccaagaaggccaagaaaggtttcatgacccctgagagaaagaagaaacttaggttactgttgagaaagaaagccgccgaagaattaaagaaagaacaagaacgcaaagcagccgaaaggaggcgtatcattgaagaaaggtgcggtaaacccaaacttgtcgatgacgcaaatgaagctgagctacaaacggtttgtagaggttatcatgagaaaattgccaaacttgaaggggataaatatgatttagaagttatcgaacgtatcaaagcccaggagatctccgaattgaacagccaagtaaacgaccttagaggcaaattcgtcaaaccaaccttgaagaaggtatccaaatacgaaaacaaattcgccaaacttcaaaagaaggcagctgaatttaacttccgtaaccaactcaaagttgtcaagaagaaagaattcaccttagaagaagaagacaaagaaaagaaaccagactggtcaaagaagggagacgaaaagaaggtacaagaggctgaagcatgatttttctcctttgttaaagcccttttgtcaacatcaagggatatatcgttatttcgatgatcccatcgtgatttcgatatcttaaatatatttattttattcattactttccagactaaaagagtgtctgtccgcatgtatattatttgtttatgtataacttattaaaaaatgtgaagtattgtgagtaaaaaaaaaaaaaaaaaaacaaaaaatgaaaaaaaaacaaaaattcaaaaaaaaaaaatggggcggcccctccaaaagaaccaaacttacggacccggccttggcaaactttaatcttttcttataggggccccctaaattctattttccgggcccggcgttttaaaaaccgcgggagggggaaaacgccggggggtttcccaaaattaattccccttgttaaccccccccccctttttcccctctgtggggataaaaaaaaaaaagagcccccacccccacaccccccccccccccccaccgggggccgccggccccggagtgggggagcaggggggggccccgccccccccggggataggggggcccacccatattaaaga

SEQ ID NO: 1083 - DNA, 735 bp, Diabrotica virgifera
gttgactgctcacattttccatcgttgagaccagaacaactaaaacacttccaacatggcggacgatgaggaaaagaagaggaaacaggccgaaattgaacgcaaaagggccgaggtcagggctcgtatggaagaggcctcaaaagccaagaaggccaagaaaggtttcatgacccctgagagaaagaagaaacttaggttactgttgagaaagaaagccgccgaagaattaaagaaagaacaagaacgcaaagcagccgaaaggaggcgtatcattgaagaaaggtgcggtaaacccaaaacttgtcgatgacgcaaatgaaggctcattaaaacaagtatgtgagggatatcacagacgtattgtagacctagaaaataagaaatttgacctcgaaaaggaagtggaattcagagattttcagatctccgaattgaacagccaagtaaacgaccttagaggcaaattcgtcaaaccaaccttgaagaaggtatccaaatacgaaaacaaattcgccaaacttcaaaagaaggcagctgaatttaacttccgtaaccaactcaaagttgtcaagaagaaagaattcaccttagaagaagaagacaaagaaactaagaaagctgataaagctgagtggcagacgaagaaatgaactaactacatagttactcgccgttatttttttgaattttacatgtttcgacttttttggattatacacacactacactaat

SEQ ID NO: 1084 - DNA, 770 bp, Diabrotica virgifera
aaaattatcagtgggcaggcgaaaccctataaattgtgcacaattatcatgtctcttattatcaactgatcaagtaacggacgcgtgggaagtttttgagccgtcaacatgggtaagccccgtggattgagaaccgctaggaaacatgtgaatcaccgtcgtgaacaaagatgggctgataaagattacaaaaaggcacatttaggaactagatggaaggctaatccttttggaggtgcttctcatgctaaaggaattgtattggaaaaagtgggagttgaagcaaaacaacctaactctgctattcgcaagtgcgttagggtacagttaattaaaaatggtaaaaaaatcacagccttcgtacctagagatggttgcttaaaccatatagaagaaaacgatgaagttctagttgcaggttttggacgtaaaggtcatgctgtaggagatattcccggagttagatttaaggttgttaaggtcgctaatgtgtccctattagctttatacaaagaaaagaaggaaaggccaagatcataattaaaatgttattttttttatttatttgcttggcacttttaatttttaaataaagtgttaagcatataaaaaaaaaaaaaaaaaaaaaaaaaaaaaaaaaaaaaaaaaagaaaaaaaaaaaaaaagggcggcaattaaaaaaaaaaaaagggggggcccgcataaaagggaaaaaaaaaaaatacgggggaccggaagaccaaaccttttctaaagggcccccaaaatta

SEQ ID NO: 1085 - DNA, 790 bp, Diabrotica virgifera
gcactgagtccttgttgactgctcacattttccatcgttgagaccagaacaactaaaacacttccaacatggcggacgatgagagaaagaaactggaggaggaaaagaagaggaaacaggccgaaattgaacgcaaaagggccgaggtcagggctcgtatggaagaggcctcaaaagccaagaaggccaagaaaggtttcatgacccctgagagaaagaagaaacttaggttactgttgagaaagaaagccgccgaagaattaaagaaagaacaagaacgcaaagcagccgaaaggaggcgtatcattgaagaaaggtgcggtaaacccaaacttgtcgatgacgcaaatgaaggctcattaaaacaagtatgtgagggatatcacagacgtattgtagacctagaaaataagaaatttgacctcgaaaaggaagtggaattcagagattttcagatctccgaattgaacagccaagtaaacgaccttagaggcaaattcgtcaaaccaaccttgaagaaggtatccaaatacgaaaacaaattcgccaaacttcaaaagaaggcagctgaatttaacttccgtaaccaactcaaagttgtcaagaagaaagaattcaccttagaagaagaagacaaagaaactaagaaagctgataaagctgagtggcagacgaagaaatgaactaactacatagttactcgccgttatttttttgaattttacatgtttcgacttttttggattatacacacactacactaataaaattttaaaactctacgacgaag

SEQ ID NO: 1086 - DNA, 1671 bp, Diabrotica virgifera
agtttttgagccgtcaacatgggtaagccccgtggattgagaaccgctaggaaacatgtgaatcaccgtcgtgaacaaagatgggctgataaagattacaaaaaggcacatttaggaactagatggaaggctaatccttttggaggtgcttctcatgctaaaggaattgtattggaaaaagtgggagttgaagcaaaacaacctaactctgctattcgcaagtgcgttagggtacagttaattaaaaatggtaaaaaaatcacagccttcgtacctagagatggttgcttaaaccatatagaagaaaacgatgaagttctagttgcaggttttggacgtaaaggtcatgctgtaggagatattcccggagttagatttaaggttgttaaggtcgctaatgtgtccctattagctttatacaaagaaaaaaaaaaaaaaagggcggcgtccttgttgactgctcacattttccatcgttgagaccagaacaactaaaacacttccaacatggcggacgatgagagaaagaaactggaggaggaaaagaagaggaaacaggccgaaattgaacgcaaaagggccgaggtcagggctcgtatggaagaggcctacctgagtccttgttgactgctcacattttccatcgttgagaccagaacaactaaaacacttccaacatggcggacgatgaggaaaagaagaggaaacaggccgaaattgaacgcaaaagggccgaggtcagggctcgtatggaagaggcctcaaaagccaagaaggccaagaaaggtttcatgacccctgagagaaagaagaaacttaggttactgttgagaaagaaagccgccgaagaattaaagaaagaacaagaacgcaaagcagccgaaaggaggcgtatcattgaagaaaggtgcggtaaacccaaacttgtcgatgacgcaaatgaaggctcattaaaacaagtatgtgagggatatcacagacgtattgtagacctagaaaataagaaatttgacctcgaaaaggaagtggaattcagagattttcagatctccgaattgaacagccaagtaaacgaccttagaggcaaattcgtcaaaccaaccttgaagaaggtatccaaatacgaaaacaaattcgccaaacttcaaaagaaggcagctgaatttaacttccgtaaccaactcaaagttgtcaagaagaaagaattcaccttagaagaagaagacaaagaaaagaaaccagactggtcaaagaagggagacgaaaagaaggtacaagaggctgaagcatgatttttctcctttgttaaagcccttttgtcaacatcaagggatatgtcgttatttcgatgatcccatcgtgatttcgatatcttaaatatatttattttattcattactttccagactaaaagagtgtctgtccgcatgtatattatttgtttatgtataacttattaaaaaaagtgaagtattgtggtttaaaaaaaaaaaaaaaaggccggccccgcaccggaagtaacccggtcctaccgtacaaggcaatttttttttggatttttaggccaatgctaaccagggggcccccccaacaaaccccccaaatctatttttttaaccttttttctctccggtggggaaccggcccaaaaacatttaaaactttcgcgat

SEQ ID NO: 1087 - DNA, 1363 bp, Diabrotica virgifera
ctgagtccttgttgactgctcacattttccatcgtttgagaccagaacaactaaaacacttccaacatggcggacgatgaggaaaagaagaggaaacaggccgaaattgaacgcaaaagggccgaggtcagggctcgtatggaagaggcctccgcagacaatagggctaataaaggatatgtcttaccgagattgatcctgtatactcctagatctgaagcagttccttttaaagcatcgtctcatgcgatagaaattgtattcaagaaaaatggagtgaaagccaaacatccagaagctcgcagcatcaattgcgttaggtgacgtggaatgttaaatactataaaaatcactgaaggagcaaatgtgaaggaatattcccaaaagagaatataaggcggccgccctttttttttttttttttttttttttttttccggcactgagtccttgttgactgctcacattttccatcgttgagaccagaacaactaaaacacttccaacatggcggacgatgagagaaagaaactggaggaggaaaagaagaggaaacaggccgaaattgaacgcaaaagggccgaggtcagggctcgtatggaagaggcctcaaaagccaagaaggccaagaaaggtttcatgacccctgagagaaagaagaaacttaggttactgttgagaaagaaagccgccgaagaattaaagaaagaacaagaacgcaaagcagccgaaaggaggcgtatcattgaagaaaggtgcggtaaacccaaacttgtcgatgacgcaaatgaaggctcattaaaacaagtatgtgagggatatcacagacgtattgtagacctagaaaataagaaatttgacctcgaaaaggaagtggaattcagagattttcagatctccgaattgaacagccaagtaaacgaccttagaggcaaattcgtcaaaccaaccttgaagaaggtatccaaatacgaaaacaaattcgccaaacttcaaaagaaggcagctgaatttaacttccgtaaccaactcaaagttgtcaagaagaaagaattcaccttagaagaagaagacaaagaaaagaaaccagactggtcaaagaagggagacgaaaagaaggtacaagaggctgaagcatgatttttctcctttgttaaagcccttttgtcaacatcaagggatatgtcgttatttcgatgatcccatcgtgatttcgatatcttaaatatatttattttattcattactttccagactaaaagagtgtctgtccgcatgtatattatttgtttatgtataacttattaaaaaatgtgaagtattgtggggagcaacaaaaaacacaaaaaaattaaccgacaat

SEQ ID NO: 1088 - DNA, 965 bp, Diabrotica virgifera
ttttgaacatattcggtataaaaaaaagcagattaaaaatggtattcgttatataaagtattcaaaaaattttatgtagtcaccacaaattctggtactttactcctttttcatcagatttggttaaatgatatgttttaaattatatttcaaaagtgatcaaaacttttactcttttgtctccaccattcctgtcaatgttctgactgtgcaagctttattaattttccatttttatattttctactaactggctgtatttgcgtttgtattttccgttgtggattacctgataattatgttatttgtttcatatcacatacgcacctttactaacattagttctatatttattctagttgttacttatactttttctcgtagatgagttcttcactctattttgttagcaactgggtagttttatttacaaaaagtaaaagtagcatgattttaggaatgtaactttttctatttattaattgcttaattttctttagatctccgaattgaacagccaagtaaacgaccttagaggcaaattcgtcaaaccaaccttgaagaaggtatccaaatacgaaaacaaattcgccaaacttcaaaagaaggcagctgaatttaacttccgtaaccaactcaaagttgtcaagaagaaagaattcaccttagaagaagaagacaaagaaaagaaaccagactggtcaaagaagggagacgaaaagaaggtacaagaggctgaagcatgatttttctcctttgttaaagcccttttgtcaacatcaagggatatgtcgttatttcgatgatcccatcgtgatttcgatatcttaaatatatttattttattcattactttccagactaaaagagtgtctgtccgcatgtatattatttgtttatgtataacttattaaaaaatgtgaagtattgtaaacggacgacaaaagtcgcaccccgggtaattc

SEQ ID NO: 1089 - DNA, 1203 bp, Diabrotica virgifera
cacgcgtcagcccacgcgtccagtttttgagccgtcaacatgggtaagccccgtggattgagaaccgctaggaaacatgtgaatcaccgtcgtgaacaaagatgggctgataaagattacaaaaaggcacatttaggaactagatggaaggctaatccttttggaggtgcttctcatgctaaaggaattgtattggaaaaagtgggagttgaagcaaaacaacctaactctgctattcgcaagtgcgttagggtacagttaattaaaaatggtaaaaaaatcacagccttcgtacctagagatggttgcttaaaccatatagaagaaaacgatgaagttctagttgcaggttttggacgtaaaggtcatgctgtaggagatattcccggagttagatttaaggttgttaaggtcgctaatgtgtccctattagctttatacaaagaaaagaaggaaaggccaccatctattaatctgttatttttaatcaataagattttattaaaatttaatttttaaataaaaattaggattaaaaattttcatattttaaaatatgttattatttatttttatatattattatttttattttttataaattttttattaaaatataaatttaaattatttaaatttagtaatgatgataatattagtattaaaaaattgtatatttagtaaaaatatataggtttaataaaggaattcggcaacatttttttcacctgtttattaaaaacatgatctttttgtattaaatataaagtctcgcctgcccactgattaatttgattggccgcgggatttttgaccgtgctaaggtagataatcatttagttttttttatttgaagctggaaggaaaggggttggaatgaaaaaaaaactggtctttatttaatttataaaagaaaattatatttttttaagtttaaaaagctttaaaattttttttaaaagaacgaaaagacccctaaatagaggttttataaaataaataaaaaaaaggttttttttaaaaaataaaatttaatttaatataaataaattttattttaaattgggggggggagaaaaaaaaaaaaatataaattttttttaaaataataaaataaataaaaaaaaattttttggatgcacaatttttttttgtataaaaaaaaaaaaaatttaacctcaaggggaaaaaacggccaaattt

SEQ ID NO: 1090 - DNA, 842 bp, Diabrotica virgifera
gactttttgagttgtacttgcccaaaatataagaaaaatttaaacaaaaatggcattacacgcagctattaagggtaaattaatatcagtcataggagatgaggatacttgtgttgggtttctcctgggtggagttggagaaatgaataaaaacaggcaccccaatttcttggttgttgataaaaatactgctgttagcgaaatagaagattgctttaagcgtttcctcaaaagagatgatattgatattattttaatcaaccaaaacattgctgaaatcataagacatgtaatcgatagccacaattcgccaataccagccgtacttgagattccatcaaaagaccacccatatgatgctagtaaggactccattttgagacgtgcaaggggcatgttcaatcctgatgagttgtaaatggtccaattgtttcagtgatgtacaaactacacagtggcaagtgcaacagtataaaaatttactagaacacaacagattcacaacagttattgttattatgtacataatatatcttgaataaaaatgtataaaatcttaatagttcacaaaaaatataaatgtttaattattaattaatatgtgtgttatagaacacattcagtattaaaccagaaactgtttgttttatttgtcatgatatttagagatattatatatcagatataatacatattattcatcattcctaccccttttttagttgctaatataacatttctttctacaattttttgtttgtagtgcgtatgtaaacatgtaaatgtaatatatctattagtccaataaaaatattctaaagtaatgccaacagaaacattaa

SEQ ID NO: 1091 - DNA, 2148 bp, Diabrotica virgifera
gccaccttgttggagagggtaacgtcgtcgtcaaatcatcaaatcgtcggtccgtgcgcaatctggtgttaaatttaatttaagtgaaaaagcttaagtcaagtgatagtttaggaaaatgcaacttaaggagtatctgtataagtgcggaatcgaagatgattcagacgacgatgaactaggcgctatgaaagaccttaccatcaacgattacatcaacacaagcgtcaacaccaaacaacaaaacgatttggaatctcaacagcgactggccgtgctcagtttcgaacaagtcaacaggctcaatgaagtcatggacgaggtggttttcatccatggcagaggaaacttccccacattggagatccgtctcaaagacctcgtgaacgtcgtgagggagaaactagaggctgatacctctgctgggggagcgggtatgaaggtgaaggacatccgattaaatggtggcgccgcttcccacgttctggccaccgaaagccaaccctacaacgatctggatcttatcttcggagtggagctgtccagtatgcggaatttcgacagagtcaaaagtgcagttctcagctctttatacgagatgctaccagaaggcgtaaaccgaaaacgaatctccacctgcagtctcaaagaagcctacgtaagcaaaatggtgaaagtgaaccaaaacattggcggtgaccggtggtcgttaatatccttggggaactcccgcggtcgcggtgtcgaactcaagtttgtcgattgtatgcgtcgccagttcgagttttcggtcgattctttccagattatcctagactccctgctactcttctacaaatgcagtgagttgccaattagtgagaacttttacccgaccgtagtcggggagtctgtttacggagacttccaagaagccttgtaccacctccagaagaaactcatctcgacgaggcatcccgaagaaattcgaggaggcggcctattgaagtattgtaaccttttagtcaaaaactacaaaccggcgagaccagactacatcaaaagtttgcagaggtatatgtgctccaggttcttcatagactttcccgacatctctcagcaaagaggcaagttggaaaactacctgtggaaccacttcgtagagcccgacgaagaagccctccgccatcagtacctaatgcttctccacgacgtagtcgaagaatcgacagtgtgcctcatgggccacgagagacgccaaacgctccagctcatcaaaaacctcgcctggcaagtcctctaccaagaccagcagcgcatgatgacccagcagccgccgcctctcgtctacgccaatggaatcgtctacgctcccatcatccagaccaactgctattgcacgtgcaataccacctggatgccacagtgctgttcgtgatgtgcgatcatggacgaacactaccgactggagagcgattggtgaactccattggttcgctggtgtgtgtgtgtcggactatgtagacgcacctcgtacatggacttcagtggcgtgacttcagtgacgaaacgggcgtcattgtactgtacgtttttaacaaccattccaaaatttgtaggcctttctggcacaaaagtaggaaacaattctgacaagacaaaatagtatttttaaacaagaccttaaatagagaaaacaatattaatatcaatgtacaaatattataattaatatttaatcttaggtaattatttataaatacttttgccaaaaaattaatactaaaaaaataccgcaaaaatactaatcgttttttgtagggaactttgtatatttattctgtcttaagatgaccaaactatcaaaaacaaattgtatttactctttttaaaattaaaataagttaaaattaaattaagcaaataaaaatgataaaaggttttcttaaaaaatatcgtattagaattttttttaaatatatttataactgtaataaacatattaggccaagaaaaattcgttattagaaagtatattaaaaaaggttataaatgaaatactttaagaaaaaaacttaaaaagaattgtcaagggaataccttttttctctgcttgataaaacgaaacgataatgtaacaacgaaaaaaaaaaaaaaaaaagggggggg

SEQ ID NO: 1092 - DNA, 796 bp, Diabrotica virgifera
  misc_feature (791)..(791): n is a, c, g, or t
aaataacatctcatctctttttgccctcttaggcgtctgattttttatccaacttaggtatttattcaattataaaaaatatccaatccgtttaggtacattattaaaaacaataataaaaatacttgtttttatcttgtaaatattgataataccttcatcaaattatatactcttaaaatttaaaagagtgttagtttttctctatgattcaaccttcataagttaggtggtagacttatctatggttagatggttagctagtacttgtacattcgaatctttctagctggattgaaatgggtgcagtaataacctgtgtataaaataacttgctgaaatctgcggtttcttgaaaaacatcataaacattcaaatttattgaacagacatataagctagtataaaagatatgcagattatttttctgagaaaaatggacattttttcaattccaaactaatgccaacgctgacattatctcagttagagcagatattcttagattttgatagttaaaaaaaaaaacaaaaaattaaaaatgatctgtctctaccattattttgcaatcgtaaagtagtctattttcacagtactctaactgtttgtctgaagttgaatagaattggcaaatgtagcacaccaacaaaatcagctatcctgtatatttgattgtgtattttttagagttgagcagctgatgctgtgatgtgtatgcagtgctatataccttatattgagaactttgtatttcttaatttacgtctatatcttaatatatgtaattttanatttt

SEQ ID NO: 1093 - DNA, 587 bp, Diabrotica virgifera
cccacgcgtccgctaaaaattacaaatttttttctcataacaaaaaacataaaatatatccttacattttacaaaaattgctaacattacacatacaatgtccagttagttctcatcaaacctgtttttgaaactatttaagctaatagcccctacgatgtcatcacttaaactgttccattgatcaaaaactcgatttaccaaaaagttttgccttacagtagttttaaaaggttcctttttcaatttatagagatgacctcgtagtctagcatcttgttgatattaaaaaaattcgatgttccccaaaatcccccttaagaattatataagtagatattaactcatctcgctctcttctatgagtcaatggagacaacttaagctttcttaatcgagtttcatagcttaatcttgcataattaaaaggtagcttagtagctcttcgttgtactccttctaataaattatatctcgtggtaaatgaggtgaccaggcaggtattaggcgttttaataagtccgacacgtagaacatttgagatggcaggaattaggttgatgataaagagcagtctggatttttgc

SEQ ID NO: 1094 - DNA, 1200 bp, Diabrotica virgifera
  misc_feature (1176)..(1176): n is a, c, g, or t
  misc_feature (1183)..(1184): n is a, c, g, or t
gtactcactcaaaactttttgttttttcaaactatgccaaaatggaaagaaaacagaactaagttcactccttgtttttcaccttcaaaactaaagggcatgtttccattcataagtgacataggcgaggaactggaccgatatattgctgattctcctgaaattatcgatgtcagtgatttgtctggtaaatattttatagaagttattgccagatgcatgtttggtatcaaagccaattctttgaaatccaaggatgcaggatttataaagatgtacaaaggtatgttttcatttacgtaccgcaacctgttatcccaatcagcacatttcttttttggggaattggcagaaattttccaactaaattttcttgaaaagtcaattaccgattatctttctgatgcactctacacggtgattaaagaaagaaaagcacacgatggaaaagcacaagatttaatcgatataataatagatatgtcgaaaatggaaggcaaagaaaatttgtcgcaagaagaaattgaacaattaatcgcgaatgcgatgtcgtttttggtagctggaggagaaactagtacttcaaccgcgtcgaatgtcttttatgagtttgctattaatcaagatatacaagaaaaagctaggaaagaagtgctaagatgtatggaggaggatggtggtattacatatgaggcaatgctaaaaactgattatttggaaatgtgtttttatgaggctatgcgaaaatatccagcagtccctcatttttgtcgaaaatctgcaactgactacaaaataagaaacacggatttagttcttccaaaaggaacccgcatatacataccactattgcctctgcatatgaatgagaagtattttccggagccacaaaagtatgatccagaacgttttcgaaattttgactggagcaaggatggaaaactagtatatatacctttcggagctggacccagacgttgcctaggggaccgttttggcttaatgatgtttaaagtggcatttatgcaatttctctcaaaataccgaatagagagagccgaagatactcctgatgaactttgagttgaaaaaagacgtttttatttaagcaaagaaggggtacaatttagtgataagatcattatattagcatatatgtagaattaccctcacttntttaatnnaacatatactaattgt

SEQ ID NO: 1095 - DNA, 799 bp, Diabrotica virgifera
tgtgtttgtgaagtgtgaagtgagaagtgaattgtcaattgttataaacctgtatctggaagataatataagtgataagtgatataatagtaatagtaatagataataattgtaatttgtaatcagtgtgtaaggtacataaataatttctatcgatttaaaaagagtgtaagaacagtacgaaggtggttgccctatttgctatcctaaggcagtacaatggcgcaagcagttaattcaaattcttcttccccattatctttggacaatgaagtccttagatcactgcttttctactgctctattcttgttcttaagatgatgttgatgtcctttttaactgcttcaaagagatttaaacataaggcatatgctaatcccgaagatgccaagctagaaaatctcaagccacaagtaaatgaaaatgtggagagagttcgaagagctcacttgaacgacgttgaaaacattccactattcttcgtgattgctttgatttatactttaaccaatcctgcagtgtatttcgcaaaaacgttattttttgcatatacactggcaagaatcggacacactgttgtgtatgctgttgttccgattcctcaaccagcaagagtattgtgttggattgttggatacggcataactggatatatgggcgttgtcagtttgcttacctttaaataagcaataattgttagtaattttgtgataaaatatttctttaaaagacagatttttatagttttgtaaaagattcaaaatctaaaacataataaaggaattggttttatttctt

SEQ ID NO: 1096 - DNA, 980 bp, Diabrotica virgifera
cggacgcgtgacatggtaacgaggtaagaacggataaagaacaaagagtgattgacgacaatgggcaaaaacaaaaaggaatatactttcgacaacccagtatttattatttctccagaagacgtagaccataaatccaatgggaaaattccagatgttgaggagaacgataagtcaccgcagaggtctcaatggggaaacgacacccaattcctcatgtcctgcgtggcgatgtcagttggactaggaaatgtttggaggtttccctttatagcaaggtcaaatggagggggagctttcctcataccataccttattgtcttgactgtagtagggagaccgatgtactacatggaaatggttctgggtcagttttgcagcagaggtcctggacagatgtattctaagatgtcaccagtgctaaagggcattggaattggacaagtctttggtgcaacatgcgtcgcatcatactactgcattctcatggccataaccttactttacctagtcaactccttcaccatcaattttccgtgggccacttgctgggaatcgtgggaagaatacctgaatgaacgaaattttacatgtgtggacaaagatacagtcaatttttctagcaataataccataagttcagcagaaatgtacttcagaagagaagtgttaaaagaaaaagacgatatcagtgacggacttggagctccagattggaaactatctcttttcctactagtatcgtggtttgctacctttttagtgtcaataaaaggtgtaaaaagctctggtaaagcatcctacttcttggcaatttttccctatattgtaatgctggttcttttaataagagcttctactctaccaggagccgcggaggggatgaaatattttgtggatgctgattttttcagacttaaagatgcagaggtatggtatgcagctgtgactcagtggttcttttctttgaacggtggatt

SEQ ID NO: 1097 - DNA, 931 bp, Diabrotica virgifera
acgaaaataccatatattacaaaacatatcaaactttattaacattcctttctatctttaagccccaaatattttacacttttcttttggattcatattagaacccacaggacaaccgaagtcgctggcaaaatatggcgagtgtcgtatccctcccaccactcgaaactctggaataccatgatgcgcactctttcccacgaaagtgtccttttctgataacaatggttggaagcacatgtacgtgctgctcattatccagaatagttggttgggggtgtaattgatacctggaagggtggattctcgtccattgtactgcacccagttttggtaggctgagtacgcgatgttgacggcgttgaagtctgctaagttttcttctccgcttgtatggttggtcttatttttaccatgtgctatttcgaaaatattatattcgtcatctacacattgtgttatttcagttcgtttatcgatagtagcattggtccataaatcttcttcgtttccttctaaattatagtaaagactgaaaccatgggtgatctcatgtcctatgattgtgcctaaagcaccaaaattcatgtaagttggacgattgccgtcgaaaatatattcttgaaggatcgatgcaggtagaattaaaatgttcaatatacgtaaataatatgcattgactgacatttctggtactcggaaatggctaaggacatcgttggtgttgataaaacgaaagaccctatccaaagtcaccttcagggccactctggctagatcaatggcagttgcattatcatctggaagatgtttaaccttatcaaatcctatcaattcttctattttagtaacgttaaacgcttcatcaagccagccaatagctgctgtaatattctgtagacgctttataccattttctctgctttcatcg

SEQ ID NO: 1098 - DNA, 995 bp, Diabrotica virgifera
ataagcaaattgtttgacggcacacgcttatcgtgttattgtaaccaaaatgttgctatgtgtatccttaatactttgtgttttaaataattgtttttgttcaagtgtttatggtgacgatgctttttcaaatgaattagagtatactgatcttgcacctccatacttttataatgacttaagatctattttgaagttcttcgaagatcctcaatacagatttacacctggagtacgtgaacttttgagcatttatcaccaacaaaaagttaagactgatagacttaacataactggtcaagttaaaaaacatcccttgttcgttatagaaggtctggctggatcaggcaaaacaacaataggacaacttttagcatccaaactgaatggagtccaagtccattcgccttcaaacagtatttactccctaaaaccattatttcaaggagatcactttaaagagtctgcatttaacgccatgtgtcattacattaccgcacttgaggtaaaagtttttctaaaatcatcaccagttatcatggacaggttctggcattcatccgcatcgtattggatatcttatgcaatacaagccaaaccaaataaatatacgatgcctcccaaaggtaacaaaatttatacatggccagaagacttgcttaagcccgatcaagtatttctgttagatgtcgacgaaactgtaagaatggaaaggatatttggaagaagtgaaataaaaaatattactgatgctgaagtggttttacacaatcttaccgaatttagaaataacatattaacggcatacaaaaatatgcaaaatcccaggagttattgtaataaactctaatgtctcaattccagaagttttggacgacgtttactccagagtaaaacatacatgaaaatttaaggtctctgcagatctattcgaagagtaaaacaatttatttatttataactgttggtaattatttttttaataaataatacat

SEQ ID NO: 1099 - DNA, 1197 bp, Diabrotica virgifera
aatcaatgttgatgctgttagattctttttagtcgattgtagacctatagaacattataatgctgggcacttgcctactgccttccacttagattgtaatttaatgttgtcagaacctagtgcttttgcgaccgctgttcaaggattacttagtgcacaaagacaagctttactacataagtcacatgctggaggtgaacacttgtgtttcctgggttctggcagaaacgaagaagaccaatacactcatatggtagttgcgtcgtttcttcaaaagcatacacaatacgtctcgctactgatgggtggctacatagctgtgcacaactatttctcagacaacgtcgatgatttccttcaagatcacaaccccaagagctgcatcgtgtgtgctcctacatacgcttcaaaaatgctgcagtctagtcaaaaaccatcacagtcgaacgacctgtttggtaaaatttcagcggccatgaaatcaaaatctgctgaggtcaaagggaggctgatagattatattgttaaccccaatggtagtccagtgcccgagaggcatgtgtctagtactgataaaataggcaagaggtacagggatgttgcaccagtgtttagtattgatgatgatcacgataacgtagcaaatgagtacgttggccctgaagacaaacaagagatggtgcaaattcaggcctacctaaaacaatcagacgtcatcgagcacttcccgtgtcaggaagtgaaactgaatggatttatgtacaagagtcatttgattgttaccagaaccgaattaatcgtattacgagaaatcccgaatatcaaaggtgctgcagaagtcatcgtaaaacggcctctgtcggcaatagtgaaaatcaccgctagaaaacgccatcccgaattaatcacattcaagtatggcgtacccgatggcgagaatttgaaaatatcggacatggataggtttcttataccgaacgcggataaagcaacgaaagtagtgtctgatcaaattcttaatcaattaaaagctaaagagtgacctttttagaataagcaaaacttcttaaatatttggtaatgtgcaatatgacttaaattatttaatatatatccaaaataatttaactgtgttaaaaaaaaattttaagaaaaaaaataggattaagaaagaaggagtctaatgaaaaataaagg

SEQ ID NO: 1100 - DNA, 1295 bp, Diabrotica virgifera
cccacgcgtccgatctctttttgcagccgcttgcaacttagaagtggttatcaatatgtgggacttctatttccaacagtcggatccatttttcatattttttctatcgctgataatggtcgtcaatgcaagagatcaaataatctccatgaacgacgaaaaccgagataaaataattgctagtcttaataatatgccatgcggtcttgaagctgatgatgtatctgatttttgcacgttagcacaatattacgcactaaaaaccccagtttcttttagaaatgatcttatgcagagcatttacagtggaaaaggcgatagtgttgcaatcgtttcacaagctttatgtctcccagttacagtacacgaattagtcgaaaataccacccatgaaacaatcaatgttgatgctgttagattctttttagtcgattgtagacctatagaacattataatgctgggcacttgcctactgccttccacttagattgtaatttaatgttgtcagaacctagtgcttttgcgaccgctgttcaaggattacttagtgcacaaagacaggctttactacataagtcacatgctggaggtgaacacttgtgtttcctgggttctggcagaaacgaagaagaccaatacactcatatggtagttgcgtcgtttcttcaaaagcatacacaatacgtctcattactgatgggtggctatatagctgtgcacaactatttctcagacaacgtcgatgatttccttcaagatcacaaccccaagagctgcatcgtgtgtgctcctacatacgcttcaaaaatgctgcagtctagtcaaaaaccatcacagtccaacgaactgttgggaaaaaatttcagcgggcatgaaatcaaaatctggtgagggaaaagggagggtgaaaaatttttggttaaccccatgggtaacccagggccccaagaggattggggctaataactgaaaaaaaaagaagaaggtacagggtggttgacccaaggtttaaattttatagagatcccaaaaccgaaaaaaagaaaacgtttggcccctaaaaaaaaaaaagatggggaaattcgggcccacccaaaaaaaaaaaaccctaccaacccctccccgcgttgggaagagaaaatagaggggtattttgtaaaaaaaaatttttttttttttttctccaaaaaacaaaaaaataaattctttttatacaaaaaaacccccccaaaaaaaaaaaaaggggggggggcggcaaaaaaaaaaacatcttctaaaaaaaaaggggcccccc

SEQ ID NO: 1101 - DNA, 1060 bp, Diabrotica virgifera
  misc_feature (841)..(842): n is a, c, g, or t
  misc_feature (924)..(924): n is a, c, g, or t
  misc_feature (936)..(936): n is a, c, g, or t
  misc_feature (994)..(994): n is a, c, g, or t
atttattgtttatttatttatttattttcctattagactaaactatgcgttggagaaacacattctgctcgcaaatcatcgatggcaaaaaagttgccgaagaaatccagaaggagctgaagagagatatagacacatgggtgagcgaagggcaccgggctccatctttgactgccattttggtaggagaggatccggctagcaacaaatatgttcggaataagatgactgctgctaaaaaagttggtataactagcaaaactttaaaattatcaaaagacttaacggaacaagaactgattgacaaaataaaggaacttaacgaagacccttcggtggacggtattctagtacagctcccagtccccgaacacatctcggagagaaaagtatgcaatgccgtagatcctaaaaaagatgtagatggattccacattaccaacatgggtcggttggctctcaatctggatacgctagtgccctgcaccgctttgggtgtcatcgaactcatcaaaaggtcccacattgataccttcggcaagaacgtagtagtgtgtggtagatccaagaacgtaggtcttccgatagccttgcttcttcactctgacgctagaaacgaatgtccaggtcatgaagccaccgtcaccttgtgtcacagacacacccctccagaagaattggagtttttcgttaagcgagctgacattgtcataagtgccaccggtgtagttaacttgatcaaaccagatatgatcaagcctggagcatgtattatcgacgttggtattacaaggataccaaccgaagatggcaaggacaaaattgtaggagatgttgattnntgaaggttgttctgatgttgctggctacatcactcctgtccctgggtggagtgggacctatgactgtagcaatgctaatgtncaatacctttanagctgcccaacttatggtggaaggggctgctaagggtgttaaagccaacgggcattanatttaaatgttaaccaaaacaaaaaagcatgttgggctttaaagatatttttcaaatggtaattta

SEQ ID NO: 1102 - DNA, 914 bp, Diabrotica virgifera
  misc_feature (782)..(782): n is a, c, g, or t
attttatttcgctaataatttttatcttgtcttgatatgaaaagatactcgtaggtgagcacgactcataactttttagtcaaaacaaatatcaacatctacgtacgtgaaaatataattaactcatctttaattaagtaaaaacatacaagtacagctgtatttttagttttagttgtacttgaatatacattacatacaaacatgtctctgaaaaatgtgaaatataccttaaataatggagccaatttacacgcagtagggtttggaacctggttgttaaaaggaaatggtgtctcaaaagctatggacatggccctagaggctgggtatcgactttttgatactgctgctatgtacgacaatgaaaaggaaattggggatgccttaaaagaacttttgccaaaacataacttaaagagggaggatgtatttataactacaaaattatatccatctgatcaaggagaaaaagcatttgatgcaattaaagaatcattaagaaaattagatagtcaatatattgatctgtacctaatacattggcctggaacatatggagtcagttctagaagtaagcaaaacgccatcctcagagatcagagctggcaacagatggtgaaagctgtaaacatgggtttgataaaaaatattggtgtttcaaattacacagtaaagcatttgcaggagttattgaataacaatcatggtataaagccagttgtaaatcaggtggagtggcatccgtattgtcatcaaaaagaactgtacgatttttgtanagtagaaagaattcagttgcaagcttaccaatcacttgggaggtgaagggccaggtgctctttttaacattcacaaattaagaagatagcagaaaaagtagggaaaactacagcacagataccttcttcgat

SEQ ID NO: 1103 - DNA, 1205 bp, Diabrotica virgifera
  misc_feature (1004)..(1004): n is a, c, g, or t
  misc_feature (1040)..(1040): n is a, c, g, or t
  misc_feature (1143)..(1143): n is a, c, g, or t
ccctatacgtccgaaattgaacccggttcaactaagcgatcgcttaagccaccaatgtacaatcgggccataatcttagaagaataggaaactaccacaatatataacaggaggaaactacaaggcataattctgcacaaaataatttattttctttcgtatttaggtccagtagcaatttatctaaagacctaaaacctacaaggccaacttaacttaaatgatatgatgttcgtaagttaaaagttaggttatgttaaaagtaaatttcaaacatttaaaaaaagatttgaaaaatgtttaccataaaaaaatgttttttaccacacaaaacattacagaggatagttagctatcgttgtttgtcaggactaaacttatgggaccaagagatttcatctgaaataaaacatgaaattgaaaagcactggaaagataaattgaagtttaagtcatttgaagacagttcgtcaaataaggaaaaatattatgtgttgtcaatgtttccatatccatcaggagctcttcacatggggcatgttagagtttatacaattagtgacacagttgctagataccaaagactgaatggtaaaaatgtcctacatcctattggttgggatgcatttggattgccagagaaaatgcagctatagatcataagatagctccagatgtttggacaaaacagaatatagcacatatgaaagaacagcttgagaggctaaactgtagttttgaatggaatagggagtttaaaacttgtgatccaaattattataaatggactcaggatttgtttttaaaactgtatgatgaaggattggtgtatcagaaagaagctctagtcaactgggatcccgtagatcaaacagtgctggcagatgaacaagtagatgaaaatggcaactcctggcggtctggagcaaaagtagaaaagagagtcctcaaacaatggtacgttagaactactagatttgccaagaatcttctagatggtctanatgatccattctgcaagattggagggatataattanattacaaaacactggattggagactggtgatggagtccaattttgatttaactattgaaggaaataataaagaatttttgactctatggactctactcctgantatgtagaaacgtaaaaattcgtggcagtgactagtgataatatattacgaaaaaaaggaag

SEQ ID NO: 1104 - DNA, 1627 bp, Diabrotica virgifera
  misc_feature (1562)..(1562): n is a, c, g, or t
attggtacgtactggcaatggaataataattaggaaatggctattatcggtggacgtattttataaaggtatatttggtacatttatattttactcgggatatttaacacaatataactttgtaaaataaacacaatataagttataaattccaataacataacaaaagcgctaatggccctggcattggaaatggtaaacgtcaaaatttatagtaaacaaggtattaaagacatgccgtattggttatccatgtttaacttattggggtttctatggccaagcggcttaattttgcaatactagtttctgtgagtaaaaaagagacctagcattaaaagtaattcgtgaataattttatgcatgggaaaagatagagtggaagaactatattgaacttacaaaaacggctattgcattatttggaggattcattataaaaacagtatgcaatacgaacagtttcctaaatattcattattggaacaaagatgttacgaacagagaaatcaacaattacaaaatgaatttctttatttttcagaatttgatattaatcctttttcctaattacactcggtccaatcgatttcgcatcgggatcagaggacttttctaataaattcttcgaggcattcttcccattcatcattaaacgcagctctcaatcccattacggcatcccggtgcatggatttctcggcctggggcccttcgtttaagctcattcccaaacatgcgctattggatttaaatccgggcttaacgtaggccaatttattgtaggtataccgatctgagtcagataggtgctggtgactcgtgtggtatggcatcgtgcattaaaataaaggcatcaccaataaataccgcatatggaaccacatgatcatccaaaatgtctctgatgtaacaatccgccgttaaacgtcctccaccaggcacgaaaaccatctcggttttcccatccatggaaatgcctgcccaaaacatacaagaaccgcctccacatgacatagtttctcgtatacagcattgagaaaatagtttttcctggccttctataaactcgacgcctcttgtcgttgccgtgtaggtaaattctacttttgtcggagaataatgcctgactccgttgatagtccgatccagatgttcgtgagcaaattctattcgtctttgcttctaggctgcagttagcttgggacccgtcgctgcccttcgtggtgtcaggttggctgccttcagtctcattctgactgtccaaacgctggtaaccacaccttgaacctctaagctcctttttgagattaccaccagtcaaatgttgatttcttagggatttccatacaaccgacgatatatactcgggacacagctgattcgcttaaatttagtcgatttgccacggctctctggctcaggccttctctcaataatactactgcttgagccgctttgacggatgtgatctccatttgtaatgcacttgcgaacttgttataagtgactgatgtattacgttcacatttgtctggtgtctgattcgtatattaagtcgnatgtcggcgtttcttttcaagtcgaagctggtgccactctacgcgagggaaccgtgagaatatat

SEQ ID NO: 1105 - DNA, 1109 bp, Diabrotica virgifera
cacgggtccagagctttgattttaaatagcctactaattgcttttaagtaagcaactttaaagacaactacaaaaatagttttaaggcatatgttttactcacacaatagtcttgagatcaagtagttttaataataggttttattagtcatattaggagaatctttaaaactaaaaggtaacaaacaagaatctaataaaaccaaacagtccggaagttctttataaaactgattagttttaaagtgaactgagaataaaccatttttaaaactacaataagacaaattatctattaagattaattagtcttatttgatactattagatactttaaaactagtgacaaatgcttaacagttttaaagttctggtagtatatctacaaggtaactttaaagccattatcttcttatttgccacaataaaacctttataaaacttaaataaaactaaaatgtttttattgtgctacttgggttatatacttttaaggctgtttaaggagtaaaaagattatataaaagcatataaaacgcttcaagcaaagactttttaaatctcacaaacttctgctgacttgtgaaaatgactcagatataaacttgctacgcataatttaaagaatttagcattaatattatgctatggaacatatatgatcatgcaatgtcttttttggttttatttcgtataatgcaatgtaagtaataacagaaactaatataaatattggtataattgagcttttaattatattgttattaacatatttagtaactgctttttggaatttgtttggaataagccatagcattggcacttctgccccatccatgatggtgatcatcttgctcatagatatcatcgtgttcatagtgatgatcatgatgagaattttcgtagtaaatagtcttttgtttgccgtgtttgaccaaaaagatcaatttggctacagacactcccaaaatggctaccgttgttagagcaagttttaacaaaagaccagcttgtagtagtttcaccaatagacctaatttggctacaacggccaggaaaatggcgaggaactttctcttcttctttttcttcttctttcttgcttctcc

SEQ ID NO: 1106 - DNA, 889 bp, Diabrotica virgifera
aattctaaacgagatcttcggaatggcagacgcagcggcaaagaaaccgaaggcagagaaaaaggcaccaaaggagggtgcaactccaagtgataaaccctccgttaaaagacgtcctttcaaaagacatggacgtttatatgctaaagccatcttcacaggttacaaaagaggtcttcgtaatcaacacgaaaatacagccctattatctgtagaaggaaccagatcaaaagatgagagttggttttacgtaggaaagaaatgcgtctatgtatacaaagcaaaaaacaggacatgtgttcccggtaggcccaaatctgtcaaatccaaagttagggctatttggggaaaagtcaccagaccacatggcacaaggggtgcagtgagagccaaattcaataggaatttaccagccaaggctatgggacatcgtattcgtattatgctgtacccatctaagatatagttgtttttataaatataaataagaaataaaaaatacgttttccaacacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggggcccccccgggggcccctggggtttttttaaaaaaaaaaatgcccttttccccgaggaaaaaaatttttcctcaaaaatctggggcaagccaactttttggggaaaaaattttaaaaaaccaaaaaaaaaaaaaggggttttttttcgaaaaaaatttgggtgggggggggaaaggaatattaaataaaaaaaccccctatttctgttaattttttttaaaaaggaaaaaattttgccccggccaaaaagaaacttgggaaa

SEQ ID NO: 1107 - DNA, 923 bp, Diabrotica virgifera
  misc_feature (890)..(890): n is a, c, g, or t
cctcttcgccaagatgataatgaagaacgaagtctcaacatttgaaagccaaagtcgaagttgcaggtggttttcttaagaaaaaacgatgtctctcatctaaaacatcatgcatcaccacaaaaagatgcaacaaatcatgtcacttaatacagatgttttaatattgcggtaatatacaatttatgatatagcaaaatggaattttacttaggatccgacgatgctagtgacaataataaaattattaggaccatagaatgggatatgatggacaaaaccaagttttttcctctgtccatgttaagttcattcagtgtccgatgtgcactttatccattgacattgattaaaactagattacaaattcaaaagcacaatgacttatacacaggcatgttcgatgcatatggaaaaatatataaatatgaaggatttgggggtctctataggggattctgggtttcttcagtacaaatagtaagtggcgttttctacatctcaacctacgaaggcgtgcggcatatattacaccaaaaaaaatgttcattctagtttaagggcacttgttgccggaggatgcgcttcattagtaggtcaaacgataatagttccatttgacgtccttagtcaacaccttatgatgatgggtgtcaacagtaggggaggagaacaggactttaatcacttagggatgaagacaaagccgaatcaaagcaaattttcgataaccattgatgtagcgaagcacattttcagaatggatggcatcgccggtttttacagaggctattttgcaggtttatcggcctatgttccgaattcggcgttatggtggggattttatcatatataccaagaccaattatacattttgatgccaagttggntctctcacctcttgctacaaagtatatcaggaa

SEQ ID NO: 1108 - DNA, 1619 bp, Diabrotica virgifera
  misc_feature (637)..(637): n is a, c, g, or t
  misc_feature (751)..(751): n is a, c, g, or t
  misc_feature (753)..(753): n is a, c, g, or t
  misc_feature (1513)..(1513): n is a, c, g, or t
gattcgttgaataaagtatggtgatttttcaatgaaggaggatttttctaaatcaaaaataaataattttgcgaaaaatgaacgaagatattacaaattttgcgtcgcatggcgacttcggtcaaatacctgacctgtcaggaatagacgacatactggatcattgcgaaaatgaactcttaaaaagtgaactatttgatgacgatgcctttatgacattagatgaccatgaccctatggatttgatgaatttcaatgatttagaacagagttcattaataaaaaattcacctacattctcttctaattatagtaacagttctttatttgattcgtcacagtcaccgttgtcccaatcctacccttctccactactagacaatagttctctaaatacccctatcagccctaagtatagtccagttcagccacaacccattgttcagaatgtacagattaaaaatgtgtcagttcccgtacagaatttacaaaactctgtcattatttcatcagccaatttgcaacaaactactcaaccggttgtatacacaacaaatattccagttcagaatcagcatataattttacagcaagataatagtaaagggcatggtgggagacagaaagggcagagagngggtattggtgcagaatattcaacagattccagtagatcaaatggcagccagtagttttgcaagcaaaaatattgaaaactgattctcaggtctcactcctacagttatgtacncnacagcagtctcaaatacaacttcccaacctcttcaaaccctattaagtaccaatagaattttaactacaggaattccctcggtattagatggtgaaagtaaggttgctataaatcgtgtccaacctatcaaagaacccaaagttaaagaagtaaaaagaagtgctcacaatgctattcgaaagaaaatacaggacaagtattaatgacaaaatcgttgagttgaaaaatattgttgtcggggaagatgctaagctcaacaaatctgctattcttcgccgaaccatagactacatccgatttcttcaaaactccaacagtcgcctcaaacaggaaaatatcggctctaaaaatggccgccagtcaaaacacactcaaagatcttttcgactactcggcgacaaataccgcccggaagatacacctcctcgttcggatcattcgttatcacccgaacattctcttccttcaagtcccgaatattgtgctacgattaaggacgaaagtgaagatgaggctataggaacagtgcgccaaggaatggctggatagttccaggttaacgctgtgcatcggttatgatggttatgttggtttttaatcctttcagagtagctttggataaatatgcgaatgtggaagacagcagaggattcgaaagaagaggaatattatggtcagaaccggcttcggtatcattttcaccatctacactaattctatggatggtaaattttgtcatcttaggcttttgtttaatanaaatgtttgttttacgcgatccatgacccctttcgagtcaaaagatctcaaattttttggagacacagaagacagggcgatgtatttctaaaaaagggtgaaaaat

SEQ ID NO: 1109 - DNA, 882 bp, Diabrotica virgifera
  misc_feature (833)..(833): n is a, c, g, or t
gtatttggttttctctagacgcaagtggtgtacattgtaaattttagatttaggtgtatgtatttaaatggtatttaagaagttacaataaataattgatataatggttactcagaatattgctggtctaaaaaatttctttgtatttaactctaccttgggaaataaggaaggagaggaattgaagaaaatcttatattattatccagtaatagacaatgtagatgtccaaataaaaaacgtagggttggtggaaggcattattcaatttacagaaacatttaaaccatccacacctgttaaatctttaaggacaactaaaacaagacatttatattttcaacccgaaaaagactactggatagttatgaccttacaaataaaccgtccctcaaaagagaaagatatttcacatgatgctgaagaattagaggatgatgtagatgacagtgtatatgaggctattcttaagcaatcatattatgtgtatagactattttggaatacatttgaatcttcaaaggatataacttcgttaaagacatctttggatgtcttttatagaacgtatcttcaatcaataaaactagccaatgcagatatattaaatgtattttctggaatccagtacctacctttagataaacagacttttcttaaagttcaatgtttcgtcaattctttggaaagcacttatggaatcattcagcactcgtcgtttttgtataatgattatttgatatggagcggtgtagaaccaagcgacatgcaaataatataccagtatctaataggaacgctacttccctgccacgttgaagctgaatttacanggcgctcgataccaagaaatgctccgtcaccctttgctgccttgcgtca

SEQ ID NO: 1110 - DNA, 1017 bp, Diabrotica virgifera
  misc_feature (900)..(900): n is a, c, g, or t
  misc_feature (931)..(931): n is a, c, g, or t
  misc_feature (960)..(960): n is a, c, g, or t
accctaagtccggttgaaatgaatattcctgaagaacatagggcattaatagatcgtattgctagtgaaaatggattcaccgattatgaaataataaccagttctggatcaagcaagggagacaactttctgggagttctgactgcgattaccatcaaagacaaggaaaaaagtttggatttgattttgaagtcttcccataccaataagggttttagagaagctgcacccattaaagaaatttataatagagaaatctttttgtacgaacgggtttttaaagagtttaaaaagttccaagaagaacacaacattgaagatccctttgacagtgtaccgaaatgttattcaagctttacggaagagggactggaatgtttagtaatggagaatttaaaaacacaacaatacgagctgtgggataaaaaagtcccaatgaatccaggtcatattaaagcagttctcattgagtatgctaagtttcacgcggtttcatttgcaatgaaacagaaaaatccggcattatttaaagaattggcagaagagaatggaggtaatccgttcgaggaaaaatatacgaaggataaagataaagaagaaaagtttaaaagttttctgactactactttgtctaatgggtacaaggtgttgaaggatgatccagttttgacagaaaagcttaagaaatatgaagaaattgtaggtcctgaacttatgtctaaactaaaaggaccagaacacaaactggtgataacccatggagattgttggtgtaacaatttcatgtttaaatatcaggatccatataataaaacaaaacctgaaggtttacgtattttagactggcaaatatcttcttttggaagtccatgtgcggacctctcttatttctttctggtnaacagtcctaacgaggtcttagatgatattncaacttatctaaaagtttaccatgacaanctggcttcacactacgtaattttgatttggatcctgaaagattgtttcccttctcta

SEQ ID NO: 1111 - DNA, 977 bp, Diabrotica virgifera
  misc_feature (936)..(936): n is a, c, g, or t
aagtgtgttttgtagtgaatgaacgtatgaacttggttgtcgttgtcaacattcgaggccagaaatattaacactttttgactaaataataagtaaggtagctgaatattacagtccacatgaatttcaaaactccagaagtaccaccacacgtaaatgtggaaataagtgaaaatgatatccaaaatggggccttgcaaattttgaaagttattagaccaaattgggaagaaagtagcataacgtttaagctgttgacagatgggataaccaataagctggtaggatgcaagcccgagggagcagatgatgaagaaatagtcctcgtcaggatatatggaaacaagacagatctgattatagatagaaaagcagaaacaagaaacattattctacttcacaaggcaggattagcaccaaacctctacgcaacattcaaaaatggtctggcttatagatatctaccaggttgtacattaactagcaaatctgtgagagaaccgacaatatacacattagtagctaaacagctggcacttctacataaagtgaatcccaacaatggaccttcgaaaacattcctatgggataagattagaaaatttttagatttgataccagacacattttcggatcccgagaaacatataaggtatatgaaaaatgttactcccaaatctaaaatagaacaggaaatgtatgaaatgaaagaagttatagaaagtttaggcagtcctatagtattcgctcataatgacctcttgttaggtaatgtcatttacaataaagaaaaaaataaggttacgtttatagattacgaatatgcagctttaaactaccagtcagtcgatatagcgaaccactttgcagaattttgtaggtatagatgaaattgattactccttatatcggaacaagaaaattcaacagaatggnataaggtataccctgacgaaatatatggacgagaaacatct

SEQ ID NO: 1112 - DNA, 1270 bp, Diabrotica virgifera
agtagacgaggtgattatggactctgatgaaaatgaggaaatactatcaaaaagcccagaagagatggctgaactcaaaaaggaaaacggtaaccagttatacaaaaccaaacagtacagatctgcactccctctctatagcgaagccatcaatctttgtccaaatgtagccccttattatggaaatagagctgcctgctacatgatgctttacaggtttacagaagctttggaagatgtcaggaaaagtgtgcagctggatccagaattcgttaaaggatacatcagaatgttaaagtgtgctatagcaatgggtgacaccactacagctgattttgccattaagaagcttcaggacttgaaagttgaccaacaaacatttgcaaatgaattaaaatcggttcagcaattgaagcagtacgagtcagatggaaccaaagcgtacgataaaaaagattatcgtttggttgttttctgtatggacagatgtctcgataatgcccctacttgctaccgatacaaaattgccaaagcagaatgcctcacatatctcggccgttaccaagaagctcaggaaattgccaatagtattctaaacatcgacaaaggaaacgctgatgccatctacgtaagaggaatgtgtctcttctatgacgacaatttggacagtgcattccaacattttcaacaagtgttacgattggctccggaccacactaaagctatgaatatttacaagagagcaaggttattgaaaaagatgaaagaagacggcaacgaggcatataagactggcaaatttcaggaagcttacaatctctacacagaagcactgcaagtggatcctttcaataaaaaaaccaacgcaaaattgtacttcaatcgtgccacagttctagccagactaactaagactcgtgaagctatagaagactgtacggctgccctgcaattagatgacacttaccttaaagcactcatgagacgagccaaatgttatatggatcttgtggagttggaatatgctgtggaaaataatgaaaaaatattgaaaaaaaaaaaaaaaaaaaaaaaaaaaaaaaacccttcgccaattccaatgaacaatcaaaaataaaaagagaaaaaaaaaaaataaaaaatacccgggggggggagaaacccggcggggaaagagaaaaaaaaaaaaaaaaaaaaaaaaaaaaaaaaaaaggccccttcctcccccctctcccccaccccacccccccccccacccccccctatggag

SEQ ID NO: 1113 - DNA, 882 bp, Diabrotica virgifera
tgtgtatttacttttttcaacccaagtgttcgctattacattctttataattaaaatcgttgtttactgtgtttttaaaacattttgaatccatttcattatacatattgttttagcacttcattgaagtgcaattttcttctatagacaaattagaatgacatgtttgatgatggattatgaatttaaaatgaaaacacagaatgagagggtaaaggtagaagacttatttgattatgagggttgcaaagttggaagaggtacgtatggacacgtttataaaggcagacgaaaggacggaagtgatagtaaagattatgctttaaaacaaatagagggtacaggattatccatgtctgcctgtagagaaatagcattattacgagaattaaagcatgctaatgtgataaacttaataagagtgtttttatcccacaatgatagaaaagtgtggcttctatttgattttgcggagcatgatttgtggcatattatcaaatttcatagagctgcgaaggctaacaagaagccagtgatggtaccaaaaggtatggtcaaatctctgctatatcaaattttggatggcatccattatcttcattctaattgggttcttcatagagatctcaaaccagcaaatattcttgtgatgggtgaaggacctgagagaggaagggttaaaattgctgacatgggatttgcaagactctttaatgctcctttaaagccattggctgatttggatcctgtggtggtaactttttggtatagggcaccagaacttcttttaggtgccagacattatacaaaagctattgatatatgggcaatcggctgcatctttgcagagcttcttacttctgaaccaattttcattgtcgt

SEQ ID NO: 1114 - DNA, 1098 bp, Diabrotica virgifera
  misc_feature (1069)..(1069): n is a, c, g, or t
aaagctttacatcgcgaagttcaaattagtccactcgggtcattttgatttctggaaggattagaaggtgctgattgctgctatttattcgcatctagcgtgttatctcctgctgataagttttactatcgtcggtttttctctagctaggtagcaacgcagcacagtccaatcgctcctcataaattcaattattaagtgcaatggaaaacggaaaactacaatcaaaaagcgccgaattatgtctctcactatacagagactccttgaaatcaaaagatatggaccatgatgggactcactttgatggtcaataccctcacgttttcgtaatactaggggcttccggagatttagcaaaaaagaaaatctatcctacattatggtggttgtatagagacaatgtcctaccagtcaatacaatattttatggttatgccagaagtaaaattactctgagtgaagtcagacagaaatgttcaccatggatggatgtgaaacccgaggaaaaagaaaagtatgaagaattctggaaacttaatcattatatgtctggacagtatacatccaggactgattttgaactattgaacaaggaggtagaaaaatttgaaaagggaccagttgcaaacagattgttttatttggcattgccaccctcagtatacgaagatgtcacagtgcatataaaaaacaactgtatgggacaaaaaggatggacacgtattatcattgagaaaccattcgggcgtgatctggaaacatctaacaagctctcctcacatttgagtcaattattcacagaacaacaattatacagaatagaccactatttgggtaaggaaatggtacagaatttaatgacacttcgatttggtaacagaatctttaaccccacatggaacagtgaccatatagcttccatccaaataaattgtaaggaacccttcggaactgaagggcagaggaagggtatttttgacgaattcggcataaaataggggatgtaaatgcagaatcatattttacaaattctagctctagtagctatgaaaaaaccagcttcagnttcaccagacgatataagaaaatgaaaag

SEQ ID NO: 1115 - DNA, 1461 bp, Diabrotica virgifera
ataacctcagacgtagacatttttgttattgaaagatacttcaaagtcaaattacgcacagatatacatgtatatcttcaaatagataattattttaggctgggttatctaaaaaccacaaacttagtttccttttaattacaaccgttctaaccgccacttgcaaagtctatttaacattccatttattatttgaatttaatccctaacaatgttccgaagacagcctatgagtgaatttgaagaatcaaaaagcgccgaattatgtctctcactatacagagactccttgaaatcaaaagatatggaccatgatgggactcactttgatggtcaataccctcacgttttcgtaatactaggggcttccggagatttagcaaaaaagaaaatctatcctacattatggtggttgtatagagacaatgtcctaccagtcaatacaatattttatggttatgccagaagtaaaattactctgagtgaagtcagacagaaatgttcaccatggatggatgtgaaacccgaggaaaaagaaaagtatgaagatttctggaaacttaatcattatatgtctggacagtatacatccaggactgattttgaactattgaacaaggaggtagaaaaatttgaaaagggaccagttgcaaacagattgttttatttggcattgccaccctcagtatacgaagatgtcacagtgcatataaaaaacaactgtatgggacaaaaaggatggacacgtattatcattgagaaaccattcgggcgtgatctggaaacatctaacaagctctcctcacatttgagtcaattattcacagaacaacaattatacagaatagaccactatttgggtaaggaaatggtacagaatttaatgacacttcgatttggtaacagaatctttaaccccacatggaacagtgaccatatagcttccatccaaataaattgtaaggaacccttcggaactgaaggcagaggagggtattttgacgaattcggcattattagggatgtaatgcagaatcatattttacaaattctagctctagtagctatggaaaaaccagcttcagttcaaccagacgatataagaaatgaaaaggtaaaggtattaaaaagtatagctccaataaagctcaaggacgttgtattgggtcagtacgttggaaatcctgatggacaaggtaatgcgaaattgggatacttagatgatccgagtgttcctaaagattctgttacaccaacatatgccttagccgttgttcatatcaataatgagaggtgggatggtgtacctttcatacttaaatggtggaaagcattgaatgaaagaaaggctgaagtaagaatacaatttaagaatgtacctggtgatatatttgatggaaaaccccaagagaaatgaactagttatccggggtccaccctggagaagcccctgtatgtaaa

SEQ ID NO: 1116 - DNA, 419 bp, Diabrotica virgifera
atttggcgcatgatcaaataaaaaggattactaagaataatccaggaaagaaagcatatcgtaaggtaaactacggggcaaaagaccccagaactcgtggttgaaagacctgagaagatgagatgaccgcttatccgcagaaatttttcgtgcagtagtttccaaagctataattgctatttggattgcgaaccttcgaaaggtgacggcgcaataaaaagaagaaagaagtaaacacaaaactattgttaattactaataagtttacatgaagcaataggtatattcgctgaagtgatgctgaattaatcatactttgattgtctatacatatgaaacacagaacaagtcgagaagttatttttactgttgaatgctaaattgtccacgtagttacttctcatgctcatgcgaatatg

SEQ ID NO: 1117 - DNA, 1203 bp, Diabrotica virgifera
caaactaagatttattacttttcaatatatattatgtatgaagaattgcaatatgacagtgttcgcgatcaatacacagaggttagtttcgacgagttttctgaggattcagacgaacaccaatcacatgtacaagggaacccccttttgattttaaaaaggcaaaagaaaaggaaaacaaggaaaacaacgttctcaaatttagcaagattaattaaaaaatctggtagactaaataccttcctgaaacaacgtacaaataaaaacatatattacatacgagattttggcaatactctccttggtataagatggagatgggtccttattacattgtttcttgtaaatgttggttgttttttggtttttggaatgttatggtgggttatagctattggtagcggagatttttctcctaatgtaactgatccctgtattgtaaataccaatacatccgaaggttacttccttctgagtgcagaaaccattacaactataggttatggctatcgatatcctacagaacaatgtagttttggatggtttatgcttgtatcacaagttatgttgagtgttgccattcaaggcaccctagtcagtgtagtatatgtaaagatcacgaaaccaatcactaccagttccacttctctttttagtaaaaaggccgtgatttgtatgagagatggtaaacttcgttttatatttaggataaatgactttactaaaaaaatttggtgtggcaccaacatttctttgtacttcatggataaagaattcatttaccctaatacagaatttgagattatccagatggaagttgaacctcatgggttattaatatttcctttggaaatagagcacgtaataaacgaaacaagtcctttgtggacgtttcgtccgttggatatcttagaatcaagatttgaagtaatagccgtggcagagggtagttctaatataacaggacaagtctctcaaaataggacatcttactcgaattcggatattttatggggccatcgttttatgccgtgcgtagattacgatgaagaagaagaacgttatattgtggattacaaaaaatttaaacaattgattccttttgatacgcccttatgtagtgcaaagatgctgagagatatacaacaaatttaacgaagaaaaattttcgaatataattagtttgtagttattattttttat

SEQ ID NO: 1118 - DNA, 1197 bp, Diabrotica virgifera
  misc_feature (1071)..(1071): n is a, c, g, or t
  misc_feature (1077)..(1077): n is a, c, g, or t
  misc_feature (1085)..(1085): n is a, c, g, or t
  misc_feature (1093)..(1094): n is a, c, g, or t
  misc_feature (1120)..(1120): n is a, c, g, or t
  misc_feature (1128)..(1128): n is a, c, g, or t
  misc_feature (1134)..(1134): n is a, c, g, or t
gaacaaaccaagacacgttgaatgctactattagcgcccccgaatcatagtttacaatgtataaactttggaaatcatgatttgggatttacaatgtattattaagctctgtattttctctctgttatgagattgatcagcatcttattaattctattaattaattaattatttaaattgctaatgaaaacgaaaccaaaatttaataaaactttccaataaaaatattctcagtgctaattaattttaatgtattacctttagtttgtggcttctagtatttctcgttgcttaccttatccaggacaaaacacggaaaataaatatactcaaaatcatacaaattttttataactattatttatttatatactataccataaatatacgattcaaaatgtatgctaaactttattctgttgtaaacatttcttatctaataaaaaaatcttcaattctactatctccttttttgaaccaaaacttttttaaatgattcggtagactgttcttattattatataaaaaaacaaaatttcattttcactttttaaatagattacttttatatcttctatcaatttacgaatgaataaattatgctgtaaaactgttcagttgacaaaaaacaaatatggtgtgtaatataaaacaactctctctgttcacaaataatctgactaaccttttctatcttctttacttcttctcatggattgtgatgtcctcggttctcccacaacgtgctcctcggatgctccgactgtccttctccttcaaactgttagcaaacaaaaacagcactcgttcgaattctctcctcaattaaatctctgactcgatacaaacaatatcaatctttataattccaagatttcttctctcagctcgatatctcgtgcaagttgatataaaccggccactcgttccagacagaaactggaatctattcggacacaacgagtttgtacttctcgacttgatcacgatttcatctcaacatgaatctgcttccacggccaccaaattaaccactttacacaaaaatactactttcgaaactggactggntgcttncgatcttnatacacanngtatttcttttgcttgctttctcatncatccganaatcancactctatcttccctccatcgtctcctcgcatcacagcatctcatactatatcactacttttt

SEQ ID NO: 1119 - DNA, 1044 bp, Diabrotica virgifera
  misc_feature (883)..(883): n is a, c, g, or t
  misc_feature (941)..(941): n is a, c, g, or t
  misc_feature (950)..(950): n is a, c, g, or t
  misc_feature (974)..(975): n is a, c, g, or t
  misc_feature (983)..(984): n is a, c, g, or t
  misc_feature (996)..(996): n is a, c, g, or t
  misc_feature (1000)..(1000): n is a, c, g, or t
  misc_feature (1017)..(1017): n is a, c, g, or t
acttgccaaaaatggacaaaaatactcaggacgatgtaacaagcaaacacagagaagaaattttgaaatatctaggcaaaactgaggaagatttagctgcgagtgtggaattgatgaagagttggttcaaaactcaaccacatcttccagaagtcccaagtactaaaaaacttgaattctacatagtaaataacaccttcaacttagaatcagcaaagacaaggatagaccaattttatacattaaggagcacgcttaccgttatttttgatacctcaaatccaaaatcgccagagcagaaggcagccatcgactcagctcaaattgttccattgccaaaattgcacgatgacctatacggtgtgatcttgttcaaaatgagagaaaacataccagtaaactttgacccacactggtggcttggagctctagtcaatgcacacgaagttaaaatacacgagggtttgatgctaaattacatcgtagtttatgatttagagcacatgacactaagccatcttttaaaaattagtcctatatttgcagtaaattccagtaaactatctgagaatggactaggtgagcgattaaaagaaatgcattttatcaactgtccaccattttttcagataataatgaatatattaagagcggtaatgagggcagacttttttactaggttacatatacatcatactgtagacaccttcagagaacggtttccatcagaactgcttccaaaagattacggtggaaacgaaaaatgcatggacgaattagaagctgcatggataaagaaatgcgaggaatatcaagaacatttcgataggttggataccctaagggtcgacgaatcacttcgacccaatccagacgttcccanagatttgatcgaacttggatttgaccgtttttagaagaatgttttttgacctttagancataagtanatatttaacagaaattagaataanntaatattnngtagtgatatanttgntagatgatacgctttangttttattttttgttaagttttatttg

SEQ ID NO: 1120 - DNA, 1256 bp, Diabrotica virgifera
gggaaatatttagatattcttgaagtacctactctgaagaacttcgctcttgacggaaacctatattcaacgggaaactcctctaaaaggatagttttatatagatgtagataatatattatagtgataggacgtgaattcacaaccggtgatttagtcacggtgattgaatcgccggtaattaccgttcgttgctaacttcgatagccgtgatcagtgaccagatatatcagatatcaacttcacggtcactgtttaacataacttgtttatgtaataaatattatgattttctcgttggacgtgactcggggtaatccgacacagtgacataacagtgatagtgaccaatcattatcttgctttgcaagataaagacaattgctaacaatttctgttatgcccggttgactgactattatttcttgtttcagataaaaaatggaacaccatctttatgatagagacagagtgggagtacaagatgcagttttattagaagactacactaatcaagatgtttttgtagataatttacaaaagagatttaaagaagatgttatttatacttacattggtccagtattgatatcggtgaacccgtatagagaactaaatatttatgattctaagactgtgcaagaataccgcaacaaacatttttttgaagttccacctcacgtatttgccattaccaacaacgcatatacatccctaaaagaagaaaatagagaacaatgtatcctaatttcaggcgaatcgggatcgggtaaaactgaagcatccaaaaaagtcctgaactttatagctgcagttacagaccagaaaggagaagtagaaaaagtaaaagataaacttttgttttcaaatcccattttagaagcatttggtaatgctaaaactaacagaaatgacaattcaagtaggtttggaaaatacatggacatccagttcaacttcgaaggaaacccagtgggaggaaatattttgaactaccttttagaaaaatcaagagtaattaatcaagcgccaggtgagaggaatttccacatcttttatcaattgcttgcaggtgcgtctgaagaagaattggataaactgcatttgaagaggagtttgtcttcctactactatttgtccaatgggcacaacggcaccactactataaacgatcagaaggatttcagtgaagttaaaagagccttgactactttagagtttaccgaaaaagacagtcagatatgttttcccgtatc

SEQ ID NO: 1121 - DNA, 977 bp, Diabrotica virgifera
ccctttaagtccgtttatattgcgtattaaaggatgtaataaacttatgataaaaataaaaatataaacaaacacatgcttaatatgtgagatacaaaatactgaagtcttcaatgtccatcccttagttacttacgaagtattgtaattattttgtagttttttttctattcatatgtgaataacttatttactaacacaaatggaaggttgcctgtgataattgtgaaataataacaccagtacactttatacaaataagctgcgaagctttctctcagggtagaaatccatgatagttgtggcaagaggttaaaaaatatatacaataatgccaaaacatcgagacgtaccgagccttcagtcgctttgcctaaagagcataggtactctagttgtccacgtggctccgcttattttatccaaaataagtatatacaaggaaccccagaaagtaatatctagtctacagacgagtctcacttggttaaatgaccatctatcctcacacgttccgttctacctgtatgatcaaatggctgtggaagtactattagctgtaaaggtatttatagaggctacgaagaagacctattttccgcacacctccatagctactttcctcacggagatgaacgtagctgttagtttaactgaagtggttttgaattgtcatttaaagagtatcgatttttcacagtggcccaaaattatgcgatatattttatacaaaaatttacacaatcttactggtctagaaaacttaaatttaggttcctgttcaggaggctggcggacgtccgaattcgatagatgtttgttggaaagcatagcaaaaatgaagcatttgaagtcattgtgtctgtgcttcgacagcacagatgtcatagtccaaacagtaggtgataattgccacagatccaatgtctcgatctcacttcttcaggctccgtaaccgacagatgtatacctttttt

SEQ ID NO: 1122 - DNA, 1990 bp, Diabrotica virgifera
atcgatacaactttattctctaaatatttcaacaactgccccgttatcgaaattccaggaagagcttttcctgttaaacagtatttcttggaagatgctattgaactcacgaagttcgtgccacccactgataccagaaaaagaaaaaataaaggtggtaaagatgatgacgaagaagaaagtacaggcgttgaagaacctgagagacgaaaatttaaacaaggttgtaggaggaaattattcagatctgaccagaaacgtcatgtctagactgaatgaaaaagaagtgagttttgagcttctggaagctcttttagactacatcaaaacacaatctatacctggagctgtattagttttccttcctggctggaatttaatcttcgctatgatgaaacatcttcaaaatcaccccgtttatggaggaagtcagtacagtattttacccttacattcccaaatccctagagaagatcagaaaagggtctttcaacctgttcctgaccacgtaacaaaagtcattcttgcaacaaatatcgccgaaacttccatcaccataaacgacgtagtgtttgtgattgacagttgcaaagcaaaaatgaagatgtttacttctcacaacaatatgactagttatgctacggtttgggcttccaggacaaacttggaacagagaaaaggtcgagctggtcgtgttaggccaggtatttgtttccatttgtgttccaaggccagattcgacaaacttgacgaacatatgacaccagagatgtttagaactcccttacacgagctggctttgagcataaagctgttacgtttgggctcgataggtcatttcctgtcaaaggctattgaacctccaccattagatgccgtcatcgaagcggaagtgctattaagagaaatgaaatgtctggatcaaaacgatgagttgactcctctgggtagaatcatcgccaagcttcccattgaaccgagattggggaaaatgatggttttgggttgtgtatttatgtgtggaggaccattggctacgatggctgcaaactcttctacattccctgaaatattcacactagacatgggccaaagacggttaagctatcatcaaagagccttatctggggacaggcactccgatcatgttgcgatgttaacagcatttgagctgtgggatcaagccagacaaggtggagaagaagcagaattaaggttttgcgatttcaaaggcatcagtatgccgactatgagagtaacttgggaagctaaacatcaactacaacaaatcttgaataatgtaggttttccagaagaaactatggcgctatttcctatggaaactgttggtccagatcccagacttgatgttgtaatgtctcttatgtgttacggattatatccaaacgtttgtttccacaaggacaaaagaaaggtattaacaacagaaagcaaagccgcacttatccacaaaacttccgtcaactgcagtaaccaggatcaaggatttccatacccattctttgtatttggagaaaaaatcagaaccagagctgtatcttgcaaacagatgactatggttacaccccttcatcttctgctgttcggttcccgaaaagtagaatgggttgataacgtggttaggttggacaactggatcaatttggacatggatcccgaggtagcttccatgatagtggctctaagacctgcgttggaaagtttagttattagaacttctcagtctccagaagcaatcttggaaatgggagaaactgacgttaaggttgtgtcaacgattaaagaaatatgcagattgcacgcaggaagttttgaactagaaagagccaaaggtagcctgcttcaatcaaataggcctcccagaggacacactctcggagggttcattggaccttctcccaaattcttcaaaggtggctttaatagtcaaggtggtggtggaggtttcagaggtggattccgtggcgat

SEQ ID NO: 1123 - DNA, 840 bp, Diabrotica virgifera
ctgagtttaaaccggtgtgagccaggttggtttctatctttaatttattaatatattttagtacgaaaggaccaactatataaaataatttttatattttgttaaatacaaaataaactgatgcacgtgtaatataatgtactagaatttaatattaaactacaaatatgcgtatagaaacgtgttacttctgttcttcaaggatatatccaggccatggaatacaatttgtacgaaatgactgcaagatatttaagttttgccgttcaaaatgccatgcagcatttaaaaagaaaaagaatccacgtaaagtaaaatggaccaaggcgtacaggaaaacagtaggcaaagagttaacaatagatccatcatttgaatttgaaaaacgtagaaacataccacttaaatataacagagaaacctggtcaaaggctgtagaagcaatgaaaacggtagagaaaataaaacagaaaaggcaaggagcctacatcatgcaaagattacgtaaaggtagagaaatcgaacaagaacgagacatcaaagaggtacaaagggatctgtctcttatcagatccccagctgttggacttaaagaaagaaaacaagaagaatctatggcgcaagatcacagagaaagtgacgaagaaatggaaggtattattgaagatggtggagaagttacactgtaaaaaatacaatttgttgtcaataattataaacaatataacatttcattgtgagttgttagttttgtagctgttacttttttatttggtactgaatgtttttgaatgtccacaaaacattcaaatacttcgaaatatattacaatatattatt

SEQ ID NO: 1124 - DNA, 351 bp, Diabrotica virgifera
gggccacccacggggaacgccagataattatccacgtgctcatacctgtttcaatcgactagatcttcctccttatgaaagctacacacacttaaaggataagctaatcaaagcaatcgaaggttcgcagggctttgcaggtgtcgattagtatctataattaatctaaaatgttgcattttaccttaaaaaatctgtccaatactggtaacttaagttttatttatagtctattgaattatacatatattatatattttatagctatatgtaagttgttgtttttattctgtatactttgtaaataattcaagtctattattatatattaatcgatatccaagtcaaaaa

SEQ ID NO: 1125 - DNA, 1052 bp, Diabrotica virgifera
aaggaaaaaaatggtgggtaccccgctgcaggtaccggcccggatatccccgggtcccccctctgcgtccgaaaaaatctggatgtttccacatttccaccttttatatcaatttcaaaaactatttcccaagtttgttccacatcctagtgttacatcaaagctaaatttaaagtagaagatgccagttgttaataccagtatggctttattaccagtagctgaagcttcaaatgcagaacctacagaaaatcaaccaagacaacccatgagtttacaaggattacttagattttctatggaagctacaagggcagaagatgcgccttctaatagtgaattcgcgcctatggacgaagagagaaagaaattccttgaagaagctctgaactcaatgtcagtagatgttgtccaaatcatgcaaaggcagatagctttcttaaaaggagttgaatctgtagatccttcagaatgcaatacgaattatttagaagctatcgaaactattttggaatatgttgataatattgatattgcaaatgattttcacaaaattggtggattcacaaccatttatccctgcatgaagtccaaagatagcaaaattcgagcagcaggatgtgaactattggcagttctttgtcaaaacaatccatattgtcaaacagtagttcttgataatgaatttatacctaaacttttacatatgatagaaaatgataatgatggacaagtcgtcacaaaggctatttatgctttaggcggtatcgtaagagacaatcctgaaggtctgacacagttaatccattataatggactcacaatgttactgaactgcctgaaaagtaatcatgagaatgttattatcaaatcagcatttcttcttggtaccttatgcagagcaacaccaaatttgaaagaaaacttacatcactaggatgtgttccacaactcatttcattatttttaactgaaagatccgcttgccacgaacatgtaatgtctttgctggtctctgtactcaaaaataatccagttgctgaagatcaatt

SEQ ID NO: 1126 - DNA, 2523 bp, Diabrotica virgifera
gtttcaagtctgagatcgttttctattttttttttttaattaaaataaggatatttttattaaatatacatctgcttttcgtgtatgtttcacgtttgctgtaataacattgactccaggaaaatcgataattgaccagatatgtttcaacttcgtaaaatcgactaaaatgaatttaaaatgtcaaagttgtcaaatcaaacgtcactgtcacattcgccagccataggcgatagacctcttttgtgtccattcaattagaggacacatgtaattttgagccgattttatttttaggtattatcgagcataaagtattcaaattaattaataacaatgccctccgacgctaagaaacgtgaacaacaacgtaaaaaagatgcagcaaaagccagacaagcaggaaaaaagaatgaaaaacaaaaaggagaagagcaaaatgacactcttaaaacaaatggtctcagtaatggtgcaacaaatggctcgagtgaattaagtgctgaagaagccttatgtgcaaaacttgaagcggatgcccgtttgaatgcagaggctcgtgcatgtactggttctttagcagtgcatccaaaatctagagatgtgaaaatagatactttttccattactttccatggttgtgaaatgttacaagatgctttattggaattgaactgtggtagacgatatggtcttctaggtttaaatggaagtggaaaatccacaattttggcagtacttggtaacagagaagtgcccattccagatcatatagatattttccatttaactagggagatgcctgcttctgataaaacagcccttgaatgtgttatggaggtagatgaagaaagagtaaggttggaaaagttggcagaggagctagttgcatgtgaagatgacgaatctcaggaacaactaatggatatctacgagagattggatgatatggcagctgatacagctgaagcaagagctgctaatattctacatggtcttggttttaccagagaaatgcagaataagaagactaaagatttcagtggaggttggagaatgcgtattgcactagctagagctctttatgtcaagccacatcttctcttattagatgaacctaccaaccatttggatttggatgcctgtgtatggttagaagaggaactaagaaattataagagaatattagtgttgatatcacattcgcaagatttcttaaacggagtatgcacaaacataatacacataaataaaaaaaggctcaaatattataccggcaattatgacgcctttgttaagactagaatggaacttttggaaaatcaaatgaaacagtataattgggaacaagatcaaatcaaccatatgaagaactatattgcacgatttggtcacggatcagcaaagcttgcgagacaagcgcagtccaaagaaaaaacgctagccaaaatggtagctcagggtctaacagaaaaagtgactagtgacaaaattgtcactttttatttccccagttgtggtactatacctccaccagtaattatggtacaaaatgtcagttttagatataacgattctacacctttgatttataaaaatttggaattcggtatagatctggacactaggttagcgttggtgggacccaatggagcaggaaaaagtactctcttgaaattattatatggtgatcttactccaacagaaggtatgattaggaaaaactctcatttacgtattgcccggtaccatcagcatctacacgaactgctagacttggacctctcgccgcttgaatatatgatgaaagaattccctgatattaaagaaaaagaagaaatgagaaaaatcataggaaggtatggtcttacagggcgtcaacaggtatgccctattagacaattatctgacggtcaacggtgcagggtagtattcgcttggctagcatggcaagtacctcatatgcttcttcttgatgaacctacgaatcacttggatatggaaacgatcgatgctcttgcagatgctattaatgaatttgaaggaggaatggtgcttgttagtcacgattttagattaatcagtcaggttgcggaagaaatttgggtatgcgaaaaaggaacagtaacgaagtggcaaggcgacattctttcatacaaagatcacttgaaaactaaaattttgaaggatgcggcaaaacggaaataatgataaacatttaaagcaatacttcagattattaggagctattgaagaaactgtaattcttttatcacgttagattcatttttaacataaaattatttaagcatattgtatggtatgtcgaaattaaatgattggccggccttggttttatttatttaataaacgtgtttcatataaaaaaaaaaaaaaagggcggcgttacgaatacaaaagtgatattcaaatccaagtatttcattgatctatactaataattagattgtttattattgtctaaatatacatttatttatgtgctttatataaaattcgact

SEQ ID NO: 1127 - DNA, 1190 bp, Diabrotica virgifera
aactatctctaacctcgaaaagctggaaaaatctagatgtttccacatttccaccttttatatcaatttcaaaaaactattacccaagtttgttccacatcctagtcctagtgttacatcaaagctaaatttaaagtagaagatgccagttgttaataccagtatggctttattaccagtagctgaagcttcaaatgcagaacctacagaaaatcaaccaagacaacccatgagtttacaaggattacttagattttctatggaagctacaagggcagaagatgcgccttctaatagtgaattcgcgcctatggactaagagagaaagaaattccttgaagaagctctgaactcaatgtcagtatatgttggccaaatcatgcacatgtagatagctttcttatgaggagttgaatgtgaaaatacgctttattggaaattgaatgagttagacgatacggacttgtatacataaatctcagtggaattaccctaactttggcagtacttggtaacagagaagtgcccattccagatcatatagatattttccatttaactagggagatgcctgcttctgataaaacagctcttgaatgtgttatggaggtagatgaagaaagagtaaggttggaaaagttggcagaagagctagttgcatgtgaagatgacgaatctcaggaacagctaatggatatctacgagagattggatgatatggcagctgatacagctgaagcaagagctgctaatattctacatggtcttggttttaccagagaaatgcagaataagaagactaaagatttcagtggaggttggagaatgcgtattgcactagctagcgctctttatgtcaagccacatcttctcttaataaatgaacctaccaacattttgtattagaatgcttgtgtatggtttagaaaatgaactaaaaattttaaagaaaaaaattagggtttgaaatccctttccctaaatttctcaaacggaatatgggctaatcctaataaacacctaaataaaaaaaaggctccaatattttacccgggcaatttttcccctcttttttttattaattaataaaatgtatttttttttttgtaaaatcacaaattttataaaccttttattttttgggaaaaaaagtaatatcaaaaatcacccccttctataaaaaaaactac

SEQ ID NO: 1128 - DNA, 870 bp, Diabrotica virgifera
ctttggttaaatttggagaccaattactcgaaggagtcaattctttttcagttcagatccactacttgtgcgagaatgaaatcaacgttcattacaacacatcctgcatagaaatgtgtctactgccccagtgtgtggagttgacaatggccagttaaaaaaccaactgtcaagcgtatggtttccctggtcattcccaagtatttttctgatgctgacttcctaaggttccttagtgttaccttggcaagtgtacatcctggcccttcttctcatcttttcacggtttgcgtgtgtgagtgacatttggtaatttccgcgattgctcgaccagccagaaagatcacaacccgaagagtcttaggatttctaccttcctagctagctggtcagcaataccagacatagttattacaaagacatagttttacccttataaaagcaattgataaaaggtagaaagacacatgtaagctctgtatcctatttgtgtattcggcgaagcgccaacttgttttgtttcgttttatatgaaaagtgtttttacacatattttgtaccttattgaaagggtgtgatcaaaataatttttttatattatgttcaaagatatcttaaatattttattatattgtatataaaatctgactataatttaaatgtagatccacccttgaaaaaatattctttatatttttacgtaatgctgtgattggggtttttgtgtatttatttgaaacaatgtatatattcggctttcttatttttgtgaaaaacactgaacagattcttcccaaaattgtcttactatattttttaatttcataaaaattcatatttgatgcaaaaaggcccacctaatatttactg

SEQ ID NO: 1129 - DNA, 1074 bp, Diabrotica virgifera
gcaatattgatttggtcgttttcttgcgagcaactccgtggacttttggacacgttctccggagtgtgtctactgcacaactcaactgccgttcgcagctcacgtttcacaagtttcacgttagtcgagttcatagttcgtcgtagttcgggtgcctttaattcgagtttttgtggatatcttcacattttccagaaacaggacaaaatggcaaacaacagggcagcaaagagcggattcgctgcagaagctcaacgaaaggtaaacgccaaatacagcgaagacttggctaaagaaagtctcgaatggatcgtgacgatcacaggagacgaactgaacacagctggtgatatggacaacttttatgaagtacttaaggatggaaccgtattgtgcaaattagtaaataacatccaacccggtatcgttaagaaaattaacacctccacaatggctttcaagtgtatggaaaatatcaacgccttcctagaagctgccaaacaattaggtgtaccacctcaggaaacattccagactgtagatctatgggagaggcagaaccttaactcagttgtcatttgcttacaatcattaggcaggaaggctgacaaatatggaaaacaatccatcggaccaaaagaagccgaaaagaacgagagaatgttctcagaagagaagcttcgagctggtcaaacaatcataggacttcaaatgggaagcaacaaaggtgcaacccaatcagggatcaatttcgggaacacaagacacatgtaaattaagaacaaatcaacttggaaccattccagcggtttgatgttaaaactatttcaagagttttaacgttaaaactgttcggtactcaaaaataacagagtcttttatagtacttagaaccacatagttgcctgttagatgttaggtacttagcctactgtttgtcgttgtataacttttaaactcaagccagaaacctgatcttttggttgaattaaaaatgtgatattataaagaaatatacgagtatttcagaacccaatttgttacacttttggagacataattgcaccattacat

SEQ ID NO: 1130 - DNA, 1525 bp, Diabrotica virgifera
ctcctatagggaaggtgggacgcctgcggggaccgcggccgcggattcccgcgggcccacgccgcttcagtgagtacactcgtgtttttgaactgattcaacatgtccctggaaacaagagctgccaaaagtgggcttgccgcagaaactcaaaagagggtaaacgccaaatacagcgaagacttggctaaagaaagtctcgaatggatcgtgacgatcacaggagacgaactgaacacagctggtgatatggacaacttttatgaagtacttaaggatggaaccgtattgtgcaaattagtaaataacatccaacccggtatcgttaagaaaattaacacctccacaatggctttcaagtgtatggaaaatatcaacgccttcctagaagctgccaaacaattaggtgtaccacctcaggaaacattccagactgtagatctatgggagaggcagaaccttaactcagttgtcatttgcttgcaatcattaggcaggaaggctgacaaatatggaaaacaatccatcggaccaaaagaagccgaaaagaacgagagaatgttctcagaagagaagcttcgagctggtcaaacaatcataggacttcaaatgggaagcaacaaaggtgcaacccaatcagggatcaatttcgggaacacaagacacatgtaaattaagaacaaatcaacttggaaccattccagcggtttaatgttaaaactatttcaagagttttaacgttaaaactgttcggtactcaaaaataacagagtcttttatagtacttagaaccacatagttgcctgttagatgttaggtacttagcctactgtttgtcgttgtataacttttaaactcaagccagaaacctgattttttggttgaattaaaattgtgatattataaagaagtatttcagaaccaaattgtttacacttttggagacataattgcaccattacatagctaacacttctttctgtcacgtatttcaaacacgcactgatcaactaagatttcgatctttcttgactactaaagaaatcaatttcttccatcaatatatataacatatctcgaactattacaatatatgcaacactgaattaaaactttttactgacaataacgtttttgaaatttcaactttttccaggagctttagcttgagttgtaagattctgctgttattgatcatttttatataagtatatttttaaaactattatttatgaaatatatgatttgttaatacatcgatcatatatattagtgtatatttacaagctatttttgatcaatttttacacatgattgttgcgaacattcctgttatacacttccataaacaatatagaaggaatagcgttgaaccgagtcacaattcaagaagcggtaaacctggatacgtaattaaaccagtacaaacatctcccgattacgatgatgtctacaactccaaccactaccaacgaagacctcaagtaaccacccccagaagtgcttgcattcaccatatcaaact

SEQ ID NO: 1131 - DNA, 876 bp, Diabrotica virgifera
acaacatttgcaacaatacctggaaactgaagatagtactacgctgtccttaagcgaacatgaaaaagtacaagccgatcaaacgctcacgcaacgagactggagacgtcagaaacaaactcttgaaaggaaagtacacgaagaagactcaacactattaaaattagacgaacgaacaacggaaacgagtcaacaagatacagcaatcaaagattggcgtaaacgcagagatagaggagacgaaaaaattaaagaagatttaaaagaggaaactcaaactctggaaactgaagagaaagttccacaggaaccagttccttggaatcagcaagaaattacattaaagaaaacacctcgacaacgtaaggaagttcaaaaagagactttggaagaagtaacccttaaaccattcagaaaatcatctgcaactagtcagacggttgaagaaacaactactgttactacacaaagaaaacctgataaagtacacactgaagaatcaagtctgttaaagctaactgcagctgaaagcattgaagaaactaaaaaacaagaaacgaagggttggcgttaaacctagagaagaaattaaaccagtggagaaacagctggttactgaagatgcaactatcttaagaatagatgaaaaccagaacgtagttaaggtgcaacaggctgaatctcgtggttggaggaaacctaaggaagcaaaaccaagccaacaatcagaagaagaaaagcccaaagtagatgagcaaaagcctgaaccagtgccctggaataaaaaagcaatccctctttaaaaaactcagattgcttgaaaagaacaaacccagggaaccttataacaagtgggctttaaaccaccaggaaaac

SEQ ID NO: 1132 - DNA, 1486 bp, Diabrotica virgifera
  misc_feature (1364)..(1364): n is a, c, g, or t
  misc_feature (1383)..(1383): n is a, c, g, or t
gttacatgtggcataggttatttcgttgtagaaacttatcaccagtattagcactttctaaaatgtctaccaatcaattattagacgtaaaaataaaagaacaagccgatcttgttcgcaatctaaaagcttccaaagaacccaaagagaaaattgcccaagaagtagaaaaactgcttgcattgaaagctcaactccaaattgacgatggcattaccagtaataatcagaaatttgtcctcaagactccaaagggcacgagagattttgctccagaacagatgtctctgaggttagaagttatggacaaaataacctcagtttttaagaaacatggtgcagtgactattgatacaccagtttttgaattaaaagaagtcttaactggaaagtatggtgaagattctaagcttatttatgacttaaaagaccaagggggtgagatacttgctttacgttatgatttaacagttccttttgcacgttaccttgctatgaataaagttactaacatcaaacgttaccatattgccaaagtgtatagaagagataacccatccataactaaaggaagatacagggagttttatcaatgtgatttcgacatagcaggatcttacgacccgatgattccagatgctgaatgtgtaaaaattatgtacgaaatattaacactcctggaaatgtctcccttcgtaattaaattgaatcacagaaaactgttggacggaatgctagaagtatgtggtgttcccacagatagcataagaaccatctgttcatctatcgataagttagataagtctccttgggaggaagtaagaaaggaaatggttgaagaaaaaaatttatcacctgaagtagctgataaaatcggagaatacgtaagattaaatggaaaagctgacttagtcgaaaagttacaacaaaacgaagtacttagtaaaaataaaagtgcccaagaaggattggaagctatgaaactactattgaattattgtgacttgtataatacgtcggataaaattttatttgatctgagccttgctagaggtctagattattatacaggagttatatacgaagctgtattactaaaagatgatactgttggaggtgatatctcagtaggttcagtagctggtgggggtagatatgataatctggtaggaatgttcaatcaaaagggtaaagacgttccttgtgttggagcatcaattggagtagaaaggctgtttactattatagaagcaaggcaagcaaattcaactaccaaatgcagaaagacagatatcgacgcttatgtagcatctgcgcaaaaaaatttactggaggaaagaatgaaactgtgctctgaactttgngataagggcttcaaagtgnaacattcgtataagaagaatcctaagcttctagcgcagctgcaacactgtgaagaaaacggcataccctttgctatagttttaggcgaaagtgaaattaaaaa

SEQ ID NO: 1133 - DNA, 1511 bp, Diabrotica virgifera
  misc_feature (1417)..(1417): n is a, c, g, or t
  misc_feature (1452)..(1452): n is a, c, g, or t
  misc_feature (1470)..(1471): n is a, c, g, or t
tctttgcgtccggtcagaatcagaaataaacgcacgtggtttacaatttgacagtttgtggttatgttattttatgtttaagtttaaaattaaaatataaatagaagagaattgtgtttgtataattgtttaaaattaaaataatttaataatggaaaacgaaggcgaagctgtaacagaacagaagcgtctgttgtgttgttttaaatcggaaaatggagaagtcgcgggtgatatgatggatctccccatagactgttccttacagcagctcacgttaatttgtaatgctttgttaaaacaggaagaaccagtaccatacttattttacgttaacgaaaacgaaataacccatactttggaaaaagcactaaatataagggaattaaatacagaaggtgttgtagatatcatttatcaacaacaagcagtgtttagggtacgccctgtaacaaggtgtaccagctcaataccaggtcatgcagaagcagttatttcagttagttttagtccagacggtaaacatttagcaagtggatctggtgatacaacagtcaggttttgggatgttgatacgcaatctccgttatatacttgtgaaggtcataaaaattggacgcttgggatagcttggtcctctgatagtactaaattggcttctgcttgtaaagatgggaaaattatcatatcgggatccttttacaggaaagcaaataggtaaaacgttaacgggacataaacagtggattactagtttaagctcgggagccttatcataaaaaccctgaatgtagatatttggcaagttcttcaaaagatggagatgtaaggatatgggatactgtactcagcaatacatttttttgtatatctggtcatacaaagagtgtaacaatggtgaaatggggtggagcaggtctcatctattcagcctcccaagacagaacagttaaagtatggagagctaaagatggtgtactatgtaggacattagaaggacatgcccattgggttaatacattagctttaaatactgactacattttaaggataggagcatttgatcccgttaaagattcaaataaagacacattaatgccagacaagaaaaaatctcaggactttgccctcaaacgatactatgaagttacagaatctattggagaaagattagtatcgggttctgatgatttcacattatttctttggaatcctgataaagacaagaagcctttagctaggctaacaggtcaccaacaattagtcaatgacgtgaaattttcacctgatggtagaatattagcttcagcatctttcgataaatcaatcaaattgtgggaggcaaaacaggaaagtttatttgtaccctacgtggacatgttcaggctgtgtacatggtatcattttccgccgattncaggcttatggtcagcggcagtgccgattccactntaaaattatggaacctgnnaaacagaaaactagaagtcgatcttcctggtcatgctgat

SEQ ID NO: 1134 - DNA, 1056 bp, Diabrotica virgifera
ctcttccacgcgtgcgcacatactagcctgatttgcagccaagcgtaacaagagtaggataaatctatttaaaacttctcattgtttaccccattaaatcaactctgattaacaataacgttttaaatgtaacatctgaggtgcatctctaatcacagccaacaaataacatgcataatgcggtgattaagagtaaaacagtacagttaaaattattagttacaggtattgttgaattagtacatggagcccttatttggtcaaattataactaagaaaatttacgattgtcagctgaaagaaagatttacatccgtcccttggaagctaactgtttttgtagacgtgtatcatattgaaagccctggtcatgtctcttgattttattgccggatgtgttgggggtgtagctggagtttttgtaggccatcccctcgacacagtcaaggtaaatttacaaacacaatgtgcagttaatcctcagtatcgaggaactgttcactgcataaaatccttaatggcaaaggaaggaattaaaggaatatatcgaggagtaactagtccagctctgggagtagcaacgttaaatgcagttgtgttcggtgtatatgccaatgttcaaaaatattcgacaaatcctgagagcctctcatcgcatgcagttgctggagcagcagcgggatttttcactagtgttatttctagtccgatggagctagttaagtcaaggatgcaggttgcaggagcccaagcaggcaaaagtccattggattgtttattaagaatttataaacaacggaaattgcttggagtatttcaaggatatggtataacattgataagagacgttccagcctttacaacctattttgtatcttacgagtatttagccagaaccgaggaaggacaggtcccttcatcggcaacaatattattcgctggtggaatggcaggtgtgatatcttggataataccctacccactagacgtccttaagtcaaaaattcagtagacacctcaaaacaattttctggagtgtatgattgcttccagcaa

SEQ ID NO: 1135 - DNA, 938 bp, Diabrotica virgifera
  misc_feature (922)..(922): n is a, c, g, or t
cggacgcgtgggcggacgcgtgggatttttttatgcactaagacacttgacttgcgtattataaaaaataaaataaaagtaggtatttgaggaaaatgttattgatattactactactcgttgctctctgtgcagcagtgtattactatgtatttgtgcctctaacgttttggaggaaaaatgaagtaaagcagaaaggtttgtttgcttcttttctggatactttcgtgtttttgaaaaagaaaagtgtggccgatctggtaacaacttggtacggggagtttccgaacactaggtatagtggcatttaccagtttggaaatccagttctaattttgagagacccagatttaatcaaacaaatttggattaaagatttcgagcattttactgatcgcaggacgtatattcccgaagatcttgatcctttatttggaaaaagtatcttttctttaaaaggcgaacgatggaagaacatgagatccattgtaagccccacattcaccagcagcaagatgaaatacatgtttgttttaataaaggaatgctgtgacaatttcacaaactactttttgaagcaaggttctcatattcaagaagtacaattcaaagacgcatccggtcgattttgtactgacgttatagcttccatagcgttcggtattaacttagattctctagaccaaaaggacaacgaattttatgccatggtcagtagggtttctaatcttaacaaatttagtaaacttatcagattcatgggatttttgttggctccgaagttatacagatttcttggcttaaaactctccgacaaagaagaaacttcattttttgtaaaccttgtcaatgattccatccagcaaagggaagagaaaggtatcgttcgaccagacacaatacaattgcttgtagaaactangaaaaatgaaaaacct

SEQ ID NO: 1136 - DNA, 914 bp, Diabrotica virgifera
caataacaagatcgtgtgtatctctgtttcctatactgcgagatttaactcttctacgtttgcttatagtttttcgtttgctctctcaagtgttagtgtgatttcttaaaaaaaaaagaaagagcgtaattctgccgaaagacgccaccgcgccgccaatacccacagcgaattcaatcacgtggtcgtagcagaggttataagtagcgccgtccccgtatattccgtctcttttccaaagtaactaaagaaagaagtacaagtacagtgatcagtggtctgcgaaacatcgaggttcagaatgccagaaacaacatcgacaaatggatattcaaacggccattccggctacgaaatggcggatggtgctgaatttctcttcacatccgaatccgtcggagagggacatccagataaaatgtgtgatcaaatcagtgacgccatcttagacgcacatcttgaacaagacccaaatgcaaaagttgcctgtgaaaccgttgcaaaaactggaatgattcttctcgccggtgaaattacatcaaaagctgtggtcgactatcaaaaagttgtcagacaaactgtaaagcacataggatatgacgactcttcaaaaggatttgaccacaagacatgcaacgttttattggcattggatcagcagtctccagacattgctgctggagtgcacataaacaaaaacgaggaagaaattggagctggtgaccagggtcttatgttcggttatgccacggatgaaacagaagaatgtatgccacttacagtagtattagcacacagattgaatcacaaaattgctgatttgagacgatctggagaattctggtgggccagaccagactcaaaaacacaggttaccgcagaatacactttccaacgtggcgcttgcattccac

SEQ ID NO: 1137 - DNA, 706 bp, Diabrotica virgifera
tttgggggccccattaaaaaaattttgggtttccaaccccgggatgtaaaacttggttcttttgaaggggcccccccttttttttttttcccttttttttttttttttttttttttttttttttttttttttttttttttttttttttttttttttttttttttttttttttttttttttttttttttttttttttttttttttttaatgatgttcaatattttattgaaaaaagaattaaattataaaagataagctacttgatttatttttcaccaccttcagatgcaggcatggatctaatgatatcactgtctccgggatctgtaatggacatagcgcacaccctgaagtattttccgcatgctgtgcctagctctacattatttccagaataatggtggactccagttttagccaacatagcgtagtattcaatttcggatttccttaggggaggagtgttgttagaaatgataataagttttgatttaccttgtctcaatgtttttaaggtctgcttgtatcccagacaatatttgccagatttcattaccaaagccaaacggctgttgatactttcaatcgccttcttctgtttcttttgggcaaccattttactgatttataaattgcaaagtgctgaaaatacagcaaatctttaatgagaaagaaccggacgttcgaaccacacttttcaatgagt

SEQ ID NO: 1138 - DNA, 1409 bp, Diabrotica virgifera
cggacgcgtgggcaataacaagatcgtgtgtatctctgtttcctatactgcgagatttaactcttctacgtttgcttatagtttttcgtttgctctctcaagtgttagtgtgatttcttcaaaaaaaaaaagaaagcctaaatttcttgtgggcctgacgatgctgtatgacttgtaaatagcgaaaccggtcgccccatcttactttaagtaataaaacgaatttaaaggattagcgtaattctgccgaaagacgccaccgcgccgccaatacccacagcgaattcaatcacgtggtcgtagcagaggttataagtagcgccgtccccgtatattccgtctcttttccaaagtaactaaagaaagaagtacaagtacagtgatcagtggtctgcgaaacatcgaggttcagaatgccagaaacaacatcgacaaatggatattcaaacggccattccggctacgaaatggcggatggtgctgaatttctcttcacatccgaatccgtcggagagggacatccagataaaatgtgtgatcaaatcagtgacgccatcttagacgcacatcttgaacaagacccaaatgcaaaagttgcctgtgaaaccgttgcaaaaactggaatgattcttctcgccggtgaaattacatcaaaagctgtggtcgactatcaaaaagttgtcagacaaactgtaaagcacataggatatgacgactcttcaaaaggatttgattggagaaccctgaatttgctagtagctttagaagaacaatctccgaatatagcagaaggtgttcacggaaacagagacgaactagaaataggggcaggggatcaggatttgaccacaagacatgcaacgttttattggcattggatcagcagtctccagacattgctgctggagtgcacataaacaaaaacgaggaagaaattggagctggtgaccagggtcttatgttcggttatgccacggatgaaacagaagaatgtatgccacttacagtagtattagcacacagattgaatcacaaaattgctgatttgagacgatctggagaattctggtgggccagaccagactcaaaaacacaggttaccgcagaatacactttccaacgtggcgcttgcattccacaaagagttcacacagttgttgtttcgctccaacacagcgacaaaatcagcttggaaaaattgagaaccgaaatcaaggaaaaagttattaaagaagtaattccaggcccatacctcgatgaccaaacagtcattcacatcaatccatgcggtctcttcatcatctcctttcttttctccggaagggaccccccaaaggggagacaaggggcctaattgggggaaaaaaaaaccatttggtgaaaccactttttggaggggggtgggggga

SEQ ID NO: 1139 - DNA, 1742 bp, Diabrotica virgifera
  misc_feature (959)..(959): n is a, c, g, or t
  misc_feature (968)..(968): n is a, c, g, or t
cacacgccaataacaagatcgtgtgtatctctgtttcctatactgcgagatttaactcttctacgtttgcttatagtttttcgtttgctctctcaagtgttagtgtgatttcttaaaaaaaaaagaaagagcgtaattctgccgaaagacgccaccgcgccgccaatacccacagcgaattcaatcacgtggtcgtagcagaggttataagtagcgccgtccccgtatattccgtctcttttccaaagtaactaaagaaagaagtacaagtacagtgatcagtggtctgcgaaacatcgaggttcagaatgccagaaacaacatcgacaaatggatattcaaacggccattccggctacgaaatggcggatggtgctgaatttctcttcacatccgaatccgtcggagagggacatccagataaaatgtgtgatcaaatcagtgacgccatcttagacgcacatcttgaacaagacccaaatgcaaaagttgcctgtgaaaccgttgcaaaaactggaatgattcttctcgccggtgaaattacatcaaaagctgtggtcgactatcaaaaagttgtcagacaaactgtaaagcacataggatatgacgactcttcaaaaggatttgattggagaaccctgaatttgctagtagctttagaagaacaatctccgaatatagcagaaggtgttcacggaaacagagacgaactagaaataggggcaggggatcagggtcttatgttcggttatgccacggatgaaacagaagaatgtatgccacttacagtagtattagcacacagattgaatcacaaaattgctgatttgagacgatctggagaattctggtgggccagaccagactcaaaacacaggttaccgcagaatacactttccaacgtggcgcttgcattccacaaagagttcacacagttgccagcttacaaaaaaattatntaaaatatntattttacaataaaaattttaattttttagctcttttaaattcgaaaataataaatatataattattaattaataatccctgatacacaaggtacaaaaaataaatttttcttttataaaaataaaatattctctcacaatactaattaactatcattaaataaaatttttctttacttttactaaaaaatattttattattttaaaataaataaaaatcggacgcgtgggttttttttaccctaatggttcaatattttattgaaaaaagaattaaattataaaagataagctacttgatttatttttcaccaccttcagatgcaggcatggatctaatgatatcactatctccgggatctgtaatggacatagcgcacaccctgaagtattttccgcatgctgtgcctagctctacattatttccagaataatggtggactccagttttagccaacatagcgtagtattcaatttcggatttccttaggggaggagtgttgttagaaatgataataagttttgatttaccttgtctcaatgtttttaaggtctgcttgtatcccagacaatatttgccagatttcattaccaaagccaaacggctgttgatactttcaatcgccttcttctgtttcttttgggcaaccattttactgatttataaattgcaaagtgctgaaaatacagcaaatctttaatgagaaaaaacttcgaaccacacttttcaatgagttgaaggaaagagagtaaccacgttgtggcaggttaact

SEQ ID NO: 1140 - DNA, 3216 bp, Diabrotica virgifera
attttataaaattcattattaccctgactctccatatactagatcagatcctaagacttcattcatactgtcttggctgtattatggtttgtcgcatctgctacttcgtcaccattgaaaagatgaatacatctcaaaaaactggaaaaattggaaatatgccaagagatctaaccgctacagcgagaccctgagacttttcaataacgagataaaatgcaaggtccgccgaagtcaaagccctaacatccgcccgtaactaaagaaagaagtacaagtacagtgatcagtggtctgcgaaacatcgaggttcagaatgccagaaacaacatcgacaaatggatattcaaacggccattccggctacgaaatggcggatggtgctgaatttctcttcacatccgaatccgtcggagagggacatccagataaaatgtgtgatcaaatcagtgacgccatcttagacgcacatcttgaacaagacccaaatgcaaaagttgcctgtgaaaccgttgcaaaaactggaatgattcttctcgccggtgaaattacatcaaaagctgtggtcgactatcaaaaagttgtcagacaaactgtaaagcacataggatatgacgactcttcaaaaggatttgattggagaaccctgaatttgctagtagctttagaagaacaatctccgaatatagcagaaggtgttcacggaaacagagacgaactagaaataggggcaggggatcagggtcttatgttcggttatgccacggatgaaacagaagaatgtatgccacttacagtagtattagcacacagattgaatcacaaaattgctgatttgagacgatctggagaattctggtgggccagaccagactcaaaaacacaggttaccgcagaatacactttccaacgtggcgcttgcattccacaaagagttcacacagttgttgtttcgctccaacacagcgacaaaatcagcttggaagaattgagaaccgaaatcaaggaaaaagttattaaagaagtaattccagccaaatacctcgatgaccaaacagtcattcacatcaatccatgcggtctcttcatcatcggaggacctcagagtgacgcaggcctaactggtagaaaaatcattgtagacacttatggaggttggggagcacatggaggtggcgctttctctggaaaagattttacaaaagttgacagatctgccgcttacgcagctagatgggtagctaaatcattggttaaagcaggactttgccgaagatgcttagtgcaagtatcatacgctattggtttagccgaacccctttccattacagtatttgattatggaacttcaaacttactcaaaattttttgttggacatttttaacaaaaacccccctctaaggcatggttaaatgtcaaagaattaaatctaaaacccccttctaccaaaagaccagcacctatggccacttcggacgggacggttttacgtgggaacagcccaaaacactacaactaaactgacaaccttccgtaacaatattttagaaatcttttattgacgcactagatgcctccttctagattttaagtttagaaaaaacttctgtgattggcgctctgaaccttgagaccgacgcgattttttgcctctctgaatcggaaacattctacagagcaaagtatcgcgtactaacaagtaactgtcgcaaaacgtgcccacagattcccgatatagaccacagtggcgtttcaagcgttactgcaattcagtgtgagtcaaacgttcagtttcaagttagatattactcgcacattgtgttgtgtttaagagaaaaaataatttggaaaagagcatttctataaacactccggactgtattgggaatggtggtcatccatgcatgaaaagttcttgcaaaaacaatatttatatattatgtattttatacaactcatcagtgttcactggttgtaaattatattttattctaattttttaacctacaactctacattccttgttattttaaaataatcgtcaaattaacatagaatttgcaagaaacatgtacaatgggcatttaagatctgctgccgtttgatatagaattcccttagtgttaattttattgatttgattttgtaaactgtagatgaataattattgtagatgatagtttgaatgtatagattttattgtacctatgtaatttattatgagaggataaaacgatctatatgttgtatacaattgatttaagtaagtttggtagatgtattgtccaatgtagatcgtaaaatttggtgtaattttttatagcatagtttattttttaaataacccaactgatactctattgctctattcaaattgtgcttttttgtctaagaaataaaatagttgtgaaaaaaaaaaaaaagggcggccgcccgcttttttttttttttaatgttcaatattttattgaaaaaagaattaaattataaaagataagctacttgatttatttttcaccaccttcagatgcaggcatggatctaatgatatcactgtctccgggatctgtaatggacatagcgcacaccctgaagtattttccgcatgctgtgcctagctctacattatttccagaataatggtggactccagttttagccaacatagcgtagtattcaatttcggatttccttaggggaggagtgttgttagaaatgataataagttttgatttaccttgtctcaatgtttttaaggtctgcttgtatcccagacaatatttgccagatttcattaccaaagccaaacggctgttgatactttcaatcgccttcttctgtttcttttgggcaaccattttactgatttataaattgcaaagtgctgaaaatacagcaaatctttaatgagaaagaacttcgaaccacacttttcaatgagcgctcgtgccgaataggcatagagtatctgttgtgttatttaaaatataaactatgctataaaaaattacaacaaattttacgatggacattggataatacatctaccaaacttacttatgtcaattgtatacaatatatagagcgctttatcatctcataataaatgacatagatacaatacaatctatacattcaaactatcatctacaataattatacatctacagtttacaaaatcagatcaatacaattaactctaaggtaattccata

SEQ ID NO: 1141 - DNA, 2142 bp, Diabrotica virgifera
cttagacaaaaaagcacaatttgaatagagcaatagagtatcagttgggttatttaaaaaataaactatgctataaaaaattacaccaaattttacgatctacattggacaatacatctaccaaacttacttaaatcaattgtatacaacatatagatcgttttatcctctcataataaattacataggtacaataaaatctatacattcaaactatcatctacgataattattcaagcgcccggaaccggccgcaccccgccccacacgtactaaagaaagaagtacaagtacagtgatcagtggtctgcgaaacatcgaggttcagaatgccagaaacaacatcgacaaatggatattcaaacggccattccggctacgaaatggcggatggtgctgaatttctcttcacatccgaatccgtcggagagggacatccagataaaatgtgtgatcaaatcagtgacgccatcttagacgcacatcttgaacaagacccaaatgcaaaagttgcctgtgaaaccgttgcaaaaactggaatgattcttctcgccggtgaaattacatcaaaagctgtggtcgactatcaaaaagttgtcagacaaactgtaaagcacataggatatgacgactcttcaaaaggatttgaccacaagacatgcaacgttttattggcattggatcagcagtctccagacattgctgctggagtgcacataaacaaaaacgaggaagaaattggagctggtgaccagggtcttatgttcggttatgccacggatgaaacagaagaatgtatgccacttacagtagtattagcacacagattgaatcacaaaattgctgatttgagacgatctggagaattctggtgggccagaccagactcaaaaacacaggttaccgcagaatacactttccaacgtggcgcttgcattccacaaagagttcacacagttgttgtttcgctccaacacagcgacaaaatcagcttggaagaattgagaaccgaaatcaaggaaaaagttattaaagaagtaattccagccaaatacctcgatgaccaaacagtcattcacatcaatccatgcggtctcttcatcatcggaggacctcagagtgacgcaggcctaactggtagaaaaatcattgtagacacttatggaggttggggagcacatggaggtggcgctttctctggaaaagattttacaaaagttgacagatctgccgcttacgcagctagatgggtagctaaatcattggttaaagcaggactttgccgaagatgcttagtgcaagtatcatacgctattggtttagccgaacccctttccattacagtatttgattatggaacttcaaaactcactcaaaaggaattgttggacattgtaaacaagaacttcgatttaaggcctggtaaaattgtcaaagaattaaatctgagacaacccatctaccaaaagaccagcacctatggccacttcggacgggacggttttacgtgggaacagcccaaaacactacaactaaactgacaaccttccgtaacaatattttagaaatcttttattgacgcactagatgcctccttctagattttaagtttagaaaaaacttctgtgattggcgctctgaaccttgagaccgacgcgattttttgcctctctgaatcggaaacattctacagagcaaagtatcgcgtactaacaagtaactgtcgcaaaacgtgcccacagattcccgatatagaccacagtggcgtttcaagcgttactgcaattcagtgtgagtcaaacgttcagtttcaagttagatattactcgcacattgtgttgtgtttaagagaaaaaataatttggaaaagagcatttctataaacactccggactgtattgggaatggtggtcatccatgcatgaaaagttcttgcaaaaaaaaataattatatatttatgtattttatacaactcatcagtgtcccctggttggaaattatattttattctaattttttacctactctacattccttttttttttaaaataaaaagttacattgcttggcacatgaatttcatacaactactcaaatgttcacctgatggtaaaatatatattaatactaaatttattaac

SEQ ID NO: 1142 - DNA, 1089 bp, Diabrotica virgifera
  misc_feature (1051)..(1051): n is a, c, g, or t
ggacatttcgatactaaacgcctttttataacaagagagtaaaccgctctcctattattgtcttacatataaaccaacttatataattttcataatatttgagtttgttaaatttctaaaaaattatttatttttaggcaccttaaacgcaatcagtgatggaatgcaatatggatggactgctccagtgttacccattctccttggtccggactcgcctgtgccaattacagaatgggaaggtgaaatgttggaaactttcttatgggtaggatcgttgtcgtgcctaccattaactatgtatcttgttgacaaaataggaagaaaaaattcgattttattagcagcagtactaacactaacagtgtgggtcattacagctttagctccgtctgtagaatacctgtatgttgcgaggtttttagcaggaacggctagtaatacagcttatgtctcaactcctatgtatatagctgaaatagctgaacaaaaaattcgaggatttttgagcagtcttatttacctcatgatgttactcggtatatttttgatttatgctgtagcaccctatattccttattacgcccactgcactctaggtgcaattttggcttgtttagaacttggtatctttccatttatgccagaaagtccttatttcttagtttttaaaggaaaacatgaagaagctaaaaagtctttagaatggttaaggcctgagggtgccgatgtggaaactgagcttaatgaaattaatgcagcaattgaaagacaaaagacagaaaaagataaaatttgggatttgtttatagtacctagttatagaaaaggaattattattatgtttgttttaaatggtgctcaacatttcagtagcataagtgtactgttaatgaatttgcatattattttggaggctgctggatcaacatatatagatccagctaccgctggaatattatttgcctttatactactgttagctgctacagtagcttcggtttcagttgataatatggcagaagactctcttaatttcgtcagttattanctggtatatgtctttttatactagcagtttacttactg

SEQ ID NO: 1143 - DNA, 1757 bp, Diabrotica virgifera
gataagcagagcttaaagtttatttcgcaaaatttagaatgtcttataattaagagtataatagaaatattttggaaaacattttacataagaaattttcgtattattgatatatagcgtttttgtatgattatataataatatcgtatggtatttttaccggggtgatcctttcggacagcttccggtcaattgcagctttaaccctgtttcaagtagctagtgtcaatgcacactagcccaaggggaccgacggcttttcgtgtcctccgaagtacggtgcacggctcgtatcatttgtagaaatgaaaatgtcgttggtgccgagatttgaacgataagcttatttctgtgtcatattaggtccccctaacattggcgctaagcagaatttaaaatattatgttgtgtagcgtactttttaccaaaagcacaatgttaataatgtcatggtagatcggggaaggacccatttgggagccctttagacattctaaggcgggtcagttgtgtcgctcctatcgcccagactatgcccataagaacatactcttcgccgtttctggggtccaggctatttcgagctcccatatctgctagaaccagcagggtctctaaatatgagctctttcgtgccgttcctcacgtctaatgctttaataaacttgtggtctcacagaaagccacaattatttagaggtaactccttcattgagctcggttgcgtaaaggtcgaatccaggatctttcacctctgaccaatcagacaatgctatcttgcattcaagaatcaacttagagctgacttgcttgggtgcttccagagcctttagaggtgcttgactgttcgaacagatataaatggatctatctggacaagccctatcattaatttgtctgaatacaatccttttacagttaaaataatacatcctgtaatgtcgcattactgtgtccaaaatgttgcttttggcaacattgtggatattttcgggtaatttatcacagctcgttcaatcctaattcatcatttaatgaaaatcttctgattttataataatttaaataaataatattgttataatattacggcgtattttgactcataaaaaacaaatatgagaatcataattcatcagcaatatgttctacattttcaaggttatttgccaacaggtgacctaaaaagctaaaaataatttttcattttaaataaaaatacttgaatattgtttgctatactattcctactgtggatacaacaaaaatgcttgattcttgacttttgtcacattgaaaccaataccaaaacaaataatatttttaaacaatcaatccaacaaacgaaaaaaccatcaaaaccatcgaggtacactattttaaacatactgatctttttatggttcatataaaaaatgctctatatcattaatgcgaaatcttacagtaaataattatagtgcctgaagctgggaagaaagggtatgaagagaaaagcatgaaatgctgggatttttagagattatgtaaaaatttagtcatataagagtagttctaagaatccatgtgttgatactataagatttattaagaaatatatatcatagctgagaaaaaaaaaaaaaaaaaaaaaaaaaaaaaaaaaaaaaaaaaaaaaaaaaaaaaaaaaaaaaaaaaaaaaaaaaaaaaaaaaagaagaagaaaaaaaaaaaagaaaagaatcacaaaaatacaaaaaaaaggggacggataacacc

SEQ ID NO: 1144 - DNA, 1385 bp, Diabrotica virgifera
  misc_feature (1211)..(1211): n is a, c, g, or t
  misc_feature (1288)..(1288): n is a, c, g, or t
  misc_feature (1291)..(1291): n is a, c, g, or t
  misc_feature (1313)..(1313): n is a, c, g, or t
  misc_feature (1319)..(1319): n is a, c, g, or t
  misc_feature (1334)..(1334): n is a, c, g, or t
  misc_feature (1341)..(1341): n is a, c, g, or t
agactcataatgcattaacggtcaatagtattcttaaaataatagtgcaatggattcgccaatagtagaagtaaccgaaggacaattacgaggatgtttgagaaaggatcatgcaggtcaagaaatatttgctttccttggtgttccgtacgcccaacctcccataaattcgctaaggtttaaagcaccagaacctgtcaagcattggggaggtataaaagatgccaataaggaaggagatccatgttattcaagaaatttttttaccgagagtatctaggttctgaggactgtctttatttaaatgtttttacaagagagttgcccaatgtatcgaaaaaactaaaaccagtcatggtatggattcatggtggaggttatatatcagactcttcgtgtgtagatatcttcggtcctgattttctgattacagaagacatagtttttgtttctatgaattaccgtttgggtctattaggatttttagctttggatgacactactttggaagttcctggtaatgcaggcctgaaagaccagaacttggctctacaatggataaaacgaaatattgaacattttaatggagaccctaacaacataacgttatttggcaacagtgccggagcctctagtgtccactttcatattttatcagataaaagtgctggattatttcataaagctattttgcagagcggtactgtcttcaatccctggaactgggggcgaaacgatatcaacgaaattctattgaaagcgggtaaagtggtacaaagtgaacaagaggcgttggaaattttaaacgatatgccttataaagagctctacaaaatacaagaaaaactccacgattcaatatgtgcaaatctttatagaccagttggacctgtaatagaaaaacctaataagagtgctttcattacccgcagcccaattgaaatatttagatcaggaaattactataaagtgccaatgatttttggtactaataagactgaaggaatgtttgtggaatataacgaactaatatttccccgattcaagccacctaccatgtcaatagaaaatgcaataccatgggatttgcagctacaagagggtagtgcaaaatataatgaagttaaaaagaaattgcaagattactactcagcaccaacaagacataatgacaaatatttgcccttctcaacttctttgtattttcttgngatagtagctgctgtggaaaaccatgttaaaacatccgatgtgccagtttatttttataaatttgtttttgaagganggntctcatgcgtgaagatagcaanaggttnaagtcatttacctgnaacatgncatgccgatgaagtagctttatgtgtaaaaaataaatttttatc

SEQ ID NO: 1145 - DNA, 1070 bp, Diabrotica virgifera
cccacgcgtccgccaatatctgtgattaaaaaaaatattccaaacaagatgaaaacagtttcagttataacattttttgtgtgtattggtcttgcgctatcagcaacacttttcaactcagaaaacattccaacaccagatagagatgagccaagctgtgaagtttgccttctggttgtgaattttgtcaaaggttacaagaatagaggctttagcaagaacgacattaaacaagaaaaagaccatgtatgtaatctcttcttacccgatctgaaagaaatttgcttgcaatcttatgaggacgatgttgattttgtttatgctgaagatgatgataaaacggtcgcagaaatgtgcttagatatgaaacagtgtacttctaagaaaaactaataattaaattttgtttgtagtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatttcccaacccatttttttttttccccccccaaaaaaaaaaaaagtgtgtgtccccccccaaaaaaaacacccccccccccccatgtttttttttttttttcccccccaaaaaaaggcgcctccttttgggtggttttggggggcccccccctcttttttttttttaggggccccccccctcccaaaaaaaaatttataaaaaaaaattttataaaaaaagggttttttattttcccgccgggccaacttaaaaaaaaaaaatttcttttatgcttttgaaaaaaaacacttctggggaaaaaagaaaagggggggtaggtaagcagaaaaacacatacacaccccccctcccctgtttttatttttaaaaaaaaaaaagagaaatgggcccctccccccccccccccccccgcccccccaacataaaaaataattaaaaaaaaaaaaataaaaacaccccccgccccccccctcccacacaaaacaattaaaatttttttt

SEQ ID NO: 1146 - DNA, 1147 bp, Diabrotica virgifera
gttgcgttttcctctaatccacagaatgccttacagacagagttaagttcatatccaggagttccaggatatgatgacgatttacctgaaagcgaattatttcttaattctgtatcattggaggagcgagaagaattctaccccatcataaagtttttaagcgacttccatgtaacaccagaacaaatagaagaactgcttcaaccagaaaatagggataaactaggacttttgatagaggttcttttgactaaagcaaaacagaaagacatacaggatcaattaagagaagagctagagagagaaaaggaaatcgatgatgtaggtgtagacgaacaagattttaacaatggtgatgaaggggtgtggggaccaccgatagattttccagaatctagaatatattatgatgaaaacgatgaagaccacgaaaactccgagtctggcagtggttatcctgttaattcagaattttttcgagagagacaattaagaaacgacaacgtgtacgaggagctgaataatatggtagacgatagaccaggggtgtattcagaaggaggtgttgtatggtcagagcctgtcaatatgaaagaaaatgttcctcaacatcgactattgaaaaataacttaaaccaaattctacagaagtataaggctttcaaaagacccgaaagattggatgtgaaaaaacctggaccaccatttgactcattaacggaaatcaacgaaaacaaaggtaaaatcgaaccacgcactaaacccaaagacatactcttaccatcgatgatgaagaaggaacctcgcggtgctcatccatatcctgacatggaaccaccccaacagagacgagacgccgatctggaatatgtttatgtaactctcaaaaatatcttaacatcgtggagccaaggaaataatatcatccagaacattttcgaacatcttgaaattagatcccaaagtttttgcggatgggaggaacttttggcttggattcctggtagcccttccaaggttcctaccaaaataagccgagggattaaaaatgggtacctgaaagttggcaaaattgttggaggagaatggaaagggcaaaccggaaacaaacaactgggggttgaaaaaatatttattggaggggggg

SEQ ID NO: 1147 - DNA, 1741 bp, Diabrotica virgifera
aaatgaaatgagagttgtactatgaatttttaatttgtttttaatgttctgttaaccatcttttcgattatccgtcatatccttagtccggtgccctgacggataatcgaggttttactgtatttcctatattttgtttttttatctctctatgttattttttaactaatagctatttaacactttccacaaagtatttattattgagttaacattgatcgactcacagcctgagtaaaatgggtaccttgggtaaaaccacaggtaataatagacagttgaaaccactggcccttacctcccttgtatactgtttgtcaatgacctacccgatcatattactcatgaccacattgtaatgtacgcagatgactcatctgtgattgtatcagcacatacatacgtagagcttcaaaatagagtgtcaagggttatcagattattccaaacatggtgtacacaaaacttgctacaactgaatattgataaaacatcgtatatacattttagatgcaaacgaaatatgccagttgtgtctattcctgaaattgtaaatgttccaaacataaaatttttaggtgtattcttggaccagttatgagtttgggatgttcacgttgaatatgttaataagaaactaaattgttcattctatggctttagtacagttgaagagaacactcaatattaaaactctcattaatgtatattattttctttgggttaattgtcaccttacttataatggtacggttattgggggtaattccacaaaatcggccacagtgtttattttgaagaagagaattattagacttatctttactttttccttttgggcatacttgtaagcaagttttcattaataacaatatcttaccgttgccttcaatatatatcttgaaatcacatattgtatattaagcataatttacattcattcaagagaaattcttgattacatgcatactcaactaggaatgccaatcagtttgttactgttggtcacaaactatccaaatttgagaagtccacagattatgtgggggtcaggctatataatcatcttccaaatgaagttagatctttgcatccggtgaaattcaaaagagttgtgaaaagtatactatgtaaacatgcattctacagtgtagaagaatacttagcaactagattgctgttatgagttctgtctaatattaataattttcatatttatcaatgtacattatgttaaatctaaaatttaagtgtatgtataggtatttgattatgtgtctgtgactatattgtgttgtatatctgacgtgtatatccatctttatgatggcagctgtaaagctataccaataaagtattctattctattctattcattcaaaatcactcattctattcgttctaacagctctattgcaccagaaactcgtactcgaacagaagtttcacctaacacaggttggcgcagttgccacaatgatctcaatgtataatccctatgttcagcagaacgatttacgtactgtatattaaaaacagttacagtcggaaaaatgaaagaacacccatgaacgatcacaccaatcacccactttgcatttgctatccttttctataacaaacgtttgttatttatagaaaaagacagcaaatacaaaataagtgattgatgcgatcgctcatgggcactccctcacctttccgactgtagagaggaaacaattacggattggcactttat

SEQ ID NO: 1148 - DNA, 1131 bp, Diabrotica virgifera
gttaacgccatctcttttccattttctagctcgtagagggcaaaatggtccaacgattagtctttagaagacggttgtcttacaacacaaaatccaacaggaggcgaattgtccgcactcctggtggtaaactcgtatatcaatacctgaaaaaacccaagaagatccccagatgcggtcaatgcaaagacaaacttagaggtattctccctgccaggccccaagaaaggtcaagattgtgcagaaggaagaagactgttaagagggcgtacggtggtgtcctatgccacaagtgtgttaaagaaaagattgttcgagctttcttgattgaagaacagaagatcgtagtgaaagttcttaaagcccaacaagctgtagttaaaccatctaagaaatagagcttaataaatgtttaatttttacaaaaaaaaaaaaaaaaaaaaaaaaaaaaaaaaaaaaaaaaaaccaaaaaaaaaaaaaaaaaaaaaaaaaaaaaaaaaaaaaaaaaaaaaaaaaaaaaaaaaaaaagaaaaaaaaaaaaaaaaaaaaaaaaaagagaaaaagaaaaaaaggggggggccccttaaaagaaccaagttttaaaacgggggggggggaaggaaatgttttttttaaggggcccccaaaattaatttccggggcggggttttaaaaacgcggggggggaaaaaccccgggggtaccccatttaattcccttttgaaaccccccccccttttcccccgtggggaaaaaaaaaaaaaggcccgcccccatcccctcccccaaaatttgccaaccccttaattgggaaagggaggcccccccttgaccggccactttaaaggggggggggggggggggggtttatggcagggggggggcctttaattttgcgggggcccctaagcccccctctttttttctttttttttttttctttttttttttccccccgtttccggggtttttccccgcccaaattttaaaaaaagggggggttccctttttaggtttccctttttttggggttttcccccccccccccccccccccaaaaaaatttttttattaggggggtggggtttccccgggggggggcccccccccccccaaaaaaaaaaaggtttt

SEQ ID NO: 1149 - DNA, 889 bp, Diabrotica virgifera
attaatcaacaaatcaatccaatcaaaaagcaaaaataaactaataagtatggttttcaattttcagatagaaaacaaagaatataaagtgtgattcattagttttttattcttattatttgaaaataatgcttcaataataatagcaatttggcatttctatcctttaacaatgggtttcattggaggaattttgaaatttttagtcaatagacttttggaattgtctattgtggtggttataatcttgttcattccaaatttaccaccttacagtcagtttacaaaatcagtaaagttacctcctcctcatcctttgaaaggatctctatctctaaaccagaaattaaataatgttgaaataaagtatcaaggaagattgtcgggtccagaatcattttcagaatatgacggtgaactatatacaggattaaatagtggagacattgtgaaattaacggggaatcatatatcacccattgctaagaccggtaaaccttgtaaagcacaatatgaggagagaatttgtggaagacctttaggtttaaagtttcacaaaggacttctgtatgtagctgatgcatattatggtatcttgtctattaacattaacaatggcaagaaaaaggtcttggtttcaccagatcaaataatcgatggcaaacagtccaaatggtttaatggtatagctgtggccaaaaatggtgatatcttttggacagattcctcaagcacatttcatctggagaatggattatttgagctgttgtcggatccatctggtaggttagttcattatgatgctaaaacaaaaatgaacacagtgcttatcgaccaaattcacgcagctaatggtgtagctctatctgatgatgaagatttcgtttta

SEQ ID NO: 1150 - DNA, 1092 bp, Diabrotica virgifera
  misc_feature (1024)..(1024): n is a, c, g, or t
aaccaatgtaggtaaatacgagaaacatactcaccgagaaaaaccttgttacaatagtaattgatacacattctgacgtttacaaagttgtaaagaagagatgaataatctttcttcaaaatacatattagtatttgtataataacctgtggtatcagttattagtgtgtgtaaaaatagttcatgttaaattaaaaacaaaaaattgtcctgtgactacttacgaatacttacttagaaaattagaatagttaagaaatcgcaaagatggaaatgaccaaagagaaatataatcccaatccacgggagactgcgaatattctatcggctctattttttggatatacgtatgatgtatttaagaagggcttatcgaagacgctggaagttgacgatttatataatccgttaaagagtgacagaagcaaagtcttgggagataatttacaaagaaattgggacaagcaactagaaaaatctaagaaatcaaattccaaaccaagtttattgaaagccattgttatgtcattttggttggagtacgcaaagctaggaatatatactatcacgacagatttagtgctaagactcattcaacctctaatacttggaaacctattggattattttaaacctgaagcacaagtttccaaaaatgaggctcttacgtatgcaggtatcctagtggctataaacatcttgaacattttgatgtcaaatcaatatatgctagaggtttttcacagtggcatgaggataagagcatcttgttgtgctgtgatatacagaaagtcattaaaattgagcaaaacagccttgggagaaacagcatcagggaaactggtcaacctattatccaacgatgtcagtagatttgatctcgtcagcttattcattcaccaattatggatcgcacctgtattgtcacttatagtaatgggtatactgtaccagagaactggatatgctggagtagttggggttgtggcagtatttgtgatagttccctttcaaacctacaccnggaaaatatctggcatatacagaaaacagactgctttcaaacagacgagagagtcagactaatggacg

SEQ ID NO: 1151 - DNA, 1379 bp, Diabrotica virgifera
  misc_feature (97)..(98): n is a, c, g, or t
  misc_feature (403)..(404): n is a, c, g, or t
  misc_feature (1371)..(1378): n is a, c, g, or t
cctttccgcgcgaccgcactgacagcctgatgaggaccttacaaacgctggtgcgctataatccatctccagttattccggagagaacgtatcatgnnttgcgcactatatgttgtcttgtttagtacgctaacgagatgaagagaacatgataatagacttgttgcgttatttaattattgtaccactgtcattcaatccgttaattactaggtaatagaaagataatctctgtgagtttgaattgtgtagttagttaatacctctgacgagaaacacggttagattattctcaaagcatgtattactgaacgttagatgttgatgtgtatacctattctcatggtatcttgttcctcagagataatccatgtcagagagaaaccacatgatgacacttgtnntttttaaatcagatacaaatctattgtaattaagtctcacactagtccttctatactaactatttgcgttcacactttattattacatcatctgcataacacaatgaatcatgcatttatatatctattgcgccgaattaccatcccgacgagtaatatatccagatattcattatctgatatatatgaacgcatttacgatataataggccgcccttttttttttttttgatgtccatagctgtacgtgttagcctaaagtgtagtcatagctttggcaaaaaacatccccgttttcaacactgacgaaacttctatttaatagacagacggtgatgctttttgactttagcagataagaatgttatacagggttaacaaaaatgagaatactacgtctgatatatcctgtaacacacaaaatactttaaagctcagttacacgatgctaataacttgttttactggaatataaaacaccaatttacacaaggagagtactaaaagtcagtacatactcggttttagtgactcacaagtgttactagcatggtgtaactgagcctttatcctggcattccaattactggacaatgctatcatataaataccatgccatctaaataggtaatctacttgttagtcctaagagtttatcactatttaagtaaacgatgaattgaattggctgttttgtgttacaaggctagtaagttttctcttttcgagtcaaccctgtagtatctcctttttattttagtcatgaatcatcatctcagcacgaagcttgttgggcaagtgtctgccggttttcggtggattcggtccatcgaaataggcagactttgtgtcctattgttgtagagtattatattataatgtagattggttctgttgtaagaagggaacagcaaaattatgttgaaaataaataatttgtacattccattatatctctgttttatcnnnnnnnna

SEQ ID NO: 1152 - DNA, 1268 bp, Diabrotica virgifera
gggattctttaactgcttaaagagggaacctgaaactaattacatgagatccctctttatgttcgattcagatcaaccttttgacaaagatagcgcattttataagtctcaattgagtaaacagatggcagtaaatatctggaaagataatcaatggggtacttacagacatctcgttttaaaaaatctggacaacgttgaatctgagcactgttatgcaaatatcaccgttcgaggagatctttccagtctaagatggatcgagagcacttacaaatacgacatggttctacctactgagaagtcattggtgtacattcactatgcttccctgaactttcgagatgtaatgacagcttcgggaagaataaacgccgatgtaataacacaagataggattgagcaggaattcgttcaaggatttgagttttcaggatacactgcagaaggtaagagagttatgggattggtaacacacggcgctctggctaccttaatgttggctgatgattatttgctctttgaagtgcctgataatatgtctttacaagatgcagcatcaatgacatgtgtatattcttctgttatatacggattggtaacgagggcaaatatgaaaagaggttcgagcatactgattcactctggaacaggcggcgttggtcaatcagccattagattggcgttagattttcgctgtaatatatttgtcacggtagggacgaaggaaaaacgagaatacttacttaaaacattcccacaaattaaaccacaccagataggtaattcacgtgatatttcctttgaaaccatggtaaagaaatatacgggtggtagaggtgtagacgtggttctcaattcactagcggaagaaaaacttcaagcttcgattagatgtttggcacccggaggtagtttcgtagagataggaaaattcgatttggctaacaataacgaaatcaatcttttacttatgcaaaaggaatgtagttttcacggagtcatgttggatcaaatttttactgaaactccgaagacaaaaaaggaagtagctaggtttttttgaagaaaatgttggtgagggtaaatttattgttcctctaccaataacttgctttagatatgatcagttggaagaagcctttagacacatggctaccggtaacacatgggaaaaagtatgataaagtacgagacgtggagcaacgcctcacccagtcctgagaagttagaggaataccaatattttgctaccccataaaactata

SEQ ID NO: 1153 - DNA, 745 bp, Diabrotica virgifera
cggacgcgtgggatttttcgttgaaaaagatagggctccaaagtcctattgccaacaaaaaaacaacgcaagacattaaacaacttttttcaagcccatctgtatttaaaaaaacagtgcaaaatgtttctgtgggactggtttacgggaatgctgggatatctaggattgtggaagaaatctggaaaactattattcttaggactggataacgcaggcaaaactacccttctacatatgctcaaggatgacagactggcccagcatcttcccacgttacatcccacatcagaggagctttccattggtaacatgaggtttacgacgttcgatttggggggccacgagcaggctaggagagtgtggagggactactttccagcagtcgatgccatagtgttccttgttgatgccaacgacagctcaagatttgtagaaagccaggaacagctaaatgccctcctctcagacgaaactctatcaaactgtccaatacttatcttaggtaataaaattgatctcccaggtgctgcttcggaagatgaattacgaactagattcggcttgtttggccaaaccacaggcaaaggcaaagtagccagaaatgatctacccggtaggcctctagaactatttatgtgctctatactcaaaagacaaggtaatggagaaggtttccgttgtttggcacaatatatcgattaattatgtatttttccatttcggtctgtcattgagttaagat

SEQ ID NO: 1154 - DNA, 992 bp, Diabrotica virgifera
gaagtcgggcgcaattgattttcctgaagttttctgttggaggttggagccatacagccggcgctttagacacgtttttcgcgctttagtctgtgttacctctagagtgttctgtaattacaaaaatgggtagaacaggggatgaatctgacgatggaattcttggtgtgagcgagttcacaaaaaacaagaacatctggaaggcacttctcgccgaatgcctaggaacattcctcctggtattcataggatgcggttcctgtataaatatgatcgaaggagatggtggggcaattattaaaatttccttcgcgtttggtctgacgatagccactgttgttcaggcgatagctcatgttagtggaggccacattaatcctgccgtcactttcagctttgtttgtactggagatgttaagatcgttaaaggcttgtgttacttagttgttcaatgtattggagctattggaggatctggtttattgaagttggttgttcctgactctaaagttggagggtttggactcaccgatacccacgatagcttatctgacgtacaaggaatggttatggaagctgctttgacgttcatgttcctacttgtcatccaaggagtttgcgatgcctaccgaaaagacttgaagggatctggtcctttggctattggattagctgcagtcgcttgccatttgactggaattccatacacgggatcaagtatcaaccccgctcgttcctttggaccagctgtaatcatgaaccattggcatcatcactggatctactgggttggtcctctgcttggaggaggtctcgctggggttatctacaagatcttatttaaagtacgaaaagacgaatcatacgacttataaatttaatactcatcaataattttagttcttaactacgtaattttttgttaattataaataattttaatttaattaaataatactaacaaaactttaaaacaaattaaataaataaaa

SEQ ID NO: 1155 - DNA, 1987 bp, Diabrotica virgifera
ggcgaaggctagaggtggtggtactttggctcaatctcagtaagctctgcatcatattgcgtttgatagtgaaacgtggtagacggtgaggcgatagtgataaggaagacggcggacacgctaagtaaagatgataagacattatatcttgggctgcgttttagcaagctccttaatccttttggtaagctccttcagaggtgacgactttgctgatctcccaggtccttattgtgaaaacattggatgctgcaacaatagattagattcttgctcagtgcctattttgggtacattatgttactgcgacgagttttgtaactctagtagagtggatgactgttgcccagattactggtcgcactgtagaggtataactttcccaactacagaacgaacacgtccaacacccccacaacccccagagaacataaccggatgtcagtggggcgacagaaccctcttccttaaccaaaaagttaaggataactgcaatgaatgtacatgtgccagacaatccgaactcttgtgcgaaagaaatgtatgtcttgttgaccaaaacatcattgaaactgtaaacagaaatccagatgagtttggatggacggctcaaaactattccgaattttggggaagaactttagacgatggagtccaattcagattagggacacttccacctcagcgttttgtaatgacaatgaatcccgtcaaaagaatttacgatccaaactcactccccagagatttcgactccaattcagtctggcgtggtttaatcactggcattcaagatcagggatggtgtggatcgtcttgggctatctcaacagctgctgttgcatctgacaggtatggtatcgtgtctaaaggaaaagaagcagttacgctcagtgctcaaaacttagtctcctgtgatactcaaggacaacaaagctgcactggtggtcatcttgatagagcgtggtcatttactaaagcttacggtcttgtagatgaagactgtttcccctacgtggccagaaacgaaagatgcacaatcaaacgaagaggaactctagaggcggctggctgccggcaacaacgatttgctgaaagaagaggaagatacaccgtaggacctgcctacagattaggaaacgagactgatatcatgtatgaaattactagatctggtccagttcaagctacaatgaaagtttatcacgatctgtttacatacagcggaggaatatacaaacactcagatttggctgtcaaccacaaacaaggttaccattctgtaaggattgttggatggggtgaagaatataactacagaggagttcaaaagtactggaaagtagccaacagttggggtgccaactggggagaagacggatatttcagaatcgtaagaggaaccaacgaatgtgaaattgagtcgtttgttatcgcttcctggccacacgtatctagaaagattttattgtcaaacgaattgggaacaaactcagtatattaagcaaaaatatgttgtagaccgttttaatatctcatgacgaatatcatcacaacgatgtttgcattcatgtttttattgtacaccaaaaatctttgtaaattccgtgagattcataaactgatctacttttattcaagctttactgttatttgtgaaaatttatacttaccaaatatttttagtgttactaaaatgccatacaaaccattataacaaagtacttaagcaacgatggtgaaattgttttatttcattcattacttttattataagatttataagttcgtagtacctaatgtatttgtcaaaaaattgttatgccaaaagatcttacagctcgtactgttacacagtattgtgatttttgacagtttgttcgaatattaggattaggtttcttatctgatttttgtatgtagtgtcattttgtattattaataaatgctataagcgtcaagaataaaaaaaaataggtgacacgct

SEQ ID NO: 1156 - DNA, 1286 bp, Diabrotica virgifera
ccctcggacgcgcattgttttttgtgacagatatcaacctataaggttggtgtgttctttatcgcatgagagaaatgctgtagacaaataaacaatgcctccccgagttcttctacattcacatcatgaccacctcgaacatcaggattctgaaggaaatgccaccttagctaaggctacagctatgtgcgtcctcttcacagcctcattcatcataggaaacataccaatcaagttaaaccaatggctcaattggagctcagatgccaaaagtaactcctacgtcaaacttttactcggtttgggcggaggtgtcctcctgtgtaccactttcattcatttactgccggaagtaagtgaacactttgaggagttggacctaactccaaacatcgaaatacactatgcagaagtattgatgtgtattgggttcttcataatgtatctcgttgaagaatgtgtccatgtttatttggaatacaaggagaaacctccagatatgaagatacctctagaaccagttgatgtggatttgggtttggctttaaaacgaagtatttccatcagaaggggagagatccctgacataaagaaaattcgtcaagagttggctgtagaagctgaacaccacggaagacactctcattcccatggtcattcgcatacacctgtccatggtggaggctcaacagtcgctataataagaggactactagtggtactagctctttcagtacacgaactctttgaaggtctagctgtcggcttagaaagctcgcctagtacagtgtggtatatgtttggggcagtagctgcgcataagttagtgatcgccttttgcatcggtgtagaactagtaacatcgggtttaaaaaacgtatctagtgattgtttacgtatttatgtttgctgttgtgagccgggctggaataggaatgggaatattggcccccgaaatgacagctccccaactacattaatatctgggatttaaagggttttggccccagacttttggatagagggggttttttttgaaatttcctacgggggaaaaaaaaaagggagactataaaaaattcggggggtattctccccccattttttttattttttgtttgtagtcaaaacgaaaaaaaaataaaaaggtaaaagtggaaattaaaaagatttaaaaaaaagagcgaaaaaaaaaaaaaaaaaaaaaaaaaaagagaggggggggggcgcctatggagggagggcaaaccttttatagccgggggggggggggggtgggcgggccg

SEQ ID NO: 1157 - DNA, 1445 bp, Diabrotica virgifera
ataccttccagtggattgtcgtcggaaatttatgtgggggtgaaaatagaaatacagaaaaaactcgtcttagaaaaggtgtacatatcctaattgccacacccggaagacttttggatcacatgttgcatacgaatgcgttcaaaaccaacaatgttagatgtttaatcttagatgaagccgatcgtttgctcgatatgggatttaaaaaggatattgtgagaatggttgaagagttggataacgcaaaaacaaatgccgaatacaacccgctagcgttactaaagaaaaaatcttttactgataacgaggatgatgatgttatagaaactacagaaactgaaaacacctcccaaaaaatgcccctaggagatcctagtagtaaagtcagacaaacggtactcttatctgctacgcttaataaaggtatagcagaattggcagatttcacgatgaaggaccatgtgtatattgatgctttggacgaatttaccactcagaatccggagatgatggttatacctaacactgtgcagcaaaagtttattgtaacgcatgtcaaacatcggttatttacgttgtcggctctgattttgtcacaagcgaaaacgaattcaaaggtgtttgtttttatgggcacgagtatggtcgattaccactacgaactcttcaccagatatttgataaaaatgccaagacacagaggacaactggcaaataatcaagtaatggtactcgaagaagacgaagatagcgacgatgaggaaatagtcgcagacgtagaaatcttcaagcttcacggcaacatggaccataagtgccagaaagcaggtctttaccagttttagagctgccaaaaagggtgttttgttatgcacggacgtagtagccagaggcatagacgtaccagcagctgattgtattgtccaatacaacggtcctcaaagcatcgaagactaccttcatagagctggaagaactggacgagctggaaaatcaggcacgtcttatatattcttaacgcacgaagaacaggatttcgtcaccgaaatggagaagcacagagtttatttacagaaacaagacacggagaggattttagaaagcttgagtgacataatggaagaacctgacttcaaaaaagctgccacggctcttcaaaagcgctttgaaagcgcttgaaaaaaagataaagaacttcatcgagcagcatgtagcgcttactcatcttgatctcgattttacaacacctattccattaaaatgagaccaatatgcgactttaaaaaggccaatttgggatactatgtaactagtttcgcgataaaggaaatcccagcagcggtagcgaggatcggtgaaaggacaattctcgtaaaaggaagctccaagactgaataaagaagcttgcaaatcacgaagatgatgctccaccaccgaaagcg

SEQ ID NO: 1158 - DNA, 421 bp, Diabrotica virgifera
ccgggccgacccaaacgtcagtttttttttttttttttttttttctatattggattttattgaaaaatacaattattaatgttacatacatcccgccacaaatggagaaacggaaataaaatagtgatattgcaattaccagaaagaaacataattaggtacatcgatttaatatttattataatttttaaactagatacatacaatttaaggcagaaaacagtcacaagagagacttcactgtttccgctatgcatggtgatatggaacaaagagagcgtgacgttattatgcgtcagttcagaacaggatcatctagggttttaataaccactgatctgttagcgagaggtatagatgtacaacaagtttccctagttattaattatgatttgccttctaatagagaaattacattcac

SEQ ID NO: 1159 - DNA, 1518 bp, Diabrotica virgifera
agctatacgcggagtagacatgtctatgccagatcgtcgtgaagagtgggacaagaatggcccagctaatgaagacagccagccccaaggctatgacggcccaccaggtatggagcctgatggcattattgaatccaactgggaagaggtggtcgataatttcgacgacatgaacctaaaagaggaacttttaagaggaatttatgcctatggttttgaattaccttctgctatccaacagagagtcatcattccttgagtattggaaatctatggtattgatctgtatcatacaagttcagtaaaaattgattttttcttaatctctattataaacaattttcatattttaaagatatgatattatttatttttatatattattatttttattttttataaattttttattaaagtataaatttaaataatttaaatttagtcatgatgatgatattagtattaaaaagttgtatatttagtaaaatatataggagtaatagagactggcgacaagattttttttcatatgcctggtagagtctacgatatgataacgaggagatacataaggccgactcatattaaaatgtttgttttggatgaggctgatgaaatgttgtcaaggggttttaaagatcaaattcatgacgtgttaaaatgttgaacactgacgtacaggtaattttactttcggctaccatgccaaacgatgtgctagacgtgacaaaatcctttatgaggagtcctgttcggatacttgtcaaaaaagaggaacttaccttagaaggtattaaacaattttatgtatatgtagaaaaagaagattggaaattagagacattatgtgatctctatgatactctttcgattacgcaggctgtaatcttttgcaatacccgtcgcaaggtcgattggttaacagaaaacatgcacaagagagacttcactgtttccgctatgcatggtgatatggaacaaagagagcgtgacgttattatgcgtcagttcagaacaggatcatctagggttttaataaccactgatctgttagcgagaggtatagatgtacagcaagtttccctagttattaattatgatttgccttctaatagagaaaattacattcacaggattggtcgaggtggtcgatttggtcgtaagggtgtagcaataaatttcgtaacggacgatgataaacgcacgcttaaggatatcgaacagttctataatacaaagatagatgaaatgcctatgaacgttgcggatctcatataaaagcgagctaataaagagtgttggtgtgttctacgacgtctcctgaagtatctttggtgcgtcgtcaatcctgtggacaccaaaatttggaaataaagaactaatttccattttaaaattacaattcagtggttttgcttcttatttaaaacccgttttccatactccattttcctatttttacacattttttaatttatttcgtaatttttaactcttaaaataaatttatttttattt

SEQ ID NO: 1160 - DNA, 1207 bp, Diabrotica virgifera
gagcccaagcgtccgctcatattaaaatgtttgttttggatgaggctgatgaaatgttgtcaaggggttttaaagatcaaattcatgacgtgtttaaaatgttgaacactgacgtacaggtaattttactttcggctaccatgccaaacgatgtgctagacgtgacaaaatcctttatgaggagtcctgttcggatacttgtcaaaaaagaggaacttaccttagaaggtattaaacaattttatgtatatgtagaaaaagaagattggaaattagagacattatgtgatctctatgatactctttcgattacgcaggctgtaatcttttgcaatacccgtcgcaaggtcgattggttaacagaaaacatgcacaagagagacttcactgtttccgctatgcatggtgatatggaacaaagagagcgtgacgttattatgcgtcagttcagaacaggatcatctagggttttaataaccactgatctgttagcgagaggtatagatgtacagcaagtttccctagttattaattatgatttgccttctaatagagaaaattacattcacaggattggtcgaggtggtcgatttggtcgtaagggtgtagcaataaatttcgtaacggacgatgataaacgcacgcttaaggatatcgaacagttctataatacaaagatagatgaaatgcctatgaacgttgcggatctcatataaaagcgagctaataaagagtgttggtgtgttctacgacgtctcctgaagtatctttggtgtgagtattagctttctatgctaaatctgctgcgacatatatatgcgaatattgtgcgctgcgccccatcacgtttctttaggacaacgccgttcgaggcacaatcatccacgaactctctgagtgtcaatttttaaatatatttaattgtttcggtttaatctctagtgtatttttaattttttgatatacatatagttagtgtttattatcattcgggagacgtgtggctgtatggaggcccgaggtcccctcgtttcgaggggtaccgacggtcgtaggcgtgttgtgatttgctccacacagttcgttcgtctctgtaagggtttagttggtatctggaaaggttattataatcgtaaaagatgtagaaggaaattctggattatcacatagactttttgtacattaagacttaataaaagtggtgact

SEQ ID NO: 1161 - DNA, 1767 bp, Diabrotica virgifera
ctatattggattttattgaaaaatacaattattaatgttacatacatcccgccacaaatggagaaacggaaataaaatagtgatattgcaattaccagaaagaaacataattaggtacatcgatttaagaattattttataaaacgaccacagacagactcactttcaggtaaaaaaatcctaacttatttgttaccacaagttagaagtggttaaaagcatcctagaagccactaagtgaattgcaatacctgggcggagcgacagtattcctatcacttcaaacttcaattcagcagccttttccgtttagctatacgcggagtagacatgtctatgccagatcgtcgtgaagagtgggacaagaatggcccagctaatgaagacagccagccccaaggctatgacggcccaccaggtatggagcctgatggcattattgaatccaactgggaagaggtggtcgataatttcgacgacatgaacctaaaagaggaacttttaagaggaatttatgcctatggttttgaaaaaccttctgctatccaacagagagccatcattccttgtgtaaagggacacgatgttattgctcaggctcagtcaggtactggtaagactgcaacattctccatctctattttacaacaaattgacacgtcagtgagggagtgccaagctcttatattggcaccaactcgtgaattggctcaacagatccaaaaagtagtaattgccctaggagatttcatgtcagcgcagtgtcatgcatgtattggtggtaccaatgtacgagaagacataagaaaacttgaaactggcgtacatgttgttgttggtacacctggtagagtttacgatatgataacgaggagagccctaaggccgactcatattaaaatgtttgttttggatgaggctgatgaaatgttgtcaaggggttttaaagatcaaattcatgacgtgtttaaaatgttgaacactgacgtacaggtaattttactttcggctaccatgccaaacgatgtgctagacgtgacaaaatcctttatgaggagtcctgttcggatacttgtcaaaaaagaggaacttaccttagaaggtattaaacaattttatgtatatgtagaaaaagaagattggaaattagagacattatgtgatctctatgatactctttcgattacgcaggctgtaatcttttgcaatacccgtcgcaaggtcgattggttaacagaaaacatgcacaagagagacttcactgtttccgctatgcatggtgatatggaacaaagagagcgtgacgttattatgcgtcagttcagaacaggatcatctagggttttaataaccactgatctgttagcgagaggtatagatgtacaacaagtttccctagttattaattatgatttgccttctaatagagaaaattacattcacaggattggtcgagttggtcgatttggtcgtaaggttgtagcaataaaaatagtaacggacgctctaacgttgaaatttttacaaatattaaaaagccacatactttatatataaatagtctatggaaaaagtggtttcggccttatctttcaaccggaaaggaaaaaagttcactagaatcattaaatgtcatagaatcaacacccccccggcccgaccccctgcctaaacccaagattcaaaaaaatagttctgagcaaagggaggggtcaaaaatactcaaaaagagtcccccaaacctaaaacttaccattcccaagggtc

SEQ ID NO: 1162 - DNA, 858 bp, Diabrotica virgifera
ctaaatgttagcgaataataattctatggtaacatataaaatttttgaaatgaggaatgaggtcgcattataaatggtagtgaattaagtattactattgttaacagtgtcttaaaatggaaagatctggaggtattctttcaggattaagtgctctagtaggcactacagaacctgctttaaaattattgttgactcttttagctggttatcctctagctttaattcacagaaagtatttgtacaacaaagaacgaagtctacaccatctatttttcataacgtcaggattcctgttaggctactggaattatggaggagctattttccatagtgttttggcagctttctttacatattgcacattatccattctcaaaggaacgagccttagtgttgcaattgtatttctttttaacataggatatcttcttattggttacttttacaccagtacagaaagttatgatataacttggacgatgccgcaatgtattataactttgaggctaataggggttgcatttgatttatacgatggtcaccagccagtggaaacattatcatctgatagcaagaaacttgctctagtccagaaacccagtatattagaaatatttggtcattcgttctttccgtcaggatttttaatcggacctcagttttctatgaagagatatttagaatttatagatgggcattataacaccagggacggccctccagacagcgtagtagctgcgataaaacgagggctactggagttgcatatttaactatattccaaacgattgaatctttttgtggtcggatgattatatgttatctgacgaatttgcacaaacttgctttcttcag

SEQ ID NO: 1163 - DNA, 770 bp, Diabrotica virgifera
gtaacaaagtggttgataagttttataaaaatgtacaagtacctcctttttgtctcccttattggattaagcacatgtttccccggcatcattgactctggacatggtctcagctcatggaatggtggcggcgcagattggcaaaaggctttggctagtgtaggaatcggtgctagtctgggccactcccctggattagatgatggtcatggccagggatcccctgacggttcaatcggtggtgatttccatcacggagtgagcgtggttagtactggaggcggaaacaaaggagctgtattcgatttaaccaatcaaggagatgcaggccaccatggagcctttggaggcagtttcgtagcttctagcaaatacagcgctggtggccatggaggagatggcggaagctctggtggatttggaggtcacggaggatacggagtttcagagggtaccggcttcgctggacactacagtgacgttttaggagccagtcaaccagttgctggatatgacggtggacatcttggaggtggccacgaagcacttactgctcttcagggaagcatcggcggaggagaaggattaggaggataccattagtagtacattgattgttatttttgttgttgttgtttttgtacatatttatttttttattgtttttattgaataaattttgttatccgaagaatgaaaattggaaaatactgaaatttaattaaatgcaagcatgttataaacacctctctgtgtgtacgcatgttggg

SEQ ID NO: 1164 - DNA, 1377 bp, Diabrotica virgifera
cttgtgttacgttaccatgtactcgttagtaatagtaataactgtactcgtattgtgtagcaatttgaaaattgctctgagtgaaacgcaagaactcttagagcttaccccagaaagtagacctgcaatccggcgaagatggtatccacaacctgaagaaattactataacctacagacctaatgctttggacggatgtagaaatttagtaggaaccagcaagccatctttatgttctgtggattcatctacaccatattattatcctagaagttgtagtgatatcctacaaagtggtggtaatagatctggaatatatgtaattaagcccaggggtagcaaagaacccttcgaagtcctttgcgacatggaaattcaaggcgggggatggacaacagttcagagaaggttcaatggacgtgaagatttttaccaaccgtggagagcttacaagtttggctttggaactttaaatggagagttctggctgggattacacaacatttatcagatgacaggatctgaacagtatgaactgttaatagaacttactgacaaggaagggataacaggatatgcccgttatgcatcgtttgctatagccggtgaaaaggatgggtacaacttgactaaacttggtgcatattcaggaaatgttggtgatgcactatcaggacaactcaatgcaaaattttctactttagatgtggatctggatggtcaagctggagattgtgctaaaacttttgagggaggatggtggtataaagacaacatttgctacgtatgttgtctgaatggaaaggtgccaactgttattttcactgatcagcagaaatggaacggaattaactgggatggattccgaggaaaagagtacaatttatcaggatcaagaatgttgattcgtcctgttagttcgatttgagaaagaggaatttagcttataaaatacaaagttgaataataccatgtatttacttatgatgataatattactagttctaaattagtatatttatgaaaaatataataggattaataaaggaattcggcaacatttttttcacctgtttattaaaacgtggtctttttgtattaaatatagagtctcgcctgcccactgattaatttgaaagcccgcgggatttttgaccgtgctaaagtagctaatcctttatttttttttttgaaagctaggaaagtaaagggctcggttgaaaaaaaaccggccttttattaatttttataaaatttactttgtaaatttaaaagccttaaattttttttaaaacacgacaaaccccctaaaaagtgttttaaatttttccctcacctttttttaacaccaaactgattctataaaaaaactcactc

SEQ ID NO: 1165 - DNA, 1283 bp, Diabrotica virgifera
acccacgcgtccgcccacgcgtccagtttgttcatcttcaccactatggcattttttaagctagctggtttgtttttgtgtatagtcgcgtctatcagtgcgttacccacggcacacgatgaagcgcgcggtaattcagttcaaaccgaacacgatcttttggatgccgtttacaacgactgccttaaaaaagactctatgtcttgtctgaagtataaagtttttaatttcgtggacaagatgatcggcaacagggaaacaattacagtgatggatggtgttcagttcgtcaaaactcccggtggtgaacaggatggtgctccacgcgctattagcagtgacgacactatcgaatctgtcattttcaacaggattacatcgttcttggggtcccatactttgaaaatcgatttgaaaggtagtgaagttgtcaacgcagtgcaatctacagcccgttcattaaacgattatgccgaatccttggaagaagaagaaaatatgatcgaaggtgccagtgaatccagaaagaggaaaggcggtggcaagaaaggcaaaggacaaatgggtgctctcatgggactgatgggacttaaagcagccatccttggaaaactcgccctggccagtattgccctcatcgctggtaaagcccttcttattggtaaaattgctttagttctctcagctattattggacttaagaaacttttgggtaacggaggcggcggcaagcacgtcacatacgaagtggttccacatgcatcccattcatcagctcacgtttctacacacgaaaccgcctatgctggtggttccggacacggaggcggctatggaggagacatcggcggcggcggctatggcggcggtggttccggcggatggggtaggtctctcgatgcccaatctttagcatacaggggacatccacaagccaaacaagcgtgaggaactgttgatgcttctagtacctgccaaaactcagcgattctagactaagtcaagaaaaacgatacacttatttatgtaatttatttaattttatagacatcgacagacaaagactttttaccatttgcccagttttctgggttagacttatttattgttattttttaaataaataataaattattttttaacaataagaaatttttaaaaaaaaacaaaaaaaagtaaaaaaaaaaagggggggtaaaatgaagaatgaaaaaaaaaaataaaaaaaaaaaaaaatataaaaataaaaaaaaagggggggcaaaaaaaaaaaaaaggggggg

SEQ ID NO: 1166 - DNA, 955 bp, Diabrotica virgifera
  misc_feature (881)..(881): n is a, c, g, or t
gctttctattggtcagaatctcctatgaatgaaataatcgtcgtaatgagttatgcgtatacgcgtgtttaaccaacgtgtatacttgactggctagagagaagaaacgaagagcattactgtagtcaaagatccaactagatgtaagtttgcagtggagaacaaacctatagaacatctcaaccaattcaaatacctcggtgtaggtttatccaattaccatgacccagtcagaggcctaagactgcagataaataaggccgcagtcagatctggatgtttaagagatattgtctggaataacccatacatgcgaacggacagcaaagtaatgacttatgggctagaatcaccaataatatcaaaagtaaaagatggttttgcttgttttcgattcagaggaacgcacaatcgccggacagctgtttccaccatttcaggctttatcaacagcgctagcgtgcactcctctgaatcgaaaaacagctcgaccatcaatttaaggggaatttcaaataccattgaaattcccatcgggacgcggtccagcgacatctcttaacaaattgaaaagtctcagatgcagaaagtaaatagttatttaaatctgaaacttttcgtgttgaaagttctttctggtacatccttaatcaattacatgatcaaaattatgctacgtacaaccaaaatggagatcctaagaggaaaaacaagaagggacagaataagaaacatcaccagtgaacaatgcggtgtacaagatgtagtgagatgggttaagtaaagacgaagagaatggtacaatcgtgtaaaaagagggtggaggagcatagtataccaagaattacgctagagcgaaaacagctggcatcgactaccgnggagaccaccaagagctgaggatatagctggcagtctactttgtcaggaatactttcacatggactaaacgatc

SEQ ID NO: 1167 - DNA, 1140 bp, Diabrotica virgifera
  misc_feature (3)..(3): n is a, c, g, or t
tcnagcgtccgtatagtagaacttactgggattaataatatatattatataaatgtctttcttgaattcttcatggctattcagccttgcaacattttgtattgggataatattcctgggatacaaatattttaccagagaatttaactattggaaaaaacgaggtgtgtacactccaaagccaattccattttttggcaatctttacgatgttgccacgttaaaactcactttatacgagtatgtacaaaagatttacgatgagactgaagaaccatattttggaatgtttatttttgataaaccggttttgctgattaaatcacccaagttaattaaagacattttgataaaagattttaacgtgttttgtgacagaaccatggcaaatgttactcaccataatcttatatcgaagtttatctatcagcaaaagtatcaaacatggaaaagtacaaagacaaagatgtcttcagtatttagttctggaatgatgaaaacgttttttacgaatttagaattaataaataagcaatttactgaatatttagaaaatatttctggtccagtggatgctaaatacatagcgggtcatttcggcactgaaatgattgcgcgttgttttttcgcaactgatccacgttgttttgaaagagaaccatcgaagttcagacactttgttcatcgtatatttcaatatagtctgaggaacaaatttatccagactggctattttttcaaacccaatttggtaaagttcttcaaattacactttatcgaagattcagtagtgcaatactttgaacaaacttttttggaagccatggaatgtagaaagggatatagtggtaaaccggtcagtatggttgacgttgtcaatgatttgaaaaagcatgcgatggagattttcctgatcaggacctacttgtatcaaatgccatctttttattgatagctggaccggaaacactgcttctataatttctttttgccttaaatgaattacctttaaatccagatatacaaaaaaaattaaaaaatggaattaaagacaaatatgaaattcctaaagggttcccctttacaagggataacgaaaaaataatatttggaatagggtgtacctgaaaattttaaaaa

SEQ ID NO: 1168 - DNA, 909 bp, Diabrotica virgifera
agatatgtctgatttcatgatcacccgtcgttgttagataaaagtagatttaggtaaataatgaaagaataattgtgttagacgaagtgctgattcatacagataggattttatgttctagtgctataatttgtggacacaaaaataataaaattatcgacactgataagtaaaaaatggcagcccttccacgcagaataattaaagaaactcagcgtttaatggctgaacccgtaccaggaattagtgctgtaccggatgatagtaacgctcggtattttcacgtaatcgtaacgggccccgaggattccccattcgaaggggggctttttaaattagaattatttcttcctgaagattaccccatgtctgcacctaaagtaagatttataactaaaatatatcatcctaacatcgatagacttggtagaatatgccttgacattctaaaagataagtggagtccagctctacaaattcgtacagttttattatccattcaggccttacttagtgctccaaatccagatgatccattagctaatgatgttgcagaactatggaaaataaatgaatcagaagcaattagaaatgcaaaggaatggacacgacgatatgctatggacaattaattgtgctccaaataaatatgggtaaaaaacataataattttacatttactagtgtatgttacgtttatttaatttatagatcaaagtagaattcttatgtttgttaccatacagttgtataaaactattgctaatgagagaactttctaaattaattgtttcagttttcttatattttgatcacaaccttcattgttattcaatagtgtatatttgacttttattattacatcttcttttatacttcaaaaaaaaaaaaaaaagggcgggcgcctct

SEQ ID NO: 1169 - DNA, 1238 bp, Diabrotica virgifera
gaaatttacagtacatatcgttttattatatcatggagtttttctgggtgaaatgtgaaggtcctgagtgtagcatggatggttgataaacgtgaaatgcgaatgcttgtttttttatggtttttttagttattgctattttgcaacaagggtgacaacttttaaaattttcagttaatcctatattgtagaaaatttaattacccaacttttatgtcgatgtaacttttctcgaaagtgaatacttttaaggttgtaatcaagaaaccaagaaaaaaatccaattttctttaattttttgacattttgattgtttggacagtgttccggaccctttaatattgagtgggaggatggctcaagtattgttatatgagatattttcaagcgatttctgcaaaaaaatatgagtcacctctcaacatccaaatgtactaatatttttacagatgcgccctggtctattaactgacatgttcgtcatatcgacgcacacgacttctggattataaatgttctaattttagcctgacagtcagagatttttctttaactggtaggaatctgttgccagacatacattattttgccgttattgacccagacaaaggccttattgaagtcgataaaacacacgaagatactatatctctacatgagctccatgatctagaaactgaaatacttatttggtggcaaatttttttaaatcaaactattgtaaattctattagagtgcagtattcttaagaaaatgttcaatacatgactcattaaatcactatatccacggcatcatcaatttaactacttcgttaggaattttgtatggtcggtctggttgctttcatatcctttactagtttgataaccatttccatctcgtcaaagattacctttcatcaggtcgatattgagtttctgttctttcgtcttcaaacagcttcccaatatgttctatatcccatctctcagagatggaatataattttacattaacaaatttctttcttaatcaatattgattatgattaaagtccggattataagcatgacagaaaggtcaaaatatacacttgcaaagttttatgaaataaacaaggttcaagaaaaaaaaacgtgtaaggaaacatggatattatgatataaaaaatgaataaaggaatttaacattaaattacaggtttttttaaatttatcgtattatttacaaaaaaaaaaaaaatttacaaaaaggt

SEQ ID NO: 1170 - DNA, 1752 bp, Diabrotica virgifera
gacagagccctggcttcagatgatatttcaaacataggtccgccttcttcgtgggatgtcgttttttgatattttaatgatgatgatgatggcctctgatgttttgaggattgatacgaggactgttacgacagtgaatagggacttgatgatgcctgctactctgatgaggacaacgagtttctagctgtatatacagatgcttcgccagggaacgcgtacaaggtcgattgatcgacatggtgcagctagccccaccccgggggcgtcctcgtaggccctgatatataccaaacgtttttattaccgccccgcggacgcgtgggaacttggtgagaagagactttttgttaaagtcgtcacccctggctgtggtttcatactttacagaagaaaaattaaaaaaatttaataaataaaatacttttatcctttttgaatacaactgaaaaattctaaattgaatgatcgattccctgcgcaaatacgagcaaaataaatcaattttatgatagtgtttttacaaaggtgtaacataatagcttacgagatcatttttttgtaattttacatgtttgtcgtagaattttagaagaagtgatagtattcttgtagctctgatgaaaggaagactgtctaggtaatatttctcttatgtagatttataagcaataaggtgtaaatattttattagtacagtaaaaaatattttgctgaaaaagaaagatttagtcaaattttaggtgtgtaaattattcaaaaggtacaaattctgcttaggaatttatataaggacaggttaagcacttcctacaatcagaactacaatatggtctatattaatgatgctagttcaaatgttttgcagtgattcccttagacacaggaaaattttacttcttggaagatgcttctgttttatatttgaatttttatacttaaaatgatattttgatagctatatcatggtgcaggtttaccattacagcaagtaaaacacattacagtctatttaaatcgtcttcaccaatgtttcccatgactatcttgaaaacacataatacattgtgaaatggaacaagatgaaactagtagagatgtaaaattgtcgataggaacctatacatttacattacattacatactttcgcacctttagatgtcagtggcacagttcctacagtgacagtggtcatactccttcgatacatctagaggtgggaaactatgtaatgtaatgtaaatttatgggctcctatcgatgattttacacctactgtttcatctctttttatttcacaatgtattatgttttccatcttttgcataattttgtcggttattagcgtgctttcactgtatgctctgttggtgtcctagtcttctatgttatcgattaataaaaactagctagtaaacttagaagggttaataaaggttttcatatattaaattgatctacgatcaattttttctttaattaaaaaagaataaatcaaaaatataagttacatctctactatgtagaggtacgacttgaagaaatgtaaattttataacgctactatccaaacttacatgtgacaattatttaatgttagtacttctatgtatatcgtttagtataagatatctcgcatgtagttttgagatttttgatataaaattgacattagaaacaaacggctggttctgcagctattcttttggttgatgagagtacaaaatcattttcaacgtaggtgtaaactt

SEQ ID NO: 1171 - DNA, 1597 bp, Diabrotica virgifera
  misc_feature (1198)..(1198): n is a, c, g, or t
aattattattaattgaaatccaaaaaatattggtttgtatgtcctaatttttaatagtatattaaaatatttcctttatttgcaatagtacatcttccaaaatgatgaacccacaatcaacgtacgcaattcaaagtactgctggagcagttcctatcagaaatgaaaaaggtgaactgtctatgcaaaaggtgaaagttcacagatatatctctggaaagaggccagactatgctcaagaagcacattcagacagtgattcagctgaggaagactttttggagaaaagaactcagttagttacagttccttctccagaacctataaggaccgaagaagatgatttgaatgatccacgtttaagaagattaaagattgctgagaccaatacagaagttagacctgaaaggcgaagacatgttttggagccagaagtcttggaatcatctgaggaggaagaagaagaaattcacttggctgaacataaacacacacttgaagctgctcctgatgatgatgaatctgaggttgaactcagtgattctgaaattgagaaaaggagagagtctttgaaaaagaaaatgttaactaaacaagaagatgagtttatgctgaaagaagaagaaaaagtggactcttcatcagatgaagaatcttccgaatatgaagaatattctgagtcagaagaggaaacaggtcccaggttaaaaccagtctttgtcagaaaaaaagaaagggtaaccataatagaaaaggaaaaggaggctcaaaagcaaaagaaagtggaagaagacgcgcaacgtaacgcagaagaacgaagaagacaaaccctcaaaatggtagaagatactatccgcaaagaacaacaaaaggataagacaacaaatgaaccaagtattgacgatgtttgtacagatgatgaaaatgacgaagtagagtatgaagcttggaagttgagagaactgaaaagaattaaaagagatagagaagaaagagaagcaatagaaaaggaaaaactggagatcgataaattaagaaaccttacagaggaggaaagaagggtacagttgagattagtacctaagaatgttacgaataaagctgtcaaaggaaaatataagttcttgcagaagtactatcatagaggtgcgttctatctagacaaggaagatgatgtgtacaaaagagactttgctcnaggcacgctggaggatcactttgataagactattcttcccaaggttatgcaagtcaagaacttcgggttctggcaggacaaaatatactcattttggttgatcaagatacaactaaattttgattctcccatggtctggaagaaatacacacatatcaagttcccttcacaacagggggggtgggattaaagccgatggttgaaaaaccatcacttaaaaagaaggaaaactaaaaaaaagggtttattttttaacaggggggttttaaaaaaaaaaaaaatttttatttccaggattcggaaaaggccaaaatgggggaaataaaatttttattaaaatgaggggaaatttaaaaaaataaaaaggtttaatttttaaaaaaaaaaaaaaaagggggg

SEQ ID NO: 1172 - DNA, 909 bp, Diabrotica virgifera
ttccattaatactgatttaggtgttaatgataaatttagtttttatttgatacattggtacattcgttaagttaaaattaagttaattggtcaattgttataatacacgtatttttttcttatggcaccagctgaagaaaacgaaagagacagcggaatggaatcccaagaaggttctcaatctcaagaaccagaggaaaatgttaccaatactagccaatctatttctggagaaaagaaaagacctgaaattgaagacagttacgatgatgagcctgatgaaaccttctgtgaaagattatggggtctgacagaaatgtttccagagtctataagaaatttcacgtggtctacagttgtaaacactaaagaaggcatcaaatttgcttatagtttttcaaggagcgcaacgtgggtagtctttagcacatctattatacttttcgcacccataatatttgaagtggagcgagctcaaatggaagaaatgcaaaagaatcaacagaaacaaatattattaggacctaattcagcgatatcagggggagtgcctcctcctatcatgcctcccatgccacagcagaagagttgagatacatagttgttattaaagcattcacttaaaattgactgtatattatattatcttttaaagattatgtaatttcaatctgttgtctaatgcatttgcagattgttactcatagaacaatattgtagaaacatgtttttatagtttgcaaaattatttgtgatacagggatggttactggcaatagtacattacagattttgtgaattacataaaatatgttattagtgaaaaagatagaaaaagaggttagaactagaaaataaatttaaaaaacaaattaaaaatataaaaaggggaaaaaaaaaaaagggggg

SEQ ID NO: 1173 - DNA, 1889 bp, Diabrotica virgifera
gaacgtgtttctccaatttttgaacgtcctaaaggtctcagttattttagtttatatataatttataaaaaaaaacccttgatttgatatatttttaagtctgtgaaatggagaaattcgccaaaacttccttaaaaaccagatattcggattttggaaataaggcaccttacggaaaaatctgaaataagttgaaaatatagtttttgattacagttagacttcttcttcttcttgtgccactcctatcggagattggaaatcatcaaggctaccctgactttgtttacagctgatctaaaaagttcattagtggtgcagccaaaccactctctcaaattccgcatccacgacattcttctacggcctggattccgttttccttctattttccttgcattatattttgaagtaatgcgtttttatgacctctcatcaggtgacccaaatactcgagttttcttcgttttatcgttgacaaaatttctgggtctcttcctatcctttgtattacttcaaggtttgtgattctttcaacccaacttatcttcagcattcgacggtagcaccacatctcgaaactttcaatattttttatgttgttctgttttgagagtccaggcctctacaccgtatcgtagcgtgttaaatacgtagcctcttagcattcttaatcgtagagggatgcttatatctctgttgcagaataattttctcatctttatgaaggtggccctggcaatttcgatacgtctttttatttcattgttttggtctccagtttcgtttattaaagttcccaagtatttgtaacttgatactttttgaatttgaaagccgtttatactaatatgtgctggttgtgtcatgtttttactgaagaccatatacttggtttttttgatattaatgtttatgccataattgttgcaagcaatatttatgtttgtaagtaatcgttgtaattcttctactcttcttgcaactagtacagtgtcgtctgcgtatcgaatattatttacaacctctccattgattatttttccttcatttgcttgcaaaagggcttcctggcagatgctttcactatataaattaaatagcagtggtgacaaaatgcatccctgtcgtactcctctacgtatttctattgcttttgatatctccgtttctattttgatgttagctttctgattccaatataagttgagaattattcgcagatctttattatctgtcttttctttcaagaatgtctcttagcctatcgtggcgtactctgtcaaacgccttttcaaaatcgataaaacatgcatgtacttcttgattaacgtctaggcatctttgtgtaagaacattcaaaccgaagagagcttctcgagtacctagtctttttaccttgttttagtagatggctcattaaagatattgttcgatgttttgaacattcttttgcattggatttctttggcagtgtaacgaatgtagacaacagtcactcttgaggtacaataccagtattgtattctgtgttaaatgagtgcaatattatacctattgattcatcattcaagagctttagtaattcagtaggaacctcaccgggtccacttgccattgcagaatccctaatgtcataattcctaataagctaatggtacttcttaaaagtagcttgacgaggaagaggcagaagtcgtatttcaactagtacaccagagaaagcagagacccaaagattagctctctcgagagagaaaggaagaagtctgctaaatcaactacagccatccgtaatatacagtgtgtctgtgtaactcggaaccatatggcaaactcttttaacatgaattttacgaaaaaaagttattccccacaaagtgctttgc

SEQ ID NO: 1174 - DNA, 1484 bp, Diabrotica virgifera
caattacctgccgggtgggaaaaacgtcttagtagatcaaccggtcaacattattatttgaacatatatacgaaagaatctcaatgggatgctcctgataagccagcggaaccagtgtcctccagtggtccagaacaagtccaatgttcacatttgttggtcaaacataaagattctagaagaccctcttcatggagggaagagaacattacccgcacaaaagatgaagctctagatattgttaaatcatatagagaacaaattgctcaaggtaagaattcatttgctgagctagcctcaaaatactcagactgttcctcagccaaaaggggtggtgatttgggtccgttcggtaaaggagctatgcagaaacctttcgaagatgctgcttttgcacttaaggttggagagctctcagagcctgtgtttacagattcaggagtacatattatattgcgcactgtctaatttatcagtagtccaggcttgaattttgaaaccattgttgaacaaagatattgctagtaagaactttgtgtatcgattcagtgttgctgcaaaacagaaacttcaacaagatctagtttatatcaaaaattttcttgatacatttaaacttcttctaaatgctaaaaaaactaattatgtacccttttctataaatgatacaaatcgtccaaactttgaaaacattaacatacaaaacattgaagatcctattgaacaagtaaatgtcataaaatacttaggagtatatttagataaaaatcttaaatgggaacaccacataacatacctaacaaaaaagattagggcccttatgcataaattttatctgctaagggagtttcttgcaaaaaaactgatcactatgatttatcaatccttaattgagcctttactaaggtatggaattttgttgtggggtggagcatatgaaaacaacataagaaatctcaaagtagctcaaaattcaattattaaaataatgttaaaaaaacctaaacttttctctacaaccgaattatataataataaaatctgtgacttgaaaacactctatatttcaacatgttgcacatatattcataaaaatttctccaaacagacactaatagaacataattatcaaactagaggtaacatcaaaagaagcttagttttaccacagttaagtcgaggaataagccaacattctgtgatttttagggcacccaagtattatagtttactgccaaacaaaataaaagaaatcaaatccataaaaatgtttaataaaaaggtagttgattgtattattggaaacaaaacacaatttgaattataaatcctgaaaaaaatgttcttttttttattttggaattcttatacctattaagttggattttttacatattattatattatatagatatgctgtttactttagttttaagtttaaattccaaattaattttgatttctcgaaagggggtttttttttt

SEQ ID NO: 1175 - DNA, 971 bp, Diabrotica virgifera
  misc_feature (936)..(936): n is a, c, g, or t
gcggacgaacaattacctgccgggtgggaaaaacgtcttagtagatcaaccggtcaacattattatttgaacatatatacgaaagaatctcaatgggatgctcctgataagccagcggaaccagtgtcctccagtggtccagaacaagtccaatgttcacatttgttggtcaaacataaagattctagaagaccctcttcatggagggaagagaacattacccgcacaaaagatgaagctctagatattgttaaatcatatagagaacaaattgctcaaggtaagaattcatttgctgagctagcctcaaaatactcagactgttcctcagccaaaaggggtggtgatttgggtccgttcggtaaaggagctatgcagaaacctttcgaagatgctgcttttgcacttaaggttggagagctctcagagcctgtgtttacagattcaggagtacatattatattgcgcactgtctaatttatcagtagtccaggcttgaattttgaaaccattgttgaacaaagatattgctagtaagaaatttgtgtacagattcagtgttgttcttagggtctttggaatgaagatatattaaatgaaaacgttatacaatgtagcaaaatgcaaacgcatgtggcagaaatcttatttttatccttcataatgtcattgggtcaactatggaaagattgaagtgaaactagggcacctagtcatgtctgaggctctttgctgcaaaatttaaagatacggttacagtcgtaacaatgctttataaaaaaatgtaaaatttaactacaggtttattggtattagaaaaataagtggaaatcgaaacatcaaatatattttagagtaaaattgtggcttcttcctataaaattgtaaatattaatttgtggaatatagtgattattattaagtcaaaacctatcngatttgtacataaattacttcgctattactatttt

SEQ ID NO: 1176 - DNA, 796 bp, Diabrotica virgifera
tggcgatgttgaacaacaatatttgttgatagtgatataaacacacaactatcgcatctcggtcgtcagtccatttattttaatggcccgcacaaaaaagtagtgatgatcatctccactacaaagtttaattcagctctgttgttgataagatagtgacaaaagaaaaactgccgtaatggcagacactcaaagccaaacagtcgaataccagtgggcctactccataatggactcgagccgggtgtccacgttcctaatatcaatgttgctcatcgtgtacggatcgtttcgcagccttaacatggagcaagaagccagggaacgcgccaacggtacaacgaattccctgctgaatcccccccagagcgttcccgcagagaacggcgtccagacgttggacaccatgcaggcgctatgtttgcctttgggggctagtgtgtcattgttggtcatgtttttctttttcgattctatgcagatgttgttcgcaatatgcacagctgtgatcgcaacagttgcacttgcctttctcctattgccaatgtgtcaatacataatgggaccgtgttccgatggcaagaagatctcctttgggatgtgtggacggttcactgccgctgaattgttttccctttctttgtcagtttttattgtttgcatatgggtcttgacaggtcactggttgctcatggacgctatgggcaatgggactgtgtgtagcttttatcgcctttgtgagattacccagtttgaaagaaaatcgacgttgcttctcactggactgtgatatatg

SEQ ID NO: 1177 - DNA, 985 bp, Diabrotica virgifera
  misc_feature (23)..(23): n is a, c, g, or t
  misc_feature (824)..(824): n is a, c, g, or t
cgaaattttaaaaatacatgttnttgttaatataaaaacaattttaaatatttaatttattgaaaacaaatcgggttaatttaataattagtttaaaattaatcggaatgtgcttgtcaagatgattagaaggtttaacattaattttttaaaaagaaatgaactagataacattaaattaaatcttagacacattttcaccggtatccaggttttctgcgattcaaaaaataaaaaggaatcccccctgaaaagattgttagacgattcttccacttttcaagacgtatccaaagaatacaagcagcaatgggccacattaccatacccccaaggtacgaaaataaggaaacaaggagaattttacaaaaaggagaagaaagatccaagggatgcgtcaattataatatttccaggacaaggagctcagttcgtaggaatggccaaagatttaatgagatttccaatggctaaggacctctttgaactagcgaactacattcttgggtatgatttactgaagttatgcttacagggccccaaagataaactagaccaaacaaaatattgccaaccagctgttatggttgcttcactagctgcgattgaacagttaaaagaagagagaccaaatgctatagccaattgtatggctactgctggttttagcttaggagaaattactgctttggtttttgctggagctctaggttttgagagagctttacagttagttaaaatcagaggagaagcaatgcagttagctggagaagcttacaaaggtggaatggcaacagtaatgtatggacctgacagtaaattanatcaagcttgtataaaagcgaaacagtgggccgttgacaaaggagatccagtacctgagtgtaaaatagctaattatttatttccacattttaaagtattgcctggtagtgaatcggctttagatttctagagaagaatttaaagggaattaactacgtaa

SEQ ID NO: 1178 - DNA, 1603 bp, Diabrotica virgifera
cattaagatctattcacacaaaatattgcaaaatggaagactagttaaataaaattaacaaataaatagcaatgtttaaagaaaccttgtaaaaataattataatcaatagatctaattgtgctaagaaaaaaaattaaaaattactatgtaatgtataatcaacgtacctagattgattgatagatagagagtaattcgagatccagtaatagtaaaaaatttgaactttttaatttttttaagcagcataatatcacatggttgtggaaataactttttatttgaactttgacatcttccagtggtagtgctcaatagcaataaagcttttattttcttcattactaataaactaaaaacaggtattcagaaatgtgagatagaatgagaagagtataagaatttgatatatgcagtaatcttaataaaaaaagatgatgaagtacaagaaattaggaaaataataaaaggcgatatagcgcatcatatttgatatgtacaactcagtcgcagacagattaattgaagttaattctgcgacctataagtcagaaaaagaaggtttataaagttgtagcagtaaagtaataccagctatctaagagacacattaatatgcagccctgcgaggtgtgaaattccataaacgaggacctaccggttttatgaaatgatcccttgtttatgcaatttcacaccttgaacaatagcaccccggtcaactgaacccggatttggtattatagtatgtggaaaatttgagattggagatgacaatgaagataagacatgacatagagtagactagcagtccagtttgtttctacatgatatgcataatatatccataattaatcacaaagaaattgaaagctgccatcactgctgtaatagaaaagtcaccaaagacttatctcatcaaaaagccacgagcaatcaagaagaacaacttaagaataatatcacatacatatatcacgactaccacagaagacctgacaacaaaaagaaaacaaattattttctattttttttttttcctagtaattggatttataattacaagcgactgtagacaagaaaaaatttaccgatttgttcttataaggtgtttcccaaaatttacgaaagatttgaatataatagaaaacactgtttctttttctttatatatagcacgttaggcaaatagcctccaccgttttgctggcacatacgacacatcttttgtcgaaattttccatgactactttgcctaaatatgcaaaaatacttaaatacgcattccttcttcaatgcacgggtggttgtaagcctctattaagtctgcagtaagtttgttagtataaacctttgacttcaaatatccccataaaaagaaatctaatggtgttaaattacatgatctaagaaggccaattctgattgccgcaaccagagattacacgcccaggaaatgtctcatgtattaattaaattgtttcacgggctgtatgacatatggcaccgtttttttgaaaccacatgtcgtccacatccatatcatccaatttaggcagcaagaactctctttagggcagtcaatgagagcaagaacaggt

SEQ ID NO: 1179 - DNA, 811 bp, Diabrotica virgifera
tgtaacgtcgcccccgttaggtgaattattctgataagtagttgaaattggtccggtttgcaatgaaattcgtccggttgaattaaaccttcggatcaggtaaataattcttcattttatgaccatgaaattcatcctcctattcttaacacattgtaacgaaattcgtccgaaataatataaaacagtataaataagcacaaatttcatgaaataagttacacacattacaaacaatatgaacattttattgtatatgttacagttcaagttgattctcagttagagttgactccaactagttggagtcaactccaactgaaacgagcagtaaaagttgattttaaaaatttaaatcaacttttactagttggagttgactcttcctggatcgattcagtaaatgtagattatacgagaatctcaagtgcatttttgatgagtgtgcgtttctttgttttgaccgtttcaactacttattagtatagtctgtaacgtcgcccccgttaggtgaattattctgattcgattttttgcacaaacttactcaaagaaatacatccgtataacaatccttataacaaatacacagggtgtcacgcggtaccgcggtcgagaaattgtttaaccaatttttgttaaccaaatacacagaaataatttttatctactctatctcatattatggggaaatgtgtagattttattgtgtgtgaattaaatttataaattgcagtatatgaagagtttaaagtgtgtctgaagtaacaatgtattttaaatgggtttttactttttcgcactgtttttt

SEQ ID NO: 1180 - DNA, 402 bp, Diabrotica virgifera
agcaattaattttgtctgttcagcgaattctcaaagtattttcttctgctccgattttagctaattttttcttgtggtttgcccgagaagtacaggtaagtgtgttggacaaagtggcctttcgttaattatatattgggaatgaaaagagaatgaaaattttcaagatacaatatttaaaactagatcatggaagaaaaaggaaacttcaataaatgtatctttcttccagtttctgaaaccgtccgagctacaccgtgtagtgtgccgatagactaacgtagaataaccacaggctgttcctgtggaaaatactggatgttataaagatgtccatatctttaaagcactaaagaattgagctcacaacatatctgggcactattgaagcattgatgaacg

SEQ ID NO: 1181 - DNA, 1527 bp, Diabrotica virgifera
  misc_feature (1388)..(1388): n is a, c, g, or t
  misc_feature (1448)..(1448): n is a, c, g, or t
  misc_feature (1499)..(1499): n is a, c, g, or t
  misc_feature (1510)..(1510): n is a, c, g, or t
ggtaaaatatggtctcaatgctcacaacttgtctagtcttaggacttgctagtccgggactatgtggtatttttgattatccatcgcagtggtcaccggatgaagttcttaacgatattacgaacgctaccgcaataattttgcagcccaatccaatttttaacgtcattataccacaacttagcgcactttttaatttatcaacagaaaacttagctgattggactgagatcctcgccaatagatttggaatacatgctggatatacaccactagaccaatcgctgataactaccgttctaaataacatcctatccacaccaacgacacagccaccttcagcagaagatctgaacaacttcttccagaaagcatcaacagtattgaaagattcatcgatctgcggtgcatgccaatttctagaacttatttttcaacttcatcaagacttcgtgattccggttctaataggaatctgtgacctttatatgggactatctacctacactgtgagcaccttttgcccgcagatagtagatctcaatttacccagcttaacatatatcagagcaaacagtaaaataatggataaccaactggtatgttccgtacttctccagaccaaggaatgctattttccgataccgcctctcacgtgggttggagcagtcaattctggcccaaaaatatatccccagccagtaagctccaaccaacaaccaatatatatcatacatttatcggacgttcacgtatcatttaattatgagactggtggagtcagtgattgcggatatccagtatgttgccttgagggattgggcaacagtcagctgaagtctggaaaagcgggacagtggggcgactacaactgtgactccgctccgaacgtattagatagtgccttggatttcattaaaacgatatatccgtctatcgatgctctctattatacaggagatgtggtcgaccatgctgtatggaatacaactgtagaacaaaacgtaaactccttggatttcgtattcggtaaagttaaagcagcatttccaggtgtagtcgctttaccatcgttgggaaaccacgaagcacagcctatgaatgtattcccacctagagagacagctatagcaaacgccggacttgaccaacagtggctttacaaccatgttgcatacttgtggggttcatgggtcgatgcacctgctgtagatatgatcaagcaacatggatattattcatacgagctctatcccaagctcaaagttattgtgctcaacaacaatttctgttactcctacaactggtggttattctacaatactacgtatatgcaaaccgaattgaattggctgcagaccgaactattggcctcagaagcaaaaggncaatacgtccatatcgtcggccacaacactttgggaaactatgaatgcatttccccgtgngaagatacttatcttaaagatgtacgaagattttcacatataatcaaaggncagttcgttgnccacactcacacagacg

SEQ ID NO: 1182 - DNA, 1261 bp, Diabrotica virgifera
ggaacaagtcatatttgtttatactattaatccctttgttaacggtgaaagtgtgaggaacaataacaaagatggcatcgcccttttccctgaaccagggccccttggacgaggaaacccaagccctcgccaaggaagaactacgagagactccagaaatgatgaaaacgggaatagagaagttgagagaatacctgaacaatgacgaatcacttaattttaaagataccgatgagtacctgaccattttccttaggccttgcaaatgggaccccaaaggcgcatacgatctgatgaagagaatagctgaatttaaagaaaaacataaaggccttttagaaaatttgttacctgacgaagagaaacctgcttttacagaacataacgtagtgaatatactgaccaatttggaccacaaaggcaggagagtgcttctcgtcttcgctggagaaacatgggatccatccaaagtaacgtcagaccaaatcttccgcatgttctacctcatccacgaaatggccgtgttggaacccaagacgcaggttagaggagtggtagttatcatggactacgacggtatgggaatgaaacaagttcgtggactcggacccgctttcagccttcttttgctcaccttcatccaagacgcgatgcctttgagattaaaagaagttcatatggttaaagaaccttttgtgttcaacatggtgtggcagttattcaagcctttcttgaaaccaaagctgaagggcaggatcttcttccacggaaagaaaatgtcctctcttcacaagtatatggcaccatcacacttgcccaagaactacgatggagaactgccagccattgactattccggcaagactggtatcctgtcatcgaagacacatgaccacatgaaagtgatgagcacctttggatacaaaagtttaggagcggaaaaaggggtgttggtccttcctaagtcttccgttaaaaatttccccaaatgttccttttgtaaaaacgttcttatcataaaaaaaagggttaatttttgtttttaaatattccgttttgaataaattttttcaaaaaaaaaattagtccgaaaaagctaaaaattaaaaatggggcgaaaaaaaaaaatattcttgtgccccctttttttgttccccccccctttaaaaaaaaaaaaaaataaatttttttgtaaaattttaatccccccccaaaaaaaaaaagaaaaaaaaggaaaacacaaatttttaaaggggtttgt

SEQ ID NO: 1183 - DNA, 465 bp, Diabrotica virgifera
agtccagccagctccgcagactggtctgtatggactggtaaacatagtgacatgtattggtcagctgtcctgaaagggctaatagatggtttgttctagtttcaccagctttatgtggtcaatgaagtactaagaggaaaataattacacattccaaagaaatatagtgtttttattttaagactaaattagatgtgtatttagaaactgaattattttttaacttactcaataaatttaaaggtacaaaataggcgcataaattctcaatttgatacataaagaatattctgtgttatatagaatactttttaatgtatcccataatcgacttatttttcttcattacatttattaccatgattttttaattcctgtcacggatagaagctcgttaaatgacttcaatatgggcacagagttgtgtaaggttaaaaaacttttgttcagttcgcctagacgttt

SEQ ID NO: 1184 - DNA, 1344 bp, Diabrotica virgifera
  misc_feature (1214)..(1214): n is a, c, g, or t
caaacaacgaaaaatgcggcttgtgcaggaaatggcggtgtttatggaaaaaaaatgtttttatgaagatctaaaccagttttgatcatcttctattaagacaagatgttcttgtacaacttaaccctgcaaaggggtactactatttcccatgcaattcatggtaatttctcgggttccaaaatacaagagattgtaatttcaagaggaaaaatcttagaactgcttagaccggatcccaacactggaaaagtgcatacactcttaaccatagagatctttggtatcattagatctttgatgccctttaggttaactggtggaactaaggactatgtaatagtaggttcagactctggaagattggtgattctagagtataatcaacagaaaaatgtttttgaaaaggtccatcaagaaacttttggaaaatcaggaggtaggcgtattgtcccaggtcaatatctggctacagatttaagagggagagctgtaatgattggagctatagaaaaacaaaaattagcttatattttgaatagagatgctcaagcaaggttgactatatcatcaccactcgaagcacataaaagtaacacattagtttaccatatggtaggtgtagatgttggttatgacaatccaatttttgcttgtttagaaatagactatgaagaagctgatagtgatcccacaggtgaggctgcacaaaaaacacagcaaacactaaccttttatgaaattgatttggttgtaaaccatgtggtaagaaaatactctgaaccattagaagaacatgctaacttcttggtaacggtacctggtggagatgatggaccttctggagttctaatttgttcagaaaactatttgacctacaaaaacttgggagaacagcatgatattcgttgtcccatacctcgtagaaggaatgatttagatgatcctgaaagaggaatgatatttgtttgttcagctactcacaaaacaaaatcgatgttctttttcttggctcaaactgaacaaggagatatttttaagataacattagagactgatgatgatatggtaactgaaataaagttaaaatactttgatacagttcctgtagccactgctatgtgtgtattgaagactggtttcttatttgtagcatcagagtttggcaaccattacctctaccaattgctcatcttggtgatgatgatgatganattggaattcagttcagctatgccttttggaagaaggtgacacatttttctttgctcccagacctttaagaaatttggtcttagttgatgaactggaatcactttctccattctctcatcagagtcgctg

SEQ ID NO: 1185 - DNA, 1075 bp, Diabrotica virgifera
tttgcggccgggcaaaatgaacacacgcacttttttatttttagtggtttttcttattgtggcacaaagcgctttttgtgccccaaaagataaaaaacacaaaagcaaaggcaaatataaaacttgggttgatcaaaaccaagtagaacttgagggcgccaaaaacagagtcatcaaatacatacagaaaaatgaccccgataccacaagggcaattaacgaactactagaaccagtgaaagacaaatgtccacaggtcgacaaggtaccgaaactcttggatgacgtatacggttgtgtgaaaaatactacagtaggttcaggcactgtgtgttcaacaattcagaaaactatcgaaaaatgctacggacctttaatcgatcttgtcggaagctgtttgcccaaagaatccaacgaattgcctttattagctcagaagataatcattggcggtttaaaacaagtctgtacttttaccgtagaagaatttttggaattgtttgctccatgtcagtctgaaacaaactgggcagatgttagttcgtgtaatgacgtcagagctgccgtagaagagttcgagaaaaagttgccttctactcaaattatttgctcattgctgcccaaactgaaaacgtgtgccaacgatgtccacagtagctcctgcaaaaatcccataactctcagatctttcactagagttgaagagagtgtgctgaaagaaagtgaacctgtttgtcggggcaaaaattaaatattttatagttcctcaacaataattttaaataaaacattgttttctgtttaaaaaaaaaaaaaaaagggcgccatggaaccggttaaaactaaacgcccgcatggattgcatgtctccggttcttaatcttcgtctcagaaggcctaaaatacctggccctgcgttttgtttttttcggccgctggtggggaaaacccctggagaaaacccaacttaatccccttgcaaaaacccccctttccccaatggggataaaaaaaaaaggcaccccaaccccccttcccaagtagcgaacccccgaatggaaacggaagacctcac

SEQ ID NO: 1186 - DNA, 1559 bp, Diabrotica virgifera
atcatggttaaaattggacaaaaaagttcaagatcaaagcatacaaaagaatcatcagactgcttcttttatgttcctagcaaaattttaccccgaggaagtggcagaggaattggtgcaggaagtgactcaacatttgtttttcttacaagttaaacaggccatattgtcaatggatgtgtactgtccgccggaagcttcagtattattagctagttatgcagtgcaagctaagaataagaaagagactgaactatggcttggcgtcacggcgctgggtttgaatatatacgaaaaagagaataaacttcaaccgaaaacaacattcacatggtcagagattaggcacatcagctttgacgacaagaagtttattattaaaccagtggataaaaacgccccaaatttcgtattctttagtcaaaaggttaggatgaacaaattgatattagacttatgtatgggcaatcacgatctgtttatgcgacgacgaaaaccagactctatggaactgcaacagatgaaagcggcggctaaagaggaaaaacaaagacggcaggtgcaaagaaatagactagcaagagaaaaacagttacgggaagaagccgaacgtgaaagggcgagcatggagcagaggttgcttcagtatcaagaagagatacggttagctaacgaggctctgcgaaaatccgaagaaagtgcggatcttctagcagagaaaagtcgagtagctgaggaagaagcgagactcttgagccaaaaggccgctgaagctgaacaagaaatcataagattaagactgacagcgatgaggaaagatgaagaaaaggtttctttggaaagaaagacaagggaagcggaaatgctaacggctcgactcgttgaagaatctgagaagagggcagccgaagcgaatagactcaaagacgagctgctgaaggccagagcagcggaaaaacaagctaaagaaaaacttttagacttcctaaatcgtacgacgacctacaacggatccaatacagtctctcctatttctgtaagcaatttttcttctgttactaccttgtatcagcctcccgttaagtcctggttacggtccagatttgtcgatgatagagaccgaaatatctacgtcgccagatcttaatttgaacatcactggctacgatttgataagcaaggcggacgcagatcagctctcgttagaaatagaaaaagaaaggatcgaatacctagaaaaatcaaaacttctcaaaaccaaattcgggaactccgaacgaaaacgcggggttgaaagcggggacaaaaaattgttttcaacttctaaccacgaaaaggcaaattagggaaaaaaaatattccccctaaaaaaaaaaaagtttggttcccaaaaaagaaaaaggttttttttgaggaaaaaaaaaaggcctttttgtttttttataaaaaaaaaaaaattttttttttttaacaaaaaattttttgggaaaaaaatgtaaaaaaaaaaaaaattttttttaaaaaaaaaaaaaaaaaaaaaaaaaaaaggaggggggggg

SEQ ID NO: 1187 - DNA, 720 bp, Diabrotica virgifera
catatgttctgccagtgcaagagtatgtgataacagctagtgtctcagaaaaatacccaaaaaatgggttccaaaatagaatacgtcgattcttcacaaatttacgctaccagctacgtcagaaattccaaagccgtaggagtgttatggggaatttttacgatatgctacgctatcatcgctattgtttcttttataacagctgagtggattggtactactagcggagaaactcccggaagaattggactgtattcaatttgctacataggagaaaatgctgaacagtgcaaagagaatttttgggatacctttatggacctcgctcatgctcttcaggcatctatggtgtttgtaggattggcagttcttacggctgtgttaaccatcttcgtcatgctgttcttttgtttttgtcgttccaccactgtctaccatatatcagcgtggttacaactaatttcagccgcttgtatgattgctggttgtgctgtttacccagctggatggaactcagacaacattcgcaaagtttgtggaacgtctacagataaatatatgttgggcgattgccacattcgatggacttacatattggctgctattggttgtttggatgctgttatattatcaacgttagcatttcttctagctttgagacacatcaagctacaggctgatccagattattcctacgtcacctagtctcttcaaaggtga

SEQ ID NO: 1188 - DNA, 984 bp, Diabrotica virgifera
  misc_feature (936)..(936): n is a, c, g, or t
gtaggagtaggtacattttttagttacgtgtattactatgtgtgttttaaatctgaatagttcgattaatatagaagtacaagatacattgctcacaaggctaaactaatattagtcccattccatcagtgctaagaaagatgatctcactgatagtcttggctgcactagcagcaacgattggctatttatatataaaatttaaattaacatactggaaaagaattggactggagcaaatcgaacccgtacatctaatctatggaaacgccaaagatttcatcaccagaaattcctcctttggtgattgtcacacaaaactgtacaacaacttcaagtcgagaggtctgaagcatggtggaatttacgtcttattaaggcctacgtatatgcctctggatctggatatcattaagaatattttgcagaaagatttcaacaactttgtgaatcatgggttttatgtgaatgaagaagtcgatcctttgacgggacatcttttcgctttagaggacgataaatggaggaggttgaggactaagttaactccaacgtttacttctggtaaaatgaaaatgatgttctctacaatgggttgcatgtaccgaaggcctcagggacatcctcaagagttacgctaaactacaagatgcagtggacatgaaggaagtagcgtccagattcaccacagatgtaatcggatccgttgcttttggtattgactgcaacagccttaagaatcctgattctgaatttagacaatttggaagaaaaatattcactcaaaccacttggacaggggttaagaagtgttctagctacgacaataccaagaaattttctaaaaatgatcaaatttaaacagaggaatccagagggtttgagatttcctttatgggtgtcgtaaaatagtactgttaattataggggagaaanataatctttatagaaaagatttcatgcatttactgctacagttaaaaa

SEQ ID NO: 1189 - DNA, 1279 bp, Diabrotica virgifera
atgaacttttaacgccagcgattttcaaaccgttctgtagttatcctttgaccgtcaaattggaaagatgcgttgcagtgtattagtcgttttaataattgcatccatttttggatgtaatgctgacaacttgaacagcgttgttcaaggcaatgatgaatttacagcgaacacttacaaggaactcgtgaaaacagtaggcaaggaaaacattattcttagtggactgtctgcagaaatcgtcttatctttgcttgcaaatggggccaaaggagaaacgcaaaaacagctgttgataggtttgggcttacccaataacataacagatgtaaataaggcattcactgaaataacatctcgcctaaaggtcaacacacccgatttaaaattgttatcagcaaacaaaatttatccagcgaaaggttttccaattgaaaaagcattccaagatgttgctgtgaatgattataattcaggcgtacaaaatctagactataacaaacctgcagaagccgctggcactatcaatggctgggttgaagaccaaactaaccacaaaatccaaaatctcattgatccccaaatgttggatgctagcacagtattggtattagttaatgctttatactacactggaaaatgggatcatccattcgaaaaatacaactctgctgatagattgttccacagctcacctactgaatccaagaaaatccccaccatgtacactgaagcattcgccaaatacgcttacaatgacaaacttaaagctaaatttttggagctcggatttcaaggcgcaaatgttactatgacctttgtattaccggacgaaatcaatggattagcagctgctgaacagaacttgaaagaatacttggctccacaaccattggaatctgctagagttgccatcaccctacccaaattcaaaatcaacacaaaaattgactttaaaccgatcttgaagaagttgggaattacacaaatgttcgaagacagtgctgaccttaccggaattgccaaggctccacttaaagttgacttttgtttacaaaaacgttaacaatgatgtcaaccccaaaaagacatttttaacccccagctaaccccaacaaaaaaattttaaaaacccaaaaattttttggttattttgaaaaacccttaaaaaaaaacttaaccccaagcccaaaaaaaacgaaatttatttttttgggtttggcgacggacaaaaaggaagccaaaaaaaaaactcctcttttttttgctggggcccccg

SEQ ID NO: 1190 - DNA, 990 bp, Diabrotica virgifera
  misc_feature (907)..(907): n is a, c, g, or t
ggtggtacccctgtaaggaacggggcggaattcccggccctacacgcgtccgctaataaacatggcgttgaaaatcattacgtttgctgctttcattgtagtagctcgagctggtgttctaaatgaagcctttccaccacaattagcctacgctgcatcgccagttgcgaaagtggcctactcagaagctccagctgtgtcatactcatctttatcggcaccttttgcttaccccgcccctccagctatcgcaaaggtagctgctccagtgcaatttggtgcttcaccgtacgccggattgtcatttgctccatcagcaccgtttccttccccagcattagctccagctttaccttaccagcaacctcaagtttattcttatgcatctccacctgttgcacctgtttcttacgcagcaccttcactcaaactggctgccccattagcttatgctgcacccattgctaagactgttattgctgaaccatctgcacctgctcactacgattttggatatgctgttaacgaccccaacactggagacagcaaaagccagcaggaatcgcgcagaggtgacgtggtgcaaggaagttactcagtggtagatgctgacggtaccaaacgtactgtcgattacactgctgatgaccacaatggttttaacgccgtcgttcgcaaggaaccagctgcagtagctgtgaaagcagttgcaccagtcgtggcaaaagtatctgctccagttgcttacgctcaacctgctccaattagttacgcgcaacctgctccagttgcgtatgctcaacctgctccagtagcatattctcattctgctccagtggcccttcctcaacaattcattaggtcatctcctttatggtcgtcttttcttaatgcttaccacattaancactgttggtcaaagtgtttttattgatttgtttggaaagtaaggtaatggggtctacatatatcgcattaaataactatggg

SEQ ID NO: 1191 - DNA, 889 bp, Diabrotica virgifera
ttcaagtttagtattttgttttcgttttggaagtttaaaattttgaaaataagatgagtacaataaatcagaaagaatatctaaagaaatatctcaaaattggagccaagacaggagagaaaaagaaaaagaaaaaatcggagaaaacagctggaacaagaatgaaaattatagatgacgacgtagatacactattatcacaagaaatacaagatgatatagatgctgccaatgaagatgcgcctcaaatagtagcagttattgatgaaagacctcactcattaattgttgatgaaaaaacaaacaatactttatggaagccaatagggcaagcatcaaataattctgaatttcaaaattttaaaataggtagtattaaactaaacaaaaacagagatgattcagagaaacatagattattggggacaaaaagtttttcaagttcaaaacgaaacgataatttaccatcaacatcaacttccaacaattacaacaaattaaaagataaacacgcagtatcaaaaggaaatggtaattttcccataaaagaaagtacttattcatacaatgaaaaaaattattcccctccaagaagagatcaagattattcacctcaaagaaaaagagatatagaccagtctcccaaaagaagagaagaagattattctcctccaaggaaaagaaaacaatctcattcacctgtaagaaaaaaagatcaagactcttctccacgaagaaaagtaaacaaagactccgactattcgtcaccaagaagagatgataaagattattcacctccaaggaaaagaaacaagtcttattctccaagaagaaagaaagaccaagattgttctcccccaaggaaagataacaaagacagtgaaaagga

SEQ ID NO: 1192 - DNA, 1077 bp, Diabrotica virgifera
catttctattctggtatcaaggaccttgtctctttttcgtgataattttcacggaaataggcatggtattcgtagggtgcagcaaaatagtgctaaaatttgttgattgacgaaggaccgacgtgttttttacacacttgtttaaccaaaaactcaagattccaccgaaaacctttatcgaacccagagggtggctaccgaagggtcgtaacttggacgaagctagcccagatactagcagccttcttttaccctacaactggaaaattttcctaaacggcgaaccgccttggcagtgctgacaaaaatctaggagatactaagtcacacctaccttaataaacctgtgtgaatctgagcacaggctgcctccttgcttatttcatcgaaaatattcaactgtatttgacaaagacaccttataaccaaccaaaaacaaaatgaaaattccaagtgttgaagaacgcattcacgttttggatgaccaatcaaacgtatggacggtgatccgggaaatcgtaagcaacaacaatcaggaagatgccttttacgtcttggatgtcggagatatcgtcagaaaacatcaggaatggcgcgaaaaactacctcgagtcacgccgcactacgctgtcaaatgcaacgacagccttacagttcttgaaaccctcaacgccttgggaactaacttcgactgcgcttcaaagggcgagattaacaaagttctcagcatgggtgtggagcccgaaagaatcatctttgccaatcctgccaaaccttccagtcatatcagacatgctgcagccactggcgttaacactatgacattcgacagtgacactgaattgcacaaagttaagaatctctttcctgaagccaagttagtcattcgcattcgttgcgatgccactgatgtccaatgtcaactgggaaacaaaatttggttgtgatcctatcactgaggctccagaactccttcgaatcgctagatcccttgacctcttcgtcttcggtgtgagtttccgcgggggaactttcccccctaaggttccgggtaatggcggggcccccgccacattt

SEQ ID NO: 1193 - DNA, 3039 bp, Diabrotica virgifera
atcaaggaccttgtctctttttcgtgataattttcacggaaataggtatggtattcgtagggtgcagcaaaatagtgctaaaatttgttgattgacgaaggaccgacgggttccttactcactttgtgttaccagaaactccggaaccaccgcccacctttatccaccccgtggttatgattccttgtcggtttttcgtgatcgcgtcggatacttcacatcgctcggttcgcgcgttttgtttgagttttccaaagtttttgagtgttcttttttaataccggtggctagatgacccgctggtagtcgacaaatttatccaaaaaaattttcatgtgttcatatgttataaacaaagtcccatttacccacggacttcagggtcgtaacttggacgaagctagcccagatactagcagccttcttttaccctacaactggaaaattttcctaaacggcgaaccgccttggcagtgctgacaaaaatctaggagatactaagtcacacctaccttaataaacctgtgtgaatctgagcacaggctgcctccttgcttatttcatcgaaaatattcaactgtatttgacaaagacaccttataaccaaccaaaaacaaaatgaaaattccaagtgttgaagaacgcattcacgttttggatgaccaatcaaacgtatggacggtgatccgggaaatcgtaagcaacaacaatcaggaagatgccttttacgtcttggatgtcggagatatcgtcagaaaacatcaggaatggcgcgaaaaactacctcgagtcacgccgcactacgctgtcaaatgcaacgacagccttacagttcttgaaaccctcaacgccttgggaactaacttcgactgcgcttcaaagggcgagattaacaaagtactcagcatgggtgtggagcccgaaagaatcatctttgccaatcctgccaaaccttccagtcatatcagacatgctgcagccactggcgttaacactatgacattcgacagtgacactgaattgcacaaagttaagaatctctttcctgaagccaagttagtcattcgcattcgttgcgatgccactgatgtccaatgtcaactgggaaacaaatttggttgtgatcctatcactgaggctccagaactccttcgaatcgctagatcccttgacttggacgtcgtcggtgtgagtttccacgtaggctccggatgccgtgaaccgccagtttttcgtagggctatttcagccgcaagggacatctttgattttgccgaaactttgggctacaacttttctctgcttgatatcggaggaggatatcctggtggaaaaggaacttccatccatcagatcgctgaaattgtcaatctcgcactggacaattacttccctgatccatcagttcatgtaatagctgaacctggtcgtttctatgtaagctctgcctacactttggtgtgcaatatccattcaattagaaacgtcaatcaagtcaacgatgagggtggaaataatatgcaccgcatgtactacatcaacgatggagtgtacggcagtttcaattgcatcttgtacgatcatcaggttgtagtaccacagccactagaagaacgcgttggagcaaaatactacgacagcagcgtatggggaccgacctgcgatggactcgaccaagtaattgaacatgcaatgttgccagaaatgaaagttggtgattggttggtgtttgaagacatgggagcgtatacccttcccgttgccagcccttttaatggttttccaattcctaaagtccatatagtgatggacgagagcatcagtgttctgatggaggatatgtttgaactgaccgacagacacttcgagatgctgaccataccgaacaatttgaaaaataaaaatgattcctcttccaaatacgaacttcctgatttcccaatagccattggaaattcgattttagattacgttgacgtcgttgctatggaataacggtacaagaagtttggattacgatctgtaaagcgacttgaacggtcgctaaaaatccatttattttcgagaccaatttttaaaattaattttctttaaaaacttccaaggtgtttatgacaaatcttctaattttaactgtagtttaattatactaaaagcaaaattgctggatgggcctttgtacgaactatcaattgtttttactcatcaattttatggttgtccaaccttcaaaattcaaataaaaacaataattttattccttaagtcatataacgtaattttcagcaaaaattaagtgtaatttgaatttttaatgcatcaaaaaccgtacaggagcccaactaatagaatataagtgcaaaaatttgaaacgtactacaatggtaggttttacaatatcagttaactacacttaactaattaaccgttaaatttaacagctatgtagctgaggaagtgctataagtagcggttaaagttaggatctattagttaagcgccgattaacggttgtttgtaaaaccggtaataaatttatatttttaacgattattgataaggaaaaggatctatagcatttttagagttattaattaggtaaacggcagaatatttgtcataatactaaaagatttttaatatagatctcttttataattaattttgggaatagttaatgaaatatttctttttaaaatacttttgtaactttgtatttaaagttgggatgtatttgttaaatacaattagattattgggttggggttttatttttatcttctaatatttgtgaatgttattagataaaaattgtaatggccaactttggtgtgtaagcaagggggcagcttaaagcttttcgataatgaataaatgttttttgttaatatagttcctaatgtattttcgtcaaatttaatttgagtaaatagactaggatatatatttattcgctgtttagatttagattattgctgcatagaattaaataacttaaggctaaaaaaaaaaaaaaagggcggccgctcgccatataag

SEQ ID NO: 1194 - DNA, 849 bp, Diabrotica virgifera
  misc_feature (757)..(757): n is a, c, g, or t
  misc_feature (823)..(823): n is a, c, g, or t
gacacacttgtcaaaattattaaaattgagaaattctcatgtttttcaaataaaaaataacataagattactccattttcaccatagaatgaccaaaataagtgaagtgtggaaagaggagtactgaatgttttctaaagtcgcatttgataataacttaagaaaattggaagaaatatgccagcagctactctaggtagcataccacatcctaataatgaagactgtggcattagggatgtttgggcccataacctggaggatgaattcagaaccatcagacaaatagtacaaaaatatcagtatgttgctatggacacagaatttcctggtgtagttgcgaggcctattggagaatttagaagttctgcagattaccaataccaaatgctgaggtgcaatgtcgatttattgaggataatacagcttgggctcacatttcttgatgataacggaaaaactccagggggtgcctatactacatggcaattcaacttcaaattcaaccttcaggaagacatgtatgcacaggatagtatagacctcctgcaaaattctggcattcagtttaagaaacatgaggatgaaggtattgaacctcttgaatttgcggaattgctgatgtcatctggtattgtcctggtggaaaatataaaatggctgtccttccattctggttatgattttggctacctgataaaactgttaacggacaacaacttacctcaagacgaaacagaattcttcgatttgttanaattatattttcctaccatatatgatgtaaagtaccttatgaaatcatgcaaaaatcttaaaaggnggattacaagaagtggcagaacagct

SEQ ID NO: 1195 - DNA, 1030 bp, Diabrotica virgifera
gacccacgcgtccgctaaatatatatcaatctactctatggaaacaaaaatggttattctgagaaatattattctcttttcgtgttttttagggctacttgcgaaggagagtcctaaaaataataggccatcgaaattgggaaacagaatcaatgatgaatttaatccagataatatatcagtttccgtatcaaccgattacattagtgatataaatctcagcgccctctcatataccaacagcccagacgaatatcttgaactatattttaaagtagcacaaactgttaatatttccggtttaccaacacaagaaggtttgaacttagaaataactaaaagagaaagtccctacgataagacaccttttactaatagaaattatacaagtgttcagtctaccggatctgaatcagtaagcattactctaaacgtctatgaatcattgaatagaaacgtagatttttcggatttgactattagttctacaattgaatacaacgtaactatattaacagagacaatcatctcctggaatgacgagaccaattttaataccgcaactcttttaaacgaagataccagaatttctttacaagatgacgccatgataaacttagcttctcatgaaggccaagatttgagtcagtgcgacaatcaacgttgttcctcgaccactttcaatagtaaagttatggacggttttgatttgaacgatggtatagaagtgttcagaattacaacagtatcaccgaaattatttagtgaaaggaaaactgtagataaaaataatacttaccatatggtaaattctgtattaatttcttattttatacaaattggcaaagtcttttaatgataatggaaatatttctagaataaatgatattttttatgaccgtgaaaaggtagaataaataattagtttttttattgaaagctggaatgaagggttggattgaaaaaaaacatgtctttatttaatttattaagaattttatttttaaaattaaaagggggaaaatttttt

SEQ ID NO: 1196 - DNA, 1155 bp, Diabrotica virgifera
agtaatcgtacttcacaaaatatttgtggtagtaccaataataaatggtagtacctaacttaagttaagtgtatactgtgacaataacaaaagaaaacatgccataaggatcatttattactgagttacaatggattaatgaagaactatttatgctgaaacatctgtattgaagacattttaggttaagggtcttatgagaaatgaatctgtgtccagaaagtatagaaatattatctatacgtcccgtcgtttgtcctttggtgagattaggtcagaaaactagtgcggctagtacagaaaagtcgtcagaaaatcaacattttgctgcaaaagatactagtttacaacctttatatatcgacacgtatagacagagcacaagtccaagttaccaatacaagcagcctccggtcaatccatctcagaaattagattatttgcaaaactactacgatgaagactgctacactgatcaacgaaacaataatttatcatattcaaataaaaacacacttcaactatcgtctttctcacaagagcaaaactattgggaatacaataaaatcaacaacaccgacacagaaaatcaaaatgttttcggtaatcacgaaacacagcaaagcaactgcctccttgacaacttcaccaggctaggaaaatccagtcctagccttgaccaaggctatcacaccttagtaacgcataacccaagtttgatcactcctaatttttgggatacaaacttgtacaagggcaaaaagtatcagacgaagaacaattctttcgataaactacccgatgagttagttgtgaaaatattttcctacttgactagtgtagacataagcttttgtgctcaggtatgtagaagatttgatattctagcctgcacaccatcgttatggagggttatagtaatcgaggatgataatataagtggcgataaggctatcaaaggtgttttgaagcaattgtgtgcacaaggaaagacaggagcgtgtcctactgtagaaagaatccatattactaatgcagctagatatcggataagagattgtagctgctagctagacgacgtccagaattaactcatttacagctacgaggatgcagtactctatctaatagcgcagtatttgaaattgctactaa

SEQ ID NO: 1197 - DNA, 593 bp, Diabrotica virgifera
gtggcttactggcaagatgatttctttggcactatttttgacaatatgtgggtgcgcttttggtcaatatagagaaaaagtactagtcaggcccaatattgccattactcctggacaagtaattagaattattagtcaaacccaagagggacccaaccttgatggatcatacgcctggagttacgaaaccgaaaatggcatcgctggtcgtgaagttgacgaccaaaagcccaagacatcgaagaagttcaaggtgaaatcaaatacacagctccagatggttctccgattcaattaacttatactgctgatgaaaacggttttgttccacaaggcgcccatttgcccactgctccaccagttcctgaagcaattttgagatctttggaatggaacgctgctcatccggaagaagatgattaccttaggggagctaatactattgagggttctgttagatataggagaccttaaagtaaatgattaatgctatgtatttattctgtaaatgtgatttgaaggtgttgttatggttatatctttgtaaaataatattctagcaaataaatagtgatctctctggagaggccgct

SEQ ID NO: 1198 - DNA, 880 bp, Diabrotica virgifera
  misc_feature (703)..(703): n is a, c, g, or t
  misc_feature (869)..(869): n is a, c, g, or t
cggacgcgtgggtttattggagagtgagatctccagttcaccgcctgtggagcttccagctcttctgcattatcttctctaagaatgtgatacatgaatatttagaggataaataagtaatacatttgttagagaaacagtgatggacaaaatgacacctaaaaagactgcagaagtcagaagggttgacaaaggcccggcctttggtgtgagacacattcaagttattttcatgttcttcttgtacctgttaatgtatggaacacgatatagtttctcagtggctttggtagcaatgactcaaagaaccacaccaaatcccgaaatacaggtatacaattggaccaacacagggattcttctctctaccttcttctggggctacgttatcccacaaacaccaataggtatactcggtacaaaattcggtaccaaatattttctcctagcagcagtttttatgaactctatggctagtctgtggataccaacaatggctgagaagatcggtatagaaggtgtagctgtatgtagggttattcagggatttgcgcagggtctggtaatacccagtgtacatggactgcttggaaaatgggcacctactaatgaaagatccagtttgtatggaattacagttgtagggtccatattgggcactatagccggcctaagcagtactggattcatctgcgcctcctgngcaggatggcctctaagtttctacatattaccctctttgggcatattctggatggtgctttattatttctatggagctggatgccctgcagatcattcatcaatcactgaagctgaaaagacttatatagaaaattcgctacattcgcaaaatatgcgggatgtgnctataccttat

SEQ ID NO: 1199 - DNA, 1163 bp, Diabrotica virgifera
  misc_feature (1012)..(1012): n is a, c, g, or t
  misc_feature (1055)..(1055): n is a, c, g, or t
agaatatagctatagcagttatttactgtctaggattagtgaaagtgtttcgtcggctgccggccaaaaattgatgggcttccgataatcgcccgttattatttttgtgattgcttggtggttttcctttattagaaaataaatagtgttacttttaaaataagtgaagattttattattagatatagtaatgattcagacaatataatattaaatattacccttcaacatccaaagactttgacctctagacttccaaaatgattgctacattaacgcaactatccgatgaatcccaaccattagtgcgtgatcctgtaagcaaaaccatattgacgctacctaaatgcaacggtaatgaactaccaatagcctcaactagtaatattagtaaagaagaactggaaaaaccaaaagaaacagaagaactcgaggaattagatgaattagaagaagtaggtgataccaacgaaattagtgatattagcgatattagcgatgaagaagaaaacgtagaaaataataataatgtagaaaatattaaagatgatgcaggcgaaaataataaaaaccagaaaccactacctaactatgagaaatacaaatttcttttttgggagttcgaaacgccaatcatttgggttagcgtctttttcatttttttgtggcatgctttgtctgtctacatggtatgcacttttccattaatggatgagatacctctggtattgtatgctacggttataggaggaatttcaggattcggagtaacaggtggtgcccacagatacttcacacacagagcctacaaggcgaggttaccattaaagatcattcttctgatttgttacagcgttgctggtcaaaacacgctatacgactgggtacgcgaccacagagtccatcacagatttagcgaaaccgacgcagatccacacaacgccaagcgaggtttctttttctcacacgtaggatggcttatgatgagaaaacatccggaagttattagaanaggacgcatgataaatctaaaagacattactgaagatccctgngtcgcctttcacgtgaagtactggttttggtgcaaactgtttctgtgctttatcattccttcttctattcctcactgctatggggagaaagttggtaccacagaatat

SEQ ID NO: 1200 - DNA, 517 bp, Diabrotica virgifera
tgtacgtcaaaatcaaagtaaacttcatttttcgtctcctttgactttcatcgtcaatagattttttaccgaagtacaagaaaagccctaataatgtctgcccttccagctccagttcgtgtttctcctttaatcaagttcggaagatggagttttcttgctttgggagttgcttatggagccttccaccaaaacaggctctccaaaaaggaagcaggcattagggaggtagaaaataaaattaaggcagaacgtgatgctaaactggccattgaaaagaaagccgcagctgacaaagaaattaaggaattggaagctctagcaagataggttactaagtttaatgttacagttttgtatcaagtgtagtgtaataaatacagccattttttgttaatattgtctttaatatcctcaggcagtgacataaaagacctcttgttatgataaacaactaaaaaattcttaatttatgtgatcgtaaaatggtgaaactattatatcaatttcagtattg

SEQ ID NO: 1201 - DNA, 1711 bp, Diabrotica virgifera
gaaatgttgacatcagcatttgtgtgtttgctaaagaaagtgaatgccaaagaatgcagtgactaccgaatcataagcttaatcataccttgaaaattctgctgaaaattatccacgccagaatacactcgaaactggagctagatattagggatactcaatatgggttccgcaatggtatgggtaccagagaggcattattctccttcaacgtgctgacacagagatgtttggatgttaaccgtcccctttacgtctgttttatagactacaataaagcgtttgataaagtaaaacatgatcgactcatggaaattctgaaaactaaaaacctagatgaaagagatttaagactaataacacacctctattacaatcagcgagcaatagtaagaattgaaaaagatacatctgaagaaatggaaataaagagaggagtcagtcaaggctgcatactatcacctctattatttaacgcttattctgaagaggtaatgcgagaaactctggaagctgaaacagtcggcataagagtaaatggagtcttagttaacaacatcagatatgcagatgatacggtaatagtagccgatagtttacaagacctgcaaagactcatgagtaaaatagtaaggtgtagtagggagtacggactctcaatatcaaaaaacgaagtttatgaaaattagtaaaaaaactataataataacgaaatcttgatagtagagggccagcagatcgaaagagtaaaaaagtacacttacttaggaacacttataacagaaaataatgacttcactgcagaaatcaaagtcagaatcgaaaaagcacgttctaattttataaaaatgaaaaaggtcctatgtagcaaagatttaacattagctcttaaagtacgcctaacaaaatgttacgtatacagtgtcctatacgatggagtggaatcatggacgttacatgtagagacaatgagacgacttaacgcctttgaaatgtggacctatagaagaattatgagggtttactgggtagatagagttacgaacaatgaagtactgagaagaataggtaaagagaaggaagttgaacctacaattaaagaaagaaaactacagtatctcggatatgtgatgcggggtgagaagtatggcatcctgcgactaataatgcagggaaagatagatggcagaagaagcatccgaagaaatcgaatttcatggctgaaaaacctgagagaatggtttggttgcagtttaaaacaactatttagagctactgcctcgtaaattaaaatagctatggtgattgccaacctccgtagcggagatggaacctgaaggagaagaagaatgatgtgaaacaacttgttaatttttactacaaatagagccaattggttcaatattagtacatatttatgcatttttatttgacttgtattggtttcgaaaaaactcaaatattacttatttttttgctagtacagacgagataactctgagttttttgtatccttctcgaggatcaatgactattatgcaagatctaagatgtattagattattggaactgaatttcaaaaaaaatattaggactctgtctattgcaatttttaagtatgtaattactcagtcgaattctgtagttattattattatttacaactttttaaggaaccatatctattgacggtatatacttcctgaaatga

SEQ ID NO: 1202 - DNA, 918 bp, Diabrotica virgifera
atttcaaaagtagctttttatacagttgacacagtttgttaataaacatggtaattacactttattttagttatttactgaattttgtttttaattttaatagagtattgtctttccttcttggacaaatgttgattcatcacaagcaattgaccaaactggatttctcttactgtccacgataattgattattgttacgggtttatttatcatctccaagaacaaatgcttcatttgaactttttgagtttatatggtacaaaaaaataacgcattgttaaaatgtaagctgtagatagtgtaataagtggaattacctgagaatatttttgtgtatttactggtccatttgttgatatattaaattaaatatcgcacccccgctgcagcagtgacctaagtcaaaatataccaatattgaataaattctaatttaatagaattgaaaactgaatattattattgcaaagtaagaagagctgaaatcttttttttttattatgctgttgtattttgaatttataatgtatatatggtatactctattgtctctttgttgcggcattaagaaaatatgaaagtggttttccaaattatttgacccccccccctaatattttagagttgtgactttttcagttaactttatttgaacgatttggtgataaattaactttaatcagtgtctaatattttatacggaaaaataaaaacagctaatatagataggtgttacattagctgataatactgttccgtaaattaaaataagtgtaacagcaatgaacagtaatatttatttatttgtgtcggtaaaatagcgtgcatatttctcgaaagagggttggttgtaattgttttgctgactaaatgtttggtgcctggcgcgtagaggacgatgatggaatattgctata

SEQ ID NO: 1203 - DNA, 782 bp, Diabrotica virgifera
  misc_feature (779)..(781): n is a, c, g, or t
cttcatcgcgtccgaaggttgattgatggctgatcggtgatcctagaaaaacgtcgtcatcggtcatagatcaaggttcctttccgacttatcataaaattaaatccattgatttgtttaagcattttatcaacttaggtgttggcggtacggtgcgttctagtattaaaatttaaaaagaaacatgaccacattatactctttggccgacgttaaaaaacacaatgataataaaagtacatggatagtaatacacaacaatgtttatgatgtgactccgttcttaaatgagcacccaggtggtgaagaagttctgctagaacaggctggtaaagaagctagcgaggcattcgaagatgtcggccactccagcgacgccagagagctgatggtcaaatacaaagtaggggaggtcgtcgaagaagaacgtactgccgttaaagccaaaaatgtcgactggggagtatcgagtaacaacgagagttcatcgtcgcagaattccttcaaatcctggttgatcccaatcgctttgggagtgctcgccaccatcttgtaccgtgcctattttcaatcctgaggaaagtagatttaattgaattgtcaaagaactccgatgaaagcatttatggttctagggactattattcatataatatagcttattttctatttgataactatcaacttagatttattatccaattgtagctaggactttggtcttaaatttgttttaaaataatacaagttaaatataattaattttacaattaagcggnnna

SEQ ID NO: 1204 - DNA, 1248 bp, Diabrotica virgifera
cggacgcgtgggcggacgcgtgggcggacgcgtgggggttcacgccgtcgttcagcaagagcttgcgatttttatttttgaaaaatagagagtattctctaatatttaaggacagtatggaagacgattgggctgtggataatcagagtggtggagttgtcgccccaaaaattgcagaactacctgaaattaagttgttcgctagatggaactgcgatgatgtccaagtttcagacatgtcccttcaggactacattgcagtgaaagaaaaaaatgcaaagtatttaccccattcagctggtagatatgctgcaaaaaggttccgtaaagcacaatgcccaatcgttgagaggttaacaaactctctaatgatgcatggacgtaacaatggtaaaaaattgatggctgtcagaattgttaaacatgcttttgaaattatccatttactaactggagaaaatccattacagattttagtttctgctattatcaattcaggacctagagaagattctactcgtattggtagagctggtactgtaagaagacaagctgttgatgtgtcacccttgagaagggttaaccaagcaatttggttgctctgcacaggtgctagggaagcagcattccgtaatattaaaactattgctgaatgtttggctgatgaattaatcaatgctgccaagggatcatcaaattcatatgctatcaaaaagaaggatgaacttgaacgtgtagccaaatccaaccgttaaatttatttctcattttatattttatttccaataataaatatggataaaacttaaacaaaaaaaaaaaaaaaaaacaagaaactaacgaaaaaaaacaaaaattaattttttttataaaatttggggtcaggccttaaagaaccataatttattttccgacatttatataccaatcaatttctactgaatcccaaaatatatttctggccggcgtttacaccagcggggcgggggaaaaccgggggttgacccacttatactctttttggaaaatcccccccttctccccttggggaaaaaaaaaaaaggggcccccccccccccccccccccccccccttccccccccccctatatggaaaggggagacccccccctcccgcgcccccctttttacgccgcgggggggggggggggggttgtataggcagacgaggaggaccaataaaacttttttttataggcccccccccacccaacccccccccccctcc

SEQ ID NO: 1205 - DNA, 909 bp, Diabrotica virgifera
tttttcatttcattatcaattcatacttttctcataaacaacttaaaaaaacgactaaaaatgaataatacagaagtacatgatacagtgcaagcatgccaatatataccttagccgattaaaatggttaaatagtgaactagaccatgcaatgaaacaaattctaaatacatttgaagaaacagaggccaatgttagcaaaactttttgtaattttaaggaagcctttatcgaagcccttaataaaagagaaaagatactattggacaaagccaaaaaggtagctgaattaacagaaaaacctggagcagttttagtagaatggaaagttgtggttgataatgaagaaaaagtaactgatatagaagaatttaggcttcaaaaggcactaggaaatgtacacgaagataaacatttagttgtcaattttcatgatgcttacaaaggtctagattgccaacgcctccaaaaagatctcaaagtcaacgaacagtattcctttagagtttgttgtaaattcgaaggtacaaccgaatggtctccatggtctttgcctcaagtaggttctaccagtcttaaacccttttcctggcaatttagtcaagattatgagttaacaaatgaattcaaagtggcaaaacctaaaaaagatgatgtggatatgctgtattcagaaggtgctcaattttccgctgggtatgcgattgattttatgtttttagaaggtcacccgagcgatgcagtagtgggtcttgtatgtgaaggattggatgaactgccaaaaaatgtaaagcgatgcaaggaaggcacgtttgctattaacagaaatgagaagactagtgtcgatggcgtgcaagagtcgacagttatggcagaatttcatagaggatctaagggtactttcacatg

SEQ ID NO: 1206 - DNA, 977 bp, Diabrotica virgifera
  misc_feature (776)..(776): n is a, c, g, or t
  misc_feature (801)..(801): n is a, c, g, or t
  misc_feature (820)..(820): n is a, c, g, or t
  misc_feature (860)..(860): n is a, c, g, or t
  misc_feature (867)..(867): n is a, c, g, or t
tacatacaaattaaacaaaatttgatgtgttggaagaactacttccttgcttgtcactttctaatttactaatttgaatggattttaggttaaaaatatgaaaaagtgattcaccattattcattatcaattaaaaataaagagcagtaaatgtaggctttccagtgataaataaataaacgttgattttgtgtcaactcatcagtattagttttttatataaatttgaagatactcagtattaaaacatcacaatatgtcacaaaataaaaaagaaaaagtccataaaatggtatatgtaatatttatatctttactattagatttgttcgcctttactatgatattacctcttttaccttcattattggaccattataaaattaatgatagcaaaggattgtacaactggctatctagccaaattcatgaatttcaaatattggtgggtgctccagaagaatataattcagtgttatttggaggtttcctaggatccttatttagtttcctacaatttttagctgcacctatctgtggaggtctgtcagatataattggaaggaaaacaattatggttatttgcctagttggtatatcactttcatatattctatgggcgctttccaaaaatcttgtaatatttatattagctcgatttctgggagggattagcaaaggaaatgtatcgttaagtatggcgattattactgatgtatcctccataaatactagaggtaaaggaatggcactaattggaatagcattttccttgngatttattgttggacccctaattgnggcaggttttgctgtatgngccaagaaacgttctggtgaatggtttatttgtcctgcancttttgncgtcctattgtctcttatttgatttaatctctttgtgacaactttttaaggagactttacctaaagagaaacgtgccaaagacgtcaaagtcacactgacaaatatgcta

SEQ ID NO: 1207 - DNA, 1201 bp, Diabrotica virgifera
  misc_feature (1076)..(1076): n is a, c, g, or t
  misc_feature (1128)..(1128): n is a, c, g, or t
tttcgtccgttttgtattatctgtttagttcaaatctggacattcgttgaccgtgagtttcgcgttgtttgttgtaaattaaatcaaccagctagtaacaaattatgacttccccattagaaaaatcttataaaataagagacgcaactaaagccgatagggatgctattgtggagtttttgaggattagttttttcagagacgaacctttaaatgcttttttagaattagtcacggaagaaaatccaacttgtgaaaccttagaagagttcacagtgggacatattccgaatgggataaatttggtagcaattcataatgatcaaatcgtaggtttaatattgagtacacctttagaaaaagtccaagaggaacaatatgactgcaaaaacgaaaagtacaataaattggttaggttactggactatgctgcaaaacatgctgatccatttgttatatatccatcaagtaccaaaggtatatcagtacaagtaatatcagttagaaaagattttaccggaagaggattagctgttgaattattacaaaagacatgtgatttggctcaacaacaaggatatgatttcgttgaaattgcatgcacgagtttatattcagcaaaactatcagaaaaaaattccttgaaatatacggactacaaagaaaatggagaaatagttttcaaacctgagtccccgcacaccaccttgaacgtatacttgaagaaattataagtaataggtttgcgtcaaatggaccgtgatagtgtgatgtcaaaacgtcaaaaaggtttccaaatattgatataaaagtaccaaacaaagcaactgtcaattgattatacacgtgatttgtgtaatcatttttaattttattttgttttaacaatcatctgcacattttttctaaagatacaatctttgttagtcatatcaatcatatttcttttaattttataaatgtccttacacaaaatcaaggatttacacactatatagtacttactgtgtttcttcaggtttttaaccagtcctatttggaaatgtaatgggaaatatactatgagcattgattancatcacgggtaccaacacattacctaccattttgtaaaaataaacatcctancaagcatatatttccatttataaaagcaaacaaacaccatgtgtgatttttctgctttgtttgaaaacatttc

SEQ ID NO: 1208 - DNA, 1408 bp, Diabrotica virgifera
cacacgcgtccgcacaacaactaataccgatagcagtggaaatatgccaacacttagctacgactttcaaccaggttctagacactgacgaaggatctgacgaaaaagccataactgcaatgggcttactgaacaccatagaaactcttctaactgtgatggacgaacaacccgaagttatgagattgttagaaccaactgtactacaagttatagctaatgtcttacaaaacgaagttcaagagttttatgaagaggtgctggcactaatatacgacctaactagtaaacaaatttctccagatatgtggaaagtctttgaattattatatcgggtatttatgaagaacggtatagatcatttcacagacatgatgcctgctctacacaactacataactatcgataccaacgcattcctttcggacgaacaaagactgctagccatctacaacatgtgtaaacaaatactcactgaagactcaggcgaagatccagaatctcacgccgccaaacttctcgaagtcgttcttttgcaatgtcgaaagaagatcgacacggccgctcccatgctgatagaattggcagctgcaagattgctgagagaagtcaagacaagcgaattaaggacgatgtgtctgcaggttctgatagcggctttgtattacgacccacagttgctgttttctgtactttcaaaaatgcctgatttcactaatcattttattaaacaatggcttcatgacacagattgcttcttaggtattcacgatagaaaattatgcgtattaggattatgtacattaatatcgatgccaaacaagcctccagtattgatcgaagtagctccgaaagtggtaccatctttgatattgctattcgaaggacttaagagagcttacgcagccaaagctgcagaagctgctgaagaagaggaaagcgaaagttccgacggggaattagaagatattttaagttctgatgaagacgaaatagacgatcagggacaggagtatctcgagaatttatcaaagagagcaactacagctttaactcagcaaggcatgaatgtaacagccacaattaatgacatcaatgatgcttcagaagatgatgattccaattttgaaccaaatgaagaaactgttttggaaacatacacgacacctttagatgaagaagactgcgacgtagacgaatatcaagcatttaagcaagtgatgacagctttgcaaggtcaagacccagaatggtataacgccctgacgaataatctgaacgaaacccaactgaagtctttaagcgaagtttgtgttttggcagaacaaagagccgcagctagggaaagtaaaagaattgaacagcaaggaggttatatcttcactcaacaagcggtgccaacatcttt

SEQ ID NO: 1209 - DNA, 1515 bp, Diabrotica virgifera
tttttccccatctctcactaatataagctctttctccgagtattcataacatgctttagcacaagctttctcagatcttagggtttagttagtgtctcatcctatgacgaagccacgatgtagtgaagcatgttgtgaatatacaaaaaaaaaacagatttccatgaggaaaaactgtcctcaattatttatcttataaactgtaatcttctacttcgttgaaatcgggattttaacaagtaatgtggataaaacatatcttagaacgacataccctaattttttagcaaattgttgaatataatttgcaaatttagtgataatagtagaataaacaattatttttcttttatttaagttatttatatctttaagggggagtctgtcctatcagattccttcttctatacgtacttttgaattttggcgccttttcagacgcaacctaacgtaacttaacctcaaaatgcaattgtttagggctaaatagatcaactttgaacttcttacctcatctttggaactctactctgtaaatagatcttagcttaagtttgtagagcagtgcaattcgtattgtttggaggatctcttacacctcagcggagatttcgcaacgaggatcaggaagctgatcccttggttaagagtcctcgtgttaattacagcgacatatgtgccaaaaatataatttattttctttggacacaagaaattttactttgttgatagatggatatttttattaatcgaaaacttatgttttacgctgagaaatatgtctacattttttttttttattacaattattttggtgactgagtagaattgaatactatcttataaccaggcaatgtttctaatacgtatttcgttacataatcaaatgtcatgtgacaatttgaataatctttgaacaaactcactaattttattgttaacctttttacctttgaatgtgcaatatttagacaaagatttgtgttaacgacaatgtattttatgttttatctttccttttgttaatatgtaattatctacagtgtgataaatattgtatttattaatctatgacttaattgatgactattctaaatgtaaccgcttttgtgattcattattcaggattgctaaatggactacatactaacatgttatataagaatgtggtgtttaaaatatttctgaacatactttctacctacaatcattcaaatcgaatgtctcagaattctaagaaatgatttaaagcacagaaaaaaggataaataggataagctaaaacaatggcatgcaattttttttgttgaagtaaaaatcatttttttaatttctagttcagtaatttgtcgatcatattaagacatctattaaaaaaatactacactgagattatatttcagtttaaatagatattacataatgtaaactagaatgtaaaaaaatatgttcataccaggtcttcacattgtttaaaagttacttctgcttccctgaattggtcatacattatta

SEQ ID NO: 1210 - DNA, 805 bp, Diabrotica virgifera
ggccgcccttttttttatttttttttaattttaaagaataataaaataaaaataaccacctaatttttaatttttggattaagttaaggaaatggaaaattaataataaaaataaaatccaaaaaattccaaattggtaatttaacaaaatggaaaaccttaaaaattaataaaattggtttaattaattcctccaaaagaaattaataaaagggaaaaaaatataaaaggggattaattaaaaaaccaattaatttaacaagtggaaaaattggtttttccaaaaaaaaaataaataataagcccaaattaaattccaatttaataaggtggaaaggggtaaggttaagttcctaatggttaagaaattaataaccaaaaaataaaaaaattaaaggcgggaatataaccggcttaaccaaaccaaatgggggaggaaccataatggaaacctatggctggaaaataaaatttgggaagtggaaatttaatttttaattaaaaggaaataaaaaaggatttaataatacaataaataactggataagtaattttaccggcaataacaaaaagggcccaaatcccttttcctcctgggtaaccggcagcaaaagcggccccaaccccggttcctccttaagaacatcctccaacttaagaaccagcaggggttaattaataaatccgtttaaattttccattaaaagaggaaataataataatataataattaattcctccaataccaaaattaaggccgggttaaggggctaatttggaattggattaaaaaaaaataatggct

SEQ ID NO: 1211 - DNA, 1243 bp, Diabrotica virgifera
ctcctcgcgtccaaatgatcgtaaataagattcttgtgttattatttcttcctttttgcttcggcaaaagtgtagaagtgacttttaaagatgtcacgttcaaaggctttagtgtttttacagaaaagttcaagaaaaagatcccgtctggaaacaaactagcagattttttgcccccgaaaactgtttatgatgccattgaaatgaaggaacaacatatacctttacttaccaaaggctcgttggcagatctagaccagttggacgaattggttattgagtactgtggtgttgaagaagttgaatctggagctatcagtaatgtacctaacttaagaaaactgtcacttaaaggtaatgccatcaagtcgattgcaaaggacgtattttcccatttaggaatatctacactagaccttagcctcaatcagatatcaacaatccatccacaggcctttgacaacatgccggatctcttaaacattcaacttgctgacaatttcataacgcaatggaatccagaatggctcaagaatacaccgctattgaccaggatctcgcttcagaataattccatagaaaagctaccagcccatgcatttaaaaacatggtaggtgataaaaagtatggaaaaatagacctcactattaatctggtatttagtcataataaaataagtgagatagatcctgaagcttttgaggatcttaccagaattaacaacttgtggctagataacaatgttctagaaagtttcgatgaaaaccttctctcgggaatcaaagttaatgatttgagactcaacaaaaataatattaaatgtttggacggtaatctagataaaatactaaaagcagaaacgaaccacatagattcgaatccgttcgactgtaattgcttggagaagatcaaggatggtcaattaaaagaagatgtggacttccacttttgctgaaatggagtgtacagcacaaagataaaagggtaagatgacagcactagaaaaaaattaaaggaaattaaaaggagaacgagacattccgaaggaaaggggaagaaaaaaaaaattttttgaaactaaacctaaaaataaaaggaaattaaattccgccgaattttaataaagaatttggtacccttaattttattatgtgttttttttttaaaaaaaaccggtttagtttttttttataaaaaacacgcaaaattttctcccacaaaaaatttttttcttattttgtt

SEQ ID NO: 1212 - DNA, 1146 bp, Diabrotica virgifera
  misc_feature (1030)..(1030): n is a, c, g, or t
gacgttcaagatggccagaaatttaaggtgttccgctagaaatttaaggtgttgttgatatatgacagactccttcctgtttttttatattctaaggatcagtgatacaagaagaagaagaagttgcaaagtggacaaagtggttgttccatgtccaatgtctataaactactttaatcgaagttgtaataaataatggcaaatggcaatacttgtgtaaacattttatgaatatcttagtttattctattgtatttatttacataaattcacctaaatgttctaaatattgttagaaaaaccgtataaataaaacaaaagacaattgaaaagaatgtgtcgccatgtcactgcggtgatttcagaaactaaacgtaataaatatggcgatacttgtgtatagatcttgttaaattaataataatttaattattcacataaatgtgtaaaacatttacatttctaagtataattaaaataaaagagtggtacggtttgtatagtgtatattaacgtatcttataggaagtaaaaacatggaagtcgaaaagaaattgaatgaagataccggtgagaaatctgataaaataatttctactaaagtaccaaattcagaaaaggacgaaaagaaaagtgaacttactagtaatacagccgaggggactgaacctcctgttaaaaaagtaaatgaatccgataaaaataaacctaatgagaacaatgctgttcccaaaccttcccctaagaaaactaaagaggatataaataagttaaaattattagttgccgatgatgatgacgatgatgatgtccccggcgattttttcgatgattttttaaaagaggattttatggctggattggatatagtagatgatgatgattgggatgaagaaaaaagtaaaaagatgcatgaatccagattgactaataagacgcagaaagagaagcctgttgaaataaaaacacctcaaaataaaaacgatattgtgaaaaaacgagagttaagaagagatccagaaaaaactanaagggctattgaaaaggataaagcaagtaaaatattatctgaaaaagttaagttatctcagacaggtttagtgccacccagaatggagatgaaaatggacatacctgaaatgaaat

SEQ ID NO: 1213 - DNA, 1013 bp, Diabrotica virgifera
cgaagtgtgctctgtttgctttggtagatattaggtactacctataagtaatttgccgccgaggattatagagcaataaaattttattgttttataataacgtacatttatcagaaaaatggaaaacaaggaggatcgtggttacaaaaaagtaccagtccacgaagagggcgtagttgaagcagcgtatgcggctgaaagagacagtgtatatgtgaccaccactcttcctgggcctaccagtagaaatttcctttacatagcggcaagtgcagctaacatagcatcatttgtttgcggcacagcttttggatggacatctccagaaattccaaaactaaacaatttaacaacaactccacttgcagatgttttgactccttcccaagaaggttgggtcggctcattcttaccattagcagcagctattggaccaattggaggaggaattatggcagacatgattggaagaaaaaaatcgttgctggtggctacactacctttcctactagcctttttattgaatgttatggccagcacagttttctatttttatgtttctagattcttgtgtggtttgggagtgggtatgatttttactgtcttgccgatgtatattggggaaatatctgatgatgaggtcagaggctcactagggtcatttatgcaactgttcatagtaattggactgctgttttcttatgcgcttggaccttatttaccagtaaaaacgtttaatattatattactattcccctccagtgatatttatagttctatttttcttggtcatacctgatagtccttactaacctcatacagagtgatgatagcgaagctgcattaaaagctctcattaaattaagagggggaaataaaatcttttagctcaaaaagaattagaagtgatcaaatttcaggtagaggaaaatctttaaaaagaaagggaagttttacaggtatttttaaaacattttttgattcaaaatcatttaaaatggtttttgttttta

SEQ ID NO: 1214 - DNA, 1009 bp, Diabrotica virgifera
tctgtccggtagcaagaccaagtaaaactggagattctacgaagatccaggattttctaggacggattttctgtttttacagtacatgttgctgtaacgacttggcacgaatcaggacaatcccaataaaatgcagcaaccagtgatggaaggcggagcggcctacgagccctctgtaagaagctacgacgatctttttccagctctaccggaatcgaccccacaacagcaaacgaactccagcataggacaatggaccaacaacaagatgagagttggatcgacaacaattacccaagtattcagagttccatacgaagaacgcaaactcgatgttcaaaaattcggcgaaggcgaatcaaatcatatctgcggtaacataatgaaggaaacaggagcccacattgaaatatctcacgctaaagatcagtcactgacattccttgtgactggcaaacaaaatgaagtacttgaagcaagacgaaagattttgacacatttccaaacgcaggcaaatagacaaatatcaatcccaaaagaacaccacagatggattttgggcaagaaaggtgacagattgaaagaattagaaaagactacagctacaaaaatttcagtacctgccatgaacgatccatcagacatccttacgataacaggtaccaaagaaggcattgaaaaggccgaacacgaaattcgcgtgacctccgatcaacaatccaaaaaggcctcagaacgcttgaacatccccagacatttccatcccttcataactggtcccttcaaccaaaacctcaacaacatgatgacagaaaccggtgccaaaatcaacgtaccccccaccatccgccaacaaagatgaaatcttcattgctggtgagaaggaaggtgtcatggcggctaaaaacaaaatcgaggatttgtaccaatcgatcgaaaaaaaattgaaaaccgttggcgggggaggtgccccgagccacacagatacgtgattggaccagaagatcta

SEQ ID NO: 1215 - DNA, 628 bp, Diabrotica virgifera
cccacgcgtccgcccacgcgtccgacttcctagtcagctgattgttaatttacgttttcaattagaatgtctaattatagcacgccgtgtaatattgaaacaaaatgaagtgatgcagtgaaatatcgagtgacaataatggaagtgaacaaattagtgtttaccaatatcagctgtgaaaatgccattaaactgtcataacaatggttgaaaaaaactagaaattctttgtgatcggtgtgttcaacaccttttaggtatgcctagaaaaattatacttgcataaatctgagagcaaaaccagttcaaaatgctgcacgtattccatgtggactcagggcgtatgatgacgtttgacatgagcttagctctagaaagcgtcgacaacctgaaacgatacgtccaagaggaattcaaaatcccagctgagaaacaagtgttgttgattagcggaggagaatgtttggacccgaagaagagggtgtgctcctattcggcaggaaccgacacaaatcctatttttctttttagtaaatcaattatcgaatctccgattcctcctccgcctactggagattatggaagtgaaagtgatgtcgatctcaaagttcaagaacactgtgatatg

SEQ ID NO: 1216 - DNA, 1366 bp, Diabrotica virgifera
cccacgcgtccggttgaagacaatctagtacactgggttattcaattttaagaactttgcaggaatatacttaacctaaagtttaaaatactttttaaaaatgaagaagaaatatgttttactcattccaattctaatctgcatgttatgtctacaaactactcaggctgcgaaaatattaggcgttttcattctttccgccaagagtcactacagtttgggaaacgcactgctaagaggacttgcagatgcaggccatgatgttacgatgataagcccttacgaggatatagtacccactaaaagcggcagctacagaagcgttgttttgacaggttttgccgagcgatatgaagctataatgaagcacgtgaatccttttgaaaaagcgtacaccaacgacttcacacacttcttaaaattccaaaagatagtctacccaggtctggaaagaaccttgtcgcatcctaacgttcagaaacttatcaattctgacgaaacctttgacgtagtgattgtagagcagtttgcgactgaagctttcaaggcattagctcaccatttcaaggcacatttagttctgttttcatccataggagctgacagtaaattaaactatgtagtgggtaatccaactatggtatcgtacgtaccacaagtagatacagatttttcaagagaaatgactttttgtcaaaggttgtataatactttgctgtatatttttgaggctgtagtcacccactaccactggcttcctttacaacaggaaggattggtgaagaaatattttccaaattcaccatctatattcgaactcaactataacgtttctttaattttggtaaattcgcatgaaagtctgcaaccatcgattcctctagtaccaaacattattcccataggaggattccatgttaagaagcccaaaccgctaccaaaagatctccagcagtatttggatgatgcaacagaaggagtaatatttgttagtttcggatcttcagtaaaggctgtcaatttgccaaaagataaaaaggaaattttaataaccagttttggcaaatttaaatcagaaagtttttatggaaatgggaagacgaatttaggtttaccaccaaatgtaaagacccagaaaatggtttccacaaatggaatctttctagctcatcccaatgtcaaactaattaatcacccatgggaggcatttctcaggttaacagaaacctgtctaccaacggcagtcccagttctttgtaagtaccaattttttggaaaccaagcgaagaatcgcccaaactgttgaattgaaataaacaatggtattaaccaatataccgcttccttgatgaaaaattttcttaat

SEQ ID NO: 1217 - DNA, 891 bp, Diabrotica virgifera
aaattccttatattgcgtttatcgatcgcgagcggccgctcgcgggagttggtttgtcagtacatggcaggtatagggtagctacagaaaggtcactatttgccatgccagaaacacagattgggtttttcccagatgttgggggatcacacttcctacctagactcacaggaaagctgggatggtatctagcactaacaggccaaagattaaagggatctgatatactcaaagcaggaattgctactcatctctgtgatagtaaagatcttcctcagttagaagaagccttgttgaacaattgtacaactgatgcagatatacaaaatactctaatcaagttttccaagaaggatgtaccaccattttcgttagaacaagtattagacaaaatagatgattatttctcagctcctactatggaggagatagtagctaaattagaaaaggatgacagcaaatgggcacaagaaactttagcacttttaaggaaaatgtctcctactagtctcaaagtgtctttaaaaatgttggaattagggcaacactataacctcgatgactgtcttcacatggaatacaatatgtgcttgactttcttgaaaaataatgatttctatgaaggtgttagagctttgttaattgacaaagaccagaaacccaactggaagcccaagacattggaagaagtcaccaccaagatagtagatgagtacttttatgatttaccaaaactaaagatcaaaatgtaaatttttttttttttttgttgtgctttaaagtgagaaatcgctttcttgttaattatgacttctttcgaaatggttttttgtttataacaatctatttttgtacaaataaatatgaaataaagggcgggcgctcaacccc

SEQ ID NO: 1218 - DNA, 1277 bp, Diabrotica virgifera
cggacgcgtgggaaaaaagtatgtagataaaactaggctactggcttattaatttctcatccaattacaattctattaatgttaaaaacgctttttcaacagcgaggtaactcactactcactctagtccaaggtcgctgttaagtgcattcaaattaaaaatatatttgtctcacaagtcagattaatatgattaaaccacctggttcgcttataaaaagttttaagtgcctgctaacctcaataaaccgaaatatgtcgtcgcaaacaagtgaggttatcgtgaaagatgtgaacaacaaaggtgttttagtgcttaacaggcccaaagcgttgaacgctctcaatttgtccatgatcgagaccatcaaaccagtattaaaagattgggagagcaagaagtctttagtattaatcaaaagcacgggagagaagtctttttgtgccggtggtgatgtaagagccgtggcagaggctggtctgagaggagaaaaaaccttaggacaaatcttcttcaagactgagtattctacgaatgcattaattggttcctataaaattccttatattgcgtttatcgatgggatcgtcatgggtggaggagttggtttgtcagtacatggcaggtatagggtagctacagaaaggtcactatttgccatgccagaaacacagattgggtttttcccagatgttgggggatcacacttcctacctagactcacaggaaagctgggatggtatctagcactaacaggccaaagattaaagggatctgatatactcaaagcaggaattgctactcatctctgtgatagtaaagatcttcctcagttagaagaagccttgttgaacaattgtacaactgatgcagatatacaaaatactctaatcaagttttccaagaaggatgtaccaccattttcgttagaacaagtattagacaaaatagatgattatttctcagctcctactatggaggagatagtagctaaattagaaaaggatgacagcaaatgggcacaagaaactttagcacttttaaggaaaatgtctcctactagtctcaaagtgtctttaaaaatgtggatattagggaaaacttaaaaccccgatgactgtcttcccttggaaaacatatgggccttgactttcctgaaaaaaaacggatttcaattaaggggttaaaagcttttttaattagccaaaaccataaacccaaaacactggacttaaaaccatttaaaaaaaaaactttaataaatgttcaatttttt

SEQ ID NO: 1219 - DNA, 1625 bp, Diabrotica virgifera
taccttaaagctttcgaaactctagttagcaagacgccaaagagggtacaggctaattatgtaatgtggagagctgcatcaaactcagtatcatatttaacagaacgtttaagaaagaggcaattagactacacagcagtaattactggcaaaacagaacgagaacccagatggaaagagtgcattgatattacttcagtcagtttatccattgcatctggagctttgtacgtaagaaaatactttaacgaacaagcaagacaaaacgctattgatatggtaaaagatatcagagctgagtttcaagatattttgaaagttgttgattggatggacgaagaaacaagagaaaatgcattggaaaaagctaaatctatgacgtcgcacattgcctatcctgacgaattactcgatgatgaaaaacttaaagaattttatgatggtctggaaatggaccgtaaccaatactttaaatcaattttaaatctaactctgttcggaacaagattttcattcaaaagattgagacaacctgtaaataaaactgactggattactcacggaagacctgctattgttaacgcattttattcatctattgaaaatagcatacagttccctgctggtattctccaaggagtattctttaacgctgatcgtcccagatatatgaactatggtgcaattggctttgttattggacatgagatcacacatggttttgacgatcaaggtagacaatttgataaagtgggaaatttagtagattggtggcaagaaacaacgaagaaacgatttgtggaaaaagctcaatgtattattgatcaatatgctaattacactgttccagaactaaatttaaatttaaacggtatcaacacacaaggtgaaaatatagccgacaatggcggaattaaagaagcttatcttgcctataacagttgggtagggagacatggaaccgagcctaaacttcctggactcaaatatactcccaatcaactattctggatctcggctgccaattcttggtgttccaaatatagaccggagtctcttaaattaagagttctgacaggatatcattctccagcaccatttcgaattattggacccatgagtaattctgaatactttaataaagactttaaatgtcccgaaggatcgaatatgaatagagttaagaaatgctctgtttggtaacattttttgaatctttatatacaagtgctatcttctaggtttctgcaaaattaaagcacataaaaaactaaaacccgttttgttgcttttaaaaatgtatcagatatttctgcataggcaataggtgtttttacacgagactttgtaaacaaaacctgttctgctattcgagtcgaattcccggtcccattgagtaggcagcaattttatagaaatatatgatgatatttttaattgacattaaacataataataattgtgcaaatctatttcatactagcgtttctcgttgtgcgttattattgcatgtcgtttagtaaatctgtaggaatgttcttgaagttaggaacttgtcacttacctttgattttcacaaaaatgagggttttcataaaatgattgtcattcacatctgaaattgc

SEQ ID NO: 1220 - DNA, 1562 bp, Diabrotica virgifera
cttttggaaagccaccggttggagaattaagatttagggaacctcaaccagccgaaccatggagtggaatattagatgcaaatcaaaataccaaagcctgctaccaagttaatgatttccttaacataagcagtatacagacagaagactgtctgtttcttaatgtttatacaccaaaatacccatcaaccactaactcctatcctgtactatttttcctctatggaggaggatttatgggaggagcctctacctttaccgcagctggcccacattatcttattgaaggtgaagtaatagtagtgacgtctagctacagggttggtccatttagttatttcttatcaattgtagataaataatttcctgtaaattactatatatatattttaagtgaatggaacttaaatgtaaaagagtattaaattttgattttttgacaaattttattattaaatattttcatatattaaagcaggatattatttatttttatatattattattattattttttataagttttttattaaaatataaatttaaattatttaaatttagtaatgatgataatattagtattataaaattgtacatttagtaaatctatttaggtttattagaggaattcggcaacatttttttcacctgtttattaaaaacatgtgtttttgcatatatataaagaccaagttaatatgggatccaaaactttccaggaaagtattggtaatgaacaaatcgtccaaggatttttctttggtccagttattgaacaaccgagtgaaactgcctttattactgaaccattttattcaactgtcgaaggtggaaggatgagcaaagttcctttgtttatcggtatcaactcagaagaagctctggacagaatcacatattcgtatttcccagggtctgtccaagcgtacgatgctgatgtcaagcagttagtaaatagaaacatgcatatacaagacgatgctacaaaagaaaccattgggaatgaattagacgcatttatactgatggacgtttgcaagacaatatggctgctgctataaagtatttcagtgatatgtcatttacacgtccacttattcggcacgcccacatgcagtccatatacagtgacgtttacttctaccaattttcttaccatggacaattaggaggaaacagaccatatcttgaacggacgcgtgggctagctcgtggggaagaaggtaactatgtttggtgttacggaaactggtcatatttggaatactggccaccagccgatgtcttgaccagtgaaagatttcgtaccctaatgaccaacttcgtaaaatatttaaacccaactccaaaacgttccaaacttttggataacatcatttggccgacagtgaaaaactacgatttcaagtacctaaacatcaatgatactttaagtattgagactgatcccaaaaatttaacttatccccagtgggttcacttgtacgacgatgacagcttcagaccatttattacttattaaatgtaatacataatatgtaataataaaggagtattttatt

SEQ ID NO: 1221 - DNA, 1550 bp, Diabrotica virgifera
aaaatggtgatcattaaatacctgttttctttgtttttaacgtatcatttagtaaaaggtgatgacgttatagtaactataccaaatggccaactacgaggaagattagaatattctctgagaaagaatgtcaccttttatgctttccaacaaattccttttggaaagccaccggttggagaattaagatttagggaacctcaaccagccgaaccatggagtggaatattagatgcaaatcaaaataccaaagcctgctaccaagttaatgatttccttaacataagcagtatacagacagaagactgtctgtttcttaatgtttatacaccaaaatacccatcaaccactaactcctatcctgtactatttttcctctatggaggaggatttatgggaggagcctctacctttaccgcagctggcccacattatcttattgaaggtgaagtaatagtagtgacggctagctacagggttggtccatttggttttctttcaactggagacgcagcatcaccaggaaattacggattgaaggaccaaacacttgcgcttaaatgggttagagacaacattaaatattttggtggagatcccgataaagtgactatccatggagctagcgctggaggagcatcagttactttccatctagcaagtccacaatcccgaggtttgttcagagcagggatttcccacagtggatcactcttgatgccttgggcttaccaggatggagctaaagaaattgcttaccgattagcccaagctatcgatggcaactttgatccaactgctacaactgaagagttagtacagtttttgagatcagctaccgctgaccaagttaatatggctgccaaaactttccaggaaagcattggtaatgaacaaatcgtccaaggatttttctttggtccagttattgaacaaccgagtgaaactgcttttattactgaaccaatgtattcaactatcgaaggtggaaggatgagcaaagttcctttgtttatcggtatcaactcagaagaagctctggacagaatcacatattcgtatttcccagggtctgtccaagcgtacgatgctgatgtcaagcagttagtaaatagaaacatgcatatacaagacgatgctaccaaagaaaccatcgggaatgaattagacgcatttatactgatggacgtttgcaagacaatatggctgctgctataaagtatttcagtgatatgtcatttacacgtccacttattcggcacgcccacatgcagtccatatacagtgacgtttacttctaccaattttcttaccatggacaataaggaggaaaaaaaaacaatttttttaagggggcgataggggagcctccccgcgagaaaagggaaattttttttggggggtttcgggaaaatggggccatttttgaaaaatagggcccccccccccccctgcctttctcccccgggaaaaaatttttttatccccccacaatgccccacaccctttccaaaaaaatattttttaaaaccccccccccccccccacaa

SEQ ID NO: 1222 - DNA, 1100 bp, Diabrotica virgifera
cccacccgtccgaattatttcatttgtgacctttgatctttgataaacccgatcatcatgtgaaaactaaaatcagtattctcagtttatacacacaatgtttttccaaagtgttgtcttcttgttttgtgtttatacagtgtacccctgcagtgacattacctttaacaacgtaaatgttactctgaaaggtgctaaagacatcaaggaaataacaggatgtttcgagcccacagaagatttaataaaggtatcctacatccagatcatcaaccaaaatattcctgttataaaaagaaacgctataaacagtttgccgaagctcatagacgtcattttggaggaaaacaacattacggacatcgaacctggagcttttagaaatctttcaatgctttatctgcttaaaataagaaataacaacattcgaatgattcgcgaaggtgtgtttgctgatctaccacttacagagctaaatctgatgaataacagcatagaaatcattcatccaaatgctttcgacaacatgcctaacttaatagtgctgtccctcaacgaaaacaaaattacatctctttctaataattggtttaaatctagtcccaaagtgggaaatattaacttggagagaaattatatatctgtcattcccaacaagatattgcaaaacatacatggagagcatatagtgcgaaatattaccattctgacgaatattatgttaaacgacaacaccatccataaaattgaagatggtgcttttaatgggcctgaaacgctgggttggttgtttttgcacagaaacgaaattggcgaaataagtgaaaacagtctgggttctctgaagaccatcgaatgggtgagactggatcataataaactgaagtgcgtgcctgacaaactagtagaaatttctcctaaaatagtgtactatctgcaatcgaatccttatctgaaatgtgtataaataaactcatataactgctgttttataaaattatactagttgtagttggatcactaattgtaagaatttgacatcatgacatcattacctttagctaaaaatagtatttaccaaatatatttttataacgtat

SEQ ID NO: 1223 - DNA, 667 bp, Diabrotica virgifera
agcggatcgacgactccaattattgtctgagatcggttacccttaccgttagacatgcttataacgttttttgcacgattgataccactataaattataaaattaaacattttcgtcatatggactagtttcattcattttattaagatagatactttggttgttaggtagtaactagggtgcataacaacaatggagaattgagtttttatttagttgtcaataattttaagtacaattttgattattataaattaaaatatgagcgaaagtgaatttgaagaaattgaacgggcttgggaagaagggtgttccgcaattagtcccgaaaaatccaaaatccgttatcaaaatagctaccaaagttttaaaaaatggtccgaaggcaagaatttaagaatcggagaaaagactctattggcatatttcgttcaaagacatatgcagttgaaagctcctggatgcctctgggcagaatatttaatgattaaatccaccctttttctttataatggcattgatatttccaagtattcaactttgattgcgtatttgaagagaaaaaatattggatactactaatgtaggcgtttctgcaggagtttctgttagaagtgaaaccacagctcaaacaagtgggatttcattaaataatttaacaaattgt

SEQ ID NO: 1224 - DNA, 1156 bp, Diabrotica virgifera
  misc_feature (1106)..(1106): n is a, c, g, or t
atttaaaaaggtacatggatatgtatgtacctagatgtggcaaagatcctttaataaacctataaaacatcttataaggagtggagcaaacatctgctcgctataaaattccgattatcaatctctctgaaagacaactatcagaataatgttgacatattgtttattttaagtgaaatgaaagtggtgtattacagacaaatttgaactgctacttatttgtgtagggataggattgagattatagaagggtgagtgtagcgctgtcgttgtaaaagcaacgacttttcttggcaatcattttgctctcgcattattgtaagttcttactttcgatatcgtttttgttcaaagcgaatttagtgtcttagaaagttaatttaataacgactgcgttcattttttacggtacagtaagtcatttcttaagaccattatttactatattcgtgaaactggatttctgttgaaatttgcaggaattacaattatcagagaatatgactgttacattggcggccaaacatgaagtagccattgacgataatgacaatgaaacatgttacgaatactaagaatggcatacacgatcacacgcaatccttattagaagacctacccacctctgaagaaaaagaagagagcaaaaagattgttgatgattccgacagcgatgatgaatacgatgaaatttactaccagaaagcaagacagctcttaccctacgaagaggcccccgaatatttacgacataatccgtatatattgacaggatatagaaggaatcttaaaacaaatttatgtatatctagtgtattttggtggaccaatgaaacgataaatatttggtctcatatatttgggttattcctttttgtggcattaacagtgtacgattttatgattttacacgtgcaagcaactctatcggacaaaattatagtttctttccttctaggatgttttatgacatgtatggcattttctgcattataccacacattttcatgcagatcagaaaaggattgtgaaaaatatttatcatatgatctttttggtatagcgttgtctttgctagctatttatacatctggaatatattatgnccttctggtgtgatacagactggcaactattctataccataacagtgact

SEQ ID NO: 1225 - DNA, 1271 bp, Diabrotica virgifera
ctgtttaattattaggtgaatagtaacggaacgatgttgatcgtagtagttgaatctcattgtatagaacaatcccattgtatacatttaacgttccattgtgtttgtcacaactaaaaaaacatttatatttaccatattttttaaacaaaaacaggaacaaacgtttagatatgaacacattgtttttagagtattatccactcaaatttactgatatatttcagaatggcatacacgatcacacgcaatccttattagaagacctacccacctctgaagaaaaagaagagagcaaaaagattgttgatgattccgacagcgatgatgaatacgatgaaatttactaccagaaagcaagacagctcttaccctacgaagaggcccccgaatatttacgacataatccgtatatattgacaggatatagaaggaatcttaaaacaaatttatgtatatctagtgtattttggtggaccaatgaaacgataaatatttggtctcatatatttgggttattcctttttgtggcattaacagtgtacgattttatgattttacacgtgcaagcaactctatcggacaaaattatagtttctttatttctaggatgttttatgacatgtatggcattttctgcattataccacacattttcatgcagatcagaaaaggattgtgaaaaatatttatcatatgatctttttggtatagcgttgtctttgctagctatttatacatctggaatatattatgccttctggtgtgatacagactggcaactattctataccataacagtgactgtgatatttgctgtagcaatgacattacatattcccgaatttaatgtggatcctaatggccagacaatagtgtttgtagccttggggctctacggtgtcattccaactattcatttggacattaaataaaaaaggggggacaatcctttggtctttttcttactttctttctttcacaaagaaaaaaaaaatagaacatgaatttccgggtttttttctttcttactttcacaaaacacaaaaaccccggaaaaacattttttggtgtggaaaatattcaacatttttttggaaacctccccctccattggggggggggcactttttttttttttttttgttgtgtttctcccctttaattttgtatcacccaaaacaaagggtgtgttaaaaaattttaaaaataataaaaaaaaaaaaaaaaaaaataaaaaaaaaattgtctcttttggtgcgcccccccac

SEQ ID NO: 1226 - DNA, 1143 bp, Diabrotica virgifera
  misc_feature (1131)..(1131): n is a, c, g, or t
atttaagggtgttcttatcaaaatgacaatcaattaatcctgctaatattattgtttaaaaaatggctcgaacgaagtttttattttaataaaatctgcatatgtgttatacctacggtttctgctataatcgagagttaagaaataaaaatctctatatagcaaaaatttagcggacaacaatgagcctaggaggatatttattgttgtattgatcagttcaccctacctaaagatatatatttaaaaaggtacatggatatgtatgtacctagatgtggcaaagatcctttaataaacctataaaacatcttataaggagtggagcaaacatctgctcgctataaaattccgattatcaatctctctgaaagacaactatcagaataatgttgacatattgtttattttaagtgaaatgaaagtggtgtattacagacaaatttgaactgctacttatttgtgtagggataggattgagtttatagtaggctatggttttcagtatcggtactgttagatgtgtttcagagtttgatgatcaagagtaggctatgcaatcttagtcatccctttccaaaagtttgtagccactagttgtggcaggtatgttgttgaacaagtattcctgatactctgtctttataagaaacctttactactaagtttgtatataaacctaaaggtttgtcaaaaaggcgaattgatagaatacacttatgaatgccggaagtgtttattctcacttgccagaaggtgacagtgaacgctgttattaacctacctaagtacatagggctcaattcttcattgatgctgtctggggcttattctatggagaaagtacttcaggtagatttatgacaaccgtttgaaaccctaattttagctgatatattactttaattgatgtgctctattgtttgtaattatatttcccaggtatgtattttagatgatcgccaaaacagtcacttttgtgtttcattaattagaaacaatttgataatctacctactccgtgtgtttattaagacattgatctcgataatcatactaagtacttatgatttacgtagactgttaaaatgtttctctgtatatgaaatatatatatgtatatgtgattanaatagatatatg

SEQ ID NO: 1227 - DNA, 938 bp, Diabrotica virgifera
cggacgcgtgggcggcccgccatgtctttgatcaacaaattgtttagcaacggagagcggtcagtgtgagtgtagcgctgtcgttgtaaaagcaacgacttttcttggcaatcattttgctctcgcattattgtaagttcttactttcgatatcgtttttgttcaaagcgaatttagtgtcttagaaagttaatttaataacgactgcgttcattttttacggtacagtaagtcatttcttaagaccattatttactatattcgtgaaactggatttctgttgaaatttgcaggaattacaattatcagagatatttgtgtgaaaagatgacatctaaattaaggctatggatcgcaccttattcggaactttctctagaaggagatggagcattttgtaaaccatgcggcaaatcgaatatgactgttacattggcggccaaacatgaagtagccattgacgataatgacaatgaaacatgttgtacgaatactaagaatggcatacacgatcacacgcaatccttattagaagacctacccacctctgaagaaaaagaagagagcaaaaagattgttgatgattccgacagcgatgatgaatacgatgaaatttactaccagaaagcaagacagctcttaccctacgaagaggcccccgaatatttacgacataatccgtatatattgacaggatatagaaggaatcttaaaacaaatttatgtatatctagtgtattttggtggaccaatgaaacgataaatatttggtctcatatatttgggttattcctttttgtggcattaacagtgtacgattttatgattttacacgtgcaagcaactctatcggacaaaatatagtttctttatttctaggatgttttatgacatgtatggcattttctgcattataccaccacattttcatgcagatc

SEQ ID NO: 1228 - DNA, 804 bp, Diabrotica virgifera
ccccacgcgtccgccctttttttttttgtccgaccgtcgggttgtttgtatgatttgtactctattagcgatattctattattttcttagagcaatggccgccaaccaagaaagaacttttataatgatcaaacccgacggtgtccaaaggggccttgttggaaaaattatcaaaaggttcgaacagaaaggattccgtctagtagcaatgaaattcatgtggccttctgaagaacttttgaagaaacactacgctgacttagctggcaaacctttcttcgcaggtctagtaaagtacatgagctctggcccagtagtgccaatggtatgggaaggtttaggcgtagtaaaaaccggtcgtgttctcctaggtgctaccaatcctgctgacagtgcccctggcaccatcagaggagacctctgcatccaagtaggacgtaacatctgccacggttcagacgctgttgaatcagcaaacaaggaaatcgacttgtggtttactgaaaaggaattagtaccctggacaccagctgccaaaacttgggtctacgaagactagataaaatactcttactatcttttgtatttaataagtaaccaataacaaaaataaaataaagtcgctaaataaaaacatttgatacagtcaaaaaaaaaaaaaaaactgactattaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagcggaaaaaaaaaaaagggggggggccccctaaaagaaacc

SEQ ID NO: 1229 - DNA, 1158 bp, Diabrotica virgifera
ccggacgcgtggggtgactagtgaggaactcatttatagttcgacgccgacgtaaagtctcatagtatggctgaacgtctagatcttctcctatttggagcaacaggggtcacaggtctacatgctattcgataccttcacaaattttcgaaagaaaaaaagttaacctggggtgtttctggacgctcggagacaaaacttaaagcagttttaaagaatgaaggtttacggatgggtgaagatttatccataatcccaatcgtacttgccgatacaaaagatcagaaatctttaaatgaaatggctaaaaaagcaaaagttttgctgaattgttgtggaccatacagactgttgggctttccggtagtagaagcttgtattaaagctgggactcaccatttagatgtaagtggtgaacccagttatatagattcacttccagaaaagtacgatgctgctgcaaaagaaaaaggaatttatatcgtcagtgcgtgtggtgtcgactgtgttcccacggatttgggttcggcatatctgcagcaaaaatttgatggcgtattgaattcagtggttgcctacgtggaactatggactgaaggtaaaagtagcggatccgttggcggttatgggacttggcaaagccttgtttatgaattccagacaatgggttcattaagtaaactaaaagcaaagctgattccaccttcagactctgcgtttaaaccaacgttgccagttaagatccgtccattctattcggaggtaactaagggttgggtgatgccctttgcaggacacgatagaaagataatgcaagagactcaaaagtatttctacgaaaaagaatcgcaaagaccaattaatggtcaagtactgatgtccgttacgagtatctttacattgatttatattaatattgtattgttaacgctatttgctttagctcaattttccttcacaagaaattggttgatagaaaatccccaaatcttttcttttggctacgtcaaaaaaaaaaaaacattccgaaaaaaaaaaaagaaacccttcttaaaaaaaccaaaaacaagggggccggcattctattctaacattttgttttgaaaaagagacgggaaacaaaaactttacacactagacatttagtacacatccccc

SEQ ID NO: 1230 - DNA, 1889 bp, Diabrotica virgifera
gacccacgcgtccgtgaacgtctagatcttctcctatttggagcaacaggggtcacaggtctacatgctattcgataccttcacaaattttcgaaagaaaaaaagttaacctggggtgtttctggacgctcggagacaaaacttaaagcagttttaaagaatgaaggtttacggatgggtgaagatttatccaaaatcccaatcatacttgccgatacaaaagatcagaaatctttaaatgaaatggctaaaaaagcaaaagttttgctgaattgttgtggaccatacagactgttgggctttccggtagtagaagcttgtattaaagctgggactcaccatttagatgtaagtggtgaacccagttatatagattcacttccagaaaagtacgatgctgctgcaaaagaaaaaggaatttatatcgtcagtgcgtgtggtgtcgactgtgttcccacggatttgggttcggcatatctgcagcaaaaatttgatggcgtattgaattcagtggttgcctacgtggaactatggactgaaggtaaaagtagcggatccgttggcggttatgggacttggcaaagccttgtttatgaattccagacaatgggttcattaagtaaactaaaacgaaagctgattccaccttcagactctgcgtttaaaccaacgttgccagttaagatccgtccattcaatacgccatcaaatttttgctgaagatttatccaaaatcccaatcgtacttgccgatacaaaagatcagaaatctttaaatgaaatggctaaaaaagcaaaagttttgctgaattgttgtggaccatacagactgttgggctttccggtagtagaagcttgtattaaagctgggactcaccatttagatgtaagtggtgaacccagttatatagattcacttccagaaaagtacgatgctgctgcaaaagaaaaaggaatttatatcgtcagtgcgtgtggtgtcgactgtgttcccacggatttgggttcggcatatctgcagcaaaaatttgatggcgtattgaattcagtggttgcctacgtggaactatggactgaaggtaaaagtagcggatccgttggcggttatgggacttggcaaagccttgtttatgaattccagacaatgggttcattaagtaaactaaaagcaaagctgattccaccttcagactctgcgtttaaaccaacgttgccagttaagatccgtccattctattcggaggtaactaagggttgggtgatgccctttgcaggacacgatagaaagataatgcaagagactcaaaagtatttctatgaaaaagaatcgcaaagaccaattaatggtcaagtactgatgtccgttacgagtatctttacattgatttatattaatattgtattgttaacgctatttgctttagctcaattttccttcacaagaaattggttgatagaatatccccaaatcttttcttttggctacgtcaaaaaagaagagcatccttctgaagaagtcaaagcaggcggtcgctatcgtctaacattgtatggagaaggatggaaagagaagctggcaaatgtaaacgatcagtacgctatgccacctaacaggagcattttagctcaattacaatttgaaaacttctacacttttactgttctcggattaatgtgtgccggtatcgctattttgaacgaaaaagacaaattgccgaaaagtggtggtgtatatagtgcaggagcagcttttgggaaaacgtctcttatgaaaatgttgatagagaatggaacttcattcgaaataaaaagtgttaaagacatataataaatttaaataaaatataaatacacatccgtaacaactcaaaaaagggcggccgctcgcg

SEQ ID NO: 1231 - DNA, 810 bp, Diabrotica virgifera
cccacgcgtccggttcaaattataatagtttaatgtgttattatttacttttaataaattgtaggacctatattttttaatagtatcaattgaattttgaagtgatctacataggtacatttgtgaaatatcaaatatggctagaggcccaacaatagtggcggtccacagtgccgctagccagggtggaataaattgttgcttttgtcgatgctgcacatgtttacaactgcaagttttgaaaagtccggaaggcattattaaactagccgaaatacttctaggtttcttctgtcaaagtctggctctaaattttggtgcaggttacgcttcgacgattggttcatcgtaccagtcctttttatctacagcttcgtggtgcctcctaactagttttcttctcctgtttagctacgtatgctcccaaaagtcactgaatttgctgagatcttctttgtttgaaactcttttcaatggagtagctgcattaagttattttggatcgtgttcgtatttaggatgggctgtgaatacatttcttcaaccaatgtacgtcattactccatttttccaagtctatcccgcaatgagtgctgcttacatgatgggtacaattcttgggtgtatttatgcctacgatggatataagtcataccaatattttaaaggatttagataagatattgacaaacacagacatgttttttcattgtatttttataagttattcacatgtatatttaatattataccttttctagtcagcatgtttaaataaatattatatacatatttttcccttaattttat

SEQ ID NO: 1232 - DNA, 931 bp, Diabrotica virgifera
ccccacgcgtctgtagaataagcagactgttaccatgacgcgaagggtaattggatgttacggagtaagatctggggagacccgcattgtgcgggagaaaacgtcaggaagcctctttccaaccaagttcgacaactacattgtgtacaacgtaggaaatactcctgtaacagcagagggaattttctcaactaaattaaggtggcataaagctgtcacgagctatgttctacaaccaggtgaatcacgtgtacttgaaatgtcgggagttttgttttttggaattggaattcgccttattaacgagtcaaattccagggctattgtccactgtgctgatgaaactggttatgtcattttagaggaaggaactgcccaaaagccaaaaatcgatattgatagagtagaaataactaataatcgctactgtgtgggcaaattatcttatattggcgatgacttttccaaaatcattaacatattttggcccaaacacgaagcaaatatctggagcaagtttcaggatctagtaaatgatgaattagatagaactgtaagggaacaagtaaacagcgtactaaataatgagttaaggataatcaaagaccacctagatgatcttaacaaaaatatcgaaaattccgctgacctttacaaaaacacatcagacttaatatttggtctcgaaaaggaatttacatttgcagactataagaatcatgaaatgagtttctattgtcttccatattattcagctctggttactttgcaagtactttattaccaattcgggattgttaaccaaaagaagatcaatctttcgggacgaatatatcacgaaaataaaaaatgattctaaaattcttttgtgattttgcagtaacgtgggtacaaaaagtattcactgaggagtgaatcatgtttatgaaac

SEQ ID NO: 1233 - DNA, 885 bp, Diabrotica virgifera
  misc_feature (687)..(687): n is a, c, g, or t
  misc_feature (772)..(772): n is a, c, g, or t
  misc_feature (802)..(802): n is a, c, g, or t
  misc_feature (810)..(810): n is a, c, g, or t
caagtctccgaaccgagcccaacccagaggcgattttacaaaatatgcccactgtcagcacaacctccgccttctacacatacgtcatccagaactgtaagtgtccgtacccgctatcaacacatcttgggaaatatacccgattccaatacatgtggtgtaatttgaatccactgtgttttgtattttcactaaagttttctatccatttattgcattgcacactataatctatctccgtattatttcggtttagatttgttcgtccgcacacgttaagatcagcattatcagaacatgattcaatctctaatacatattcatcgtgcagttttaaatattttcttaaatataattcagatattctttctacgtatttagatgaaacgatgaccaccaacaaactgacgaccacactcaagattactgcataatagtttgttaaaaggttcaaatggcaacatctgttctggggtcgagtatattttgtgagatgtgttggtggcggatacgtatacttcttttctggatgacatattttggtatattttgtaaaattgcggcccggagcagtggcatggagcccaagcaagcaattttagttacgcggacaagtcactagaggataacaggtctaaagcgcctcacgctagcctgaatttacaatcgattaggattagggcatcnacgttggagttctattacccagaactcccacgtgaagagcatttggctcatagttgtgcccctatcgcgcatcagagtgctatanggggggaaaagggatggtctggagcattgnaaacgtgntggagtgacttctgtttttactttgagtatacacctcgctccaatgaattgtacactcgaatgtctttctaagga

SEQ ID NO: 1234 - DNA, 873 bp, Diabrotica virgifera
cgagactgacgatagagaacaggtacgcggtaaacagtaattttgtaaagctcagttttcggtaaaaatgtattgtcctacttttcgagtgttgtcatgtacaaaacaaatcaccaaccaactcagaaaaaaatccatacaaattagttccaattcagatgagtctccattggacggtattagaattttagatttgaccagaattgtagctggccctttttgtactatggttttaagtgatctaggggctgaagttatcaaagttgaacgtccaaaaacgggggatgaatgccgtaaatggggcccaccttttgcaaacaacacacaagaaccttgctattttctctcagtcaacagaaacaagaaaagtatgtgtgttgatttgaaacatccagaaggaaagagtatattgtacgatttagcgaagaagagtgatgtcttggtagaaaactatgttcctggcaaactagacgagctgaaacttggctatgaagattttcgaaaagtggcaccacatttaatatactgttcaatcactggttatggtcctgatggtccttataaaaatagacctggttatgatgttatagcagcatctatgggtggtttaattcatgctacaggtactataagcggagaaccagtcaaagttggagtagctatgacagatgtaactactggtctctacgcacatggagccatcatggcggctctcatcaaacgctcgagaaccggaagaggccagaaaaatgattgcaatcttctttccactcaaatatcgacacttataaacatcgggagccaactacctgaacgctggcaaagaggccacaaaatggggcaccgcacacgaaagtatagtaccctacaaat

SEQ ID NO: 1235 - DNA, 1056 bp, Diabrotica virgifera
cggacgcgtgggtttttttttttaatataaaaatataattttcatttaacaatacatattacaaagtttaaaatttattataaccccctagcaggtcgtttcaatactttgggacagcatacgccagcatactttgattctactggacaaaagtatttggtgtatgctgctaaatcggtcaaataaggtaaaactgtcggacagtctttgattaatacacattcaccttcaaccccttgtggggtttttggacaaacaccatggggataattaacaaggttgttatctcccagttcaaaaacaccatcaggcaaagtaatcgttctgttggaattcatagctgatgctagccaaggtaaactatcctcaattttaggttttacatcaggacgagttgaggtggcaattggcgtaggaacacgagcatggtgagaagaatatgaagatgcaagtcgtggagcataatccatgtggagactgggcgaaaacgaggcagacgctaaatatgaatgaccaatcgcaggtcttcttgccattttgttgtaggctcttactggtcctccaaaacgacctcctctattttgtgaagcttcctcagtatcaacagcattagttgcattgggttttacaacaactagtgaagtaacctcagtcacgaaagaatacttaagtgctaattctaaggcctttttggtcaattcgtctttattttcggctacttcccttttttcaagagtttgtttaatggtcagataagcccacaatctctccaaagatgtaacgggttcttcgatttttggtaataatctaatgggtcctcttctgcctaaaccgtttacttcagcagttagcttgtttcctgtatacttcccagcaatagcaatctcgtttcctctaaagtagatgggatagtggattctagtcagttccttggcttccgtgtcatatttaaagttgatgttggtcattagaggtgatgatattataaaagtcgtgcaactgtagagcagcatcgcttgcatcataaatgtgtctggaaaatccagagttctcgag

SEQ ID NO: 1236 - DNA, 1036 bp, Diabrotica virgifera
cattcacattattcggtttggtgcatgcgattcgtgttagttgtcagaaaccaaaagttacagatacagatacaacattcttcaagtaacagattctaatcaaataaaccaaaaatgaagatgagacgagttatattggacgtagatgttgggacggatgactacatggcattgttgcatttaatgcatgccgaaaatagaggcgaaatcaaaattgaaggaatagtttgcacaagtggaaatactgatcttgaccatgttgtaatcaatactgtgaggctattggaacttataggaaggactgatataccggtattcaaaggggctaaacgtgaattaatacttttaaataatatagaacgctatcatggtgaagacggtcttggagatttatattatgacacagatccagatctgtcgatagtaagtaaaacaccagcagctgtagcaatacacgacatagtagacgcgcaccctaatgcagtttcactaatctgcgttggacctctaaccaatttggctttatctcttaaactttacgacgacttggcttctaagattaaggatgtatggattatgggaggaaactacactgctgttggaaatgtttcaagatgtgccgaatttaattttcatgtagacccagaagcagcttacatagcacttgaaaatctgatatgtccgatttatgtactaccttgggaaacttgtcttctgccaaaaataccactggaatggaggtttgaagctttgggaaacgcgacacctgaacttacgttattaaccaaagcggaagaaattatatacaaaagacacaatagggaacactggattccctgcgatacattcctgaccttcgcttttacgaatcctgaggagcacattcttaaatctagtattcaccatgcgtctgttgagcttcatggcgatctcacaagaggacaggttgtattagatcatctgaagatgaaatcacccaatgttattatttatagagatatagatactcagttatttattaaagaaatgctaaaat

SEQ ID NO: 1237 - DNA, 1113 bp, Diabrotica virgifera
ccgccttctgcaccaccaccaagagtagaaactatcgcagaggctgtgaaagccgcttcgaagatacctcaaggattcaaggacctggtgatgaagaaatgtgaagagcgagggatgctctttgtacccatgccgaacaagtatcatgaagcgaagcaagtttacaaaatcggatcgaacggcatgcagtgttacatagacagaaacgttatattttattctcagaataactcaacgtggatccctacgtcacttaacaagttattagactctgcgtaaatctaattgtaaggtattcacgtgacaaatgcccaattgtaaacaaacgaccaagatcaaaggtgatatcattatcacgtagcgctacaaccctggctgggtcttggctgactgtacatcttgtttccaatttgtttggtcttccatcaacctagggtcaaattgaatgttcatttttcggagatctgaggatgctatctctccatcgcattctgggacgtccgagtggtcttttgcgtgtaggaatctcctcccataccagtcttacaagtctctcgttatgaagtttgtgcacgtggcctgcccatcttagtcgctgtgatttaatttcttggagaatagtgatgtcgtggtgaggtccgaaaattttttcgttcaaaacgtcagagcttttcttcgtttgctttggtcatggtccacgtttcgcatccatatgttagtacaggtctgacgatggatttatagattttgatcttggaacttcctgtaagattttttgattttataagcttatccagtgcgaatagacagcgatttcccgattggattctgtcttttatttcttcagtaacatcgttgtcagctgtgattacggcccccagatacttaaaacgttgtaccctttgaaatttaaggtgttgaccgtcacattttgtcctagcctgtctcttcccgttgttctatttatacaaccatatatttttgtaccatcctccgtgtttattaattcattgggaactgttcctttttccatttttgctatatgtccgagccatcttaatcttagtactagagtacctcacaatttaataatccgggtgtcaaaatgcttag

SEQ ID NO: 1238 - DNA, 1329 bp, Diabrotica virgifera
atcgaaaattggcaataataactttgtttacggcagctctaaatagatagcggtggtctcttaataccggattcttcttcggcctgggcttcttcttccggcgatttcgccctgtattatgaggtgtaaaaggttatacctctctagatgtctcattacatcgaccgaaacagtcctacagtaacagtaagacttgagttcgaactaatacagaaacataaaggtatagttgttacattatatctttacacacacgtcatgattcattttcaaacaaaacaacaaatgtgaaacatacgtcaatatgtaatatcatcatcatcacgtagcgctacaaccctgggtggatcctggcgactgtacaactttcttccaatttgtttggtcttccatcaacctagggtcaaatggggttgttcatttttcggagatctgcttggatgttatctctccatcgcattctgggacgtccgagtggtcttttgcctgtaggaatctcctcccatactagtcttacaatatgtaatatcgcaaaatctgaatatcacttaatgaccaaatatgtatctcaaaagactggcattgaaagtttttgtagtgtgtatttcactttctcaagttctctgccatccagtccttctatcttctcttcttctattactgagccatattttgtgactgaagaatatttgtctatgatatggagtatgatacttatacaacattaacttggctgatgatggaagcataacactcaaggaagaaatagtaattgaactgactctgcctagtcgacacttacccaaatatcgataagcttgtacataatgaagtgaatgtatcataatggataaaacaagacaaatcgtcctattagaggtaaaactaactaagtgcacttttttgagatattgacatttttattaatttgaactcgatacggtactgcccagctctggagaagtcacctgggactctaacccttctaattgctgagataatttatggtacaattcactaagtgcattattgtgaattttggtttcagggcaaaactcattaaaacgtattattgcacttagtgaatttttccttccaagattgtgaatttcggtttcatggtaaaactcattattgcacttattgcatttttccttacaatctggaatgccgaatcggtacttagtggtctttcaaacaatacattagataacataatttattttgcgattcagcaggcgacttgtgtgttacattgcactgttgaaagtgtacattatatttgtgtgcattatctgttcagcaattgattattattaaagaaatatg

SEQ ID NO: 1239 - DNA, 492 bp, Diabrotica virgifera
tttgggcggcgagggccgcccaaaaaccccaaggaaggaacttttcaaaacaccccccaacgccaggacacaacgaccgccacaagagccgacaagggctacgtcttggttaaacaatttagttgaatgacgtgaaaatattatttttggagctttggtacaatagaaacttttttgttccggttgttttagtattaaacgtattataaatacagattctgttatttttgctcaatttttttgtttatctaatccgatttaaaatgataatattgcatggaacatttttcaaatagagatctttatattttttgaacaaactttgttgtcgaaatgacaagagtaggaaaaatttagaaatatacgacaaacgttttattttttataaaatattttgtaaatttttcctcttttcggaagacctactttagttagtcgtagacgtagtttttaaatgacaccctgtaaattgtacattgtatatagaccttg

SEQ ID NO: 1240 - DNA, 1231 bp, Diabrotica virgifera
tgataaagtttgattagtttttgtggacacggaatgatgtccaaaaacatcgtcaccatgtctagggaaatatcgagaagactctctctgacagctttacaatttcagagaacttatgcaacagatcggccatattctacagctcttggagttgtgtctgacgaaatgcaagacaaagacatctacgaatacaagatcgaaaaggtggatcctatccccaaagactacaaagagattcctggtcccaaagagctcccatttattggcaattcttggaggtttgcacctattattggtcactataaaattcatgaactagacaaagtgatgtggtcgttgcacaaacaatatggcaaaatcgccaaagttagtggtttgattggccatccagatttgctgtttatttttgatggcgacgagatcaaaaatggtttcaagaaggaagaagccatgcctcatcgaccatcaatgccctcgttgcactattataagcagaagttgcagaaagattttttcaatggaaatgagggaattattggagtacatggtcccaaatgggagacgtttcggaaacaagtgcagcaattcttgctacccccaataacagctaagaagtatatcgaacctttagatgagatttcaactgacttcataaatcgaatggaaaacatgttagataccaacagagaattaccagatcacttcctatcagaaatttataaatgggcattagaatctgtagcgagagtctcattaaatagaagactgggatgcctagaaccaaacctacctcaagattcagaatctcagaaaattattaatgccattaatacgtttttctggaatgtagcagaggtagaacttaaactcccaatttggagggtctacaaaaataattcatttaaaaagtatattggagccttagaagatttcagaacattgtgcttgaagtatatcacccattcaatcgaagaaatcaggtcaaaatcatatgacaacgtcaaggaacaagatatttcgattttggaacaaatactgttaaaaactggcaatgcaaaactggcggcagtattggctttggatctctttctagtaggagtagatacgacttcgattgctgtagcctccacgatgtatcagttatcgcaaaatccagataaacaacaaaaattattcaaagaacttaacaggggtctccccagccttgaaccaaaaatgaaatacctgcaca

SEQ ID NO: 1241 - DNA, 681 bp, Diabrotica virgifera
  misc_feature (584)..(591): n is a, c, g, or t
gggccgaccagtgaaaatggcggatcagaccgaaaaggcatttcaaaaacaaccaaccgtttttctcaaccgcaaaagtggaggaaagaaaaatttaagacattctcgcagtgtagggctcggttttaaaactcccagagaggcaattgaaggttcttacattgacaagaaatgtcccttcactggaaatgtatcaatccgtggccgtattctcactggagttgtccaaaaaatgaagatgcaaaggactattgtcatccgtagagattatttgcattatatcaggaaatacaatcgttttgaaaagaggcataggaatatgtctgtacatttatcaccctgcttcagggatgtggaaattggagatgtagttacaattggtgaatgcagaccactttcaaaaacagttagattcaacgtattgaaagtaactaaaggtagcagttcaaagaagagcttcaggaagttttgagtgatgaaacatttttaaaataaaaatcttataaaatgaaaaaaaaaaaaaaaaaaaaaaaaaaattaataaaaagaaaaaaaaaaaaaaaaaaaaaaaaaaaaaaaaaatnnnnnnnnttttttttttccccccaaaattggggggggggggggggcccccccccccccccccctttgggggggggtaaaaaaacccggggggggggg

SEQ ID NO: 1242 - DNA, 1105 bp, Diabrotica virgifera
  misc_feature (815)..(815): n is a, c, g, or t
  misc_feature (846)..(846): n is a, c, g, or t
  misc_feature (871)..(871): n is a, c, g, or t
  misc_feature (925)..(925): n is a, c, g, or t
  misc_feature (931)..(931): n is a, c, g, or t
atttttatttattttaaaataataaaatattttttagtaaaagtaaagaaaaattttatttaatgatagttaattagtattgtgagagaatattttatttttataaaagaaaaatttattttttgtaccttgtgtatcagggtttttcaaccaattacaaaaattctagacttgattaaatagcttcttctacttccagtgcttatcctctagagccatcacataactcagctggctaccgataaaaaattacactccactgtctaaaatttttgacatgagatcgtcttctaccaggcccccatttaattcattttttttttattagttggagaacggagaagacttcattttgttttccataatctggctctaatatacaagtttaatggagtatcttgttaaaaatttcctggtctttttgcataaactgtaccattatatttgccacatgatagacatacaacattgctaaagaatattagactccgtaagattccatgcttctgtacaatccaacagtaaggaatgatatctcttccgagtggtcccaatcctgatttgggctacatcacagatagaaatttcttgttttgtggcaggatcatatcattaatgtaatacaagccaaaaagctacttttggttattaaaaaaaggacatgggcttagtttaagtgtaactgtagataccgcattataaaaaaagataccatttgtaatatcaatcactgatcggccaggagatcagcagaattgtatttattcaggactttatttctataattaaccgattttttttagttcaaatgttcnccagtaatattgtttaaacttaagaatttanatggtgtcctttttactattttaanctaatgaaaggtgggtttaaaggtggtgatattagggcaatctagagttactancagatntgatttttagtcgtttttaggtgatcttgtaactatctataacgtgaattcattccacatgttaagagtttggtcttttgatgatgttttgagccgttatactattctacagtaagcgccacgcttctagacacatgggtaggtacctaattgatatacttatgggctaatcca

SEQ ID NO: 1243 - DNA, 956 bp, Diabrotica virgifera
  misc_feature (937)..(937): n is a, c, g, or t
aaaacgtcaactgaccagtcagataaatattttcatgactagtaattttttgaatatcaaaaaataaaataaaggatacttatttttgtcaggataaacaataactaggctaacaatggagaacatagctaccgattctggaaaaatagtgaagatggaagtggattacagtgccacttgcgacgataaaatccccgagtgtcaaaaactagcaaaatcaggtaaattgcatgatgccctcgatcaattgctggctttggagaagcagaccagaacgggggcagacatgatatccactggtcgagtcttggttgccatttgccaaatttgcaaggatgcaaagaattggtctgcactcaatgaacacatcgttttgttgacaaaaaggaggtcacagttgaagcaagctgtagccaagatggttcaagaatgctgcagctatgtggatgaaactccagataaggagactaaagtgaaacttatagacacattaaggcaagttacagaaggtaaaatttacgtagaagttgaaagggctcgtctgactcacaaattagctaaaatccgtgaagatgatggtgacatacaacaagctgctgacattattcaagaactgcaggtggaaacatatggatctatggagaaaagagagaaagtggaattaatactagagcagatgaggttgtgtgttgccaagcaggactacattagaactcagatcatttccaagaagatcaatactaaattcttcgatgaagatggctcttcagatttaaaattaaagtattacagactgatgatggaggtggatgaacatgagggctcatatttggcaacttgtaaacattatagggctgttcttaataccccaagcattatggcagacgccgaagaaagacaagctgcagcgcaagcccgtgttctttacattatattnggctcacatgataatgagc

SEQ ID NO: 1244 - DNA, 440 bp, Diabrotica virgifera
acaaaataacaaaattttaaacggattcttcacgcgtccgtatttatctaaatataaaaattattttatatatttggtcctttcgtactaaaatatattaataaattaaagatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaaattgttggaattgcatggtgatggaggcaaaggtggtgctggtgactccactggtgaagctggttctaaagtcgacaggcctgagggatacgaaccaccagtacaagaatccgtttaaaattttgttattttgtaaatgaaaagattaaaaaagagtataaatacaaggtatttataat

SEQ ID NO: 1245 - DNA, 967 bp, Diabrotica virgifera
cattactgtcatgcggacgcgtggacggatgtgtggtttttcgagtacgacagcaatcatggccgtcggtaaaaataagggtttgtcaaaaggtggcaaaaagggagttaaaaagaaggttgttgatcccttcacaagaaaagactggtacgatgtgaaagctccatcaatgtttgccacccgccaggtcggcaagactttggttaaccgtacccaaggaaccaaaattgcctctgaaggtttgaaattcagagtttttgaagtgtctttagccgatttacaaaatgataatgacgccgaaaggtctttcagaaagttccgtttgatagctgaagatgttcaaggtagaaatgttttaacaaatttccacggtatggatttaaccactgacaagctgaggtccatggttaagaaatggcaaaccttaattgaagcatctgctgatgtcaagacatcagatggatatttacttagggtgttctgcataggctttaccaacaaagaccaactttctcaaaggaaaacatgctatgcacaacatacacaagttagagctatccgtaaaaagatggtagacattattaccagagacatccagggctcagacatcaaagaagtagtgaataaactccttcctgacagcatagccaaggatattgaaaaggcctgccagggtatctaccccctacatgatgtgtacatccgtaaagttaaagtattgaaaaagcctcgttttgaactctccaaattgttggaattgcatggtgatggaggcaaaggtggtgctggtgactccactggtgaagctggttctaaagtcgacaggcctgagggatacgaaccaccagtacaagaatccgtttaaaattttgttattttgtaaatgaaaagattaaaaaagagtataaatacaaggtatttataataaaaaaaaaaaaaaagggcggcgctcgcgatctagaactag

SEQ ID NO: 1246 - DNA, 1332 bp, Diabrotica virgifera
ttaactggtcgcgggtgcaataattgacttggattttttagtaataatgaaggcggtactactagttttggcttgtgttttggtttctgcttactcccaatgtgatgaaaaaccagatgttgaagtagtttgctactggggaagctggtctgtatacagaaaagaaaacggcaaatttgcaactaaagacattgatgtaaaaagttgtaccacagttatatatgcatttgcaggtattaatttagatcaaaagacaacatcactggacacgtataaagatttagacttaaagggctttgcaaattttacagcccttaaacaagacaacccttgtttgacaacaatgttagctattggtggctggaatgaaggttctcgaaaatattctgtgatggcaaattccaaacaactacgtgaagattttgcagacagtgttatagcatttctagcctactatggatttgacggtgtcgacatagattgggaatatcccactaccagaggtggtattaaagaagatggagaaaattttatttcccttttacaggcactaaagagtaggtttgaaaagtacgaactaaaactctccattgctgtttccatagatgtagacttgattaacacagcgtatgtagtaccaaaattagctgatttagttgataacgtcaatgtaatggcttacgactatgtgacatcagagtcaaacgtgactggactctcttctcccttgtcaaaaataaaagatacgatttcccattggctgaaagcaggactaccatcaaaaaagctttaccttggaattccagcctatgcaaagacttttatattagcaaatgaaagtaatgcggatataggtgctaaagtcacaggacaaggagatccaggagagtttactcaggaagcaggattgttggcatattacgaggtaaaatctttgatgaatgatccccgtgaggtggctacaactgttgatgatacaaactcttttttttttgcacttttctggtttacactggtttttaattttgaaaaccccccggaaaaccccgccccgcccaaaaagttaatctttttccaatgggaatcaaccacctttgggggggaaattttttgtttttgggccccctttgaacaataaaacaaattttttttagggggaaaattttatgggggggataaataaattctcccctctattatccctcgtgcttataaaaacaaaaaggggctttttccccccacaaaataaaaaaaaatctctctccccccaaaaaaaaagaaaaaaaaaaaaaaaaaaaaaaaaaaaaaaaaaaaaaaaaaaaaaaaaaaata

SEQ ID NO: 1247 - DNA, 1084 bp, Diabrotica virgifera
cggacgcgtgggcggacgcgtggggttaacttgtgctattgtcgctccgctctgtgcgttcgtattcacgtgtgttttgaaaatgtcgtacgaaatgatcactccgacttctgtcgaagaatcgcagccgatatcccgtacttatcagtacaggaaagtgatgaaaccaatgttagaaagaaaaagaagagctagaatcaataggtgcctcgatgaactaaaagaacttatggttactgccctccagagtgaaggtgaaaacgtttctaagttagaaaaagcagatatcttagaattaacagtgcgtcacctccacaaactaagaaaacaacagagattatccaccaatccagtgatagatgctgacagattcagagctgggtacacacactgtgccaatgaagtctccaggtgccttgcttcaactcctggtgttgatatccaacttggaaccaaactgatgacccaccttggacatcgcctcaatgaaatggataaagtatctcctctagttattcaagtaagttcacaatatacacctcctggttcaccaaacctagaaactgaagtgcctcaccattacacaatgcctttgacaccagcctcatccagttcttcgaggtgtagcccctcaccaaatcaacccatggattgttccactgcaggtttgctgaaagttgcaaagcaagaagcgatgtggaggccttggtgaaacatagactttatttttttgtaaatattgaaaaatctcacttgtgtctttcgatgtttaataattgctcaattgctttaatcttagatttaagatagagtcagatctcttccatttttgaaaagctttaaatttaatgttaggtaaagtagagatagaatctattaatttatttgtgatattatatgaaagtggtacctgtgatttttgaagcaatgttaaagtaagcatcataatcaaaaaatgtttattgatatgtttgatgatgaaagaggttttttggtgaatttttgtattcgagcgaactggggaaaaacgtttgtatttttaataaaaaaatacttgaaaaaaaatttttattttgttacaatc

SEQ ID NO: 1248 - DNA, 827 bp, Diabrotica virgifera
caaaaaacgtcatcacgaaaagtccacataatcttttccatgtagatatatctttttaaaagtttataggtgcaaaatatgatagtcactacacagtctacacattgatttatagtttaattacccataggacattattaacaatactagaaaaaaatgaggtattgggtatttattgtaagtttaggtcttttccaatttgcattaggaacagaattaacattcgaactgcccgatagtgccaaagaatgctttcacgaggaaattaaaaagaacacaagttgcacgttagagtatcaggtcgtaactggaggcaattatgatgtagatgtagctttagaagaccccaaaggcaatatattgtacaaacaagtcaaaatgcagttcgactcacacacctttgtatctcaggatcatggtatctacaaagtatgcttcagcaatgaattctccactttttcacataaacttgtatatatggatttccaagttggagaggagcaacctttacccggtattggtgaacatgccaccgttttaacgcagatggagtcatcagcccaagaaatccacaaatctctgaacacgattttggactaccaaacacatcatcggttaagagaagcccaaggcaggaaacgcgccgaagaactgaacgaaagggtgctctggtggtcgataatggaaactttggcagttattactattgctttcgggcaggtgttcgttttgaagaactttttcacggaaaagaaaccttacacgcaattcaaataaactttgtgacctaaaccattttgtaccttttccttctttaatatatttat

SEQ ID NO: 1249 - DNA, 1060 bp, Diabrotica virgifera
ttttgatacagaggtaacaaaaaattccaatcagattgaccataatatacaaatgtcaacatgagactaatactggttttgtccgttctatcagctctcgtagccatctccttcgccacagtctcagaaatcattggaggtacactgataggctccctcatagtccacaaagtagcgaaggaccttggtattggaaacataataacgatcgaaggtgacgctagagccaaattgggcaacaacgaaatcgcagttgaggctgcagctggcgttggaggagacgtggtcggataccacgccaatgttgaaggagatgtgttgggacaggaagtgaaggtgcatggtgatatttatgatggggataaggttatggataaatacagaactgtttcaatcgatgaccaaggtcgtcaatacgtcttggtacgcaaatgggtcggcaccacccctgtattggtaagacaatacatcgacacccttgacgttaacggcaaaccagtaccgaccaacccaatggtccgtcgtgttggcatgatcatagaaatccgtcgtcccgatggtaccatcgagctacaccgtccagatggaaaaatcatcattcttcgttcaggagctatcatctacgtcaaacgccctgacggtactgtcgagcttcgtcgccctgatggtactattcttgagattagacgccctggaactttcatcgaggtgaagcaaccagatggtaccatagtggtttacaaacttgaacttgtcgtaccagagactaagcctgttcccattgatacatctatggttccagttcatgttccattaatcaagcctacgcttttggaaacgtctagatatccagctagatatccagctagatatccagcttaaattcttacacgacagtaatgaactgagaatttaaaataaaaatggaaaagaagaataagtacgtgttaaattatagaatgaagtaaataaaatggtaataaataggtttaggattgatagaaatgggttggaaaaaataaaaaaggggaaaataaaaaaaaggttttaaaaatttggg

SEQ ID NO: 1250 - DNA, 704 bp, Diabrotica virgifera
caaaacacacaacaacaccatggcttttaaagtactcgtctttgctgctcttgtcgcttacgtcaatgcaggaatatttggcgaagctccagttgcagccccagtggtctctgcatactctgcggcacccgtcgttgctgcagcacccgtggttgctgccccagcagcagtttcaaggtcttatatccaaacttacagtagccactctgcaccactcgccgttgctgctccagttgtcgccaaatcagtggccccagtagtgtctgcctattctgcacctcttgcgctaccagcagcggctccagtcatctcttcctactccgcaccggttgtagctaaatcggtaggaccagtcgcatactctgcccacgctccagtggtatcagcttactcatctccattagtagctcaaagcgtatcccctgtagcgtatgctgctcctgctccagtattgtcagcgtattcttctccagttgttgccaaaagtgtagcacctttaagctatgctgctccagctccagttttatctgcatactcagcaccagtagttgccagcagttttgcaccagctcctcttgcttatgctgcacacggatcaccattggtatctgcttactcttctggaccacttgttcaaccttggtagactgtatatcgactgatatgtacgtatttattatattaaaataaaaatatcgcttaca

SEQ ID NO: 1251 - DNA, 1112 bp, Diabrotica virgifera
gcaatttcagtggctaacttcctttctctaaacacgttaagttatccagtctattttttaggttaagtttgtgtaaagtttgtgtaatttgcagtaatttgtcattattaaaagatttacaagtgttgagtgtgcagtaacagtttattatggctgaatctgtaaaagtacaagaatacaaagaagaagtaaagaaacaggctgaatcattagtactcaaaggatttccagaaactatcgtaaaattgaacagtatcctcgaaacgtctcactttaaaaacagaagcttcaacgatgttcatcaagacttaaacataccaatcccagagccaatcatcttgaacagtcacagtgagctgccagtggcaaaaaaggccaaactggaccccagcctcatccaggatggcactaaagttatgattctacctactggagcagtttccactaacaaaaatatagtagagttgatagaacaagtcaaacctcatattaggaagcttgtagaagactcaaatttgataaagatgtggatttcctttatgattccaaaaattgaagacggtaacaactttggtgtatccattcaagaagacacattggccgaagtgcagtctgtggaatcagaagctgctgcattctttgatcaaatttcccggtattacgtttccagaggtaaattaatatcgaaagtagccaagtacccccacatagaagactacagaaaatcagtacaggaattggacgaaaaagagtaccttagcttatggttagtgatgtccgaaatcaggaacagatactgtgcccttcatgacatcgttcttaaaaatctcgacaaaattaagaagcctagaccctcaaatgctaccgaatctttgtactagaatcaataaaaattcattctgtcatattaaatttatttgtaaacattaactagttggagtatatctggcgcgtatggaagtttttctaaaagtaaacatattttcttaagatttgagttgacatttttcatgtatattatttttgtcttagggtagttgttcaccaaacttttttgacaataaaaaaaaaaaagaagggaggacaaagaaaaaaaaaagcaaaaggggggg

SEQ ID NO: 1252 - DNA, 1049 bp, Diabrotica virgifera
  misc_feature (1010)..(1010): n is a, c, g, or t
aatggttatgttattgcacaaataaaattaaaatatttatgttaatatggctcttgtgttgtcgaatatagcgactaaatctaacttaaaagttatagaagaaaaattgtttgcattaagtatctgcaatagcaatcaaacaagatgtatggctaaacttaatcctccgcctagactaagaaatcctacatggtttacaaagaaaatgatatttacaagagatgaagaaataaccaaagaaaatgagaagtttgtccaagaagtaatacaggataagtacagtaacataacacctaaaggcgaagttgccacaaatattgagtggacaccagagctgcaaagaactggagtgatagccagaaagattggggtatatcctctttggctaaagaatggtaaacctatacagaccacgttacttcaagtattggataatcacgtcatcaaaaaaatagcccctgacgaatacgactctcccagaaaaagagtattagaagttcgcaacaagaaagcttgcttactgttgggtgctgaaggtgtagatccttctaagtttactaaagaatactgtggtctcttcaaagagtctggggtcattccaaagcaagtacttgctcggtttttcgtgagtcctgatgcagtgctacccttgggcacgcttatctcagccatgcacttccaagtaggcaatgccatagatgtccgtggaaagacgattgatcgtggtttccaaggagtaatgaagcgacatggtttcaagggaatgcccgcatctcacggtgtcacaaagacccacagaagaggaggtaatataggtggaggtggagagaaaggaagagtgtggcctggaacgaaaatgcccgggcatatgggcaaccgttttaggatagctaaaggcttgaagatattaagaataaatacgaggcacaacgtgctttgggtcacaggtcaagctatacccggtgaaacgaattctatttgctttatttatgattcaaagttgcctttancgaagccagagaaggctttgccttttccaacgtacttgg

SEQ ID NO: 1253 - DNA, 938 bp, Diabrotica virgifera
caagcatttaataaatataatagaataaatagaagtatatatatggtgttcaaaataatttatttcatgttcatttaacactgaattttggatttaaaaagttcatttatagaatttagctttgtagcattttatttacggcattcagtaaatgcatatattggagtaagttactttatataatttataaaatcgttattaaaacttagcaatctacatttctacataatacaatgagttcaggatttataactgaatcggaagtaatagaaatcaggaaacggcggcaagaagaatgggaaaaagtacgaaaagcagatgatccaaaggaacgtccagaagaaccgtacgataatagaagtttgtatgaaaaattacaagaacaaaaacagaaaaaggaccttgagtatgaagaagcacacaaattaaaaaatatgataaaaggtctagacgatgatgaaatagaatttctagatctggtggatcgcacaaaaactgaagctgatcgaaaaaaagaactagaagaggaacaagaactacgagattacaggaacagggtatctattttacaagaaaagtcaatagatgaaagacttcaagctgaaattgttgtcaacaagacaaagagagagaaacaacccaactctcaacagaaattactaaagggtgttgttataaagaaacctgaaaatcagaaaaggaaaatagatgaggttgataatagtgaagaaacaaatgtaaagaaacagaagaaccctgaaaatcagaagaagaaaatagatgaggttgataatagtgacgaaacaaatgtaaagaaacagaagaaacctgaaaatcagaagaggaaaatagatgagatagataatagtgaggaaacaaatgtaaaggaacaagcaattattgatgtagatgataagtcaactaaaaatacacaaact

SEQ ID NO: 1254 - DNA, 1303 bp, Diabrotica virgifera
tgacattgcgataggtttcttatttttaatttcaggaaaagaaaccacaaaaatttaaaaacaaatagtcgaaactcacagtatgtcttccttaaacgatagcaacgacgtctactcctcaaactattctagcagatcaggacttcatggtaaagtaagccccttttcttcgccgtatttgaattatgacccaggatatctaccacaagcgcaaccagaatttatattcttggatggagccagtaaacaaagaggcagatttgaacttgcttttggacaaattggtggatcatgcatgataggagcagctttaggaggtgcctcagggttttataatgggttaaaagccactacattggcaggtcagactggaaaacttagacgaacacaattgataaattacattatgaagaagggtagtgctactgcaaatacatttggatctgttgctgtgatatattctgcatttggtgtaatactttcttgggccagaggaggaactgatgatgatcttaatacaattgtagctgccacagcaactggatgtttatataaatcgacagctggacttagaaaatgtggtttgggtggagctattggattaggagtatcaacagcatatgccctctgggtcaatagggataagttatcagaattacggcaatttaatccagcgtaagatttagttttaaaatactttaaggataatatagagtatagtgattctaaaataaatatttatgccataaaaaagtatattcgtaaaacatagtgagtcatagatgttatttttggttataacacttttgaagatatatatttcaaatttaaaatatattatgtcagatgcccgttagcactcttcagagcactaaaattatgagaaagaagaagaaaaaatatattacagggtttgctgtctcgttaaaaaaccatgagattatcaaaaaaggggtttgctctttaagtgaaggaggatatgaaattatactttaactgaaacattataaataatacaaataatcattgtataatgtagttgatgatttcttaaatacagacataaaaattagagcaaaaagaggagcttatcatgtttctttttcaaatatatatttttgaagggatatagtacagtttttcggaagaacttccttgatctgattattcaaatgaaatttcacgagacaagaagtagatatgtaatttatttggaaattttttttacttcaaagtattttatacactaataaataagttgttgaaaatttacaaagcttttatttcagaccattagagatga

SEQ ID NO: 1255 - DNA, 945 bp, Diabrotica virgifera
  misc_feature (894)..(894): n is a, c, g, or t
  misc_feature (900)..(901): n is a, c, g, or t
  misc_feature (905)..(906): n is a, c, g, or t
cccacgcgtccgattaaatacctgaatggaatactttcaagtggaggcaacaatggaggacaaactttcccttactcagatggtgacgccgactctttaccgactttaactgggattgtagttatagtcttcaaacaatattcagagcgttccttttagtattggaacatctcatagaacacgttcacaaccagtccaatggtttcgttgtaatagtagactggactgaatttaccttccgacagtcgacttacttaaaaccttcagtactaaaacttatgatagaaggtctacaagactgcttccctgctagattcaaaggaatccatttcatagcccaaccatggtacgtagaaacagcgttagctctcataaaacctttcttaaacgaaaaggtcaaggaaagaatcttcgtgcatggaaataaccttagcactctacatgaacacgtccataaagacgttctgcctgcagagttaggtggtgaagaacccagttacgaccataggacgtttttggacatgcttcaagagagattgaaacaaaatcatgacactagctgatcgggcagcaaagatttgattcaggaaaacgtttaccaaagaaattttcgatgaatgttattgaatcgatggtatttttaagatattacaaatattcagacaataaataatatgttgatactgtttaatgtattgttacagcggaatttttgttgcttagagcagagtctttaatgtgataataattatttgttagtgaatgtcgaacaaaggataccggaactgtttaagttagctaaatattattcaggaaaggggtgatctattaacaaaaattatggatatttttagacaaggacttaaataaactcatagtggtgtcattgacttncttagnnttanntttattatatcatgttttttttatatatcacccctaaca

SEQ ID NO: 1256 - DNA, 4762 bp, Diabrotica virgifera
  misc_feature (4750)..(4750): n is a, c, g, or t
gttttgaagcaataaaaaataagagagtagatattaaagtgtattgtgaaaaatagcagaagagaatgcagatctttgtgaaaaccttgactggtaaaaccatcaccttggaagtagagccttccgacaccattgaaaatgtgaaagccaagatccaagacaaggaaggtatcccaccagatcaacagagattgatcttcgctggtaaacaacttgaagatggtagaactctatctgactacaacatccagaaggaatctacccttcatttggtccttagattgagaggaggcatgcagatctttgtcaaaaccttgactggcaagaccatcaccttggaagtagaaccttctgacaccattgaaaatgtgaaagccaagatccaagacaaggaaggtatcccaccagatcaacagagattgatcttcgctggtaaacaacttgaagatggtagaactctatctgactacaacatccagaaggaatctacccttcatttggtccttagattgagaggaggcatgcagatctttgtcaaaaccttgacaggcaagaccatcaccctggaagttgagccatccgatactattgaaaatgttaaaactaagatccaggataaagagggcatcccaccagatcagcaaagattgatcttcgctggaaaacaattggaagatggaagaactttgtctgactataacatccagaaagagtctactcttcacttggtacttagattgagaggaggtatgcagatcttcgttaagacactgactggaaagaccatcactttggaaagtgatccatctgataccattgaaaatgtgaaagctaaaatccaagataaagaaggtatcccaccagaccagcaaagattgatttttgcaggaaaacagctagaagatggtagaaccttgtctgactataacatccagaaagagtccactcttcacttggtactgagattaagaggaggtatgcagatcttcgtcaagacactaactggaaagaccatcactttggaagttgaaccatctgataccattgagaatgtcaaagctaagatccaagataaggaaggtatcccaccagatcagcaaagattgatttttgcaggaaaacagctagaagatggtagaaccttgtctgactataacatccagaaagagtccactcttcacttggtactgagattgagaggaggtatgcagatcttcgttaagacactgactggaaagaccatcactttggaagttgaaccatctgataccattgaaaacgtgaaagctaaaatccaagataaagaaggtatcccaccagaccagcaaagattgatttttgcaggaaaacagctagaagatggtagaaccttgtctgactataacatccagaaagagtccactcttcacttggtactgagattgagaggaggtatgcagatctttgtcaagacactaactggaaagaccatcactttggaagttgaaccatctgataccattgagaatgtcaaagctaagatccaagataaggaaggtatcccaccagatcagcaaagattgatttttgcaggaaaacagctagaagatggtagaaccttgtctgactataacatccagaaagagtccactcttcacttggtactgagattgagaggaggtatgcagattttcgtcaagacattgactggaaaaaccatcacattagaagttgaaccatctgatactattgagaatgtgaaagctaagatccaagataaggaaggtatcccaccagaccagcaaagattgatctttgcaggaaaacagctagaagatggtagaaccttgtctgactataacatccagaaagagtccactcttcacttggtactgagattaagaggaggtatgcagatctttgtcaagacactaactggaaagaccatcactttggaagttgaaccatccgataccattgagaatgtcaaagctaaaatccaagataaagaaggtatcccaccagaccagcaaagattgatttttgcaggaaaacagctagaagatggtagaaccttgtctgactataacatccagaaagagtccactcttcacttggtactgagattgagaggaggtatgcagatcttcgtcaagacactaactggaaagaccatcactttggaagttgaaccatctgataccattgagaatgtcaaagctaagatccaagataaggaaggtatcccaccagaccagcaaagattgatctttgcaggaaaacagctagaagatggtagaaccttgtctgactataacatccagaaagagtccactcttcacttggtactgagattgagaggaggtatgcagatcttcgtcaagacactaactggaaagactatcactttggaagtagaaccatctgatactattgagaatgtcaaagctaagatccaagataaggaaggtatcccaccagaccagcaaagattgatctttgcaggaaaacagctagaagatggtagaaccttgtctgactataacatccagaaagagtccactcttcacttggtacttcgattgagaggaggtatgcagatcttcgtcaagacactaactggaaagactatcactttggaagtagaaccatctgatactattgagaatgtgaaagctaagatccaagataaggaaggtatcccaccagatcagcaaagattgatctttgcaggtaaacaattggaagatggaagaaccttatctgattataacatccagaaagagtccactcttcatttggtacttagattgagaggaggtatgcagatcttcgtcaagacactaactggaaagacaatcactttggaagtagaaccatctgataccattgagaatgtgaaagccaagatccaagataaggaaggtatcccaccagatcagcaaagattgatctttgcaggaaaacagctagaagatggtagaactttgtctgattataacatccagaaagagtctactcttcacttggtactaagattgagaggaggtatgcagatttttgtcaagacattgactggtaaaactatcacattagaagttgaaccatctgatactattgagaatgtgaaagctaagatccaagataaggaaggtatcccaccagaccagcaaagattgatatttgcaggaaaacagcttgaagatggtagaaccttgtctgactataacatccagaaagagtccactcttcacttggtactgaggttgagaggaggtatgcagatcttcgtcaagacactaactggaaagaccatcaccttagaagtagaaccttcagataccattgagaatgtgaaagctaagatccaagataaggaaggtatcccaccagaccagcaaagattgatctttgcagggaaacaactagaagatggtagaaccttgtctgactataacatccagaaagagtccactcttcacttggtacttcgattgagaggaggtatgcagatcttcgtcaagacactaactggaaagactatcactttggaagtagaaccatctgataccattgaaaatgtgaaagccaagatccaagataaggaaggtatcccaccagatcagcaaagattgatctttgcaggtaaacaattggaagatggaagaaccttatctgattataacatccagaaagagtccactcttcatttggtacttagattgagaggaggtatgcagatcttcgtcaagacactaactggaaagacaatcactttggaagtagaaccatctgataccattgagaatgtgaaagccaagatccaagataaggaaggtatcccaccagatcagcaaagattgatctttgcaggaaaacagctagaagatggtagaactttgtctgattataacatccagaaagagtccactcttcacttggtactaagattgagaggaggtatgcagatttttgtcaagacattgactggtaaaactatcacattagaagttgaaccatctgatactattgagaatgtgaaagctaagatccaagataaggaaggtatcccaccagaccagcaaagattgatatttgcaggaaaacagcttgaagatggtagaaccttgtctgactataacatccagaaagagtccactcttcacttggtgcttagattgagaggaggtatgcagattttcgtcaagacactaactggaaagaccatcaccttagaagtagaaccttcagataccatcgagaatgtgaaagctaaaattcaagataaggaaggtatcccaccagaccagcaaagattgatctttgcaggaaaacagctagaagatggtagaactttgtctgattataacatccagaaagagtctactcttcacttggtacttagattgagaggaggtatgcagattttcgtcaagacattgactggtaaaaccatcacattagaagttgaaccatctgacactattgagaatgtaaaagcaaagatccaagacaaagaaggtatccccccagatcaacaacgtttaatatttgctggtaaacaattagaagatggaagaaccttgtcagattataacatccaaaaggaatctactctccacttggtactaaggttgagaggaggcaattaaaatacaaaacttttgtttatttctgacagtggtttttaaaaggctgattttttatttacacattgcttaaatattattaaaccaaaggaataaataaaatctttgtagtaaaaaaaaancggacgcaagaa

SEQ ID NO: 1257 - DNA, 704 bp, Diabrotica virgifera
aattgactcgcgcaggcgtacccccagctgccggtacgacaacgtccccaacagatctccccacgcgtccggtcgattttattcagtgattctgattgttcagtttttgtagttgtacagttttcgtattaggaaataaatcaaatatggcatcaggagtaactgtagcagatgcctgcaaaaaggtccatgaagaaatcaaaagggacaaaaaacacagatttgcaattttctacatcaaggatggcaaacagattgatgttgaacacataggagaaagaaatgcagagtatgatgatttcctaactaaactgcaagagggaggagctaatgaatgtcgttatggacttttcgattttgaatacatgcaccagtgccagggaacctcagagtcaaccaagaaacaaaagttattcctgatgtcgtggtgtcctgaaactgcatctgtcaaaaagaagatggtgtatgctagctcattcgaatatcttaaaaaagctttggtaatacagaaatctatccaagcgacagatttagcggaagcgagtataacagcggtagaagaaaaattacgatccactgatcgtcagtaacgccttttatttttattatttttctttttgtatctcgactgtctactcacgcaccgacctaccgaggtgtattatttatataagtatttgaatatttaataaagcttcatttat

SEQ ID NO: 1258 - DNA, 972 bp, Diabrotica virgifera
gtcaagaacaagaccggccattttacaataccttgttgtgggattattcacctttcaaaattaaaattgtaattaatgtcagaaccacagtcagctctcctattaagaaaacagctagcagaactgaacaaaaaccctgtggagggtttttctgcaggccttatagatgataatgacatctacagatgggaagtactcataataggtcctcctgatacattatatgagggaggttttttcagatgtcatctttattttccgaaggaatacccacttaggccaccaaaaatgaaatttgtaacagaaatttggcatcctaatattgataagaatggtgatgtatgtatttcaatattgcacgaacctggagatgataaatttggttatgaaaaagcctcggaacggtggttaccagtacatacagtagaaactattttaatatcagttatttcaatgttagccgatcctaatgatgaatcacctgccaatgttgatgctgcgaaagaatggcgagaatcatactcagaatttaaacggaaagtagcaagatgtgtccggaagtcacaagaacaagaggagtgttaggactgtattaaatttgaattgataaacaactaattatataaaaacccataattgatttgattcccgggctgttaaaatctacgtgactttttgtatgtcgtttccgtagttttttatacaacttaataatagtaatatactttttaaacattcgatagacttcaacatgccgccggaatcaaatcacgtgtttcaacatttctttcttgtgttttttaaatataattttgcgatctcagcaacaactgagaaatttttttttttaattagggatccgaaataaatttttagtttagttttattacaattttgaataaatgtcaccttgattttgaaaattgatttgcattttttggttgtcacgactggtctttgtaaaaagtttat

SEQ ID NO: 1259 - DNA, 1225 bp, Diabrotica virgifera
  misc_feature (1085)..(1085): n is a, c, g, or t
  misc_feature (1114)..(1115): n is a, c, g, or t
  misc_feature (1130)..(1130): n is a, c, g, or t
  misc_feature (1133)..(1133): n is a, c, g, or t
  misc_feature (1170)..(1170): n is a, c, g, or t
catctacgctttagctgtcaatgggcataaacaacatgttcctgctattctcggaaaggtgcgtaaagcaattggctacaaccaagatgctgtaaatatcactctaaggttgatcaacaaaggtgaagaagaagctgggtttgaagtactaaaatcaatgcctcgggttactcgcgaagatggttcgcccgctccaaccggttatttctttattaaacaactagttaaggccgatcgtcctttaaacgttatcttgaagtactgcgatataatggaaaaagaacatatgtacgatcgaggttttctacttgcagctgaaatgagtcttcaactgggaaatgaaaaactagcatatccaatgcttgaagagcttcaaaaacgcggtattactgtcagacaacatttcttctggccactatttatttctaaagccaacgataataaagctgttatagacattttacagaaaatgcatgatttcaacgtttttccaaacaatgaaactataagggagtatgtgataccaaatctaaaaggaaatagcagtcaaattttagctcttcttcgagatggaaacatttcagttggtactgctgcatctagtttagtcgtgttcttattgcttcgtaatgagattaaagaagcagcagctattgctaccacgatacaagcttactacaatcccgatatgactaggaggcctcttactaattcattttacaaaacgaacgatctaaagtcttatattgcgatattgagaaccgtgttcgacaacgtagatcgtaagagaaacacacagaaaaacgaagatgacgacgaagaagcgaccgaaggagttaacaaagcggaactggtaggaaactttgttctcgacttaacttcaaaaagcagggcatttgtggagaaaattgaaagtgtattgaacgcattgtgtgaacaaggtcttagtatatccacgccaacagccgaaaaaatagaagataagttaggagaaaagatgactgatcagatttcacagttattagaaagactaagttccggagaactgacgccggttccagtacaacggcaacctccaagctacngtccatcacaccaaatgaatattccacanntagaaagattgatancanatctaacagccaagaaatcagaaactaaacgactgangagacaactgtttactttgtattatagagctaaggatctagagaaaaccgaaaag

SEQ ID NO: 1260 - DNA, 588 bp, Diabrotica virgifera
actgatgttaaatattttattgctaataatctcttgcgttttgataacccatgcaacagctgacacatgttgtgcagctaatccaaaaaatatttattatttaggagacaaacaggtaaattgggctaacgctgtgctagcatgccaactcgttggaatgagattagtaagtatccagagtcaagctaagaatgaggaaatctctgcatttgtgcgaacctcaggagtgaagaatataggaatcgataacgccatatggacttcaggaaatagacgacaggacaaagttcattggctttggttagctcaagaagctcttgtgtacactagttgggacctggtctttcatgaaccaaacaatgctactggggacgaagaatgcgtgagcataattactaataatggaacagttactacttggaacgatatcgcttgtaatcgcttattttatcctttatgcgagaaacagatttgttgttctggttgcaattgtggctgttcttaatttgattaacggccatataaagtaatttttgctatttacttaataataatggtattaatattataataaaaagaataatacat

SEQ ID NO: 1261 - DNA, 710 bp, Diabrotica virgifera
aattttgacaccttacataatttcgaaaatgtcgcaaactaaggaaataaagtcttatagttatttcgatagcccagacggccacgatgttttagataaattcttgtgcgttatgaaaccagcttcattaactgcatttggtattggaacaattgatgtagttgcctggtcacatcccaaggggtacctaccaactctgggacgatatgcatatatgggattccctattgtaggagcaagtgcagcttttgtgctcgttacaaatgcttctgcaagtttccgcaaaaaggacgatgtttggaattggttcattggtggtttttcagcaggatctgttgtgggagcctggaagagacatgccatgattggatttaattgtggaatgtttttcggcatacttgctgtatgcagaaaaataatggcagataacaactgggaggttacaccaagtgtggctcctgtagctagccaaaatgcttggaattatgattttacattaactaaagaaaggccaggtaactggactactggcagggaatgatatgttttgtaaattatgtatattttaaatgatagtctttaatacaataaaaatatttagaattattaaagtttttcgacgaatctaccaagcgttaacgctgaagctgagcgactggataaagaaaaaaacgatgaaacaattatgggtgtgtccccttcagaatatc

SEQ ID NO: 1262 - DNA, 422 bp, Diabrotica virgifera
ctacttggtgtccattccactttttctttttttgtctataattattatgttgctaatagataccaaaaagatatttgacaaaaagttccagctttatataatctttgtgcatatttgtttaatagtacaagttaaaaaactaagtattgtgattctataccgatagttttactgaaattaattgaccaatgctcaaatctttagactgtgatttgtttgcaacaaattcagtttaaatttcaaatgttcaggatgtccgtgtatgtttgtaatgttggtaatgactgagctttatatagattgttaaatagtgcaattatgtatacatcaaatactttatatacagtatgttaatatttgttgaataaacaattataaaaataaaaaaaaaaaaaaaagaaaaaaaaagttctagatcgcga

SEQ ID NO: 1263 - DNA, 1081 bp, Diabrotica virgifera
gactattagatatttttattatttgtttgctaaaattaaaatctttagaagatatatttaacaacttaaaataagggagaaatacgttaataagagtaataagggagaacgagtaaatcatctaaaatatgcagacgctatgatatcaataggcaatagaataaacgaattacaggggaggatctagagcagtggcgtaccgatagatcagcgggccctggtttgagttgggatgcgggtccacccgcccagtaaaaactcacattgtataacacgagtatcgaacatctagtaacaacttaaaataagggagaaatacgttaatagagtaataagggagaacgagtaaatcatctaaaatatgcagacgctatgatatcaataggcaatagaataaacgaattacaggggaggatctagagcagtggcgtaccgatagatcagcgggccctggtttgagttgggatgcgggtccacccgcccagtaaaaactcacattgtataacacgagtatcgaacatctagcctattattgggattatttttttttgacccaccgtataaaacttgcattgaatatctcagtttccgaatttctgcaagtttgtagtttacctaccacttattcatggatcgtgctaatataaaaaaatacaagtgtttgagttagcacgttaggcaggcaccggaggttattctttaaacaaggacttcggcaagcaggtaaaacgagcaaggccttacaaaagcgttccctgtgtttcttaaaagttttaatttcatatttttttatgaatagttattcttcgtttttattaataagtaggtacgtacacgtaggtagtaaaatttaaatttattaaagttacatttcgtagtgtgtacttgtgtagttcaaaatgtccccgtcaaatatgaaacaaaagaagcaaaaggcgcttttagagcaggcccctgcgaggcccgggccctgggttccgcggaaccatgctcagtacccccctgatctcaaaaactcctttaaatttaccttaagggggggggggttttggtttcattttttttgggaaggaggtttttt

SEQ ID NO: 1264 - DNA, 1646 bp, Diabrotica virgifera
gacacagaggagcaagttccatcaattggaccctcatctgcggcgacaaaaaggcaggcctttccatcttctgggctgacgacggtttagacactggaccaatcctcctacaagaggaatgcgacgtacaagaaaacgatacggtggatactatttacaaaagatttttgtacccagtaggtgtctctgcagtagctagagcagtagacatggtcgctgatggtaatgctccaaaagtagttcaaagtgaaaagggagcaacgtatgatcctatgctgaacaagccggagttacaaaagatcgactggaataaaacagctctagaactccacaacttcatccgtggtatggactctgttcctggagctagttgcttgatgaagctaccagactcagcagactaccaagaagccttgttgtttggttcatcattgtggaaaacagcaatacctatcggaaaagaaatcttgatcgaaggtactaaaccaggaattattcacgaggaaggtttgctgctgacaggatctgatggggactatgtcaatgttaaaagagttaaaataaacggtcgcatgaaaaacgcttcagtattagaccaaattactaaacaagtagagattgaactaaccccagaagaaaaagtattaattgaatcagtcagggccgtctgggaggccatcttgaacatcgatattgaagatgacactgatttctttgcaagtggggcaggatctatggatgtcgtcagattggtggaagaggtcaaagaactgttcaaaactgagctagaaaatgaagatgtttttatggcgccagtattttccgaattttgcgttaatgttgtccagaaaagtcgtggaggaaagggggagatcaaagtagaatacagagcaatagaaatggaagcaaataagatgaaattgcgttttccttgccaactatttattaacggagaattcatggatgctgaaggtggaaaaactactcaaactgtaaatccagctacagaagaagttatttgcgatgttcaatgcgcttccaaaaacgatgtcgataaagcagtagctgctgcaaagaacgcatttgaaaacggtgaatggagtaagatcagtgcaagagaaaggggtctcatgcttttcaaacttgctgatttaatgcaagaatacaaagaagaactagctacaatagaatcaattgattcaggagctgtatatactttagctctaaagactcacgttggtatgagcattgaaacgtggaggtatttcgctgggtgggcagacaaaattgaggggtctacgttaccagtatcccacgcgagacctaacagaaatctctcgtttacaaagaaagaacccattggtgtatgtggattggttaccccatggaattacccattaatgatgctttcatggaagatggcagcttgcctggcagctggaaataccgtagttattaagcctgcacaggtttgtcctttaacagcattaaaattcgcagagttatcagtaaaagctggaattccaccaagggttatcaatgttgtgaccggatcgggatctgttgctggacaagccatagccgatcaccctcacgtcagaaaattgggattcacgggaagcacagaaataggacaagtcataatg

SEQ ID NO: 1265 - DNA, 979 bp, Diabrotica virgifera
cagggttttcagaggccggccacagatttgatactattccagttgtcaagtgttgtcaaaagattcatcctatctacttttccttataaggcaacataaccgctaagatacggtttagtgattcagttctaagataaaacttttacttttatataaaaaatacaccattgctgtacattagcgaagaaacaagttatttattctgtttatatagataagaaaatatttaaagaaatagaagaaatcgccgcccggaaaaatgtcctacacaccaaaaagtatttatgccgctctccctagaactcaaagagggcaaccacttgtattgggcggagatcctaaaggaaagaattttttatataccaatgggaactctgtcatcataagaaatatcgagaatccttcaatttctgatgtttatacagaacactcatgccaagttaatgttgccaagtattccccaagcggcttctacatagcttctggagatcagtctggtaagataagaatatgggacacggtgaacaaagaacatatcctcaaaaacgaatttcaccctatcgggggcccgatcaaagacatcgcatggtctccagacaaccagaggatgatagttgtaggggaaggccgtgaacgattcgggcatgtcttcatgtcagaaacaggtacgtcagtcggagaaatttctggtcagtccaaacccataaactcctgcgattttagaccagccaggcctttcagacttattaccggatcagaagacaacaccatcgctatattcgaaggaccaccgttcaaatttaagatgaccaaacaggaacactctcgcttcgttcaagctgtaagatactccccctcaggaaacttgtttgcttcagcaggtttcgacggtaaagttttcctctacgacggtacgtcgtccgacttgctgggcgaagtcggaagcgccagctcatttctggaggcgtctatggcgtaa

SEQ ID NO: 1266 - DNA, 1324 bp, Diabrotica virgifera
  misc_feature (1314)..(1314): n is a, c, g, or t
gaaatattttttgtaaggtagtttgaagttattgaattcaattgaattgtactagcatacgatttgttttggtctttaattacgtttttattttcatgttttatattttggtgtatgtttctagagcgagattgtaattatttttttttgcaaaggattttttaaatgaagaatccgcaaaaacgtaaaatctatagtttttttaaatatctgcagggcaaagcatgctaggtacatacaaccttgtaccaggggaagggttgtaatgtttgctacagggcgcaaaactgatatacggggtgtcccatttaaaaaaaatgagaaggttttgtatttgcaaatggtgatcacactgtatattttatggctaaaagtggggaatattgaattgtttaaaggtaacactgtattttgggaactttgacctatcacctggatttttatttccttggaaacgtgatccacagccctatgaatgttgccgtttttctcggtggagatgtaaatatttcaaaaattattaactttaggcctgtgggaccttatacaaatttttcatatttttgaatagtgtgttcagggatgatttagtatatagggtgttctatttagaaagatagaactttggttcataccgtcgttctgactctgtataattgaaaataattttaaattatgggcctctttgatacacattggttttgttataaacatttttttgtatatctcatagtttagccgtagtcaaggaaagccagaggtttggcgcaccctgtatgatagcagatttatcttgcggtagtggcgccatcgagcgaagaagctaagtacttattggaccacccatgtattcatatggaataagttgtaatcattggttagttttatgtattagaaacaatgggttcctttttatttggtgcataaatattaagaaaactgatgaaactcatttgatcataataaacgatatttattaggattttcactttctaacaaaaattgtttgtggaagtttgacaaacaggaaaagaaacctaaacataagtgactcaaaaatgatttttcgtgcgataatagacaaaatctacctaatacccattcttcttaaagtcggtaatataatttattttatttatgatcttgtaaatgttattctgttgtgtttggcgattgtcctgcaagcagttaaataaaacttgcccaaaacggtttccaagtttcagtcaacacttactgtattttaatccgttatgtaattttattgtatattatcaaatacatttggatttggaataaaaagatacacttganaacacaacac

SEQ ID NO: 1267 - DNA, 1184 bp, Diabrotica virgifera
ttcttttatttagataaacatggtaaaagtaaagaaaccctcgaaaccagaatctaagcagattaaaaaagttgttactaaggtgaaaaatggtaaaacagtaagcaagaaaccaaaagatgggaaattgaaggattcactaaaatctgttcttgaagaaaagtttaacataaatgttgaagatgtggagaatgcagtagccggtgttattaagctacacttaaacaaccctaagattaagaaccaattattcgacgaagataagtttgctgtaaatatgaaactaaactgtcacaaaattccaaggggatatccaaaaatactaagagttcccttaaagtattccctgttaactcccgaagatgatgtgtgccttatcgtgtccgaaattaaaggtataggtaacagagaacacgaaaaacatgttgatcactatgaaaaacttctagcggagaagaacgtcaccaacattaaaaaaatcatgactgtacacgaattgaacactgaacacgaaactttcgagcaaaaaatcagacttgcagatttatatgacgcgtttttagtgtgtgggaaagttagtggcaaggttgtacataaatgtggcaaaatcttttacaagaagaggaaagttccaacatcggttaatcttaaagctacgaagttaaaagaacatattgatagaaacttatcaaaatcatttcttcatttacatttgggcgatacttataatgttcagttgggacacagtaagatgaccgtagcacaaattatatattttacatctgcatatttagctagcgaatttcctggaggatgtatattacatgtgtgtacacgataagttaaatttatttattatatgtatatttataaaatcttatttttatattattagtattatttatttttggggattgagcctataactattattttattaactttttattatttaaatatcacataggaatatttaattgcttattttaaaatatgatatattttatttatatattttattatttttatatttctttggttttgtcattcacatataaatttgtgttatttagttttagtgctgatgatactattagtataacaaaattgtatatttatgacatatatataggattaataaaggaatacaggaaaatctttttcacctgataatgaagaacatg

SEQ ID NO: 1268 - DNA, 1585 bp, Diabrotica virgifera
gtgccactccttccgtttcgtcttacactatttcggttgtgccttctcgacaagtcagggtattgccgggattagggaaggttcacgtaacgtatacatacgaccgcatcgtaccgtacgtggggcacaagcggcttacggtcgtaacggcccctcccagagtatggggaacgcgaccaagtgttcttcagcgcgaattcgaccgtatcgagaacaaaatccgtccttggaccggttattccgcgactaatcgctacctcaactccaactccgctgtgaaaatgattttccttcgagatccaattcgtcatattacagactataggatatatccaacaactccaaaatatcttcgtcataaagtttacaaacctctaagtttgtattgcgactattatgaccctatcagatccctattctgggattcttcatattggccattgtataagactactgaatcgtttatcgatcaatgcaatcaaggaactggagatcggttacagagaatattcgatgacgagacgagacttattcgcgctcaaacggcgtctctgttgaaacggattcatgacccggttcctcgtgtccaacgatacagctggcccgcggtcgctgcaaaatacgataatggtcttccggccagactacataacgacaactacatccaccggttgttagtgacctcgcctaactctaaaaccgaatacaccacctattacacggaacccgttaaaaaatatatcggagccggtcatttagctgctgtttcctacgcaggcgacagagtatacagccgcagtaatcaatgattattcttttcgccccacatctacctctacgaagatcccttgaagaatgacatccaacttttgagctactacatcaacaagttcaagcaggagaaagctattactgcaagcagtgagcctgctaaagtgccattgaatcctgctcgtgctacccgcaagtttactgcaaagagattggaagatgatgaggaagcagcaaaggaaatgcagaaacttcgagaggccagagctgcaagattggcgttcataaatgaggaggaaaagattgaaagatcgtcggtagcagtggatgatgcggtaaaagccaagaagaagaaagaggacgagaggttagcagaagaaaaggccttggcagaagaacaagcaaggcgagaggcccaaaccaagaaggaggaagctgcaagaaaagctgagttggctagacaagacgaacttgctgcacaagctgccgctgaaaaagctgccgagctagaacgacaagctgaacaggcacgcaaacaggaattggctaaacaggctgaaatagaaaaggctcgcaaggctgaagaagagcgcttacgtcaagaagaacaacgcagacaagaagaagaagctaaagcagaagaaacaagaaagcagcaagaacgacttgaagaattagctcgccaagctgaagaagaaaaacaagccgagctcgcccgacaagcagaagagcttgccgaattagcgaggcaagaggctgaattagctgagcaggccaaacgagaagcagaattagctgaattagccagacaaga

SEQ ID NO: 1269 - DNA, 1634 bp, Diabrotica virgifera
caacactaagagacgccgatctccgaattttctcgcctttttgcccctcgaaaatccgaaaaaatggtttatgaaagcgatttttacacgaccaggaggccctatcgtgccactccttccgtttcgtcttacactatttcgggtgtgccttctcgacaagtcagggtattgccgggattagggaaggttcacgtaacgtatacatacgaccgcatcgtaccgtacgtggggcacaagcggcttacggtcgtaacggcccctcccagagtatggggaacgcgaccaagtgttcttcagcgcgaattcgaccgtatcgagaacaaaatccgtccttggaccggttattccgcgactaatcgctacctcaactccaactccgctgtgagaacttactacgtaaattacccaataacaggatcagattactacgattactactactcgctcaattcaccctcaacgtattattctccaaggctatatagatggtactcttcttggccaagggaataccgtacatattggcccatgtacagaacctacctcagtagatatttgagaaactattaccaaaatctcgactggcccagttactactggtctacttatctaccctacaccaaaaacttggactacgaatttagcgatatcgaaaacaaaatcgataatcttcgaaaaacgatttacttggactacccctatccaatcaaggctgtggattatacttactacccgcaatcttacaaaagctacaccccgctttcgctctactatgactactactggcccctcagcagtcttaaccgctatagctcctactggccttactatccataccacagatacttgtactacaagtatactttgccttccgatagatattaccatttaaaaggaatattcgatgacgagacgagacttattcgcgctcaaacggcgtctctgttgaaacggattcatgacccggttcctcgtgtccaacgatacagctggcccgcggtcgctgcaaaatacgataatggtcttccggccagactacataacgacaactacatccaccggttgttagtgacctcgcctaactctaaaaccgaatacaccacctattacacggaacccgttaaaaaatatatcggagccggtcatttagctgctgtttcctacgcaggcgacagagtatacagccgcaggccccacatctacctctacgaagatcccttgaagaatgacatccaacttttgagctactacatcaacaagttcaagcaggagaaagctattactgcaagcagtgagcctgctaaagctgcaaaagttgagaaagctcagtctcctgagaaagaacaagagaagccagaaatcacagaaattaccgaataaccaaaacctctccgtctaataatttctactacctacattcttctttcctgctaatcttattttattaactgaatttaattatgtgcacataattgattgtattttttatatatagtttattttgaagagatgtactgccatgttgagttacgtacgtaaaacaaattatttttattgttatttttgcacagaagattgtgttttgtgagatggttatattttgggcactgtgttcaataaaatctattttgatt

SEQ ID NO: 1270 - DNA, 972 bp, Diabrotica virgifera
aaccacgagtccgcccacgcgtccgcaacactaagagacgccgatctccgaattttctcgcctttttgcccctcgaaaatccgaaaaaatggtttatgaaagcgatttttacacgaccaggaggccctatcgtgccactccttccgtttcgtcttacactatttcgggtgtgccttctcgacaagtcagggtattgccgggattagggaaggttcacgtaacgtatacatacgaccgcatcgtaccgtacgtggggcacaagcggcttacggtcgtaacggcccctcccagagtatggggaacgcgaccaagtgttcttcagcgcgaattcgaccgtatcgagaacaaaatccgtccttggaccggttattccgcgactaatcgctacctcaactccaactccgctgtgagaacttactacgtaaattacccaataacaggatcagattactacgattactactactcgctcaattcaccctcaacgtattattctccaaggctatatagatggtactcttcttggccaagggaataccgtacatattggcccatgtacagaacctacctcagtagatatttgagaaactattaccaaaatctcgactggcccagttactactggtctacttatctaccctacaccaaaaacttggactacgaatttagcgatatcgaaaacaaaatcgataatcttcgaacacagatattcgatgacgagacgagacttattcgcgctcaaacggcgtctctgttgaaacggattcatgacccggttcctcgtgtccaacgatacagctggcccgcggtcgctgcaaaatacgataatggtcttccgggcagactacattacgacaactacatccaccggttgttagtgacctcgccctaactctaaaaccgaatacaccacctattacacggaacccgttaaaaaatatatcggcgacagagtatacagccgcaaggccc

SEQ ID NO: 1271 - DNA, 1477 bp, Diabrotica virgifera
  misc_feature (1290)..(1290): n is a, c, g, or t
  misc_feature (1343)..(1343): n is a, c, g, or t
tttttgcgtcccaacactaagagacgccgatctccgaattttctcgcctttttgcccctcgaaaatccgaaaaaatggtttatgaaagcgatttttacacgaccaggaggccctatcgtgccactccttccgtttcgtcttacactatttcgactccaagacattacgtggtgacggattacccagagcgtacccgcaaatctgcagagcaagtctattcttactcctattcttccgactcttctaatcgctccggttatggcgacccccgctctcgttcttacacttccaccgagagcgtctccagatcttccactggaggccctggcggttacaactatacttcggaacggaccagccgctccagaggcgacggtcctggaggttacagctccagctatagctctacttcatctggcccaggcacatacagacactactcctatcgtgtctaagacctcttgagtttctgcttgtaacctagttatattcttttaaaatcgggaatatccttagtgtttcaattaataaagaaaaacagtaaataaggttttaagtaaaaaacagtaataagcaacttaaattttagaagatatttttactatactgtagtccttaaactaaaaactatactaacgctagtataagattacatcaactggattgtttttttaatttctctatgtcgagtgttagttttacaagataacctcgccttacaattgtctaaaaacattattgatacagggtgtacataattaggaaatattatatcgttattaaggatattcccgaaaatttcaatatggtttagattataattagatatagatatatatttacacatgcattaacaaaattgtgtttgatatatagtactttatactaattttggttgaaataagtattttaggtcaaattataaataaaataagagttaaaaaatactagaaatcaaattgtgaaaaatacatatcaaaaaccccttagcggcttcatataattcttgatttgaaaatataggtatattaatgaatattttatacaaatttatgataggtacaattggaaaaaataatatttttggatactggtaatttttttttaaatggtagagtgacgtaaacagaacatttcaaaatgttattagtgtccattttattattttttttacaattgtttgaaacaaaaatacctatcttattttgaccagaacaatattttaatcatatatagttatttaacttttactaacaaacacaccatattcgcactgattttagattatantattagatgtttaaggtagttgtataataataaatttttgaatctatataaanattttatttttcgaatgctataccataaaaaatattttcgataatgtaatttttagaaactaatctttatatatccattttatttatcgagaagatatatttgatataattattgtgatcaccttacatatact

SEQ ID NO: 1272 - DNA, 1622 bp, Diabrotica virgifera
agaaaactgataagtatattgcttttctcatttatttatgtggttaaatagtgggttagtgttggtcaacgtagatgataacaactgaacattgaataaactacaagaataatgttaagcataaaaattctgttatgtatgttgctggcacaccaatctgcggtagaagctgtatataatgttggagttggacgagccgattgcacaggaccatcagcagaaattacttttatgggttatgccaaatccggtcagaaaggatgtggtatccatttaaggcagttttcaagagcatttgtgattaaagatgagaacactctagttgcatttgtgacaattgacacatgtatgatgaaccatcccctaaaacaagcggtaatagataaattggatctaaaatatcccaatgtatttactctaaagaatacaattctcagtggaacacacagtcacagcacacctggaggtttcctcaaggatgtaatgttggacataccaagctcgggatattgtaaagaaacctttaacgcattggtagcaggaattgtaaaatccatagataaagcatacaacaatcaagttgaagcaagaatcttttacagcactactacagtaactaatacaaacaggaacagaagtccagctgcttacctctataatccagaatcagaaagaaaaaagtatgagactgacgtggacaaggagctagttcaaataaaatttgtgagtaccaaggataacgttgcaattggtgcaatcaactggtttccggtacatcccacctcaatgaataacaccaactgtttggtgcattcagacaatgttggatatgcgtctcttctgctagaatctagtgttaacacagactccttaccaggtcaaggcgatttcgtgggtgcttttgcctctactaatttgggtgacacctcaccaaatcttaaagatcctatttgtgtcaatacgggagaaccttgtgattttgttcatagtagttgtgccggaggaaataaatattgcatctcctttgggcccggtgaagatatgttcgaaagtaccaagatcattgctaataacttgtttcaaaatggaaagaaactactggatggcgcaactacagacgcaacagaaataactggtaccatacaatatattcacaaattctcacatatgcctagtcaaaccactacttaccaattggagaatggaacacaaattaatgtgaggggttgccttccagccatgggatatggctttgctgccggtacaactgatggccctggagaatttgattttgaacaagcaactaatacgagcaaccctttctggaatgttgtaagggactttattttccctccaacacagatgacgttgtatgccattttcccaaacctatacttatcatgtcaggaaagttacttagccatacaaatgaaaccggtaacagttctacccaattataaaaaaagacagtttgttctgattgccgttcctgaaaatttaaaccctgtcgggaaaaaattgaaaaatcctcgtagaaaaccatttcccaaacgaccacccccccaatttttggtggttaatggggtttaagaaactttttccccttacattgcccccccaaa

SEQ ID NO: 1273 - DNA, 1185 bp, Diabrotica virgifera
ttcattacatcgataagtcacattccgttgttcttagtcaaagaaaaatcagaatgaagctgttcatccttgctgccctcattgtggccacaagtgccaacctaggcgcctttgaaaaatggaccagttttaaggcaacacataacaaatcctactcccttgttgaagacaaacttcgtttcgcagttttccaagaaaacttgaagaaaatcgaagaacataatgccaaatacgagaacggagaagaaacctactatcttgccgtcaatcaatttgccgattggtccagtgctgaatttaaagctttgttgaattctcaaattatcaacagaccagaactatcctttatcgaaacatacgaagcagatcccaatgttgaacttgcaagttctgttgactggagaaacaaagctgttttgggagtcaaaaatcaaggaagttgtggatcttgctgggctttcagtgccacaggtgctctcgaaggtcaacttgccattcacaaaaatcaaaaggtcccactaagtgaacaagaattggtagactgtgactcatcaaactctggttgcaatggcggtttaatgacaaatgcctttgcatatgttaagagccacggacttgcatcagaaaagcaatatgcttacaccggcagagatggtagctgcaaaagaggatcaagaacactttctactatcagtggatatgtaaatcttgccaaaactgaagctgcactggctagtgctctttctagcgtaggtccagtatccatagctgtagatgcagatacatggcagctttatggaggtggaattttcaacaataaaaattgtggaactagccttaatcacggagttcttgctgtgggatacactaatgacgtcttcatcgttaaaaactcatggggaaccagctggggtgaacttggttacatcagaattagtcgcggtcacaacttatgcggtcttaaccaaatgaacagttatcccaaattgtaaatgagaataaataaataatatacattataaatatgtaagtttgcataaagaaataaataaataaaaattaaaaaaaaaaaaaaaaaaaaagaaaaaaaaaggggcccagagaataaaaaaaaaaaaaataaaatgttgacataaacttctattttgataaaagaaggggggggaaccccataagagggggggg

SEQ ID NO: 1274 - DNA, 1488 bp, Diabrotica virgifera
  misc_feature (1474)..(1474): n is a, c, g, or t
ccttacgcgtccggcacgagtgagtgatatggcgtacaagatatttttatttagttgtctcatagctgctggcagcgctggcagtgtccaactgcagacctctgcaccagctgtaggcccttctcctcagatccatatcaccgctacacctgccgttcaatattctgctcaggtccctcatcaaggagctgtgattattcaacaagcaccatctttacttcaaaatgccgctctaatcctttcacaagctgctccaatattacaagcaccacaattgatccatcaaacaccacaattggttcatcaagcaccacaattggttcatccagcaccacaattagttcaacaagcagcgccatacatccaacaagctgcgccgtacatccagcaatctgcaccaatatatcagcaaccggctccagttcttcaacaacacaattcatttctgcaatacgcagtacgaatagctgttccaacggctcagtatgctcaaaactccccacctccacagcctgcaattcagtacgcaccccgggaagtgcaaatatctcaaaaacaaattcaacaagaatcacctgtacctattcttcaatattctgcccaactacaagcgccaactccatttcaaatatctcgcaatcctgtacagattatagctaaagcagttccacaatttacaccctcagttcaatatgcggaacaagacactggctcagttgaagattcagatatagtagaccagtacgacgaacctgctccagaagcgttagcacctatagttgcagctcctgaagctccagctcctgtacactatgccccagttgtcaaagcagctaaagtggcgaaggttaagaaacccgatcatttcgaccacaatcctgagtatagctatggatatgacattgaggatggacaaacgggagatagtaagagacagaatgagcaaaggcaaggagatgtggttcagggtagttattctgtagtggatccagatggtcatagaagaacagtagaatacactgcggatccaattcatgggtttagcgcagttgttagaagggaaccggttaatattaaaagttcgagacctgtgagacgtagtaggaagtataaaacaagagaatgaaataaaagttaccaaagtttgtaggaatacattgtgatataaaaaagtggtgattttttaaggtagaccatattatatatcgaagtggtacaaaggtgtaatagatatccatggtggcctaaaaatactttgaaacttaaaacgtataggtataggttataggtctagtcaagaaataaatgtatacaaaatgtacataatatagatgtgttataaatagtatttatgatataagtggtaaaagtacaattttaaggtacgcatgtgaaagtttgcagaatgagcgaagcgaattctgcaattcacatgagtgccttaaaaatgtactttttaacacatatatgatancatattttttatac

SEQ ID NO: 1275 - DNA, 963 bp, Diabrotica virgifera
  misc_feature (904)..(904): n is a, c, g, or t
cccacgcgtccggaccgcttcaggataaggatactaaaaatgaactcgaatgcaaaccccaaatatagcgtttggagacaaagtcttccccaaataattgcagtttttataaagaatactttactatttatccatggtacgagcttgggatttccgacaattttggttccaggaatatctggaaatgaccgttccgaaacgattctattcggtcaggatgaaatctcctggataagttccataaatttaatatttatacccatgggttgcttgatctctggttccatcacacaagcgattggaaggaaaagagcaatgcagattattaacataccatttataatatcatggctgcttttccacttttccacgaaatcttggataatttttttggctgcgtccatattaggattcagcggtggtttattggaagccccagtattaacgtacgtagcagaggtaacccaaccacatcttcgaggaattctctcatgcactggtaccatgtcggttacattgggaatgttaagccagtttatcttgggatcattcatgcaatggcgtacagtgactctggtgaattgttcctttcctgtcatttcatttcttttgctgatgattgtaccagaaacacctgtgtggctactatctaaaaatcgaatagaagaagccaagaaaagtatagcgtggttaagaggatggactaatatagaggacattcaggatgaatttcaagaattacataagcagatttgtaacgaaaaacaaccagacagttttaaagaagctatttcgcagaaattgaaaaatttgaagcttttttcgaaacgcatcttcatatatccaagctccctattagctttgtgtttttccttggacattttaatggatacggaccgttccnagtttatgcattaaaatattccagcagatgaaagtttctattgatccttactattacga

SEQ ID NO: 1276 - DNA, 487 bp, Diabrotica virgifera
acccacgcgtccgcttttcagtccgggcttctcgggcccgggatttgtttcgggcttctctaatatgtcgtataatccgtgtaatgccctattgtaatatgcccgtgtaatgcgtaatagaagcgttgtaatgccctattgatcgtaattagcgtttgtcgtatttcatttgagagtaacgtacatttctgtaataaagaaaatcatattttattatttctgtttttttatcaatcaagttctgttgaccacttgtttgatgaaaaaaaaaacagttttgttagactaaaatacagagaatacaaggaaccgccaacttgcacaataattaaaacgtatttagaaagttttatactaatttttttaataattgctcataagaatttaaaaaaattcccatgtgatgttttttaattagtaactttttttctagccgtaagtttttgtagcattaacgttaacatggttgtttactaaaattaatttt

SEQ ID NO: 1277 - DNA, 935 bp, Diabrotica virgifera
  misc_feature (738)..(738): n is a, c, g, or t
  misc_feature (795)..(795): n is a, c, g, or t
  misc_feature (827)..(827): n is a, c, g, or t
  misc_feature (887)..(887): n is a, c, g, or t
gtaaattttaataatggaacattgcagttctgtagaatcattaaaaatcgaaataaaggaattgcaggagaaattaaagcaaaaacaaaaattattggaagagttactgaaaaaagataatgatactattgctgaaagtaaaactatttcaaccaacgaaattatcagatacagccggcaaatgattatgccagatatcaccatagatggacaaaaagcactaaagaatagtaaagttcttattgtaggcgtagggggtttaggatgtcctgcagctttatatctagctactgcaggagtaggaaaaataactttagttgactatgatgaagttgaattatccaatcttcatagacaagttttacatagtgaagatgatataggtgtaccaaaagttatgtcagcttataataagcttaaaagaattaatagtgatatcaaaattatcccaatcagagagcatgctaatagtaaaactatagaaaaccttttacataacaacaaatatgatgtagctatagatggtaccgataatgtagccaccagatacttactaaatgatatttgtgtattgcataatatacctttagtatctggcagtgcccttcagatggagggacagctgacagtatatcattacaaagatggaccttgctacagatgcctctttccagttccaccaccagcacatactgttactaattgtggagatgggggcgtcttaggaccagttcctgnaacaataggtgtgttacaagcactagagactattaaaattataaacacatcagctgntgtgctttctggaagattctttatcttgatgnatctacatcgacttttagaaatgtgaaaatgagacctagaaatcctaaatgtgatgtgtngtggtgatgaacctactatcactactttgatagactatgaacaatttt

SEQ ID NO: 1278 - DNA, 589 bp, Diabrotica virgifera
ccgggtgcacccacgcgtccgcagacgcgtgggccgcccacgcgccgttgtcaaagcactgccacaatgggtaaaataatgaaatcaggaaaagtcgtattggtcctcgggggccgatacgccggcagaaaagccgtagtcgtcaaaacctacgatgaaggtacatcagataaacaatacggacatgccttagtagctggaattgataggtacccaaggaaaatccacaaacgcatgggcaaaggcaaaatgcacaagaggtccaagatcaagccttttatcaaagtattgaactacaaccatctcatgcccactagatactctgtagatttggcatcagacttgaaagttgtacccaaggacctcaaagatgccatgaagaggaagaaggctagattccagacccgtgtcaaatttgaggaaaggtataagcaaggaaagaacaaatggttcttccaaaaattgaggttctaggctgtagatttaattttataattgtacactttttattttgagaataaaatgtggataaatgttaaaaaaaaaaaaaaaagggcgggccgctccgggatctagaaactagctagtt

SEQ ID NO: 1279 - DNA, 1139 bp, Diabrotica virgifera
actgaatgaagcactaatgcactacaaggaagctattaggattcagcctacctttgcagatgcatattccaatatgggaaataccttgaaagagatgcaagacgtatctggagcccttcaatgttacacacgcgccatccaaataaaccccgcatttgctgacgcgcacagtaatctagctagtatccataaagattcaggcaacattccagaagccgtgcggtcgtacagaaccgctttaaagctgaagccagattttcctgacgcatattgtaacctcgctcactgcttacaaattgtctgcgattggacagactatgattcaaggatgaagaagttggttaacattgtcgcagatcagctagagaagaaccgtttaccgtctgttcacccacatcattcgatgttgtatcctctttctcacgatttccgcaaagctattgctgctagacacgctaatttgtgtttagagaaaataaacgttttgcataaattcccgtacaagtttagcccggaccttaaaagtagattaagaatcggttacgtcagcagcgattttggaaatcacccaacgtcacacttaatgcagtcgattcctggaatgcacgacaaatcaaaagtggaaatattttgttacgctctaagccaagacgatggaactacatttagaagcaaaatctcgagggaagcggaacattttatcgatctttcttctttatcttgcaatggaaaagccgctgatcgaatttattcagataatatccacgtattagtaaacatgaatggatatacaaagggagcacgaaacgagatatttgctttaaggccagctcccattcaagtgatgtggctgggatatccaggtaccagcggtgccagtttcatggattaccttattaccgatgaaattacgtcaccgatagaagtagcagatcaatacagcgagaagttggcttacatgccatacacatactttgtcggagatcataaacaaatgtttccccatttgaaagaaagattgattgtaagtgataggacgggacagaatttggctgataatggcatcatcatcaatccatcagatatgttttgtcctgcttcttattcggacgtcaaagaagatcaagaagatcataaaa

SEQ ID NO: 1280 - DNA, 996 bp, Diabrotica virgifera
gcgtccgaggacacgtgggcggacgcccacgcgtccgggccgccctttttttttttttttgtttattaactattgtaccactcggttgaaaaatcgctaagcctactttggattcggctttcgagcgataatatagtacggagaatagttgaacagtagtttagattctgtgaggcagtttagaactagaaatccaatttaggtgccatggcctttttcaaatcgatgtggaaaccaaactcgaagcacgaaaagctttctgaagaattattttcaaagattaccaaagaacccaaacaagaaaatgtacctgaaaatgatgccaatacatttaaattaaaatatataggttgtacaacagtcgaaaaagtaacaggagataacgtcagttcggaagctgttaagactatcatcaaaaacgcgaaaaaacttaaaggaaaaacattggcaaatgtaactttacatatatccgaaaaaggagtcatagtaacggacgcagaaggaaacgatgttctcaaaatatctatttatagcatatccaactgttccactgactcatcccaccgacaactattttcgttcatatcatcagacacaaaccaagtaaacacttgccacgcttttctttgtcccaagcgaaaagtggcccaaaatgtgacgttagccgttgccagtgccttcagcacagcctacctcgattggagccaacatacgatgtctagcgagggaatgaaaaataccgttcagtcgaaagaaaacgagaaaaacaatctaaatcaaatcaataagtctgaagttataatagaagaaaagcttatcgattttgatagtgagcctacgacggaggatgatctgtttactcttgaaagtcaattgcttttcaacaaaaatgactgggtttcgtttgatgatgacggtttcgcagaccccagcaagctcaaatttttccagtgatgatctcgccaatgagaaatacgtccatacacataccttata

SEQ ID NO: 1281 - DNA, 981 bp, Diabrotica virgifera
  misc_feature (943)..(943): n is a, c, g, or t
cttcctggggtccggaaagaggaaagagctaaacactaaagagataaatagaataaatccatcatattctttagttttatattgaataaaataagtctcagtaaaaagtatcttcagtataacatatttacaaataaaaacatgcattgaacgagttataaaatattggaccatggatttaagagctgtaataaataacgtaagaaactttttcagttctcttcagtttcatcccaccggctctgaaaggaatcgaaagagaagtgctttggattctattgattcatgtatgagccctaagatcagaagagttcagtctatcaacttagatcgagagaattattatatgagtccaaaacctttgagaagaccatctgtatataaaactcctagtataaaaaagatagaatcagtagttctagatgacgatgaagatgatataaatattagcagtaaaaaaataaatggaaatactctcagcggtaatgctaggactggaaaatttacgtctactccatatggtaacagttttagtaaaaaatcggtaaacggaacagatagtaaagatgtattatttgttaaagaactcaaaccatccagtgatgaagatgtaacatttgtcagagaacagaaatcatcttccctaaaaagagctgatgctcttagaaaaggattaaactatctacggccatacagtggaagtatttctaaaccaaaaattgtacagaacgaacgacagttaaaagaaaaatataattcaacattcggattattaaatggtacttcatcattcaatatgaattcttccatacgcttaaatgaaaagaaattgtatagagagatacttgactccacacaattttttacacctagatcatcgtttgacactctttcatgacgaggagagataaataatggctgcggctctatcccctatgtctancaaagacagaattaaaaagggtggtagacgatttttga

SEQ ID NO: 1282 - DNA, 918 bp, Diabrotica virgifera
caaaatgatatgacatagaggggtgttgttcggcaaaattaagtcaaaagaatctggagaattttgaacgtagttgtgtgattaatatgaacatagtgttttaatcggaatagaatttaacagaaaagattaaaaatggcctattactatagaactttcatggaaacgttttggtgtgagcacgtttggttaccccctaacaccacttggaaagacatagctcctgatgcggatcctaatgttcgtcatgctgatccaaaacacttattttatcctttgccgatggcatttgtactgttatttttacgatatatattagaaaagtactggtttgctcctgttggagtatcattaggaataaaaaataatagaccaaaaaagacacccgataatcctgttctcgaaaaagcatatacacagtcaaaaaagtggaaacataaacaggtacaaggtctggctaaacagttggacattagcgaaagacaagtagaacgatggttgagactgcgcaaagcacaaaacaaaccatcaactttagttaaattttgtgaaaattcgtggaggtgtctatactacactcttagctttatttatggtttaacaattttatgggacaaaccttggttgtggaatataaacgaatgttggactggttttccacatcaagacgtcactaatgatatatggtggtactatatgatctctatgtcattctattggtcgctgtcagtgagtcaattttttgacgttaaacgcaaagacttctggcagatgttcattcatcacattgctactatagtactaatgtgtttatcatggatagttaacgtatttcgaattggttcgctggttttagttgtacacgattgtgctgacatattgttagaagcagctaaaatggcgaagtattcaggatat

SEQ ID NO: 1283 - DNA, 1250 bp, Diabrotica virgifera
gtgagttccgtagagtgttttttagcgactttagcgttgttagccagtttaaaatttgattaaccttgaataggcgatatacacctttacctctctttaatatttatgatttgaattattgtgctactttaacttgagtgaatatatttaaattctaagtagttagagaccgacgccgatagtactctacttgtaaatcaaccgagaagttcttaagttagtttgaaaaaatggttcaggtcgaggtttatactgtaaaaaacaaaaaactcggggacattacagcttccaacaacacaacagtaggtgatataaaaaaagaaatagcaaaagtaacgaaacttcctgcagatagacagtcactgaggtcagaggccaagggaaaggatataagaaatgatgctaccattcctaatctagaatcattaagaaaagtatttgttaaagacttagggccacagattggatggaatacagtatttcttcttgaatatgctgggcccttatttatatatgctgcagtgtcttttagaccatggatcctgtatggagatactgctagcaatgccaccttcaccacaaccgccaagctagctctaggctgttggtccatccattacctaaaaagaatcctagaaacattatttgttcatcgtttttcacatggaactatgccaattagaaacctattcaaaaattgtggatattattggggattttgcctttatgtagcgtaccatattaatcatccactatttacacctcctccagttttattccaggctgttggattagctatgtttgctgtgtgcgaatcagggaatttagcaactcatctacttttaagaaatctcagacctgctggaagtactgttagaaaaatccctcgtcctgacggttgtccattaaatctactattcgactttgtttcttgtcccaattacagttacgaagttggttcatggattggttttaccattctaacttcatgcattcctgctgggatctttactggagctggctcctatcaaatgacaaggtgggcattaggaaagcacaagatttacaaaaaagaattttcaaactaccccaaacaaagggaaagctatccttccccttaattttaaaaaatttttctaaattaaactttttggtaattaatttaatttttccgtaatttatttgggggggcctggtggaaaaaaaaaaatttatcttaataagggaaaaaaaaaaaaaaaaaggggggg

SEQ ID NO: 1284 - DNA, 580 bp, Diabrotica virgifera
  misc_feature (492)..(492): n is a, c, g, or t
  misc_feature (507)..(509): n is a, c, g, or t
  misc_feature (537)..(541): n is a, c, g, or t
tccaattgtagccgtgtatataaggtaaacaatattcagaagatcaatatgtctgtcgttaacgtatcatttaatacgactagcgaccattccaaatgggctgtaacttcaaattccagcagttcgtggagttgtgtaggagatatcaatcgtgcgcaacatcaactggaaaggggtggtggaactgtgtgcctacaaaatcaaaaattatctacaaatttccacaagttaattagtgccgtagaagagtgcccaagaaaggagtcctttgatattccgacagtgattaatgtataaaattttatataatatatatattctatagagaataattccgtcttattttgcaaactatttagcaacatttttcagcaagtttccctctgggggtatactagggttccatattttattaataaattaccaatatttgttaactttaaaaattttaactgagaaaataaacctttttttattttaaaaaaaaaaaanaaaaaaaaaacaaannnaaaaaaaaaaaaaaaaaaaaaaaaaaannnnngggggggggggggccccccccccccccccccctaagggg

SEQ ID NO: 1285 - DNA, 1242 bp, Diabrotica virgifera
actagttctagatcgcgagcggccgctcgcccacgcgtccgcccacgcgtccgcttcgctcttgcaatgtcttcacaaatactgttttttctttgcttgtattttatcgctggaagaacaaatgctctgagttgtaaagacgaaaacaatcgtgatgtagattggtttgttgcatacaaaatacctatccaaagtggtcgtggagatataattaaggctggtcttggacatatttatttaacatctaccaattcatcgacatggactttttctaaacgttcgattggtgataatagttcccttattggaaacactcttcatgacttttattacaatagaaccaaattaagttatattttgtacaacgatgaaccaccaaatcatccaatatctgcagcgaaaggtcacacgaaaggagttgttatttcaaatacagcaggaggttactggttaattcattccgttcctaaatttcctgaagtgggcaatagctactcctttcctagcacgggcgtcaaatatgggcaaacctttctttgtgttacaatgaatttaacaaacataaatgcagtaggtcttcaacttcagtacaaccaaccccacatctacctgcagcaggtactctcagatattaaaactcgtgtaccagatctagcaagtgcagctcaaaatgtcactgttaagtccgctccattctatcgtgttgcccaaatctattcaaagaagaaagtggcctttacctcattcgccaaacacagaaaattcaaccaggaactgtacgaagatctggtggctccatacttaaaacaagatttagtggttgaaacatggccaaatggggctggtagattacattccaattgtagccgtgtatataaggtaaacaatattcagaagatcaatatgtctgtcgttaacgtatcatttaatacgactagcgaccattccaaatgggctgtaacttcaaattccagcagttcgtggagttgtgtaggagatatcaatcgtgcgcaacatcaactggaaaggggtggtggaactgtgtgcctacaaaatcaaaaattatctacaaatttccacaagttaattagtgccgtagaagagtgcccaagaaaggagtcctttgatattccgacagtgattaatgtataaaattttatataatatatatattatatattctgaaaaaaaaaatagggtaaacctttttttctttttaaaaaaaaaaaattattattttgg

SEQ ID NO: 1286 - DNA, 1129 bp, Diabrotica virgifera
gataaagttcaacatttttgtgcttttaatcagtcacatttttgttgctgagtgttgaacgcatcgtttcaaaaaaaaataatacaatggcagcaataggaaatgttttgtctagaggattttctacaactacagccaggaatgtgattcaaaatgtgaccgtcattggtggaggtttgatggggtctggaattgcacaggtcgcagctcaatctggtcaaaatgtaactttagtagacgtcagctcagatgtcttgaaaaaatcagaaagcagcattcaaaacagtcttggtcgagttgctaaaaaactacacaaagacaacccagctgaaggaaaaaagttagtagatgatatattatctcgcatccagtactcaaccgaaccacaaaaaggagtacaaaacgcagatctagttgtagaagccattgtggaaaatatggatataaaacataagttgtttaagagcttagacgaagctgcaccagagaaaactcttttcgcctccaatactagttctctatccatcgcagaaatcgcatctgtaacaaaacggctggacaggtttggaggacttcattttttcaaccctgtacctatgatgaaacttttggaagtcatcaggatttctgaaaccagtgaccaaacctacaatgccatgatggcttggggcaagtccattggcaaagtctgcatcacctgtaaagatactcccggatttgttgtcaataggttgctggttccttatgttgctgaagcggttcgtatgttggaaagaggcgacgcttctgctcaagacatcgacactgcaatgaaactaggagctggttatccaatgggccctttggaactggccgattatactggtttagacactggtgtgttcgtcctcgaaggttggcacaaaaaattcccggaaaatccgctttttaacccagtaaaagctccaaaagaaaactcctaaaaaaagggtaaactaggaaaaaagactggacaaggattcctaaataacccaaataaaataaggttggtattactcataaactttaaaaggtttttttgtttttaattattaaaaaaaaaaaaaaaaaaaaaaaaaaaaaagggggggggcccgctctcttaaaaggg

SEQ ID NO: 1287 - DNA, 949 bp, Diabrotica virgifera
ctcctcgcgaacgattgaagtaaattaaaaaaaattaagacttattacaccatcaacaataaggtgaccggtcaccgcttgatgacaaaaccatttaccattccgttggtgcacccatagaagaagagagaaatccaatcagcgggaaataaagttcaagtaaaaatagaaacaaatcctacgtgtgctgtattatagtgtataggtaaccaaagcaagcagcggtgaggtatatcgaaactcgttttcccatctttacggttacgcctatacttttccacattacttaaccgagtgtgacacaaatactacatgtgcagaggttgattatcaactttgctgcttgttttgttattttttaatcaaaccacatcaagagatttaaagatggggaatgttgtatactcaatcatctggctgcttattttgataattgtttcatttttgatagcaggaatatgtgcaggattatacattatagtccatccactaagtgtttgcctggagccgttagcgggttttgcggagattctactctctggagtgcagttcccccattactgcgcagaaaaaatgatgagcggggcacctttaggttaaaattttttaaaccattcgaataagttcaaatcttactaatacaaatacaaaagtaaagtgttcatttaggctctaagatagtgtgggagttagtttttttatacctatatttgttaaaatataagagcttatataaatgttgaagatgtaaaaattgtttcctattataatacgattcattaatatttaatattaaccctatccagcagcggacaaagtttcagggagggtggttaaaaatattttggtttgaaaataagttaaacattaaaaaaaaaaaaaaggtggggaaaaaaggtttttatattgtgttaacaaaaatattatttttttccttataaagcaaatt

SEQ ID NO: 1288 - DNA, 974 bp, Diabrotica virgifera
atttcttttaaaaatagttatcttcacccgaacttattctggatgatttatatttgcttctatatacaggattgatcaaacacggctcagataatgattgtaactggagcaaaggcaagatccttgttgagagcaattcaaaatggaatcattgataaaataaaatcggcttacgaaaaagaaattaatattaaatgttatggaagttgcaggtctgtcctgaattgggctacgtattttggattgattaaacacagcttagataatgattgtaactggagcaaaggcaagatccttgttgcgagcaattcaaaatggaaccattgataaaataaagttagcttacgaaaatgaaattaatattgaatgttatggaagttgcaggtctgtcctgaattgggctacgcattttggtaaagtttctattgttcgcaaattactaaaaaataagaaattgataaaaaacacagacttggacacttccttacatatagctgcattggaaggttatactactcttgtaaaattgttgttaaaacatggagccgatattgaatttgagaatgatgatggagaaacaccattactacttgcaattaaatctaacgatggatataatcttaaagatgttgacagtcttgtaaatattttaatagaaaatgaagcagatgtaaatgcgagtgataatggtctaaatacttctcttcatatggcttgtcaaatgggcttgtgcagtattgcggaactattattagatgcaggagcagatattaatttgcaaaatggaaccggctggactcctttgttttgtgctgcttattatgatcggctgtttattgtgaaattattattacatcgaggggcagatgtcaccatcactgatgatgagtcaggagacacagcattgcatatgtgtgttaaatgtgacaaagtggctgttacagaattgttactttcaaatggagctgatgtga

SEQ ID NO: 1289 - DNA, 973 bp, Diabrotica virgifera
ggcttcgtttaggttttagcttagcactagcaccacgttttcgttttaagttgactgttgactttggccattgtttaagtgtagttgtcttatcgttatcgttacaatttgcaatttggattgagtttgagttgttaggaccaggaccaggtttataacacaagtggatatctattcatcatggcaattgattgggaaaaaattgtaactgaactaagtgctgtgttccaagatgagcaagagacatttgcgagagttttgttttatttaggagaagaagaaaaggtgtataaagatgccgataaactaggaccgcagatgaagatcttaatgtcatctatgaaagtagcatctttgtttagtcagtacgccaaacggttagcagaggacacaaagagggctgattcggatgaaaagttcaaacgagtgatgggtctaatctgggcccaaatgatggacgctaacaaacagacagatgataaagataaaaccccagatgtaagcattattgccaaattagaacacctgtctctagaagcttcgccaggaatggttcgcgccttgagcattattccatatgaaagccaaaagcgttttttagtaatgctcaaagacatcgtaccaacaacagtgctatcgaatgtagagtatgttgttgaaactgttaacaaagtaggtggtgctgtagtaactgtagctttagctagtatacaattggcatatgaagctattgttaacattagaagatggtggaatggagagatttcaggcaagagatgttgtaaaaatattatagattcacttgctacaattggtggtagcgttggtggaggatttgctggtgtagctgtgggagcacttggaaggtcacttggcatgataatccgaggttttggtggaggattgttggggggaaaattggcccaaacgtcttttcccatggatgactgaaaaggattttaatgttccaaaa

SEQ ID NO: 1290 - DNA, 1384 bp, Diabrotica virgifera
  misc_feature (1315)..(1315): n is a, c, g, or t
ggcgcgtacaatttttgtgttgtccttgacttcaattttttttacttttaaccttggggttgaaggtacggtgtgtgtggatcagtttgatccgaaagatgcgggtgtttgccacaagggtgtaaataatggagattcagaacaaaccattgaaatggaccagtcaattgtgcagaccacggaaggaaaattaaggggatgtattagacacacttttgatggtgaagagttttatggcttccttggaattccttacattaaaccagctttaggagacctacgatttaaggctccacaacctccagaaccttggaccggtattagagatgcaacaaaagtgggcagtccagttttccacaaagaaacttttactaaatcttttcttggtggcgaggatggggtcaatcttaatgtatatactaagaagcccattccacaaggttcaaagcttaatccagttatggtttacattcacggcggtggttacgttgaaggccgtaatggtcccgacatgttcggacctgagtatcttctcaccgaagacgtagttttggttgtcatcaactacagattgggcattcttggatttttgtccctcgaagatccttccttaaaaatatacggcaacgctggacttaaagaccaagtggcagcactcaaatgggtcaagaggaatattaaaaactttggtggtgatcctgataacgttacgatttttgggcaaagtgctggagctgccgctgttgagtatttagtagcttctcctgcagctaaaggacttttccatagggccattttccagagcggttcagtcggtagcttctgggcttctggacaaagattttcaaagggccttttgcaatttttggaaaaaggcaacctgtcagacacacaagctttagaatattttaaaagtttgtctgttagagaattgtacgacattatgactaagtacaccaagagtattccatcacgaactttagggcttcttggtccgatagaagaaattccaaatgatacagcctttatcactaaacatccactggcagcatattatttctggggattataacaaagttcctataatggatggggtacacttcaaatggaggtgatctgtctcagctctgaacttatggaagatcaaggcaaagctttcgtagacaatttcgatatcgaattcattttgaacgctatgataggaattgaaaaaggcagcgagacatctaaaaagtacgtacaacggatacaagagatttataagatgccaaatggtgaaatcaacaagtacttagtattatcagatctcttcttntgtacaggtggcgttgggtggtgcaaacatcacgcagctacgtctaggtaaccagtttatttgtacaga

SEQ ID NO: 1291 - DNA, 972 bp, Diabrotica virgifera
atttacaaacaaggacataaaaactagcagtaaagtgtaattttattattataataatattataatgaatttaaatatgtgtaatttaaacaacactatggataataattctcttgaagtaacaggtgttaatttaaaaaataaaatagaagcaatcttgggatggccagtggacagtttttatcttactcttaatggaagaatcgtacaatcagatactattgtccaacgtgcctcaatagattctctaaggattattcccagaatatttggtggaaagggtggttttggttctatgcttagagcaataggagcacaaattgaaaaaactacaaacagggaagcatgcagagatttaagcggaagaagactaagagatatcaatgaagaacaaagattaaaaaattggataaatcaacaagctgaaagggaaaaggaagccaaggaaaggaagaagaagaagcttgaaaagatgtgtgaacaacctaaatatgaattcaatgattcagaatatgacaaagaaagatctgcccttccagaaatggttgaggatgctgtacttcaaggacttcaagctactagtagtactagtgataccagcatgaagcgcaaaggtgataaaaaagaagtgattaaaaagaaaaaagcaaaattatgggttgatgatgaattggatgaagaccttagttcagaatatgatagcagtggcaatgaatcatcaaatgagtcaaaaaatggtgaacttaatatagaaaagtcagctcaagcaacaagatcagacaattcattagaagatgttccaaactctttgaccccagataaagcatcagaacaaaaggaaaaggtccaagaagcatagaatttagcatagaactatttataaaataaaaatgtaaaaagaaatatcaaataaacaaataaatataaacaattttgggtacaggacaaaaaaaaaaaaaaggcggccgctct

SEQ ID NO: 1292 - DNA, 920 bp, Diabrotica virgifera
  misc_feature (830)..(830): n is a, c, g, or t
  misc_feature (901)..(901): n is a, c, g, or t
cgattttgtagaaaagtaaacaaaatgacactggcgtaccttgtggcatcaataccggttttgccattttatctactatttttactaatattcttcatcttcaaacaaatagtcttcgtgattctacgatacaaatacggctctcgtctagtagaactaaatcatgcagatacttattattgtgttggagaagtcgtagacaacagcatagttcttttcatgatcctaaattcagatctgacagaagaagacatggccaaaaaaaattgagaactgcgtcgatacgaagcttgtccagaatgcgaaacaaataaaaaatttgttcacgtcactcaacagtacgatgggttataattatcttctagctgaagaggctcttgctaagaatcatgtaagtatacttgacgtccagaaaagaggatggaccaccttacatgagttagcatatgagtacagtagtgagcctttaccgctgaacaagtacctgtgggagatggttgtggttaaagccactgaccaatggaaagttcaaaatggtttcaaaaagggacaagtgattgtttacatcagactacaccatgctatcagtgatggtctatcaggaatgaacctactctgcagtcttataggtaatagcgacacattcgacaattttctcaaaacaatgtccaagaatatcaaaaccaaaaatagcgtccttcaatttttgcaaaatctttacttctttttcattatacctggacttatggtggtcgagatctacaaaattaccaaagacaagactttatggcgtaacaaatcttgtaatggaaaaaatcgatttgctatanaagttgaagatggtgttgtcgaaaagtggctgctataagaagggaacttaagacctgcacattttctgaangtctgctgacagctacttc

SEQ ID NO: 1293 - DNA, 842 bp, Diabrotica virgifera
aatcaaaacaaataggtgcacttttgaaatatcttgtaaacctgcaagaaatgatgcgaaatgaaaccagaattttatccgataaggaccaagaagtgtctttcagttcttatgtgcaaatggatgatttattagacaagctaaaattgttaaactatgagtctgaatttttaagtggccttaaaattaaaccaatacacaaatactacttcatagtaaccaaaaatccaggggaacaattttatctgttttcgttattagctgcatggctgattaggaaaaatggaaaaccatttgaaaatcctcaggaatttgatgaccccaatgagactattgataggattataaatgaagtgaaacaaaatggcatgacagttgatttctctcccaataaactgaaacaaggtgttggtgaatatgtggtggcaatacttgactacttaacaaatatagcacttactaaaaacaacattatacttaaaagaccaaaaccacccgaagagaaagaggaggaagctgaagttttagatgacgaatctgaaataaatctagacagaatcgaggaggagatgatagctgcatattcagatgattctgatgaagaaaatatatttcgcttagacgaactaaaaccgacaaagaaagaaatacaagttacagaattaaagtcgaacgttgacgaagaaacttggaaattggaagtggaaagagttttaccgatgctaaaagtaactgtcaaaaatgacagcagagactggagatcgcacctagaacaaatgaaacaacaccaatctaccatcgataatacattcggtactgctaaaggtcaattagaaaaatta

SEQ ID NO: 1294 - DNA, 934 bp, Diabrotica virgifera
  misc_feature (867)..(867): n is a, c, g, or t
  misc_feature (895)..(895): n is a, c, g, or t
cacgtaaagtccggtcaacagaaaatgtcacgaaaataagatttttctcaattttaaaataaaagttaaaatttttctaccaaggaaaattctctgatataccgactatcataaataagcaaaacacaatccctactttacaatttttttaggttatgttaatgtcaagaacgtgattttcttttagaaatttatatttaacaatgtatggattacagagaatttcataccgaatctatattcgcaatgggtttcgacattattcccaacaacctgcaaagaggaattcctttatcggccggctctttgaaaatttcaaagatgagatggccaagaacaaagaaatgaaagaatccctgaaaaaatttcgagaagaagctcaaaaattagaacaaagtgatgcactaaaagcagctagacagaaatttgaaagtgtagaaaaagaagctagtaaaggtagcgaagtttttaaagaaagtttaggttctgttaaggaaaggcttaaaggagttatagatgaagctagtaagtcagatttagcaaagaaggctggcaaattcacagaagaagttggtaaaactacacataaaattagtgaaacagctcaagaaattagtaaaactggagcgtttcaaagtatatctcaagctactaaggctgttaaacaagaaatagacaatactagtatagaaggtagagtatatgttagtcctaaaatactaaggaagagaacagaaacaagtgcagttgtccaccaaaaatattatgaaccaaatacagatgctacaggtgttgaactacacaaagattctaagttttatgaatcttggcaaaatttcaaagataacaatccatatgtacataaangtatggactggaaatttaaatatgatgnaagtgaaaatcctgtcatccgtgcttccagagctctaac

SEQ ID NO: 1295 - DNA, 1860 bp, Diabrotica virgifera
acgcgtccgaccacacgtccgcccacgcgtccgcgtcggtcgaagtgaaaggttgtaggtgagagcacacttaaaaaaatcaatttggtagtaaattttaattttaataatagcattcgttgtatttttaaaatatttacgtgatacacatctaagtaatacggagaatctgtattttaccagactttttgagttttattgtagtcgtaataggtatcagcaaatatgcctagaggtagattcccatcgtctcctagaggaggctacaggggcagttccagaggttccagccgaggactttcgtcctggaatggctcctcgcggtcaggagggtatccctcgagcagatcctatccacccgcaatggaatcgaggaatccctacgagcccaagtattcgacttcagagagatatagagaagaatataagccttacagagctgaatatagcaccagtatcatggtacgtgaaagaagatcccctgaacgtaaacgtttgagggtggaagctcctagttccaggcatgaaagttactatggttcgagtagacatgaagcaccatatgaacgaagaccaagtgaacatcactcttcattatcaagaagggaagaattccgtaggccttctggacctccaccaaaacgcggttcttaccgtggaagaattagttcaaggggctcgtctagtataagagctaggcctagaactctagttcctagatcatatgctattggcaggagaattccacatatatctgaatatgcaaggaggcttaagatagctagaatcaggagggccattgcaagaagacatgccatagaagaagctgaagctgaaaatggagatgaggatataaaagcagaaattgaggctgaggaagcacaaatcactgaagaaagtaaggataatgaagagagaaaagaacaaagcaaggctttcatcaaacttcaatgcccccattgccatatgcgggctttgacctacaagaaatatgaattgcatttgggtagccgtacccattctcttgcaatgagaagagttgcttttaagcagaaagcgatcttaaatcagatgcgccgtgctcagaggaacactcaaaatgaattggaaaagggtgctgcggatctcgacagtgtaactacttactgtcccctgtgcaaactgaatttcaagcaaaagaaagctgtgcatcaattatctgagtcacatgtaaacatgaagaagttcttgatgcccacttgcaaagtttgtaccctggcctttaagagtcccatgtcttatgaaaaacatttgtgcacagtggatcatattaagcgtaaacaacgaggagggcgttgatgatactgatatagagaatttcaccaccattgattcagtgggagatgaggaaaatgcagaaggtggtgaaagtgtgggcttggagaaaatccgtaaaatcgaagcctactattgtgacttgtgtaagatgtatcttcaaagagcagaagaatctgaaatggctcctattttggctcgtcattgcaaacaacgtgtgcatgttcaacgttacaaggtagtcaccacgcggcggaggagttaaagtcgtgccaaaaaccgaagaccaaactaaagaaaagggataagttgtggggctgaggtttgataaagacctaggcgatattttagcagaggctcaaggaaaccagagtgagagtgaagatgaagattctcgtattaacggtgagagatatgataggtttaaactaagcgagaaaggggatgaagatggagtagagaataagttgattatcaatgacgtagaaactaaataaatattaattatatttgggtccaatggtgtttcagtagatttagtgtact

SEQ ID NO: 1296 - DNA, 950 bp, Diabrotica virgifera
taaaacaataatcaggcccatagtaagttatggctgcgaaacatgggtggtgacacagaaatctgccaatgcattagatgtgtttgaaagaaaagtattacgtaggatactgggccaaataggggaaaataacaactggcgaattaggtataattgagaaatatacgagcaatatagcgaaccaactctagcacaacacactaaactgcagagattacggtgggcagggcacgtggtccgcatacatgagaatagaatccccagaaaagtgctgaatgcaagaatgcagggaagaagaccggttggaagacctaaaaagagatgggaagacgaagtcgatgaggatgccaggaacttcctgggaacgcgttcatggaaaagaacagcggtaaatcgaaatgattggagaagcttattgaaggaggccaaggctcgatttgggctgtagtgccattgaatggatggaaatggaataatttaaccttctgaattgcttcagctaatttgttatattccttcccattcactgtgttacaattcacttttccttattctttatcgcagaacgaattatggtctgaccataattagttcaaatacatgtatggtatgctctgaccgctatgcgtgcaagtcagttacctcatgagatataatttgtttaacttataatgtaccaatagctttaggtagtatttaaagcactgaaatgcaaaatgatgcattgtataaataagtttgtacctattcatttatattttatttttattactaattttatctattttatatttctttaatgctgcattcttatataattttgatagtgggtttgtcttgtttgttagtaataaataaatatcagttaattaatatattaatgtaatatgtaataaaagttcatttaaaaatttattttatattccccaaaatacattcttaatagaagt

SEQ ID NO: 1297 - DNA, 1218 bp, Diabrotica virgifera
actcgttctcgatcgcgagcggccgcccgcgacctagaagtacgaatcgtatagtagtgaggagggtggacagaatagattacccgcgaaaaatcattccagcaagtgcacaaaattaaaccaaattttattcattacctgtgatatataaactactttaaataactaaaatgggtgtaccagccggagatgtagaaaaaggcaaaaaaatctttaagcaaaggtgcgaacaatgccatactgtagaatcgggcggtaaacataaagtaggccctaacttacatggattgtttggaaggaagacaggacaagcacccggattcgcctacacagatgccaacaaagccaaaggtatcacatggggcgaagacaccttatttgaataccttgaaaaccccaagaaatacatccctggcacaaaaatggtgtttgctggtttgaagaagcccaacgaacgaggggatcttattgcctaccttaaatcggcaactaagtaaattattctggagcaccatcataactttgtttttggatgaattagaagatgctccttaatctttcctatattttttgtttgaagacatgtcgttttacaatatacagttttgaacattacaaatggtataggaaagataatttcttactaccagctagttttcagttacttctggaataatattggcagtttttatctgccaactttaattatatactgcaagatattaaatacaattatgtacatagcaaattgtaagaatcttctgtttgttatgttagatattgtcttttctatctatcactataattcatacaaagacaattaactcgtgtgtattagtagtattttcatctattacatatgttattgtatcatgacagatgaagtactgtgtacaaaataggcaatttttaaattattttaatcatatttaaattatttcataccattgtattaagtataccaaaaactgtacagtacgactgaaacattcagtatcttgttatttttttgtccttgttcattaaactatttatgaatctaaaaaaaaaaaaaaaagcggcgggtctttttccaaataccctctaacaatttaggaaacccggggtataaaagattaaaaaaaagaaacaattttatttggggtccccccaaaaatttaaaatttccccttgtgggcccggcggtttttttaaaaaaagcgccgggggaaggtgggg

SEQ ID NO: 1298 - DNA, 1002 bp, Diabrotica virgifera
aaatattgcattgtaggattacaagtgtaatttttctaagcttgtattcttttcattaaacttgtaaaaaatgcctcttatgactgagtatggtgcaatgactggtcctaatgattggagagatgccgctcacagtacaggaacctctattatggccgcggagtttgatggaggcgttgttataggagcagattctcgcacaactactggggcttacattgcaaaccgggtagcagacaaactcaccaaagtcactgaccatatatactgttgtcgttcaggatctgcagcagatacacaagcaattgcagacattgttgcttatcatcttaattttcatggtatggaacttggtgaagaacccaaagtacaagtaggtgcagccattttccaagaactttgctacaattatagagattcgctaatggctggtatactggtagcaggttgggataaaaagaaaggcggacaagtatattccataccaattggtgggatgtgtgttagacaagaagtgtcaattggaggatcaggttccagtaatgtttatggttacgtagatgccaacttcaagcccaatatgagcaaggaagaatgtgtgaagtttgtcacaaatacattggcacttgccatgtcaagagatggttcttcaggaggtgtagtcagacggggatcatcactgaagctggtattgaacgaagagttgttttaggaaatgaattgcccaaattttatgaaggttaattgattatttttttagctttggtatgttttggtatatattataaaaaaatcagtttcacaggaagattcctttcaacatggattcaccgttcatccagatgtatttcggtaaagacgagagccgcgtagtatcctacaacgaattttcgcagtttcttcacgacttccatgaagagtacgcaatcgaaggttttagaagggcagatacaaatggcagcgggtttatttccctctcggccttccaagaaatgatgacca

SEQ ID NO: 1299 - DNA, 1273 bp, Diabrotica virgifera
caagttgcaccgcagtcttctcgtgtgattgataacatgaaaaacaagtagattaatcttactgagtgtttgagtgcccaagcaaaatgtcggtcaaggttttcaagaatattttgaataataaaaaaaatattttgagcgcgaccaaatatgttagtgtttatactaggaagctgggtacatctgacggacagtctaaaattttgacctgtggaactacagtggacattccaaatgtttctatcccagaatttgtttatcccagtttggacaagtttcataaatatactgcaatggtgtgtgctacaacaggaagaagttatacctttggtgaagttaaaaagaaaagtaaaactttaagtagagcgcttagacatattttcaaattaaaaaaaggagatgtggtagcgatcttctcgccaaacaaagcagagtatgcgattgcaatatttggcatactcgacgctggattaactgtaacgactctgaatcccatatacactccagcggaagtagcacgacagcttcaagattcatctgcgaaagtaataataactcaaacaccatctatacctacagtaaaagccagcttagatcttttgaaaacaactattccaattgtagcaattaaatcaacgcaaaacgagagccttccttcaggaatcatcgactttgatgagcttttgaacaccaatctagatgtacctgacgtagatgtattacccagcgatttagctatcttgccctactccagtggtactactggtttaccgaaagtagaattaactcactcaaatattgtatctaatttatgccagatgcacgacgattcattaagaggcaccaacagatgacaggtacagctggcattcttccattctttatatatgtctacaatgacatccttacgaaagatgtgaaatgataaccatcgaatgaattatatatattaattggctactagaatattaatattacaaaatctaagtgttgatgaaagataccgctttagaccagtaaaacatgaaactttctatcaaggatgatgacaaggcacgatcaccaatggtatgaataataaatacatttatgctgaatttaaggacaatgtatgtagagattggaaaacacgaagtagatttaatgactaaagcatggatcatagttatctaaatgctcaaagaaagtttgatgtacaaaaaattgtgtacttatagacatgaaaatccaaatttgtggccggatgatcaaaggaacatgaatagtagatgac

SEQ ID NO: 1300 - DNA, 1511 bp, Diabrotica virgifera
gccgaagaagaaggaactaaacaatggcggacgcagctccagccggtggacgtggtggattccgaggaggttttggaggtggtggccgtggaggcggtagaggtggtcccagaggccgaggtagaggtcgtggcagaggacgtgttcttgcaaaggaagatccggacgcgtgggtatcatcggttcgtcattcattgtccttttttggataaaaaattccagtaagtatccgcataacaccaaatggctcaattttcatccagttatgcttattaaaaatccaaaaccggctgtaagaaagtggctaaaacgaggggctgtggcgttattcgttatagaaggagcaagttttgttggaagctattttctttggtatagagtcaacacagatagagatacaagaaagtatttataccagaattatccatcagttttggaagcatactataaaattggagaaacatttgattcccaaaatcaaataagacaaattgatttggcttactggaataaggaatcttaatggcatctagacttgttagatcattattctggttagttgcttgtggaggtgtcagttatggtcttttaattttgactacaccaacagaagaagacatcagaaaaagaaaagaggaattacttactgttaaagaaaaccgggaacatttaaccaaaaaccaacagtttatggatgttataatctcagcatccgaaaataagaagcctatttatcgtttaaccaaggaagaactcgagagagaatttggaaagaagtaaaccctagtaacccactgtatcctatatccaacatgaattctactataactttcgaaaacacaaatgaaaaagctaacaaactaaatcttttaaccaagagagaagtggagcggcaactgaatctgcaaaaacgtaaagacaacaaggattctcttgtagcaggtaacgaaaaattggagtttttcgaaactctattcgcagaaaaacgatcatacatagaaaacatgatagatctgtctaaaagtgtcccagtgaatgaactccctgatcatttcaatgaaattttaaaagaaatagtaactttacaaaaatatgtagcagcttcgagtatttttattaggaattatgatatgcaaaaatgtcagaatattttacaggaattaacagtaagaacgaaacaagtagaagacgaattgctacccaaaaagaaattttcctttaaaaataaagttaaacaaaaggcacagaacagcgaaataaaaagtaaaagtatagacgatgtcgattttaaaccaaaaattgagccagttaaaaacgttaccggtttttttaaaaaaagggaataaaaatccctctttttaaaaaattttgaacctgcttaaaaaggatggttttttaaaaaaaaaaaaaaaaaaaatctttggggcacggggggcccccccccccttacccctttaaaatttctataaaaaaattagatgggataatattcttccccgccgccccccccc

SEQ ID NO: 1301 - DNA, 1286 bp, Diabrotica virgifera
tataggggaaaggtggcacgcccgccggacgcgtgggcgggccggtgggcccgaccccagccgaagaagaaggaactaaacaatggcggacgcagctccagccggtggacgtggtggattccgaggaggttttggaggtggtggccgtggaggcggtagaggtggtcccagaggccgaggtagaggtcgtggcagaggacgtggtcgtggaaaggaagatcaaaaagaatgggtaccagtaaccaagctaggacgtttagtcaaggatggaaagatccgttctcttgaagaaatctacctgttctctttgccaatcaaagaattcgaaatcatcgatcatttcattggatcagacttgaatgatgaggtattgaaaatcatgcctgtccagaagcaaactcgtgctggtcaacgtacacgtttcaaggcgtttgttgccattggagatagcaaaggacacattggattaggtgtaaaatgcagcaaggaagtagcaactgccatcagaggtgctattattttagccaaactgtctgtcgttccagtacgaagaggatactggggtaacaagattggtcaaccccacactgtaccttgcaaggttactggaaaatgtggttctgttactgtgcgtttgatcccagctccccgtggtaccggaatcgtttctgcccctgttcctaagaaacttctgcagatggctggtattgaagattgctacacatccgctagaggttccactggtactttaggtaactttgccaaagctacatacgcagccatcgcaaagacctatgcttacttgacacctgatttgtggaaggatatggctttggctaagacaccataccaagagtttgctgactacttggctaagaatcaccgtcctgtcactggcccagctcgtgcggaaactgcttaagttcacgtgttttgtgatcttttgtatgtaaaataaataataacagctttaaaaaaaaaaaaaaaaggcggcactcgcgaaaaaaaaaaaaaaaaaaaaactcttgatttaaagatcccactttttcccccccggcgtgggggccctttttctttttttttttggggccccttaattttatttcctgggcccgcgtttttaaggcgggggggggggggaaaaacccttggggttctccccctttttttttcctgagcccttcccccccttcccccccgggaaaaaaaaaaaaaaagggggccgctcgcgatctagaaccagttcccccccctttccccccccccatttttttcccccccccccc

SEQ ID NO: 1302 - DNA, 863 bp, Diabrotica virgifera
gagaggtagtacctttgtatcggtttgactgaacactggtcctcacaagctcacagggctagatgaagcgaatatagctcttccaagtggagccttagcctctctctagtgaagaccgtaatgcgtggtgaagagccacatcctacacgaggtgcccctgttaacgcagaacattacggatctagaccggaaggtcgataaatattcctgaaaatggtaagcagcatttccagtaccatgttggggcgtatggaaatttatccaggaccggcctaatattggatagtaggaggcaagactgcagcagtttgattggattctatactgcgactcaccaacccgttcggcaagcgtggtgtcttatgttgccaacatcccttcaaataaatcgaaatgtcagattttaaaacaaagacggaaagaccccaggtgagtaggataaatccagagtctcacactgatttatcagtctgtcccaaggattctggggggggggacaaaaaactgacgaaacgagaaatacgaaaacccttttcattctacgttgccacctataatgccagaactctattgtcagaagaaaaattcttcgaaatggaagatgcaatcaaagaaattaaatgggacgtaataagagtctgcgaaatacgacaccgtggtgaaaacttaaagacgctgaaatcaggacacctcttctatagcattggctccgaaaccaaatcagttggagggggtcggtttcttcatccataaaaaacataagaaaaacgtagtttatatgataaaagtgtgtctacaagagttgcctatgtaaccctaaagctcacaacaggtataaactgaaaattatccaggtatacgct

SEQ ID NO: 1303 - DNA, 983 bp, Diabrotica virgifera
  misc_feature (19)..(19): n is a, c, g, or t
  misc_feature (33)..(33): n is a, c, g, or t
tttattttaaataattatntacttattttcttnaatatttcattaactataattttttctatttgttttaccagttttcttcgttaaaaactcgttggcgccctcttttattatcttctatttttttatttaaatcatcaactgaacatactgaacgtaccccgtatattcttactctctagagatatctgtcttaatacggaacatgcctgccacttcctacgtctattgtgattgggaggcattgatgcggcttgattccagccaaagctgtgtataaagacagtttgccgacggggattcccataccacaggctccttggtctcctaaacctaagatacgttcaccgtcggtgactactattgcacggacatctgtttcaggccaatttttcataatttcatatacgtttcctttgtcgtatattgtaacgtacatgccccggggtcttctgtaaaccaatccaaagttttgacaagctaatcctacgactggtgtatatactaagggcataatatctgttacgtatttcctgacgaaactgtagaataatttttcattgcggtccaaaagacctatcaggtacatatatttgtttaaattatcgtctaatctgtccaaacattttttacaatgttcgatttgttgttcctgtgattttactacgggaggtaacaacccatggattccaagctgttgtctctcttcgaaggtgaatgccagacccttatttaaagcgggggttgtcaacctctccagaccggatactcctccaggaacgaggtgctctccatttccccaatttccaacccgatctctttccatggttaggtttgatttgtttattgggagtggactagtactgcaacaaaaagaagaccgtactgattccttttaatgcacggtctgtaatactgcaaaaattattacgaaccgaaaatcttgcggagtatctgtcgtataaacacctcttacataaact

SEQ ID NO: 1304 - DNA, 1394 bp, Diabrotica virgifera
atttttgtgaaaaaacgaaattttgttttggtgtcgtgtgaaaatattattttaagaagtttccacagactgccacagcccgaattccaaagatttgatcccatcagatcaaagaattccaacatcgttaaagaggctctagacaatactgataacgcatataatagccgttcccagaaaagtggcggccgagtatgtatctctctcatacaattaaacaaacaagaagcgtatgtatccgtgagtaatttttttgcaacgtttagacggccaattcaaaatatgttgtgcgatgttgcatatacaatgagcagtcaaggcattgtaagataaaaatgcatgggtccattgaagaaggcatattccacgcgattgaccggcagccgggaggtccactgttttttgtttggagaagatggccaatttggttggaagtaaaaatttttttggaaggccccctcggggggtctcccaagaatagagttattggtttttttttttttttttcaaaccttaggttcaaatttggtgttggggatggggaggcaattgatggggcttgacccaaatataaaaggggatttccaagtccttggtcttaaaagatacgttcaccgtcggtgactactattgcacggacatctgtttcaggccaatttttcataatttcatatacgtttcctttgtcgtatattgtaacgtacatgccccggggtcttctgtaaaccaatccaaagttttgacaagctaatcctacgactggtgtatatactaagggcataatatctgttacgtatttcctgacgaaactgtagaataatttttcattgcggtccaaaagacctatcaggtacatgtatttgtttaaattatcgtctaatctgtccaaacattttttacaatgttcgatttgttgttcctgtgattttactacgggaggtaacaacccatggattccaagctgttgtctctcttcgaaggtgaatgccaaacccttatttaaagcaggggttgtcaacctctccagaccggatactcctccaggaacgaggtgctctccatttccccaatttccaacccgatctctttccatggttagatttgatttgtttattgggagtggactagtaaaagtctcagttttggtgtttggtgatgttttgatgttttgttcagtctgatcgtccttgttaaaccaactccacgagctcagcatgacttaagaaggtaattgtatcagtataagaagaaaaataggtgggacaacccggattccaatggaaaataagcgccttttagtgtatgatctgtaacactgcaaaaattatcacgaaccgaaaatcttgcggagtatctgtcgtataaacacctcttacataaaccaccgaaaaaag

SEQ ID NO: 1305 - DNA, 1431 bp, Diabrotica virgifera
cccggggggtcccgtttccactaattccctcccccttttccccttgccccggtgggcccaaaaagaaagggattcccccaaattcgctttttccccggccccctttgaaaatttatatcccacatgattgggaaaattgtttgtttttgtgtattttttaaaaaaagccaaatagacccagagctacggctaccctagcggtaccctgaatgtcgtcgtggaaagtacaatattcatttctgtacttttccaacaatctgaatgcgtttgagttaccaaagtcttcgaattggatcaaagtgttctgaccccatcggcgtactacggcttccatgaattcatcgaggagttcatcgtactcttgtcctgtgactctcttttgtctcaaacctatatacaaaggatctttcagatgagtctcgttgttggttcctacgtctattgtgattgggaggcattgatggggcttgattccagccaaagctgtgtataaagacagtttgccgacggggattcccataccacaggctccttggtctcctaaacctaagatacgttcaccgtcggtgactactattgcacggacatctgtttcaggccaatttttcataatttcatatacgtttcctttgtcgtaaattgtaacgtacatgccccggggtcttctgtaaaccaatccaaagttttgacaagctaatcctacgactggtgtatatactaagggcataatatctgttacgtatttcctgacgaaactgtagaataatttttcattgcggtccaaaagacctatcaggtacatgtatttgtttaaattatcgtctaatctgtccaaacattttttacaatgttcgatttgttgttcctgtgattttactacgggaggtaacaacccatggattccaagctgttgtctctcttcgaaggtgaatgccagacccttatttaaagcgggggttgtcaacctctccagaccggatactcctccaggaacgaggtgctctccatttccccaatttccaacccgatctctttccatggttagatttgatttgtttattgggagtggactagtactgcaacaaaaagaagaccgtactgatttatcacgcgtccggatcacatgatcggaaagtctagtatttgtaatcctcaatgaagccaatcgaccagttacgggtacactagcggtaccttgaatgtcgtcgttgaaagtacaatattcatttctgtacttctccaacaatctgaatgcgtttgagttaccaaagtgttcgaattggatcaaagtgttctgaccccatcggcgtagtacggcttccatgaattcatcgaggagttcatcatactcttgtcctgtgactctcttttcggacgcgtgggcggacgcgtgggcggacgcgtgggcggacgcgtgggcggacgcgtggg

SEQ ID NO: 1306 - DNA, 1269 bp, Diabrotica virgifera
  misc_feature (672)..(672): n is a, c, g, or t
  misc_feature (676)..(680): n is a, c, g, or t
  misc_feature (696)..(696): n is a, c, g, or t
  misc_feature (698)..(698): n is a, c, g, or t
  misc_feature (706)..(707): n is a, c, g, or t
  misc_feature (715)..(715): n is a, c, g, or t
  misc_feature (732)..(732): n is a, c, g, or t
  misc_feature (776)..(776): n is a, c, g, or t
ctctaaataaaaaaaaaaaaaaaaaaaaaaaaaaaaatttaatttttctctcccccccccccccccccccccccaccaaaaaaaaaaaaaaaaaaaaacgtcctttttttttgttgttttttatttttttttttttttttaataaaaaaaaaaccccccccccccccccccccccccccgggggagaaaaaaaattatttttttttttttttttttctcccggcggaggaaaaaaataaaaaaaaaaaaaatgtggcccccccccccccccccccacaaaaaaaaaaaaaagaaaattttttttttttttttttttttttaaaaaaaaaaaaaaaaaaaaaaaagaagggggttgttgtttttttttttggggggggggggggggggggggggcccccccacaaaaaaaaaaaaaaaaaaaggggggggggggttctcccccccccccccgttgtttttttaaaaaaaaaaaaaaacccccccgggggggttttttttcccgccccgcctcttttccccccaaatatttataaaaaaaaaaaaattcctcttttttaaaaaaaaaaaaaaaaccacccccgggggtttttttttaaccacaaaaaattttaaaaaaatctcccccgggggtgttttttaagggaaaaaaattttttgtgtgtttcggaaaanggannnnnccttttacaacggggnanacgacacnnaaaaaacncatagtaggtaatttgntcctttggtaactcgaaaagtagtcaccaacaaacaacaagtgncgagtatacttaaacgttatacttattacaatgttcgatttgttgttcctgtgattttactacgggaggtaacaacccatggatcccaagctgttgtctctcttcgaaggtgaatgccagacccttatttaaagcgggggttgtcaacctctccagaccggatactcttccaggaacgaggtgctctccatttccccaatttccaacccgatctctttccatggttagatttgatttgtttattgggagtggactagtatttgtaagggttgttaatgtaaaatattgttaagctcttcttttaaaacactgtaataagtacacagttttcttataaataccatacagtaatttcgttgttctgtacgaattaatatacaacactcatcgtcttgttcacaataacattgttttgcaaaagaaattatttcctttttagttggaataaattatagaaatgttactacgactctttatagggtgttgtgacgaa

SEQ ID NO: 1307 - DNA, 1523 bp, Diabrotica virgifera
cccctctttttccccttggggggggggggtgggttttcccccccccttccagggggtttttttcccctttaatattatttataaaacttttttgaaggtttttcccccacccccatattttttttttttccggggggcccccccttcccattaagtaccctttcctttttccccctttgccccgggggccccaaattgaggggaataccccaaattctgctttttccctgttcccttgggaatactattccccagattcggaaaagtttaggtttttgtgatccttcaaagaaaccaaatagaccaggttcgggttccattagcgggtccctgaaagttggtcgttgaaaagtacaattttcatttctgtacttctccaccaatttgaatgcgtttgagttaccaaagtctttgaaattggatcaaagtgttctgaccccatcggcgtactccggttcccatgatttcatcgaggagttcatcgtactcttgtcctgtgactctcttttgtctcaaacctatatacaaaggatctttcagatgagtctcgttgttggttcctacgtctattgtgattgggaggcattgatgcggcttgattccagccaaagctgtgtataaagacagtttgccgacggggattcccataccacaggctccttggtctcctaaacctaagatacgttcaccgtcggtgactactattgcacggacatctgtttcaggccaatttttcataatttcatatacgtttcctttgtcgtatattgtaacgtacatgccccggggtcttctgtaaaccaatccaaagttttgacaagcttctcgaaagtgacttgtgtttctgaatttatttcagaaatctgaaatcatctgattattccgtgaagggaataataaattgaggaaataattattttcctcgatattcgtcgcgcctaaaaatttagttagtccaagaaataaccatgccacgtgaattgacagaaattaaggaattcctcctcaccgcaagaaggaaggacgccaaatctgttaagataaagaagaacacagaaaacaccaaattcaaagtacgttgctccaggtttctgtatactttggtgattacagataaggagaaggcagaaaaactaaaacaatcacttcctccaggtctccaagttaaggaagttaagtaaatgactataatgtagaaataaaaattttttgttaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaaaaagggggggccctttaaaggatccaagtttaagaacggggggtggggagggaaaatttttttaaaggggccccaaactcaacaaaggtgctaatcgcagatgctggatacaaagggaatgattgaaaatggtaaggatgttgctgcaatctgaattccacaaaggaaggcaaatacgaggtacacttcaaagtgactcaactccgaccaaag

SEQ ID NO: 1308 - DNA, 970 bp, Diabrotica virgifera
  misc_feature (895)..(895): n is a, c, g, or t
aaaaacccggtaaaccaatgggaaaacgccctcggaagtggtgaaaaacaactaatagtgccaaagaatattttttttgtatacctcgaaggctcaaaacgtaatcaaaacctttgtataaaaaagttataagcataaatacttcttctttacaagtatttaagaatattgtctttttttaaaattgtttacaatttagaaaatttcaaaaaattgtcacgtggtctatcaaaaaagtcataatttaaatgtcaatgtcaaaaaataacctttcaaaaaaaaactttagtgtttgatgcagtttgatgttatttttggggttattaaaaggattttataaattgatctattaataaaccatgagtactcaaaaaggaaatactggccgtactcgaccccagaaacacaaaaatcgttcagctttcaaaaataatctccatgataccaaccacagaaccaagatgatcaactctattcaagttagtgatgtatgtgctcgatgtaaagatattatagaatggaaaataaagtataaaaaatacaagcctctgacgcagcccaaaacttgcaataagtgtggattaaaaacagttaagaaggcataccatgtcatgtgctcagattgcgggaagaaattgggagtatgcacaaagtgttgtgagaaaagggaagtttttgtggctgaaccaactgagaaacaacaggtgcaattggacaacgaacttaaagctctgttacagtcattgcccgaaagaaaaagaagaacattcatcaggtatatgaataaaaaagataaagataaagaagaacacagaaaacaccaaattcaaagtacgttgctccaggtttctgtatactttggtgattacagataaggagaaggcagaaaaactanaacaatcacttcctccaggtctccagttaaggaaagtaagtaatgactataatgtagaataaaaatttttttgta

SEQ ID NO: 1309 - DNA, 800 bp, Diabrotica virgifera
cccccacaccatcttgattattgaggataattagtgaattaaggagatcaacatggcgtccactttgtttgctcttactgcaagagcaatcagaaatgttccaaaaactactggacaagctgctgctatgagcagttatgcccgcactttaattggcaaaagggaaatagtaggttttggatacaatggagaacctaattatgcagatagggcagatttcccaatgccagccattaggtggagagaaccctcagccgacacaaacgctttgagagaaaaggagaaaggtgattggaaaaatttaagtatggaagaaaagaaagctttatacagagcttcgttctgccaaacttttgctgaatttaaagccccaacaggagaatggaaatcagtcgttggattgggtttagtattagtatctggagctttttggatcttctatttctttaaaggatttgtgtacagccctctacctattactttcgacaaggagcacagagaagcccaattgagacgtatgattgatcttcaagtaaatcctgtgcaaggtcttgcttctaaatgggactacgaaaaggatgactggaagaagtagacataatttcaaggtttatatatacattacatgtaaaaggattgctagtgtttgacagccactagctatcctttctttttaataaatattagtaatataatcatctagaaccttatttatacctttccgtgatataatgatacaatgtttagtgttgatgttgatatagattgctaagtatgaataaagatttttttcttttcaa

SEQ ID NO: 1310 - DNA, 1355 bp, Diabrotica virgifera
  misc_feature (879)..(879): n is a, c, g, or t
attggataaaagtcagacgatagatataaaataatatatgtaggtatatgtacctaccaaataatattgttaattattataaaatttcatcaagatgaagctattagcagtgtatcttatttgtttaaaattggtgttcagcttggaattggattcccaatgtgacaaccgggggacgcttgtttatgaagatatgcactgcaagcctataacgaaggaaggccacaaatgccctgtagaatttaagtgtgatttggaagccaaaggcaatacttgcagatttagaaacagagatattccttttggttcttatctatctgacaacgatacgtacagcgcttgtagtgtagggtgtagttgtcaagaagataactctttcgaatgtgctgaattggattgccctgaatacgaaaacccgagccccaccagcaatgactgctatttaaagtataaacttggagaatgttgctctgtaggcagaatatgtgccagaaaagaccatcctgtcgaatgcaaaaccgatggagcgatccacatggaaggcgaggaattctacccacaaggcacttgtctaagttgtgtatgcggaaaaggtttcgctggaaaatatactccggagttttgccagagaaggtcctgtttagtgcaggttcataacagagataaaatcaaagataactgcgcccccttttatttatacgataatgacaacaccgctttgttgtccccattccatggggtttgtccaagtacaaatataacaagggtagctgctaatccaaaagcggagaaagatacaggtttgacttgcaaatttggaacggacacgtataaactaggcgaaagaatggaaactgtctttaagagtttcgataatanagatagaagagtcccatgcgaatgtaagttgccacctttcctcacttgcagacaaaaaataatctatctatgaagaaatcaatttggatctgaagatatgtaacatgaaaatattaccagtttttaatgaacccaagaaattttgttggaaaataacaatggttaatggaaataaaaaaaaaattaaaacatctttttaaaaaaaaaaaaaagggggggccccttcttaagggattcaaggctttactacgccggggatggcgaacgccataactctctttttaaggggccacccaaaattttcatttccctgggcccgccctttttaaacacccccggggacggggaaaaaaccctcggggggttcccccaccttttaatccccctttggcaacccccctccccccttttttccccccacggtggggggtaaaaaaaagaaaaaaagggggcccccccccccccccaaactcccc

SEQ ID NO: 1311 - DNA, 1018 bp, Diabrotica virgifera
gttcatttattttattctaaaataattttaaataaaatagaaaatagtactaactctaaactaaaatgaattcgttaaccagaacgttatataaattaaatccagttcttgacaatttacatatttctccaataataagtagtgtccgatataaagcaaaaatagtacccttgcctgcaattggtggtggaagtggaaattgttttcgcagaatagtacattatcctgaagaatacacggtaaaacctttagatgtaaccaatttgggaggtcgagatcctaaaacaggaaggatggttgtaaagggaatcggaggtggaataaaacacaagtaccattggatagattggaagaggattggaccaaatgaagaaggaaaagtacagactgaaaaggttattaaaattattaaagatggatgtcgcactgcaaatgttgctttagttgcatatggagataaattgaaatacattttggccactgttaatatgaaacctggagatattattaaaacttcttgctatattccacgcatccctgtgagagctaatgaaggagatgcttatccattaggggcaataccaataggcactcaaatacacaatgttgagatgtatcctggaaaaggaggaatgttggttcatgctgcaggaacatatgcaacagtcttacgaaaagctccaaataattttgttattatcatgatgccctcaaagaaggagtttagtttaccagcacagtgcatgtgtactgttggaaggctgagtaatgtagagcatggcagtactcccattggctctgctggaaaaaatagagaattgggcataggccaagatctggtttgtggcaaagaaagaggggctgtcatggtagaaaaattagaaggcctccccagtaagaacaattgttggtaaaccaataaaaaaggttgaaccaatccaactttacctttactaaaccatttgtaaaaactctttaaatcccaatatcattaattaagaattaaatggggggatat

SEQ ID NO: 1312 - DNA, 1430 bp, Diabrotica virgifera
gtattaacatcaagcgataggtaccaccaaatttctcgtagtttactagatttttagcaaaaataatttagaaaagtgatctggttatgctaatcaagaactgagaaggaacaatggtttcaagacttgtgttagcgttggttggacttatttcaaccgtgaatggtttggataatggacttgcccgtacgccaccaatgggctggatggattggcaaagatttaggtgtctgacaaattgtacactatatcctgatgaatgtataagtgaaaaattgttccgagacatggccgatcgtatggcagcggatgggtatcttgctgctggctatgaatacattatgatcgacgattgttggtcttctaaagagagagatagtaaaggaagattggttcctgatcctgatagattcccaagtggcattaaaaacttatcagattatatacacagcaaaggtcttaaatttggaatttacgctgattatggaaccttaacatgtgctggttatcccggtagtaaagagtatcttaaaattgatgctgatagatttgcagaatgggaagtagattacttaaagtttgatgggtgcaattcagattggatatttatcgacaaaggttacattgaaatgggtaaacatttaaacgcaacaggtcgtcctattgtttactcatgtagttggcctgcttatcaggaaccaaataaaatgcaatctaactacacagctttggctgaaacttgtaacctttggagaaattgggacgacattgatgatagctgggaaagtgtcacatctatcatagagtggttttccgacaatcaagatcgaattggaccattttcagcacctggtcactggaatgatcccgatatgcttgtgattggaaattttggattgagttttgaacagagcaaaggacagatgtcagtttggtcggtaatggcggcaccgttgataatgtcagtggatttaagaactattgagcctaaatttagagcaattctcctcaacaaagatgctattgctgtgaatcaagatcccttaggtgaaatgggtcggctagtgctaaagaaaaacaatatttatatatggacgaagaagctaacacctaaagctgatggcagacaacctcacgccattgccgtactaagccaaagaaccgatgggtacaaatatagaatggaatttactttaaaggatttgaatattaccgatccaaacggattcttgataaaggatatttttgatgaagataaatctgtggcatccatagcagatgatgaaccgttcgtcctaagaatggcacctacaggaggcactttgttggttgcaactcccaaaaaataaacgaaaaaggatttagtcagtgaccaaaatattaaatactttttagatattttataaataaataaataaattattttaata

SEQ ID NO: 1313 - DNA, 1131 bp, Diabrotica virgifera
gaagatagattaactaatataacaccaccagcagagagtaaagtgataccaggaaaaattgtcaactcgccatacactcctctgaaacctgtaaaaatcattaataacaatttacaacataatagccatatacaacagcctacagctccaccaagagtgaaaccgactattacaggacagagacaagtttctgaaactgatctatatttattaggagccatagaaaagttggtttataaggtcgattttatggagaagaggttgagacgagttgaggaaatgctttattatagtatggctggtaataggatagatacagagccgccttgccggacaaactatacaaaagttggacacgattgttatcatttcaatagtgcaacaggcagagaacttgattggaaagcagctagtaaatattgtaagaagatcggtggatttctagctgaaatggagagtattgaagataatcaagacttggttacctttattcaagcaacacaacatttaagaggcagagacttttgggttggtggtctgaatccaggtcttctctggatatggagcaacagtgcacgacctgtggcagcacctggatctcataccaacaaagacaatccttcgtcggctattcaaggagaaggccgctgtttgaggctagcctacaacacagcacttcgttcatacagttacaaagggacagattgctcgatcaggtacaacttcatttgtgaattgcccgaaaacacctccagtaacgaaatcaagagattgggaagaagtaggaatattttgagcgaggaactgagcaagaattaaaagaaacatggggattaaagactgaagaacatgagatatctgcatatatagctcgtccgctataacttttctcatgcgtcacgattcattttccaacaaattaagtcaaaacaattagcaaagagacagtttgtgcggccgaggtattttgaccgtgcttgggtatcataattattaggtttgttatggtaatctggaatgatgggttggatgaaaaaaaaacttgtctttatttattttataaagaatgttattttaaaggaaaaaagcttaaatttttttagaatataagaagaccccatagagttttat

SEQ ID NO: 1314 - DNA, 981 bp, Diabrotica virgifera
cccctaacgtccggaaaaaaatgacataaacgccaaatgttttaataaaaaatcatatctttttgttaacgtccatgttagaaaaggccgttttaggtgctaactgcacccctcctgccatcgatgaattccctcaggatctcttcacaagaacacagctacaaaatggagctgtcattgttcatatcctagttaccgtgtacctgtttgcggctattgctattatctgtgatggatactttgttcctgctgtcgaaaaaatatgtcacattttaaaaattccaccggatataggaggtgcaactttcatggcaacagcaaccgcttctccagagctctttgtaaatattgtcggtacttttgttaccgaaggcgatattggacttggtactatattaggttcgacagtatttaatattttgggagtcactgcatgctgtggactaactttggcatttacaggaagcaaatcacagttggaatggtggtctcttacgagagactctgtaatatatggtatttctgtatgtctgctggtatggtttttaaacaacgagcagatagaatggtacgaagcactcacattagtacttgtgtacgtgttgtatataatttttctcatatttgatcaacaaattcaaaaatatgtcaaaggaaaatggtgctcaaattcacttagcgacgactcattgcaatcaaaatcggtagaaagtctggccaccagtcaagaaacaatttcaaaaatttccaataaaatttcgaatattgacagtatagaaaatgttaaagaatctacatctgttgaaatggaacaatattattgatgaagatgatgatgatgatgatgtttccttatttagttggcctagtcacatcagtacaataaaaaagattgcctggataataaattgggcaataaattgcgcattctttttcacagtttcccaattgtgagaagctaaaatcaaataaatgggattc

SEQ ID NO: 1315 - DNA, 1457 bp, Diabrotica virgifera
gtcctgtgcgtccggtactttcagttgtttaagtgtcatggcgtacttcgcaacgacgattttcttggttgcgttggtagcctcaagcggtttggcacaacagcaggccaaagacgatgaaccgaagaaagaggagagtttcgaggccgaaatatgcaaagacaaagacgcgggcgagtggtttcgtttagtgggaggggagggggacacctgtcgagacgtcattcaatgtacatcttcgggcctgcaagccattcgttgcccagccggtctatatttcgacatcgaaaagcaaacatgcgactggaaggactcagttaaaaactgcaaattgaaaaacaaagagcggcgggtaaaacccatgttgtttacggacaaacccgtatgtaacgaaggtgaattggcctgcggagatggtcagtgtatagaaagagggctcttttgtaacggggaaaaggattgccaggatgggtctgatgaaactacctgcgatatcgatagtgaccccaatagtgccccaccctgcgaccccgcagtatgcgttctccctgattgtttctgctcagaggacggtacaggcattcccaatgatttaccagccaaagatgtacctcaaatgataactgtcacatttgacgacgccataaataataacaacatcggtctatacaagaacattttcaacggtgaacggaaaaaccccaacggttgtcatatcaaggctacattcttcgtgtctcacaagtacaccaactactcggcagtccaagaaatgcatagaaaaggtcacgaaatcgcagtacattcaatatcgcacaatgatgacgaaaacttctggtccaacgccagtgtaaatgactgggttaaagaaatgggaggtatgcgagtcatcactgagaaattcgccaatattaccgataacagcgtagtaggagtaagagccccttatctaagagtaggaggtaacaaccaatttactatgatggaagaagaagccttcttatacgactccactatcaccgcacccttaaataacccaccactatggccctatactatgtattttagaatgccacacagatgtcacggaaatctccaaaattgcccaacaagatcacatgcagtatgggaaatggtacttaacgaactagatagaagagaagatcctgaaaatgatgagtatttaccaggttgtgccatggttgactcatgttccaacattcttactggagatcaattttataacttcttaaattataatttcgataggcattacacatgaaaacagagctcctttgggtctttacttccatgccgcttggctaaaaaatcatcccgaattcttggatgccttcctttactggatagatgaaattctctcagaccatactgatgtatattttgtaacagtgacacaggttatccactggatgccgaatcctagaagcgtcgccgac

SEQ ID NO: 1316 - DNA, 969 bp, Diabrotica virgifera
  misc_feature (898)..(898): n is a, c, g, or t
  misc_feature (903)..(903): n is a, c, g, or t
  misc_feature (926)..(927): n is a, c, g, or t
cccaaataaagccagaactaaatctaaaatactgctgagagaatgtagcagtagaaatagtattaacttattcagcttgtccatattcattacacatttgactttactttattaaattatgattgttaatcgtactcctccccaagatcacttctcaatcatcctactttagaaaatatattttatcgtctacttagcctttattttttataattgatcttttttgcgtaaaaaattatatattttgtgtctctcaaaaatattttactcttgttaactatgttatatagtttgttaaactttcaaatatctatttgaagataaagactgaatattacgcctatacgaaacgatatgatgcctttgaagtttttgttgaaataatgtgactgttagcgataatgttgttcgtaataatgcagtaaggctgtatcagcttgtaacttcagtacggtacaatgttattttgaaataaagacttaagccgtagccataacatattacgaccaatatagaagggaatgagaactacattgttagctagtttagtagagttttacaatacctcattaagatttaatttatgccagtcttagatggatattttgtacgcttgacaaattgtaatttggataaaatctaaaaacttggtatgtttactctctatggacttctcttttaattatgtaagggaatgtacccagtcgtactatcaataaaataatcaataaactacatgtatttgatgtatacagagtttctttttcacaagtatcttgtttgatacttaaattttgttgtatgataatattaaacgctaaattcagttaaaatcatttttaaactgcaatttacattgctatttttctgacagtatggtcatgacctctttttcggntgtgnttaatatttgtgactcctattanntcagtgtttgctaattctatccacctctgctctcgttacatg

SEQ ID NO: 1317 - DNA, 890 bp, Diabrotica virgifera
gtgaagtatacgcgtacgtttcttttaccgggaactgtttacagggaattttaaataattctcttgttataaaacatttcaagaatttgtgactattttggttaagggatgaaagctttgacttcaactaacagtccgctgtgttgagaaaattaatggcaaattctctctatatttgaagcactgtcgagtgtacaagacaagcaaaaatatggcttttaacagataatgtggtttatgttcatttagagaaatagacaattattagtgcaaaaatataagaaaattacaaattttattgattctaaattatagtggtaagggtaaccaacaattattatgattaagattagtgcaacgttaaagctcagtataataggattaatcatttttacaatgatttttctgcgttttcaaggctcactgttacaacgcaacacttactcgttaaccacaaaattattgttaaatggaaagaccttcctgctatcaactggtgactataatcgtctattgaacatcagctttaatttttctatgataaatcaagtgtgccaggaaagtgctcctgtgttagtgcttatagtagttcattctgcaccttcaaatttcaagaagaggcagacaataagagatacatggggacaagtagaagaaactaaacaaatagtgtttatgataggagatccgagttctccagaacaacaaaaaaagttagaagaggaaaatacgttatttggtgatattgtacaaggtaattttatagacaattacaggaacctaactttacagcacgtaatggttcttaaatactttgtttatcattgtcccgcagcgaaatatttattaaaaaccgatgatgacgtcttcatcaactggccaagtatgaa

SEQ ID NO: 1318 - DNA, 700 bp, Diabrotica virgifera
gtcattgtgaagtgaattgtggagaaataacctgattttacataacattaaattatcagttacgtgttgacgtgtgagtaatactaataaacgtactaagaaaatgccacgaagaggaagagcagcaccagctcgtgcaccagcacgttcaaatcttcccattagaactccagctcctacacctccagcaccagtatatgcagccccaccagcaccagtaccagcaccctcacaaggtcccgggttgtttggccaaatggctgctacagctggaggtgtagctgtaggatctgctattggtcatactgtaggacatgcagtaacaggattgttcagtggtggtggatcaagtgaagcacctgtccaacagccaccacaacaagtagcactccaacaacagtatgctgggacaggagcagctggagaacaaggcccatgttcttgggaaattaagcaatttttacaatgttcatctacacagtctgatttgtcattatgccaaggattcaatgaagctctacaacaatgcaaagttagaaacaatattgctgtttagacaagctcgtgatatattttaaattccggtgttactgagatgttaaaattattctaaacattacctcacagaatgcactatatatgtagataggaatgttacagaaatgttaaattaaatgtttttgccaataccacaacccaa

SEQ ID NO: 1319 - DNA, 1123 bp, Diabrotica virgifera
  misc_feature (1073)..(1073): n is a, c, g, or t
ggttcattaaaaggcagtttagactacttaagtcatttacctaataattcattctacgataagattttgtattttaaataaaagcggataacatcggcagctgcggtgtggattacgaatacgtgtgaaatacttttactcacgagaggtgcgagggcaaaaacacagggttcgagaacattcaaaatggccattgaaattaaagatcaatttaccaaagaatcttgccacaggtctattttaaaacagtttattttggggatattagccaatttttccagtgtcggtcccagtatgagtttgggattctcggcagttgctttacctgtacttcgtggacatttgaacaccattgagttgtcttggtttgcaagtatcgcatctttagcaacaccttttggttgtttctttgctggtccttttgcggatcgatatggaagaagaatggcacttttttttgttaatatcgtatgcctgttaggatggataacaattgcagtattttgttacgccaaaccatctcatttctggatcctgttattgggaagagtgttaactgggctttcaacaggactatgtagttccccagcaaccgtttacatggctgagatatcctcgcctgacttgagggggatcttcactacatgggcctctgtatcattttcattgggagtgttggtagtatacttcttgggatttctttttcagagcaatcttggagcaatttgtttgataactgcagtatttccgtgcgtgggaatcttattctcaatcttcttgataccagaatcaccaacgtggctggtaggaagatatcgaacggaggaagcaagatctagtttgtgcagaattttcaatactggactaactcctgatgtacaagcagagctggaccatttaataaaatgcaaaggagtgtcgaacatgaaatcagaaaagccaatgtataggaaaattttaagcaagttggaatatctaatgcaacctcattgtttaaggccgatgattttggttctaacctacttcttcttcccaacattcagtgggtatatttgttatcatcttttacgctnatagatatcgtaataatgctggcataacattcgatccttacattactatt

SEQ ID NO: 1320 - DNA, 802 bp, Diabrotica virgifera
ttacacagatgctgataccgatgatttacctgatcaatatgactggagactgtttggagctgtttcaccagtaaaagatcaagccatatgcggatcttgctggtcttttggaaccgtcggcacccttgaaggatcactttttttgaaaaatggtggtcggttggtacaattatcccagcaagctttggtggattgttcttggggctttggtaacaatggttgtgatggtggggaggattggagggcttaccaatggatccaaaaacacggtggaataccaatcgatagtcattatggaggctacaagggagaggatggattttgcgcagctgatgaggtggagaagacagctaaaattactggttgggtaaacgtaaccgaaaacgatgaaaatgctcttcgtttggcactcgtgaagcaaggaccaattagtgttagcatcgacgctagccaaaaatctttcagtttttattcacatggagtctattacgaagaaaattgcggaaacagagaagaagatttggaccattcggttttagctgttggatacggttcaatcaacggcgaaaactattggttaatcaaaaacagttggtctacttattggggaaatgacggctacatcttgatgtcttccagaaacaacaactgtggagtcatgacggcggctacctatgtaactatgtagatatttaacataacatccatatttaaataaaaaaataagaaatccaatttatttatattgtaaatatttatcaaataaattttcttcataataaaaaaaaaaaaacggacacga

SEQ ID NO: 1321 - DNA, 1830 bp, Diabrotica virgifera
tataggagaaggtggtacggctggagagggcggggcggcgcgagcggccgctcgcacgcgttgtgagatgatttcgaagttcaccctggttttcttggtttgcattgtcgcaccagcgataggtgatccaccagttccagaatggagtgacacttatagcgtagaaggaactatccatttgccttatgcagaaatagtagagcctttccatgcttggtatgatggaaaatctaaaaattcgcgcattgattactacaatgggacggctaagacataccaacttggaggaaatggaaatggtgtccaactgaaagtagttccattcactacagaggaggtcctaaaccaaataacgtgcttccagatcaatggaactgaagacgatccagtgactcctcaatcgattttgccagatttagaaggatttgaatatcaaggcatacaggagtatggagatagagaactagaggtatggtttctaaaaactgtccagttagaaaaagaaaacgaatacactctatgggttgtccgagatgagcatggtaaagctattccagttaaatatgatatgagaggatacaattcgttattgggaagccactacgatcattactatttgctatacacatcgaagtcttacaggactcacaagattgatccctccgtttttgaagtagaaactaatagtgaatgcagaagttttcctggacccggaaatcaacatgttcacatcatgaaccccatggccgaatacattcgtcccgaaaaaagtgagcacgtggactcaagctttggcgattttataaataaccacaacaaaaattacgcagacacaaaagaacacgtttttagaaaagaggttttccgtcaaaacgtcaggttcatcgaatctgtcaaccgacaaaataaaggatatagtctagcaattaatcatcttgctgataagactgacaaggaaattaaatacctgaatggaagactttcaagtggaggcaacaatggaggacaacctttcccttacacagatgctgataccgatgatttacctgatcaatatgactggagactgtttggagctgtttcaccagtaaaagatcaagccatatgcggatcttgctggtcttttggaaccgtcggcacccttgaaggatcactttttttgaaaaatggtggtcggttggtacaattatcccagcaagctttggtggattgttcttggggctttggtaacaatggttgtgatggtggggaggattggagggcttaccaatggatccaaaaacacggtggaataccaatcgatagtcattatggaggctacaagggagaggatggattttgcgcagctgatgaggtggagaagacagctaaaattactggttgggtaaacgtaaccgaaaacgatgaaaatgctcttcgtttggcactcgtgaagcaaggaccaattagtgttagcatcgacgctagcaaaaatctttcagttttattcacatggagtctattacaaaaaccccttttttaaaaaaaaaaaaaaaaaaaaaacctttttttttttcttggcctggtgtaacctggtgttgttcttgaagaacatagtacattttcaatataatgccatttcggtaggatttagaatatggcctataacatatatactaaaaaagtttcatatgttaggttccattctttgctgcactcggttaaaccacgagtaaataggaactatatcatgctataccattttacttgtggttgttgagtagttgtgtgtctaaagctgtgcagagaaccctctgcagagtattaggatcatgtcgcacttgggataac

SEQ ID NO: 1322 - DNA, 1290 bp, Diabrotica virgifera
ctgtgattttaccattttattaatcgttctataaatatgtataaaattttctaaccctacaattacaatattgcaagtacagtacaattacagattgtcgtacattcggtaataattattataaatagcgtgagttgactgatattgcaaacagtacctacaaaagaaaaagaacacaaatacatagatacatatcgccaaagaaacaatcgtaccaaaaaatacaatttttactaaaattttaaattgaattttgccaaataaatttctctaaaaacaattattaaaaaacagaaattattaaataattttaattttttttgtttcaataccaatcaaaatcatgtatgtaggtacgcaattaaacgtaaagaagggcaatttaaaagtgtatgaatataaacgaaatattttcgagatagttgatgggaaactagatgttttatttactagttaatattattagttatattagaactgttcaatgtgttctgattccatatattgttaagttaaaatgcgaatatgtcaccacaaaactaaaattttagtaatcaagagatttttttctgtgagaaaatcattgtttaatcgactgaaaaacaacattttggacagtaaatcaatatattggcgaaagtagttttaaaatggcataaataaagaccatggacgtgactgtacgattctcaaaaaaatgttttttcttgtatggaggagataaaggacacaaattaatattaaattaaacacgaaaataagacacacaactcaatgaacatacgcacatgtgaaaataaaaacaatgtgtgacaatattttcttgaaaaataataaaattgttaaacagatttgtaatttttttaatataaaagcaaaaatatgattataaaaaaaagagttgatagatctatattgataagatttgtcacagtatagtagacaatgttttaattcaaattttcttcaaataaaaatgtgatgtaattgtcaaataaaaatgtaaataaaaaaaactatacatttatttatgaagaaaaaatactgctattgaccactctttcatgaaccaccatatactttataaactatagcaatgtattatataaatatgaatatttttttttttttattaataaaaaaaataatatcaatctgattttttttttttcttgttcacaatatgtaatgctaataaggaccagtgggcagaatcatctttcaatggaaaattacaaaagattcattttacagtaaatttaaatcgctgcacagcaactcgataatttt

SEQ ID NO: 1323 - DNA, 901 bp, Diabrotica virgifera
ggtaatcactgacagtgacgtagtgacgttgtcactgatcatttgttgacgtttactaaaaaacaaaaataagattatctatgtatataatagtttttattttaataatgtaattattctcttcgtatgaaaaatgtttacgttagtttatggattttataagcatatggtacagaaagatgaatattgtgtattaattttgggccttgacaatgcagacctacttagaagctgcaaaaactaaacttactaaaaactacaaagcaattcaccctacgaaaattacaacaactgtaggattaaacataggcaaagtagatgtaggaggaataagattaaatttttgggatctaggaggacaaaacgaattgcagagtctttgggataagtattatgaagaatcccatgctgtaatttatatagtggattcttcagatagagaaagaatggatgaatctaaagatatatttgataaaatgatagccagtgaatatttaaaaggcattccactgttagtattagcaaataagcaagatataccagaatgcatgggagtacgagaagttaaaccaatatttaataaaaatgcacatctcattggaaaaagagattgcatggttatgccggtgtcagctttaacaggagagggtgttgatgaaggtattcgttggttagtggattgtataaaaagaaattcgtatttaagaccccccaggaatcaagaagaactgtaacgcagtttacaaggaaagtgactgagctttgtaaaaagtattacctcatactgcatatacgatgtataaaacacattcatttagtaagaatatcgaattatgagttgtatatattgtattgtacatttttataatcaaggaacatgtaaatatataaaatgccgagt

SEQ ID NO: 1324 - DNA, 187 bp, Diabrotica virgifera
ggaaaacgggaacacgagcagagacctaagaaataaggatattaattggtccagatatggacttggaacagaggcagccagggttaggggtaacacaagcggttttgttgatctgtcaaatgactatggtgctgggggtcatcaagcatcaggggctaatgaactatttgcagaggaatagagagat

SEQ ID NO: 1325 - DNA, 1427 bp, Diabrotica virgifera
gtcaaagttgtgtccaggttatatcaagttattcagtgctcctctttttgaagtaaaataaatttctaaaagtataattaaaatcttaaatgtgttcataatttctcaagtttacgtgataggataaaaaatgagtatttataaatgtttttagtgtgctaaacaaaaattactaattactaagataacctcaaacttcaaaaacaaacaatgtggaaattttcgcgtaaaagttattctaatgcaattggaattacaacagatcaatggaaaggtgtaactgtgaaattcaacaataaaataaagggaaccctactagaaaaatggattaaatactggaaactgttagcaggagattacagagatgttgctcttaacctcaaaagtgaaatgagacaaaagcccctaaaatctgccgtgtatttatcgggattgtcatttctagcctactgtggaacacataatccagatttaagaaacttcagagcaaaatatattgatagcgctaatcagttagcactggtaaattcttcggtagcaaatccaaactccgtaaaccatttaaagtatatagaaaaatgctttaatgcaaacctcataagatttataaatttaggtgtattgtctattgtatgggttgatgaatttagtgaagattgtgataattatgaaagtaattgttcgtatttgcaagttccatatacacgttttggagaaagaatacttgatatcggtttcttgaacacttggtgggtaatatcaagaaaaatgttggactatgatattaattattaaattgtttattgtgttagaaataaaaaaaataacttacctaaagtttataattggaaaaaaaaaaaaaaaataaaaactgttcaaccacaaaaaatttacatgatctgaatacaaaaatactaacaaaatacaaaaaacaacaccccaaaaaactaacttataaaaaataaaaaataaaaatatataaaaataaaaagggggggggcccccccctttttttttttttttttataaaataatttttttttataaaaaaaaaccaccgcgcagagggataacaacccttaaaacaaacatttttcttcttccccaaaaaaaaaataaaaaaaaaaatatttttcccccccggaaaaaaaaaaaagaatttttttttttttttttaaaacctttctctcatatttccccccccccccccaccaaaaaaaaaaaccaaaaatggagaaaagaggaaaaatatttttttttttttttttaaaaaaaaaaaatataaaaaaaagacaaccccctttcttcaaaaaatcacccgcccccggtagaaataatttttccctctcttttattagtggtttctctgtgtgggggggggttggggggagacagaaaaagaagaaaaaaaaaaaccaacccccccc

SEQ ID NO: 1326 - DNA, 1750 bp, Diabrotica virgifera
  misc_feature (1637)..(1637): n is a, c, g, or t
  misc_feature (1683)..(1683): n is a, c, g, or t
  misc_feature (1703)..(1704): n is a, c, g, or t
  misc_feature (1734)..(1735): n is a, c, g, or t
cccacgcgtccgtgagtttttgagaagtttaattattatttaataagaaaatgactattttgtatcatgtttggtttgtgcgaaaatgtttatttagttttggatttataacctattaaaaattcaaacgaatttcggaagtggggatacttttttgacatatcatactttgtatttgaatctcaattctgggaaataattattgcaaactgatatgggattattatttgattggcgtagtctatgcaacgaatatcggtatatgtgtgcgtataaatgcacattttaaagctactgctactgtaattctactacagaatgcatttatttagcactaatttttaatatgcggatatgcggtaaagtctagagtagacacttttcttttctttctcacttagggagaaatttgatatctataccaaagtgcgtgagatcggctgttgagtgtatccataaattattataagataaacatagaagtttttaaacttgttatgaaataggtctccctgcctcaaggttatatcttatatccctaaagtggtttgagttgagttgatacaatgcgttttgctgaagtttgaatcttccatccagatcgaagatcgaattcagttttattgagatagtataagtgggtggaagcaggaagctgagatgtctgaaagagtaaattacaaaaggctttgtgtcagatccgacaaagatggattcacgtatccaaagacaatagcgaaagaacgaggagaactttcgacagtcatttccattgcaatttgtcttattctatttttggttgacttaatccacaatgaaaatagtttttgcgtatttgcaatacaatacaccactggagtcgtgctgactatagttttgcaattgatctaccgatttattttgatgtgtgaagaaatgcgacatttaatatcacgttacgatagaaacgtatggattttgtttaaggacgttttgcattttccaattcctgtttatatgacattttttttcggtgttatatacctggtatataattactcatctacagcctttgaactttggaactcaagtgtcacactgcctagaattgtgtccatgtatctaaacatgtacctgttgggaaaacttttgaaattggattctggcccgcttaacgactctctatggatagctgaggataatggtttggattacggctctggaatggcatattcctttttctttggatatctaaatctagttcttccaaaaacaggtagagaagataagcatttgaaagaaatcatggaagactacgaaggtagtaacggcataacgtttgccgtacataaactatttatactaataccgaagtcaatgaaatgtttcgttagtttaaagaacgaatattcgccatctgtggatgaaagtagatcgttagaacaaaaagttatgacagttgctggggttcaaaatagagtatataaaaacgccgtttataagatcagtccaaagaagaatgattacatttatgtctcagcagaatatgcaacacccttgaagacttttaaagacgtttttgacaatagaggacaacattcagaaaatttccacaaacataagaaggacattattttacagttctatttgacgcttanacgagtattggaacaaaaaggacttaaccaattttgtgaactgatntattatgaagattctatcannaagatggtggtactgcctattacgatgtgnngaaaatcattcatga

SEQ ID NO: 1327 - DNA, 640 bp, Diabrotica virgifera
aaagatggcggacgcgtgggttttgaaggctttggtcctatgcatttcttgtgtggcattttcagctgcagtttatctagatggctggggaggtggcacagcaaacagaaatcctcaaagtgctacttgggaaaaaatcttcgaaagcaatacccgatcatcagtacttcccttgtttagacatgacaataagttatattacatgggcgtacattttcgggcaagatggcaaaatgctttccaattctgtgaatcacttcatatgaaacttctaacaatacattcaaacgaagaaaacaacagaattcataaatacattagagatgctagcaaaggaaccgaatactggatcggaggtacccgtttggtagatggatccagctgggtatggatgccatacggaacgcaaatcgattacaccaaatggtctaacggccaaccaagtgacattaacgaaaagtgtctacagttatggataactgacaatcagttaacatggaatgatcgtgactgcaacgctgagttctacttcatctgcgaaaggtacgtggactcgaatgatagtggacctccaggagcatcactttaatggcttatattaagctattttaattctttgtgccattaaaagataacatgt

SEQ ID NO: 1328 - DNA, 1665 bp, Diabrotica virgifera
ggtatacctgacggaatataatggacgagaaccatctagtaaagaaattgagaaaatgtacgttcaaataaacaagtctacgttaataacacatatcttttggggtgtttggtcattggtgcaagcagaacattcctcaattagctttgattatatggggtatgcagctatacgtcttaatgagtattttagcaaaaaggacctatttctaagtttagagctacccagctgatctggaagaatctagaatacatattaaaatttagtgatattggatgatatcaaaaatattttttgaaaattagatacgtttaaaatgaatttagtattctaacaaattagagtataggggataaatctcacttaaaaagtaaagcaagcaaacgtatgttagaataatacaaaaaatagaagaattcagaatcggacgcgtgggaaaaaatattattattaaagtaagttgtcgtactaaattaatcctgcatttttttattatactagggagagacaatgtatatttttgtaggtagctatatttcctattaaatgcaggtaccggtaaaaccattggtatctgtttaaatacctcatcacttgaatgtattaatacatctcctcattcactctccgattgtccactgctggacatagatctccctcataattttctatctgtttcgatcttatgcctcttgcatccaattcctatggcaacgttttagatcatcagtccaacgtgtcggtggacgatctcttcttcggtaggtaggcactatatctttgtctccatttcagtatgcgctttttccgtctgttatctgccattcgagtcacgtgacctgtccagttccattctaatacgtatcacatataatacgtataagatatcgaatagtttttttccctcaggtgcttcaactaatcctagcttttattcgtctctaaagtaagtagtatgtatttaatggtataatctatcatttgtttttgaacaaagaatacttataaaaacaaatacgtgtacgtgtagcaaagtaaatattagtattaccacatttgattatattaaatgtgggacatattaattattctctttcccggtgatcttattaaaataacatatctaatgttggaataggacaaataaaaacacaattttttccaaaaaaactttaaccattacatactataagtagactgaaaaatattagtacgaagtatgtccccctttagtagaaatgacctctccaacgctattttagcacagttgttcatgagttcatcatcgtggaacccacaattgtatagcacttgttataatttttcctttgtagatcaatttaagctaagcatttcttaagaaaatgctaaggagtttctcaatgggaattaagggcggggaaaataccaagggccagtcaaagcactttttctttttttttttctcctccaaagtttaaaaccaattttcccctttgtggaaaaggggaaaaaggaaccacccctgtgtaaaaaggttccctattgttaatccccaaaaaaagaaaaaaaaaaaaaaaaaaaaaaaaagaagattccgccccaatgttctctccaaaatggggaaaaaaagggtttttgggtgaaaatttttctatagggggttttgtgacccttctttttttt

SEQ ID NO: 1329 - DNA, 706 bp, Diabrotica virgifera
cccaaaggtgacaaaggagaaaaaggatttacaggacgcgatggaacaaaaggagataagggtgatcaaggatttacgggaccctcgggacctataggacctactggtccccctgggcctgttggtagaagaggtttgcctggccaaagaggagacaaaggagagaaaggaccaatgggtttccctggagatcgtggaagagatggttctccaggactccctggtctttcaggtggtaaaggtactaaaggagaagcaggtataccatcggtaggaccttctggtccacctggtcctattggtgaaccaggagaaaaaggattacctgggttcccaggtaaacctggtcctaggggtaatgacggatttccgggattaatgggagagaaaggagatgttggttctccaggattgaatggactgacgggcccagcgggtcaaaaaggagaacctggacctattggacctccaggtattgatggacgtgaaggaagccctggatatccaggcgccaagggagaattaggtcctaggggacaaccaggacgggcaggtttacaaggtttcccaggtttaaaaggagaagcaggattccctggtggcactggtcaaaaaggatttaagggaactataagaatggcccgcactccctggaagccagggatggatggtctacccgggaaaataggagaaaaaggagaacgtg

SEQ ID NO: 1330 - DNA, 1009 bp, Diabrotica virgifera
  misc_feature (972)..(972): n is a, c, g, or t
tttgcaactatagtgtcaagtcaaaaccaagcaaattccaaaaatgtgtggtggtttctaaaattgttgcttagattatacttattgactgaaagtgtgaagcacatgcagaatttttaatagttgaaattcacctattatcagtccgtaaatatattaaaagtaatgggtaatgtacacgcttattcttctaaccctcctccaccacctccaccaagtacaaccttcccaaggaagaaggatactgatcctgcagctagtcctccggaggtgattgaaaatccaggaccattagaagagattcattcaaagtgcaaaaatgttttccccacatgttttgaaggcgctagagttatgcttacaagaggtcttagtaatcacttccaaatatcccacacaataaatatgagctctgttactcccagtggatatagatttggagctacttatgtgggaacaaaacaaatatcaccaacagaggcatatcctatattgctgggtgatattgatccctcagggaatctgaatgccactattatacaccaaattcagccaaatcttcaaacaaaatttggagcacaggtacagaactcaaaatttcaagtaggtcagttaacaatgaattataagggttctgattatactgctagttgtacagtagccaatcctgatgtaattaatagttcaggaatagttgttctacattatttacaagctgtaacagctaagctggcactgggaactgaactggcctatcaaaaaggaccaagtattccaggcggagaaatagctttattaagtgcagcagctaaatattcaactgacaacgcacaaatatcaggcacattaggcgtacaagggcgttcatttatgttactaccaaagagctagtaagcagttaccaaattggagttgaaattgaggctaaacatagaatgcaagaggctgtggcatctgttggttatcaagtgnatttaccaaagagtgaagtagtatttaaaggtcacat

SEQ ID NO: 1331 - DNA, 1682 bp, Diabrotica virgifera
ttatccagtcgtgtaagccatatttgtcagtgggttcgctagttccgtagtgttgtgcacatttaacatctctggcctgcgcgtactcctaataacttaaaaaatggcagatgacaaacaccccgtctatggacccttctttggagtcatgggagccgcggctgctatcattttcagttcgctgggcgccgcctatggtacggcaaaatcaggaaccggtattgccgctatgccggacatgaggacgaacttatcatgaaatgcattatcccactatgcagaaggattgccgtctacggcctggcatagctgtacaatctctcgctagccagacagctctacctattattcatgtgatattcggttggttttgaatcgattaacaactcttcgtcttctttccattgaaagggtgacgctgatcacttttcaaccggacactcccgaatttttcacgcaatgatattaaacattttttgccgcattctgacatgtatgcacttagcataatacctctatactactatgtccgccccgcctccatttttatcatccctaaaccgcatcagatccgcatctcgccgatccttgggcatctgtcacaatcattgcaacgttagtaattatagcgagctgtctaaatgattgaataatcgaagtgtgtcgattttccacgggcgtgaccattaggtaaaactgaccggacaactgcctctcttcttctacatgtgatcttgatactcattttccatcaaattttattgcttttgcggtcgtccctcgcttacctctatactatccttccccgcttatctcctaaacacgctaatctcgcccttgatgtttgactcgacatatagaggttgaagctgggacgtccggcggtatcccgctgacctccgattgtccgttagcaaactcgactctttgagaccctattatatgagactcccttcttgcagtcaaatggcccactggacttaccatttcaagaccctatgggaccccaccaatgcaacccctacatatggagatgcgttcttgccgctatcatcatacatgaggcccgggaacttattttatgaaattcgattaccgccatggtcgctaggcccgcgacataaggaaaccaacattgggatgtacaggtaataatcgcccctatgctttattcatgaaattcatttattcctacttagcccacactatatatttttacagcggtattcttccattcatatctggtctttccctactgattattgctaatggattgctctatgttatgtacttgacagttggccaaatgatttgtaaatgctggaacaatgtcaggagtgtctagtcgaatatcttgaggcggattctgcggcaatattgacggacaactgccttgaccttcgtgtaaaatgatcctgacaataattttcgacccttcgtatgtaatgatcttgattcttattttgcctctccagtaagtacctctatactgtactccccctaccaactcgcttcctctataatatctcctaaacaccgtcgcatcttgatattatcaaatctcgccccagctcccaccttggagtatcttgatctccgcctgattcaacgtttgctgtatagtgttatgtatccatgtacctatctgcactttacttggtagcaggcgatcccactgactg

SEQ ID NO: 1332 - DNA, 1508 bp, Diabrotica virgifera
agaaaaaaaaaaagaaaatagaaaaaatggtaacaagagaccacggctaaccggtatgagtatttacccaggaagaagcacgcaggagggcaatgtaaataatttagttatgatgggacccgtatttttcgcgtgcggggcaaaacaaattaataattttagtaaaaaagactgggcctcttcatcgctgctgtgtccacacacacgactaataattccttatttccatattcatggaaccggtcgagttttcttgacaggtttttgtattaaaacgaattttcttcctaggcaaaataaaggtcttagttactaataggttgttcaaatgaaaatgtacgaaacgacactgtgggtataaatgaagtctttattcaaagtattcaccatttacccgagcacaacgatgccgttgattagccgaaggattcattgatcccagaactcctgtggaaatgaacagtcttccccgtatacatccggcgttgaatagcaactggtttaacaccttccgctgtcagaaacctgataacgccccgctgctcctcaatcgtcgaattttgcaatgtgaacgccatgatgtgctcacacgaactgtcgcgtcaattggacggctctcttataagagcctctattctctcctgcgcatgcgggcgcccgggaatgccccgatcgaatccgaaggctacatttgcctccctggatgtctcactacgttatcccataacggcataggcaattatgtttgcggttaagttgttacgacgtttcgtgccttttcatttgatcagtcgcagtataatatacaagagaagagggaaaacaaattttgatttattttgcctcgtacgttacaatacctgtgctatcattgtaaataattttaaacatacttagaagcctctatttcattttcatggcgggtcaccactattattaaattaattgtatagttagtagaatttaggttaccgtttttcttttaatataaaagctagactctattgagcctaggtatttgaataaaattttaattcaatgacgtttagatgtctaggtgtcgctatctgttttgtggcaggtgacgctggtgtaagagggaccggacaactaccaatgacccttcgaacgaatgatcttgacgtacatttcatcttgaattcattttcgcctaatgtattactgctttatgtttttacctctatactcagttacctctatactactcgcctatcttcccagtctcctaaacacagcgtctcctaaagtcgcgcatctcgccccgatcaatcttggctctaattgtctacatgtaaaatgtatacatgtataaatatatcaggcgatgacagtgactgaagagcccaatgtaaataatttacgtatgatggggtgcgtatttttcgcgcacggggcatcagatattagtaattttagaacaaaagactgagcctcttcatctctgctgtgtgcacgcacactactaataattccttatttccatattc

SEQ ID NO: 1333 - DNA, 1449 bp, Diabrotica virgifera
catgacactggggataatacatttcatgataagttccggcctcatgaccgacatagccttttaccggttcctgattttgcacggaccatatgacgaaccccccggctatgaacccgtatctttgcacgcatgtccactcactcctgctatcattttctattcgctgggcgccgcctatggcacggtaaaatcaggaaccggcattgccgctatgtcggtcatgaggccgcaacttatcatgaaatgcattatcccagtagacatggcgggaatcattgccatctacggtctggtcatagctgtactgatctctggtaacatccaagacagctctacatattcattgtacagtggttttgtccatttgggtgctggtctttcagtaggattttcaggattggcggcaggtttcgctattggtatcgtaggtgacgctggtgtaagaggtaccgcacaacagccaagactcttcgtaggaatgatcttgatcctcattttcgccgaagtattaggtctttatggtctcatcgtcgccatttacctctatactagagcttaagcgcccagctcccctaaattttcatctcctaaacacagcgtaccaaaagttgcgcatctcgccccgatcattttgtttttaatgtctacatgtaaaaataaaaactgtataaatggtagcaggcgatgaaagtgactgaggcgggcaatgtaaataatttagttatgatggggcccgtatttttcgcgtacggggcaaaacaaattaataattttagtaaaaaagactgggcctcttcatcgctgctgtgtccacacacacgactaataattccttatttccatattcatggaaccggtcgagttttcttgacaggtttttgtattaaaacgaattttcttcctaggcaaaataaaggtcttagttactaataggttgttcaaatgaaaatgtacgaaacgacactgtgggtataaatgaagtctttattcaaagtattcaccatttacccgagcacaacgatgccgttgattagccgaaggattcattgatcccagaactcctgtggaaatgaacagtcttccccgtatacatccggcgttgaatagcaactggtttaacaccttccgctgtcagaaacctgataacgccccgctgctcctcaatcgtcgaattttgcaatgtgaacgccatgatgtgctcacacgaactgtcgcgtcaattggacggctctcttataagagcctctattctctcctgcgcatgcgggcgcccgggaatgccccgatcgaatccgaaggctacatttgcctccctggatgtctcactacgttatcccataacggatacgcaattatgtttgcggttgtacgacgttttcttgatcacgcagcctcacgaatttttgcacatgaacccccatgatgtgcccacacgaactgtcgcgtcaa

SEQ ID NO: 1334 - DNA, 2528 bp, Diabrotica virgifera
  misc_feature (97)..(97): n is a, c, g, or t
gaaagctgacacgcctggaggaaccgcgccgtaatgaccgacatagacccacacacccgcccacgcttccgcactaccatcacggagggcgcccatngcacacttgaaacatgatatcagccgccggactcccatcgactccaaatgaaggaaaccgataaaacggacaagacacgcccgtctgatcgtacccttactttattagtgatgattagacagcgccatgaatatctacgactcacgataaaagctgacacgccgaggaaccgcggcgtcatgaccgacatagacccacgcaccggttgtgatcatgtaacatccctgggctgccaatactcctaatacttaaaaaatgggagatgacatgacaccccgtctatggacccttctttggagtcatgggattctgattgcgttgtgcacatttaacatccatctgacctgtaaatactcctaataacttataaaatggcaagatgacaaacaccccgtctatggacccttctttggagtcttgggagccgcggatgctatcattttcagatcactgggcgccgcctatggcacggcaaaatcaggaaccggtattgccgctatgccggtcatgaggacggaacttatcatgaaatgcattatcccactatgacatggtcggatatcattgtcatctacggcctggtcatagctgtactgatctctggtaacatccaagacagctctacatattcattgtacagcggatttgtccatttgggtgctggtctttcataatgattttcatgattggcgttaggtgtcgctattgcttgctgaacgcccatttttcaccgggttcgctagttccgtagtgtgttgtgcacatttaacatcgttctggcctgtaaatactcctaataacttaaaaaatggcagatgacaaacaccccgtctatggacccttctttggagtcatgggagccgcggctgctatcattttcagttcgctgggcgccgcctatggtacggcaaaatcaggaaccggtattgccgctatgtcggtcatgaggccggaacttatcatgaaatgtattatcccagttgtcatggcggatatcattgccatctacggtctggtcatagctgtactgatctctggtaacatccaagacagctctacatattcattgtacagcggatttgtccatttgggtgctggtctttcagtatgattttcatgattggcgttaggtgtcgctattgctatcgcaggtgacgctggtgtaagagggaccggacaacagccaaaactcttcgtacgaatgatcttgatactcattttcgccaaagtattacgtctttatggtctcatcgtcgccatttacctctatactatagcttaaccgcccagctcccctaaattatcatctcctaaacacagcgtacctgaagttgcgcatctcgccccgatcattttgtttttagtgtctacatgtaaaaataaaaactgtataaatggtatcaggcgatgaaagtgactgaggcgggcaatgtaaataatttacttatgatggggtccgtatttttcgcgtacggggcaaaacaaattaataattttagtaaaaaagactgggcctcttcatcgctgctgtgtccacgcacacgactaataattccttatttccatattcatggaaccggtccagttttcttgaaaggtttttgtattaaaacaaattttcttcctaggcaaaaaaaagccatacaaactaatagttaaccgattagtattggaacccaatcctaatcgtatcaggatgacagtgactgaagatccgcatgaacatactttacgtatgatgagtgcgattcgcacgcggccagtattagtagctgaccctcttcatgctgtgtccacgcacactaataattccttatttccatattctgcatcccggatatggacccttatttggagtcatgggacccgcgtttgctatcattttcagatcttgggcgcgcaatgagaagatgaacacgaaccggcattgccgctatgccggtaatgacggccgcaacttatgatgaaatgcattatcccactagacatggtgggtatcattgtcgtctacggcactggtcatagctgtactctgtcgtctgataacatactcacgatcgctctacatattcattgcacagtgggaatgtccatttgagagctggtcttgcctatgatttgcatgattgacgttaggtgtcgctattgctatcgcaggtgacgctgctgtaaaacggaccggacaacagcctaaactcttcgtacgaatgatcttgatactcattttccgcgaagtattacgtcttgatggtctcatccaccacagatacctctatactataactgacccgcaccgctcgcctatgatatcatctcctaaacacagcgtacctgaagttgcgcatctcgccacgatcatgttggatgtagtgtctacatgtagatatacatagtgtatattcggtatcaggcgatgacagtaactgaagat

SEQ ID NO: 1335 - DNA, 1243 bp, Diabrotica virgifera
atttttaacttcaaagtgacagttttcgcagtgacgtgcttgtcagggggtgacgtgttaatttaataaacaattactgcattgggcaaaatgttggatttatttacaatttttagtaaaggaggcatagtattatggtgcttccaaagtacaaatcaaatattcactccttctgttaatgctttaataaagaatgtcattttacaggaaagaagtggtgtaaaaacattcgaccacgatgggttaattctccagtataagttagacaatgagttcgacttagtatttgttgttgcataccaaaagatactgcagctgtcttatgtagacaaatttctgaatgatattcatcttgaattcagagacaagtataaaaatgagcttactgagaagttgtattttcaagattttagctttgtggatacttataattccacattaaagtcggctgagaattggtctaaggttcaattaaagcagccgaaacagatgaggacttttgaggagtcttttaaatctaaaaagactgtttcatctatgatagaaaggaagggtgaagaaaaaccacagaaaccaattaaaaagaaggaagtgaacttcagtactgaggaaaaaactattgcacctccatcacctcaatctcagaagaatggacttattgatgaagaaaccttagctatgaatagagcaaaatttgcaaagaagatgcagaaaaagaaaccagaggcaaagaagagtcctaaaagtcctcctgcagaaaaagcgggcaaaaaacccagggtatgggatttaagcgggtctaacaaggatgtggatctattggaacgaacaacagatagacctgaagatgccagaagtaattatacaccagatgctgatatggttggtcaaatgaaaggtgtaattaaagatctagaagtggaatcttctgatgaagaatacgaagatgaggaagaagttgaaaccgttcaacagagcaaaccagcccccaaaggaggaatgttctctatctttagaggtctagtcggttcaaagaacctgaccaaatctgatatggaaccggttttggagaagatgaaagaccatcttattgctaaaaatgttgctgcagatatttcggaaaagctttgtgattccgtcgcaactaaattggagggaaaagtattggggaccttcgatagtgttgctacgactgtgaagaatactctcaatgaatctttggtacaaatttttaagtccaaaa

SEQ ID NO: 1336 - DNA, 667 bp, Diabrotica virgifera
ccaggattatcttggaaagagcaaattagaccattggaacctgaaataacagctgtacaaaaagcagcagctgatcacgatggattggtcaacgccgtgatagaaggcattccaaaagaagcgcgagaaagaggcgtgtaccccgaagatgccttgagagagcggttcttaaaagtagaacaagtcgccagaacagtggcattaattccagaggagggtgcagcactaccggtccacttgttgtcctatttgcagtcgttgatccttataaaggccgctagtcctattcctcaaagcgaattaaataatgaaataatagatgtttcgacgttaaacacaaacgacattcttcaaagagccaggtattggttagatcgaggtgacttcacacagacgttgaggtacatgaatttactcaaaggtgctgcacggtgcgtggcgaaggaatggatggacgagactagaatttatttggaaacccaacaagccgcaaacacgctgatggcatacgcctcctccagcggtttggcgtacttgtgatgtgtacaaaaaacaaaataaaaaaaattcaatagttcaatcatgtaatttctgatcaattgtgttatcgtatttatttccaatatttgtcatcgacttacttttttaaatatattacgttttagcc

SEQ ID NO: 1337 - DNA, 1135 bp, Diabrotica virgifera
atttatttgtttaaactatgattttcgcacagaattggtctcgagcgttgttgaaaagaaatattttaaactcatgtcgctatcaacatggatatattattctggttcctgaaataggagaagatgtggatggtaaagattctgcttccaaacaaacttcaaatttaccggaatttaacaatgttaccattgaaaattgtcgggcagctattgctaaacagagcctggagtttgaagagggtgtaaaaagtattgaaaaagagatagaaagtaatcccaaaggagatatttttcagcaaatatttaagcctttagaagtagtaggtggacctctagatgttacatggggtgtatctaagactctatacttaggcaacagtacgttaatgccaacatcaagttatatggccatccatgaaagggctagaaaagctagagcttcaaagtataatagtaaaagcatttatagtgctgttaaaacagctttgaatattaagactgagaggagtagtgaagaatctagaattttacaaaagtttgccactgaaggtcggttgaatggactagagcttgattctacaaaaaaagttatcttgagtgagtatttaaacaaattaaataaggagaaaactctctttagacagaagacagaagtatccactaagcgttttacacaaacaatatcggatccagaaattataaaagatataccaaaatctgttcttaaattactagcgattgaccctaataacgctgataatggaccttggaagttaaacctccaaccttacagttatatgcctgtaatggaatattgctcggaacgggatatacgatggaatctatggcaggctttagttagtagaggcagtaaaatgggagatagtgaattatcaactagtttacatatagaagaaattcgtatgcttagaagagatgtagctggcattcttggatttgaaacatttgctgacatgtccctgcaaacgaaaatggtaaaaaatactgcagaaataaaaatattttactgagcttattggaaagtgcaaaaagtgcccaagatgcagaagttaaacagttgtacgattttgcagtagagaatgaatttgaggatgataaacttgaattgtgggat

SEQ ID NO: 1338 - DNA, 1011 bp, Diabrotica virgifera
  misc_feature (956)..(956): n is a, c, g, or t
cccacgcgtcccattgaattcaacaatatcacaaaaaaatgagtgccgcaactgtgagtcgtattgtcgctgctaaagtttttggcaataattctttcaaatatggacaagtggcaaaaaatgttaggttatttagtgtagctgcaacaaaagaaaactacgagtttattaaagtttccaagactggagaaaagcaaaatgttggactgattcaactcaacagacccaaagcactcaacgccctctgcaatgggttgatatccgaagtatctgaagctttgaactcctttgacaccgacaaatccgtgggggctgtagtcataaccggaaacgaaaaagcttttgcggctggagctgatattaaggagatggtatccaatacctttgcaaaatgtgtcactgaagattttattggtgcttggcagcttatcgctaacatgaagaagcctcttcttgctgcagtaaatggatacgctcttggtggtggttgtgagttggccatgatgtgcgacatcatttacgctggggataaagctaagtttggacagcccgaaattcttcttggtgtcattcctggtgctggtggcacccaaaggcttacccgaaccgttggcaaatctaaggcaatggagatagttttatctggtaaccaggtaacagcccaagatgctgaaaaaatgggtctggttagcaaggttgtaccagccgccgagcttttgactgaaactgtaaagcttgccgaaaaaatagcaggaaactcacagatcgccaatatcatcgctaaagaaagtgtgaatacagctttggagaccacgttgaaggaaggtttgcactttgagaagagaatgttccacgccctgttcgctactaaggaccaaaaagaaggaatggctgcatttattgaaaagagaaaggccaactttactcatgaataatttatataattttctacttgntgatcatttttttgaagaaatgtattatatatatttttattaaatttttatagat

SEQ ID NO: 1339 - DNA, 566 bp, Diabrotica virgifera
acccaagcgtccgcccacgcgtccgctagtcccggtgaattgtggtttatcggacaaatatttccaatagtccttgtagcaacaaaagtaatccaaaaatgactgaccaaccactaccacctccagttatgtgggcccaaaggtcctctattgtatttcttaccataaatttagaagatgtcaaaaatccggaaattaagttcaataaagattctatatattttaaaggtacaggaggtgtagaaaaaaaggattacgaagtaacaattcccctgtataaagaaattgatcctgaacagagtaagagcttcaataaaggaaggtgtattgaaattattgtaactaaagcaaacacagatggaccctactggcctacattaacgtctttcaaaaagaaacaccataggataaaatgtgattccaacaaatactagcataaaactaacacctcctagggattgagcatacaattcaattcgcatttatatttccttttctcggcaacaactaagattacactctttcatattttcttatattgttatacctatctttatatcttatta

SEQ ID NO: 1340 - DNA, 869 bp, Diabrotica virgifera
tacacgtcttccggcataaattgaaaatgtacagttggcctttaagtgcaaacatgagagctgtgatgtaccactcggtgctcttgttaatttgttttttagttagtttttcaattgagtgcaccaactatgggtaccccttcgagaatcacctagcacagatgactccttataggatagtatctaataagagttttgaccggatagaatatagaggttgtacaccaaaaaagatatggatgatggtaagacatgggactaggaatccaaaatattctgtgattgaacaaatgctggctcgtttgcctgagattagaaaacttctagtggagagtacatctttaccaaatgatcatgtaaaaaatagggacctcgatcttcttcgcaaatggaaactcacattagacgtagacgacaagaataaactaacccacgaaggtgaggaagaaatgctggttttagccgaaagaatgcagagcaggttccctgaattattcgacgaagtctacagtaacacatcatataagtttaagtacactcattcacaaagaacactgaggagcgcctattttttcgcagcaggattatttggaaaagctacggccaaagatgtgtggttcccagcacctttgaggaaggatccaattttaaggttttataaattgtgtgataaatggaatgttgaagtcaaaaagaatcctgctgccttgagagaggtaaccatattcgaaaatggtccagaaatggcgaagttggtgaaagaggttaataagaatttggcattcgaagaacacgaggtaaacaaagatgacgtattgctgatgtaccaaatgtgtgcatttgaaacagcatggaacaaaaagagaaat

SEQ ID NO: 1341 - DNA, 1083 bp, Diabrotica virgifera
  misc_feature (1048)..(1048): n is a, c, g, or t
ggtcggcgtaattaacaggttctttgcgttctttccgagtgagtcacttcttatctcttctattgtttttcgggtagtgtgaattaactttttttttctcacaacatattcatttcttgtgtgtagttttattaacagaaaaagaaaaatgtcgctgtacccgagtttagaagacatgaaaatggaccaaatggccaatgcccaatacagccacattcaaaggagtattgccgccccacaagccactgctcccggtgctccaccaccttacacatatcctggatttgattccatgcctgtcctccctgcattgggggccgacaataaacaactttacccctcattaggggaatttatggggctagaattaagtgaagctgtcattgcagagaacatgccagagtattcccaggtggttctctatcaacagagcgttgttccccaaactacatcaactggcctaatagctcccatttctggacaatcagtcggccttcaaagagctcaggtcactcacggtgttcgccaattgatactctgcaaagataaagataacaaagtgggagttcgcgtcaaatccatcaacaaaggtgtattcgtctgtgtcgttgtagagaactcgccagccgccatggcagggttgcgatttggagatcaaatcttgcaaattaacgatgaaaacgtcgctggatatacgatggaaaaggtccacgctatgttcaagaagagccccgtgaacggtatcaacgtagttgtcagagacaggcccttcgaaagaactatcactttacacaaagacagcgtgggttgtataggattccaatacaagaacggtaaaattatcacaattgttaaggactcttcggccgctaggaacgttgttctgatcgaacatcagctatggtatgtggatatgccatctccgtctacctgaaagtaaccgaaattactaacatcatacagccaaccaaatgtctcaagtgaatcaacatctccacattattcaatataatttttctatttttatttttttttttttttaggaaangatgtaaaaagaaaagaatatacaaatgacgtttt

SEQ ID NO: 1342 - DNA, 1140 bp, Diabrotica virgifera
ctagaactagtccgaaatggcggagaacataaattcagtgcttaatgcgcttatttttgattttttaacaaaaaagaatatcaaacttgctccccagtttcaaaaagaactcaaaccggcatctttagtaaaaggatcaccagtacttgctgaaatagtgtcacattatttaaaatcaggtccaaaggcaaaacaattaaaagtgaatgcagaagacagtgacgaatccagcagcgaggaggaagaaacaccaaaaactaagccaattgtaaacggaaatgtaaaatcaaataaaaaagacagcagctctgaagattcttcagatgaggaagaacaacctaaaactgttaaaccatccattaaacctatacaaaagaaaccagaaagttctggtgattcctcttctgatgaggaggaagtaaaaaaaccatcagtgaaacctttacaaaagcaagcacagattccagtcaaagcagcagtaacaaaagatagttctgaagattcttcagaagattcatcagatgagccagaaaaggctcctgctaagccagttcaaaagaaagcaccaccagtacccaaacaagctacaaaaaatgttcaaaagaaagaaagtagttcagaagattcatccgaggaagaagttgccagtaaaccagtgccaaccaaacaaccacaaaataagcctcaaaaagaagaaagttctgatgaaagttcatccgaggaagaggctcctaagaaaccggctcctaagaaaccagctcctaaaccttcagtggttaccaaaaaagctgaatctagctcagaggattcctctgatgaggatgaacctgttaagaaacctgttgcaaaagcaacagcaacaaaagttataccaccaaaaatacaaaagaaacaagaaagcagtagtgaggatagttcaccagaagaagaagaagcacctaagaaaactgtaaatcccacaccagtaaaagcaaaaccagctcaaactggtgtgaagaggaaagctgaaagtagttcatctgaagaatcatcagatgaagaacctccagcgaaaaaacctgcagttgctcctgcaaaaaaaccagcagctgttataactcagaaaaagtcggttccaaagaaagagagcagttcagatga

SEQ ID NO: 1343 - DNA, 1582 bp, Diabrotica virgifera
ggctcctgctaagccagttcaaaagaaagcaccaccagtacccaaacaagctacaactgttaaaccatccattaaacctatacaaaagaaaccagaaagttctgatgattcctcttctgatgaggaggaagtaaaaaaaccatcagtgaaacctttacaaaagcaagcacagattccagtcaaagcagcagtaacaaaagatagttctgaagattcttcagaagattcatcagatgagccagaaaaggctcctgctaagccagttcaaaagaaagcaccaccagtacccaaacaagctacaaaaaatgttcaaaagaaagaaagtagttcagaagattcatccgaggaagaagttgccagtaaaccagtgccaaccaaacaaccacaaaataagcctcaaaaagaagaaagttctgatgaaagttcatccgaggaagaggctcctaagaaaccggctcctaagaaaccagctcctaaaccttcagtggttaccaaaaaagctgaatctagctcagaggattcctctgatgaggatgaacctgttaagaaacctgttgcaaaagcaacagcaacaaaagttataccaccaaaaatacaaaagaaacaagaaagcagtagtgaggatagttcatcagaagaagaagaagcacctaagaaaactgtaaatcccacaccagtaaaagcaaaaccagctcaaactggtgtgaagaggaaagctgaaagtagttcatctgaagaatcatcagatgaagaacctccagcgaaaaaacctgcagttgctcctgcaaaaaaaccagcagctgttataactcagaaaaagtcggttccaaagaaagagagcagttcagatgattcatccagtgaagaagaaacaccagcagtcaaaaaacttactccagctccacaaaacaaatctacagcaaagaaagaagaaagcagttctgaagattcatctgaagaggaaacgaaaaaacctgctcccaaaccacaacctgtaactaaaaaagctacatctaataaaaaggaaagttcatcagatgatgacagtgacgatgaagatgatgaagatgaaaaaccagctttaaaaaaagccgctgtcacctctacacttaaaaagcctgctaaaaaagagtcatcggatgatgacgatgacgacgaagaggaagaaacaaacacctcaaagcaacaggaagatgagaatgaagaaagtgaacttaaaattaaaaaacccaaatatgacaattttgttaaagcgggccaaaataaaagttttgatggaaatgacaagggcgatagaaattcgttcggtggccgtgggggtagaggtaggggaggccggggtggcttccgtggtggattcaacaacagaaattctgacggcgacgggggtgaaagaaatagctggggaggaggaaataatcgtggaggtggattccgcggaggcaggggaggaaaccgcggaagaggcgatggcggtttcagaaattcgtttggtaacgatagaggagggggtaggggcggttttagaaaatcgtttggcgataatgataaaggcggtagaaagtgggaggttcggggatag

SEQ ID NO: 1344 - DNA, 2623 bp, Diabrotica virgifera
cgaaatggcggagaacataaattcagtgcttaatgcgcttatttttgattttttaacaaaaaagaatatcaaacttgctccccagtttcaaaaagaactcaaaccggcatctttagtaaaaggatcaccagtacttgctgaaatagtgtcacattatttaaaatcaggtccaaaggcaaaacaattaaaagtgaatgcagaagacagtgacgaatccagcagcgaggaggaagaaacaccaaaaactaagccaattgtaaacggaaatgtaaaatcaaataaaaaagacagcagctctgaagattcttcagatgaggaagaacaacctaaaactgttaaaccatccattaaacctatacaaaagaaaccagaaagttctggtgattcctcttctgatgaggaggaagtaaaaaaaccatcagtgaaacctttacaaaagcaagcacagattccagtcaaagcagcagtaacaaaagatagttctgaagattcttcagaagattcatcagatgagccagaaaaggctcctgctaagccagttcaaaagaaagcaccaccagtacccaaacaagctacaaaaaatgttcaaaagaaagaaagtagttcagatgattcatccagtgaagaagaaacaccagcagtcaaaaaacttactccagctccacaaaacaaatctacagcaaagaaagaagaaagcagttctgaagatagatctgaagaggaaacgaaaaaacctgctcccaaaccacaacctgtaactaaaaaagctacatctaataaaaaggaaagttcatcagatgatgacagtgacgatgaagatgatgaagatgaaaaaccagctttaaaaaaagccgctgtcacctctacacttaaaaagcctgctaaaaaagagtcatcggatgatgacgatgacgacgaagaggaagaaacaaacacctcaaagcaacaggaagatgagaatgaagaaagtgaacttaaaattaaaaaacccaaatatgacaattttgttaaagcgggccaaaataaaagttttgatggaaatgacaagggcgatagaaattcgttcggtggccgtgggggtagaggtaggggaggccggggtggcttccgtggtggattcaacaacagaaattctgacggcgacgggggtgaaagaaatagctggggaggaggaaataatcgtggaggtggattccgcggaggcaggggaggaaaccgcggaagaggcgatggcggtttcagaaattcgtttggtaacgatagaggaggtggtaggggcggttttagaaaatcgtttggcgataatgatagaggcggtagaggtgggaggttcggtgataggggcggaagaggaggaggattcagaggtgataggaatggcaggggaggtggtttcaataacagtttcaatgagagagacagttttggtgctaagtctgcagaaaataagaaaattactttcgacgattaaatggacgaattttttatgttaaatgctaatgcaagaggatcctggggcgagaaggcaaattatgatttgaaacatactcgtggaaaatctttcagacatgagaaaacgaaaaagaagcggggatcctaccgcggaggcaccatcgatacttctattaattccattaagtttgactagattactctcaaattgtttctttatcatatttactgtaatttatatacctatagttatttaattaattttaaggtatctttaaactctttaattgagcggagaacacacatatactaaactgattgagaacagatttgttgaggtttggtttaaatatttctttgccatcgttgtgtcaattaaataactgctttgtcggtaacactcaaaagatatttcagatgtaatcgagatagaattgttcatttgagaatttaaattgatttaagaaaatgtatataaaataaatatattccgtctcaatatttatgattatcctaagacctatcacttgtgggctgttatattagtcccccttgctatttaatcatttaaattaacgttgttgtttgaactaagagctccttttaatctagtatacaaaaagttctcccgcacttccatagatttcttatttttaatcataactcaattttcatcaacgttatatctacacaggctacaatgttatcgtgcaatcaggaattacaatcaccatagattttttaaccacgtctggtttgtgattgtgatggcaaatgttttatccttgaactaatgaaaaaaaatttaagtttatacatattggcgaacagtttgataaatatagtaagtgtttttctcctgactcagattttgtatttttttacaaagacgttccatacaaaacgatacttttttgtggaaagttatcatggtagtatgttagaatggtgccttctcatttcataactatacttaagattttatgttacgtgtaaatagtatttctgtgatttggaccgactttttaaatcacttccaagtgctgcatattgtggtactttctgtgattcagaaacattgtaccggatttaaacataaaatgcgtctagaattgttgtatggatattttttattaaaacaataaatattataaaacaaaaacggacaagg

SEQ ID NO: 1345 - DNA, 958 bp, Diabrotica virgifera
cattccgcgtccgatgaaataccattcctgcattttcattatttttcttatatttttgaaagttacttgcagtgaaaaagataacaaaggcgatgaatttgttgctacggaagaatggcaaaccataaaagaaggtcagaaagtaccaagtggcttacattatcgtataaatgtccaaacaggtcttaaagaagcaaaactaatcggaaaagatcatgacgatacaaataaagaaaccagtgttctggaagtcccttccgaaaaaacacaagatcacccaaccattgatgagctgaaagaagtgatgaagaaaattaaaaatgatgatgtaaagcctggtgggaaagtaaaatctgattttcgaacttatgaacaattgaaagaggaattaggatccttaaatttaacttctaaggtagatgctgagattctacaagacctttttaaacagcaccaaaaagaaattactaaagaaaagataaatgttagatcagtacttaatattctagaagattttgattacttgggccaccagtttgatactgggttagagtttgttcgccaaaatggttttagagatgttatttacaaaaatttaaattccactcatgagcagatcaaacagaatacattgaagttgtttggatctctggttcagaacaatgctagggtacaaatccatgcactagaaacaggcagtattccaattctcttgagatttttaagctctgatcagacagagcttactacaagcaatgctttgtttgccttgagttgtcttgtaagaagattccctttggcacagaagagatttttaaaaatggtggagtatttgtgattttacagatcttaaagaaggattccataaaactacaactaaaaaaagtcactttaatgactgtgatttgttccttgaaaaaagacaaaccccaaaataacttaaacaggtttagttttg

SEQ ID NO: 1346 - DNA, 926 bp, Diabrotica virgifera
  misc_feature (911)..(911): n is a, c, g, or t
acagacagttattacagtacaaacaagataaacgttttcggttgttcaaaatgttcgtaacgcaccatttttctatcgacgaggtgaataatttacttagtgagagtttcgttaggatttttggaaatgtggttgaacactttcccgctgctgcaattggaattttaaaatgcaggccttttaacaacagcaatgccttgattcaagcgatttgtgacttcttggatggcttaaaagcacatgaaaaagaaaagatttttcaactgtaccccgacatcttagacagcgccctatgcacatcccccatgatatacgacaaagaaccatcatttgttaacatcgaagaaaagaggaagcttcaggagctaaacagtcgctataaagacaaattcggctaccctttcatcaccaccatcagcgatcacaaccatctctactcagaaatccagtccagaatggaaaacaacaaagatgatgagcttcaaaggaccttaagggaggttaaggcgattgtgtatttgagagtccaggacattgtaagctaaagaagtttaaaagacgtttagggacgagacgaaagcctttaataaggttcagctgtgtcgactggcgcacgttagagtacgaagaagtttattttacacatggatttgagtttatctacgaagtagaccactattatctaatatttattatattgatatggctttataaagagagcttgctgagtttactaactttgtttaaacctctagatactcagtatctttctcctagttcatcttcgcttattgactgatggctttcgatgttattctgataagtactagaataatttgtgatgttaggtactcttaataacatttagtcattgaaacatactcctgacaccaaattttctcgaaaagttngctttttactctatt

SEQ ID NO: 1347 - DNA, 920 bp, Diabrotica virgifera
gttaattaaaatttcgtgatttactctaatacataacgtaccggttaaatagtttaaaattttggtgaaatcgtaaagtattaaattcaacatgagtccatcacctcccacaccatttacatatcctttcaagaggccgtggctaaaggactatggtgcagctgctcctgttggaggcggaagtattggtcttaagggaatcatagcagggggtataactggtggtatagaaatttgtatcacatttccaacggaatatgtaaagacgcagctccaattagacgagaaaggagataagaagaaatacaatggtatcgcagactgtgtaaagaaaactgttaaaagtcatgggttcttcggtctgtacagaggtcttagcgtattattgtatggttcaatcccaaaaagcgctgtaaggtttggtgcctttgaaagttttaagaataaaatgcaaaggcctgatggcacccttagcatatctggtagattactttgtggtatgggagctggtgtttgtgaagctattttagccgtgactccaatggaaactgttaaggtgaaattcattaatgaccagagatctcaaacgcctaggtttaagggatttctgcatggtgtaaagatgatcgtcagggaagaaggtattggtggtgtatacaaaggagttacagcgacgataattaaacagggttctaatcaggcgatacgattcttcgttatggagactttaaaagatgcttacaagggaggcgatcgtgataagaagattcctaagatagttgtaggtgctatgggtgcttttgcaggtgcttgctcagtatacggaaacaatcccatcgacgttgtgaagacccgtatgcaaggtttaaaagcgaaaaagtacaaaaatacccttggactgcgccgttaaattatgaaaa

SEQ ID NO: 1348 - DNA, 953 bp, Diabrotica virgifera
cacaagtcacaaacgaatacttagcatttaatgagaaatttggaccagtagacaagcttcaaactaggatgttcttggtaggacctaaagtaggagaagaattcgaagtgaccatcgaaagaggaaaaactctaggcattaaaactctagcagtagctgaagacttaacagaaaacggtgagagagaagtattctttgaacttaatggtactctgcgatcagtcttgatcagagacaagtctgcaggtgaagaattacacctccatcctaaagccgagaaaaccaacaaaaaacaagtaggagctcctatgcccggtaccgtaattgatattagaataaaggctggtgacaaagtagagaaaggtacaccattagtaatcctttctgccatgaaaatggaaacagtagtccaaagtcctgtagctggagttgtcaaaacgatagacgctgccatgggaatgaaacttgaagctgaagatttaattattactttagaataggtactactttcaggaacgctattatacagagcctggtcataattttagtaacattatagttggttctttaaaagaagatactcataagagactttgtgacactacgtgcctattggagagtgtaatatacgtctttatcaccatattggtactgatagcgtactcaaaaaacttgattttctcaagttatctatgactatcagtgtttggatcttctatcatgcgtttcatcacagaagttgttctcgtgtgatgacacaacttccaagtaggtggtacattttgacgatacatttattcccaagacttattttaagataaaactctgttgcgcggttgacctcacaagtttaaatccaggttgatacccctcatgattttattgggtccatggtgatacacatgtcaattattttggttctgctagtatagatgtctgtaacatccccctat

SEQ ID NO: 1349 - DNA, 944 bp, Diabrotica virgifera
attctaaaatacctgcgtttactgcacagacgaaagtatgtatctttttcaacaaatatcggcattcatttaaaaaaatatgtccttgtaagtagcaaatttaaaaagctttctctagatttgcaaaatatgaataggcaagacatggtaatttttttaaaagctcattaaatatgaacgttgctcagaaaattaaatacttggaatgcttgcgatggtcttacacggtcccaattttatgttatttggcattttttgtcatgatttggatgctggcagtacctttaaaacacaatataaaaattgtcaaggatttgaaagtgaatgtagaggattcttttgaaatccgaataaagaacagtaacttcaatactgataaacgaggcgaagaggaattgattgataaaaacgaatatttggttgattttaataaggatggtactcgaactctactggaagtttttgaaaaggctgataaagacaaaaacaacaagctagattcaagagagttggcgatgtggattagacaaaaaattgtggaacatatttctactgctatcagttcaaatttggaactttttagtcttattgatattagtcctcaaaatggtgtgatcacttggagagaatatcatacatactttttaaaaaagaggggttttagtgacaaatttattggagatcatgatgaaaaaaggcataggggacttgagagatcgcttaaaggtacgtatttatcagaaagaataatgagagataaagccgcatggactgaagcagccaaatcgaacccaaatacattaactatagatgaatttttgtcctttactcatcccgaatcgagtgttacaaaccaattgatgctagtggacgaactgtttgataaatttgtagagatggtgatgagcttttgacagaagatggagttgccggtctacaactga

SEQ ID NO: 1350 - DNA, 1206 bp, Diabrotica virgifera
  misc_feature (1160)..(1160): n is a, c, g, or t
gtctcttctgacaaacaataatgtcatcgatgttattgtattgttagctacgatagttttattgggtattgcctatgtaagatattgttatgggtattggaaaagaaagggggttgtgcagttaaggcctcaattccctttgggaaattatggaaataatcttccacgaggaatctcaataggagccgtaaccaagaagttctacgatgagtttagaagaaaaggattgaaatttggaggtgtatatttgggactagacccatatttagtaatagtagatccgatatatgctaaagacattttaacaaaagattttcagtactttactgatagagcactgtattttagtaagaagagtcctataaccgtacatattttatctcaagaaggtacagaatggagagaggcaagggccaaatttaccaacatattcacctctgcaaagatgagattctttttcgaaactctaaaaaaatgcagcgaagatttacaatcaaccttgaaagaatacgttgatcaggataaagatgttgatatatttgagactgtagcttgttatacaaccgacatcattggagatgtagtttacggcattcaagctcaaagtttctccaaggaaggtgctattttcagacaaatgggaagagagctgtttaacgtattcagtaaattctttcaatttaagattttaatgaccatctgttaccccaaaatcgcaaaaatgctgggcatagtcaatattcaaggccatattggagagttcttcatgaaatttttaaaagaagctatggatgtgagggtagcgaacaaggctactagatcagattttcttcagctgctcattgagatgaagaattctggtgttgatcttactgacgatgaaatggcttctcaggcatttttgtttttcaccgctggatttgagacctcttcgatgtctagcagtctgacattatttgagctaagtcaacatcaagatgttcaagataaaataagggaagaaattaatgctgtattgaagaaacacgacgataaaatatcgtacgacgtactgaaagagatgaaacttttagatcaagcttttaatgagactgcgaggaagtatcctgttctatccacaataactagggtctgtacgaaggattataaactcgaagacnaacgatttgttatcaaaaaaggtactcctgtgctactcccgctttt

SEQ ID NO: 1351 - DNA, 945 bp, Diabrotica virgifera
  misc_feature (912)..(912): n is a, c, g, or t
ttctttcacgcgtagcaaaaacgataccaaaagtgcattattccgctcgttgaagatcagtttgtgacgaaaagatgcgccctcctacacaatacccccaagatatcgcccaagagtccgaggccgaaagtgaacccgaccccaggatgggggcgatgatgatctgcaccaggctggctggaagggctgtcatcagggtcatcggaaggtgcaacgatgctaaagaaaatgaaaatcttgatttatccgattgccagttaatgcaagttcctgatgcagtgtaccacctgatgaggcacaccgagctcaaaacctgtgatctcagtgacaacgtcattacaaaaatacctccaaagtttgccgccaaattcaaccaaatcacagagctcaacttatctcacaatcaagtgtcgaagttgcctgatgaatgcgtaagcctaggtgcgcttgagagactggatatatcgcacaacaccttcatagaattgcccgattgtattttcaaaattcccaaattacggcatcttaatgccagcaataatagtatagttgatttagatgtagattgtttaaaagatgcaccatcgttagaatcagtagacctaacaaataacccattggcaccgagaatatatgaacaattatctagattatcagatctccgaatactgctcactcccagagagaaagaagattgggaagatctcaccatttaatatttacgtaatatattttgtggcaaatgctatagactgaagacagctaattgataggttcagttatagcggactacttcctaaattgtgttccctcagagacgtatctcgattgtagctgtagatcagagtatgtagtcgaattatgactaataatgtaaatgcacatataaataaatatgtacaaatatacaanggtataatctcccttttttgtagtctttaatct

SEQ ID NO: 1352 - DNA, 926 bp, Diabrotica virgifera
ggatttctaggggaaattgaagctcccgtctagggatattctgaaatttcatctggcaaccctgattaaaaattagtcctaaaagatataagaaaacagcataaaacgtgtgataataggaaaactataatataaggatggtatcaattttttgaataacacaaatcaagagaaattttatattttactaaagtaataaaatgggtatcttttttagtaaaaaaaagcctccctccagagtaacagaacacgataaagcagtgttacagctcaaacagcaaagagataaattgagacaataccaaaaaagaattgagctctcacttggtaaagataaagatatagctaagaagttacttaacaatggccaaagagacagagcaaaacttttacttaagaagaagaggtatcaagaacagctgttgtccaagctagatgtacaacttgataatctcgataaaatggctagtgatatagagttcgcccagttagaaactcaagtagtgagtggtctaaaagcaggcaacgaagctttgaaacaaattaatgattccctcaaaattgaagatattgaacgtatattggatgaaacaagagaagggattgacaaacagaatgagattaacgaacttcttagtggtcaattgacagatgaagatgaagcagctgtagaagaagaattggctggtatgattgagcaagagatgccttccgtgccttcagaagaacctaaagtggaagtcaatgaggaagaatcagaggatgaagaggaggtagctgataaagaaaaaccaaagcaaaaggaaaaacggaaagaggaacgtgtagcagtgatggcctaacaaattgttactttgttggtatttttcaaccatgtatgtaaatttcttaagttatttataagtaaagtaaacaaaactttttat

SEQ ID NO: 1353 - DNA, 1058 bp, Diabrotica virgifera
  misc_feature (774)..(774): n is a, c, g, or t
  misc_feature (810)..(810): n is a, c, g, or t
  misc_feature (905)..(905): n is a, c, g, or t
  misc_feature (944)..(944): n is a, c, g, or t
  misc_feature (1009)..(1009): n is a, c, g, or t
gttaattataataattcacttaataattttgaggaaatataaaggatttgtttcaaaactgacacttttaattattaaaacaaaaagttatagctgtcacttcaagattccacggtaacttttttggatttttttcatggctatcatctgcctatctttcatctggctttcatttggctgtctttcatgcctatcttcatacttcattctattaactattagatgtttctttccgaaatacctcccaaagctattgggaaaattatacctgacttgaacggcattcttgaaaaatagtgaactggaatttagagtaccaacacccatcttatctgtgataaatatattaaagaaccagctttcttaaaattcttgtttttccgacattgctagcttttggtccttatgattactataaacttttaatgtgagttataaatgtaatattcatgtctacaataaaattaataagtgttaaatgtattttcttattgttgagtactgtaagagcaacatgaaaacactgaattgaatcgaattttgtccatgagatttagaaagtcatccttcctatatacaccatttacattatatatgacaatagtatttttattatctttttggatttatataaacctagtgacttgttgttcaagtagtagtacaataattgttaaagaaaatgtagccttgttacaagaaattagggtactcgaaaaagcttctggcctattttgtgtgttaggtcttcactattgaaaaatacactaattntgtaggaatgtatcttgtttgttaattattttgtanataaaatcacatatacccctgttattgtatagtaaatatgttaaaagtgggcttaagtctacattatttcatgtaaattcgtattattttcatcncattgtcacatccaaaggtgaagggcttaattaatattngtcatagtttagtaacttttgattgtacataatatataaaatcaattcagtaccatttaatctgntgccaaaacagggtaaactatatgtcatcttaataaattattctatagc

SEQ ID NO: 1354 - DNA, 821 bp, Diabrotica virgifera
ctagtgtatcaaatatcatgaatgccttaaccactttcattgcaatttgctgtttatcagtaacagcaaaggcgagaccaggaattgggtcaacaaagctagaaggtattccggatctgcaaacttttggtggaatctcttaccccaaatatgacatacttcatcttggtgaatattccaaaggatttgtacccggagataccattcatgaaagcaaacacgaaacaattactgtaccaaaaccctaccccgtaaaaattccagtcccccatccctatccagttcacatttccaaaccctatcctgttgttgagactaagtacgtcaaagtaccatatgcagtgccccatgaaattgtcaaacatgttcccgttcccgtagaagtgccaaaaccatacccagtgtcggtgcatgaacatggtgattctcatggagcaggatcctcacccgtctatggagtacaaaatggtggagaacattatggaacttccgaacaggtctcaaactatgaaacacaggaacccaatatcgaagaaggtggtttaagcgggcatcaagaaaacagtttaacggacggtaacccaggctgggtaccagttgaacatcacgaagagtaaagagtaacttagttattatttgttttaatttctagactgatcaaaggtatgtttttttgttgaataaaattgttgtttgctaaaaacaaaaaaaaaaaaaaaaaaaaaaaagctaaaacttattaaaaaatttaccaaaacaaaaaaaaccaaaaaaaaaaaataatactacaaaaaaatcatgaaaaaatatgggggggccgc

SEQ ID NO: 1355 - DNA, 1128 bp, Diabrotica virgifera
gtcacaactgcggtttaatagtgatagaaaaataagtttttttttttaaatttactaagcgaaaaagaacaccatgttgacgacctcagatcttctactcacagatcgaagaaaaataagagaggaatggaaaaaatctgattttcaaattggcgcagacattgatattataaaaagatggtgcaaaactcaaaagcaccttccagagctaccatgtgataatacgatagaatattttttaacaaactgcaaatttagcatcgaaaaaacaaaacagaatttagacatgtattattcaattccaaacttattgccagaaatgtatgaaaagaagcatccttgcctagataagatgaaaaatgtagaaaaagtcgcatatatgataccgatgccacgtttaaccgaaaatttacatagaataacagtggtaaaatttagggatagtgatcctgatttatttgttcctgtagactattccgcatttctctttaggaatatatttgaaattaaaaatcgagaagatctgacaatgggagaaataattataatagattacaaatattttaaatttggtcacgttataaaaatatcaccattgtttgcaaaaaactgtgcatttattttagaaaaagtttggtctaatcgattaagagaattgcattttatcaatgctcccgtcttcatagataagatcatggccctacttaaagcgttctttagtaaaaaactacaagaaagggtgcacatacattcagatctagaggatctgtttaaactggttccaagggagctgctgccatctgattatggcggaaatgaaccttctttagatgaattccaaagagtatggtcacaaaagtttgaagataacaaataaagatttaatacattaaacacgctgaaagtaaacgaaagtcttcgtgccagaaaaattggaaaatatggaaattttaggatatcatgggaattttaaaaagatcgaagttgactaatatcgtgcagcaccttttgaatataaggtgcatgtatgccatttttaatagagtaatttgattatgtactaatagatgaaaagtctatttgtcaaaaggattgataggacgaggtttcgaagtataaatgcataat

SEQ ID NO: 1356 - DNA, 951 bp, Diabrotica virgifera
  misc_feature (913)..(914): n is a, c, g, or t
  misc_feature (934)..(934): n is a, c, g, or t
tctgtgttggttttcaatcgtctgttccaaacttaaaatatgtcccacccttcattggagtcaccgcaaaaaaaggaaacaacatttaagggtacttttgatttagaagaaccatcacaggagttgttgcaatgggccaaagaaaacataaatgaggatccagatacaagggatctgttgatctctgaactgaaggatatgatatacgaaagaggggaatgcactcctacaaggaccgatgacgagttcctgctgaggtttctaagagcccgccattttattcttaagaaagcacaccgattgtatgtaaactaccacaacttcatccaagaagctcctgaatatttcaaaaatgtcaacttgcaaaagttaacagagatcaagaagacaaaaatgtttaattgtcctttaagtagggatcaaagtggaaggagaatgttgatatataatattggtgaatgggttccatctgacttctcccccacggagcttattcaatttgtgatatttttaattcaaataagtatgttagagcagaagacacagataaacggagtggtggctttgtttgatcttagtggattgtcgctggaaatggtatggtacatgagccccaccttggccaagcatatggtcaatattgctatgacctcaatgccctgtcgtgtagaaggagtgcattttctctacagctcatggatgttcgatacagctttcagcatggttaagggtctagtatcaccgacagtaacagacagaatttattttcacagcgacctggaaactctgtattcccatatagatcccaaataccttcccaactcgttaggtggggctcaagaagattattctttagaatccctggtacatgatatattggagacccatggtgaaacggtgaagactgaattanngaagttaggataccctggtnaaggagtcctttgatct

SEQ ID NO: 1357 - DNA, 1042 bp, Diabrotica virgifera
ctcgtgccggcacgagcggcacgagcccgagcgacatcgaaccaaaatggcaaaaatcgtcctcttcttctgcgccatcattttggcttcagcagctgctttaccaacccaatcagctgacggaggtgttgtcgacatcatcaaaaaggtcgtgcacaagcttgaagacataatggaaaaggtttttactgaaggtcccaatttcatcgacactttccctgacaagtatgacgaccgccttactaaagtgctagatgttacaagggccgtgcttactaaaatcgctcaagcacttaaagttgttatagataaagttgctgaacaaagtaatgatgctggaaagaaattggtttcctgtgtcgaacaacacgaagctgatctcgtcaatatccgcgtcgctctcgtcgaaggtgccggcaaatgcgtaaaagatagcgtcgtcgctttggttaacactggcgcacctttgctcaaagatctaactgaaatccataagcaagcaagagacgccgccgaagaaattgacaattgtgaaggagataatgcagctggtttgctctgcgtttttcaggtcgccatggatattctcaaagttgaccttcagattcccgatgctgtgaaaggtgatatccaacccgtcattgatgccggtaaagcccttcatacagcaggcaaaaagtgcatccacgatcaagtacccgccttctatgctaacactggaaaacttttgggtgaaattgctacatgtgctgctgcctaaattattagaagatgttatgaccttttgcaaaaaaataaaaaaaatttaacataaaaaaaaaaaaaaaaaaagggggggagagggggctctaagaaaaaaaaaaaaaaaaaaaaaaaaaaaacagcggggggggggggggggaaaaagaaatttttttttttttttttatgagggggcggcaaaaaaaaaaaaaatactatttcgggggcgcggggggggggttttaaaaaaaaaaaaaaggagggggggggggagggaaaaaaaaaaaaaagaagggggggg

SEQ ID NO: 1358 - DNA, 907 bp, Diabrotica virgifera
atctgtgcgcggacaaaaaacttgttatcgccgatttattataatttatattatgaagtgactgtgtcggtacttaatagctttatgtatattgtgtttgttttcatttaaattttaaatttctataccaaagatatgagccggttgaacatattcagttttttgaaaatgcttcaagcattgtgttgtgtactgggagttacatcagcatcttcagacccagttatagtctccagagaagaatggggggcccgcgctcctaaaaacatagaaaatatggcgaacccagtaccttacgtcgttatccaccacagttatctaccaccagcttgttacaatttaaccgattgtttcaaagccatgcgttggatgcaagaccttcaccaagacaccaacggttgggcggatattggctacaactttggtgttggcggagatggtagagcctacgaaggaaggggatggtccagagttggtgctcatgctccctattacaacagcaaaagtattggaatatgtataattggagattggacagttgaacttccaccagaaaatcagctagcgacagttcatgagctaatacaaaaaggagtgagagaagggtacatccagaaggactacaaattggtaggccataggcaggttagacaaggtaccgaatgtccgggtgacaggctcttcaaagagatacacaagtggcagaatttttgtgaacaaccagacgagatagcagtaaggacaaacaacacttggttccttaaaaaaactgtacatgacaatagtagggataaggaagataaagatgaagacaataatgacaatggtattaataggttagaaaaaagaactgtttagatttaagtaatacattttatttattattaaaagaaaaaaaaaagggcgg

SEQ ID NO: 1359 - DNA, 1747 bp, Diabrotica virgifera
gttatcaaatttattattggtttgtttgtttatctttgtacctagttccgttaattattaaataaaataggtttagttccgctattattgctagatagagtatgttggatttagaatttgactatttttttgaagaagacaaaattgcctaagtaacttatttgatctgtcttaatgtaccagtacttttataccgaaatgtatccaacggcatattactaccccacgttttatcatgaggatcgcatgggaatgacggttacatcgggaagtgtcaccataagaaaagatgataataacctgattggtatcagcattggtggcggatcgcctttatgtccttgtttatatattgttcaaatttttgacaacacagctgcagcaaaagatggcaccttgcaatcaggagatgaactggtttccgtgaatggtcaatctgtaaaaggaaaaacaaaagttgaagtagcgaaaatgattcaagctgcaaaggatgaagttattattaattataataagttacacgctgatcctggtcaaggtaaaagcttggatatcatcatgaagaaaatgaaacatcggctggtcgaaaatatgagttcctcaacggccgatgccttgggtctatccagagcaattctgtgtaacgataccttagtaaagaaaatgcaagaactgcaagacaccgaagttatgtataggggacttgttgaccactgcaaaagaatgctgcaagctcacatggagctgcagcaggcagttaaggcgatgggggatattttttctggaatagcagtaagggaacctcaacctcgagcaagcgaagcatttagattatttcggtgaacaacatcgtagtattgaaaaaatgggtttagagatggtaaaaaaagtaaaaccagtactttcagatgttggaacatatctttacaaagcgattccagatacaagacttacagtaaaaaaatacgctgataccaaatttgaatatctagcgtattgtttgaaagttaaagaaatggacgacgaagaatgtagctacgctgccttacaagagccgctatatagagttgaaactggaaactatgaatacaggttaattttacgatgtagacaactcgccagatcaagatttgctaaattgagagcagatgtattggttaaaatggaattgctggacaacaaacatgtgcaatcgcttggaggtcatttggttaaagtcataaagggtttgacagagctgcatacaagaactgtagaattactaaatggacctgcgctgtttccggttgaagtcgacttaaccactaacgcttttcaatataaatctacaacccctgtagcacagtacaatgacgatgacaaagaagtcgaggaaggggaagaaatattggatattgaacgtgacgacttcatcgcaaactttagtgtacctagtgcatcaaatgaaacttgaggtaattttattggacgagacctttcacatcttatacaatgtgctatacaaagagaacaagacgaggaagatatggacaacttgacacttttatcttcccctgtgttaccagatactcccccaaaataagcctctaatgccagaatttggaattattttccccttgaatggaattaacaatattggtaggaacttgggaccttggcaataaaaaaaaatattgtaatattatttatatttatcgcgggttgtttataaaacaagaaaaatttattatttaaaatttttttttat

SEQ ID NO: 1360 - DNA, 1053 bp, Diabrotica virgifera
  misc_feature (22)..(23): n is a, c, g, or t
  misc_feature (38)..(39): n is a, c, g, or t
tcacaaaatttttcatctctgnntcgcatgcatttctnnttcggcatgggcatagccacctttacttaaccaagccatgaagtgaaacttggcaacatctattggtagaccgattaattttgacacgtccgcttaaatacttttcactgtatttactgagaaactgaaatattttacaatatttcgtgctccaaattataaagaacattaaaaggtatgttattaagatgattttagttcaatataaaatattttcatataaacttgcgtgcatatagaaatccgtccacttaaaaattttgtcatttttaatgtcttatatttcctaaacctgttggcagatttaagtgattttttttagtatgttatagcttaattctttaacaataccgctgtaataatattgttactaactagttaaatttttatgatgtaccgggcatttataaaatactgaaattaaaacccaactatatagactccggtttccttaacattctgtttttttaattaatttgcttatgtttaacaactagatttgttctttatcaattcaaggtgtttctaaataagttcgataaactttaaggggaaaggaacaaaatgaaaaattttgacgcctgtattttaaatgtactcatttttttcgaattctgagaaaactaataagtatttttgaaaaatttaaacgcagaataaaagattactttattaccgagggccgaaaatcacttagaatgaataaaaagttttttaatgacatatttgaaactaaaaatcacactaaattttcttaggttttcacccctgtaacttataaaataaacacagaagttttcaggaactttgggtccttggtcctaacgtaatctttcactccgcgtttaaacctttgaaaaatacataattagttttcttaggattcgaaaaaatgaataccgcttatattctcattattcgtttttttttgtataataaacgttacttacaaggcattacttttaatattattttgtacaaacttctactaaataatattttcttgttcgactc

SEQ ID NO: 1361 - DNA, 1376 bp, Diabrotica virgifera
ggataatggcatcacatccaaacctcaacttgtttgctgctggacatgatggtggaatggttatattcaagcttgagcgtgaacgtccagcttacacagtacatggcaacctcctgtattatgttaaagaacgttacttacgaaaacttgattttaccacatctaaagatgttccagtcattcagattcgtggtggaggaaaaataccagtttataagatgtcctttaatccagctgaaaatgctgttcttctttctacaagaacttcaaacttggataatagcacatacgatttatatgtgattccaaaagagcaggagagagatgatcaagtaccagaagctgaaagcaaaaggtcttctggacttacggcattatgggttgcaagaaacagatttgccgttttggacaggactcatcaactaattatcaagaacttgaaaaacgaagtcaccaagaaggtacaaactcctacatgtgatgaagtattttatgctggtactggaatgctgttattaagagattctgaacatgttactctgtttgacgttcaacagaagagaactttagcacaagtgaaaattaacaaatgcagatacgttgtctggtcgtctgatatgtcccacttggctctcctttccaaacacaacgtgactatttgtaataggaaattggatgttttatgttgtttacacgaaaatactagagtgaaatctggagcttgggatgatacaggagtttttatttatactacaagcaaccattttgaaatatacacttaaaaacggtgaccaaggaattattataaccctcgatcttccaatatacatcaccagagtaagaggaaaccagatcttttgccttgatcgtgaatgcaaaccacgggtattgacagtggattcaatggaatacaaattcaaacttgcattaattaatcacaaatatgaagaagttttgtatatggttagaaattcaaaattggtgggacaatctatgatttcttacttacaacaaaaaggttatcctgaagtagccttacattttgtaaaagacgacaaaactcgatttactttggctctggaatgtgaaaatattgagattgctctagatgctgcgaaatctttgaatgacaaagcttgttgggatcaactagcacatgctgctctatggcaaggaaaccatcaagtatgtgagatgtgttatcaaaggaccaagagtttcgaaaaattatcattcctatatctgattaccggcaacctggacaaattgagaagaatgatgaaaattgcagatattacaaaagctatatcatctcaatatcatgctgcactgttgcttgctgatactgaagagcgtgttaaacttttgaaggcttc

SEQ ID NO: 1362 - DNA, 889 bp, Diabrotica virgifera
  misc_feature (757)..(757): n is a, c, g, or t
tgaaaacttaaaacaacaaaattgtaaacagtttaatttagtgtaacacagttttaataagcatccaaaatgaacgtcatatcggcaattaaggcctatatagtcaaaatgaccagcgagagcgaaccgggcatgaaagtgctactaatggacaaagacacaacaagtgttatcagtatggtctatgggcaatcagaaattcaacaaaaagaggtatttttactagagcgaatagactctcccagcttcgcaaactcgacaggtcttcgttacttgaagtgcttagccttcctgagactgactcaacagaatatcagtgctctatgtgcagaacttcgaaaccctaagtatggtgcttactatgtctactttagtaatataatagctaaagctgatatcaaaattcttgccgagcatgacgaacacgaggtggttaaagaagtccaagagctttacatggattatttggctgtcaatccacatctgttttctcttggtttaaacgctgctttgacttcactcagttggaatccaagtgctttacaaataagcgtccaaggcattatttctgtattactgtctcttaagaaatgtccagtgattaggtatcaagcaaactcaaatgtttgtaaagatttgggctcaagaatagacgaggttataaataaggaatcttcgctgtttgctttcaaccagatcaatagctctttattacttattttagatcgtagagatgatcctatcacacctttactanatcagtggacttatcaagcaatggtgcacgaattattaacaatatactacacagagttaatttgtccattgtgccaggtcgtgcaaaagaactgtcagaagtggttttatcagttgaacaagacacttttta

SEQ ID NO: 1363 - DNA, 212 bp, Diabrotica virgifera
aaatatagctgctacaccaattatattttaaagtcgaacagacttaataatatagctgctacaccaattatattattaagtctgttcgacttttaaaattttacatgatctgagtttaaaccggtgtgagccaggttggtttctatctttaatttattaatatattttagtacgaaaggaccaaatatataaaataatttttatatttagat

SEQ ID NO: 1364 - DNA, 850 bp, Diabrotica virgifera
ggccgccctttttttttttttttcactaatctttcgtataatgttatagacactttaggttaccctgtatatcgttataattttgtttatttaatgtgacttcaaaaaactgcacacagcgcaattcttacaatcacattgatttcgaggtatgttaagttgcttttaaacgagcaatgtttttactacaatatgtggctccaacaccgagaacaatggccccgccatttatgacaacattaaatgcagcaaatggcaaatgcagggcaacaatggataatggcagcggtctatgttgtcttaaaaggaaatttcaagaaaaaaaaggaaaagaaaaacaacaaaaagattatggattcgaccttactcaaacatgcgtgaaactttagataacataagccttgataatcacttttaaaggcttttcaggagtgtcaaataaaaaatattgcatcgaaaggaaaccactttactgctttaccactgacactaccacttttaatttttttttgctcatttttagcttacgtactcaaatttgaatttttcttaagttccattacttgaaatctcaaatttttcgaggacaacagccgtttattatggatttcgatctttatatattacgacatccacattgcacaacccaggtcgtatgtttttcgataataaaatccataatcctcccatcgaccaactactagtcattttaatcctccagaatttttcaaaacagcaatcaccaaaacaaaattgcaagtattttcgctcgtcaagcgatcgtccggcaattattgtaaaacgatacgagcgatactaaaaatgtgtaaatattaaggtgcgtactgac

SEQ ID NO: 1365 - DNA, 1028 bp, Diabrotica virgifera
aattcccgcggccctttcacgcgtccggcagaatacacgtagaaactttttaattatttataagtgggtcggctctgtggtcggctgacgtgttccgattaattataatcgagaacgatcagagaacgatcacaaattcaacatcaacacgtcaacgcgaatcgatacatgcgcagatttttattctgacagttttattgaaagtcaaagtcatcaagtcatgtttattactcgtccttgtagcaccggcataggtataccaggtataggtgtaaccttattattagcaccgttattagttatagttgctatagtaaaagcaagtgctaaactagaagagcagttttgttccagtgacagtcttgacggttgttctcaatccactaataccatgtcgagtcccgacaactacaaaaatgcgaattctatctacgaattcacagcaaacgacatcaaaggagagccagtatctttggagaaataccggggccatgtatgtatcatagttaacgtagcctcacagtgtggatataccaaaaataactatgcagaattggtcgaattgtacgatgagtatgcagaatctaaaggcctcagaatccttgctttcccgtgtaatcagttcgcaggccaggaaccgggaagtaatgcagaaatttgccaattcatgcagaacaagaatgtcaaatttgatatgttcgaaaaagttaatgtgaatggtaatgacgctcatcccttgtggtcatatttgaagcacaagcaagggggtgttcttggcgattttattaaatggaacttcactaaattcatcatcgataaaaacggacaacctgtggaaagacatggacctaacaccaatcccaaagatatggtcaaatatttagaaaagtattggtaaatgcttatttttttaaattttcttgatgttagtatgactctatattcattgttaagtaatgtttttatatttttattttactataccaaaataaaatgttttaattatttaaaaaaaaagacgggggctc

SEQ ID NO: 1366 - DNA, 953 bp, Diabrotica virgifera
tcttcgcgtccgggggatttttgttcgggattatttgtcctagcttcctcggaaactggtcttggatgactgtcaagaagatgctcccctctgaagatattttgcatggtcccatcaaatcaattgagtgtgtcaaggcttttctacagtggatagttacatttttcctgctggtttcatctgcaatggttacacataagatattttctttgtacatagtcaggccactagtatttttacgctatgcagtaaatgattgtcgcaatccttaaacggttcctattcggggtaggttcctattcggatcctacaatgttgcaaacaatgacgtataaagaatacgtcaatttatggtcgcccctctcatatttatgaatcctcgaaaactaatagagaattatatgagaaaaataacaagataacaagtggagttgacaacgcttctaaaccttatatcaaaggcctatcgctcttccgtgtcgccttaaatttaagggcataaaagcttccgaaattcttatcaaaatttgagccttgctttttattatctatcggtaagccaaaaggagctatgcggtcgtttggcttcaaccggcaatttttatgcttacttttttaagtgatatactgttttagtcatgtattgagtaagatattagttgtaagttttttgcttcaattattttggttataacagaagtttttagataaatggtatttctactgaaaataagattgattgcaagtgtgttggaaatttcacaagatgtaacttgtatgatgaacaaataatatattttttggtcgattttgctcatatttatttgtatgtcttatacgcgtttttaaagtatgtacttgatcagtcttgattttggtaaaattactatattgtattggattttgagacaaaatgtcaattgtcactaagtgcataggtacagtttgtcaaa

SEQ ID NO: 1367 - DNA, 1393 bp, Diabrotica virgifera
cgtattgtatttctgtcatgttgtgttatgttaactttaactctaaatttgtgattttaattttaaaaaatagtgcacaactcttttaatttatgtgttgtagtataacttgagttaattctgtaaaattcgtgttgactgaccagagtccacgaataatttgtataactttacgatgactgaacaacatagatttggaaacatcattcaacctataacatgtcatgcttggaataaaaacagaactcaaatctctctgtctccaaacaatcatgaagtgcacatttaccagcggagtgctgccgaatggaaacttttagatacgctgaaccaacatgacttgcgtgtaatgggaatcgactgggctccaaacaccaacagaatcgttacttgtgctgcagaccgaaatgcgtatgtttggactcaagataaggataacaagtggaagccgacattggtgctgttaagaataaacagagcagctacatgtgtgaagtggtccccagatgaaaataaatttgctgtaggatcaggggctcgcttgatctctgtgtgttatttcgagtcagaaaatgattggtgggtgtcaaagcacatcaagaaacctatcagatctacagtgacttgcttggattggcatcctaacaatgtgctacttgctgccggatcttctgatttcaaagtcagagttttttctgcttacattaaggatatcgaaaagactcccgaaccgactgcgtggggttcgaaaatgcctctgggacaattgatggctgaatttgtcaattccaacgttggagggggttgggttcacagccttagtttttctccagatggaaacaaaatttgttgggtttcccacgattcttcgataaacgtggcagatgcaagtaaagggaatgctgtccataaacttcgtaccgagtttttaccatttcttagttgcacttggatcggcaataaatcagtagtggctgctgggcacagctgcattccgatcgtatatggactcaaagataatggtcaattagcctttactgcgaaattggatgcttcccagaagaaggaaagcggaggattgtcggccatgagaatgttccattctttggacaaacaagcaagaagtgaaacctctgataccaatttagactcgattcatcaaaacgccataacttgcgtctgcatttacactggaaaaaaagagaaagcgttgaagatttctacatctggagccgacggacaattggttatttgggacttaaattccctggagagatccattcaaaacctaagaattgagtaaagagaagtgttttaaaaaactactttgaaataaaattttcattttgtgttttttaagttactgaatccgaataaatggcaaaactttaaa

SEQ ID NO: 1368 - DNA, 1013 bp, Diabrotica virgifera
  misc_feature (936)..(936): n is a, c, g, or t
aaaaccaccgaatacagtacggacatccaccaatagtaccgttcttccgttattttttaatatctaacatttttcggtgtttaaatttttggcgggttttgtgcagtgtcgctttaaccatgcaatggaaagagctgaagttgtagaatttatactgcggtttttgcttgtttgaaaagtgttcgacggaaaaactattataaattaaaaagtgtttttttggaattatttttgaaaaatcggacgtagaatttagaacaacatggcgactgtgataagttcaaatcaaagtatggtgtcacaggcctacgactattatgtatggactctatctttatcagattcaagaacaaaaggatggcttttagtagattccccagttccaaccctattgttcatttgtttatatttcttcatagtatggataggaccaaaaatgatggaaaatcgaagaccttataagctatcttggctactagtaccttataatttatatatggcagggctaaacttttatatagcttctaggctatttactgcttcattccgcttgaaatataattacttctgtgaaccttgcagacagaaatacacagctgatgaaatgcagattgcagatgcagtttggtggtactatttttctaaacttttagaattctgtgatactcttttctttatattaagaaaaaagaacaatcaactgtcgttcttacatgtgtaccatcattctactatgttcgccttttggtggattggaattaaatgggtgcccagtggttctaccttcttacctgccatggtcaattctggaatacatgttttgatgtatgcttactacggactctcagtatttggtcccaagttgctcaatatttatggtggaaaaatatttaacgatacttcaactgattcaatttacttgtgccttgatcctgngtgcaaacggaataagaatgggttgttgattccccctaatggatgcactacacacttattgggtatatgatatcatt

SEQ ID NO: 1369 - DNA, 1043 bp, Diabrotica virgifera
gtccatcacgtaatcgggagcttcttcgtatttagtggactgtcaccagaggttaacgtcatcaagaacgctcagagatggtgatcgatagggaagagaatatattatatcgtattcatttattccactggtgcgttcttatttcggttaagtgatagtaccggtcgtactataccatcatcgataaatatggtgcaatattttttacttcttctggcaactgcatgcctaacatcagcatatcccaaagaaaatccggcagaaatcaataatcaacaatatcaacaacggcctgtattcgttcttctggatcaaactcttcaagatcaactgtacgcacaacaaatacaaaatgaagtaagggttaaagcacccctacaagaaatacaacaacctcgaatccaggaactacaacaaccgcgcattcaagagcaacctcagttagaacagcagcaaatttatacaccaggaggctttcaatatggtgacccgcagcttcaatatcctggttataatcaacaagcatttccaagaatccaaccatctattcttctctacggagcaggaggtcagggacaaccaatcttgatcaacccaggaaacccaccaggcaatttcttggtacctcaacaacccggcgttgtttacagaaacaaccctcaaaatcctgtcttcgtgggaggatatcctaatccaaaacctgcgcatattcctccaatcgaaaaggatgctgaagagattcctaccaatcctgccaacattcctccatttcaagcaaagcctagtgaaagcaaacctgaaaaactagaaacattcaccgaagacaattttgtcccttttccaaaaccagcaggtggaaccgacgcttcaggggaagctgagagacgacaaccaccacaacagttcccaaacaacaacaatctgaaaccaggtcaacgattttttattctttacggacagccactgtatcaaaactatcctctaaactatccagaaattccaaactttggattccagcagatcgaacagcccttccagcaact

SEQ ID NO: 1370 - DNA, 1216 bp, Diabrotica virgifera
aatttacttaaaatgttaagatgtaaaataattagtagtgtaattttatttttaattattattcaacattctgttgccataaggacatatactaaagatgatattttgaaattacgagaagaagtaaaagaaatgttttatcatgcttacaatagttacttgaaatttgcatatccatatgatgagctgagaccaattagttgcgatggagtagacacatatggcagctactccttgaccttaatagatgcactggatacattggctatcatgggaaattactcggaatttcaaagagttgtagatatactttcagagaaaaaagattttgatgcaaatatcaatgtttctgtttttgaaacaaacattagaataatagggggccttcttagtgctcatctgctttcccataaggcaggagctaaattagaaccaggatggccttgtaatggccctttattgagattagctgaagatgtagcaaaaagactgatagtagctttcgatactaaaactggcatgccatatggtacagttaatctacacagtggtgttcccaaaggagaaactacagtaacttgtacagcaggtgtaggaacatttattgttgaatttggtacattgagtagattgacaggagatccattatatgaagaggttgctcttaacgctctttattctctgtttaaccacaagtcccatttaggcttatttggaaaccatgtggatacagacactggaagatggacggcacaagatgctggcataggatctggggtggattcttattttgaatacctagtcaaaggttctatcctacttcaaagaccggagctgatggaaatgttttatgaagccaaaaaatccatagacaagtatatgaagaaggatgattggtacatgtgggtttctatgaccaaaggtcaagttacgttgcctgttttccaatctttggaatcatactggcctggagtattgagcttaattggtgaaacatccagcgcaatgaaaactcttcataactaccatcaagtttggcagcaatacggcttcacaccagagttttattacattccccaaaacgaagccggcagtaacaaggaaagttatccgttgcgacctgaattaattgaatctattatgtacttgtatcgagcatctggagatccttttcttcttcaggcgggagaagatattttgagaagtatacagcata

SEQ ID NO: 1371 - DNA, 749 bp, Diabrotica virgifera
atcattttggtgtaaaaatgtttactaagattataatttctattgcctccctttgcctcgttcaggctgctgtccaaccagtagtccaacgaaccccaccagtagtcgcagcagttcctgcagaaaaccccgaatactcctttgcctacgatgtccaagataccttaaccggtgattcgaagagacaaactgaaaaccgcaacggagatgtcgttactggtgaatacagtctgaacgatccagacggtaccagaagaatcgtacaatacagagcagaccccataaatgggttcgtagctgtcgtcagaaaagaaccacttctagcaccactagtacaaccagctgtaggtgtagttcaacaaccctctgtagatagcgtagccatagaagcagcagatttggaacccatagtagctgccgagccacaacgttatgttgccagacaacggcaagttagacctaacaacgaagacttcgaaagcaggagggaacctttggatcccaaaagagctcaacctaaaaacaccaagcctgctaagttggaattggctgacgaacaaccacaaagtttcccagttgcacctgctgcaccggttccagtagctcaatttgccccaaacgtctttagtgctccctacgtgtctgctccagtcgtatccttccctagatattcagctccgttcacttacagtactgtgactgtattctaattataatgtatttattgaagcaactacaaattctacaat

SEQ ID NO: 1372 - DNA, 794 bp, Diabrotica virgifera
ggaaatttgttttttattgttggacagtggctataaacacatggtgtttgagtgatgttttcaatgatctcccatttaaaatcgaactattatgtagaggacgtacaagagcaagtgaggcaatttctacgtagcatgcaataaaacgcatgcattgtccaagggaacactatgtgtttatagttttgtttgaccgtaaaaaggtaaatttttggcaatgcaaatgattaacgtcgatatagtttgacttgagctttcaaatgcggtaggcaaaattgctattgtcttttttgatcaaaagatgttcgtgttaaagaattgcagtgttttctatttttttagagagttcaaccacgttgtttctaagaatatgcatcctactataaggcttgtaggaacattttttgcttggaatgacccacaaaatacaaaagggatgttttgttttgcgagaggtcactgttgcatagttcctctggttctttgtttgtagaaatcttgtcgacatccgaatcggctgttacccggaagattcttgctctacgcttcacgaatacatagggaaacttgagtaggtacatctgactaagggagggcggtgtgcgcgccctggcgacgttactataaggtaacttacgttcatcgaactctttttgatcccagaatatgtgatgtaatttatgacatgtcttttttttacactctgtataatagataacaatacatcggactttgattgacaactttactgctaacattctatacatgttttagcgcgctacactattttgtcg

SEQ ID NO: 1373 - DNA, 821 bp, Diabrotica virgifera
ttttttaaaaaccttaaaataatttacatttataataatgtacttgtttatttaatattatattataataatttatcctgcaagtgattagaaatgtctgctttaaaaagagttcaacagtgggcaacttttgcaagaatttggcatatatatgatgcagcctggcaaaacccatttcattcagctgaacttctaagaaaatacctgatgggcatacacaaacccatatatcatcctatgaatgattgtggagatcatgttatagtcataaacagtgcagatattgctttaccaggagatgaatggaaaaaaagagtttacttccatcatacaggatatccaggtggagctagttggactttagcttgggagttacacaaaaaagatccaacattggttctaaagaaagctgtatataatagcatggatggtaaccttcaaaggagatatacaatggaacgattgcacctcttccctaatgcagatgtccctacgaatttattagcaaatgtttcaaatcaaataaaacagttaagacctaaaccaaagaggctggatacttatccagatgaagaggtgaaacaatttccgaagattattgatctacctaaagattatattttacgataaattggaatataggctgtagtagttttataaataaaaatttatttgataatactaaaaaaaaaaaaaaaaaaaaaaaaaaaaaaaaaaaaaaaaaaaaaaaaaaaaaaaaaaaaaaaaaaaaaaaaaaaaaaacccccaaaaaaaaaaaaaaaaaaaaaaaaaaaaaaaccccaaaaaaaaaaaaggggggg

SEQ ID NO: 1374 - DNA, 1027 bp, Diabrotica virgifera
  misc_feature (922)..(922): n is a, c, g, or t
  misc_feature (936)..(936): n is a, c, g, or t
tttcacgcgtccgggcaaatagacgtgtactttcaaaagaaaaagtaaagttcattattaattgtaattaaacatattaaacccaattaaacaattagtcatgatatatactacagtaggtgataaaaatataatataaagtgaaattctagtgctttaaatatggttgtgctactttcaaaattaactttgtagcctcttaagaatgcaatgcttcctagacgtcgtcgagctggctctgaaactgagccccaagttatagtaggtaacgataattattggactaaccctcagcctaaaacgaatcagtcacacacggtgtatccaaacaatgttacatctgactactatttagaggaagattatatcgaagactacactgaaccagaattagtcatgactgccagagacagaactagtgaatttgtaaatactatacagacattacaaggcaggaacattgctagggcagtagctgctagggacccgaagaaatcgagggttatacaaagtcatagcgagtttatgctaattgcgaagaatgtgggacggcatatagctagcacttatgctaaattggaaaagttgacattgttggcaaaacgaaaatctttatttgacgacaaaacatcagaaatccaagaactcacatatatcataaaaggtgatcttagcaacttgaatcaacaaatagcccaattacaagatgtatctaggaaacagaagcagggatcaagtgggaaacatctacaatcacacacgagtagcattgtcttagcactccaaaaattagcaagtatgtcaacggattttaaacaagtgttagaagttaggacagaaaatttgagacatcagaaaaacagaagggaccagttttcccaaggagggttgcctcctccaactgtggcatcatcctctgctncaggaagtttattngtttcagaaacagatcaagtgagtataaatatggaaagtgcagcattgattccaaagggcagacccaaatccaagcctctttgatgtatga

SEQ ID NO: 1375 - DNA, 340 bp, Diabrotica virgifera
ccggccgacgcctgggccatacgtccgaaaatattaaaataattattccaaatttaaaggatggctgttaggtttggatccgctttaaaggaattacggatacacctctgccaaactggggctgctagcaaaggagtcagagagtttatggaaaagcactatgtacaagtaaaatctagcaatccaaaatttcccatacttgtaagagaatgttctggagttgaaccgaggttgtgggcaagatatgatttaggaaaggaaaaatgtatttcattgaaagatttgtctcctgaaaatgttttgaacagagttcaagctgtacctaaaggtccataaacca

SEQ ID NO: 1376 - DNA, 893 bp, Diabrotica virgifera
aaaacccttaaaactagacgcaataatttgctttgcaacttcaactgcttttagtttgtaaattctttaaaataatgcatattaaaattagaaaagacggtgacgcaaatcaagaatgggttatttcagtatcaaaagtagataaagttagtgtcattgaaaaactggtcgcagaaaagactggtgtaaaacctaaacaacagactcttcttttccaaggaaaaacgcttgaatccaaagtttgcattcttgactaccaaattcaaaacaacaacgttgttcaactatttgttagggacataaataattctgaatcaaaggaaattactaatgggatcagcactgaagaccctgataaaaagttaattgaagccgaaagtagatattatgctgttggtgattttattgatgtgttattggaagatgatgggacctggtatgaagcgtttattctcaaaatatattttaaaaaggaatcatctgaaattttaacccaggaagatgaaaataaactaatcttcagaatcaaaagtgctgaccacataattcctggttttgaaactgatgctggatttaacgacataaggcctaggtcatattttatttatgaaccagaagatctaactcccgaaatgattgtcttagcaaattataatctagaggaaaagactacaagaggccattggtatgactttaaagtacaagaggctagtaaactgaatgtatcaggtaccgctttagttggaaaagacaaaacacctgttgaagattgcaatttaatatttgttgatagaattatgagaatagaacaacccgttctgttaactgaagttagtgctgaagaaaagttgtccagatattcgaaaaaaacaagagatttaccctttcactgc

SEQ ID NO: 1377 - DNA, 1050 bp, Diabrotica virgifera
aaaaatggcatcttcaaatcggggagaggcagttccaaaacaaattcagcaagattgggtaaatagggaatacatagaaattattactattagcatcaagaaaattacagactttttaaactcgtttgatttgtcctgtcgctcaaaacttgctggtttgaacgagaaactaaccatactcgagcgcaaaattgattatttggaagcttgtgtgacaaaaggagaaacacttacatgagaccagcttgtttaatccattctcataatcatgctgtctttttacagatttttaaagtgtttgccatcaaaaacttcacatcaaaacagaacattgttttactggattaatttacaatttaactcattagatattgaacgtaaaaaaaagttaggacctgatcgtacatgtgcggaatggatattaagaaacggtggctctgtgaaatttgttagctttaaggattatttatcggactataatgagttgcctctggaaggtactcttcttcgcattaaagaagtagatgcttcaaatacaagcattatgcattctggatttgaacacttcaacggttgcgaacacatagatttattaaaattacacaagtgtgcttatgttgatgataaagctttagaacagttgcattatttaaaagattctttatgtaaattacaagttacttgttgtccaaatgtaacagataagggaattttgagtttaggggttttaaaaaaattggccaaattaaatatatgtgaccttacttctgttaaatcattagaggatactgtacaaaaattagaaactagtttgcctcattgtgaaatatcatgggtcactggatgagtaattttcaggccttgtagatataaatgtgcattgtaaatatacatattttcatttttacaacacaaatgttttttaaaactaacataattttcattattattatacaaatatgaaagtataatactatttgtctacaagctgaaacataaatggataattatctttagtttttatctcaaatatattttaatttctttttc

SEQ ID NO: 1378 - DNA, 468 bp, Diabrotica virgifera
caaaatgtccaagagaggacgtggtggttccgcgggagcgaagtttaggatctcccttgctcttcctgtaggagcagtaattaattgtgcagataatacaggagcaaagaacttatatgttatcgctgtacaaggtattggtggacgacttaaccgtctgccagctgcaggatctggtgacatgattgtagccacagtcaaaaagggtaaaccagaactcaggaaaaaagtcatgcctgcagtagttatcaggcagcggaaaccatttagaaggaaggatggtgtcttcatttactttgaagataatgctggggttatagtcaataacaaaggtgaaatgaaaggatcagccatcactggtccagttgcaaaagaatgtgcagatttatggcccacaattgcatcaaatgctagcagtattgcttgatgtgtatatgtttaagaaaaataaaataggatattgttctt

SEQ ID NO: 1379 - DNA, 1672 bp, Diabrotica virgifera
  misc_feature (14)..(14): n is a, c, g, or t
atttccccggggtncgaccccacagcgtcccggactagttctagattttcggcatagagtttgggtgttgtgtgttcttgtgatatctgcaacatgcggagaggaactgaacaataaaacgtttccaggatattttatattcggtacagctacagcatcctaccaagtcgaaggtgcatggaacgaggatggcaaaggacaaaacatttgggataattttacgcacgaggatccatcacgaatttttggtaacgctaacggcgatgtagcctgcgactcttatcacaaatacaaggaagatgtggctctattaaaggatttgggagttgatcattatcgtttttctatttcgtggtccagagtcttacctacaggatacagtaatgaagtaaatgaagccggtgttaattattacaaaaacctgataaaagaattaaatgacaacgacatatttcccctagtcaccatgttccactgggataccccacaacctttagaagatataggtggctggaccaatgacactatcatcgatagattcgtggactatgctcagttcctctttgaaacttttggtgacgatgttcagatgtggctgacttttaacgaaccaaaacaaacctgcaatggaggatatggaaacggaattcttgcacccggtatccaatcgcctggcgtaggggaatacttgtgtacccataacgtgatcaaagctcatgctgcagtatggcatttgtatgacgaaaaatacagacggcgtcaaaacggtcaccttggaataactcttgactgtttttttggtgagccagatagtgacagtcaggaagataaagatgctgccgaaagaatgttgcaatttaattacggttggtacgccaatgcaattgtgaatggcaattacccaaaagtaatgagaaatgtgatagccagaagaagtgctgcgcaaggcttatcaaaatctcgtctaccagactttacttcaaaagaaattcaattcattaaaggttcctttgattttcttggtttgaattactacacagtaaatatggtcaaagcaagaggaagcgaagttcctgtggtttccagctgggaaaaagatatggaagtagatatctacctgaaagaggaatggcccaaatcgtcttcctcttggttaaggattgtgccatggggtatgaggaaaatgctgaattggatgaaaaaaacatacggagatgatacggaaatatttattactgaaaatggtgtatcagatgacggttcttccttggacgatcaaatcagaatcgattattatcagcaacacataagtggtgttagagatgctctagacgatggtgttaacgttattggatacacagcttggagtttgatggataacttcgaatggatcagaggatattctgagtgttttggactttaccaagtaaactttactgacgcagatagaccgaggacgccaaagaggtcagtagaattcctcaagaaagttatgaccacaaggtgcgttacagatgtttgtgaagactattaataagtagaaagaaattgtttgtaaatatgaatgttggatttctgttattcagattcaattttttcagattaacaactaattttttgttacttcttgtaccctttcaaaaacgggctctgatctggagggcgaattgtc

SEQ ID NO: 1380 - DNA, 933 bp, Diabrotica virgifera
  misc_feature (895)..(895): n is a, c, g, or t
  misc_feature (909)..(909): n is a, c, g, or t
gaactctgttataattatattagttggttacttactatctgtaggaacatgtgctacaacagggtgcgaaataaacccatttggtagtaaaactccattagtagtaaaatatggtacttcgtctctaatcgaacccacacctggttacaccactctttcatttaccaggaacgctgcagtagagttcgcctgtcctggaactcaaatcatcaagaacggtacatcattaggagacattgtaacagctacatgtaaaacaggcgatgtctttaacatcaatggccacgctgtgcattggtcctatttgtcttgtaataacgtaattaatcccacagttagagaaattactagagcaacagacacaaatgatccaaacaataaatgtgttgataatgttaaaaaattacaaatcattcaaatcgggtttgcactaagttctgaccgtttcaacgaagccatgactgtttgtttcgatagtactactaagcttgcaatatacacctattttgttctatcaaaatctataaattatagggctagaaacgttgccaacccttccttttcgcaggatgatattttttatagaatggggaggtctgtgaatgcgatgtaccaaagtatccagactacttataataccctcgttggattagaggctacgtccactcagtatgttaatacaagtatttttccaaatagaggacatttggctgccaaagctgattttgtgtatgaaccacatcaaagagcgtcgtatagatatgtcaatgcagctccccaatggaacacttttaatggaggtaactgggaaccagtagaaactgacgtaagaaatatgccacaacaaaaacgttgacttaaaagttggacaggagtttatggaattccagccttnccactctcaacttncgaacttgtagatctctatatcta

SEQ ID NO: 1381 - DNA, 1063 bp, Diabrotica virgifera
  misc_feature (954)..(955): n is a, c, g, or t
  misc_feature (1025)..(1025): n is a, c, g, or t
cacgcgtccgaacgtcatgtgaaaaagctaggttatatttttaaaagaaagtaaactttactttaaattagttgatttgatttattcataagaattagtttataagtataaataaaatggcttcgacgtccacttcagaagtaaatgcaggcaatagtaataaacctgtgtgtctaatagttttgggaatggctggtagtggaaaatcatcattagttacaagattagccagttctgacaaaaagccctatgcagtaaatttagatccagcctgtagtaatttaaattattttgcaaatatagatattcgagacacagtgaattataaggaagtaatgaaacaatacaacttaggtccaaatggagcaatagttacatctttaaatttgttttcaacaaagattcccgaagtaattgattttattaaaaaatcacagaatgaattgtgcatattagatacaccaggacaaatagaagttttcacatggtctgtatcaggctcgattataacagatacattggcatcttcatttcctacagttatattgtatgttgtagactgcgtaagaagtacttctcctgtaacatttatgtctaatatgctctatgcttgctccatcttatacaaaaccaggttacccttcattattgttatgaataaaatagatatagtagatcactcatatgccaaagattggatgacgaattttgaagtatttcaagaagctttggaatcggatgaaagttatattagcaatttgacaaggtctatggcgctagccttggatgagttctaccaaaatttgaaagtttgtggtgtgagtgcagccacgggacaaggaattgaagatctgtacaaacttgttgacaaagctgctgaagaatatgaaaatgaatatcgagtagagtgggaaaaactcaaagcagaatctgatgccaaaaaggcagaacaannataagaagataaagagaagcctaatgcagatacatcatctggctctttaataacagagcttcctaatggngagagaactgtcagatatctatttgaggcatcctacaa

SEQ ID NO: 1382 - DNA, 977 bp, Diabrotica virgifera
  misc_feature (883)..(883): n is a, c, g, or t
gtgattgtggtgttttatcggtgttaagacaggatgggtttcggtcaaaaaattctagtccctctagtccttatagaaatgtccctactggttacatccagaataatatatgaccatcagcaagaagataatcacgaagggcaacaagttcaatacaccaattactatggtcacgaagagtctgccacaacagcacatttccaacaacccgtccagtttcccgaggaacatagccaaggtttgcacaaagaggaacacatcgattattacgcaccagccaagtattccttcaaatatggagtcaacgactaccacactggcgatataaaaagccaacacgaatccagagacggagatactgtcaaaggccaatacacacttgtagaacccgacggatctatcagaactgtagactacactgctgacaaacacagtggatttaacgcagtagtgcgcaaatcaggtcccacaaaacacatagaaggaaggcatctggaacaccaacccgaagaagagcaacatatacctcagcatcatttggcagaagatcatgttttaccgcagtatcaactggaacaccaacaggctttggaagaagatgttgaagaaggacatctggaagctgaagatgctagtcaatatgaagaagaagagcattaggtgttatattaagtttaaggacgtaatggtttgtaaataagcgaactcaaagattaaagtagtatcttttaaaattattggagaaaataagaatttttgtttgtaagaaaaagtatcatcatcaactatatttttttataacacttttaacattttgggaacgtaatattcgaatttatacactcacagacaaaaatcttgcatattttgaaattatggtgtngaataaatttttttgtgctgcccgcagtgtcatagaaatatgatttctttcccgaatgccatgttttaatgtatgtaatgaagatcatataaat

SEQ ID NO: 1383 - DNA, 831 bp, Diabrotica virgifera
aataaacattggtagtgctcattcagatttgcgtatttgtttacacccttaattcacataatccatattatgtacagtacgggaagataattcaaggagaacaaatactttacataattatacatatacatagaagtttaaaatgttaattcaaggaatattgaatgtgaccctttgtgcactttatgcccttccaggtccaccacagatacactttcaaggtgacacaatccaattatattctataaatagaatactatgtcctgaaatagatcctgttagagatacaatatttgaattgtacacaagattaaatcctgaagtgccccagattttaagtactggtgatactgaatctttaaaaaagtcaaatatcaactatagtcggcctaccgttattttttttcatggatttttggaatcatcaaagtctgataatgcagtacaaatgagaaatgcatatttgcacataggtgactacaatgttatcctagtaaataacgaaagattgctagcaggattagattatttaacagcggctctaaactgtgaaccgattggcaaattttccgcaaaatttgtagacttcttagtaggccaaggtttacgactatcttcactgcacattatcggcataagtctgggagctcaaatagctggaatgacgggaaaaaatatgaagactggaaaagctaaacgagtaacgggtctagatcctgccggaccattgtttcaagttttcccaaaatccctaaaaatcggtgttggagatggtgagtttgttgatatcttgcatactaatgctttttacactggagaattaaggctatt

SEQ ID NO: 1384 - DNA, 927 bp, Diabrotica virgifera
  misc_feature (845)..(846): n is a, c, g, or t
ctggatgataacattaacattttgtccgcttaagaatgacttacaaactgaaagtaaacttttttgcggccctattttgggcggcggtgttttttgcaaataatcaacctagttgtgccgttttgtcaaaagatttaaaggcgattttacctagtggagatcaaatgccattgatcggatttggtaccagtaaaattttgggcacagaattagttaaaaataccttagatgacgcattagcagcaggttacagactatttgatacagcagctgtttatggtaacgaagaagatattggaaaggcgttaaaggaattgttgccaaaacataatttaaccagaaaagatatttggataacatctaaacttgctgcacgagccgaaactcttggcaaaaatgcctacgctgccttggaaaaatcagtaaaaactatcaactgcgactacttggatttatacttgattcattttcccggaattccatcgcccgaaaagaagaattattcagccctacgcgacgaaagctggcaacaattggttaagggcgtcaaaaatggtttaaccagaaatatcggagtatcaaactataatgttcatcatttaactgaactagttaataatgatcatggtgttaaagttgcagttgatcaggtagagtggaatccacgttttcatcaagatgatctcataaacttctgcaaacagaatggaatccttcttcaagcatacttctccataggaggaacaggcaatacagatttaataaataacgttgaagtaaaaaaaattgctgaaaaattaggcaaacacccggcacaggtgctgttgcgttgggccgtacaacannaatgtgcagttattccaaaatcactatcaagaaaaactatggactcaaatctagatttgaatttcgaaataccacaagctg

SEQ ID NO: 1385 - DNA, 873 bp, Diabrotica virgifera
gttagatctaaatgaaaattttattatttaggatagaaattttcaatgaaataattattaattagaataattttttcctgatttataaccatgacagaagacgtccaaagacattctgttcacactcttgtgttcaggtctttaaaacgatctcatgatatgtttttagccaaccaaggaattctgccatcaattgatgatactgcagaaaaaatacgaaggttggttaaggcaagagactcttatggtatggtattcgatgacgttaaaagaatgcaagccatgaaaaacctgagggacgctgaagctggtccaaatccaccccctcctggaacagcagagactccagatggtcagccagcagacagtgcagtggttccttacactgataatagtttagtattaaaaagccaacaaaatactaatcagaatcaattgagtaatcaattgaaaagggcacctacaatgccaaaaccaaaatggcacgctccatggaaactgtacagagtaattgctggacatttggggtgggtgaaatgtgtggctgtagaaccaggaaatgagtggtttgctacaggagcagcagatagaattataaaaatttgggatttggctacaggccaggtaaaagtttcactaactggacatgtcagtacagtccgaggtttggccattagtcctagacatccttacttgtttaattgtggcgaggatagacaagtgaaatgttgggatcttgaatacaataaggttgtcaggcattatcatgggcatttgtcagctgtatattcattatcacttcatcccacaattgatgtactgttgacagctggtcgagactctactgccagagagtgggatatgcggaccaaa

SEQ ID NO: 1386 - DNA, 938 bp, Diabrotica virgifera
  misc_feature (775)..(775): n is a, c, g, or t
aaactaaccaataaaattgtgacaactaataatttaaaataattaattaaatgctttatttatccactaatccactttatcggcaacaattagaagagaagaagaaataatagttcttgtgcttgcttggttataaaataattatacaattagcttaaatgatacaatattgaagaatattaacagtttaatatgaattccaccctatttgatgtatttaggacagcagctttgctagttctcacaccaaaatgttttgataattactttttagaattcaactatttagacgggccatgtttttttgcaacattgagcaaaggtctaggatttggaatcattttgggatccctgacagttaaagttcctcaaattctcaaaatcctcaacaacaagagtggagaaggcatcaacatactaagtgtgaccctcgatttgagtgccataacaatttatatggcatacagttttgtgaaaggttttcctttcagtgcttggggagatgcaagctttttagctatacagactgtcttaattggatacttggtattatattatcaaggagctataaccaaagcaatcacgtatctcttagtatatgtaaccgtatgctatgttatgatgttcggaatgacaccgctggaattcttgtggtctcttcaaaccttcaacatatttttagtggtggttggtaagctgatgcaagcttacaccaatctacaaaatggacacacaggtcagctatcagcagccacgttgattatgctgctagcgngatctttagccagaatcttcacttccatgcaagagactggagatagtgtagtaattttaacttatatagctagtagtttatctaatgctgttctagtagtacaattattgtactactggaatgtcgatcccaagaagaaagtagaataaattattcctttagc

SEQ ID NO: 1387 - DNA, 1205 bp, Diabrotica virgifera
  misc_feature (1066)..(1066): n is a, c, g, or t
  misc_feature (1106)..(1106): n is a, c, g, or t
  misc_feature (1120)..(1120): n is a, c, g, or t
  misc_feature (1143)..(1143): n is a, c, g, or t
ctcagagctgtgattgttaatagttaattgattgttaaatagtgtatgttttttatcgcagacagttgaattgacaacatgaatcccaaattggaaagagtgaaagaaatttcaacgacagaattgggagaaggacctcactgggatgcggaaactcaaagtttatatttggtggatatctttggacaggcgattcatcgatacgttcctgctactaggcaacatactaaagtagttttagaaagatcaaaagtcccatctgacgcagcttacaaaagaaaaaatttagtttcgctagttctacccgttaaaggacagaaagacagatttgtcgttggtcttgatcgagaactacttgcagtgacatgggatggagtaagtgacaaagtaactaacatagaaaaaattgtcgaagttcaaactgaaaatgaactagttaataacagatttaatgatggtaaatgcgatccttctggaagaatatgggcaggtactatgggagaagaaccaacaaatggtaatgttgcacctggaagaggttccctattttcaatccaaaatggcaaagcagttaaacacttgggacaattaggaatatctaatggattggcatggaatgagcagctaaaaaagatgtactacattgattcgtttaaaagatgtatagaagaatacgattttgacattcaaaatggaacaatttccaatggcaaatctatattcagtctcgaaaagaataacgtagtaggatttcctgatggtatgactatagacgttgatggtaatctgtgggtagctgtttttggtggatataaagtaatcaaaatcgatccaagaaaacctgaaactcttttggccacaattcctattcctgcaaaagaggtaacttctgtaacatttgggggacctaatcttgatgaactatatgtaacatcagcgaactttactattaaatgggggagtgcttcctccccccaaacatggaggaacctataaagttacaggattgaacaccaagggttatgccggagtagctgctgtattatagagatatgctagctatctncattattaataatttgtacaccgattgactttttttacantaaacaatatactncatatgtatatacatagatatancaatgcactgaattaagaaataatacactctttttaaaaaaaaaaaaaagggcggcgctcta

SEQ ID NO: 1388 - DNA, 1661 bp, Diabrotica virgifera
gtgagagataaccttttaatgacatcaaaaatataaaaatttagtaactacaaaaaatggccaatcttttcaaatttttcaataagttgcctccaaattttagatcagtttcaacaactactaccaaaaatgatgcctggttatctaagatttttgttagaaaaattgaacctacaaaggaatcacacagtagaatgttaagcgataaggaaattatctactctttgcagacacacaactatagacccgattctaaagtagcgtatttacaaaatgtaaaaaataaagtggactatataaaagcacaagattctttatcaaaagaagttgaactagtaggttcatggaccgtaaatgtaggagaccaagatcaagctctacatttatggaagttcacaggaggttttgatatgattgatcggtataacgattttacaggaaaaaaccaggaattccaacgtctaaatgaagaacaaggaaaactggttagatcccgccacttgcaatatcttctagcatttagttactggccccaaattctaatgcgacaacccaaaaacatttatgaaattcgtagctacgctctaaaacctggaactatgatcgagtggggtaataactgggctagggcaatcaactacaggcaaaataatgatgaagcatttgctggattcttttcacaaattggtagactatataatgttcaccatatttggtgttattctagtttgaacggcagaaaagaaactagggaaagtgcctggaggtccccaggttgggatgaatgtgtcgcttatacagtaccgttgatcagagaaatgcattgtaggattatggtaccaactgaattctcccctactctttaaatgtgaacaagctcttcaaaaccttattttttaattgtatgaatattattatctataacgccgcgaaatagttggtatttcagttagcgatataatttaaacgaaaagtctataaataactacaacagtatacttagtttttttcacaacgtaaatgtacattctctgatttgttaatacatagttctttttgcatttgacattaaaaataacttaagtgagtgtgtgaactttactaccatattcttttgctgatattaaaatggaaatctgtcatataaaatatctttattttaaaaatattatactcagtttgtataaatactcactctttaaaattttttagaacatttgctaacttctaaaaaatactgtccgaagaaaatttcagaattacttactaaatttgtttaccaaatgtggcaacggtatttttccaaaaacgacaaaatagtattacctaaattcttcttttggctgagatgccatgcatgtttaaaaaatcttccatcattcatctgtctgtcagctgaaaacttatgtatcctctccgcccgttcacacggcatacaccttacgatagtttattcaaaactatattttaatcgaatcgagacagcctgttaagacatgatgcacgatacgataatttcccactgtttcttgtactgcactacttgagaaaactaaacaactaattaaaaatttccctagctatttggtgttcgactaggtcgacaaaattcgaatcatgtgaacgagggtatctacagtcggaaaggtgaaggagtgccc

SEQ ID NO: 1389 - DNA, 1150 bp, Diabrotica virgifera
tgtatttttatttaaataaaaaattctgcttgcaatttttttttttcgcaaaaatggtacaagtttgaagggcgactactagagaattgcctagggcgtcaattgacctaaatgcggccctgtctatgcaaccctacctcagatacctctgggagatttatcgtatcagtcttcagagtccaggtctaagtgctatgtaatattataatattactgaccaaacatagcatttggtccaataactcttgaaggccttgggaattgtcatataaaatagcagtgtcatcagcgtatttaagctttttgatccgtttctacattgattttcactccaaggtctttatcttgcaaagcctgtttaaaaatttatatccgagtagatattatataacagcggggatagaatgcatccctgtctgacgcttctttgaatgtaacattcgttggctaatctcccattgactcgtatgattgctttctgcttccagtgtatgaattagtgttataatgatagcaaattttcacaggctatttaaacgcaagtcctatttttgattgaagggtttcctttttttctttccgttgtttttcgtctagttcggacagaaaatcaagacttcgttcatttttaaacactccgcaaaagcaaaatttatatcacatctaatgcagtatactctctctataaccaacacgggtattacgaggtttcgcttataacgaggtacattaggtgtcccatgaaattcttattgaagtataacacttctataacgagacatacttggttataacgagggaaatatgatcgacgaacatgtttctttagttgtttttgacgtggtgatggctataaataaatagctgtctgtatacaaatgaaatgtctaatatatgtgtgcttatcgacgccagtgatgtaataaactccaccgcctgtcaacttcttagaagttaatgttttagaaaactacatattcatatgtaggcacaatattattgttgtatgatataacgaggtaattagtctgccatttcagttttcgtttagaaggggtctactgtacttttagtgttgtgttctaaactggattcacagtgtttacgaggtatcgagactatattacgagattttttagtttgtggttgt

SEQ ID NO: 1390 - DNA, 879 bp, Diabrotica virgifera
gatgaatattggcagactttggaagttgcccataacttggtttatgaatatgggtatttgacttgggaatggagtaaaggtataagaagttacatacccccgttagtggtatcaggattgtacaaatttttaaatcttcttggcctggacagtgctgaactcttgatttatgctcctagagtccttcaggcgtttctcagctcctattcagacctgtgtttctacaaatggtcagggaccaaaaaaatgggcagtatttgcgatggcaagttcatggttctggttctacactggatccaggactctgataaatacgttggagtgttccttaaccacaatagctctatcaaaattcccatggccaggaaaagggatagaggaatcttctaccttcatatggataacagctttattgtttactataagacccaccagtgccatagtgtggcttccactgtgcttgtaccatttgaagataaccaaagagtcattcttaaacatcaccttcaccaagtattttccaataggatttatcatactatccttaagtactcttattgacagcttatgtcatgggtctcttttaataccaccctatgggtttttaaaattcaatcttcttgagaatttgagctcattttatggagaacaaccttggcattggtatttatcctctggtttgcctggcatactaggtatacaagtgctaccttttcttctggctacagtggttgttttgaaaaatagaaaagtacatcccaatgagttagtgatgcttgggacaattgtttttgccgtggctgtgtacagttatttacctcacaaggaattcagatttttattacctctattacctttggtgttctatatatcatccag

SEQ ID NO: 1391 - DNA, 553 bp, Diabrotica virgifera
tagtaatcggaccggtgcggcttgttctcttgcttcaatcaattttggcatatcgctatgctaaaagagaagcattgagaggaagatacgaaagtttacgcgaacctcttgttgcttgggacaatagagatgcacgtttagacaagagaaatgctgacaaccgggcatggatatatgacgatgaacgtttggacaagagaaatgctgacaaccgggcatggatatatgacgatgaacgtttggacaagagaaatgctgattaccgtggatttggatatgacgacgagcttttaagcgagcgagaagcttttgtaccgaagaagcgagtatcatggaacataaaaaaaaggagtatggaaaaatctagcctagttccatctggattttgggtagaccacgacgaacgtgttgcgtaaatatctaactttaaaaacgtatgcccttaaactaaaaattgtttctggaaatttccgaaaatttagacgaaaatattaggcagtaaacgtacttttgttgtgtatctaaaaatataaaaatacttggctcattttcg

SEQ ID NO: 1392 - DNA, 915 bp, Diabrotica virgifera
  misc_feature (862)..(862): n is a, c, g, or t
  misc_feature (866)..(866): n is a, c, g, or t
gcaatgacaatttacctgtctggcaacaatgttattgcggcgatattgttaaagaataaggctataacattagataatgataagaaaatcacttaaataagacaacgggtttaggaagttcgagacatcaaaaatgacccatttttaagttggtgtgttaatttcttggagtactgttcttatatactttttgataaaatcggtcgggtcatcttgtcccatagagtatcgagggacagcaccagtgttggaggtagaactttttgttggttggttaattcatacaatgataacaattagaacacaacgtctttagaattaccacgacatggaccacaccagttgtagtgtagccaatttcgaagagccctggtcagcttctgattttcttattttccaaattacgctcatttaccgacaaacgattggacagtccaagccaccacgcacttgccataaatgaccataaatggtttcctctttgtccaagcatcgtaaatcacaaattctgagcaaaattacgctatttcaccttgcgctgattgccgtcttcagattttatctttttctgttacatatcttccatttcgcaaggcgtgccacgttacgttccgttggatgccgcttttacacaaaatatcaaattacaagaacaagattttttacgtaaaacgatcatatatcaacagattattggctaatttggtatacattacctacatatttcattagattatattttagcatcattaaccatttgaaaccgatatctttggtttctgatttagatttcaggatataattacttaaaaacacatttcatttgtatgtgtataccaaatttttgttttctacctttgtnatancattgttattattaaaaagtaataatagtgtataattattttgaaatac

SEQ ID NO: 1393 - DNA, 1108 bp, Diabrotica virgifera
  misc_feature (24)..(24): n is a, c, g, or t
atttatttatataataaatttatnttaattcggtaacgtaataaataaataattttataaaactctataggggcttctcgtcttttaaaaaaatttaagctttttaacttaaaaataaaattctttataaattaaataaagacaggttttttttcatccaacccttcattccagctttcaataaaaaaactaatgattatgctaccttagcacggtcaaaataccgcggccattcaaattaatcagtgggcaggcgagactttatatttaatacaaaaagacatgtttttaataaacaggtgaaaaaaatgttgccgaattcctttattaaacctatatatttttactaaatatacaattttttaatactaatattatcatcattactaaatttaaataatttaaatttatattttaataaaaaatttataaaaaataaaaataataatatataaaaataaataataacatattttaaaatatgaaaatttttaatcctaatttttatttaaaaattaaattttaataaaattttatttttaagctcatccctaaaaatatttaatattaataatataaaaatatttaattataaatatattgttaataaataaatttaatttatttcttaaaaaattagatatatttaaaaacgaataacatttcattacaaaaaaattatttaaaatatttattttacaataaaaattttaattttttagctcttttaaattcgaaaataataaatatataattattaattaataatccctgatacacaaggtacaaaaaataaatttttcttttataaaaataaaatattctctcacaatactaattaactatcattaaataaaatttttctttacttttactaaaaaatattttattattttaaaataaataaaaaattaaattgaattactctaatatttttttttattttcattttttatttatttaataatttaaactattttaactttaattataaaccaaaatattttaaaactaaaaaaactaatttaaaattcaattgaaaatgataataaattttattttcttctttcgaccctacatctaattttaatttaccaataaactgatt

SEQ ID NO: 1394 - DNA, 680 bp, Diabrotica virgifera
aaaatagaaatagcaactgtgattatttgttctagaaaaacgaaaaaggacctgccgtacagaggggaagcttacctgactttaaatagttattgcaactattgaaaatgactcgtggaaatcagcgtgaattagctagggcaaaaaaccaaaagaaacaacaggagcaggctaaaaataaaagaagtgatggactcactctggagcaacgtaaattcagggatgctgagctcatgagggaaaagcagaagaaaaaacaagatgatgaatcgcaaggaagtggccaggcctgtaaataaagtgactttgcaggctctttaatatattttgtataaatttgaacgataattaagatatgttttttacataaccagtgatagtatatgtgaaatatgtaatatattgacgaaaagtgcagtcgaacatcatagtatgtaaattttggtatttgtttaactgttctgttttttttttgtatatattcttaaggggtacatattattcagtatttataatttggatttattaatacttattatacaaatacttgtattacattataacatgtcaactttataatagacaatcattgtttttgcattaattcattgtatcattacagtattttcatcccattaactaactatttctttatatacttctttaatacattctttgtt

SEQ ID NO: 1395 - DNA, 845 bp, Diabrotica virgifera
gtctgggccaaacatcgcttcagcagaatttatcacagagacagttgataagttttcattgagtgtgccacaccgaaatgttgatcaagtcgataattttgctattgtctgtatgttggtgtgcctacagcgccatcgcatctcctgtgtccaaaaaagaagaaaagcgtaccgaagccaacgtactctacgaccagcgacaagaaggagaatggaatgttagagctcacttagataactttcttatcatgatcgttccaacacaaacagttgcgacagcagccagcccgagtcttctagatttcctgtcaaaatctttacccaaaggaagccacatcaagagaattaaaaatttcaaaaaacatcctgtctctgaattaccacaagaaagtcaagctttggagacacaacattttatagaatccaagacagcaccgtaccacgttgatttaaccaagcctagtgctgatattaagccaacacccagtgatgatgttgttttagcgaactcacccagtcttaaagtgatcaagcctgaagggaaacttaagaggtcaacaagatttgcaagaacctacattatatcgattccttccgaaacagagtacatttcaaggaaatacgccgaaccaaaatcagcgcttaggaaacacaaaaaaactatcaaagaaaaatcaaaagcagaactgaaactattgggatcagaacttgagcagtgcggacctggaatggtcagagattcctatggagtatgtactactctaaagcattaatttatactgtgaacttttatttattttctattgttagtgatattttaaattaataaacaaattttttttgtc

SEQ ID NO: 1396 - DNA, 1115 bp, Diabrotica virgifera
  misc_feature (958)..(958): n is a, c, g, or t
aagtctacatcatggaagtatggtgtttttacaatgtatttccttaaataaacggccggtttcggctgtgatttctaaagtataatttaagaaatatccacaacaaaacgtatttcacgagattttaatttttattagttaaatttattagattaattataattaccgtataaaaaaagacacgtagccaacagcttttgagtatattagttatggtgtatttttgttgaactaaataaacttatacatcagaaaaatgttaccgttatcacacaaggataaagcgtacccaagaggctttggttcaagaatcaaggaaaaagtaaatggttggattaggttaatattttcagacagaaactccagaaatttattcctcttccttatactgaacctgtctttcgcatttgtagaattaatttatggagtatggagtaatagtttaggtttaatttccgatgccttccacatgtttttcgactgcactggcctgcttgcaggactagcggcatctgttatcactaaatggaaagcgaacgacaggtactcttacggatatgtgagagccgaaattatagctggcttcgtgaacggactgttcttgctctttatttctttcttcttgatgtcggaggctgtcgagcgtgcgatcgaaccacctgaggtcaaacatgaaagactgtttgtcgtatcagtcctaggtttgttggtcaatttagtaggtatctacgccttccagcacggtcatggccattcccacggaggttcccacggccattcccacggaagatctaatcatggacattcccactccgtcaataaccatcaccattcccacgacatagaatttgacagcggcaattcacaaataatgaaaggagtcttcctacatattctagcagatactttaggtagtgtcggtgtaataatatccgctgtgcttatgagcttgttcggntggatgatcgcagaccccatctgctcaatgttcattgctatccttatagcacttagtgtcttggctttgataaaagattctgtaatgattcttatgcagaggcaaccggcagccctggatatgtcctaccgcatgctatcaaaaagtggtcagtctg

SEQ ID NO: 1397 - DNA, 794 bp, Diabrotica virgifera
cgcctgcacgggccgggacttcccggcccctcccccccacgcggccgaaatttaatataaacaagaattgtattcttgtataaataattatcacagcttcgctttacttgacttaattgataattaataaaagacacgatgaatactcaaaccgcaacataacctattcactaatatgcagcgtgcaaaatagcaaatatgtctgattcggaggggagccgcttttcggataacgaaaatgcgtctgcagcggggtcggaaaggtcccgcagctcaagaggtagcgttcgaagtaaatctagatccccgactacatccaggtcgagatccatgtcgaaaagtagatcgagatcaccatcaagaggctctagaatgtccagatccagatcacgtctccctctcgttcaagatcaagatcaccttctacatctcagtctcgttcacgctcccgatcgaaatctagatcacgaagcaggtccaggagcagatcggcaagatctggatcataagcaaaagaagcttcaggtcctgaggatgttgtggaggaagaagaaccagatggagatagtctaaggtcatacgaatatgacagtgaagaagatgaaagtgatgatgggggtagagcgcagaaaaggaaaaataataaagacagatatggcggatttattattgacgaagctgaggtagatgacgaactcgaagatgaagatgagtgcgaagatggagcacaatacattggaattgttcctatcgaagttgacgagattgcacctacagcaagagaaattgaagga

SEQ ID NO: 1398 - DNA, 1038 bp, Diabrotica virgifera
catccccccccccccacacggatcttcataacccttcactcattgcaaccattccaccggaataatcgatatagactattacaacaggctaaacgctaccactgttcggtactcaaaccctacccagacttttatagcaccttaaaccacctagatcgcctgatacatgttatgcacttagcctactgtatggcttccataacttataacccctgccagacatctgattttttggttgaattaaaattgtagatattataaagaagtatttcagaaccaaactgtttacacttttgtacacataattgctccattacatatctaacacttctttctgccaaacattacactctccatttctttagtactcaagaaattgatttctttagtactcaagaaatcaatttcttccatcgttatatataacatagcaagtagtattacaatatatgcaacgctgaattagaagtttttactgaaaataacgtttttgaaatttcaacattttccaagagttttagcttgagttttaagattctgctgtttttgatcatttttatataagtatatttttaagactattatttatgaaatatatgttttgttaatacatcgaaaatatatattagtgtagatttacaagctatttttgatcgatttttaaacagtattgttgtgaacattcctgttaaacacttccataaacaataaagtaaggaatagcgttaaaaaaaaaaaaaaaaaaaaaaaaaaaaaaaaaaaaaaaaaaaaccaaaaaaaaaaaaaaaaaaaaaaaaaaaaaaaaaaaaaaaaaaaaaaaaaaaaaaaaaaaaaaaaaaaaggaaaaaaaaaaaaagggggggccggtttaaagggaccaagtttaaggaaggggggaggggaaggaaaaactttttttatggggccccaaaattccattcccgggccggtgtttttaaaagggggggaggggaaaacccggggggtaccccaattaattcccttggaaaaaatcccccttttcccacgtggggaaaa

SEQ ID NO: 1399 - DNA, 875 bp, Diabrotica virgifera
  misc_feature (832)..(832): n is a, c, g, or t
aatctaataaccttaaatcatgtttatgaaaatagattattttgattgatactgattactgactgaaagtagtaaagtgaaaaacagtatcttaacaaaatgatcaagtaagcggttgaattataagacatgataatatttaactaaccgaacttcaactttaaaatgactttagccagtactccaacagaagtacctgtagaactggtacattcaaaaagcatcattgttattcatcctggttcctttaatttacgaattggcagagcgtcagacctaaatccagtcacaactctacatgctatagccagaagaagattacccagtggattcatatacaaagatagttttttatcagaaagagctgaaactacccccgtacaagaattagaggatgctaggctagctgtttctcacactttacagtcttgtctacaatctgatggaaggaggagatatgctactccaccacagcagattgctgcattcaatagacgttcagaaccagaattacttaataacagtggaggagaatgggtaaaaccagagggagatatagtaataggaaatgatatcttacgattagatccaagacaagattttaatgtgcattttccatataaaaggggagatctaaatatacattcagaaccaggtggttctttaacatcagtgatggctgatctagaaaccatatggacctacatattagaaacaaacttccaaatcagccaaaaagacctaaagtaccacagagctgtgttagttatacctgatgtatacaacagaacatatttgagagaattgatgtatcttttactgagcaggatgngtttttggagctgtgtttttttggtgcaagatcacgtagctgc

SEQ ID NO: 1400 - DNA, 1005 bp, Diabrotica virgifera
tctaatcaagagttagacactagagacccgaattttacgtagtagttaattaacttaaacacacagagaagacacacacacattgttcaaaaattacaacaaaaatgaaagtttacgtattatttataatatgtgcaattactttgcttcaatttgctgcatctgatcgcgcatctgacatgaaagccagaatagatcaacttaataggcagaatcaacaaggatcctatggcaatcaaccgactacaaataaatatggacaaaatggttcatataataatggatacaataatggccaacgttatcctaacagtaaccaaattggacaggtgaatcgcaatgcttccagggacctgtaccccaatctaccacaaaataataacggaaatcccaattgggcaaatcctaactacaatccaaatggaggtagctatggtaataataataacaataacaataacaggtatcctgctactggttacaataacggccagtcaaaccccaatgatccgtataacagaaataatggatataactccaaccaaaaccaacccggatctcaaggatacaattcaggaagcaatggatacaactccggaactaaatatccctataatcaaggtcaaaatggtgcaaaccaaggatatcacaactctggaagtccaggatatcctatcactggaagtatgggttatcccaatactggaagccaaggctaccccaacaccggaagccaaggttaccaaaacactggaagccaaggttaccacaacactggaagtccaggttactcaaacacggaagtcaaagtaaccccatcactggaagcccaggttaccccaatacagggtacaatcaagggaatcaagggtatcctaactccaacaattctggtaatcaggggggccagatattaataaaatacttaatataatacctaccagaaagggtttttattttttaaaaatgatttttaaaaaaatatttatttcttttccaatattt

SEQ ID NO: 1401 - DNA, 762 bp, Diabrotica virgifera
agtcaagaaaaggtgtcaagatgacatgtaaaaggcgcaatggagggcgctccaagcacggccgtggtcacgtaaagccagttcgatgcaccaactgtgctagatgcgttcccaaggataaggcaatcaagaagttcgtcatcagaaacattgttgaagccgccgctgtgagagatattactgaggcatcagtatatcaagcttacgttctccccaagctctatgcgaagctccactactgtgtatcctgcgctatccacagcaaagttgtgcgtaatagaagcaaaaaggataggagagtcagaactcctccacagagaaacttccctggtagggacaatgctagagttcagcaacaacaacctaggaagtaaactgtttctttagttttacaataaaatttaagaaaaaataaaaaaaaaaaaaaaaaaaaaaaaaaaaaaaaaaaaaaaaaaaaaaaaaaaaaaaaaaaaaaaaaaaaaaaaaaaaaaaaattaaaaaaaaaaaaaaggggggccccctctaaagaatccaagtttactaacggggggttggaacgtaatactttttttatagggcccccaaaattcaattcccgggccgcctttttaaaacgccgggatgggaaaaacccgggggttccccaatttattccccttgaagacattccccctttccccagttggggaaaaaacaaaaaggccccccccaatcccccttcccaacatttgcccaccctgaagggcaaagggaaccccccct

SEQ ID NO: 1402 - DNA, 963 bp, Diabrotica virgifera
gcaggttttacaaaatataattattttatgttacaatatcaaagtactgaagaaatataacagtaatcataaattgtaaattaaatgaagcttaattaatattcatataattttaaaatatatttaatttttgatatttgaaatatgcaaagtgcaaaagcctcaacaacccctggacaatctccaacagttaatgtccaggagttttctataagagttccaaaaaatgtgcaaaaaagatatcatgtaatgcgattcaatgggacgttagatgtggattttgaaaaatggaccaaagtcagtatggaaagagaaaacaatatgaaagaatttaaaggagtagatgaagaagttccaaaatttggcgctggttcggaatttggtagagaagctaaagaggaagccaggcgtaaaaagctaggtatagtggctaggaaatacaaggcggaagatcaaccatggattttaaagtcatatggaagcactgttaagaagtttaaaggcattagagaaggtggggtttcaaataatacagcatattatgtatttacacatgcagaagatggggcaattgaagcatttcctctacaagaatggtataaatttcaacctatccagaggtataaagctttgtcagctgaagaagctgagatggaatttagtaaaaggaacaaacatttgaattatttttctttgatgttgagaaagaggctaaagggtgaagaggaaactgaattggatgaaggtgaagagaagagcaagaaatctacatccaaaaaagagaaagagctcaaaatatctgagatggatgaatggatggacagttccgatgatgaatcctctgctgaagaggagaaagaggattccgaagaacagataaaatgaaaaagccaagaaggtagttccaaagaagaaacaaaaacgagatacagatgccgaagcatttgaagattctgatgatgg

SEQ ID NO: 1403 - DNA, 1057 bp, Diabrotica virgifera
catcaaccttcttcaaacttgaacgtcaagtgtgagaggttacgtggccgaagttttctaattttaatttaaagtaaacatgtatcttttcggcttccttatttcactggtttgtttgggcataaatcaaagtttggcctattttatcacagtagatgcacatgcagaagaatgtttctttgacaaagtggaagctggcacaaaaatgggtctcacttttgaaatagcagaaggaggattccttgacatagatgtgcgtattatagatccaaacggccagaacttataccagggtgaaagggaaactgccggaaaatacacatttgcagcccacacatctggtatatatacatattgtttctcaaacaagatgtcaactatgacacctaaagttgttatgtttaatatggctgttggggaatctccaaaggcagaacaacaagaaggtgaaaatgctaataagttggaggaaatgatcagagaacttacaaattcattgtctggtgtaaaacaagaacaagaatatatgcaggttagagacagaattcatagaagcatcaatgaaagcacaaattctagggtagtcatgtggtccttctttgaagcagtaattttagtagcaatgactgtagggcaggtatactatctcaagaggttcttcgaagtaagaagagttgtgtaaacattaagtctgatcattacatatttcttaaaattttgtaaaattgataatatacaaattatgtatgtaatttgaattttgggacattgtaaattaaaaaaaaaaaaagatctctagttttaaatacaaagtctgatggtacagaattgattgtgtttatgatcgataaccttattgtattcaggaagactgaaactggttagtaatgtattactattaatttgttctgttgaattcacctgcaaaattatttaaaaatcattttttttttttacatgaatttatcaaaaaatgaatttttttgaagttcccaaataaaaaaaaactaaaaaaatctttattattttgaaaataaaaaaaacttaacgggaaaaa

SEQ ID NO: 1404 - DNA, 1022 bp, Diabrotica virgifera
cccacgcgtcgcggaattattttaggagtatttattatttttaataaaatagttatgagttcagccagcaaggttcggtgaaatattcagcgccgcaggactagcttttaatatattaggagatctaacaatgcaattgcatcctattgcagaatctcctacaggaaaatggactgatgaagaaattgagatgctacgccaagttgtcaaacaattttctgatggattaaaccaaattagtgatcacataaaaaggcggacagtatcccaaattaggacggcattaaagaagaaagcctttgaggatgcaggattaccagtgaggcaggttaatcaggcagtaccgccagtccagcttcaacagcaacctatgataaaatctgaagtcactttaaatatgttaaatgctgcagaatctgaagttgatgttgaaggtctccatgaagatgtaaaactagagtttgatgggggaaatgatgaagtttcatcgtaagttttcattttcaatgaactactaaacaaaattgtaaatttttttaaatattaaaattataaggcatatagatattatgtgccactaataatgtctgaaaagtggttttgattcaggtattcatgatttttatggatacactgctagtttacggttgttatattaacaataatccaactatacatatcaataatgtccacaaattatttacaacatttaacgtaataataatatacagttagaaaataagtagttgtttgaaaatacctttgtatgtgtttttaataatgaaaattccagtaaaataaaaaatatttaaggaattttaatatgtacttataattaataataactttatttttgattctgatattgatataaagttactaaaatgtttggtattattgatgtgtatatattatttcctctgctaatttataactattcataacttgatgtagagtgactgctgaaatacatgtttgcaatgacaaaattcaatccaagacatgcagagtattagaactac

SEQ ID NO: 1405 - DNA, 824 bp, Diabrotica virgifera
acatcgaattcaacaaatacaaacagacacaaaatgaacaagtacatgattttagctgttcttcttgtaggcgctgtcctcgttcagggaaaaagcgtccaaaaagaagataaaaaagaggacagttctgaagaaaatgtcagagaactagcagaaatattgaacaaaaaattcaacactactcttcttctcgatatgatcaaaatggccgaacaaaccaaagctaaatgtcccgacttggaagaaaaacttgacgaagtttccgagaaaattgaaaaatgcgttgatgatgtcgaacttggatcagaaactttctgctcactcatcaacaagaacttggttaaatgtactaaacccgccatagacctaattgcttcttgtttaccagaagaatccaaagaccttccagtaatgttagagaaaatgctcgctgctgttgtcaaacaagcttgcagttctacggttgaagaagttttggaattgatgaacccatgtgcccttgaaaaagatttcgcttcgtacccagcttgcaaagaaatcaaaacagttatcgatgaacacaaaaataaacttccatccaagtcactcatctgctcaaccatgcccaaggtaaggaactgcgctaaagctcacattgaaggtaactgtcaaaacacaatcaccagacaagctgccttgaaattccacgatgccatcgatgctgcccttaaagacgactgtgatgcccttaacaaagcctaaataatttatgacaaaatgctccaaaaaattaataaaacatttttatagttaaaaaaaaaaaaaaaaaaaactcgggggggggc

SEQ ID NO: 1406 - DNA, 2168 bp, Diabrotica virgifera
  misc_feature (741)..(741): n is a, c, g, or t
  misc_feature (1973)..(1973): n is a, c, g, or t
  misc_feature (1997)..(1997): n is a, c, g, or t
  misc_feature (2098)..(2098): n is a, c, g, or t
aaaggatacccgttaaattttttccaacaagcaaatatttagatggggaatattggggaaatcttggagcaggacaactaacaaatgaaggaaaacgccaactttttgctttgggtcaatacacaagaagaagatatccaaattttcttcccttgaaatataacgcgtcaagtttccacgcttatacaacagatgttgatcgcacccacatgtccgcacaaagcaatatatactccctctttccagctactgacgagcaggtgtggcgtagaaacttgaattggcagccaattcctattcatccaataagcagggatgagttctggggagattcagcatgtcctaacttttatatattaagaactgaagctctaaacgataagttgtctcaatctattgatgaagaatatgcaggtgtatataaatatattagtaaatatagtggattagatattaaaagctatttccaaattcacactgtttttgacaatttcaagatccaagaggacgtaggacttcctcttccagattggtctaaagctgtgtacccagaacctataacgtcgatcgcagggtggctttttgaggtcttttctaggacaacacaaatgaagagactcattaagggcagatttttgaacaaagtagtagaatacttcgaaaaaatggcagacgatccaaagtcttctgaaaaatatcaattttacagtggtcacgacagcaacatcgcatcactcttanactcgtttggatccttcaatcctccttatcccccagattttgcaagtacagctcacatcgagctgcacttcgaaagttggcgccacgttgtgaaggtgtttagtaaagatcggggacaacgtgaagcaaatcagtgttaatggatgttcattgagctgtcccccgtcaaaatttaaagaagttctcagcgatattttaatcgataaggagacttatgatgaagaatgtagtaacatcaaagatactagtggactgaagaaactgctactagcagacagtaacactcacaaaatcactacagaagaagttagggagaccagttttataacataatgtttattttttattcatgacaaagtggatagattttgatattgattaaatttcttattaatcgcatataaataaagtaaaataaattaaaaaaaaaaaaaaagacagatacaaacgaatataaaatgaacaagtatatgattttagctgtcctcctggtaggcgctgtcctcgttcagggcaaaaaagaagactccagcagctcatctgaagaaaatgtcagagaagtagcagaattattgaacaagaaattcaacaccacccttcttcttgatgttatcaaaatggccgaaaaagctaaagcaaaatgtccagacttggaagaaaaacttgacgtaagtgattaactgaattatgtatatattattaaaaccgataggtagatattatatttaccaaaataatatgaattaatcaaccgctgatcggaatactaacgaatttaaatgaaataatagtgccatgtacagaataagtttagaattttaaatttttcttctatttataggatatttccggaaaaattgaaaaatgcgttgacgaaatcgaacttggatcagaaactttctgctctctcgtcaagaacaacttggctagatgttccaaaccagccatcgatctaattgcctcctgtttaccagaggaatccaaagaccttcctgtattggcccagaaaatcattgttgccgtagtaaaacaagcatgcagttccactgttgaagaaattttgggtaagttttttatttgtttgtacttttatattgaatcaaatattaaggtaactgaaaggtagtattcccttgtgattaatctggtatattgacgatgtagtcttagtaagaaggcaatactgaaaggaatttagagtaaagactggaacagtgaagataaattcttanagaaagaggtttataacttagtgngacaaaaacataaactagtctaaggatggagtttctaagctgttgcattatggcagacggagttattcggaatatactgatattacaaaatgctctatganaattgcaaaactggctctttagacagataaatgaatacttttgaaggtgtatattaatacatattttttt

SEQ ID NO: 1407 - DNA, 936 bp, Diabrotica virgifera
ggagatgcgacaattcgtgttgtttataatacctaatcaagactttatttagtatataagagttgacaactgaggacaaaaatataccaagttgttgacaactgaggacaaaaatataccggacgcgttcttcaaagtagacagatacaaacgaatacaaaatgaacaagtatatgattttagctgtcctcctggtaggcgctgtcctcgttcagggcaaaaaagaagactccagcagctcatctgaagaaaatgtcagagaagtagcagaattattgaacaagaaattcaacaccacccttcttcttgatgttatcaaaatggccgaaaaagctaaagcaaaatgtccagacttggaagaaaaacttgacgatatttccggaaaaattgaaaaatgcgttgacgaaatcgaacttggatcagaaactttctgctctctcgtcaagaacaacttggctagatgttccaaaccagccatcgatctaattgcctcctgtttaccagaggaatccaaagaccttcctgtattggcccagaaaatcattgttgccgtagtaaaacaagcatgcagttccactgttgaagaaattttggaattgttgaacccatgtgcccttgaaaaggacttcgcttctttcccagcttgcagagaaatcaaaaccgttatcgacgaacacagaaacaaacttccatcgaaatcactcatctgctcaactctccccaagatcaggaactgcgccaaagctcacattgaagcttcctgccaaaacacagtcaccagacaagctgccttgaaattccacgatgctatcgatgctgcccttaaagacgactgtgatgcccttaacaaagcctaaatcatttatgacaaaatgctccaaaaaattaataaaatatttttatagttaaaaaaaattaaattataaaaggcatacc

SEQ ID NO: 1408 - DNA, 1517 bp, Diabrotica virgifera
cctctcgcgtccgtttttttttttttggcttgttatacctttaatcttgcggttcctgatttctacgaacaacacaatacaaataataatttctctattaatttcacatttttgtccattttcattttattaaaaactgttttatttgcttaatagcgaaagaatgttacacacagtttttgagggtcttataaaatggcagttaattgtatctaaatcgtctcattaatataataacttcgaatatcttttattaaaatggtctttagagtaataactgtaaaaatgtccgctaatttgagttctagttactagtttaacatcttctaggtgcttatcgaatttgtctagcttccacaatggatcacttcgttgtctgcatatcctttctgcccaggtttgggcacgtggaatatccctcctcactcctcgtttgcgactgtcgagtacctccatcacatcatcgtagtagttccttctatattcgtggatgtatctgtatggtaaaaatttgggtctaatccagtgtttaaacaatatcaatttgtcgggatctaagtattcttcttcggcttctggtctttcctcctcagcagctccctctgcaggagcttctccttcggctggtgcttcttccgctgctgcaggggctgcttcctcctctgctccagctttctttataagtgatttaacgggtggtggtggtgcatcatcatctccacctgcgaaccagctgtcttcttcatctgccatattatttcaggaatactataactagaacaattcgaatagttgaacttggaaagtagagacagatacaaacgaatacaaaatgaacaagtatatgattttagctgtcctcctggtaggcgctgtcctcgttcagggcaaaaaagaagactccagcagctcatctgaagaaaatgtcagagaagtagcagaattattgaacaagaaattcaacaccacccttcttcttgatgttatcaaaatggccgaaaaagctaaagcaaaatgtccagacttggaagaaaaacttgacgatatttccggaaaaattgaaaaatgcgttgacgaaatcgaacttggatcagaaactttctgctctctcgtctagaacaacttggctagatgatccaaaccaggcatcgatctaattgcctcccgatttaaccgagggagcccaaagaccttctgttattggagcgagaaatcattgctgccgaagtaaaacaagcatgcagttccactgttgaataaattgtggaattgtggaaaccgtgggcccgtgaaaaggacttagcttctttcccagattgcagagaaatcgaaaaacgctatgcgactaatacagaaacaaacttccatccatatcactcatctgctcaactctccccaagatacaggaactgcgccaatgatcgcattggagcttcctgccataacacagttcaccactgcaatgtgcattgaaattccgcgatgctatctatgctggccttaacgacgactgtgat

SEQ ID NO: 1409 - DNA, 1251 bp, Diabrotica virgifera
ataaattcagccgcgaatttgtgcagaacctgcgtaatgaaatcgatctggcggatatcgattacatcgtgattaaccatgcagaagaggaccacgctggggcgctgaccgaactgatggcacaaattcccgatacgccgatctactgtacagccaacgctatcgactcgataaatggtcatcaccatcatccggagtggaattttaatgtggtgaaaactggcgacacgctggatatcggcaacggcaaacagctcatttttgtcgaaacaccaatgctgcactggccggacagcatgatgacttacctgacaggcgacgcggtgctgttcagtaacgatgctttcggtcaacactactgcgacgagcatctgttcaacgatgaagtggatcagacggagcttttcgagcagtgccagcgttactacgccaatatcctgacgccgttcagccgcctggtaacaccgaaaattaccgagatcctggcttcttgatgttatcaaaatggccgaaaaaaccaaagctaaatgtcccgacttggaagaaaaacttgacgaagtttccgagaaaattgaaaaatgcgttgatgatgtcgaacttggatcagaaactttctgctcactcatcaacaagaacttggttaaatgtactaaacccgccatagacctaattgcttcttgtttaccagaagaatccaaagaccttccagtaatgttagagaaaatgctcgctgctgttgtcaaacaagcttgcagttctacggttgaagaagttttggaattgatgaacccatgtgcccttgaaaaagatttcgcttcgtacccagcttgcaaagaaatcaaaacagttatcgatgaacacaaaaataaacttccatccaagtcactcatctgctcaaccatgcccaagataaggaactgcgctaaagctcacattgaaggtaactgtcaaaacacagtcaccagacaagctgccttgaaattccacgatgccatcgatgctgcccttaaagacgactgtgatgcccttaacaaagcctaaataatttatgacaaaatgctccaaaaaattaataaaacatttttctagttttaaaaaaaaaaaaaaaaaaaaaaaaaaaaaaaaaaaaaaaaaaaaaaaaaataaaaaaaaaaaaaagggggggcctgacaaccaaaaagtttttattaacgtttttatttgcgctcatttgtgtttctcgggcacaataaaaaacaatttgggaaagat

SEQ ID NO: 1410 - DNA, 1282 bp, Diabrotica virgifera
gctgctgcattctaatgcacatgttaagtaaaataacacttatgtctactatggctctatatagttctatattattcatgtcagaagttaactttatcaattaaaaattcattgaactagatttatgtttataacgaagtaaatcaaatatggttgcagagtatgaatgtcaagaatacgtccagattttgaaacagaatattgataaacattgtgaaagtctaatctaattaattcttcacaggacgttagagttttttccaacaatattgctgagcatcggaatgatattaacaggaagactaaaaatccgaaactattacacctacaaattcaaaaactatgcagaaatctccttaaccatatttcccacaataaaccactagcatgaaccacagcaggagttgcactagtaggatcaacgaatccaacagtcacagatataccaacacttgacagcaatattaatacagcatctagtgccacagaagttaaagttgaacctatagtagaggccataccagagccaccagtggttcctgacgtagttgagtcaactggggaagtgttgaatcagttgaatgcactaggagaaccaacttttgcttctttaggtttgggaggttacagtcctgtaggaatagtacagaattgttttgaatatttacatgtcacaatgggtatggaatggtgggcagcaatagctataggaacactagtgatcagaatttgtctcttccctttggtgattatggctcaaagaaatgcagcaaaaatgaataactacctccctcagatgcaagttcttcaactgaagatgactgaagctagacaaactggcaaccaaatggatgctgcaagatactcacaagaacttatgatgttcatgaaggagaaagggttaaatccttttaaaaatatgattgttccattagcacagatgcccatctttatatcctttttcatgggcctccgtcagatgacaaatgttccagttgacagtttgagcaccgggggattattttggtttacggatcttacattacccgatcaatattttctgctgcccattattacaagcgcaaccttatatgcaactatcgagttaggaacagatacggccaaactgtcttcccaaaacatgcagttaatgaaatacgtattaagaggattaccattgatcgtcttaccttttaccgttaacttccctggtgctatactctgttattgggcctccagtaatttgatttcgctggttcaagttggatttttgagagtacct

SEQ ID NO: 1411 - DNA, 626 bp, Diabrotica virgifera
gctgcttcgattgataacttattttgaaaaatatattagttattagtcaattacacattatgcattagatttcctgcaaatagtaaactgtctgatataatgcaggacgatgtggtttttttagtatttacttgccattaattgtaatagtccattacaatcaaagaaactaacgatgctgttaaaagagcttcttgaattacctaaatttataaataccagccatcttaaacaagccaagcagtaaactgtttgatgatttaatgattcttaaacctatatccaagtgtcttcacactatactggtgtaaaaataatttaaatataaaatgtatagtatttgtgtagtgatagtaaaaattatatcctcctaaaaagtgaaccccagtttttaagcttatgaaccattttatagcatgttgagagctagaaattattagtatgagctcaattaaaaaatattacactactcaaaaatattttttaaaagcataatgagtactcttataacatggtgccttagttgatgtcaactaaactacatcgttgatattctattaagatttattatttaattgaagattgctggctgtaaatgtactgcacacgtgttcttatatccttag

SEQ ID NO: 1412 - DNA, 1166 bp, Diabrotica virgifera
  misc_feature (1139)..(1139): n is a, c, g, or t
tggttatgtttacaacgtgcaaattttaggctattttgtaatttttatattttttttgatactacaaaatgaggattgataatgacgaggattatagtgcatcagactctgatgacgattacacagaaaatgaaagaatattacttaataaagtaagaaatcgaggcaagaagttttcagatgatgagcaagaagtttttggtgttggaggcgatgaatcagaagataatgaagatgatgatggagatggaagtgatttagcattaagtgatgttgaaggacaggaggatgacaatttaccggataccagagcatggggcaaagataaaagaaagttttatcaaactgattatgtagatggtgattatggaggttttcaaggaaaagatgctcagcttgccgagttagaggaagaagaagcaaggaacctacagaaacaactagcccagcacttagatgatgatgattttggcctggatatatttgcaaaaaaagctgatgaagatgataaacagaatgaagagatcatcaaaactgatatttcaaagttgtctaaaagacaaaaactacaaattatgcaaaaagaatcgccagagttcttcaatcttgttcaggatttccaaaataaaatggcagtagtgacatcacacttacatcctgttttgaaaaaagctgaagctggggatataccacaatgcaaagctgttgattttgtacagtttaaatatgaattgatactaaagtaagtaaaattaatctgctgatatgtgtcataagataaaaaaaagaatgtgtgtgtactttgtacgcacgtgagaagttatacttctgttataatataatctaacttcatattatgatttcatcgaaatcaatatatctactttaaacagatttttttattgtgtttaaatattaaactgtcgatcagatagctcagtgcgactagcggctgacccgcacttcacttcgccgtgaggtacgagagttcaagcccagctcaggccatcggaaaacaaaaaggctaacgcgtcagtataaaattctaaatatgaatctggcgcttagactggaatatgcgggcatctgatcgacctatgagggagcagtacggcaagggataagggcttgcggctcgntgaaactcccccatagatccctaccga

SEQ ID NO: 1413 - DNA, 1353 bp, Diabrotica virgifera
acgcgcccgcttctaagcaaatattttatttattgttttaaaatgaaccttattattataaaaggcaagcatcataatggaataaaacgagcaaagtatgccgccactaagattaaaaaacgcaaattaactgataaaccaataaagaataaaaaggacgaggaaataacgagcagtgaagatgaagaccttgttaacaataaagtatcagatgcatctctttcagaggactagcatgaaaccgcgcaagaaaagaagcttcgtttagctaagatttatttggaagaaatagaaaaggaagaaaaggctacaagggaagataaagaagtagatgaagcagtcttgtctaagagattaaaggaagactacttgaaggagacaggtaaattacaactgcaagtagccaataagtatacgcaaatagatgaagagaaccggctaactttaaaatgtacagaacaacataaaagccttacttgtttatgtatttcttctgatgaccaatatgtttatgctggtagtaaagatggagtagtggtgaagtattccttatcagataataaaagaataggtgtaattctatttgttaaaaactctgagggagaaacagtgggccacagtagtgaaattttgagtttagcaatatcatccgatagtaaatatttagctgtaggtacaaaatccagtgatgtttatatctgggatccaaatacttttaagtttatcaagaagtttcaaggacaccctgtatatcgaggtctactttctcttaatagagggtatagaacatgtaaacttagtacttttcttccacgcttaatgtctggttattattggtgtttcttgtttcacgacaagctagggaaataatgatcgctcataacagaggttctagtattgggagaaggcaaatggagcctgactgtcgcctgaggctgagctgtccttagcttacactcgatgacctcgtagaattatcgagcttggatagctcttcaaccgtgacaagctcttacggctcttataagggaatatcatattctagacaaagcttttcctgcaataccatgtctctgttaattctctgttgttttattttgaaatttcttggttatgatacatacgtgtttaataattaattgatattaaatattacatattagtgttaaatattattattaatagtgtattaaatattaatattatagataatagtgttcacaatacacctatgaatttggaacatttatcgacaattatcaatgtcttttagcctcttgggtttagggggggagcgggaactctaattgaaaaaaacctaaagggaaaaaaacccaaagggtttttaatttt

SEQ ID NO: 1414 - DNA, 1384 bp, Diabrotica virgifera
gtcaatccaaaatacaaaaaatagtggcgtctattaggaaaaacattttattatattatagagtgtttgttttaaggctcagtatctctaaatagaaataataaggtaatcatgagtaaaagaaacagtcctgttccggaagaagaaccaccagccccagaagagtatgttgtagaaaaaattcttgatagtcgtattaatgatcatggtattaaagagtacttcttaaaatggataggctatgaagaaaaagacaacacctgggaaccagaaggtaacttagattgtcctggactaattgaagcttttgaaaaggaaaaggctaggaaagacaaagaaaatgagagaaaacgcagaccaagcactttaacagaacaaagatcagtgaagaaaaaaactgacgacaaaaaatcattaggcttcgatagggggttagagccagagaagataattggtgctactgatagtccgggacaattaatgttcctaatcaaatggaatggaaccgatgaagcagatctcgtacccgctaaacaggctaatataaggtgtccacaggttgtcataaaattctatgaagaaaggcttaaatggcatgcgccctcgctagaagattcaaaaggcgagtagatgtaatgtttagattatattttaggtttttaatcatgaaattgtgagaagttttaaccagtggcggtttaacctaacttcgggccctgggcactagagatttagggggccccttcattgctattcgttgtcaatttttttaacaaaaaaacacatgaattaacctgctttattgtaactataaacgtttattgtaaaacccatacatttttaaaaataaaaaaaaagatttttaaaacaaacgagaaaaatagcaaacgtaaaaatattctaaaaaatacatttaaaaatattaaaaagaacagaaagttctacagaacaacacatgacaaacaaaaaatcatattctaaaaaatatataagacaaaaatttgctcactttttttcttgactaggcattagcaaactgccatattaatactatcaaaattcagttgctccacttcttcattttttataatacggtagtgattatgcgtctaggttttcttgacattcttaccttcagtatatgtatctttattctttttaaagccaaaaaagaccgctcgctgacgcattagaaattggtatcgtcaaataaacttgcagtgaagctaaaaattggcaaaagttgcctttatatcctggatgacaccaaattttcaaatgtattcaaattttggcataacgttataaaatgaataatttcattatgcaagttctctttgttgttctgaagctatttcttttgtgcaatttttataatcaacta

SEQ ID NO: 1415 - DNA, 521 bp, Diabrotica virgifera
agcggacgcgtggggtcaagtgaagttatattaaatatatttataataatttatcctatcgtcatcatgagaagtttaatagttgccacgattgtacttttcgccgtttatcaggcagtagatggtctcattgcctgtcacgaaaccttttgcgacaatcaaaaatgtacagaaaacctcgtttgcaaagattctgaagttctggttcccaagggaaccatttgcggatgttgcgacgactgctacagaaaactaaatgaaggcgatgcttgcaggtcacgttttttcggaggaggtccattcagaggaaaatgtgtagacggattagtatgtaacgctgaaggaaaatgcgccaaagtctaaattatacacgaactattatgttgataaataaatgatataaatgataaaaaaaaaaaaaaaaaaaaaaaaaaaaaaaaaaaaaaaaaatcctggggggggcccccgccccaatttcccccttttggggggtttttaaaaatacaggggcccttttttta

SEQ ID NO: 1416 - DNA, 1239 bp, Diabrotica virgifera
  misc_feature (1139)..(1139): n is a, c, g, or t
gatattcctagcgttcagacgtgtgctctgatgactttgatgcctatatcattgtttctttcgttaatgccacattggtattatctattggtgaaacggtggaagaagttacagacagtggttttctgggtactgcaccaaccctatgctgttctgcattaagtgacgatgctctagtacaagtatatcccgatggaattaggcatatttgtgcagacaaacgtgtaaatgaatggaaagctggtaaaaagagcatcgtaaaatgtgccgttaatcaaagacaagtagttattgccttgtcaggaggagaattagtctactttgagatggaccatactggtcaattggatgagttcaaagaacggaagcgtatgaattctgatgtcctgtgcatggctctagcaaatgtaccaccaggtgaacaaagatcttggtttttagctgtaggccttgctgacggaactgtcagaataatttccttggaccccagtgatcgcttggctcctagagcaatgcaaccgctaccagtatgtgctgaatcactttgtatagtagaaatgggttgtactgagagagatccggataatgcagctgcagcaagtaccactagcaccctttatttgaatattggcttacaaaatggtactttgttgagaactgtgttggatccagttactggagatcttactgacactaggactagatatttgggttctagacctgtgaaactatttagaataagaatgcagcagtctgaagcagtattagctatgagcagtagatcttggttaagttactactaccaaaatcgcttttatctcacaccattatcatatgaaagtttagaatatgcctcgggattcagttcagaacagtgcccggaaggtatcgtcgccatttctacaaacactttgaggattttagcattggaaaaattgggtgcagtttttaatcaggtatcatttcctttggagtacactcctagaaagtttctaatccatccagaatccagtaacttaatgatcctagaaactgaacacaacgcttacactgaagaaacaaagaaacaacgccgtttacagatggccgaagaaatgagagaagctgcaggtgaagatgagcaagagcttgcccaaganatggctgaagcgtttttaatgaagatctaccagaaagtatattctcagcaccctaagctggccatggtatgtgggcatcaaccttacggggttatggatc

SEQ ID NO: 1417 - DNA, 1101 bp, Diabrotica virgifera
  misc_feature (1054)..(1054): n is a, c, g, or t
catccaacgtcgcgcgtcggtttgtatcctttgattggataaacaaattctaatctaacatcaactttaacctcacgcgttaaattaaatatcaatattattattattatgtgatcgcactcatttatggcgtttctttaatatccattatttatacaaatttgcgatttctaaaatgtcggtgtacattttattaataaatgttttgttattgaaccattttcttatagtgaaagttcagggaggttttcggtcaaaaagagaagatattgaaacagaaaatactgtgatagaagttttccatgactgcaaatgtgtgaattattatcagtgcgatgctaataatagagtgattacaaatggtgaaaatttaattgacgtaagaatgggtggaaacgttaataaaccagggaacacgaccagaattcaatgcaaaggaggcacattcgaaggagagttgatctgctgtaaagttattaatggcactgaaagcagtactgagaaagtaattccggatacagaccatgataataccactgtagatccaacgcatcaaactcagtgtggaaattgtggaactcagagaaccaaaattaacgtcagaattatagttgatgaagacagtgaggaagaaatcaatccactggatggagaatttccatggattactcctatttacagaaaaaataaacaaggaaaatggtatttttacgccagcggaacgctcatacatcccaaagttattttgacagctaatcacttattcaataggaaacatgccaataacttcaaagtaatcctaactggtaacatagaactaactaacgttggaaataatgttaataatgagcggaatgtggcagaaatagtaaaccatccaaagtattatgcaggtgccctttacaatgatggtgctctattgatcttggataaacctttcgaatctacgaatacaaattcgataaacaccctgtgtttgccacctgataatcttaacatcaattctctgggcagatgtctcgtggcaggatggggaaacggatccgaggaagcnagtacacgaattttgaaaaaagttgactttacaaattgtccccatcg

SEQ ID NO: 1418 - DNA, 1213 bp, Diabrotica virgifera
  misc_feature (1139)..(1139): n is a, c, g, or t
cccacgcgatccgcaaaaattgcgttacgtagtaggtatactcccataagagtgcgatacggaggggggtaggggggttaaaaatcttcgaaaatcgcgttacataatacttgaacgctcccttaacactttctgctcgggggcaatatacatacttatctcatgtggcacttttatacagtgattgtaaaattggtgaaatgaaaacatgttagccatgtcaatgggacctcattgataacattcttaaaacggaagccatgtcgacggacttagaagtggtaagccatattcataattcatatattatccaactgaatagaaataaaagaagttgagactgagactaatgtgaagatgaggatgtagtttatgattagatggaagggatggacagtaatctctattcaaccacaggagttacattctgaagagaaaggtgcggttggtgaaaccggggttgacgagggatccatgattcaaagaagaatatgacatataatcccaatttgaatacgtatattactacatacatagaaagaaatatgatgaaattgcgtatctgtgaaatagtattatcatatcaacaaaaataaaggcgctgagatcgcgtctacacttttgggtattttaaaccttccgaactataaacaaattgccgtagtattactactaagaacaagcgccagtggcgtatcatgagtaatttaacgcgactgttcaaattataaaaataataaaagattctcattaaagattcaacagatatcgcaaccgcggttgatgagtccgcggataacgagggattactgtatatcaaataaactgtttcagagcagctatctctaaaatccagattgctgatctgtcacagagatggcacttgaagaagatagctccttattaccaaggacagttaaatattgtttatatgggattagccacagttgattgtaatgatgaattacattgttgtctaaaaatattgatgttttgtttttcacttcagaaatttagacatgccacaagaaacagttgcagaaccatactaaagatagtatttttttcaggattttaatacataatattcttgaagtttgaccaatctgtaaaatgaattatcttgaagaatcatcatnaatatgggaatgattcagtagaactttttctttagcttcatctgaatacatcaaagaaacactgctgtttatct

SEQ ID NO: 1419 - DNA, 946 bp, Diabrotica virgifera
  misc_feature (831)..(831): n is a, c, g, or t
  misc_feature (840)..(840): n is a, c, g, or t
  misc_feature (866)..(866): n is a, c, g, or t
  misc_feature (884)..(884): n is a, c, g, or t
ggttaagatctaataacattattgaaaagtttgtaatacatttgtgacttccagtgtacctgccgtaaaataaaagttttacacgctgtgccaatttctttggaatagcttttaacagtttcatagtaagttgacataatggaaattccagcaccagaaactttgaagaaacctttagtagtacccaataaactactgatgggagctggacctgcaaatttgtctcccagagttctgcatgcaatgagtcacggtgttttgggccacatgcatgaagaaacatttaaaattatggacgaaataaaagagggtattaaatacgtttttcaaactaaaaacgagacatctttggcaattagtgccagtggacacactggtatggaggctattttgtgcaatattttggaacctggagatagagttttaatcgctgtaaatggtctttggggtttaagagctgcagacatggctgagagatatggtgctgtgccaattaaaatgtctaccctaccaggtgacaatttcagtttcactgaaatcgaacataatttaaaaaaatatcttcctaaattacttttcatagtccagggagaaacgtctactggagttcaccagccaatagaaggacttggtgatctttgtcacaaatacaactgtcttcttggtgtggatgcagtagcttcagttggaggagtaccattttacatggataaatggggtgtggatgcggtttacgctggcgtacaaaaggctataggagctccaccaggcttaacgattatatcgattagtaacagagcactaatgcacatatatgcgaggaacactccnaatcaattnattactgggatatgaaagttctaggncaacagtggaactgctancataatgttcgaccataccacccatacacccagtccagtcttctatgtagtctacgtgaaag

SEQ ID NO: 1420 - DNA, 960 bp, Diabrotica virgifera
  misc_feature (921)..(921): n is a, c, g, or t
cctattatgattgcatcatctgcgtagcaaagtattctcacggttcggttacccattgtgtatccctgattcattttgttaacactacctataacttcatccattattaaattaattaggcattgactgaggccgtccccttgtctaatgccgacattgattttatttcttccgtgagcccgtgtgtggttataattcgtgtttttttggatctattgagctctttgattttgtttttatacctctacctctgacctatgtttttcttttcaaggatagtgagcacgtcctttaatcgtactctgtcgaatgcctgtttcagatctacaaagcatgtgaacatgggcttgtcgaattcaattttatccatcgtttgaaattatgcataataatgtttgttatgcaatatgcataagtttgacatattttcaaaacatttaaagagtttatacccaagtatttttggtggctcggccaccaaaataatttttggtggctcggccttatgtgattagcctgtatcagcactgacgatgatattttttgatcgaaaacgttctgcaattttgatgtagctctttaagggattttaataaattatataccttttataaaggattttcaataaatattttgtgattagtggtatacagccagctacaggaaaattctttccttgtggattccatgtttatgttagttcagaactggtatctggttatattggatcaagaatatcaatattaaagatgaattatgcttctctctcccgaagatcttgcaatcttgtaattattcacaaatatgcgaaacgaacgaaataattttgatatagaacatatttatataatgacaagaagcaatattattatagtctaataaaggcaaagtctgtgagatattagtattattaatgtatantaatatttacagttatatgataaggcatggaacgaatga

SEQ ID NO: 1421 - DNA, 973 bp, Diabrotica virgifera
ctcagataccactattagtccacatctaatagttttatgtatatgtacctatttcaaaatgtataactattactgtgtatatgttgcgctagtgagtagttgtttatatctgtctaatgcaggaacaccaccactagaatactctgaaaagtccaataaccttggaattattgatggacaggaagtcatacctcattcgatgccatacatggctgccattcgtagtgaaataaattacaccacagttttatgtggaggatctttaattagtgattccttagttctgacagcagctcggtgtgtttatggagctagtgaagttacggttactttaggggctcataatttgacaatcaacgaagaaagtcaagtcactatgacttccacatcatttgttatccatgaagattataagcattctggggtacttcacgatattgcagttattgaattgcctaaagcagttactttaaatgactatattgccacgataaaattgccagattttgcagacattagcaatagctatgaagaacaagcagcatcagttgccggatggggaagagtaaatgatgcagaacaattaaacagcgatgttttactctaccaaaattttaccattattccaaacataatgtgcgagctctcatatttattccaaatacaatcaaaccaactttgtacatcaggtgtatcgggaaagaatatttgcttaggagataatggtagccctttggtattgaatggcgtacaaattggcatcgcttcctatggtaccgtatttggatgttcgttgggattccctggtgtgtttaccagagtaacaagttatttaggatggttaatgctttaaggatttgaacatcatgatcctgatcgactactatatataatggttcataatgaatggctattattttacctgtagattatattaataattaagattttagtttaatacctgagaataaaa

SEQ ID NO: 1422 - DNA, 930 bp, Diabrotica virgifera
ataatgtctctatcgaaattatccgcgattctagtccagaaaaactatataattagacctagtctcgtatgtgtaagtcgtttggaaaaatctacaagtgcaaatgtgcaacatacaaagaagcccaattggaatcgggccgttagtgaggcagaaaaaattgtgggatatccaaatagttttctcagtttgagatggttacttagtgatgaaattgctaatgttgccttgcaattaagaaaattggtagggtctaatcaccccttactcaaaacagctaagggattattttttaatggaaaaaataatatgcaggcatggggtctaatagtgttgctggtatccaaagcagcaggtcattctgccgatataccagagatggaagaggacaaatctgcaggcgtattacacagtcaaagagctttagcagaagtaactgagatgataagaacgagtcatcttgtacacaaaggtttagtaaacttgcagcctcccgttaaattcgatgctccaggtgacatgatatccggtaacaagatagctctcctatccggtgacttcctcctaagcaatagctgtgtggagctcgccaatcttaaaaatcaagaactggttgaacttatgagttccgctgtcagggatttagcagaggctgagtttgtagaaccgagagatatccaaaacgctcctcttcctgcgagaccaaagagaagtgcaagaggatatgagcagtttgtagatagtaccatggagcctttggtggtgagcgaagctctgggcaacgctagagctgaatggacattgcgacatgtgttaaacgcaggtagcctgttgggaaaatctttgtcagggactttgaaggtagcaggccattcgtacgagcttcaacaaaagggtatctatttggaaacatttagctcttgcgtggca

SEQ ID NO: 1423 - DNA, 1063 bp, Diabrotica virgifera
cggacgcgtgggctttttggacaaagtatttggtggtttcttagtcctcgaaatctctagatttggattgatttaatttacattattgtcattgtcaaaaagtacatagggcattgcaacatgctgtcaaatctaaatcaatatgggggctggtaggcaaacctaaatgtcattctatcagttttcaatgtgttttagatcattttagttgcgtttctttgtaattttgttttgtacaatgattaattaacattttcactggaagaaataatgtaaaaagataatatgcctgatttatgttgtgttttgaagtgtataatgcgaagtcatcatgataaaaagttcagttttattggttgccatcagtgctacattttaagcataaacaactaaataaagttatcatcttagggacaaaaacaatggttaaatgctataaaacgtcctataaaaatgctaaataactatatccgtgttactcaagcttggaaaactgtctccaccgtaggctaacaccgaccactggaggaaaatggacctatattgtacaaagactgtgccaattacagagatccttcattatggatttcttcaagatttgtaaatgtcctctgtaataactattattcaccataggtcagtaattattgatttctaaccttcaaaatagtcgagaagtgacctattatttactttactatctccactgtctaggaaagtacttatcggctatcatatgtcactttccttgccgtcaaatgtcacttgtcataaatgtcaaaataatttatcaaattataataaaagttaatgtagatattattatttgaaacttaattattaatgatatattatgactaaaatagtatacatatgtatactcgggagaatgtatttcagcctcgcgtctgtagcttactttggtaattcctgaacaagctaatttgacaatcaattctcctgggcaatatgtaatatactatgactcttagtgatatcgacttagtcgtaaaccactggttcttaataataatacagggatattcgtaaaaaaaggttctgc

SEQ ID NO: 1424 - DNA, 699 bp, Diabrotica virgifera
attaaggtttagccgtttcagtaatctttacagtgatttagatctaatttaaggcgtaataaggaaaccgaccttgtatataaaaaaagaaaaaatgccacaccaccacgatcaccaccaccatcaccaccaccaccacaatcgtggaataattggtgagatcatccacgacgtgctacatcccaatcaccatcatcaccaccctccaccaccaccgccaataattccagtaccagttccagttccgacaaactacgggccacctcctccttactacggaccaccaatgccaccgccaccacaaacctggtatggaccatacggactaccaccttgcggtcattcgggatatagccacgggtgccatcactgccaccaccatcaccgtcgtcattattgctaaaaagacttggtttaaacaattgtcagttgtacattgtacaataatagtacttataagattttaataaagtactatttactggactaggtgtcgaaatttatactttgttgtacagtagtgcacgtattggatcttgtattcgagtttccttagacagtattagacactatgattttagcatagcaattttattagaaagattatatttttgcacttctataaataagaaaaaataatttcaaacatatttttatttgaacttaattttaccttgtaataaattcatcttgtgaact

SEQ ID NO: 1425 - DNA, 639 bp, Diabrotica virgifera
ttctgcgtccgaccgaaccggagccgggtgctaagttcttccttccagaaatttctaacgtgttcgaaaccaccacgtttttgtaataattgtataataaatttctcacaatcactaaaatgtcaggagcagctaaaagattgatcccactttttgatagaatcctcattaaaaagtttgaagcagtgtcgaaaactaaaggtggtattgttcttccggaaaaagcacaagataaagttttacaaggtactgttgttgcagtgggacaaggagctagactacaagatggttcatttgccgctcctactattaaagtcggtgataaagtactcctccctgaatatggtggcaccaaagtaaatgtagaagataatgcagagtaccaaatattcagagaatctgatattatagccaaagtagaataattgactgttttcatttaaatttgttgcattttcttgtttagataagtctgaaccctgtgggtttatgtatgaatgatctgatccctacacggtttcagacagtttgtggaaacattcaacaattactgtactatatttttgttgaaaatgatttcctgatttttatattgtagtaaaacttgtactgttttttgttacaaatatatttgtatct

SEQ ID NO: 1426 - DNA, 928 bp, Diabrotica virgifera
ctgttttgaccggtttttagtttcgtttcaactgcagattgtgtcgcgactgaattttttacacggaccaaggatggcggctgaaattatcttcatcaaagcatcaccaattgttgcagcaaccatgttgtctgatatggacgagcttcccaccatcaaattaggtgactacactcttcagctagaattagatgagctcaagccagaagttcaagagattgccaagaaggaacttagggaaacccctgatgtgaaaaaggcagggatagtggctctaagggatctactaagagaggaaaaagaccttaaagtacctctagaaaacgacctttggcttacaaggtatttgaggccttgtaagtactacccagaaagtgcctgcgatctgatcaagagatattacaaattcaaaattacacactccggtgtatacgatggattgatgcccagtaaagaaaagaatatttttgaacaaaatattctaacagtacaaccaaacagagatcagttaggcagaagaattttaattattgaattaggaaaaaaatggaaaaccgataaggtatctttagatgaagtattcaaaggctgtgttttgttccttgaagccgccatgttggaaccagaaagtcaagtctgtggagcagtggtcatcttcgacatggatggtttgacgctgtcccaaaccaccaaatttaccccctcgtttgccaagagaatagttgattggttgcaggatagcgtacctctaagaatcaaaaacatccacatcgtcaaccaaccgtacatcttcaagatcgtctttgccctcttcaagcctttccttagggaaaaactgagaaaccgcatcatcttccacggcactgaccgcaaatctctccaccaatacatgagcccagaatgtttgccggaatgttacggaggaacc

SEQ ID NO: 1427 - DNA, 2214 bp, Diabrotica virgifera
gcttaacttattttgtttgtatttatagaaatcccattaagcacctgaacacgtgaactgcaaccaacggtaccggtgaatcggtatagaaagtcggccgtactattgcacagttttactcctcattttgtcgttagctatagctgtgttgtgatatttttattgttaatttagaaattttttgcacctccaagatgcctattgcagcaaccatgttgtctgatatggacgagcttcccaccatcaaattaggtgactacactcttcagctagaattagatgagctcaagccagaagttcaagagattgccaagaaggaacttagggaaacccctgatgtgaaaaaggcagggatagtggctctaagggatctactaagagaggaaaaagaccttaaagtacctctagaaaacgacctttggcttacaaggtatttgaggccttgtaagtactacccagaaagtgcctgcgatctgatcaagagatattacaaattcaaaattacacactccggtgtatacgatggattgatgcccagtaaagaaaagaatatttttgaacaaaatattctaacagtacaaccaaacagagatcagttaggcagaagaattttaattattgaattaggaaaaaaatggaaaaccgataaggtatctttagatgaagtattcaaaggctgtgttttgttccttgaagccgccatgttggaaccagaaagtcaagtctgtggagcagtggtcatcttcgacatggatggtttaacgctgtcccaaaccaccaaatttaccccctcgtttgccaagagaatagttgattggttgcaggatagcgtacctctaagaatcaaaaacatccacatcgtcaaccaaccgtacatcttcaagatcgtctttgccctcttcaagcctttccttagggaaaaactgagaaaccgcatcatcttccacggcactgaccgcaaatctctccaccaatacatgagcccagaatgtttgccggaatgttacggaggaaccctagatttgccaaggataaatggtaaccaatggtacgatttgttggttatgtgtgataaggaatatcttgctatcaactctttcggttataagaagaaaggagagctataaggacggtacgaagaacgctccattcacagccatataacaactacgaactgtgtcctcgtatttttcgcagcataatagagataataactatttattatttttatataaaatcgtattctatttttatagcaatgttgccagttttttcattagatattttaattttagacaacggctcaaaggactatatgtgttaacaatattttcatcaattttttgataacttttatacattttagattagaaacaagtggtgtaagcctttttctttcttctggttgtttaagtttaagatagacatgaagtctggacagtaaggaaactgattgtataaacttcaaaaatatacgtgtcaaatttttagaatcttgattcttccgttgaatattcaatttcgcaaacattgtccaaaatgatatctaaagtgggtaataattgaaatagttaaaatattcgttcaatattgagcaaacttattgcgtttaaatacaaatacattaaaaacaattaggtacccaaaacagttttagcctttttatttcttcctaccctttcgtcaccaatatttttctaccccttttccatctttttctgggtctcctttttcctccgaccttttataactatttttaaagttaatttataacatagacataggcactgttagtttttccatcgcatcggtataataaaaacctgtcattaactgaagtatcattttagtgacacctttacataccaactttatgtaaattagggaatttgaataatatttgaacaataatctgtaatatttgatacaattacaccaatgattcatgtttatcataaaccttttgttctttagtgatttttactacacttttactgtcttttttttaggttactacatattataattattattgtacgagtattatgacctaaaaatatttgtgatagctttcatcactttctttaatagtgtatttgttgtacagtaattattagttttatgttaattatacgtttgtttttcattattgaataaaaaatcatacttgtttaaaaaaaaaaagaaaaaaaaaaaaaaagggcggccctcgcg

SEQ ID NO: 1428 - DNA, 974 bp, Diabrotica virgifera
cggacgcgtggggtctagaaaaagtaaaaacataaaacataacctaaatgatttgacgatggctatgtttagggctttaggaagaaatattcctttcttaaaagaacaatttggagcgctcttaggcaatactagtacttccgtaaaatttatatgtggagtagtacttttaagttatgggttatcattctcagatgaagctgtcagggtgatatctgttacccctggctatttaatgcccccatccttttggatatggacgacctttacgttctgtttcatggaaatacatttttatgaagtgttagtggacattgtaactgtgggactatgtgggaagttgatagaacctttatggggacaaatggaaatcatgactttctttgctgtagttaatctgggtgtagctgtattgaccactgcgttttactttattttatattgttgcacctttaacacggagtttctgtttagtgtacacatacatggattagctggatacattgctggagtttgtgtgacagtgaaacagattatgcctgatctagttatattgaagacaccatttggaaaaataagcaatagaaatgtaccattagcagtatttttcttatctgtcatagttaagcttataggacttgttgatggtacttatccaacaatgtttttcagtgggatgattgttagttgggtgtatctgaggttttatcagaaacattctaatggtaccagaggagatttggctgattattttacatttgcaagctttttccccaatgtcattcaaccaccaattgcagttttaagtaacgtaatccacacgggtttggttaaaataggatatgtagaaaggtagtagaaaatttgatatgtccaatccaactggtgtcacagttactgtccctattgcagatcagcatgatatggaaagacgaagacaattgccctaaaagccctaagcgaaagggtaatcg

SEQ ID NO: 1429 - DNA, 913 bp, Diabrotica virgifera
  misc_feature (835)..(835): n is a, c, g, or t
ggcgtttgcaaacttttttaatttattaaagtgtattaataagtataaaacgaaatagtagcctaaaaatgggggataaagcggatgccgagacgtttgatgatgcagttgaagagagagtaattaacgaagaatataaaatatggaaaaaaaatacaccctttctgtacgatctagtgatgacccatgctctagagtggccctctttgactgcccagtggttaccagacgtcactagaccagaaggaaaggatcattctattcacagacttattttgggaacacatacgtcggatgaacaaaatcatcttttaatagccagtgttcaattacccaatgaagatgcacaatttgacgcttcccattatgataacgaaaaaggagaatttggtggatttggttcagtttctggtaaaattgaaatcgaaataaaaatcaatcatgaaggagaagtgaatagagctcggtatatgcctcaaaatccatgtgtcattgccaccaaaacaccatcaagcgatgttcttgtctttgattacacaaaacacccaagtaagcctgatccaagtggagaatgccatcctgatcttagattaagaggtcatcaaaaagaaggttatggattatcatggaatccaaatctaaatgggtatttgttatctgctagtgatgatcacaccatatgtctatgggatattaacgctacacctaaagaaaatcgtataatcgatgccaaaactgtttttactggtcatactgctgttgtggaagatgtagcttggcatttactacacgaaagtctatttggttctgtagctgatgatcagaaactgatganttgggatactagatgtaataacaccagtaaaccatctcacactgttgatgctcacacagctgaagtgaattgcttaag

SEQ ID NO: 1430 - DNA, 1167 bp, Diabrotica virgifera
tagttctagatcgcgagcggccgctcgcgatctagaactagtaaaaaatatgaaaaatgtttgtattttattaataatgtaagtgattatttaactaaatatttaaacagtttagtcaatacggctgctgactttttacacatttttccgtaatgtatactttaaaccacaaaaaatgtttaaacaatcatttaaatattataagtcgaaaaatccaccacccaatttggatgatgttctcaatttaaataagtctgaggaattattagcaaaatccctaataaagtatgttgacgtacattttaaatacgaaggaagggtctcattatggtttaagaaaacccagtgaatgggaagcatatgaaatcatatccaaaagaggcttaattttcatcaaaaatccatttctgccaagtggtcaaaggtattggattaaaaaaagtcttcaagaatactccaaaaaaccaaataaactaaacattgacccctttaataccttgacaaataatgcagactggtgggatgttggccaagcagataagaaaattttgatgagtctgcgatgggctactcttggttatcatcacaattgggattccaaaatatattcagaacaaaacaaatcagaatttcctatagatttaaaagatatgactgaatatgtatccagtaagctaggatttttaaacttcactgcagaagcagcaattgttaattattatcatcttgattcaacactttctggtcatactgatcattccgagcaaaatttagaagctccattgttttcctttagttttggacaaagcgcaatatttttacttggaggggaaaccttagacgagaaacccactgccatatttttgcatagtggagacattgttataatgagcaaagattcaaggttatgctatcatggagttccaaaaataatgaaaactaacaatgaaacatggaatgaggatagtgagtatgtcttagctaatgaagactttttagtgcctaaagatattttgtggaggccttttggtagttatttaaatcattcaagaattaatattaacgccaggcaggttttagatgttggtcagttaaagctattaaacacagaatagatgtgtacaaaaattttacaaaaataaaatatttacggacgacgtgggagag

SEQ ID NO: 1431 - DNA, 825 bp, Diabrotica virgifera
attgcaaaataatgcttacttaagattcatattttactataacgtcaataagttttatccgtagttgtacattttgccgatgtttccagaataacattggcattatactggttgtgttgcctgcttttgcaaaactattgcttaaacagttctaaaacatggctcctaggaaaggaaaacaacccaaagaagaagtccaactatctcttggacctcaagttcgtgaaggtgaaatagttttcggtgtagctcacattttcgccagtttcaatgatacatttgttcatgttactgacttgtctggtagagaaactatctccagagtcactggaggtatgaaagtcaaagctgacagagatgaagcttctccctatgctgctatgttagcagcccaggatgtagctgaaaaatgcaaaacattaggaatcactgcactccacatcaaattgagggctacaggtggtaacaaaaccaaaacccctggaccaggagcccaaagcgcactcagagctttggctcgttcaaacatgaaaattggtaggattgaagatgtaactccaattccatctgattccacacgtaggaagggaggtcgccgtggtcgtagattgtagacagtgtctattttatctatcgatttattgcaatttttgtttatatatttaagtatataacatgttcattcaataaaatttgactgagcaattacctgttttgttagtcctttatttttcatattgattataaattttcagaataaaaattaaaaatacattcaaaaaaaaaaaaaaaaaaaataaaaaaaaaaaaaaaaaaatcctaagg

SEQ ID NO: 1432 - DNA, 1500 bp, Diabrotica virgifera
attgaatttgttttaaaattcccttcctaaatttagttcactgccgagcaagtgtctttaagggattatgtaacttttttgagactaaacaatggcaaaaatcaatacagcacttgcagttcttttattcatagtttcggtagcatggtgtcaaccgacttcagtgccagtaaatcaaacttcaccaccagtacaaagtactaccagtacaacagtacctccatcgatacctgagaagtatgaatacattgttaaactactgttcggactagaaaacgaaaaaataccggaatttatagttaaagctatctatgacgctaattttgcgacccctgcagatttgataatgctgtatgatgtaggaaacataagtttagctcaaactgtagaagtactacaaaaactaaaatacgatccctctaacgtattgagtatgaagggcttagagaccatactggatgatttaaacgtaaagtttaaaaatttctataatacgatatttttagaaaagttgaacatatctggagttcaactacggaattttttgcaagctctaaacattaacactgccgagttttctgaggctatgacctacggggatgaagacccactggttatattcaaaaaaggaaacttttcttcagcaaatttccaaaaggctttaaacactattaacgagactgaagaaaaattctacagtgtttgcagacaagaaattttccaaattgttattactcaaaactctacatcagatgtcttaagtaatttgaagaaataccattttgaccaacgtgaagctcttcagttatggaagattatgaatgtgactgaagagaatgttgaaagtgtaccagtttttgcagatctactgacgagtctggaagacagcctaaaagataccacttatttgggtgttataaccagtaacacacaagtagggatcaacgaagctgtgtatgatgatattaaagacaaactgaaaatggcaaaattatacgctcagtctatttataataataataacactgtagcgttagttccagagaaaagtgagtttacagatttagttacgttcaaagtacaaaaccataattttacagaacatgctcagatagcaacaacgaagaaagatctcaccaactgcctttttgtaacagtcaacaacggtacagtaattagtacaaaagtagatgtagctcgatacagggattctgagataaaagttgaactcaatttgacccagctaatccaaggcagtcctttaatatgtgacaagaaagtgtatggattagctaaagaaattgatgaaggagatatcgtttttgatacatttaatgttgattctgacaaatcatcagtaagcactaatgttctaagtacgtgtctggcaattctttgttttgtagtgtactttaagatatgaacattgtacataactataggtatctttatagaaagaatatagtggtaaactttgtaatagattattattattactat

SEQ ID NO: 1433 - DNA, 2315 bp, Diabrotica virgifera
gacactatcgtcaagaaataaattcgttattaatttattgttgaacgttgtcttaaacggggaattagggtaaaccatcttaacctttaagataatttgaaattgaaatcaacgtaaaataattctgtaaacaaaattaaagtcacaaaacgtgcatactggataggttagaagttgatgactaaaaactaaaaggtcacgtgtcatgcgccaaccaatgcgacacgctggttcccaagacgtggcatgaactacgatcgtcttccaagtcctccatattgacattcgacaacttttttgggaggacaggtgaatgttatagcgtttttcaaagtgtaaggtgtttattttcaaaaagtttataaaataagcaatcactatgggtaatgtgtttgcaaatttattcaaaggcctctttggcaaaaaggaaatgaggatattgatggtaggactcgatgcagctggtaaaaccacaattttatataaacttaaattaggagaaattgtaacaactattccaacaattggatttaatgtggagactgtagaatataagaacattagttttacagtatgggatgtaggtggtcaagataaaattaggccattgtggagacactatttccaaaacacacaaggcctaattttcgtagtagacagtaacgacagggaacgtatcactgaggctaaagatgaattaatgcgtatgttggccgaagatgaacttagagatgccgtacttctcattttcgccaacaaacaagatttgcccaatgcaatgaacgctgcagaaatcaccgacaaactcggtctccattcactacgcaaccgcaactggtacattcaagctacctgtgcaactagcggagatggtctctatgaaggtctggactggttgtccaatcaattaaagaacgccaatcgctagaacataggaaaagagaggagtgcgcaaaaaagtgtgcgagtgcagatggtttttttcttgtactcttgtcgtgtctactacctcgcgcgcgcgcgaaacgtttcgtataccatatgttgcaatttttgtgtccgatggggaaattcgtcatgtttcactttgggggttataaaattggctgttggcgacaagtggtgtatgaggtgaatccgaaaatagttttaggcaatatatcatatgaatctcagctttctttaggttgagagttgtttttgtagtaaaagaaccttaaacatccttcattggcgatttattattttttaactgcatgaaaatcttagttttaatgtttttatataacacttttagattgtactaacttttaacattccacaaatttctcataaaattgtgatatcttttctaatacctcttatatcaatgaacttatttttgcaggccaaaatattttcttagaaagtaattttgtatcatctataaaaatttaattttgggaattcaattaaagactttaactggcaaattttaaaatgttaaaggttctagtcacgtatttagtctggacttgcactttatagcacttgtcgcagaaagcatctaacccccaaacacgtatggtgacgtcctatttgcagaaaatgcactataatatacgatagtaattatttattgtcctctttctggtgaaaacaggctttttgtaacatatattttttattgtttgtaataggttaaaatgtacagtagacacttatatttaaaataaatattattttttatctatcaatccttgttgtaacatatggtaaggctgttcgtatttaaaaaataaaacaagaacatgtttttgaaaagttttgggcacggctcaagtattttattgtttaaatttaagatgaagtacgaatgggcgcgcccgaatccgacaagatattgtatagccccgtattcgttgtcaaaccaacgggtcttgctctggtagttaatttcggcgttagagttcaagaaggaagtagatttttttatacttatagtaaatatattatgggatatttaaagactggccgattggcttaccagacttacgtcccgcagatcttaaccggcgatgagtattcgaggtttgtttctggtcagattcgggcacgtcgtactgtacataaaatacttttgtttacttctcaaatttgtaactcagttgtggatactttgaggcgtaattttattttgacaaactgtggatttaaggttacattataagtgatttatttaaagaaatatgtttttgatttatcgtggacattccctgtttgtcagctgtattatcaaataaatttatactactaaaaaaaaaaaacggacgaaa

SEQ ID NO: 1434 - DNA, 1628 bp, Diabrotica virgifera
atatcccaagaatttgatgttcatgagacaatcgatctgccacaagaatcagttgttagacaagaagaacctgacttcttgtctgacttggagtcccaaattattccagatactaggtccagtaagaaaagctcagtaaagatagattcccctgttgttaaggagcttttagaaattgctgccaaacatctcggctatgaaaattcccagattgttaccattcatgtaactgatttagatcctcattattacatgttagatgtgatatttgagaagaatcgtgtctacgcagagtgtttggtatacatgaaacttaacgatgttgatactgcacagtctacagtagataaagttaaatgcgtcaatcaggatggcacacctctttctagacacgtaaggcaagttccaggaggtatatctcctatttcaaaagatgatccaaaagtaaagcgttacttaaaagatgggttgctacatttggataaagagtcctcccatgaattcaaatttaaagtagtcgaaattttggaggtttctagacaggttgtcagcggttctctccatcgtatcaaagccaagatagctttatccgattgcaaaaaagagagcaatattgacgcttctcaatgcggtgtccaggcaaatggtcagtcaacaatttgcgatttcaaagtttgggaccaaccttggattgaacatggaagagaaacaaatattacttgtcatgatgactcacttgtaaaaaaacaacatcattcgttcagattacgaagatcacttgacgataacgatgtagaaacaatattatcaagtgtatttgaacattttctggccaagtatgacaagaaatataggaatgtagtggaacataaatatcgttttggagtatttaaagaaaatttgaaacttattcatttgctaaataagcacgaacaaggaacggccgtatataaaattaccaagtttgctgacatgacatctgaggagttctcagcgtctcatggatataggtctgatcttcgaagcgaaaacgatattcccttccaccaagcaaaaatcccggaaattgatctaccaacatctttttgactgtggtgaccagaacgtagttacggtagtcaaagatcaagggatgtgctgtagatgctgggcttttagaaccactgataacgtcgaaggacagtatgcaattaaatacttaaaagttacagtcattttccgaacaagagttagtcgatagtgataaattggatgacgggcgtaatgatggtttgatggataatgcttactggactattgaaatattacgaggtcttgaattatgaaagagagtatccctactaaggagtggacaaataatgccacttcaacaaaactgaagctgtcgctagattgacgggagctctaaacataagccacgatgaaaccgatatggccaagaggataactcaaaacgctcctattactataacaataaatgcgaacgcgatgcagaattatgctgaaggagtatctcatccatttagagttactctgaaatcccataaaacttggatcatggagaactcatagttggatatgatgcccatactaccaattatacgtagaaacgagtgccttattggatc

SEQ ID NO: 1435 - DNA, 1054 bp, Diabrotica virgifera
actgtacaatatcccaagaatttgatgttcatgagacaatcgatctgccacaagaatcagttgttagacaagaagaacctgacttcttgtctgacttggagtcccaaattattccagatactaggtccagtaagaaaagctcagtaaagagccagcagtccaaaaatgacgccaacccattgtattttggtttaaatgaaatttctgaagaccagccgtccaaaaatgaaatcccagtgtattctggtttaaatgaaatttctgaagaccagcagtccaaaaatgcaatcaacccagtgtattctggtttaaatgaaattcccgaagttggtttaaaaaatcgcaaggtaagggccattgaggtagtagagatcaacgaagtacgacgaccatcaaagagtacagatcaacaagaacaacaggaacaacaagaacaacaggtagaacaagaagttgtcgatgacgaacattcggtccttaggagaaataaatcagatagtgattcctcgagtagtagtgattcttcagatagtagcgattcctcagatagtagtgattcctcaaaaagtagtgattcctcagatagtgatagtaaggccccataagaaacacaagaaacataagaagcatcaccagaagaagcaccatcaccaaagatagtgatgatagtgacagtgatagcgatgagcacaaacataaaacacaaaaaggacaaacatcacggtcacgatcttaaaacgccaaacctatgaaacacaagaaaagaatagggatgatgatagtaaagaaccctcaagtaaaagggtaagcattcattccaaagcacaattccccaattccaggggattcacgacaggttcttccgaatttcctcccagtttcggaagaaaaaaaaaaaaaaagcattaagcatttctaaacagaacataaaaaaaaatcttttactttacccacccctggatggggcctggaaaaaaagtttccccccggttggttaaagggggtttctaaaaaatgtgcggccaacccctccccgccttataaaaatccccca

SEQ ID NO: 1436 - DNA, 1083 bp, Diabrotica virgifera
gatcctcatcctcattagcggtcatcaagtcgttcttgacaatgaacatgaatttttgtatttttaattgagaagtgtgccttggaagtgatggaaaacttggtgtttgttgtgttgtgtgcagcctctattatctgtggttccaggatttcgtatgcttatgaagattatgacattggcagtaaatgccacacttcaggactaccgggtatatgcaaaagtgtcacagaatgtccacaggcattggactcgttacgaaaattccataaacacaattttaaaagatgtctttgggaccatatggacgaaatcatatgctgccctggcaatgtggtaaaggggcctacagagatagatccctatcccgacggtagtacggaagtacctactaaaagacccaacacggacaataaaggacaatttcctaataaaagaagataccaacaagcttgcgatgcaattgaaacagaatctagatcaaatattatttttcacatcacagatggtgaagatgctttggacaaggagtttccacatatggtagcccttggcttcgaagatagtgatcttccaccgggagaactcagctggaaatgtggagcatctctaatctctcccaatttcttgctgacagcggcccactgtgtatctaaagagaaacctataagagcccgtatgggagttacaaaaatcaccgatacccatcatcaagaaatcgatgttaagagaattagaatacacgaatcttatgatccgttagggaaacacggtgatcttgccattgtagagttaacaagaaatgccactttatccgatagcgtgaaaccagcgtgtctgtactggaaacatgacgatcctctaggactacttgtaacaggatgggggaaaacgtctgtgtataacgaagatgatagaagtgtaattttgcaaaaagccaaattggttcctgtttctactacatcatgtaacaatacatactctactagatctctgggtattcaaacaatagaaaacacacaaatctgtgcttttggaaactcttctgacgcctgctggggtgactcaagaggtcctttgcaatca

SEQ ID NO: 1437 - DNA, 1260 bp, Diabrotica virgifera
caatcgtagaaaaaaaataaaaaatcctaatcaaaatcatacaaatacaaatttacaaataatataaacagagtacagagatataatagataattttaacgtgccgagcgtgtagtgaacccagttaatcataatcacagtgataagtaataaggttttatgtttggtaatgtttggtaatcgttttattatgattggatagtgaatgtaaatgatattcaaactatttttaaacacagtaacgtcaagactgagaccatattccagtatgtcgtctttgaaagaagctaaaagactagcagcatataaagcagtagatgaacatgtcaaagatggttacattgttggggtcggtagtggatccacggctgtgtttgcagttgatagacttgcagaacgttatcacaaagaaaacatcaaaataaaatgcgttcctacatcttttcaatccagacaatggttactgcaaaatgaacttcccttggcagatttagatgtttgcccccaattagatgtttgcattgatggagctgatgaggttgatgccaacatggttttgataaaaggtggaggaggttgtttgctacaagaaaaaattgtggccagttgctcaaaaaaacttgttgttattgctgattataccaaggattctgagaagttgggacaacagtacaaaaaaggtataccgattgaagtatctcccatggcgtatgttccaatcagaagtaaaatagaaaaagcttttggtggtaccgcccaactcagagaagctgttatgaaagcaggacctgtagtgactgataatggcaatttcattctagactggaaagatttcaaccaggattatgactggagtagtataaattctgagcttctgcagattcctggtgttgtagaaactggccttttcgttgatatggcagtgatggcatactttggaatgcaagatggatctgtaaaagtaaaacatagcccaagaaaagctgctaatggcagtaatggcactaatggctttaagttataagattttttctatattgagaggttaagaatggtagttttaagggaattagttgaattttttcaacatttagataagtttcagtaaattaagaacaaacaaaccattgagaggttaagaatggtagttttaagggaattagttgaattctttcaacatttagttaagtttcagtaaattaagaacaaacaaaccatatttgttttttttttattaaataaatagatatactcatctag

SEQ ID NO: 1438 - DNA, 1144 bp, Diabrotica virgifera
gcaatagattgaataatcatattatctactctattgccctattggatcaacttgacaaggatattaacaccttttccatgaggatcagagaatggtattcctatcatttcccagagttggtgaaaattgtaccagaaaactacacatatgcgaaggtagcacaattcattaagaacaggaaacttctttcagaagaatctctggaagctctagaagaactcacaatggactctggtaaagctcaggccatcttagatgcttcaagatctagtatgggaatggacataagtgacatagatttactgaacattgaaatgttcgctactagggttgtatctttgtcagactacagaaagcggctagcagaatatttaaggaccaagatgtcagatgtagctcccaatctcgcaacattgattggagatcaagttggtgctaggttgattgctcatgctggttcccttactaatcttgctaagtatccagcttctacagttcagattttgggtgctgaaaaggctttgtttagggcactgaaaacaagaggaaacactccgaaatatggcttgatcttccactccacattcataggacgtgctggcaccaaaaacaaaggtcgtatttcaaggtaccttgcaaacaaatgctcaattgcatctagaatagattgcttttcagaacagccgtcacaagtgtttggagaaaaacttcggcagcaagtcgaagataggctaaaattctatgaaagtggtgatattcccaagaaaaacatcgaagtaatgaaagaagctatagaagagtatgagcagcaagtagcacaaacacagtctgggtttgggaaaaaaaaagaaaaaaaaaaagaaggaaatctcaaacttggcaaaggagaccggtttgagggaagcagaaaaatagaaaccctcccaaaccccaaaaaacaagaaaaaaaaaaaaaaaactatcccccttttgatgggtaagctacgctttccgaaatttaaaaggggaatgcttgtaggggggcagaaagaagaccccaaaaaaaaaaaaacaaaaacaagactttttctcttctggggaaaaaacaacaccctcccaaaattaaacgggaactgcgtggtggggggggggagaggccctcccg

SEQ ID NO: 1439 - DNA, 1122 bp, Diabrotica virgifera
cggacgcgtgggtttttctaattgtaatccctgtatttccgggaattttttgacaatgagcagaaaaagtgtaacaagattaaccgaatcacttaattgtaaattcctttgttctaatgactttattagatctggtaaaaaactaaaattaacttttatgaacataaggtctttagcaatttgtacgttacttaaaagctcttgactttcagttacacactgcaagtcattttgaatatctaacacaacgtcttttatggcatcaaaatgatttgcgtagaaaattgctgctttgatccatgttccccatgttgtaattacgggctctggaggcaagtttacacctgataatttttctttatacatttgcacacgtaaaggtgctttcaaaaatacttttttaacgtttgaaattaatttattgactaaatcaaattcactctaagaacttctgctactctgtttatgccatgtagaagacaagtgacgtgtaccatatttgggtaaaatattttcaaattttgtcctacctttaccatatacggagcggcatctgataaaaatattaaaaaatgttcactttttatttctgttggcaaaaagaaagcagagagtgtttgctgaatgaaacggcttacagtcacattattggttttctccagttgttttgcagctattaaataaggttttcctggttcatcctcttttaaggcgccgattataagatgcaccatatatcgaccacatgcatctgtactttcatcgacaattacgtaaaaggtgttatcgcttaaataaactttaatttcctcaattactccatcatacaattcattcgcattgccctttcttagcgttgcctcgttaggaatattgaagttacaatatttttgcaaaaattgcctaaaatatatattttgtaatttttttaacggaatttttgctgccaacaaagctttacacaggtcttgattaaacaaacgtttttcttttttttattcatcttgattttgaatattttgaagagatgtatgaatggactgctgaacgggtcctaatgcaatcttttttagcttcaacttatgagtagcagtttttaaatgttggtctacttgaaacttc

SEQ ID NO: 1440 - DNA, 1388 bp, Diabrotica virgifera
cctttaacgcgtccgatttaatctagtaaaatccctttcgactaaaaatttagtgcatgttaatgaattaacgagcgttttaaagggaaggaagtctcttcagctgtctaataaaattaaatctacaagtaatatcagcaagacattgcctaaacctctagaaaagccacaagctgaacgtattaaacgagctttaaactatgagaaagcgaaattaaaattggatagatgggaagctcttgttcaggctaatagatcagctgcacaattatcgttccctttaaatagtgatgagaaagtaaaggtcattgagaaacgggccatatcttaccccttatctttcagggttaaatcggaccttcagaaaaatttggaaaatatagattcacaaatagaagagtatcacatagatacagtagaaaagaaagaagatgaagactatccacttacactagaagaattaaaggaaaaaagaaaagaactagccaaacttcgtgcacaccagagttttaaagaagcaaaagctagacgccaaaataaaattaaaagtaaaaagtatcatagaatattaagaaaagaaaggataaaacagcaacttaaagagtttgaacaattacaaaaggtaaatcctgaagaagcattaaagaagttagaagatattgagaaggcaagggcagaggaaaggtttagtttacggcacaaaggaactggtcagtgggcccgaaataagcaagttagagccaaatatgataaagagagtcgtcaagaactggctacacagctccttagtagagaactcacacaaaaactaaaatcagtcaacagtgattctgaagatgaaggtgcagttgaagacgaaacctcgccaacaaatcagaaagtggatgaaagtaatccgtgggttaacggcataaaaccaacaaaagaggttgctgattttgttagtggttacagaaaatactggaatgaagttaataaaaacaataataaaaatgaggaagaagataaacaagcgcaaacaccgaactgttcagacactgatgaaagtgatatcaaaaataataatatgattgaccaagacgataataaacgtgttaagaaagtcaaaaataagggagaaaataagatcaaacgaaatgaagttagttccagcacttcccttctcaaaaacgaaaaagcgaaaagtaaaaagaaagaaaaaataaagaaggaaaataaaacgaaagaaaaaacaaatatgaaagaaaaaccagataagaaagagagcaagaagagaaaatcattagacatgtcagaatgggaagttagctataataaatctggaaatgatgacattgaagatatgtttgattctttagaagccaagatgaacaaaaaaattagccaaa

SEQ ID NO: 1441 - DNA, 1627 bp, Diabrotica virgifera
  misc_feature (1501)..(1501): n is a, c, g, or t
  misc_feature (1514)..(1514): n is a, c, g, or t
cccacgcgtccgagtggagacagaacaacgcatgtcaagacggagatgctacaaagcgtgaaatttgccagagatgtgccaagcaaactaagtcccccctggcctatcctatgtgctgtaatgaagaagatgaagtccataaatggtgctatcgttacaccacctacggcaaggtcgcataggaatatagtagcgatgctacttattaataaattagtgtgatagggcattcaatacgaagccaccaacaatgcaatttatcaaaaaaaaatctttgatttagtcagaggaatggtgcgtgtggacggacttttatttgtgatattgtaaagtataagtgtatgttaaaaatcgtgtgtgtacctacttatatattttgtgttaataattagtagaggatgattctatataaggtcgaactgcaccggtgtgttcaatggatggaagttgtttgatatgtaatttggtatgttaaagtttataaaaaataagggatgctcaatataattttgtcctgaatattaatttatttgtaattagaaaaatatttttttttataaatttataagaaaattctcgatccggtcagatattattttagaatttttggatcattcggaacaaaaaagatcgtttgtctttttttttctcttaaattgacagttgatcgttttcaacagttgaaaaaatcaatactttaaaataaaataagtccaaaatacttatcaagaactgatataataaggtttgaacttaaatttaggtacttcgtaatttcaataataatatttttacttatactttttgagccttgaaaatctttttcggtttaaaattttttataactcgaaaacgatcaacttaagaagaaaaattacaaaaggtttttgtgttcgaattatccaagaaatctaaaataatatctggacggaccgaagttttttttagtttacaaaaaaagtaattttttaattattataccccttgttttttataatttttaacatactaaattgcatatcaactgatttctatccattaaacatatcggtgtaggtcgaccttatatcgtatattcgactatattggtgatatttataagatgaattcttacatttttagtttgacaaaaattggatcagaatattttaacgataaaacagccttatcttatgagcttatttcaacaagaacatttaacttcagtctggagtaaaattttgcagcattaaattaatttaataacactttgacaatcattttttcttcatgggaaactaacaaatgattttcttgtagtgtttcctgtcgtatacatctcgtatatttctatagttaccttgatatcagtgatgctatcataatttactttcctttagtttggctccttgtataacctatttcatgtaacaaaattgcagtagtgtacaattttccttttgtgatgtcatcttaaatgtttattttaaattgaaaacaattattgaaaatacttgaactntctgtgcttatgngaatagcaaatagtgtgtaatacagcaagctcagtctttcatttacaccaatctacaattcttctttcgcctagagcaaatatgtttgtacatcttgtacaaacaaacatgtc

SEQ ID NO: 1442 - DNA, 921 bp, Diabrotica virgifera
cagtgactcagttcgtctcagttattcttgtatgtttgctttggtcggtgtggttgaaactgttcagcgatttgaagtgtctgcgattcgtgtttacattttttaggtgctagttactctcttgtgttaacctcaaattgatttaaacgtcaaaaatggatgaccggaaagcgctcgagaagctttaaatgtgccgttcatcatcgagatcgcgaagtttcgtcagaaaacgacttccatctgctactagtggagccgccattgttccgcaggatggttaccatagtggcgaatgagtttttgactgatgacagagatagaaaatactatgccgaccactacacgtgttgtcctcctcctatttttatactaaccgttaccttagccgagttggggttctatttatattactacattaccacaggagaactcaatccaagtgggccagtactagtagactcaatatttatatatagaccagataaacgaatcgaaatatggaggttcctgttgtacatgttattacatgctggatggctccatctaagcttcaacctagtagttcaattgttggtgggcctccccttggagatggtccacggttcgggaagggtagcgttaatctacatgtccggagtggcggcaggttcgctagggacatcagttttcgataacgatgtctatctagtgggggcctcgggcggcgtctacgcgctactagccgcccatttagctaatgtattgctcaattacaataatatgcagtgtgggatcttgaggctatttggaatttttgccattgcttcttgtgatgtcggctacgccatctactccaggtacgatgccgtgggcctgccagttttctacgtagcccatctcaccggagctttagccggcctgacgatagggcttctagtgctg

SEQ ID NO: 1443 - DNA, 955 bp, Diabrotica virgifera
gtttaagtttaagactcacacattgcataaaataattttataactaaactaaatcatggggaagaataagaaagacaagaaaaagggaaaaggggccgagaaaacaacagcaaaaacagaaaagaaactgtcaaacaaaatgaagaaagaactgcaagctaagggagaggatgatatagaatctattttattacaaattgagaaggaagagaagaaaaggttgactgttactgaagctataatcagtccaccttcaagaagattaaatttcacctttatggcccatccagaaaaagaacagcttattttgtatgggggagaatttttcaatggacaaaagacttttgtgtatggtgacttatttttctacaatataccaaataacaaatggacagtagttaaggctcctaatggccctccccctagatgtggccatcaaatgattgtctcttcagcaaataaaggtcaattatgggtgtttggaggagagtttactacacccacacaatcacaattttatcactacagagatctttgggtcttccatttagctactaaacagtgggaaaaaattactgctccgaatggaccatcagcgagaagcgggcacagaatggtattaataaagaagcaaatatttgtttttggaggttttcatgacaatttaagagattgtaaatactttaacgatatatacagttttgatattgaaacatacaaatggaccaaaatcgaacctttaggtactcccccacaatctagatcgagttgctgtatgattggactcaacgacggaaaaatacttatatatggtggttacagtaaagagaaagtaaagaaagatttagaaaaaggacatgtatatagtgatgctttcttattgacaccaaaaaaaaatgatacagctgctacagtgtataaatggtctcaggtaaagattggagggatctcattt

SEQ ID NO: 1444 - DNA, 414 bp, Diabrotica virgifera
cacgcgtccacccacacgcagatttctcccagcccttcgcactctttctcagcgtcattgggaacctttttttacgaatgcccctagtatctaaagtttgttcgctaaccaaattatttaacggggctggaacagctacgtattatataagtttactgtagacgtggcaaacttttcactaacaggagattgcctagtccaattactacactgagatggctctgcgaataaacctatggttttgatacgttcaaccgacatgctggaaatgatcgacatacaagttgacacgaaagttgtatttattttatgtaaatgaagtgaacaatgtttatcgggctaatttttatataatagcttatctagtagtcagatttggtattacttaaggaagtatgtgatttatagttatga

SEQ ID NO: 1445 - DNA, 1287 bp, Diabrotica virgifera
ttcttgcgtccgatttagcccaaaatgtctgaagaaagtgaaaaaaactcgttggaaaaagttagtgaagtcgatggaagtacggacggaataatattaaataaaagtgcaaagaaacgtaacaaaaataaaaagaaaaagaatgaaaaccaagaagaaaacagtgaccaaagcaacgaggttgtccaagccgaaaacaacttattatctaacttatcgaaccctattaatacaatatcaattaaggagctaaaagcagccatggaggtatttactctatcacaaaaacctgccaagagttcagaggaagctctaaagaagacattccagttttggaatacccagcctgttcccaaaatggacgaaaaaataactgttaacgaagccattgaaccagacaaagaacctgctgacattagacaagaaccgtacagtttgcctgatggttttatgtgggacactcttaatctagatgaaccgttggtgctcaaagagttatatacgttactcaatgaaaactatgttgaagatgacgattgtatgtttagatttgattatcaacctgaatttttgaaatgggctttgcaacccccagggtggaagcgagaatggcattgtggagtcagagttgtaaaaagtggtagattagtgggatttatctctgcaattccagcaactctaaacatttataaaaagacacaaagaatggtggagataaattttctatgtgtacataaaaagctacgttccaaacgagtcgcaccagtgttgattcgagaaatcacccgcagagtacacctgaacggcctctttcaagcagtgtacaccgccggcatagtcctaccgaaaccagtgagtacttgtacctactggcatcgatcgctgaatccgaaaaaattaatcgaggtgaagttttctcatttgtctcgtaatatgacgctgcaacggactctcaagttgtacaaactgccggacaagcctaagactccgggatttagaaaaatgacagccgaagatatacctcaagctcacaaattactagtagagtatttaagtcgattcgacctagcgccatattttaacgaagaagagttcacacattggttcctacctagaacgaacataatcgacagtttcgtggtggaaaacaacggcgaaatcaccgatttcgtcagttactacactctggcatccacggtaatgcatcacccggtccacaagaacctgaaggccgcgtactctttctacaacgtatccaaagggacgtccttgggtgccccctgatga

SEQ ID NO: 1446 - DNA, 1430 bp, Diabrotica virgifera
gttcggctaggatttatctagctactctttgtgtccgtaccctgattaacaaagataagatagacgtactaagactgctatattttatttgcgattaatcattcaagtctttaataccatcaagtgacgacgatcgacgtgattaaacgatgacggagaaagaaaataaggaatccaatgaagatcaatatgataatgaaattgcggaaaagaaaattccttacccgaaatcagtattctttatagtcagtaatgaattttgcgaacgattcagctactatggcatgcgaactatcctcatcctgtatctcacgaatatactactgtttagtgaatcacaatccttagtaacttaccattcgttctccatggctgtatatttttttccaatcattggtgccataatttcagacagttttttaggaaaattcaatacaatcctctatgtttcgatgatatatgctagtggaagtatattacttgcactaacagctagtgatcccatagggttacccaaagttggcttctcagtattgggcctattactcatagccgtgggcactggtggtattaaaccatgcgtcgcagcctttggaggagaccaatttcgcctaccccaacaggagaaggatctagagaggtttttttcattattttacttctccatcaatgctggaagtttgatatcaacttttattactcccattttaagaaatgatgtacattgcttcggtaatgagagctgctttcctttggctttcgcagtgcctggaattctaatgataatttctgtagtcatcttcggcttaggacggccaacgtataaaatcaaaaaaccagagggaaacgttatagtacaggttacaaaatgtattgtgtgtggaataaagaataagttcaagtccaaagataaaaaggaacattggcttgattatgcagaagaaaaatacggagaaaaactagtaaacgaggttaaggcaacactccatgttttggttctctttcttccgctgccgattttctgggctctctatgaccagcaaggatcaggatggactttgatggcagtgagaatggatggaaacattggattctacacaattttgccagatcagatgcaagtcgtcaatccattgttgattttggcttttattccactgtttacctactacgtatatccacttctaggaaaatgcaacttactgaagacttctctgcagcgaatgcgttgtggaggacttttagcagctgtcgcttttgccgtttctgcatttgtcaccatggctattggaaaaaaggttccagagttgcctccagctggtaaatttacaattaaggggggactaacccgcgaaactgccagaaggtttttaagccccggtgggaacagaaaataaaggctttttttcctttggcaccacaaatcttca

SEQ ID NO: 1447 - DNA, 926 bp, Diabrotica virgifera
ctaaaacagtctcctcgtctgctaacacaagtagataagtttgacaaaatgggagaaaataacatcaaagaaaatctcctggtcggtctaggaaacccgcttttagacatttcggctgtagtaaataaacaatttttggataaatacgaactaaaagaaaatgacgcaattttagcagatgatagacatcgtaatttatacgaggacattacagaaaattacaaagtaagttacattgcaggtggcagcgtacaaaatactttgagagtggcacaatggttgttgggaacacctaacgtagtaactaagtttggatgtgttggaaaggacaaatactcaaaaattctccacgacaaagctacagagagcggtgtaaatgttaggtatcaatatcatgaaagcgaaccgacagggacctgtgctgttcttataactggccaacaccgttccctttgtgcaaaactcggcagttctggacatttctcagtggagcatttgcgccaaccggaaaatagaaaactattagaaaatgcacaattcttctacgtgtctggatatttcttatcagcaaatcgcgaagcccaaattgaagctaataaaatagcattgaggaatgaccgaccctttatgctgaacttaagcgcacctattgtttgtcaaatctttgctaaggatatcctagaaaccctgccatatgtggatgtacttttcggaaatgaatctgaggctgaatctatatccaaaagcttaaatctaggctccaagaatgtggaagagatcgctttaaaattgtccgaactacccaaagaaaacaaaagacgaaaaagattggttgtgataactcaaggtgtagatccagttgtatatgcatttgaaggccaggttaaatcattttcagtagtaaaattgccataagacaaaattgt

SEQ ID NO: 1448 - DNA, 927 bp, Diabrotica virgifera
tactttcaatgggtctaataaccctcagggcccttataaatttaaaaataaccccggtacaccaatctgtaagaaacagcggtcacagtgtaaattaccgaaaacgagctccagaagcctcaagaactgttatctgagctgctgaaggcgttcaaggtttcatgtggtggtggatcctttggcatttgtggacagaacctgaccacattcttggcaaatttccataaccagatccttccacatggtcagatgaagaactgggtatacaacagtaaaatgtgtatatttgaaagaacgcattatggatatcgtcttattgaagttgagtggtgtttggaaggaataagagaagacctcctcctatcaataatccagttacgatgaaggtaggtgctggacagtataagtcaagtaactgagcaattactatgtaccaattataccaccaagacgagcagccatggatacagcaatacctgtagctctaagatgagtggggaagatttctgtgatgagcgaatctaaagcagcgttaccgcatgaaataacactactgaatattgcagatacaattagattatgagtcttgttgtaaacgaaatacatgcatgctgagcacaatccagatgatactgtactgaacaccaagaaaaattttctgccatttacttacattatggttcacttttgtagtgatttggatgaactatgttaaggaagtcttaaatcaataaaaaatgatcattttgtaattcacctggagataaaatatatcttcataattagtattagtaacgtaagagaaattagtttagttaatagtgtttatacattttcgtcatgtattatattattaataaatattattattcaaatcttcaccactcaatcttagagctacaggtattgctgtatccatggttgctg

SEQ ID NO: 1449 - DNA, 1206 bp, Diabrotica virgifera
ctaaacaataaatgtaaatatacaacataattttgaacagactccaacattcacattcaacacatttccatacataaatgacgaatgaatgaagattattttttagtttgacaataataatatgctgaacatatcatactgcccaccaaatatttcagtatggaatatatggatactagttctagatcgcgagcggccgcccttttcattcctttttgtaaaaaaattgtcacgtttaaggtgatagtttatagaaatcaagaaaataaacaaaagttatcaaaatgggtcgatatgcacgtgaacccgaaaatgctgcaaaaacctgcaaagctaaaggttcaaacttgagagtacattttaagaacacatgtgagactgcaaatgcaatcaaaaagatgcccctcaaaagagctgtagcctatttaaagaatgtagtaatccagaaggaatgtattccatttagaagattcaatggtggagttggtaggtgttctcaagctaaacagtttggtactactcaaggaaggtggcccaaaaaatcagcagaatttcttttacaactcttaagaaatgctgaaagcaatgctgattatagtggacttgatgtagatagactagttatagaacatattcaagtaaacagagctgctagtttaagacgtcgtacatacagagctcatggtaggatcaacccttacatgtcttcaccctgccacattgaattatggttgactgaaggagaatctacaccagaagctcccaaaaagtattcacagaagaaatcggctcttaataaagttaagaaaccaaaagcacctcaagctgtatcaaattaaacagtttgttatttaattaaaatatattttctgtattctctaaaaaaaaaaaaaaaaagggggggccggtcccaagaaggggtccggggtttaacgtacctgcggtatttcgaacgccaaagactctttttattaaggggaaccataatattactatatttcctgggtcctgcgattttttaaaaacaaccgagagttgggaaaaacccgggcggtttatcccacaattgtatatatccctggccgcctttcccccccttttttgcgcaatagggggagaaaaaaatagaaaaagagccccccccccttcccgccccttcccccacattcccttccccccctaaaaggtaaaagggcggccctcccc

SEQ ID NO: 1450 - DNA, 1085 bp, Diabrotica virgifera
gttatactgcggaggccatctagccctgcagtggtgatctaaaccacatctctgaacactttcgagcttcagcggaccagtaatctggtcatactttgcggaattccaacccaaatccaagagaggttccatgctttcattcatggccgctttctggaccttgggtaacttatttgtagctggattagcttggttgattattccagctgatattggtttcaagaaccagtattttgtgtataattcttggagaatatttcttctcatttgctcattcccatcctttatagtggcggctttactgtgcttcttgccagaaagtcccaagttcttacttacacaaggtaagagtgaagaagctcttgcaatctttaagtacatttaccatgtaaacaccgggaatgatcccgaagactatccagttaaacatctcatctacgaacaagaagagctcactcttgaacaaaaagccaaaattgcaaagagaggcaaatataccaatatgattgttgatattttagataatagtaaacagttgtttgtttcaccaattttgaaattcacagttatttcaattaccatcaactttacatttcacattggatactacggtcttatgatgtggttccccgaaatgtttaacagatttgacgaatacgctaaaattcacgatggtgcagaagctggtgtatgtgaagttgtggactacgttgtcagtagtggcagccacagtgccagtgttttatgcagtgacaagatttcatcatctgtatttttagaatcattgataacagtgtctgctgcattaccaagtaacatcgttgctgtattgggaatggacaaactgggcagaaaatttttcttggtgttcagtacagtatcatctggattgtgctcagcatgcatgtatttcgtttacaacaagactcataatctaattgtatctgcattcagtagttatttcatgcggcgctgcactgcataccaaaacgagcatgtcatcggcaaagttctcaacaaatggctgacgtctggcacacttaatagataacatattatcatcacccacccatgtcccgatgtcc

SEQ ID NO: 1451 - DNA, 992 bp, Diabrotica virgifera
  misc_feature (989)..(989): n is a, c, g, or t
agggtttgggtttccttcctttaatttttattgtgtaattgtaaggattgacacatgacctcaaaatttatgttggtaatacagtaaactactccttttctttctattgggcagacaagctctctttagagaggtgtggacatgaaataaatctaaaaaaatacaaagcatcccaaaagaaacgtactttaaacaaaagtttaaaaaatgggccggtacgcacgtgagccagaaaatgctgcaaaatcttgtaaagctaaaggttcaaacttaagagtacactttaagaacacatgtgaaactgcaaatgcaataaggaagatgcccctcaaaagggccgtagcatatttaaagaatgtaattattcagaaggagtgtattccatttagaaggtttaatggtggagtaggtcgttgtgcccaagcaaaacaatttggtaccactcagggaagatggcctaaaaagtcagcagagtttcttttacaactcttgagaaatgctgaaagcaatgcagattacagtggactcgatgtagacagattagtagtagaacatattcaggtaaacagagctgcttgtttgaggcgtcgtacatacagagcccatggtaggattaatccttacatgtcttcaccttgccatatcgaattatggttaactgaaggagaatcctcacaagatgctcccaaaaaagcttcacagaaaaagaaatcaacccttgacaaagtgaagagaccaaaagcacctccagctgtgacccattaaatgttcttactgtcacctgttaataattaaaataatgactttgtcgatatagttttttatttttttttatagttcgtattcaaatcctgagtagtatacatgtgcccatatcgctttgagatacaagttttaagtttttctgctgttctcggttatcgttacggggctagtctattgttgataacaagtgaaataaaaagtaaatagctatgtaaaaaaaaaanaaa

SEQ ID NO: 1452 - DNA, 956 bp, Diabrotica virgifera
cacaatacttgagacaaaaaaatataaaaacttgactttctctgttaaaacattatatttatagttaaaaatgtcgtctggttcgcctaattattgtagtctagttattttgctggtagttactgttttatgtcaaacaaaatgtgacgaagacggtaccatagttgaattgaagcaaggaaaaatcagggggcacgtactaaaaagtgaaaatggacaggactattatgcatttcaagaaattccatatgctgctcctccagtaggaaaaaatagatttcagctccctaaagaaccagagccatgggacaatattctagatacaaaaaaaaatacaaaaatttgttaccaaacaataagcaggttcgactttcttaaaatagaagaggattgtctgtatatcaatgtttacagtccacagaaacctggtagcgatgacttactcccagttcttctatggatccacggaggtggtttagtaaatgaatccagtacaattgaatactatggcccgaaatatattatggatcacggtgtggtcgttgtgacttttaactaccgtcttggaccatttggatttcttggtaccgacgatggagttattccccagaatcttggtttaaaagatcaaagatttgctatagaatgggttaatcaaaacattcatctctttggaggaaatccagaacatgtagtcctagttggtgaaagtgctgggtctctatctgttggtttacacttaatgggagactgggaaggaggcaaagaactatttcatggtgtcatcatgcagagcggtactcctatttctggtatttgtactacacaacatccaactgaacaaacttttaggcttggtaaaaaggtggatccatcatttgattcaaaaagctccgaagaactattacaagtactacaaagtgcttcagcacatgacattcttctgggctggaata

SEQ ID NO: 1453 - DNA, 2580 bp, Diabrotica virgifera
ccttgtccgtagtaattgctcagttactatgttaccaattaccccaccaagacgagcagcaaccatggatacagcaatacctgtagctctaagatgagtggcagttcagcgaccttctaagacagagcgcacgagaccgaatctcggcactaacgacattttcatttctataaatgatagagccgttaatctacctctgggaaaagaaagacatcgcaatagccacgcgcccggccatctagccctgcagtggtgatctaaaccacatctctgaacactttcgagcttcagctagaaaccccgtccgctgcccccactgagccgcaccccggaactcgcccaaatcatcaaattcccgtcgccgcaaacacaacactctctgtgcttactgcgtagaatggtagaaggtgaatcaccaagaaaccaaaagcaagactctgatgtaaaaatcgagcacctagcaaacggctgcggatcaaaggatctcgagcttggaaactttacaacgaccaaagaacttccatctaaactctcgtcggatgtagataaatccagtgataaagctgacttcgaaaaagccatcgaactcaccagatatgggaaatttcacttcttactactagcagtatgcggcttcgtaagcacctccgaggagatggacgtcatctcgatgtcgttcatcctcccttcggcccagtgcgacttaaacctcaacactcaaaccaaagggtggctcaattccatcatatttattggtatgatggcaggagcctacgtttggggttcagtagcagactcattgggtcgtaaaaaggtgcttattgtgagttccttcatgaatgctctatgtatagtagcttctagcttctgtcaaacatatgagctgttcatggtcttcagatttctaaacggggcggcattagggggcagcggaccagtaatctggtcatactttgcggaattccaacccaaatccaagagaggttccatgctttcattcatggccgctttctggaccttgggtaacttatttgtagctggattagcttggttgattattccagctgatattggtttcaagaaccagtattttgtgtataattcttggagaatatttcttctcatttgctcattcccatcctttatagtggcggctttactgtgcttcttgccagaaagtcccaagttcttacttacacaaggtaagagtgaagaagctcttgcaatctttaagtacatttaccatgtaaacaccgggaatgatcccgaagactatccagttaaacatctcatctacgaacaagaagagctcactcttgaacaaaaagccaaaattgcaaagagaggcaaatataccaatatgattgttgatattttagataatagtaaacagttgtttgtttcaccaattttgaaattcacagttatttcaattaccatcaactttacatttcacattggatactacggtcttatgatgtggttccccgaaatgtttaacagatttgacgaatacgctaaaattcacgatggtgcagaagctggtgtatgtgaagttgtggactacgttgtcagtagtggcagccacagtgccagtgttttatgcagtgacaagatttcatcatctgtatttttagaatcattgataacagtgtctgctgcattaccaagtaacatcgttgctgtattgggaatggacaaactgggcagaaaatttttcttggtgttcagtacagtatcatctggattgtgctcagcatgcatgtatttcgtttacaacaagactcataatctaattgtatctgcaatattcagtagtgttatttcatgcggtaacgctgctttagattcgctcatcacagaaatcttccccactcatcttagagctacaggtattgctgtatccatggttgctgctcgtcttggtggcataattggtaacatagtaattgctcagttacttgacttatactgtccagcacctaccttcatcgtaactggtttattgataggaggaggtcttctctgcctattccttccaaacaccactcagaaaccacttcaataagacgaaactatccatacgtgaccgtattttatgaagattgacttgcgttctaagtttctgttatgttaagaaaatatgtttgccatttacttacattatggttcacttttgtagtgatttggatgaactatgttaaggaagtcttaaatcaataaaaaaatgatcattttgtaattcacctggagataaaatatatcttcataattagtattagtaacgtaagagaaattagtttagttaatagtgtttatacattttcgtcatgtattatattattaataaatattattattcaaaaaaaaaaaaaaagggcggcaaaaaaagacccgtgggggggtaatgaatcagtttattagtggagagtatgaactatgtgtatggaaaggatacaggaataaaccgcgaagacttctgaggagcacctgaaaagaacatatatcttaatgcttagaatgaagagcctaagggatactacctcaagacaaagggagagtactgtaggcaccttgcag

SEQ ID NO: 1454 - DNA, 1331 bp, Diabrotica virgifera
gagctcacgccttttagtggaacaaattataatagagtacaaaaagtcagaaactatgggtgtctccaagtttctccttttattgggagcccttttttgtgccatagttgctattcaagcaaacaattatggaatgcagatctttgtaaaaacactcaccggtaaaaccatcacactcgaggttgaaccatcagataccatcgagaatgtcaaaggaaaagttcaagacaaggaagggattccaccagatcaacaaagattaatctttgttggaaagcagttggaagatagtcgtactctctcagactacaacattcaaaaagaatctacactccatttggtacttcgtcttagaggtggtatgcaaatctttgttaaaactttaactggaaagaccatcacccttgaagtagaaccttcagatactgttgaaaacgtcaaagctaaaattcaagacaaagaaggtataccaccagatcaacaaaggttaatctttgctggaaagcagttggaagatcttcgtactctctcagattacaatattcaaaaagaatctactctccatttggttcttcgtcttagaggtggtatgcaaatctttgttaaaactttaactggaaagaccatcacccttgaagtagaaccttcagatactattgaaaacgttaaaggtaaaattcaagacaaagaaggtataccaccagatcaacagaggttaatctttgctggaaagcagttggaagatctccgtactctctcggactacaacattcaaaaagaatctactctccatttggtacttcgtcttagaggtggtatgcaaatctttgttaaaactttaactggaaagaccatcacccttgaagtagaaccttcagatactgttgaaaacgtcaaagctaaaattcaagacaaagaaggtataccaccagatcaacaaagagtaatctttgctggaaagcagttggaagatatccggactctctcagtctacaacattcaaaaagaatctactctccatttggtacttcgtcttagaggtggtatgcaaatctttgttaaaactttaactggaaagaccaccacccttgaagtagaaccttcagatactattgaaaacgtcaaaggtaaaattcaagacaaagaaggtataccaccagatcaacaaaggttaatctttgctggaaagcagctggaagataaccgtagcctctcagactacaatattcagaaagagtccaccctgcatttagttcttcgtttaagaggaggaaaataatcttgttgaaattaaatatatttttatattttcaataaataaattataatct

SEQ ID NO: 1455 - DNA, 1477 bp, Diabrotica virgifera
  misc_feature (1352)..(1353): n is a, c, g, or t
  misc_feature (1378)..(1378): n is a, c, g, or t
  misc_feature (1401)..(1401): n is a, c, g, or t
  misc_feature (1437)..(1437): n is a, c, g, or t
ttttgattatttcaattttcgaaaacgttcaataagcagggtgcagggtcaagaagtaaagtgttctagaaatacagattaaattgtttcctttgtgttattgaaaggcaaaaataaaataatgcagatctttgtaaaaacactcactggtaaaaccatcaccctcgaggttgaaccatcagataccatcgagaatgtcaaagctaaaattcaagacaaagaaggtattccaccagatcaacagagattaatcttcgctggaaagcaattggaagatggccgcaccctctcagactacaacattcagaaagaatctaccctccatttggtgcttcgtcttagaggaggtatgcaaatctttgtaaaaactctcactggtaagaccatcaccctcgaggttgaaccatcagataccatcgagaatgtcaaagctaaaattcaagacaaagaaggtattccaccagatcaacagagattaatctttgctggaaagcagttagaagatggccgtactctctcagactacaacattcagaaagaatctacactacacttagtgcttcgtcttagaggaggtatgcaaatctttgtaaaaactctcactggtaagaccatcaccctcgaggttgaaccatcagataccatcgagaatgtcaaagctaaaattcaagacaaagaaggtattccaccagatcaacagagattaatctttgctggaaagcagttggaagatggccgtactctctcagactacaacattcaaaaagagtctaccctccatttggtacttcgtcttagaggaggtatgcagatctttgttaaaactttaactggaaagaccatcacccttgaagtagaaccttctgataccatcgaaaatgtcaaagccaaaattcaagacaaagaaggtataccaccagatcaacaaagattaatctttgctggaaagcagttggaagatggtcgtactctctcagactacaacattcaaaaagaatctactctccatttggtacttcgtcttagaggtggtatgcaaatctttgttaaaactttaactggaaagaccaccacccttgaagtagaaccttcagatactattgaaaatgtcaaaggtaaaattcaagacaaggaaggtataccaccagatcaacaaagattaatctttgctggaaagcagttggaagatagccgtactctctcagactacaacattcaaaaagaatctactctccatttggtacttcgtcttagaggaggtatgcaaatctttgttaaaactttaactggaaagacaccacccttgaagtagaaccttcagatactattgaaaacgtcaaagctaaaattcnnagacaggaaggtataccaccagatncacaaagattaatctttgctggnaagcagttggaagatagccgtactctctcagactancacattcaaaaagatctactctccatttgtacttcgtctt

SEQ ID NO: 1456 - DNA, 1161 bp, Diabrotica virgifera
gccatgtcaaagataagatcctatttattagaacaaatatcgaaattcagaaaacctatgactaactatcaaatcccacaaaataacctactgaaaaataaagggcactatgaattcttactatcgaatgaaagaaacatagctgaggaaatagctaatgaatatatagacacaatgagtaaaatatactattcatattttaagtcatatgaggccagaattatgaaattacaatatgaagaaaatattaccgttgatgaccttatgggaatagaggatacagctactagaggaatgtttaacaagtctcttaaacataagactacagtattttctattggaaacagaggagatgttttggcacaacaattagaagctcctattattgttccccatgcagaaaccaaaaacaggtttccatttgaagctctgtttagaagtgtagaatatgctctagtagataacgcctgtcgagaatacttatttattagcgaatactttattgtcaaaaatcaatctgcacttgacttattctacaaaattatggagaaaaccctcacacttcttacgaaaaacttaaaaagctacatttcatcttgctacgattccatagccatatttttatgttttcatttggtactgagatataaaataatgtgccataaacgatgtgtaccagctttagaccagtattgggatattttagagaacattcttctgccaagatttgagtatgttgttcagttgaatataaagagtatacgcgattgcgatgttacaaagtttaatctggaattaggtccacattatattgccagaaggtatgccgagttcagtgcagctatatgtagtataagcgaaaacttctattatgaactgtttagcaagcttttagcgagactcaaaatttatctttccgtaccaaccttcagttctatcacctactattccaattttcgggtaatccaccaacatgaaagctccctggcataataaaacgaaaaaaactccccctcctcttcccaaggttttctataaaaatttgagctattaccttcattttttttttaaaaagaaaccattaccctttttgcggttctaaaagaaggaaaaaatttttttaaaaataaaaaaaaaaaaaaggggggtttctttggtaaa

SEQ ID NO: 1457 - DNA, 754 bp, Diabrotica virgifera
ggcactggtgcagcttggttaaattatcaagcatttcggctaaacaaaaaagcaacatggcaactgaaaacgaacaaggagactgtcctgacgatttggaatcggccgaagaagaggaagttgatggatccaaacagttggatttccctaacgtttatgctgcccttcaaagtccataggaatgctgcgatgcttgcattcttacctacctcagtcatgtgtagtattagttagatttctaaagtatttgctaagggcgactacattttgctacatggcaactgaaaacgaacaaggagactgtcctgacgatttggaatctgtcgaagaagaggaagttgatggatccaaacagttggatttccctaacgtttatgctgcacttcaaagtcagaggaatgctgcgatgcttgcactcttgcctacctcagttaagagaagaattaaggctctaaagagaatccaattagaggcaactaatattgaagctaaattcttcaaagagaggccccatctaaaatgtaaataccacaagttgtaccagcctctttacgagaaaagaaataccattgtcagccagcccatacgaacccactgatgaagaatccccatcctcgtatgaaaatgattaggatcccccgaaaaccccatccgaaaaaataaaatttggcgattctactcccaaaacagaacctcacgacgaaaaaggcgatactgattccagattacaagttctcagggatgtgggcctact

SEQ ID NO: 1458 - DNA, 2598 bp, Diabrotica virgifera
aaaatattcacttcgctataaaattaaatagagggccaaattatagaacatggagacattaaaaacgagggaaaacacaagaccagaatgtcttaactatcgaacctgaaagaatgaacgcaccagttaattcaaaaaggcaagtatagtagataaggagaaaaaggtttgtagatttttttcttacacaaacaggtattgtgacatatttaatcgaatataagacaagaaagggacatatcaggggattgtgcatatccataaattaacaaaaaacgacatacaaaaacaagaaaacattattatacgttgtgtactacaacagtatggggcaaaataaatagtactgaaatgaatatttaaatggggtttgacttgaagtggggcactccctggtgtggttggtgtgttttaatgaaaattttaaaaatccaaaaggattgcgttcaagacgttttgggcttgtcagtccgtcatcggtgagctccccgtccttgcagggtggccacggtgccaaacgctggttgggttccagctacgtggtggaaggtgtggaatagtttgtcttgaggtccgcccacgcgtccgcccacgcgtccgcccacgccccacgcgaccgcttggcaacacgagaatcacgttgtgaatttttatagtaaagccagcatggcaccaaggtacgagatcgcagtcggcctccaaaggggtcacaaaaccaccaaaatctcagacaaatccaaactgaataaagttcgtcccgctaggttgaaggggatccaaaccaaacacaccaaatttgtcagagacatcatccgtgaagtcgtaggacatgctccatatgaaaagagagccatggaattgttaaaggtgtcaaaggataagagggccctgaaattcctgaagcgtcgtcttggcacacacatcagagccaagaggaagcgtgaagaactatccaacatccttacccaaatgcgtaaacaacaagctacacataaatagattgtattttgtttaattaatagataaaaaaaaaaaaaataaattatcaagcatttcggctaaacaaaaaagcaacattgaaaacgaacaaggagactgtcctgacgatttggaatctgtcgaggaaagttgatggatcagatcggacgaaagtggggtcaatccgaattttctttcttccatttgccgcctttggtactggtgcagcttggttaaattatcaagcatttcggctaaacaaaaaagcaacatggcaactgaaaacgaacaaggagactgtcctgacgatttggaatctgtcgaagaagaggaagttgatggatccaaacagttagatttccctaacgtttatgctgcccttcaaagtcagaggaatgctgcgatgcttgcactcttacctacctcagttaagagaagaattaaggctctaaagagaatccaattagaggcaactaatattgaagctaaattcttcaaagaggtacataatctagaatgtaaataccacaagttgtaccagcctctttacgagaaaagaaataccattgtcagcggccaatacgaacccactgatgaagaatctcaatggtcgtctgatgatgagtctgatcttccagaagccattaaagaaaaaattaagttagacgattctaaaaaagaaacagaacctcaagacgaaaaaggcgttcctgatttctggctcacaattttcaggaatgtcggcctactgtctgaaatggttcaacctcatgatgttccaatactcaaacatttgaatgatatcaagattatctgcaaagaggatccaatgaaattcattcttgagttccacttctccacaaatgaatacttcactaataccgtgctcacaaaggaatatgatatgaaatgcgcaccagaagatgatgacccattcagcttcgaaggccccgaaatattcaagtgcgctggctgcataataaattggaacaagggcaaaaacgttaccgtcaaaaccgtcaagaagaaacagaagcataagagcagaggcgtgatacgcacaattaccaaaactgtccaaaatgattcgttctttaatttcttcagtccgccaacaattccagatgacgctaaagaagaagacgtagatgaagatttaaggaatttgcttaccaccgatttcgaaatcggccattatattagagaaagaatcgtcccacgagctgttctcttcttcaccggagaagcgtgtgaagacgaggatgatttcgaagaagaagaggaggaagacgatgaggaagatgatggggactcagatgataaagaggttgctacaaaagttaacaaagatcagcagaattgtaaacagcaataagattattcaccgctgtggctttaaattcaatgttatcatcaatcttaacatggctttttgatataaattattagtttcttcctacgttatgtaaaaaattgttaacagtcttaattatagaatcatgttgaagtgacagtttttgtagcgtacccaaatctgttatatttccaaaatttgttttgtaaggagtatataagtaaatcatttcgtactaaaaaaaaaaaaaaagggcggccgctcgc

SEQ ID NO: 1459 - DNA, 1240 bp, Diabrotica virgifera
tattttttttattcttaagttactgaaaaaattttggcgtgaatacttatgatctttttgtgaaaaagatcttactgtatattttaaatatgtaatttacttaactcattcgctgcctgtcaagaaaatggaactcggctagggccgttctgttaaaaggcgcctgactgattggcgcgtgaatggcacctgactgaagtaaccatatcacgcgctggagtgtgatcgtcagcgaatgggttaaatgacaagtggttatagatgtttatacagtctaaatatatacagtgagttaaatattgggtcgagctctccgtgggtaataataattattggttcaaaaggatccaaacttgtcacgggttagctctgccggacaatagattcagtaaaacacaggtttaatttaaataaaaatatatttttgtaatccaatacaataaaataacaacaaaatagtattcaattctccgactattgtctcccttttggcacccatatcgagccgctgttgatgaaatcgggtctcaagatatcgttggtaggttctctgcatagtcgaatgattcacattcaattgtcttgccacatacctttggtttgctccattttccgggaatgtaaccatctgaacacactttctatactttttcatcgttataaaaatagacttcactgtcaggaggccagtgtaccacgaagatatctcagaaactctttagaagactacaacagttcacacagttcttaaaaccatcaattctgcgaagcttcgttgattcgtaaataacgattggcacccatatcgagccgctgttgatgaaatcgggtctcaagatatcgttggtaagttctctgcatagtcgaatgattcacattcaattgtcttgccacatacctttggcttgctccattttccgggaatgtaaccatctgaacacactttctatactttttcatcgttataaaaatagacttcactgtcaggaggccagtgtaccacgaagatatctcagaaactctttagaagactacaacagttcacacagttcttaaaaccatcaattctgcgaagcttcgttgattcgtaaataacgattggcacccatatcgagccgctgttgatgaaatcgggtctcaagatatcgttggtaagttctctgcatagtcgaatgattcacattcaattgtcttgccacatacctttggcttgctccattttcgggaatgtaaccatctg

SEQ ID NO: 1460 - DNA, 1115 bp, Diabrotica virgifera
ccttccaggcgttcgtatgagtgtgaagtatatgttgtgggcttttttattagttggtatcactgtttgtgatactgaactaaacaaaaagcggtttccaaaagattttatgtttggagtggctacatcttcatatcaaattgaaggtgcttggaacgaagatggcaaaggagaaagcacttgggaccattttgttcaccaaaccccatcacccattgtaaataattatacaggtgatgtagcttgcgattcttaccataaaatgaaagaagatgtggctttattaaaatatttaggagtcaagcattacagattttctctatcgtggtcaagaattctcccaacaggttacaccaacaaaataaaccaagctgcaattaaatactataaaagcctgatcagagaactcacagacaatggtattgaaccggtagtaactatactgcactgtgatacaccacaagcgctggaggacatgggtggctggacgactgactggatcatcgatcggtatgtggaatacgccgcagtttgctttgaaaattttggagccgacgtcaaatactggttgacttttaacgaggcgttttacatgtgcactttgggttatggaacaggtactcaggcacctggtaggaaggctagtggtattggagattatatttgtggccataatattatcaaagcccatgccaaagcttttcatctgtataatgatacatacagaccagtgcagaaaggttcagtaggaatttctttggtgagcatttatgcagaaccaaaatctgacagtgatgaggataaggaagctgctgaaagaatgatatattttaattttggatggtttgcaagtccaataatgttcggttcttatccgtatcaaatggaaataacaataaatgaaagaagtgttgtccagggattcgcacaatcgcgccttccctcttttactgaagaagaaaaagcttatatcgcgggcactgtagactactttggcgttaattattattcgagtgttgtggctgaaaacttgccagatttcaagatttagacgtttcatgggaagctgatgttgagtgataccatctcaagacccgcactgggaaaataccaca

SEQ ID NO: 1461 - DNA, 427 bp, Diabrotica virgifera
ctcgaatagtactcgtatccccatcgataaccattatctggtgttttacatagataataacaaataacaatcatgatttttaaagtatttttgtttgcgttgttcgtagcagtggtaatggcggaacaaactgcagaagaggcatggccacaatataagaaagatttcaacaggtcgtacgacgccgctgaagatgccgaaaggttcgccatattcaaggaaaagtacaaccaaatacaagaacaaaacaggcaatacgcagctggtaaatcaacatggacagcaggagtgaacgactttactgacagaaaacccgaagaacttaaacacctccatggtctcagggttcctgagggaaacgccgctggactccattaacctattactacctgaatgttttatacctgaaataaagtgatcaatttcg

SEQ ID NO: 1462 - DNA, 1038 bp, Diabrotica virgifera
  misc_feature (911)..(911): n is a, c, g, or t
  misc_feature (917)..(918): n is a, c, g, or t
  misc_feature (962)..(962): n is a, c, g, or t
  misc_feature (973)..(973): n is a, c, g, or t
  misc_feature (978)..(978): n is a, c, g, or t
gttctgagttctgtaggctggataaggtttttggtatttttctgtagaggtagagtgcaattaatggaggtttaaagttttattaactaagtacctctttttaaaccagaagaacatgtctgatgaaggaggtcctaacgtaaaaagtcttcgtgattttcggtatcaaaagaaaccgctacttacacaagatggtctcagtctcagttcttctccatcatctgaatcgagaccccgaagtcgaattttgccagtctcgtcggattcagataccgaaactgaaacaacaaccaaaacaatacaccctgaaacagcaaccaaaacaactgaacctgcaaatatagcacaacctgcccctacaacaacaaccacaacaactgatcctgtgaatacggcagagcccccacaaaatgaaataatttctgaaatgaaatggagcgaagtggatacatcagtatccactgattcagtggccaattcaagtctagcccagaaaagtgatacagtatctaacgcagcacaacagtcagtgccacagccagtcactcctgtccaagttgctaataacagcattgttactatgaaattcaatggttcctatacaccgaggactacaaagaatccttcggttttagagaaggaaaagcaaatgaagtttttgttggaaatatttcccaatttagatgctatgaaaattcataactgtctttccaaacacagtttcaatacagatgcagctgctgcagaattgtcaaagttttacaacaaacctgttgaccatgcttacacagactggagacaggatcacgacaagaagatagaagaagccaagaagtatgaattacccaatacccaactgagcatttgaaatgttcagcaaactctccaaaacagcaattattcacaaactncacaannactcacaaaacaaacaattttcacaaactcagggtggtaaaggngaaacagaggnacagntaaaaaagaagaaagtaaaacgaaagaaaacttatgatagtgatgacagtactggaaatc

SEQ ID NO: 1463 - DNA, 944 bp, Diabrotica virgifera
  misc_feature (855)..(855): n is a, c, g, or t
  misc_feature (865)..(865): n is a, c, g, or t
  misc_feature (895)..(895): n is a, c, g, or t
caattgccatcttgaattgcgtataatctaataagcgcggaaagtagtggatcatactgaggtttcagtttgagatggctcctttacccgatgattctgtgcaaacaacacctctaccaaggcagttcctacgagaacatccaaaagcaatttattcagatggaaaaggacgagtcaagcaagacctagtttggttaaacatatttaaagttatattttaccacacactagcagtttatggtatttggaaaattgttactttacaatccatgtggcaaactctcctgtttaatactatattctacttcttcgcccttattggagtgacaggtggtgcccatcgtctgtggtctcacagagcttataaagttacgcttccaatgaaactgctcatgatgtttatatgcactgccgcctaccaagatagcatccacaattgggcgagagatcataggttacatcacaaatataccgatacagatgccgatccccataactcaagaagaggattcttcttctgtcacattggatggttgatggtgaaaaaacatccggatgttataagtaaaggaaagaccatcgatttgagtgatattaaaggagatcgtctcattatgttacagaacaaatacttctttaaaattgcacctatcttgggattggttttacccactttgattccatattacttctggggagaaacattatcggtttctttcttagtgaccgtggtccgattattgcttagcttacatgcaacattttctattaacagttttgcacatctttatggaaccaaaccatatgatcgcaccataaatccaacagagagtaatgtttaaaagccatcgctgntggagaaggntggcacaactaccaccatacctttccatgngattacagagctgccgaatttcaaaccactttttaaactaactactacc

SEQ ID NO: 1464 - DNA, 738 bp, Diabrotica virgifera
tggttatcggcgtttcacaggaaagtttgattaaatcgatgaataaattatctttttattcaatatatgaaatacacagcaaaaacatttaatttttcctgatttactggtatatttgcgaatgttaacaaataacttctgtagtgaattgtcttttagtgttttttagttggaaataaagattaaaatacataatctacaagaatttttcgggagtaaaattgtggataaatcctcagttctggtgtatggagttttaataaaagtgatgatgggcaacatctaattgtgaagatacgataaccacagaagaagacaaaaatgtctttcaacagagggggttactcgcggggaaggtctcgcggtacatgctttgaaaggggaagaagtgatagaggttacatacctcgtgaagcagaagagcgcagtcgaccatatggttctggtaacgaaaaacgtgaaacaatgcctgaggccagagggtacaactcttttagttctggcacagataacaggaagtacagctattctaatcctgctacagatagcagaaatccatctcgtggaagagatatagatgaagggcgaagggagtctaatattcctcgtaaaagaagtccttatgatcaagatcgagcttcgcattcttatagggaacgtgattctcgcgaaagaaatacttttgccagtgaaagaaagccttttactagtgaacgaaaggaaacctatcgtgaaact

SEQ ID NO: 1465 - DNA, 986 bp, Diabrotica virgifera
  misc_feature (680)..(680): n is a, c, g, or t
  misc_feature (882)..(882): n is a, c, g, or t
  misc_feature (899)..(899): n is a, c, g, or t
  misc_feature (904)..(904): n is a, c, g, or t
  misc_feature (906)..(906): n is a, c, g, or t
  misc_feature (917)..(917): n is a, c, g, or t
caccgatacccataacgatgagtctttgttgatgagtattggattcgttggtgatggccatcccagcattaggccgaatggaagacatgctagtaatacgcatattgacaaagactcaccgatacccataacgatggaccaaagtgcaatgatagccggtttcttgatgatcggcaacaccgtggggacacccttttgccggaaaacattcctaggaacaaaatttagtattctaataggtattctaattatgggagctggatggactctgatgtggcaatcccaaaacatcttttggctactaggaagtcggcttctggtcggaataggcaatggatactgtgcaggccaagtcaagatgtacatcagcaatatttgcggcgaagatctgaaacagatgttcaccaaactaattaatttgtacatttttctaggaattatattgatatactcattcggaccttttattgacttcagatacacgtcaataacatgtatgttgatcacgttggtcgttttctgtataattttattgttgccaactactcctaaggagctagttaaagcaaataaactaaaacaagctagaaatataatttctaaactaaaaccgggcataaatttgaataccgaagtgaataaaataagtgacagcctgaagatagacaatcaagaatacnggttttttacctttgatgaaagacagagaagcgcgtataaattttataaaattcactttgctgacattttgtcagcaaatttagtggtgcccctgctacgataatatacactcaaattttactcagggaatcacactgttcgtaccctaagtatttcgctatagcgatgcccattacgttttttatcagcaatgtcattggntatatttctgatgccanggttnancaaaaaacagnaattattggtgtctacttttagcgttattttattacaaataacaaaaattttaattgttttatttttga

SEQ ID NO: 1466 - DNA, 944 bp, Diabrotica virgifera
cattgacaaattgacatttcaatttcaatgttttatttctgattttcgtttgctgctttgttgtttatacatattgtaaaaatacagctaaaaacttttaaaaatgagcgaagccaaggaagcaatggaagttgaagtggaaacagccccggtggctgaaaattcaaaatcttccatggaggtaaccacagatacaggcaaaaatgtaatggccccgggagctgttggatcaatcacttgttcccttcatcctcttgtaataatgaatgtatcagaacattggactagggaaagggcccaagaaggagctgtgcaacaagtcattggagctttgatcggcaaacaaaagggtagaaatattgaagtaatgaactcatttgagctagtatttacacttataggaggtgatatagttattgataaggattattacaacatgaaagaagagcaatttaaacaagtcttcagtgatttagatttcattggctggtacacaacaggtgacgccccaagtgaaatggatatcaaggtccacaagcaaatttgtgaaatcaatgagtctcccattttattgaagctcaacccttatgataaaaatattgaacatttaccagtaaacttatacgaatctgtgatagacttagtaaatggtgaagccacaatgctgtttgtctctcttacatacactctagcaactgaagaagcagaacgaattggtgttgaccatgtggccagaatgtcagcaacggattctggtgagagttccttagttgcagaacatcttactgctcagcatagtgccattaaaatgcttcattctagagttagattggtcctggaatacatgaaagctgtgcagagcggacattgccgaggaatcatgaagtacttagagatgccttttctttatgccacagattgcctgttattgatggttcaaggtt

SEQ ID NO: 1467 - DNA, 755 bp, Diabrotica virgifera
cggacgcgtgggtcaacgatgaaattcttcatttgcctggctttcatcggtttcgtagcagcttttccacaaaaggaaggcagtgcgtatacccaggaagcgattcgacaagcacaaaatacgtttttaatcccaaaagatgctcagattcaaaaggtacaagaaggtatagaaattggagcatacgaaagcattcccggaaaccaaaaaatcaacttattcgaaattttgggtgaccaattccccccagaagtcgtaaacaaccttcaacaacagatcgatcaagtgggcaggagctaattgtgaatgaggttttatttaaatcgtaaggatgtgatatgaaattgttaatgtatgtcttctcgtgtcaaaaaaaaatgtttcggcaagtactatctattgtacttttttaaagttttatttttgtagtttggtgttaaaatttttatttcttttgtacatattaaatataattattctataaggtgttttaaataaagtctaaacaggtaaaaaaaaaaaaaaaaaaaaaaaaaaaaaaaaaaaaaaaaaaaaaaaaaaaaaaaaaaaaaaaaaaaaaaaaaaaaaaaaggggggccccccaaaaggttcaaacctaagttacccttgaatgaaatttcaaaccccttcaaaattttccccaaatttaaatcacagggccttcttttaaaaacttctgaacgggaaaaaccttggttttaccaacttaaacccctttgaaaaaatcccccttt

SEQ ID NO: 1468 - DNA, 304 bp, Diabrotica virgifera
acggaaaaggcaacaaagatcatgcatagcattgctagtctagcacagaaggaatatagaatttcgttccgacagatgagaatatacctaagtacaatacttgcatcaattgtagggtacggttcaagtgtatgggcacatagactaataaaaaaaaaaaaaaaaaaaaaatacaaaaaaaaaaaaaacaaaagaataaaaatttgtagtgtcccaataaagattttacttaatttttttgtaatgcaatgttaatcgtttacaaaaatttcaccattttcaattcattggccatctttattca

SEQ ID NO: 1469 - DNA, 732 bp, Diabrotica virgifera
gtacaaattaacaattttacgtaacctgtgatctttttaatactgatctccttgttgattaaattaaaactacgtcaatcatttagcggtttctggcgttactgccacatactggtttttccagtcaccaatacacaactttattacccgttttggtgttttttttataaattgcagtgataacaaggattgaaaatggttcgttctcatcatgtagaaggctatgataattttgtcaattttatgaagaacttcaaggcacaaggaaccgtagtttgtatttattttggtggctctgtagacgaagcgactggtgaaagttggtgtgatgattgtgtaagggcatggcctgtaataagtaaggtacttgaacagctagacgataatgtggatttcatacatgttgaagtaggagacagaccaacatggaaagacccaaacagctcctttcgtaaggatcccaccaccaaactgctcgttttaccaactttgctcaaatgggaaaacgccaaaaagacttgaaggttcccaatgtgaaaaagagtttttggtcaagatgcttttgtgcgacgatgatgatgaagactagagatgtagatatatatgtactggatgttttttttatatgattattaccaataagctgaaatattaactttgtattttgtatctattatagagtattttccgatatgtaaataaaaaatttgcactctttgcaattttaatggt

SEQ ID NO: 1470 - DNA, 1024 bp, Diabrotica virgifera
cttttacatactaatattaattatctattaatattgataatttctttattgtctttattgaaaaaattacttttttattatatataggtaactaacgacaatttgatcggtatggtaatcggatccaatataaataaattctgttcgtgtttgaattaaatgttcagtaaactttttattatcaatatttaacaagtgcctccgcaacagcaattaacaataaatgtcagaactggtcataccactccagtagaaaattagaaagaaacttaacggtcttcttcttttcttcttcttaaatcaggagagagttagaaacaggtcgtaagacctttttactatactctgtttttttccttaaactctaatcagtcctgtgacctcaacgaagaccaacagttttcttattggtagttttcggatctcttctggttcaaacctcagttgaccagtgaatttctgcctcacgtcacttagcacattggaatggcatctctactttcatttcgcactttttgagcaatggttcattcaccttacctagattgtataggtggtttcttaaacggcaatgttcaatcaccattttagtggatgatttaatctctcgtttattgaggtggatcaaattgttagagttttttaccaatattcttgattattttttagtcttgatttgcccttgcgtggttctccatttcttttgatgattctttatcagccatttctgaacctcattttccgtagcagctttagcgatgccacagaaagggtctgggccttgtttctctcgagtacctctgtttattcccatgcaccccttcataaccccgaacctatataaaaacactttattgtcttctatgatggtaaaaacatatgaaagaacttcaaagtaatacaaagtctagaataacttttaaaccagtaaaaaaaaaatcaaagtcaaacaaaaaaaaaggtgacttggctataaaactttctataaaaatattcgaaccccaagggccgaaaaaatttcccc

SEQ ID NO: 1471 - DNA, 1632 bp, Diabrotica virgifera
cggacgcgtgggttagttgtctcctaaacttggtgttgtgtggatctcgatcttgtatgtgagagactattagacggtgtgactgaatcgatgtgttgtagtagtgtggctttaataaggagattcctcactaaagttgaaacaacctgcacatgatgctaattgctgtgatattttccatattcgttcaactctgttcgtccgaaatacacaggggtggtattttgtaccccagaaatacagagactcgccaagtgatctcattagatggattgtggaatttcatagttccgaatgtgaccaatccttttgtcggtttcgagaaccattggtatagaagtagtcttaaagaggttcttaactttgatgtacaattgatgccagtacctgctagttataatgatattacgactgatgcgagaataagagaccacgttggattagtctggtatgacaggtttttctttgttcccaaaagttgggaggaaacagaaagagtgtggataagatttggatccgtttcctatgcagctcaagtatggataaatggtgaactagtgatgagtcacgaaataggccacttaccatttgcttcagaaattacaagctttgttaaatttggaaaggagaatttgatcacggtggcatgtgataatacgttactacctgacaccgtaccacaaggaaaggttgaagaattagtaagcggaagactggatcaaacctacacttttgacttctttaactatgcaggtatcgatcgaccggtgtttttatacacaacccccaaaacttatatcgatgacatcttcatttctacggtagatgttaaagaaaacattgcgttactggaatacaatattacggtcgttggagataatagtttgtcatctaaaatttgccgcgtgagtcttatagacagaagtcgcaaggttgccttttccagtcaagacaattgtggattttatggagttatgaagatcgagaatcctaatctatggtggccttatcttatggacgatgatcctggatatttatacaattttcaggtggatatattcgaccaggatctcactccagtagaccagtattttctaccagtaggtataagaaccctaacgtggacaaacagttccttcttgataaacaacaaaccgttatatttgcatggattcggaagacatgaagattcggatattagaggcaaaggcttggatcttccactggtgatcaaagatcacaatttaataaaatggatcggtgcaaatgcttacagaacgtcacattatccttacgctgaggaaattatggacgtcgcggatgaaattggaataatgatcattgatgaatgtccaagtgttaatacagacatttttacaggttccctgttggcaaaacataaaatttcctttgacagaattgataaaaagggacaaaaaccgaccagctgttattttgtggagcgctgccaacgaacccagaactgctgcgccagcagccaaaaactatttcaggaagtaattgacacataaaatcttggacaatctagaccgaccactatcgtggaggcccaaattttgcagtagtgaatcctcaaaatttggtgatatcatcagcttcaacagatacaac

SEQ ID NO: 1472 - DNA, 982 bp, Diabrotica virgifera
  misc_feature (941)..(941): n is a, c, g, or t
tgcctccgataaatttgacgtttaatttgtaaatagaaataacaatccccttttttttatacattttaagctcatattaatatttccgaaatataaaatatgtctggggctagtgtttgtgtattagccttgaatggaagaagacagacagtaaaatgtacaccaaatacaacaattttacagattttggaagaggtgtgtaagaagcaaaacttaaaaccagaagactatgacttaaaacaccacaataaaatattagatacaacatcaacgtttagattttctggattgcctaataatgctcaactagaacttgttagtgcaactaaagcaaggttagacactgaagtcactttggcagtaaacttagaaaatggaagtaggttaattggtaatttcaatcctagtgagactttatttaacatacttaccaaaatgtgcccagagtgtcttggtgataatagaagtccagtagttatttacaccagaagagaaatgtatggccaagaacttaatagtgtaactttaaaaagtttaggattaacgggaggaagagctatgataagagttattgataaggatcctgaagacctaaaacaacaagccaatgtttcatccattataccttcaaaacctgtagaagaaaaaccttatataagaaaataccagcctacagaaccaaatgtagattctataaataatcaggataattcagataaaacagatggccaaccaaccaatgtagagaaagttcagaaaaaacagaatgtcgatcttattcaattggctagagagaaaagaaagagtaatgaatttcctcccaaattacttgaggggcataaagatgttcctgaaaagcaatcaaaagtatctaatactcaaaacaaaggttacatttgtgaacacaaaaaatggaagtggatgagtgctccccctaattncgagaatgtgacagagaagatgatgatcgaaaggaggactt

SEQ ID NO: 1473 - DNA, 992 bp, Diabrotica virgifera
  misc_feature (836)..(836): n is a, c, g, or t
  misc_feature (937)..(937): n is a, c, g, or t
  misc_feature (947)..(947): n is a, c, g, or t
  misc_feature (949)..(949): n is a, c, g, or t
tgcatacgtgtctcactatttcaaacatattcttcaaaaagttctgtgaaaatggcaccaaaagtaaacgtaaaagaaagatataatgatggtgaagtggatcttagcatgtccgatttaagtgaagttccggtaaaagaaattttgagcttaaaaccagttcacagtttagacttatctaacaatactttaactgtgttacctaaaaattttacttcattaacacatttaacaacattggatttgagtaaaaacgatcttaaagagttaccagaagattttggtaatttaacaaaattgagacatttagatttatacagaaatcaattgcagcatctgccattaagttttagcaagcttaaaaatcttaaatggcttgatttaaaagataatcctttagttcctgctgttgctaaggtggcaggtttgtgtattaatacaaaagaatgccagaactgtgcaaagaatattgtagcctttttcaacaaattagagaaccaagtatcagctgatctggaaatgagaaacaaagatcggcagaaacaactagagttcaatcaaaaaaagaaacaggaagagaagaatagtaagaagaaagagaaacaaaaagaaaagaaatccaatgtgaaagttgttgaacctactaagcagaatcaaaaagtaagcagcaaggggaaaagcaagaaagtcaaagaggaagattctatttttggctcaattttatctagcatattgggctgggcacttctcatgttggtactttatgtaggttttatattctataaagtatatggttctaaaaatgttttagattcagctagggatgtttttattanagatttacataaactttatgatgatgctcctaatttttggtggtatcatcaaaggaatatttgcaaaattttgtacaaaatatttacactagataatattntttaatctgntnaattaggcatattattatcattaatacatattttcatttaaag

SEQ ID NO: 1474 - DNA, 975 bp, Diabrotica virgifera
  misc_feature (969)..(969): n is a, c, g, or t
gctatgttacatttggttatgctattttggttacagttacaaaaagttacatcgttaccgttacatttttatgtgttttaccgtttgttattgttttttaaactatgaattcttcaaaaatttattccgtattcacctatagaaatttattttggaaaagaaaaaagtcatattttggaaagtacaatgttgtttctcctggtaatgtttctccaatgttaactgttccagaagaaatagaaaaacctagttattcttcatctggaaaacctggaccttcacctgactttgcagaaataaaaaatgtacatcagatacacaagatgatggattcatgcaagttagctgcagatattttaaaaaaagtagaaaatattattaaggttggaattaaaactgatgaaattgatatatttgtttttaactcatgcttagcaaataacgcttatccctctcctttaaattacaataattttccaaaatctgtatgcacatcaatcaataacgtagcttgtcatggaattccagatgatagaccattagaagatggagatattattaatgttgacataacggtgtattacaatggataccatggtgactgttcaaagacatttttagttggtaatgttgatgacgaaggaaaacagttagtggaagcaacaaaagtctgtttaaatgaagccattagcatatgcaaaccaggtacttatttccgtgatataggattctgtattcaagaaaaagccgaaaaacttggattccagattataccatcatttattggacatggcataggaagttattttcatggacccccggatatatatcacatgaaaaataattatccaggacgaatgggatcaggcatgacatttacaattgagcccatattaacacaaggtgatcaatacattgtaatattagatgataactggacagcaattacagaagacaatgcacgtacgncgcaat

SEQ ID NO: 1475 - DNA, 571 bp, Diabrotica virgifera
gcgtgggcgcagactttattatggaggaatgaagaggaattgaataacgacagacatgttaaaacagtttttaagacccttttctctatcatatgaaagctataataaacatatagtagttcaatctaaaaggtttgcaggccactcaaaatgggcaaatatcaggcacataaagggtgccaaagatgcagaaagatcccgactttttaccaaattaggacgacaaatcaaagtggcagttcaagaaggaggatctgttgatcctaagaaaaatctacagttaaatcaggttatagaacaaactagaagagctaatatgccagcagctactgtacagagtatattgaagagttgtgaaagtagtaaatcccaagacaagagttatatgttggaaatcaaaggccctggaagctgttttatcttatgtgaagtctacacaagtcatcttacatggtttaaagatgatacttagtacaatttctgaacacacatccaatccagattcagagctggaggtgccctgaattcgctctaggtaaaggtcctatcatacgctaaaaatgaacccttt

SEQ ID NO: 1476 - DNA, 1139 bp, Diabrotica virgifera
cccacgcgtccgacttaaaaaatacctttctcttattccatattattgtattaattcagtttaagaggagtgtttgtatcaagatcagccaaaatgacattggctaaaatgaattttcttagaattggtttactactatttttcgttattagcttttcgtctgttctgggaaaagctcgacaaagtaaaatgaacaattttaaagtgttagttaccaatcctacagtgccagattctggaataactctactaaacgacaatggatgcaacgtcacacagctgcaaaccgaaagtagagaaaacattttaaaaaatgttcgaggaatggatgctctattttgggcatctggtattaaactggattcagaagtattagacgcagcaggaccacaattaaagacaattggacttatgtcagctggttataatcatgtggacgtagaagaacttaggaaacgaggaatccgtatgggaaacacaccgaaagtacttaatgatgcagtggccgatattgctatactcttaactttggcagcatctagacgtcttcatgaagctagattaagtatagaaaacggtaactgggtcacaaatgattgggcatggatgtgtggtcaagatataacgaattctacagttggcatcattggacttggtcacattggacaaactattgcaagaaggctaaagggttttgatattcaacagttgttgtatacaggccacaaagaaaagaaagaaggaatcgaattaggagctaaatttggatcactgaatacacttttaaaagacagtgactttgttataatggtagtacctttaacgacagaaacaccccatatgtgcaatgaagaattcttttcaaaaatgaagaacaccgcagtattctttattgttagtaaaggagaagtagttgaccaaccaacattaataaatgcacttaagagacacactatttttgctgctggcctagatgttatgactcctgaacccctaccatcaaaccctgcattattaacattgccaaatgtcgtgtctgatgacacatctttgcacctctagctccactccgaaccccgggcaaacggatgggcccactcttaacacgcccccaaaaaatttttttaagaaggggtttt

SEQ ID NO: 1477 - DNA, 458 bp, Diabrotica virgifera
ggggccccccacgcgtccgcaaataatcataatagaaaatcattaaatggcagtgtttatagatcaagagttacttacaacagccaattacttcacctggtactcaattttttatagaacatcagactttttatttatacatcctgtagatttgtttactttatacagatgaatactgagtggcagtattatacatagagcgggtggtgattttttttaaaagtcgccatcttaagtggttgagaaacgtttaatagccatataattctttatttattatcggatatagtagtcaatgtgcaaactaagtgtcagtataactataattatgttctctttgtatattagatgttaaccagagatctgttactaaatatatttttaagtagtagaatcagttttactgttgacggtttgtcacttagtctgctatgtctgtttaaatgcaaaggctattt

SEQ ID NO: 1478 - DNA, 971 bp, Diabrotica virgifera
ggaggttgaaaaaatagtttgtggtcctagttaatgtttctattgtgaaaatgcacagagaaaatattaaatgggaacctattccatatgatcctgatttcaatggtcctttaagaaaaagatcatgtacggatattctttgtctaatgatatttttggttttcatcggcgcttggattggaattggaatatatgcctacacaaatggaaatccctcaactctactggttccaagggatacacttggaaggcgatgtggcagagatactgatgtcctgaataaaccgtatttgctctttcacgatataactaaatgtttggatccatccacacctttcactggatgcaaaacaccacaagtttgtgtttcgtcatgtccatccgaatttaagtattacctggatcgtaaaactaacgactgcggtgaatatctttttgagggtacggattgtccaccatatgtgttacccagtacatctcttcaaaaacgatgtattccaaacgtggctaaaattgatgaaaatatgttaaagcaaattggtgagtcgctgggaaatttgaagaaagcagtaaacaatatcaagctattatatgattttcaagagatcggccaaaatgtaattgaagatttaatcaaatgttggtggaaaattgcaataggtgttgttattgcattggtggtgtgtttattctatatatttattctgaggtggttcgcaggtcctttagtatggctttctattattggtgttgtcatcggattaggtgcaggattgtatttctcaatagtccaatacaagcatgctctaaacgacctcgccgacaacgccaaaacgcaatacgaagaagaaaaggaactgcgcgaaaaacaataaaaacaaacaaggatttatggcttacatgcgtagtaatcttagcaattgtattagtggtgatattgcttatacttcttggttctccgaaaacgaatc

SEQ ID NO: 1479 - DNA, 1526 bp, Diabrotica virgifera
gttaccattgggatccaataatttagtttatttagtattagtaagaattggtccataaatttgcctgatcgttcttctttggatatactcctatataaatctggtgtccattgatagtccgattctggataagtgtccgattcttcatttattttgtgtatttggttggataggttcgtattaccggatgtgggtgtacgtagacctgatctgttatgtggtttggtgttagtgtgaattggtccataaatttgcctggtcgttcttctttggatatgccttttatgaatctggtgtccactgatagttcgactttggattaagtgtccgattccacatttattttggttattgattttggattcctttggtatgtttattattggtattatttgacattagtgagaattgttccataaatcttcctgattgttcttctctggatatactattatgaatctggtgtccattgttagttcagttttggataaagtgttcaattctttacctattttagttactgattttttttattcactttggtacatttacttttgatatggttcgaattggctcacaccttttcctggttgttccgttcttggatataccctttataaatctgatgtccatggatagttcaattttggttttagtgcccaattcgacacttagttattagtatgaactttagtacaatatttagttttgttttgacttttgagcaatatatgttaatatttggtagcagagagtaacatagtaacattttagtatgagtttgagtcatgtattgatttatttttccttgaccattagtttatatttagaagtaatcttgcgaatcaacgtggattgttagactattgtaaatttagttgttaatattttgaagtttaaaaaaaaaaaattttttttggttaaaaaaatttttttccccgagtaggaggggattgtaacggtccacccgttatattatcatttttagcgctgtaattatttttaaaaaaataattattttctcttgacctcccatttaaattctttaatttatcgtaaaggacttctcatgtgacgtcacactgtacggaacatagttgttgaaccgttccttgtcgtttaattcgtgttccgtgagagtttgacgttttcctcgctgactgtggaggaatgagaggcacttggccggtggctgcgaggttgacaggttggtgttggtggttagtaccgtaaatggcggttaatttcttcgaaattaatttttatttcaactaagtttggaagtatagtaaaaagttaccaccacttgtttcctggagtacgggtttcctggagtaaggatgggagtaccatcagtggaagaggaataaaaaattaaccggtaaatcgttttttctactaatgttttttagttaaccttgaatatatgaaatagttggttcattgttaaatgttcttagccagtcccttaggtgaaggatgtagattatttcgatctttatattatctttatatcgatcttatat

SEQ ID NO: 1480 - DNA, 1094 bp, Diabrotica virgifera
caaagagatttttcagcgctgcgtctccgtctatttattacgtttggtttttccaaatcgtttgcactggttctcttattgtgaactttcaataatcagttttttaccttttgtaaacatcagtttttgcttcacaggattcacagtattgattaacctgtgtacacacttttattacaaggtaactaacactgaacctgttaaaaaaaggaactacgtctgttaatgaaaacaagggctacacttactctaacaattaattgtactacaactgtaaattaataagtcaattaaattaaatcatatgatttcaaatggatttcggtaaattatttattcggccgtctgctgtgcaaagggtcgataatttggtgtaaattttaaagaaatcatacataataaaaaaaaatttattatatacttatataaatattgtagaattaaatttttgtaaaaaactcaaatgatttcaccgagtgtctactgttgtaaatattatgtgtgcctattttcattggaacatcctgtaaatgttatacacgatgtagagtataattttgataaaaattcgggttatatatttaggaaatattcgctgccgtagatttttatactctttttgagaatttatctggtcatttagcccactcggcaagattaaatatatgtatactgcaacctaatatttttcgaagtcatttttaaaaactgtatcatatatttgtacttagtagagcaagtcactattccttgttaaatgtgaacttaattatatgataatgcagtacaagtttctatactacgtcacattttttacaaaaccatttaataagaccaaataaacaaacttcttgtttaaaaaaagtactgaatctcttatgaggatttgtttgagtgaggcactatattttccttgagaaacaataaaaacgttttcttaatatagatatatgaatattttgtacatgtagaggtaaatttactaactaaataaaatagaggtaatctatggacaaagattttgtatgtgatggggtaatgatttatattttattgtaatatacctatataccgattttaacactgaaacgaac

SEQ ID NO: 1481 - DNA, 440 bp, Diabrotica virgifera
gcgtccgccaacgagtccgcggacgcgtgggggaatttgtaatgaaaaaaacgtagaaatatatactacaatgaagtttttaagatcgacagtgtgctacattgccatcttggcaattctctttaccctctgtgccgatgaggttgaaggaaggagaaaaattttgatggggcgaaaaagcattaccaggacatatcttcgtggaaatgctgttcctgcgtatgtgataataatccttgtaggaattggtcaaatcatcctgggagggatattgtacgttgcattgaggaagaagatcattgctgcacctgtaacggcatcatatgcagtggctagacaagaaccataaattttatttgtctagaatattattttctaaatatgcatcttttttaaattattgtctacgtaaataataagtctagaaatatataaaaatt

SEQ ID NO: 1482 - DNA, 1960 bp, Diabrotica virgifera
gttcctctcgaatctcgtgttgtttcatttttcattcgaacttttctataaaagaataaaatgtttggtggaggacgtgcccctattttggtgttaagtcaaaataccaaacgagaatccggtcgaaaagttcagctggaaaacatcaatgccggaaagcaaatcgcggatgtgataaggacatgccttggtcctcaagctatgttaaaaatgcttatggatccaatgggaggtattgtgatgactaatgatggcaatgctattttacgtgaaattacagtacagcatccagctgcaaaaagtatgattgaaattgcaagaacacaagacgaagaagttggagatggtaccacctcagtaattgtcttagcaggagaaatgttagtggcagctgaacagtttttggaacaacatattcatccgacaatcataattcgccagtacagacaagcactcgaagatatgattcagttattggaaggtccattaagtataccagtcgatagaaacgataaaaatgctcttgcccaagtcgtgaaaggctgcattggcacaaaattcataagtaaatggtcagatttggcagtaaatattgctttagatgcagtaaatacagtattattagaagaaaatggcagaactgaagttgatatcaagaggtatgccaaagtcgagaagattcctggaggatccattgaagaatctaaaattttaagaggtgttatgcttaataaagatgtaacccatcccaaaatgaaaagatatatacagaatccgagaataatacttttggattgtgcattagaatataaaaaaggggaatctcaaacaaacgtagaaatttcagcagaaacagacttcaccaaactattagaactggaagaggagcatgtcaagcgtcaatgtgatgagattattgcactcaaacctgacgtcgtcttcacagaaaaaggagtatcagatttggcccaacactttttactgaaagctggtattaccgctatcaggcgtgttcgaaaatctgataataacagaattgccagagcctgtggagccacgattgttaaccgaacagaagaattacaagaaagcgatgttggcttaggagctggactcttcgaaatcaagaaaattggtgatgagtatttctgctttgtggtcgaatgcaaaaatccaaaggcctgtacaattttactcagaggtgccagtaaagacattctcaacgaaactgaaaggaatctacaagacgccctacaagtcgccagaaatattgtcctatctccccgtttagtgcctggaggtggtgccatagaaatggccgtagcccagcgtctgatgcagaaggctacgcacggaccttatagagctcttgcacacgctttagaaattattccaaaaactcttactcagaactgcggagcaaacacaatcagaacattaactgctttgagggcgaaacacgccaaccacacggacgttaacaaaccatgcctttggggtattgatggcgaaactggagagctcgtagagatggacaagaaagaactgtgggaacctctagctgtcaaactccaaacatacaaaaccgctatagaaactgccattctcttacttcgcattgacgacattgtatctggctccaaaaagaagggaggcaacgaaccaccaactcctagccaaatgcaacagcaagaagctagaggagaagctgaataaactaatgctccaaccattcactaaattaataacttcttcgtctttgcaagatttctataaacataataatgcttgtaccattgctggaattcttcgatatcggtacaacgcttttacggaatatattgtatataaatatataaaaaaaatggttttttttcttgtacgcacaggtaaagatgattattgaagatcgcacactacagtgaagcaaaaaaaatgctctgagcaagatttgagacct

SEQ ID NO: 1483 - DNA, 902 bp, Diabrotica virgifera
  misc_feature (888)..(888): n is a, c, g, or t
cggacgcgtgggcggacgcgtgggcggaagtattcaagagactgccttttacaacataacctggtatttaagtttttcttcgttatatggttaaacataacgaaaactagtattaaatgaatcggtgataaatattccatttaaataatgagtaactctattatttataagttattagttttaagtttagtgattcttttgggagttggtggaagtaatggtcagctcatttatgctgtgaattgtggtggtgaagctcatacagactcctttggaattcggtatgaaagagatcctcttcacggccgtattggtatcgcatcagattatggtaaacgtctgttaattggaagggtgcccccaactgattacatcttgtatcagactgaaagataccacacaaacacctttggatacgacattccagtaatatctgatggagattatgtactagtattaaagttttgcgaagtttattttaacgccccggatcagaaagtatttgatgttgttttaaatggagatcatacgattgtagctgatttagacatattcgagaaagttgggagaggtgttgctcatgacgaatacatacccttcaatataataaaaggacgtcttcatgtcaacggagaagaatcagatattcgtggagggcgtattagagttgagttcataaagggttacaaagacaatcctaaaatcaatgctatgtatgtcattaagggtaaattagaagatgttcctcaactaccatcaattccagctgaaccaagctccactgtagaagaattaaaagaagaaagtgaaaccattccaaaatctaggcgacctagtggacccaaacaacctgatcatatattgccgatgatacatccctgatgcttncctattttattgcg

SEQ ID NO: 1484 - DNA, 1054 bp, Diabrotica virgifera
atccaaacaggcataactttgacgatgtcacagaagctcgattcgatggatgcatccagaacgttactataatgggccaagcaattgatttgagaaacaatattaaagcacgtccggtagaacctggatgtcctgataaatggtcttcaatggtgtctttcggacaagatcaagatcattatgttggatgggacaaacttcctttaaccaatgaatttaatatgagccttaaattcagaaccatcgatgatgatggccttattctctacatttctgatccttcccaggataacacgatatctttatcattacacgacggtcatcttgttcttattgaccaaaagatcgaattaaaatctaaagggatattcaatgatagtaaatggcacgtagtgtcagtaatccacaatgatacatatctcaggatggatattgacgaccaggaaagtcaagttactgatgctactcctccgtttatacatgcgccagtttctagtttatatgtaggtggattacctagaaccattgatcctgctcagtattcagtagctgccactacatcgttctatggctgcgtagctgatctaacagttaatggcaaagttaaaaactttgccaacactactgacagacatgctgaaattctggataaatgcgttttagacgattctccagaagatatagatcattcaataccagatttaaaaccattggataataaagggtattatacaactgaagctcctccagaaattacaacaaacatcgaagaagggtacgctacagtaagaggtgatggaggtaatgactttagacctattaatgaagtagacattccacgagctcccgttacagatgttgtaaccgaggtagtaccgacagaaccaacgcttcctaaacggattggtactttacctcctacgacaatatcgcccgtcactgatggttgcgcattatcaccaaacccagtacaagaaagcgttcaagtagtaggatatagatttggtactcacaacggtagtagattggaatgtcctactgcaagaggaaaact

SEQ ID NO: 1485 - DNA, 961 bp, Diabrotica virgifera
cacaaatacgttttaaagacgtttttaatatttagttttatgtataagagatatatctttattaaaaatgaattccaacaaatttagaacaatggaagatgaaatgagcaggtttgaagcagagatatctgctgctccaatactcaacgcctatggcccagcatacatacctggttttggagctatacctccaccaccagcacctccaatgttaataccacatcaagttaataagggtgtcaaaagatatgataatctatttttaacacctacttctactcagtccgcagtggtttctgcgaaacctactttatatgctgctcctaaggcaagtactcaatcaatgcctcaggcagccccgacacagtcagtagattttattgctcttcaaaatgaagtggagaaaaaattaaagaagttgaagaatgagaaagttagtgcagaattagctatttctcaaggtaaagctagcagtgcactacaatcttttggtcctgaggattataaaagaaaaagtaccaaaaatagaaagctgatgagaacagctggaggtcaaacttgggaagattcctcattggctgattggcaagatgatgattttaggattttctgtggagatcttggaaatgatgttactgatgagctattgactagaactttcaataaatttccttcatttcaaagagcaaaggttatcagagataaaagaactaataaaagtaaaggctatggttttgtaagctttaaagaccctgccgattttactaaggccatgaaggaaatgaatggacgttatgtgggtagcagaccctataaagctaagaaaaagtacatggcgcaataggtgtatagatattgtgaagaagaaggagaaagaaaagtagcccttctaatttattgacttcttggagtagatgaatctttttatgttttacatgttataaatggatgaattgtacga

SEQ ID NO: 1486 - DNA, 709 bp, Diabrotica virgifera
aagatatttacttagtttttgacgagatcagtgactttcaaatctctatctgtatctggttagtttgccacgggtcatttccttaacatgtatcaaaatgcttatctacgaaacggattgatagtattggttattcttgtttgttttggtacaaattcgaatggactaaaagtatctgtctactacgaagcgctgtgcccagacagtgttagatttattggtcgtcagctctaccccaaatgggaccaaattaaggactatatcgacgagttggaatttgtaccctttggcaaagctatatacgtgcaccacgatgctgatattgtaaagcaaacatctgagcgttactcattcagttgccaacatggtcgtagagaatgccaaggaaacaagtaccaggcttgtgcactatcgcaaaataaaggcaaagatgtagaagtgcctttggtttattgtatcatgaaaagaatatatccttcttctctcaacactgctgaacaatgtgccaggaaatattaaatatctatccacggtttctctctgcctgtacattaaggatacatggattcatgcatctgaataccacaagggctgcgatacaatctatagacatgatatagatataaattctacaaacttcgagcttgggatggattaggccaaatttagaaatttttaaaatgtcccaatattgctacattatttccaa

SEQ ID NO: 1487 - DNA, 993 bp, Diabrotica virgifera
  misc_feature (677)..(677): n is a, c, g, or t
atttttgatgtttttgataggcttcaataaaaaaaaattatataaaaatggcaaaaaagacatacgatctattgtttaaacttttattaattggtgattccggagtagggaaaacatgtatattattccgattttcagatgatgcattcacaactacatttatatcaacaataggtatagatttcaaaataaaaactgttgaattgagaggtaaaaaaatcaaactgcagatatgggatactgctggtcaagaaagatttcacaccatcacgacttcttactacagaggagcaatggggattatgttagtttatgatattaccaatgagaagagttttgaaaatatagtcaaatggttaagaaacatagatgagcatgctaatgaagatgtggagaagatgatattaggcaataaatgtgatatgacagacaagagggtggttagtaaagaaagaggagaaactatcgctcgtgaacataacatcagattcatggaaacatccgccaaggccaacataaacatagaacgagctttcagcgaactggcagaggccatcctggtgaaaacggccggaagagacgacccggtggacagggtgacggtagacataagaccaacctaatacgaataagtcttgttgtaattagtaaaaaaaattgcaaaaaaaaacaacgtnaatttaggagtatatgcatgtgaactgatttctatacaagatggctcatatttagttttattttctgaacaagcacttaaattttgttgtgttcagtggaaaattcggttgtactcaaattttcctttttaatgaaaacatttgtgaattaataaataacaaagacaacgtttttgtagaataatagaatatttattatgcgatagattaacagtttttcaaagatacacaagtttggaagcaggtgtgccaattttagatgaataatgaaaacttatttcttcgtatgatttttctaattttaataaaccttttt

SEQ ID NO: 1488 - DNA, 1294 bp, Diabrotica virgifera
  misc_feature (1254)..(1254): n is a, c, g, or t
aaatgaagtactgcaagatttatatcagtttattgctgctaggagcttgccatctgttaactggtgacaatgaacactccgaagatctagagtacttcttgtacgaagacaaagacggcaatcttaaagtagagcgtctcctaaacagccgaccagaactcttgtcgtcgtctggatccgatgtaaagtactttttcttcagcaagtctaaccctggagatgaagaaggtgtggagattcacagcaacaacacagagaaattgaaaacgacatcatttacaacaaagagagaaactatttttatcgtgcatggatggaaggatagccataaggcagatgttaattctcatgtcagagaatatatactcagtgacaaacttaaagccactatctccgcattaccagactctattgtcaaacagactcaagctgccattggagaaaaagaaggcaaaattgacaatagagtcagggtagaaataatcaaggaagaagaaaagaaaattaaagaggaaagagaagaagtcagagaagaaaagaaaaagcagaaattggagaaagacaaagaacttcttgtggataaggcaccagtaatatcgactgaagcaacaccgtgtctagatgatacagctttgaggataactaagaaacccgaaaaagtagatgaaaaggagcaacgtcttcagtccaaagattttgctattattgaaactgccattgacactgtttccaaggaaaagaagtttattgtagaaaaggaggaaatacaagaactcaaatcagagatggaagattacaaacaagatgttgaagacctggctaaagctgtagcaagtcaaccaaaaccagaggttaaagaaacaaaagctgccaaacgtcttttcaagagcgttaataaaatgattaataaattggacaatgttcttgtcggtttagaaaaacgagagaaacagttgaagaaagacttagaactagaagcaactgacaagaagaaggaagaactacttaagatcgatgacattatagctgttattcataaaataagggatgtaccggatcaaagtaaaatcgaacaaattaaaaacgtgctaaaacgaatggacgacgatcaggatggatctttgaaaatagaggatgttttgaaggtaatcgaaataataggaaaagaaaatgtcaacctcagtcccaaacaaatagacgagttggtagatctcattgacaaggaggaaatcctcgaagtagaagataaaattngaaaggcattacagaaagataaagaaacgaaggccaaaaa

SEQ ID NO: 1489 - DNA, 1091 bp, Diabrotica virgifera
cggacccatgcgtccaaaatgaagtattgcaagatttatatcagtttattgctgctaggagcttgccatctgttaactggtgacaatgaacactccgaagatctagagtacttcttgtacgaagacaaagacggcaatcttaaagtagagcgtctcctaaacagccgaccagaactcttgtcgtcgtctggatccgatgtaaagtactttttcttcagcaagtctaaccctggagatgaagaaggtgtggagattcacagcaacaacacagagaaattgaaaacgacatcatttacaacaaagagagaaactatttttatcgtgcatggatggaaggatagccataaggcagatgttaattctcatgtcagagaatatatactcagggaccacgatgttaatatctttgtcgtcgactggagtccaattgctggaaaaggttacttaacagcacaggggtctatgcaaaaagtgggaggatatatagcagacttcgccagatctctgaataaaaaatacggtttacaacttaataagttgaaatttgtaggtcattccctgggtgctcatatctgtggatgtgctggagctgctttggatggacaagtcgacagaattgttggtttagatccagctggtcctctattcagagaagagagaacagacaaccgtattgacgctagtgatgcagagaatgtccaaattattcacacgaatggaggaaagatgggatatttggctccatgcggagactctgacttctatccaaatggaggaaaatcacaaccaggttgtggatttgatttaggtggcggttgtgctcactctaggtcatacgaaatatatgccgaatcattgactagcacaggatttgttggacagcagtgcaatagttatgaggaatatcagaagggtaaatgtaccggaccaaaagctagcatgggaatgttccatattgataaaatggcctctggttcctactaccttaaaacacacagcaaatctccattccataaaggataaagatgtttattgtactacatagttaaataaacaataaaatctaacgtaaaaaaaaaatacaacacact

SEQ ID NO: 1490 - DNA, 992 bp, Diabrotica virgifera
ttctctttttacatcgtgaatgcacagcaaaaggacgaaatggcaaaagacatgaattttaaattattaagtggcgatctaatgcctttggttggatttggaacttaccaggttcgcggggacgatttgatcaaatctgttctggatcatgctctggcagctggataccgacttatagacagtgctgcagtgtatggcaatgaagtatccattggaaaagcattgaaagagttgttaccgaaacataacttgaccaggaaagatatatttataacaacaaaattgtctcctagtaatcaaggtgaacaggcatatagtgcccttcagagatccttgcagaatctcgattgtgaataccttgatttatacttaatacactggcctggtgcacaaggcataaacagtgaaaataagaataacacagttcttagagatgaaagctggcagcagatggttaagggtgttaaaaatggcctaactaaaaatattggagtctcaaattataatgttaagcatatgagagaattattgaacaaaaaccatggtattaagccagctgtgaaccaggtggagtggcacccatattatcatcaacctgaactgttagatttgctaagaaaagaaggcattctattacaggcttactcttcactaggaggtagtaataacccagatttgttaaatgacaaagaaattaacaaaatagcaacaaagttaggaaaaagtcctgcacaggttcttctacgttggccccttcaacaaaatattgccattattccaaaagcacgctccaagaaacatattgacgataatattgatataaactttgttattcctgaagatgatatgaagatattaaacggtttgccacaaacaaaatatgcttgggacccagataccatagcttaattaaatttatacttttacggattatactaacgtagttcttagttttattttttaaaattaatccaactttttccataaaataa

SEQ ID NO: 1491 - DNA, 1228 bp, Diabrotica virgifera
  misc_feature (1118)..(1118): n is a, c, g, or t
  misc_feature (1198)..(1198): n is a, c, g, or t
  misc_feature (1220)..(1220): n is a, c, g, or t
cctaacaacattacgtcttagaagtaaaaaacgcccatttagtttactaatacgagtatatttataacagtgtgctttcatttcaaaaaccaatacgttctttcttcttcgtcggttattctgtaatcggtattactcggaatccgttccaaatgactttgaaacacgaaaactcgttatctctacctcaagaagaaattgtgcaacaaaagaagtttgctcgaccgagatatgaagaaatcaagaaaaattgtaattttactcagtttgtgcgtagtggtaatgataactcagatttatatgataacacacaatgttaaaattgaaacagtaaattactacaccaaagaggaaactgatttaccagaattatatgtaattacaccgacgtttaagaaacctgagcaaataccagaactagtgcgtttatcacaaactttgttgctgattcccaaattgacgtggttagtggtagaagacgggtatgaaaagaatgatcgtgttgaagctgttttaaaaagaaaaataggattaaactatagatatttactggcacccatgcccgaaaaatatcgaaacagttcctacgcaaagcccaaaggagtttcgaataggaataaaggtttgggatggataagaaaatatgctaaaaatggagtgctatattttgccgacgacgataatacatacgatgtaaagctattccacgaaattagaaaaaccaaaacagtgtccttatttcctgtcggtttggtcacagaattaggattaagtagtcctattgtagaaaactgccaatttatagatttctatgatggatggatcggtggtaggaagtttccggtggatatggcaggtttcgctgtttcggtcgagtttcttttgtcgcgtcctaatgctagcatgccctatacggcgggatatgaagaagatggattcttgaggagccttgcaccgtttgaagccaaggaggctcagattctagcttcatgttgttcggagatattagtttggcatacgagaactgtgcatacatcaccagccaaacgaaataatttgacaactgtatataaaaatagtaatcttccaatattgcaagaacttatagtgtaaattanagtgtaaaactggggttagttgaaacgaataaaactgtaagtgaaacaatatttataatgatgtaattttgataaataanagaaagaaatctttccttcagnttacgaat

SEQ ID NO: 1492 - DNA, 1544 bp, Diabrotica virgifera
agtgggaataatacatgattggtttagttgcaacttcagatttatgtgcatatgaaccttatattcgaatatctgtcatactttggctagaattatggaagagaagattgaaatagagaacctgcatgctattttctaatacgtggatgaatgttttgacttccaataaatcaagaacatgcctatagagcagtgaattcaacagagacatcactccacagactcgtaaaaaaagtgaagaacataattgaaaataagaggtgattaagcctttttagatataaagaggatattccacaacactttgataatatcaataaccaatgccttgagacctaaaggagtcgatgatatttgtttgaactttatgctcaggaatagagttgaaaatactaccatccatggagtgttgtctgtgttgacccgggtcaacagaggatacccgcaggatgatattttgtccccactgctgtagaatttggcgatggacagactaatagggaatttacaggcaaatggtcacaaaacaattggatattcgggtgataatatggtaatcagagatgtatgaacgaggcccttgaactagtgaggcaataggcgtattttgagggcctaaatatacgtaaacacaaattcaccatagtcgcttaagttaggttctctaaagatacagggacaaaagttcagctaaagagagagatactggttaaatacctgggaacgtggctttttgaagactgggcatcggacagggaagtaaaatgtcacattgagcaagctcgacaagctttcgtaaaattcagaaggtagccgtgttcagagttcgatcttcaactgagactaagccttttttttttttgaaacatggcagttccatgtgcacactaacgagaagtttttcccgtatttagtgtaatttgccaaaaataaagtgtgaaatagtagttttcgagtgcaaaataagtcaatatgaagttgaacgtatcgtacccggccacgggttgccaaaaacttttcgaagatgtttaattatatatttattattttttaatttaaaacagctagaatattaaaatttttattgaaaaataaatatgattaaataatttttttgaaatgaaatgttattcgtatttaaatatatctaattttttattaaataaattaaatttatttattaactatatatttataattatatatttttatattattaatattaaatatttttagggatgagcttaaaaataaaattttattaaaatttaatttataaataaaaattaggattaaaaattttcatattttaaaatatgttattatttatttttatatattattatttttactttttataaattttttattaaaatataaatttaaattatttaaatttaggaatgattattgtattagtattaataagttgtatatttagtataacccatatgtttaataaaggaattcgcaacatttttttcgccctgtataataaaacatgcctgttctgtatcaagtatgtagtctcgcctgaccactga

SEQ ID NO: 1493 - DNA, 2037 bp, Diabrotica virgifera
  misc_feature (1576)..(1584): n is a, c, g, or t
gccgccctttttttttttttttgtgtaatatttttaagtataagtttagtattataaggaactatttcctataaaggctttttgctatgtattcacaaaattatagatactagatttctttctgaaaagtgccctacaaatgttcataagacgtacattgaatgtacataaggtgtacactgaaagcttcaatacaacgtacaatgtacgtttgtagcggacgttctatggacgtccaattttgtgaactctggacattcgttggacgtccatcggatgtccattgtaccttagcgggacgtccattggacgttccaatgtacaccgatgtacgtccattggatgtccataaaacgtacttgtgctatctgggcagccacccacctgcctcttgacaatttgagcatttaatttaagcaaaaagcaatgatttttttttcaaaaaaaactgttttcgtgttttctggggaggggtgtgcttaagtggaggggggggggggggagcgggaggtggtagggtgagcttatgcgtgctagctgccatctgcctttcttatctctcgtttttgaaaccgggcagttccatgtgcacactaacgagaagtttttcccgtatttagtgtaatttgccaaaaataaagtgtgaaatagtagttttcgagtgcaaaataagtcaatatgaagttgaacgtatcgtacccggccacgggttgccaaaaacttttcgaagttgttgacgaacacaaaattcgtatcttttacgaaaaacgcatgggtcaagaagttgaggctgatgctcttggtgacgaatggaagggctacatcttgaaaatatctggaggtaacgacaaacaaggattccccatgaaacaaggtgttcttacaaacggtagagtaagacttttactttcaaaaggtcactcctgctacagacccagacgtaccggtgaacgtaaaaggaaatcagttcgtgggtgcattgttgatgggaacctcagcgtgttggccctagtcattgtaagaaaaggagaacaagaaattcccggacttactgacaccaccatcccacgtcgcctgggacccaagagagcatccagaatccgtaagctcttcaaccttagcaaagaagacgatgtacgtcaatatgtagtaaagagacctttggcccaaaaagaaggtaagaagttaagaaccaaggcccccaaaatccaacgtcttattacacccgttgttttgcaaagaaaacgtcatcgtcttgctttgaagaagaagaggtgccttaaacgtaaagaacaagaagatgcatatgctaaactattggctcaacgtaagaaggaatccaaggctcgtcgtgagatgttgaagaggcgtaggtctgccagtatgcgtgatagtaaatccagcacgcagagtggtcagaagtaaattgtaattttttatattttaagacaatgtatgaaataaacgttgttgcttaataaaaaatgaaaaaaaaaaataaaaaaaaattttctggatcatcttaacaaaaaccaaacttatattccataaaaaagggaaaaaaataaaaaggggnnnnnnnnntttcttgaaaatatctgataatattgacaaacatgaattaccccatgttattaggagtttttacatacgtaaaaataattatattattatcattagttatttttagctatggacttagaagtaccgttttattaaaatttaatttttattctataattacatattaaaaattttcatattttaaactatgttattatttatttttatatattattatttttattttttataaattttgtattaaaatatatatttaaattatttaaatttattaatgatgataatattagaatttaaaaattgtatatttagtatgaatatataggattaataaaggaattcgagaacatttttttcacctgattattataaacatgctctttttgtattaaatataaagtctcgcctgcccactgattaatttgaatgcccgtgcaattttgaccgcgctaa

SEQ ID NO: 1494 - DNA, 1040 bp, Diabrotica virgifera
attcgatttatttcttttgagtgatttcaaattaaatttaaaagtgatttaaaaataatttttgtagttcaggaatatataaaattaaaaaatcacgccaataatcaaatggaagtaaaacaagaaattagcgaagaaacgtgtaaaacagaaatagacaatcacttggatgatgctcttttggatgactttaaatgtgaaagtgaaataaaggaggaatccaattattggcaaagtactcatgacacatacgattctgtagacttaaagaaatgccccataaatactgaaatagaacaacatggaaataaacttaacctatttgaagaaaaccaaaaaactgaaaaaggtcatctccaagatgaaatcaaaacagaaattatggagaaactcattgaagattcgtcttacgaaggaaatgatatgaatcgacacaatgaaggaaaaacattaaataagaatatgcaagttgtgactgaaaaaagaccttataaatgtgacacttgttttaaacaatttagtaacgtaagtcatttgaaaaaacatttgagagtgcacactggacaaaaaccttatcagtgtgaaatttgttttaaccgatttagtgatacgagtagtttaaaaagacatttcagattgcacactggggcaaaactttacaagtgtgagatttgttttaagcaatttagtggataaaagtagtttgaaaacacatttgagagtacacactgggagaaaaaccttacaagtggtgaaatttgttttaagcgatttagtgtagcaggaagtttaaaaagtcatttaggaacacacactggcagaaaaaccttacaaggtggtgagaatctgttttaagcggtttagtggaggaagtaatttgaaaagaacattttcagattgcacactggagataaagattacaaatggaagatttgttttaagcaatttagtcaagcaggataatttaaaaagtcattttgggaaacacacactggcagaaaaaccttacaggtgggagatctggtttaaacagtttagtc

SEQ ID NO: 1495 - DNA, 1038 bp, Diabrotica virgifera
agttgaagtagagtagatagtaagtaagtgaatgtacgttgtgaatgacggaagccggtttgttacagagaggaggatggagtccaacacgataacgttgacgagatttttcttggcggaacaacaaaaatttccagaagccacaggtgaattgacccagctgctgacttctattcaaacagctgttaaggttatcagtagcgccgttagaagagctggtattaccaaattgtttggtaccgtaggtgaaacaaatgtacagggagaagaagttaaaaagttggacgtattggccaacgaattatttatcaatatgcttaagtcatcttatacagtagcattgcttatatctgaagaaaatgaaacaattttggaggtagagactgaacaccgaggaaagtatatagtagccttcgatccattagatggttcctcgaatatcgactgtctggtatcgataggttcaattttcgccatttacagaaaatccgacaacacagttccagccctcgatgacacactaatgtccggaaggaatgtagtagcagccggatatgcgctttatggcagtgcaactatgctggtcatatcttctggatctggtgtgcatggtttcatgctggatgccaccataggagaatttgttttgactgaacacaacatgcggattccgaaaaaaggaaaaatctactctataaacgaagggtactaccacgaatgggatgatgccataagagaatacgtcgatgccaagaaagatccttctaaggggaaagcctatggtgccagggtacgtaggttctatgggtcgcagatgttcacagaactattaaatatggaggaatctttttataccctgcaccgaagtcttcccctaaaggcaaagcttaaattgatgtacgaatgggttcccgatggccttttttgcttgcccaggcaggaggattagctactggtgggaagaattaatatattaaaatatccaaccccactaccccaccctccaagaaaactccccattttttttggggggctttt

SEQ ID NO: 1496 - DNA, 1193 bp, Diabrotica virgifera
aaatggcatcccgggaagattggtcagcagaaacgcaatcaaaacttttacaagaagaacagagggtttcggttttaaatgaaattaaggatcatttaatatcaattccacagtctgaagcctctaaagttgccaatagttttaacatacctctggtctttgactgtttaaataattccaatacagaagaagttgatctagcatgcgaagtccttagtttgtttatgaacaacttgagcattggagagagcacaaataaatatgatgtaccattagaaagagctttgcaccacccttaccctggcgtaaaaattatggctctcaatgaaatacacagaaacgtatcaaaagaagaaggtcttataaatgtgtgtcgaagaatttccttgttaagcagtgtaatccaatgtgttggggatagtgaactagcagttgctcaagaagctgcaaaaattgtttcagatgttggtatttcggatttaggcttaaaagttttggtgtctggtgatattgttaaggagatacaagaaatcatgtgtataaatgaacttacaaggcttagagtctatgagatagttgttaatatttctaaagaatcggaggctaatttggaattactaaaatcgacaggcatagtatcccaaattttagaagaactgaacaataatgatgtgttattgaaaatgaatattgtggaacttcttactcagcttggactaaatatacatggttacaattacttagaacaaaatggagttctaagcaaattgtttgcattaattgaagatgatgaagaccaaattactgtaaagttttgtgaaccaggtattttaaaatttttttggaaacatggctcactggaagcccactgaactgctactaaaataccctaaaatatttgacagactattttgctaatatttgaaagtagggatctaacgatagtagggattaccttagacacactaagggattataggaggtacgactgaagggaaaatggggttttaaagtcttacggaaaaaaaatttaatttatggactaaaaaaccattattgaaaattggttatcctcctttttccaacgggaaaaaaaaggcttaaaaagccctttgaaaatggaaaaaaaaaaatttttttttggtacgggggtctggggacccccccaacccccaatttggtgggggggccac

SEQ ID NO: 1497 - DNA, 922 bp, Diabrotica virgifera
atctaaatctgcataacatgtaatatgactttagtaggagatttcgaagaaaaatcagagaaaaatgttaatagccaacaaaaccaagctggtacaataccacccgatgccagtcaatggggctacgacctatatccgagcagaaaatcccacaatgattcagcttcaatcacagactatcttaaaggaaagggcaaagagaatatagataaaattcattgtgagagaaacgtatataagtgtataaaagaaagtccgatggttaagttaatgatgggggctttgaaggcttcagggtgtactgttgatattaggagacatatttcttgtgaggagtgtgctcctactgttagtggaggctatgatcctataatgaatcaagtagttatatgtcaaaactctgccacaaaagtaggtgcagtgaacactgttctgacacacgaaatgatccacatgtttgactactgcaaaaataacgtagacttcaaaaacctcgaacacttagcatgcactgagatacgagctgccaacctggctcattgcagttttctttccgcgctagttgctggagatgcctcacttttttacatcaaagaagcccaccaatactgtgttaggaataaggcgctcagttcggttatagctgctaggaacgttagtaaagaggaagctatggttgctattgataaggtcttttcaaaatgttatgcagatttagagcctgtaggtaggagaataagaagaaattctgctgatatgtataaggcatatgaagagggacagtattatggatatggataaactaaaatgtagtgttcaacgttgtaggcatttgttgactatttgtaagagaagaaaaagcagaatgtgaaattttactacagcatattttgcaggaaccatcccctagtgtttatattat

SEQ ID NO: 1498 - DNA, 948 bp, Diabrotica virgifera
ataaaaaataagttgtcagacactaaaaaaacgaaataaaaatttcagtactattaaaaaaaattttttatgatgaaaaaataattatttttctattcaatcaagaaacagaaaatacgaatagtgaaaatgtccgaaacattcattgaacacgaaaaatcctcccaaagtgtaatttcctccgattccggcaaagacattctagaagaatctgacgtacccgatctagaacccattagctcaagtgaagacaatatcagtaaaaacgatgaagttgaaaatatacccgaagaagagaaagaaaaaatcaatgaacctgaagaacctaaaccagaatgggttgatcttcttggcagtggggctattatgaaaaagaccattgctgaaggtaaaccagacactagaccacaaagaagcgaaaagtgcattataaattacagttgctacctcgaagatgagactttagtggacagtgctgataatttcgaactaaatttaggagaatctgatgtaatacaaggacttgatgtctccctaggacttatgaatattggagaaaaatgtaggttaaaaattacacccaggctggcctttggtagaaaaggattgccttcaaaaattccaggagatagtttagttatctatgatgtagagctagtaaatgttgagccagaagatgatgttgatatgatgcctattactctgagaaaagttaaaggcaataagaagagagaaagagggaattggtggtatactagaggagaaaacaatatagccattcaatgctatagaagagcactagattatttagacgaagtggaaggtggagatcaatctaaaggcgaagtatcagattcagatttgcagagtattttggaggatgaaggtgagtgtttgtaataatatggcagctgcacaatcaaaatggagatgtacagtgctgccctt

SEQ ID NO: 1499 - DNA, 986 bp, Diabrotica virgifera
cttcaatttcatattttattcggcaatttcgcagttttagtgataattttaagttcctaaatctaaacattgttcaaaaatgtaaagaaggtggatttttactctagagacctgttacatacgcgtagactgagtttgcattagtaacatattgccctaatttaaaaaggcaaaccaataataagactgtaattttgtgtttgtgatattgtggaaaatgaaaaactaagccgtaatttcagtaaaactatctgaacaaaaaaagcattgttacaaaaatgatgaggctcacaagaaaatcaatccaattattcagcaatattgctagaaatcattctgatttactagctaatcacaataaatctggttgtgctttattcaagattaacatatacagctgtaatcaatgtgtgttctactgtcaaagtaccaaatccacgtcgaaaatagaagatacaaaacccacatttcctttgggaagtttattgaaagaaaataatgataaggcacaagaagcagctgaagaagaagagcgaaagaaacagagggaaaattcatggagaacaatgaaactcacccttgcatttcttggaatctctttcacatgtataggaacttatgttatatttactctaggaagtcctgaaaaggattctcatggtgatcccattaaagatgatcttgctgataagcctgttgttctacaatacatcattagaacctatagagagttagattactatagaaaactgattaaagaaccatcaagagaaaaattactaccagatccattagagtatccttatttgcaaccaaaatatacattagtgttagaattaacagatgtgcttgtacatcctgactggacttacagcactggatggaggtttaaaaaacgtccaatggtagactattttttagaatcattgcatggatcctatgaaatataatatatactgcggaacaagggatgactgtatttccat

SEQ ID NO: 1500 - DNA, 1309 bp, Diabrotica virgifera
agtccaggcaaaatttcatgccgtcctgtttctgcacggtcaagtcgaggatagcacccctgctattagggaaacttcgtcgatggaaaccggtcgatgctaacacgtacttcgtatgtcaacgaaattgtctttcaagatacatataatttatttagatatacagaaataacattttggcctaactacgctttatacacagaaaacataataataatgatatgactcaacaaagtctaaaattacattgatacatgttgaatcaagaagttgtgcattattatttccagaaaactaaaataatatcaaaaacataccgatctttaaaaaatataataaccaataaggataggtaacagcaaatttctgaaaggcgataaaactgatatgaccatgtaattttattattatatattttaggataccttaatactcaatggattttccttcaaaataaactgctatagtctttttattgttctttttgcggatttgctatgtattattattaccatcaactcgtttggcactgaattaagcaaagatgaccgtgctaagttgtaccctcgctgtggaagactcaaccccgatggtttggctgctctagtgagagccgaggactacgaccaagttaaagcagttgctgaatactacgctgaatattccaaactgtttgaaggagctggcaacaacccgggagacaaaacattggaagacaaattctttgaatacgaagtacgtcttaacatcaatgctttcatgcaacagtttcactttggggtgttctactcttacttgaaattgaaggaacaggaatgcagaaatattgtatggattgctgaatgcgtagctcaaaaacacagggctatagtctttttattgttctttttgcggatttgctatgtattgttaaaacatcaacacatttaatgtatatgttttaccaatacatagcaaatcctcacaaagaacaataaaaagtctcgcagtttattttgaaggaaaatccattgagtattaatgtatcctaaaatatgtaatcataaaattacatggtcatatcagttttatcgcctttcagaaatttgctgttacctatccttattgtttattatattttttaatgatcggtatgtttttgatattattttagttttctggaaataatattgcacaaattcttagttatctgattcaacatgtatcaatgctttgttgagtcatatcataaatattattatgttttctgtgtataaagcgtagctaggccaaaatgttatttctgttgtatatgtaagaataaataaaa

SEQ ID NO: 1501 - DNA, 915 bp, Diabrotica virgifera
ctgctctagtgagagccgaggactacgaccaagttaaagcagttgctgaatactacgctgaatattccaaactgtttgaaggagctggcaacaacccgggagacaaaacattggaagacaaattctttgaatacgaagtacgtcttaacatcaatgctttcatgcaacagtttcactttggggtgttctactcttacttgaaattgaaggaacaggaatgcagaaatattgtatggattgctgaatgcgtagctcaaaaacacagggctaaaatcgataactacatcccaatattctaaaggaatttcttgtttgcactattgtttgcattccatttggctcatttagttcttagtgtcagtaagtggaattatcaaaagtatcagtttctatgattcagatgtactattcagaccttcagacaaatccagttagtacaatgttttcgtttcacattattatcaactaatctttcagtcgtccaagattgttataaaattaaatatacattaaatgttttgatgttttaacaatacatagcaaatccgcaaaaagaacaataaaaagactatagcagtttattttgaaggaaaatccattgagtattaaggtatcctaaaatatataataataaaattacatggtcatatcagttttatcgcctttcagaaatttgctgttacctatccttattggttattatattttttaaagatcggtatgtttttgatattattttagttttctggaaataataatgcacaacttcttgattcaacatgtatcaatgtaattttagactttgttgagtcatatcataaatattattatgttttctgtgtataaagcgtagttaggccaaaatgttatttctgttgtatatctaagaataaataaaattatatgtatctagaa

SEQ ID NO: 1502 - DNA, 1485 bp, Diabrotica virgifera
ataatcatatgacacttgggtgaggtgtttttatcccgtgagatatttttgcagtccttttaataaaattcttcataattcaccatgaagggctgcgttttcaacatcgacaacggttatttggaaggcctgtgtcgtggctttaaatgtgggatcctgaaacaatccgattatttgaatttggtccagtgtgaaactcttgaagatttaaaactgcacttgcaaggcactgactatggaacttttttggccaatgaaccttcacctttgtcagtatccgtcatcgattcaagacttcgagaaaaactcgtgattgagttccagcacatgcgtaaccaagcagtagagcctctctcgacatttatggacttcattacctacagttacatgatcgacaacataattttgcttattacaggaactcttcaccagagaccaatcagtgaattaatccctaaatgtcaccctctaggtagcttcgagcaaatggaagccatccacgtagctgctactccagctgagttatacaacgctgtattggtggacacaccacttgctccattcttcgttgattgcatcagtgaacaagatttggatgaaatgaacattgaaatcatcagaaacaccttatacaaagcttacttggaagcattttataccttctgcaaggaaattggaggtactactgccgatagcatgtgtgaaattttggcttttgaggcagatagacgtgctattattattaccatcaactcgtttggcactgaattaagcaaagatgaccgtgctaagttgtaccctcgctgtggaagactcaaccccgatggtttggctgctctagtgagagccgaggactacgaccaagttaaagcagttgctgaatactacgctgaatattccaaactgtttgaaggagctggcaacaacccgggagacaaaacattggaagacaaattctttgaatacgaagtacgtcttaacatcaatgctttcatgcaacagtttcactttggggtgttctactcttacttgaaattgaaggaacaggaatgcagaaatattgtatggattgctgaatgcgtagctcaaaaacacagggctaaaatcgataactacatcccaatattctaaaggaatttcttgtttgcactattgtttgcattccatttggctcatttagttcttagtgtcagtaagtggaattatcaaaagtatcagtttctatgattcagatgtactattcagaccttcagacaaatccagttagtacaatgttttcgtttcacattattatcaactaatctttcagccgtccaagattgttataaaataaaatatacattaaatgggttgatgttttaaaaaaaaaaaacaaatccccaaaaaaaaaaaaaaaaaaaccatagaaatttttttttttaaggaaacacctttgggtggtaagggcaatgctaaaccaaataaaaaaaaaaaaaaacaactggg

SEQ ID NO: 1503 - DNA, 873 bp, Diabrotica virgifera
aataaatttcgtaagataggtgtttttataccggtttctagagtattctaattgggtaatacaatacctataactgtgtaattcgattattgtgaatccaaaaatgagttgccctatagggaaagacgccgttgacaaattaaaacaatttatatcactatgtaagtcaaatcctgatattcttcatttgccggatcttaaatttttcaaagactatttggaatccttgggtgcctcactccctgaaactagaaatatgccatcggatatcaaagtagaacccaaggaagctactgatactgaagagccagtgcaggaagatgtagaatctgatccggaatccgaattggaatttgacatgactggatgtgtagaaccagattttatagatgatatgaatcaaaaaatgggtgatccctccaaagaattgtccgaagaggttacagatcaagctgatgagaaaagaatggaggctatgtcacagttatctgaaggtaatattgagaaagccatagaattattcacagaggccatagaactcaatccaactagtgctttattatttgcaaagaggggccaagcttatctaaagcttaccaagccaaatgcttgcatcagagactgtacaagagccttagaactgaattgtgattctgcccctgcatataaatttagaggaagagcttatagactgttgggagagtgggaattggctgctaaggattttaggcaagcatgcaacatagatcttgatgaacagactgatgaatggttaaaggaagtcacaccaaatgctaaaagaattgaaggacatttgctgaagaaggagagaaagaagaaagataaagaggagaaggaaaagattggatagga

SEQ ID NO: 1504 - DNA, 1122 bp, Diabrotica virgifera
  misc_feature (1041)..(1041): n is a, c, g, or t
  misc_feature (1048)..(1048): n is a, c, g, or t
  misc_feature (1059)..(1059): n is a, c, g, or t
  misc_feature (1092)..(1092): n is a, c, g, or t
tgatttagttcaaataccgaatgaatgcgtggtggaagacgttgtgggagccatatacggtgatatcgattttaaattcccaacctttccacagttattagcagaccgctcaataatttgcctaaggaacgacgtctgcaccgaaataaataataagatgctgagacggttgccaggcgatatcgtgaccgtttacagtgtcgataatgtcgactctgacaatccggaagacgcagaaaatttctcgatggaatttctgaatcgtatcaaatacggcggcttacctgatcacgagttaatgctcaaggtaggcgcacccgtcattttgctgcgcaatattgatgcgagatcaggcttggtgaatggcacacgcctcatcataaaacaagtcagtcaaaacgctatcatagccgacattgctttcggagtaaataaaggaaaaactgtatttattccaaaattcgacatcaaatgcagagtcgacacgcattcagtgaatctcaaacgaagacaattcccagtgaaattaagctttgcaatcactgtgaataaagcgcaaggtcaaactttggagaaagtcggtatatgtctaacgacaccagtgtacgcacacggtcagttgtacactgcactttcacgtaccaaacgaatgtcagcactcaaagtccaaattcgaacgagcgaacatcaaggaacggctaaggaaaatcacatcaacagaactttggctcgcaacgtagtttatgaatcagttatggatcgattccaataagctacgcgtcgacattcgcaagtttggtcgtcatcgcaagtttcgtcgttatcgtaagtttcgtcgtcatcgcaaatttcgtcgtcatcgcaagttttgtcatcatcgcaagtttcgtcgtcatcaccatggaagaaaaccaagtattgtcgccccgttaggtgaattattccgattcgatttttttgcacaaacttgctaaaaaaaggtttttgtaacaaatccataaggtgccagacggtaccgtgtacgaaaaattgtaacaattntttttanaccattcacanaattatttttttagttcgatcatttatacattntttagatcatttggttcattctaagaaaaa

SEQ ID NO: 1505 - DNA, 786 bp, Diabrotica virgifera
agactgaagacctgaattttcttttataatattgataataactaaatccacatacaatggcttcaatatcagcaacagaacaaaaaggaatgcaacagattgatctcactacactgaacgtacaacagctatcccaactaaaacaccaattggacaatgaagtcagcttgtttcaagactctcttgcgtctttgaaggtagcacagggcaaatatcaaacttcaggcgagacactggagaaaatcactgcggaaactgagggacaggacattttagtacctttaactggatctatgtatgttcctggtaaacttcatgacacacaaaatgttataatcgatattggaacaagatattatgtagaaaaggacattgagggagcaaaagactattttcagcgaaaagtcaagtttgtaacagaacaaatggaaaaagttcagtggctgggcatagagaagagcaaaataagggaagctgttattgaaattgctgaaatgaagatgtcacagcagcagcaacaacagccacaacagagctgaatccttagaagtatttaatttgagtctttgttatttattatttcacaagaactctgtgcctcatttcactgcagtttggtttcgttttgtatttagcttctttagtaaaatgacatatttagaaaacaatcaattttaatgaaatctttattgcattgaaggatattcgttaagttttttttttttttattgtcaatgattctaacatgattattttttaaaataaagaaattctcagttttgatgc

SEQ ID NO: 1506 - DNA, 936 bp, Diabrotica virgifera
tgtaattactactgattaattcattcatagagattctgtgccaagagcacgccaaatagaatcggatttggcgtgctcccacagctggccaatagaaacctacaagaataaaaattacagcgacaatttttgataattttccgtcgtcaagtattttacgtcagatgcccttcattgctacgcaaaaatacattcagtgacattgccctcgtgacacattttgacataatttcactccccttcgggtcgtgaaattaaaactgtcaaagtgtaactcgggaaacaaatcgataattttcttaatcatttttcactaaaacaatctttgctgtacacatttcgggtgaacttgaaagaggaagatttgctagtggtgtaaatttgttgttatataaaaaaagtacatgtggtttccgttctgacttgatgttattatcgtatggtattatttcacattgcgtgccatccttatctgaagttgttagcttaatacctataacctgatcttctaacaacacgtaacgcgcaaatggcggcttcaccaatttaaaaaaagaagcacatactttaatagaatcatggattttcaaatgatccggtagtgctaacgcagaattattatcgattccacaacttgtgtaaggacaattataagaacgatttctcttgttacagtatatttcatgtgatactatttctgaatacttgaaatgtttaccacaattccatttgcaaaaacgtgtcagaaaagttgagataatcgaatgtttcacgtataaatgattgtcattgattctattttcatgggttaaccactgaaaacaacaaaaacaaagaaaatcattatgtgtaggacttgaataatattctacgtcatccgagtcagaaatcgaaaagatgcagttttctttacaattaaaaccccacgcgtctgct

SEQ ID NO: 1507 - DNA, 1295 bp, Diabrotica virgifera
  misc_feature (1166)..(1166): n is a, c, g, or t
  misc_feature (1207)..(1207): n is a, c, g, or t
  misc_feature (1246)..(1246): n is a, c, g, or t
  misc_feature (1248)..(1249): n is a, c, g, or t
cggcttctgtggaattccaattaaaatgcatgggaaacttggtggtaaattagtgggtattgtgacttcgagagacattgacttcttagacgacattaattttgaaagtattaagttagaacagataatgaccaaattagagaatttagtaacagctcaatctggagtaacattaacagaagctaaccacatacttgaaaaaagtaaaaaaggaaaattacccatagtgaacaccaatggcagtctcatagctcttatggcgagaactgacttaaagaaggccaaaagttatcccatagcttcaaaggatgaaaacaaacaactcatcgttggagctgcattaggaactagggaagatgacaaagctaggttagcacttttggcacaagctggagttgatgtggttgttctagattcttctcaaggaaactcaagctaccagatagatatgatcaagttcatcaaaaccacttaccctaacctccaagttgttgcaggaaatgttgttaccaagaaacaagctaaaaaccttatagacgcaggagccgatggtttgcgagtgggtatgggtagtggaagtatttgtataacacaagaagtaatggctgttggacggccgcaggctactgcagtttataaagttagtcaatatgccaagcattttggagtgcccgttatagccgatggtggtattcagtctatcggtcacattacaaaggctcttgctcttggagcttcaacagtcatgatgggttcattattggcgggtacttcggaagcacctggggaatacttcttttctgatggtgtgaggcttaagaagtaccggggtatgggaagtttagaagctatggaccgtaaagatgcaatgggatcagcgatgaataggtatttccacaacgaagtagacaaactcaaagtagctcagggagttagtggcagcattgtagacaaaggatcagtattgcggtttttgccttatttacagtggtggtattaaacatggatgtcaggatattggagtgaaatcattgaatgatcttagggacagcatgtatactggccaacttcggtttgaattaagaacacattctgcccaagcagaaggaaacgtgcacagcctgttttcatacgaaaaaagattgttctaacaattccaataatcnttccataggtttcaaactacattttgtacaaacaattatancggagggagaaagattcctcattatattactttatcttngnntagtattttatattagaatatgattaattatagtaaatacaatttt

SEQ ID NO: 1508 - DNA, 915 bp, Diabrotica virgifera
ggtatataaaagtatattttagtaaattacatagaatttttacatttataaatatattattaaagtagcctcagtgatgccctatatttaactgaaaaaataattaaaggtacattttaaaagttattcttattctatacctcttgaaaattaaaactaaatgtaaaaaataacctggcgaggatgagttctaattttatacgtatttaaagactgacagtggaatagatattaggtatattcgtttattagccatgacaatcagaacattgttgtggaacgtcctgatcaagcgcagagaagaaatgtaaatacacactctcttctttacacattggaatagtgccattaaacatgtaatggacattgggagtaaattataaatgtatatcttgaaccgtctccatctcatccgatgaatttgtcatatacgtgaatacagtttattccatgaatttccatgattgttttgaattatcgcgataacgaatattttactgtgcaacaagaagtacgaaagtaaaatcaacgaatatacagctcctagaagaagtttttatatgaaacagatggtcataagtatgaccagtaagatggtctaaaactggacatcaaaaagactaaattcataatagtaacaaagaagctatacaccaatgtgaatttacccacacgtccgcagccagttgaaagagtcaaggccccgtcctacaatatttagggggtttggttcactgatgctaatgaccagacaagagaaatcaagaggcgaatagagatagcgagacaatcgtttgtcaaaatgaaaaagttcctatgcagccgggacataaatataaaattaagaacgagaatggtaaggtgctatgtttttctcggttctgctgtacggcatgggaacttggacactgaaaa

SEQ ID NO: 1509 - DNA, 973 bp, Diabrotica virgifera
  misc_feature (916)..(916): n is a, c, g, or t
  misc_feature (940)..(940): n is a, c, g, or t
ggaaaattgcacaaatatttgtgtttaatactgggtttgtcgtttgacaggtgaagggaaaagttttctctaaaaaagcttacattactaagatctgttacagaataacaagaatttcattctatattattactcgccaacactaggaatcactttgactttgaatattttttccatcggcgcagacagcagacagagtataaggaccttcatatacggaatgcaaagggcggtcgtgttgcggttggactcgtctccgacccgactgctccaactgtccagttgaagtcgtgtgcgactgctatcctcccactcaaaaaggtccggaacattcaatcagttgccatatggattcggatgaagagagactacttttcattttgttattacttaaacgaatgcgtataaaacgtcgtagaacgtgggtgcacgctatattaggtttgttccaacacaacgagaaaccatccatgtagcgttcaccgtcctgcgcagtaaacaaaataacccatggaacgtactacttcgtttccatggaaaccatggaacgttaattatcgtgaccgttacatgataccgtaacgtgatcgttacatgatggttctttgttgtgctggaacaaacctattttaatctagagagcagaatgaaatatttcaagtcaccattcaaatcagctgtattttgcatttttcttgaaagcaagcacaataatagtatactgtatcgtggatcgtggtacaacgattaatgatctaatcgcaatgctcgaaagaaaagatgcggtttggaatcggactgcagactgctccatgcggttaatggtaggatgtgtccaaccactttttactgccagcagcacggcgaaactcaaccgcaagtcaactgcattggtgcagttggactgcatgagcgntccgtatgggtgcgaaagggatanatttgtattgaaactgcagatcgtccaacgcga

SEQ ID NO: 1510 - DNA, 1051 bp, Diabrotica virgifera
atcctgtcagaaatgaaactgatgataactttgaaataattttgtaattttttgtaatttaataatttaacaatggttaatataacgacaaccaacacgaacatacgagaatatttttgtaaaattattaaagacaatgaggatgtttctgttggggtagcagcaatcagagctttgatggagttgattaaacattccaaatctgagactgttcaagagttagaagctaatctaaaagatggtatccaggagatgaaaaactcaaactacacagtagcaggtattaactctggatgtgaattatttttacgttttataacattagcttctcttgatacaagtggttttgatgagtgcaaacgaattatgttggatagaggtcacctttttattaaaaagctggatgaagccaggggaaaaatcgtcaaattagctgcaaatttcatcgaagatggctccaaagtattaacgcattcaagatcacgagtagttctacaaacgttaagaaaagcacataaacaaaataaaaagtttgaagtattcgtcacaatttcagaacctgataaaagtggtttaagaatgttagaagatttaaaatctgacggcattccctgcacagtaatactagattctgcaatcggctacatcatggaacaagttaattttatcatggtaggggcggaaagcgttgtggaaagtggtgggattgtgaataaagttggtagctacacgatggcagtatgtgctaaagaaatgaagatacctttctatgttttaactgaaagtttttaattttcaagattgtttccacttagtcagcaagatttacctgaagagtataagtatacttcggaaattcgagcaaaatcaaatcttaaagaaattcatccactagttgactatactcctccttcgtatatttacggattgtttactaacttggggtattttaactccttgtctccctttcgcctggtaaggggcagaaaatttaataaaaatttggtttttgggaaaaattaacttaaaacaaatttttttttatagcctt

SEQ ID NO: 1511 - DNA, 1008 bp, Diabrotica virgifera
  misc_feature (591)..(591): n is a, c, g, or t
ggccgcccttttttttttttttttgacaagccaagcatctttaaaatgaattgaatgtatgtcctttgcttaaaaatccagaaagatataatccagatactttaaatttggttgagaatttacaagccaggaactattggttgccctctttagaacaaatggtcaaaaagtttgttagtaaagctcaatatttacacccagatgatccgaaagctacagaaaaagcagaagtttgttaccaggactttcacaatcttcttgaacaacttacgtcagatcccaatattttaaagcctcttagtgttagaactttattggagtttaatgaaaataacctacgatcaaaatattttaaagatgcttggcttgtccaaaaagaaaatgaaagtacaaatgctttatctcaatttaaatctagaattaaacagatagattctattaaggattttcatagcaggtggtttgagataatacaaggagttttagctggaaacgtttttgattggggtgcaaaaatagttatagatattttagaaagtaataaaggaaattttggttttgatgaagcaacaaagactatccagaagaganccttggttttcggataaattagatgaatttgttgacaagttaaaggtcaaaccttataaaacatgtattattttcgtggacaactcaggatatgacttcgtccttggaatccttccattggcaagagaatttctgtcgcaaggaacaaaagttgtgctaactgctaacagctacccagctttaaatgacgtaacatttcaagaacttaatatatattgtaaaaaagctgcggactattgtaaaatattcgaaagaagcttattcaatggaaaattagttactgtagagaacggacagaaaggaccctgcttagatttagctgatttatcggctgaactatgcgaatgtatgaaatcagccgatctgggtataattgaaggaatggctcgtgctgtacatacaaatttttatacaaaa

SEQ ID NO: 1512 - DNA, 1588 bp, Diabrotica virgifera
cgtgtgcgcggacgcgtggggtagtagacagtccacaggtgttttgtagaatttagcaaatgctaaatatcataaaaatagaaaaaaatagtatagaagtgattatcacatctgaaaagaaaatagtattgaaaaatatctatagattaatacaatctgatatagaagaaagggttcttctagccaagccagaaaaagataaggatattgtattaataatcttcccaggcaaaaatatcaattttccagaagatatcaagataaagacagataaagctttggaattaataaaggattggtccatttatttcaaagatataaataaatttggcaatacagttgtttttgaagcagttataaaagaattgaataacaatgtcttcaactgaattggtagcaagtcagttttttgcaactgatgttaacatggattataaaataccttccataatgactagagacagggaagaaactgttgctacaagagagatatcagatgtacttgatctcttaagtaacaaattgccaactgtaaaggattattactctgagactgacaaggcatggagcctttctaaacagatagacataaaatttgaggaaaatgttgcattgccggctcatctagcatttggattatatttaaatgctaatttttatactaaccagttgaaaactgttaataagctgacagtgttcaacttcaaaatgaactaccaatcagaagataataaagtgtataacaccactgtgcccatatattcaaccaaaggtaatattgataatgctaaattggagaccacttggataacaaccaatgatatcgaaggttattcaacagtagtaatcaactccttgattgatactgctatagctcaaaagaagctgtatcctctaaaccctaaaatcagaagagcaataactgatgatggtatttatcaactagcagatgaagatgtggatatggtacctgatgttatcaaatgcctgaatgtagcagcaatgagaaagccaacgttgttttctaagacgacttattacgacgtcaatttgataattgctaatatcatagtaacagtttttgggaataagaaggcatcacacttagccttagatattggcatgaagagaatcaagcaagtcttaaaggcagataattccaagagctttgatgctgatacagttgcatctcaagttagatgcttcggttatactgacagaattgacattgatgatataaatgacatattacggatggcaaaatcaggtaaatcatttgatggaggactttctaacaaagctaaaactgcaggcactaagccaatagaagaaaaaggctctgtactctcaaaaaaccaaagaaagaagttaaacagacaacaaagatcgattaataataatcagtaatatggttggtaatataaataagataatataaataaaataagcaaaaaaataaaaaaataaaaaaataaaataaaaaaacaaaaaaagtgcaaaagcacaaataatgatattaattcttatttttccgtaagtgcaaaagatataaaatcttatataagtgtatggactcggacgcgtgaag

SEQ ID NO: 1513 - DNA, 729 bp, Diabrotica virgifera
tcgcggggccccccacgcgtccgcacacgcgtccgaatattttgatctgcacagtgcgacatgttttttgccgtattttctctctttattttccaagcatttgctgcccctagccaccatttgggtatcatagatggtgagaatgccacactgggcgagtttccctatatagtcgccgtggaagattgcgatggtttatgttttgtaaaatgcggtggcgttttgttaaccgaaagttattctcactgctggccattgtaacaaaaaggaaatgttcgacgatcttcaggctcacgttggaattacaaatgtcgatgatacagaccatcaattcaggcatgtagtaaaaattattgttcatccaaaattcgacgaatatgcttcaatcagttcgcacgacatagcagtcatgaagcttaagacaccacttatattagatgatagagtaaaagttgccgttctaccaaaaccaaacacagacgaattatctggaaatgccacagtaacaggttggggagcaatacaaactgacccctacaaaatatatcctaatgacctacaaaaagccatagttccaattgttgaatataatgattgtatggccaaacttaaggccgaagttggtgaggatttgcccgaatacaaccaacactgccgtttgttactgtacccgcataccggtggaattcggacccctgttatgcagactctggaattcctttgaatcaa

SEQ ID NO: 1514 - DNA, 1257 bp, Diabrotica virgifera
gcttaatagtatttagacactataatgtcacaggagcaaggttcaaagttaacgtcacagatgggctacatacaacgaaagattgcattttccatattaaaacagaaccgggtgaaatgaaactgataaacaaccctcttcctatatttcctttgcagaaaaaattcctaacatcaaaacatttaattactgtcgtctcagatccttacagaaaaattgaatatgatgttgttaaagctccaagcttgggcaggcttatgatggagtcagaaaaaccgggaatatttcaagacatatcaacgttttcgcaggaagatttaaataccagcaaagtattttacgaacacactcatcagttttctgatttatatgcgaatgattcttttgtcttcaatgtcaggactcacttggctccaaaattattgaatcagctatttagaattgatattctgtatcgtctggtggacttgacgcttatatgaatataccaaaactgtatgtagacgaaggaggtacaataacaataccgttaaacatgtccggagtagtaacgttcctagaaagtcacgcaggacttcgttctcctataattcacgcatctgctctacctcctcagcacggccaagtctactctcaacagaatcggaatgtgacaaccttcacgcagctgcaactagagtccggtcaggtttactacgaacacgatcattctgacacgttgggagataatatctacttttcgttgtatctgattccagggccaattactttatgcaacgtaacagttcctataatagtaaaccccgtgaacgatcaaccctttgtattggtaacaccagctccaagtctggtagtagtacaaggagaaaatcgcactataacaagacatgacttagcgacagaagatgccgataccccaccggaaaaacttaaatatgatgtcatctcgggaccatcccacggaaaacttgtcctagaaaatatatcagtaacttcattcacgcaagcggatattgacaacaacaaactgtactatgtccataatggaacctctttaaaagactcgtttccgtttaggatttgggatggaaaatttagaccacagtttaatttgtttaatgttatagtttctccaatcaatatcagtgtcaaagcaggtatggttgttaatttattgcaaggatcctatgatattatcctatcagaacagcagttcttcattaacactaatgctgataaaaatagggtcgagttttc

SEQ ID NO: 1515 - DNA, 976 bp, Diabrotica virgifera
  misc_feature (935)..(935): n is a, c, g, or t
  misc_feature (960)..(960): n is a, c, g, or t
gtttggagtggcccctcacctcgtggctgtctcttcctccgttccgtttatgaaaacattatgagagtgttcaataagatggcgaaacgttaacttgtaaatattgcaatggagtggaaaaaagtgttgactgttaccgctatcagtaatttctgtccgttagtgtataaaataatagtgcatacaaagtacgcttagtataaaaaccaaataaaaatgcgtgaattcaaagtagtagtgctgggctcgggtggggttggaaaaagtgcattaactgttcagtttgtttctggttgttttatggaaaaatacgatccaacaatagaggacttttatcgaaaagaaatcgaagtggacaattcgccctgtgtgttggaaatcttagacacagcaggtactgaacaattcgctagcatgcgcgacctctacataaagaatggacagggttttgtcgtagtgtatagtttaacaaaccatcaaaccttccaagacatccgccccatgaaagagctcattaccagagtcaaaggaaccgaacgagtccccattctcctagtcgctaacaaggtggacctggaccaccagagagaagtggattacgcggaaggtaacgtcctgtctcagcaatggggatgtcctttcatcgaggcaagtgctaaaaacagaaccaacgtcaatgaagtgtttgcagagatcgttcgtgagatgaactttagtcccgaaaaagaaaaaccaagttattgctggtgtaccatgctctaatatcaacccatgcctcttgtttattcctcctgtatacttttgtttttctatcatttttaatattattaatgttactacttgttgggaacaatgaagacagttgctttgtgttaactgtgattgctgaactgatctgatttaaacacctattttaatctacacctttgttctgntcatttttctctattattctactgnctcctgctactatgga

SEQ ID NO: 1516 - DNA, 844 bp, Diabrotica virgifera
  misc_feature (797)..(797): n is a, c, g, or t
ttgagaagtacctgccacagtttcacaattatgactacgtcaaaagaaagaatttttcatgttacggaaattttgttccaacagatgatagcagtcttcgtacttcttgtattgtggcagttatttatatcaaatagccctgttaatagcaaaggtacatggcatattatactgtgtgttacgggtttcgctttatgcatggcagaaggtgtacaaatatttcggcatgagagtgtcgttacatttggcaacactagggaagaaaaaaagctggctcatatgatagttatggcatttgcttttgtctgtataactattggcatctcactaaaaattagccagaaagaagattccaatcgggcacactttacttcgacacatggtattttaggtttaattacatggatattcagtttcatcacagcacttggaggtgtaattactatgtattttagacatttattaagtccaagagtgataaaactttgccacattcttcttggaattaccacttatgcattaggagtcgcaaccctctgctatggtttacaatatatgtacggaacgggaagaggttgggtggctttggttgtgttattggtggtttatgcaacatacagtttaatcgggccctttaaatcaatttacaattatttgaggaacgattagtacatcactgtgcagaaatttggtatttacgaaaataatgaccgaaaaccagaagataataatatatttatgtatattctgtatatttatttgttttagtgctcgcattttttacaactgtaacgtgngcgctattccatttgttttttactataacaataaaacatagactgac

SEQ ID NO: 1517 - DNA, 1075 bp, Diabrotica virgifera
  misc_feature (762)..(762): n is a, c, g, or t
cccacgcgtccgatcgaattttgaattaaataataattttacatatattctggtttctcaaaatagcattttatttactgttgtctaactggaactttaacacatacaatttttgcatgtatttaatttttaatctaaaatttgtatgtatattaattattatttaagcccatcccaagaaaaatattttgatattgcgccatctttatagtgactttatataaattgaaactatttaaattttatgtgaactgaatacactaaaacacattcaaatgaacagaataaaatacgctagtccacttttattagatggcgaagcaacagtagctgtggaaaataacgtgaggctgtatgatggagatcaaaagacctcatttgaaggtggagagttgataatcactacacatcgaattttatggggccggcaaggacaaatagctcgagggcaaacatgtttagctttacatttacatctagttgtgtttttagaagaggagtcccctagtgccttcagcttcagtcgatcaagaaaagtagtagtacacttaacagagacaaatgattattcaaatggcccacagttgacaagcatctacaactttattaaattatccttcagagagggttacaccaaccatgttccatctatccttaatgatttacttcaaaataggccatgggagccaaagatctctatagttccatctgtacaagtcacagtacaaagacctatcgttcctactattaaacctagattgngaattgtgggaatagaaaggagtattcaagctaaacaaaaagaaacagatgagagtataactttggctttccaagatttagacaagttgatggtcatggcaaaagatatggtgaatatatcaaggaccatatctacaaaaattaaggaaaaacaaggtgatataactgaagatgaaacaatacgatttaaatcttatttactcagtcttggcattgatgatccagtcaccagagattcctataaatccgataatcaatattatcagagcttagctagacaaatatgtaattttattcaaaaacatgttgagga

SEQ ID NO: 1518 - DNA, 1029 bp, Diabrotica virgifera
taaacagacttctaaaattgtatgattttgttagaaagtggtagaataacgctaaccaatttaggagtaacactgcaaagagactctctgaatgttttgttgctgttccgataaggaggactacggaaaaggtccgatggctgcaataagaaaaaaattggtgattgttggtgacggagcatgtggaaaaacatgtcttttaatagtatttagtaaagatcagttcccagaagtatacgtgcccactgtattcgaaaactatgtggcggatattgaagtagatggaaagcaggtagaactcgccttatgggataccgcaggtcaagaagattatgatcgtctgcggcccctttcatatccagacaccgatgtgattttaatgtgcttctcagtagactcccccgactcattagaaaacatcccagaaaaatggaccccagaggtaaaacacttttgtccaaatgtgccaattattctggtaggcaataagaaggatctgcgtaacgatcctactaccattaacgaacttaaaaagatgaaacaagaaccagtaaaacctcaagacggaagatccatggcagagaaaatcaatgcttttgcatatctagaatgttctgccaaaagtaaggagggtgtaagagaggtttttgaaaatgctacccgagctgcactgcaagtcaaaaagaagaagaagccccgttgtgtaatgttttgagccactacatattctatattttatattaataatcgttacgtgtgttaattaatttcaagggggcttctgcatgatgtattgactaacaaaataaacccctacttttctaaaaaaaaaaaaaaagggcggctgctgcttcattcccaaacacagaaaccatttcagcgagacattgctgttgggataatcctctgcaaaaattgtaaaaaattattgctcgaaaatgttctcgaattagatccatttttcgaccgactgggtaaacttctaaaattcactgtatctacgcaacttgttttgttttcataaaactc

SEQ ID NO: 1519 - DNA, 1852 bp, Diabrotica virgifera
cgaggtccacgtcggataaaattgtatgattttgttagaaagtggtagaataacgctaaccaatttaggagtaacactgcaaagagactctctgaatgttttgttgctgttccgataaggaggactacggaaaaggtacgtttttttgcttgatccttatctgtctgttatccccgctcttacttcgtgatttatttaatgtccgccattttcgttcgtagttgaataggcgttaactttgtgtgttttggcaggtccgatggctgcaataagaaaaaaattggtgattgttggtgacggagcatgtggaaaaacatgtcttttaatagtatttagtaaagatcagttcccagaagtatacgtgcccactgtattcgaaaactatgtggcggatattgaagtagatggaaagcaggtagaactcgccttatgggataccgcaggtcaagaagattatgatcgtctgcggcccctttcatatccagacaccgatgtgattttaatgtgcttctcagtagactcccccgactcattagaaaacatcccagaaaaatggaccccagaggtaaaacacttttgtccaaatgtgccaattattctggtaggcaataagaaggatctgcgtaacgatcctactaccattaacgaacttaaaaagatgaaacaagaaccagtaaaacctcaagacggaagatccatggcagagaaaatcaatgcttttgcatatctagaatgttctgccaaaagtaaggagggtgtaagagaggtttttgaaaatgctacccgagctgcactgcaagtcaaaaagaagaagaagccccgttgtgtaatgttttgagccactacatattctatattttatattaataatcgttacgtgtgttaattaatttcaagggggcttctgcatgatgtattgactaacaaaataaacccctacttttctcttcagttctatttgttcaaactccttttctccttgtggacaaatttaagtattaagttatattttcatatgtatttaacccattgtttattggttcttagagttacacgacccagaaatttaattttaaaacaacacaacgatgtagcaagttactttttagagtttaatatagaatagatcattattttgtttctttattccccaccaaactagtattgcacattgcaattatttggctatgaattttaattgattaatgtaaaattttgatttttgaaatatccttagttgtctcgatttttgatgaacttccagtgaggggtgtgtaacttataagctttttttatacaatggtaaatgatataatcagtgtcatgtgcacaaaacttattgaacgtccacttagatcatcattgtagtactaatttacaagcatacgttgattcattttatagtatttatattttataacctgatcaatatattttgtttcaaaaatttttttctgtatctatagttatcttttacagatattcagagtacccattgatttttatttagttcaatgactgcagcacatttattatgttttgattagaagtcactgcaaatgaaacaagtggattaaaacttttgactaacagatacacaaaaaaatgtttgtgttgcagttattgcactgggactaaaaggactaacagtgatgtcatctcttgtgtaagggtagttactaccacctgttgtcctttaagtctcaaaattaattttgaaataaaaatatttatttgttggcaacatttctagtattacgccgagttgcctattattgtaatagctttaaatttttcaatataatgtattctaaaattaaaaaaaaaaaaaaaaaagaaaaaaaaaaaaaga

SEQ ID NO: 1520 - DNA, 924 bp, Diabrotica virgifera
ctgactcgtcttctccggagcgttaccgcaagggagtcgcgattttgtatccggagtttttagttggccgattcgcgttgttttggatttgtttagtgggtgaaaatgcaggttttggagctacaacacgatgactacgacgattcttcagtctatgacatcggttccatcgatactgcattcaggaaaattaacaagaattcaacaaactttttaatctggaaagtagagaatatgaacattatcgcaataccaaaagaccagtatggtactttttatacatcagattcttatgttatttatgcagctagtttatatggacaatcttgtggggttgatatggtgagtaaagaaacgaagggctccatagaacaccacgtgcatttctggcttggatcacaaactaatcccgacagatcaggtgtagcagcttacaagacagtcgaggttgacaattatttaaatggacacgctgtacaacacagagaaacggaaggatacgaaagtgcccggtttttgagctactttaaaaacggaataaggatattaaaaccagaaataatcaacgactgtcagcctgttaagctatacagagttagaggcaaaagaattcccgttgttaaagaaatgcccagcgtatcttgggaacatttcaatagccaggacattttcgtcataaaaacgccaaaaataatttttgtttggtccggaagagctgcagatgctgtggaaaaattgcatgctactacaatagtggaagatatgaaggaaaaacacaaaatcgccaatttggccttcgtggacgacggttacgaaaaaactctgcaagatgatatcaaaaaggagtttaacaaatatttacattggaaaaacgagtagtgttacccgaagtttccgaaaacgacgaaaatggcactaccaaaa

SEQ ID NO: 1521 - DNA, 874 bp, Diabrotica virgifera
caacaataaaaaactaaaaataattagtgactccttatccattaattaaattaaacagctcatttttaatcttaatgtcgaatgtattgcttaagacatacagtcctatttgtccaaaacttcgcgtcaaagaaaattcgccctactttttttttgtatagtacagcagagcttctcaaagacagcaaaccaaaaatggggacgtcaaatttcgtattgaaaaggtatgataatataacaaagtctgaagaagatcataggctttatagaggtctggaattgtctaaccatatgaaagtgttgcttgtaagtgatccaaaaactgataaatctgcagctgctatggatgttaatgtaggattccttagcgatccaaaagaagtgtatgggctggcccacttttgtgaacatatgttgtttcttggaacaaagaaatatcctaatgaaaatgactacaataagtttttaagtgaacatggtggcagtacaaatgcagcaacatatctggatcacacagtttacttttttgatatagttcccaaccaactcccccaagcattggacagattttcccagttctttattgctccactttttacagagagtgcaacagaaagagaaattaacgccgttaattctgaacatgaaaaaaatttgcccaatgatctttggagacttgatcaattaaataaacatttagccaatcctgatcacccatttaacacatttggaacaggcaacaaagacactttaataaaaattcctaaagagaataatattgatgtaagagagaagttactagagtttcacaataagtggtactcatcaaatattatgagtttggctatattaggaaaagagagttagatgaact

SEQ ID NO: 1522 - DNA, 812 bp, Diabrotica virgifera
aaaataaccgaataacgaataacaatgtgggcaaccttgatcacagtttcgatcttcgggttaattattggaaatgtggaagctggtccaaaacatttgccgtcatacatcactgcctgcaaaagaaacgatccagaactgaataaatgttgcctggaacaagcacgcatagctttacctcacatcgtggatggagacaagagatacggaatcccatcatttaaaccgatgaaattggagaaagttagtgtgaactctggaaatttaaaaatcgatttaaaagatattgagctctatggattacctgatgctgatatccaagatttggcggttgatttaaaaaaacaaactgttaaaatagtctttaagtgccctcaaattgtcattttgggaaaatacgtcatggatggtaagatcttggtactacctctgaacggagctggagatgccaatgtgacaattgacaaccccgtatttacctacacatccgactacaagctggtaaataaagatggtttggactacgctcaattaggcgaccgcaatgaactttcttacgacatgactagagtatacttcaaatttgacaacttattcaatggaaacgaacaactatctaaatctacccacgaagtcgctaacgccgagtggagagccatagttgaagaaatgagtccaggcattaaagcagctgttagaagtattgctggtcttctagttaattctatagctgcaagggtccttatgactggttatttttggcttaaaattgatttttttatttgtattgaaatatacctagtaatttctcg

SEQ ID NO: 1523 - DNA, 920 bp, Diabrotica virgifera
gtggtgaatgctcagtgttagtagggtgtctgggaaaatattataggcaaaatgatactgaaaagtgtattttggatattcattccgtctctactagtttttgtctacagtgaaggagtagtaaaacaaaaaactaggaaaggaaaatttcttctgccgttttatgttcaacataggccaatagaaaatagaggattgtatggagatccatacctgactgaaagcagtttcgatttcgtcatcatcggatccggtccttcgggggcggtattggccaacagattgtcggaagtgccagaatggaacgtactgttgatagaagttggcggggaagctgactcttttactgatataccttatatggcagaattcttccagtttactgattataactggggatactcagcggaacaacagaacacttcgtgtaatggttgtccgaataaaagaatgagactaccttccggaagagctctaggaggcagctccatcaacgactttttactgtactccagaggaaatccagcagattttgacaaatggcaagaatctggaaacccaggatggtcttacgaaagcgtgttaaagtattttaaaaaatccgaaaacgctaatctcagcgcggctgatcctgagtaccatcaggcgggaggaccattgaccgtcagcgatattccgtatagaacacaatctgctaatgcctttgtccaggctgcccaggaagcagggtatccgtttttggactacaatggaaaaaaccaaattggtgtttcgtaccttcaaaccatcaccaaaaacggtaaaagagtcagtgcagaaaaagcattccttagaccagtacgttatcgaagtaaccttaaaatcatcaaaaattcccgcgccatcaaaatcttgataagccctgacaccaaacaggctta

SEQ ID NO: 1524 - DNA, 904 bp, Diabrotica virgifera
gatgatgatgatagacgtttttctgtttttgatgtgaaactgaaaatttgtatttattaatattagtgatattagtaataaagatgtctgatcaagaagagaaaattactcaatttagttcaataacaggagccgacgaacctagggctcgcttctatttggattctgctgcttggcaactagaggttgctattgcaagatattatgaaaatgatggtgaagagtctgatactgtagaagaagttccatcaatggcagactctcccagatctccagcatcagtcaaaaaacctaaacccaagggcaaaccatccaattttgctactattaacactattaatagctctagtgaagatgaagaggaagagggccaagcctattatgccggaggctctgagactagtggccaacaagttttaggacctccaaaaaagaaggactttgttgcagacatgtttaagtcagtgcaagaacatggggttgaaatactggagccaagtgcttctacgtctagttctagagcatttagagggacaggatataagttgggccaagatgacaatgactctgtagcagtcccgggtgttcctgaaccaatgacttcttctgaggtaacattaagactgtggcaaaatggttttactgtaaatgacagtgagttaaggccttacacagatccggccaataaagaatttctcgattctattcgtcaaggggaaataccccaagaactgcgaagaggtgcatcggaagttcatttagccatggaagatcatcgaatggatgcttttaacaaagtaaacataaactaaaagctttccaaggacaagggtatactttaggaagccagcctcccgtagttgttggcacatgcaaagaaaaaaataaaccaaataatgaagcg

SEQ ID NO: 1525 - DNA, 1583 bp, Diabrotica virgifera
  misc_feature (631)..(631): n is a, c, g, or t
  misc_feature (704)..(704): n is a, c, g, or t
gacacctgacacctgacacccacatctacaagtttattttttggatttctttgttgataataaatttgtaatcatctgtgaatggaaacaataagttcgaactttatcacataatattacaagttatgactcatttttattataactaacgagaaattccatttaataaaattttgttttgattaaaaatgtatgtccctaaagaaaatcccgaaagcaatggggaagagagtgatactgaaagtgtctatgaagatgaagacgagacgactagaattcttcctcctgaggttgaagataccacaaattgcatgaaggcccgacatatcttaggtatattgggatttttaggctttgccaatgtatatgccatgagagttaacttatctgtagcaattgtagcgatggtcaataccactcaacccgttttcactaataattcgtatgaccattgtcctattacagacaatagcacaaatacgaatggcactgcaacgccaggtgaatttgactgggacgaaaagacgcaaagtatagtgttgggatcgtttttctacggatacgtgctaacccaggtgccaggtggacgattggccgagatcttcggcagcaagcgagtatacggaatagngtgttttggtcacttcgattttcactctacttactccaattgctgcgagaatgaactttacactatttattantcgttagagttttggaaggaatggggcgagggtgtcacttttccttcgatgcacgcaatgttagctagatggattcctcctttggaaagaagcaaatttgcggcgtatgtttatgcgggtaccaattttggaacgatcctttcgttaccaatatcaggatggctgtgttccctaaaattagataatggttggcctttaagtttttatatatttggagtgttgggcatcgtttggtacttattttgggtgctgttaatatacgatacaccaatgtcacatccaaggattgatcctcaggagaaagcttttattttagccagtataggacctcaggacgaccgtgatacgtcttcaataccatggaaacatatgttacggtgcatgcctttatgggctatattagtaacacaatgtggtcagtcttgggcattttacacccagttgacagaattaccaacgtatatggcacaaattttacactttgatatacaatcggatgctttgctttcggctgttccgtatttcacaagttggatcggaggtatattgttcagtatattcgctgattggttacttagtaaagggtacttatcgttatcgacatcctacaaggtgttcaattctgtagcgtccgtcattccttctattggattactcggtgtagcatacgtggggtgcgacaaggtagcagcccagctgttgctggctcttacagccacgttcggtggagctgtatacgcaggaaaccaaatgaatcacatcgctttgagtccgcagtacgcgggtactatgtatggaatcacgaactctgcagccaatatgtgcggatttttggctccgtacgtgatagggcttttaatacaaggacaggaaaccctc

SEQ ID NO: 1526 - DNA, 1346 bp, Diabrotica virgifera
  misc_feature (1295)..(1295): n is a, c, g, or t
  misc_feature (1319)..(1319): n is a, c, g, or t
  misc_feature (1329)..(1329): n is a, c, g, or t
agatcaagttccacttgtcggacaggaacatcaattccaggttcttgttaccaaccacccatgtccaagtgctaaaggaggtagccataagatgtgtataggaaaaatcaccatcctgtaccaaggccacaaactacatgttctcaaggacgaaaatagaccaagattgaaacttatcatggacggagaagtaatcgatgattattctggagttagacacgtcgtaaaagttcatagagattcaagtggcgatatgaagattcttctgcctacaatccaagttgaggtattagtaacttacccaacactcgcatccagtgtgaaggcaccatcttacatcttcgaaggaaagcttgaaggtatttgcggtaactgcaatggaaaaccaaaggatgacttcacaaaaccagataaaaatacacctaaagatgatttagactttgaactgagctggttgtacgaaggtcttcctcaaaacaaagaagaatgtggcgctgaaaaagaagaaacatgcgtaccagatcccacacaacctgacccatgtgagcaattattggatatcaacaaatttggaaagtgtgccaaccttttggatccaacttcatacttggattggtgtcaaagagatacttgcaagggagatccagctgaatcttgcactgcccttgaggcatacgccaaggactgcgccaagtatggcttctgcgtcaactggagaaacgatctttgcccagctccagtctgtgatcctggtttgttctactcaccatgcggaccagctcatcctgaaacatgcgagactatcatagagggcaccaaaggaggtataaagggaggaaagaggaatattcctactgagggatgcttctgtcctaaaggaaaggttctattaaacgagacttgtgttacaccaagagaatgcataacttgtgacaacgaaggacatcatcctggagatgaatggaagaaggacaaatgcacaaaatgtaagtgccaaggtaccaacttggaatgtgagaaacaagaatgtgttgatccatcgactatttgtgaacatggatatactgccgtcagagtaccaaccgctgaagacgaatgctgtgataaatatacttgcattcctggacctactttctcaccaacttgcgaaccaccacaaaacttggtgtgtggtaaggatcaagttaccagactgactactaaagcagatggctgccaatcttacatttgtgagtgcaaagctctggaagaatgtgaagaaattgatcttacttcaacagaaccacttgaaccangatacgtcaaagaaattgacaccnacagcagctngtgtccatcatcaacta

SEQ ID NO: 1527 - DNA, 973 bp, Diabrotica virgifera
catggtgatcgagaatcaggttttatagatgatgaattgtttgtggagctagtccatgcattggttaattaccaggaaaaggataaaggggataaaggagagaaaaagaaagaagagaaggaaaaggagaaagaaaaggacaaagaaaagaaagaaaaagtagaagaaacaaaagacaagaaaaaagatgatatggactttcccacttttgttatttttcaatctatttcatctcagtttcctgataaaggtggtccggaagaactaagagataagtatgtggaactcactgaaagaactgaccccaacgctcctccagagtgtacaccaaatattgatggacccaatgctgcatcagtgcctagagaacaaactctccactcattccatactttattttgtagaaggtgctttaaatatgattgcttcctacatagactgcaagtttgccatcctggacccaatttacagaagcgtcgtgggcctgatctaaaaccttttactgatccatgtggaactgactgctatttacttttggatgtagtgaaggaaacaatggctgccagagcgaagcaggaagaagagtctgaaaaagaaaaggagaaagaagttaaagctaaagtacctactaaaacagccgcagaaacggttacagaactgaaaacgaacggcgttagcaacccgtctccaaggaagatctgtaaacagcagagtgttgattctggaaacgaagcaagctctgaagatagtaacgacagtaataagtacaaagataatgataattccgatccagtttctaccacaacgtcgtttagtttattgggtttgatgggagccaacgatcacaaggaatggactggttcagatgagagtctattccgagggctgcataaagtttttcttaataattactgtgccattgctcaaattatgctaaccaaacctgtcaacaggtatatcattttgctcaaaa

SEQ ID NO: 1528 - DNA, 1004 bp, Diabrotica virgifera
aggccgcctggtaacatattgtcatgtctgtttgaggcattgcgatcttaggactttgacatcttgaaattatataaccaaaaagtgggttttttaagggacatccatatttttcagtgaggtattacgagaatatctgctgaaatggctgctagaagaatcacgaaaagtgctgttaactgggctgccttaagcgaaaaggtccctgaacatcagcgtgcccagtttttagcgttcaaaactaagtccgacagctatcttaggcgtgtcttagcaaatcctgaacaagccccagccattgattgggcttactataaatccaaagtaccagttgctggaatggtagatgatttccaaaagcaatatggagctttatctattgcattccctgcagacactgtcaaacctcaactggatgctttagaaaaagaaatcaaaagtgatatcgaaaaattcaaaactgaatccaatgctcgtattgctgagtacagaaagcaattggcccacatcgccagtctaattccatatgatcagatgacattggaagattaccgtgatgcttacccagaagacgctatcgaccccatcaacaagcctacattctggccacacactcccgaggaacaacacgactatgttgacaaagatgcccagcccagccaccattaatactgtaaaggtggtgatgctttcaaatacagtgatttgaataacactttcaataatgataagtttatgaaactatagtgttttttcctgcatttgaaagtatttgtacttgtcatatactaagttctatagttgtgtctactacatttttaattagaatttttttttgttattagaataaacttaaatacccttccaaaagcaatatggagctttatctattgcattccctgcagacactgtcaaacctcaactggatgctttagaaaaagaaatcaaaagtgatatcgaaaaatcaaaactgaatccaatgctcgtattgctgagtacagaaa

SEQ ID NO: 1529 - DNA, 888 bp, Diabrotica virgifera
agctgtgtatattcgttgaataatacgcccgcccgaaggatctttcatagctaagtataattgtattaatataaaaccgaaattaactataccaagcaattactgacgacgccatgggtgaagttgtagaacgtagaatggaatctatgtcccaagagatacttgaaatgcgaagacttaaactattctcgatattagaaacgaaggatattataaaaaaacgaagagcttttgaatgtaagctaaatggtgtagagaaaaatttgcatcatttcaaggattatacagattatgaactctccttactaaaagacataaagttaagaagaaagaaactgaaaatatcagaaaataaaaataagatagaaataagcatactaaaaaatataaaaagtcgatatgaaatagccttacagagatttacaaatgaaatgaatcttcatcttgaatattttaagttttgcagagagtataactttcgtcaagctgcatatttatgtgttcagaatatgattaaagcttttgcacatgttcctgatatttggctagttgcagcagccttttatgtctccagtgatactaagcaatctttggctctgatacataaaggtattacaattcatcccagctctcaatcactacaattagaagctattcaattagagcttttacgaagacaaaaaaatcagtggcccagcgatattcaaggggataccctagatgaggtctattacataaaaatagaacaatatattgatgctatagaatagaacattcacgaccatgcttgtttcatcagcatattgaatatattagatccacatgtctttactagaaatattcagctcagaattatagaattgttaatgtctagatattccaatgaac

SEQ ID NO: 1530 - DNA, 1005 bp, Diabrotica virgifera
cggacgcgtgggcggacgcgtgggacaaataataataacgatacaacttctacagaagcaacggtaacaacggagggtacaaatgcagatgaaactacaactgaaataagtaccactgaaagtaatgctgctgtaaatggaactgaaacttgtctcagaaataatgttgtctgcccagttgttgacggatacgattcagtgtacgccgctttacctgactgctccaaattttgcctgtgcctgaacggtgtgccattcgaacatcaatgttcagatggtctgctctttaatccacgatcaaatgcctgcgattggcctcagagaacgtcttgttctggtgacaataacgtaaccacttctgcagttcccgctgtttcaaccgaatatcttacagaagaagaaacaacagtacacagtagttcaacaagtaatggtgagaataatgtaacaggttctgtagttcccgctgtttccaccgaagatcttacagaagaagaaacaacagcacaaagtagttcaacaagtaatggtgagaataacgtaacaggttctgcagttcctgccgtttctactgaagatcttacagaagaagacacaacagttcaaagtagttcaacaagtgaagaaagccgcaacgaattaccagttggatcggaagagtgtttgcaaaataatgttgtttgcccagcagttgatggcaagttcccagtatatgcagcacttccagattgtaccaaattctgtcaatgttcgaatggagcaccatacctttacaactgttcaggaggtttacacttcaatccttcactaaatgtttgtgattggccagaagatgctggttgtgaaagatcaatatagtaccgtcaaattcttcaaatattttggtattataaattttgaataagagaaaatgctgacaaaaaactgtttactgatatactcatactagttactgattttatattttgatccaaagagattataaaaataaaattaatataagcc

SEQ ID NO: 1531 - DNA, 623 bp, Diabrotica virgifera
gactcccaattgatacaacaataaaatttactgtggatctaacgtaaatagccagtttcccaagcttctgataattacacacatagctaataaacgattactttagttactgctaatatatatgcctattaactgtcatacatttttgtgtgatattcgtatttattcactattcatacaatactatgataattgtagaatacttaaataaattcaaaagaatacatgacaattaactgacagttaggtcgatatattaaagatattatactagctttaaaagttactgtctcttggttaggtgcgaaattaacggatgtttgtggaagtggccatactactattgtaacgcccttaagtatttattgaaagtagggcagcagaggtgctgtttaagtatgaaggtgccttaacattactttttcatttatattttcttgcaaagtcatttggcacctcaaattgttcgggtacttagttgatctaagtccaaaaattggtaaccatctgtttgagaaaaatatattgtaatattggttcatgttgataaaatgacattttttatcaaatcggtaatcagtattgatttgttttcttaagtgaaactttcaataaatttattc

SEQ ID NO: 1532 - DNA, 543 bp, Diabrotica virgifera
gcgtccacgcgtccgcccacgcgtccccccagtctctattaaaatattgtacaaaaaatgaaatcaattttcattattacattctttgcttgcattggtcttgcagtaacagttgcaattccaatgaacataaaaggtccagctccagatttagatgatccaaactgtgtagtctgcttttccgctggaaattttattcaaggatttaagaactcaggtgattccaaggaagaagcaaaacaacaaagaaattttatctgtaacctgtttaacactgacgagctaatgcaaatctgtatgagcacttatgaagaggacgtcgaatatatttatggagtaactgacctcagaacagtaactgaaatgtgcatagacatgaacaaatgtaaagctaaaccaaatatctaattgtgttttttaaataaaaacatgtttttattgttttaaaaaaaaaaaaaaaaaaaaaaaaaaaaaaaaaaaaaaaaaaaaaaaaaaaaagaaaaaaaagaaaggagaaggaaggaaagggggatagaaaggggg

SEQ ID NO: 1533 - DNA, 1430 bp, Diabrotica virgifera
  misc_feature (1289)..(1289): n is a, c, g, or t
catctcaataaatttgtgcatttccttcagtagttacgttactcaattctccaacgaacacaccacattttataaagaataagactggcgcagttagtagaaatttccaattagaaaaagtaaagcctttttttctaatcgattttaatcgttaattgggaaattggagaattagtgacttagtagttgagttccgagtgtaaggccacgaggaaggaaaactgaaggaacccgtaagcaacttgaagaattccaagtgtaaggccacttgttgtgtaaagccacaaagcaattcggaagttctggagaggcgcaactagtaacttcgtgaaatcttctcaaccaccagcttcagtgaaaagccactcgaccctggaaacggtgaagcatttccacagaagaagcaacaacatcccggctaccataccggctacatacagtttagaatttcgaccagttccagtgtaaggccacttgatctggaaggtacaaaacgtgctcacacccgttctctgcccgttccagtgtaagaccacttgatctgggaaattgcaacgttctccacccgttctctacccgttccagtgtaaagcgactagatctgggaagctgcaacattttcaacccgttccggtgtaaagtcacgttttcacggaagtacttgaggttagtcgaattatattcattttgtatttgttttaatttttttatttactctgtttcgctattttccaacttttaagatatcatatctagtatttgcattttttatttatttaattcatttttggttaatacaatggcaattagtaatgtaacagcaacaatttcagtcagtacttctaataattatattaattgtgagaaagctatcaagtttataaacgtttttaatgggtcctcctcaaaattacattattttatagtttctgtttatttgatttgtacaaaatgtgacccagaattgccaattttaccttttattgtaataagcagattaaaggaaatcacattatttttatctgatcgtgaacataatacatttagtcaaatgatatagtccgaagtaatattatcaagttcactgaaaaaattgaatatcgtaaactaaaattagaccatctggacaaaatattacaaacaaaaataaaggatattcagcatatttcgcctttggttaaatcaaacaaacaggcagacgccctgttaagtgcgtccataaaccatatggcatatctctcatacaggaaagtaaattgccgaatttcagaaggttaaagctaacctgngtttaaataattttttatattttaacgagcaagtcttttaataccttaataaatacaagatattaaaaatagaaatattttgtctctttataatgagaataacgagaaattgttttgaaattataattgatagttcttctg

SEQ ID NO: 1534 - DNA, 959 bp, Diabrotica virgifera
aatctttttgtcttcacttttgtttaaagccacataaaagtaaatgatgtggccaagtgttagttaagcaaattcaagtataaacacttaaggataaccagatagtatttagtattgcttcgacgcgtacataaatatgttttccagcaaactttttatcatttttatcttatttttaagtgttgaaatatgtatttcacattcccattctcatggagaccaccacgggcattcccatgacgagcctgcttcattcaaatattcaagagcagcgaatgaaccagaccaccatgagcatgttcatactcatgaacatgtccatgcccatgaacaccatggagaagtaccccataaatctaaaaaccaattaaatactcaggagttgtggatccaagcaatgggttcaacgttacttatcagtgccgctccattttttatattattctttgtcccgttagacaataccgaaagcagccagcctcttttgaaaatattattagcctttgcttcaggaggtttgttaggagatgcctttctacatttaattccgcatgccactatggcaatagaagagcaaaatccacatagtcacagccattcgcacagtcacgaacctggagaagaacattctcatgatatgtctgtaggcttatgggttcttgccggcatagtggtatttttggtggtggagaagtctgtaagaatccttaagggccccagtcatagccattcccatagtgctccagccgcttccaacgaaaaaactgccactaagaaagatagcggcgacaaaaaagtggccaaaacaccaaagaatgaagaagaaccagcgaaagagattaaagtagctggatatttgaatctggctgcagattttagtcataattttacagacggattagctatcgggtcttcgtatttagctggaaatactggtagaatagtcactacgatcacta

SEQ ID NO: 1535 - DNA, 1302 bp, Diabrotica virgifera
cgattaggttacgctttgttacagttttattgccgaaaatagtggtatggaaaggtgaagtgttggaaaggtgaaaaacggacttgtgtgttaaactagtttgttgtttttctttaagttatcatagatggaactcagatatttgctgtagaggtggtcaaagctaatcaaagaatgatgttaatcacatcgcaatagtcatgctctttttacatcttggaaacaagataaggaaaggtcagctatttcgaagaataaacatgttgaagatccatcctccggattagagagacgaacgttatagaagataatatttaatctagtcaaaatccaactgtgataacttaaaatccgttaacctaggctgtatcaaaatggtattcgaaacccttctagtttcaacagctttaagaacaataggaatagtaggatcgaccctctggttgattcccttaattctagctggaataacgtatataaactacaacaaactagatcccgaaacgccaatcatggatgctcagagactttacagagattatgactttatagtggtgggaggaggatcggcaggtgctgtagtagcgtctaggttgtcggagatttcaaaatggaaagttttattgttggaggcaggctacgatgagaacgaaatcagcgacgtcccatcgttggcggcctacctacaactttctaagatggattggacctacaagacggagtacaccggcagagcatgtctcggcatgaagaacggacagtgtaattggccgagggggaaagttcttggagggtccagtgttttgaattatatgctgtatgtgagaggaaacaaaaacgattatgattattgggagcagttaggtaaccctgggtggaattatgaaaacgttctaaaatacttcaagagatcagaagacaacagaaatccgtatctaacaaaaacgccttaccataacaaaggaggtctattgactgtacaggaatccccgtggaggacaccgttagtggtagcatttctggaagctggattggagatgggttaccctgtaagagatatcaacggcgctgaccaggctgggtttatgatagcacaaggaactatcagaagaggatcaagatgctcaacagcgaaagcgtttttgaggccagtgaagcttagaaaaaatatacacatagccttaaatgctcacgttacacgagttttgattaatcccacacaatgagggcgttcggtgtggaattcgtcagaatggaaggaagcagattgtcacagccaaacgagaaatcatcctctccgcc

SEQ ID NO: 1536 - DNA, 1207 bp, Diabrotica virgifera
cgtacattcttcttttttgtcgggtaatttcattaaaaatttttttgcgcgccctgtacggataattgtgtaaatgtttatatgcctaaatggtgaatttaatgacctttcaggtgagctagcgctcgacccctgttctcatttgaaagaatcatcgattgcgtcatcacccccaggtggatggcggcgctagtatgatatatatgccagaatatcatatgttgaatgggtttattgacagattttaaaacacaatgtaggtatacccccaaaatatattttattactattcctttcttttatctgtttcaatagtttattaatgtttcttcactgcttatatcaataatacatagtctcaatttacaatcaattactttcaactgaattttaatcccttcctttcttttcttttctactctaattctcaccctttaatttatatctcaatttcatgtacctacattgttgtctatcaattcacatttattactgttattactatatgactgctaatatacccttttagctataatttttaagctttccgatttttcattctttttacgaccactactcctctcattaaaacatcaaggagtattgactttaacaatttaggttacagctgcacgtccacatctaacatacatattagatatcgacccgttttgatccaaacgttgttagtcttacactaacacatacactaataaatagaagtctttaataaatataaataaaaacaaaaatcttttaatagcgtccgataaaaatctttaaagccggtacagatttgttggttgtctttcaccaactatctcttcaccctcaaaaattcccaaattccataaacttttttacctttgcaacattctccgtctattccaccatatcccgttagcataacttaagcagatatatcatgttaatgaatactgaggtagtacctccttgtaaccgaatcatttagttacttgtaaccgttgacctgaagatgctctgcatactttagagagcgaaaccggtcgtcggaagttacaataaatgattgagagtacgtctgtcttttacttcattcaaaatatcataatttaaaaaagaaatcgacctgtttcgggattttccctagtgtcgtcggtttgcgaaataaagaatttattcctttcaatttgcacatactgtatatacgagtagttgcaaaatt

SEQ ID NO: 1537 - DNA, 1242 bp, Diabrotica virgifera
  misc_feature (1188)..(1188): n is a, c, g, or t
cccacgcgtccggaaagacaaagagaaagggagcggctcaagaaagaagaagaacagaggaggagagagaggactaggagggacgatagagggttagataaaccttcaggtgatcgtgtggaacgtcttcttcctccaattgaagagcgagttccgccatcccggaagggacactccactgaaagagatcgcgatagaggacgagatgttcgtggacgagatcgtagtaccgaccgtccacgaaagtctcccgatagacgtggcgacatggataaggatcgatcatatgataggggctacgataatagaagccgacctgatcccgagagagactacatcccagggcatagagacaaggattatgatagtccttacgagaggggacgtccacttgacgacagaaggtatttagatgtggacgaacactacggagaaggtgtcagagatgataggatgtatggtgcccctgttgatgatagaagaagcaggagagatatgtgggacgaaagaggagttgatgacagagaaaacatagatcacagatctcgatacgcaccgagagacgatcacaatctgaaaaacaaccgtggcggagattggggcgatcttcaacatggtgaatattccaatcacgactgggataggaacaggcgtccggtaaattcagaatgggacgccagagaaaactgggatattgatcagcacaaacaaacaggcgccgggcaaggggaagacgattggagacattataacaggccggtggattcttggactaatgacgacaggagaagatggccgcaggagtggagggatcgatcgagaccgagaagtgccacttcacatcaagtggaacctgtgaatgtgccaccttcagaagattccaatctggaatcgaatcgcaaaaaggaaattccgccattgttgcaaccggcaccagctgcagaagaacctggcgttaaacccgaatcttcagaagaagaaaccatgaagcaatcctctccgccaccagttaaacgtgccgcggatgaagccgtagatagtccgggtagtgcaaagaagatctgtgtaaaacaagagaccgtccaaccacctctcgaagatgatctcagcgaaattagtgatgatgccgacgatattctaaatatggttgaagatgttccagatagtcccaataaaagaagaatcaancagaagctccagaaatacaggaggctgctgccacaacttctgtagctgctctcg

SEQ ID NO: 1538 - DNA, 935 bp, Diabrotica virgifera
acgcacgcatccccacgcgtccggtctatttcatattatttaaatgtttaatattgtacaaaagctgcttaatattaagttattttgatttttgatcatcgtaaatgtatttctaagttttaatttctattacaaatttaaacaacaaatcttgtgtggttccttaaaattcgcaaacatttatttctatataacactttgttattttttattaacaatgacaacagatcctaactgcattttttgcaagatcatagcaggagatgctccagcggatatattgtttcaaaatgaagagttagttgtatttagagatattaaaccagagtctaaacatcacttcctagttgtgccaaagaaccatattctgaatgtaaatagtttacaaacaaatgaggacaggcttttagttgaaaggatgttggaaattggtaagaagattttagcggaacacaatggtgatttagacgatgtaagaataggtttccattgcccaccttttaattccataaaccatttacatttacatgtgatctccccagcatctgaaatgggcttcattaagagacaggtgtttagaccaaatacctggtggtttcaatctgttgatgacactttactaaggttaagcaagttatagtggaattaatattatatttattatattatcgctatacaagaaaattggtgattattggcaattagatattaattaatttggaccagttgaagaaaagttcgttattattttataatctaatttagaatgtaatatgtaaagaggaacttaaaagtcaagataaaaacaagaattttatgcattacttcgatttttatagaatggattgtctttgtgatattttgttaaatcgctgggggggaattaagttaataaaaaattgttactttgttttaaaaaaaaaaaaaaagggcgc

SEQ ID NO: 1539 - DNA, 1322 bp, Diabrotica virgifera
  misc_feature (1306)..(1306): n is a, c, g, or t
ggagttaggagccagcgtcatcagcttaaggtatcaaccagaagaagatcaagaagaggaacaagaggaaaatttagttgccaacagtaaatctcttaatgtaaaagaaaactcaagtttaagatgcctcttaccccaaattctagcatcacttgcagcagctgcatttcacattggaaatggaacagcaatggcgtattctgcggtactcatttcacaactggaagaagatggtagcgattttaaagcaacaaaatcagaaaatgcgttcatggccagcattatcatcctaatagccccttttgcatcaatcgttagcggtgtgctaatggacaaattcggtcggctaaacacgataaaacttgcaatagtgcctggcgttttgggctgggtggcgctagcgctggctcctaacatgaagataattattatgggcaggatattaactggaattgcagcatcttggggtacgaatcctgctattgtctacatcacagagatagcacatccaaaattaagaatgtcactcatgcaactatcaccaacttacgtgtcactaggtatgattgttgtgtatttggcaggaatgtacacaacctggagaatggtagcttggatttgtaatatatttattgtattaccagttatagtcgtattctttataccagaaagtccaatgtggttgatattaaaagggcgaacgaaagaggctaaaaagtcgttggaatggttaaataaaaagcaaccacagcccgaaggaaaaaatgaaacatttgcggaaatccaattcaaagtgctcaaaaaacagcacgaagaagaagaagctaaaagcaaaaacaaaggaagttttaaggaaattctacatgaattcatgaaaccaacgggatacaaaccacttatcataatgtgtcctttattcttctgtcaacacttttcaggaatatacatcacaatgttttactcgattacttttataaaggaagcaggaacagatttgaatgcctattttgtatctgcattgattggtgtagtacgattcattatggccagtactaatgtcgttttgctaaaatatttaaacaggagaacagctttaatatctagttgtgccggaatggcttttttcatgtacctttcgggacaatacactctatggattaaagaagaggttacgacagccaaatgggttcccgtagtatcactattaatgtatgtcgtctgctcagttaatggactgatgtatttaccttttatggttatatcagagctgtttcccagtgaaattagagggagtcgttatactatnaggtacagtatgtcca

SEQ ID NO: 1540 - DNA, 884 bp, Diabrotica virgifera
cggacgcgtgggcaaaccaattatttaaccagctccgcgctatgtgatacgcttcctacacttctttgagaaaatcactatagcattctaactttaatgagttatatagtagtttgtagcggtgttatataagaagttgagccgcatatatgccgctttaaaggctccctaactgaaccttgtgtcagttatatatccaatatattttgtactatagttttgtaaatttgttttgggactggaagagatttaactagtattaaaggttacgaatgtgtaactagtggcaaagtacaggttttacaggtttaattgatgtttgttaactatagatctgcaaatatattttttgaattattaatttatgttgaataaaaatatagtgaagggatacatggcctagtctagtaggacctatgtgcgaagtcacctactgtgtttatacaagaaacttaatctaaatatcttttttgtcgttaatatcttataaggagtgatttgatagtactgtagctagcgcatttataaaaacatttcgtaaaacataacacattctgttttagtcaaagacggatgatttgtagtttatgtgcaagtgttgctgtggttatggagcccacgttacactatgttgtgaccttgagatcatactatgacaagagcagaagtcaacaacacaaagatagaaatagcaccacgtgaaacgaagataataatacacatgttttacttgtttatatacaatcgcgacagccttactatgacattaccagaaattgttatcataataattattattaataactgttatcataaggtttgcattatatttgccgttatgtctatatttatattttccactgaaaaagtatttcaagcgcatc

SEQ ID NO: 1541 - DNA, 1577 bp, Diabrotica virgifera
  misc_feature (605)..(605): n is a, c, g, or t
  misc_feature (1484)..(1484): n is a, c, g, or t
  misc_feature (1486)..(1487): n is a, c, g, or t
atttacccaccacatcactaaagtattaatcaccacactttataaattcaaatttttagagttggaatctacaaagttagtgataattagaaccattgtggcattcagaaacggtctaaactttcaatgttagcaaccttttgtatatagctacaataccgatataacagtgaactgaaaaactctagtgtagtgatacaaagcatttaccatgggtcttaccatatcagcagtgtttaataggttgtttagtaaaaagcctatgagaattttaatggtaggattagatgccgcaggtaaaaccacaatcttatacaaattgaagcttggtgaaatcgtaactacaataccaaccatcggcttcaatgtagaaaccgttgagtacaagaatatatctttcacggtatgggatgtaggtggccagacgagaatcagaaaactctggagacactatttcgccaacactgatggactcatttttgtggttgattccaacgaccgagaccgtatcgcggaagccgaagaagaattgcacaatatgttaggagaggacgatttaagagactgcattttgttaatattcgccaacaaacaagatttaccgnaactcgatgtccactgctgaattgaccgataagcttaagttgcacactttgaagaatagaggaggtgggtacatacaagccacatgcgtccgctcaagggaatggtttgtacgaaggactagattggttgtcgaatgaattggccaagtgaataggtagatgttgtgaagagtagcttttatattttttattgataatgtaaaatcctgttttatttccctcagtttggtagaattcatacaatattgcttctatgttgataactttatatgtttctatcattaaaatatggataattttatccaaaatctagctaaaccactatataacgcgttggctgtgttacgagacaaatagacctcgtattatactaacggttggctctgtcgactatgttgtaatacactgtggcattactggacatatatgcctcgtaaagcactcaatgcaggcttataaatatctctaaatgcagccaaagtattaatcttagctttaactcttgatatttttcaggatttgtgtataatttattgaaagtttagttaaatattacatttttcttcgattttgttcatttaggcaatctcacattatttatatgtaacatgttattgaatcatacccgccatagccaattatatacccgccatagtctaatttcagagattatttttttgttttattgacgtgagtacattttttaagaaattcgtttcaacatttttgtctctcctctattcattcattcattaaagccggatttacatatacaagtacttggatccgagatatcagtagaactgcgaatttttacattaaataccagtgattcaaaggaaatattcattatatctgcaatagcttcatatgcattantnnttattttgttgatatcacaatattccctttgagttacattccacaaacattcaaatgatcagtaaaactaataactggtccatctgttct

SEQ ID NO: 1542 - DNA, 1018 bp, Diabrotica virgifera
  misc_feature (27)..(27): n is a, c, g, or t
  misc_feature (841)..(841): n is a, c, g, or t
ccttacgcgtccgaccgttgatccggntatcgataagattgttataaacaaagaacttgaggaattacataacatcaatttttcgcaaaataaaacattttgttgtatttcttgggtacttctaagcaaaaaatgttcttacaagttttttcgtaggatgcatagttttcgagataaacgcgatggaacattcaaaaaatcgaaaaattgcaatttataaacgagaataacttttgattaaaaaataaaatagcaattctgctaacagtatttgaaagtttaagtcaaattataccggttttaattatttgcatttctaaaaattaatttttttattattaaacaaagctatttttataagccaaaaaattgtttatgattttggaacattgctgaggccccttaaatattccgattttaattctgtggggtgtattagataggtagagcgcctctttatatgtaaaaaaaattagccaacttctaaatggtctactttttgttcagaaagattttagaaaatttgaacttttttaaaaacatttatattgcaagtttgttatgcggaatctattaggtcgattttaatgaaatttggtagaccatttaagtaagttataagaattttctaagcgaattactaaggttctaagtgccaccaaggtggttaagaaacattgaataacaacaggcgtgttttgcccccttattttgtatttatttctatattgcagaaaaggtaataccttaagacattttttaaccagtcgtatatcatacaaaattcaattatcttaatttaatttttttacgactttgttccaaaacgaattggttttanagttataagcagggaaagcagaaaaaaatcgatttttttcgagaattttaatattttgatttttttattaatgttccgggcatatttgagagggagcatgagtcaattattattactgaaggtgacactttatctgcaaaatccaaatgccacctctcacatccaaaaatacacgat

SEQ ID NO: 1543 - DNA, 1147 bp, Diabrotica virgifera
  misc_feature (1045)..(1045): n is a, c, g, or t
aaagtcacgtgaatatgtcccacgataattgacgaaaaaacgtagtttttatgtcgtattttagattatttttcattttatggttttaaaaatacacaataagttctctttaaacaaagcacacttctgtattttaaataacttaatagcataaaaatgttgttgtcaccagcataattatacctactttaattacgtttttcattgtcaaccattgttatcggtgatttcaaaaacagataataatttcaatatttcacagacaataaaaaaactaacaatcgccatatgacaatgattatttctaattagtttaccaacagttataaaattatgtcaatatttttgtatattttgtccatttaaagcgcccgtgttgtgggaaattagtgataaatataattttggatgttgcgaacacttggaagatgcccaacaaattatttgctgcaattaccagaaagaagacgttcacatacaatgaagaaactacaagtctagcaagagtgctctccttggtagatctggtcggtttaggcgctggatctacactaggtctgggagtctatgttcttgcaggatctgttgcgaaaacctatgcaggtccagcatcttcgatatcgttttttattgcagctataatatcgctatttggaggattgtgctatgccgaatttgcagctagagtaccaagaactggatacgcctacgcttactgctatgcaggagtaggagaactagtggcatttgtagtgggatggaatttgcttttgggggcagtactgggagctgcaagtgtggctagtggaatgagcagttatattgacgctctgtttgagaagcaaattgctttaaccattggaagctggttttccatggatgtgccttatctcacacacacgccagacattctagctttagcaatcattatacttctaacaattcttctatctgttggtatgaaggaatcttccatgttcaataatatttgcactgtcttgaacctactgacgatatttactgtcattgtggcttgtgcaattanagctgatatcaaaaaactggacaattgcccaaagaaagcattcaaacctgagtacaaagaaacagcggggaacaggagggattcttcccatacgggggttgc

SEQ ID NO: 1544 - DNA, 895 bp, Diabrotica virgifera
  misc_feature (722)..(722): n is a, c, g, or t
  misc_feature (813)..(813): n is a, c, g, or t
ccagtacggtatggtggtcgacgataagaacaatctaaccaatattattattattatactcacgatgtgttgttgttgttgttgttaggaaaaacaaaaatcaagatgcccaacaaattatttgctgcaattaccagaaagaagacgttcacatacaatgaagaaactacaagtctagcaagagtgctctccttggtagatctggtcggtttaggcgctggatctacactaggtctgggagtctatgttcttgcaggatctgttgcgaaaacctatgcaggtccagcatcttcgatatcgttttttattgcagctataatatcgctatttggaggattgtgctatgccgaatttgcagctagagtaccaagaactggatacgcctacgcttactgctatgcaggagtaggagaactagtggcatttgtagtgggatggaatttgcttttgggggcagtactgggagctgcaagtgtggctagtggaatgagcagttatattgacgctctgtttgagaagcaaattgctttaaccattggaagctggttttccatggatgtgccttatctcacacacacgccagacattctagctttagcaatcattatacttctaacaattcttctatctgttggtatgaaggaatcttccatgttcaataatatttgcactgtcttgaacctactgacgatatttactgtcattgtggcttgtgcaattanagctgatatcaaaaactggacaattgccaaagaaagcatcaaacctgagtacaaagaacaagcgggaacaggaggattcttcccatacggngttgcaggagtaatcgcaggaacgcccaattgcttttttggttttcaccggattcgatgctcctgcagcttgcagcgacgaa

SEQ ID NO: 1545 - DNA, 562 bp, Diabrotica virgifera
  misc_feature (516)..(516): n is a, c, g, or t
  misc_feature (554)..(554): n is a, c, g, or t
taaaagctgacgctgcaccgcagctaaataacaatatttaaaagaaaaactaaattttttatacaaaaatcactcaaaattaattcttattgtatgaaatttatataggagttcatccgggtaaatcaagatggcaagaggtcagcaaaaactccaatcacaggctaaagctgcggaaaaagccgctaaagccaagaaacaacaggggcacagcgctggagaccagaaaaaagctgctcaaaaggcactggtccatgtttgcgcggtttgtaaagctcaaatgcccgaccccaagacctacaagcagcattttgaaaacaaacatccaaagaatgaggtgcctgcagaacttaaagacatataacgtatatttaatgtttaataaccgtaagtgttcactttaagttgggcacactttcttcttttttacttacttgtttttatgttaatatattaggatgtatttaattgtataaattcttaccagctgagggtcgcacttttttttctagatcnttgtttttatgttataattttaagaagtatttcttgtntgtataaa

SEQ ID NO: 1546 - DNA, 615 bp, Diabrotica virgifera
ctctttcacgcggccagttgtttaaacaatcaaaacatcaaacaatcaaaatatcaaaatgaaagtgctcattgttgtcgctttaatcgctgtggcttgtgctgctgcttatccacaatacaatcaataccataattctccattccaagctccagctcgtgctgcggtacattccgtgcatccagtacattccgtgcatccagtacaaccagtagcccaaccccaacatcacgctagatctggtgcctacgattcatccaaagatgctagagttttacgttacgacagtgaaaccagtgtaggaaacgacggatacagatttgccgttgaaaccagcgatgggcaccaaagagaagaacaagctgtccttgaaaatgccggaactaaagaggaatcactctctgtatcaggaagatacttttacccaggattgaacggcgaaactttcgaagtcacctacgttgctgacaaagacggctatagagctagcggacctcatctaccacaacccgttcaagcccttcattaaaccataaaattgttttttgttgatattcaacattaacgcttataaataaaaaaagttatatataatagaaagttttatttttctgt

SEQ ID NO: 1547 - DNA, 963 bp, Diabrotica virgifera
  misc_feature (835)..(835): n is a, c, g, or t
  misc_feature (849)..(849): n is a, c, g, or t
  misc_feature (854)..(854): n is a, c, g, or t
  misc_feature (856)..(857): n is a, c, g, or t
  misc_feature (897)..(897): n is a, c, g, or t
cttttatcattgaccagaaacaatgtcttctgagcttgataattggatagaaattgcaaaacaatgcaaatatttaccggaaaatgatcttaaaaagttatgtgatatagtgtgcagtattttattagaagaatcaaacgttcaacctgtatctactcccgttactgtatgcggtgatatacatggtcagttttatgatctcgaagagttatttcggaaaggcggacaagttcccgataccaattacgtatttttaggggatttcgtcgataggggctactacagtttagaaacattcacaagacttctaacgctcaaagcgaagtatccaaacaaaatcacattattaaggggcaatcacgaaagtaggcagatcacgcaggtttatggcttttatgatgaatgtatgactaagtatggaaatgttaacgcttggaagtattgctgtggtgtattcgatttgttgactattgctgcgataatagatgagaaaattttgtgtgttcatggaggactaagtccagaaattaaaactttagatcaaattagaatattagaaaggaatcaagaaatccctcacaaaggagcattctgtgatttggtatggtctgaccctgactatatagatacctgggctactagtcccagaggagcaggtttcctatttggagccaaagtcactaatgatttcatgagaattaatgctctaactttaatatgcagggctcatcagttagtacatgaagggtataaatatatgtttgaggaccagctggtgacagtttggtctgctcccattattgttatagatgtggcaatgtagctagcatattgnaattcaccactgcncacangnngaatgcacactgttcaaggctgtgccggatgctgaaagangtatacccagtagaaatatcacaccatactttttataatttaattttaaatatattttttaatacg

SEQ ID NO: 1548 - DNA, 787 bp, Diabrotica virgifera
cttcacaattatagatacaatccaaacatgaagggaaaagtcatcaatcttctagttttgttctcgtgcttttggttatcggaacaggcacaagtgaaagtttcaatttattatgagacactttgcccagatagcattgcttttattaaggaccaattccatcctacctataaggatctcaaagattacatcgatgtagaatttgtgccatatggtcatgcctcagaaacaaatataactggacaatgggcatttacttgccaacatggccctgctgaatgtttcggaaacgctttccactcctgtgtacttgctctaaattccgacaaaagcaaaacagaaaactttgtctactgttctatgagcgcagaggatccagctagtcttcaaattatcgaacagtgccttaacaaagccggtctggactggaaaacaattaaaaattgttactttagtaatgaatacgttaaatatcttatacaaaatggagaaaagactagagcagctgaagatacttctttcattccaaccatagtgctaaacgacaaattcagtcagcaaaatcaggacgacgctattagtgacttcagaaaattgatctgcaagaccttgaacaatgggccaaacgaatgtaaagaagaccacataaacgtaattttaacttaaaatataatataaagtaataaaaatactctttaatttctttaaaattctagacctttgtaaaagaaacttaactgctagagaaaacagaaataacgaaaaataaagattagattttgttctg

SEQ ID NO: 1549 - DNA, 895 bp, Diabrotica virgifera
tccgggaaatttcccggggtcggacccacggcggtccgggaggagaggtaattcaaatagtgtgtgtagttcctgaaatgggggtttttagaggacaacttttatttttaagattatgatttccacaatattaaagtccctgattgtggcaacagttttttttgaaggaaactgcaatcagttgaaaaaaattcaaatgagccaccaatctactcagctttccgaaaatgccatgaggtacttatcaaaactatcaaatgttaagtacactaatgaagttctagataatattttaatacctcgtgttgttggaacatcagggcataagaaagtctttgagtatataaagaaagagcttaaaaacctggactggaacgtagaggttgatgagtttgaagatgatactccaatgggtcgtctgacatttaaaaacattatagccacattgaatccaaatgctgataggtatctagtattgtcttgtcactatgatagcaagtattttgaggatattgtttttgtaggggctatcgactcagcagtcccttgcgcgatgatgttaaatttaatcaaagtaatggacaaagaattaaaatcagtacaatcaaactctttaagtttaaaacttatattttttgatggagaagaagctttcgttgaatggggacccagagattctatatacggtgctaggcatttagcacaagtgtaccaaaacaaaatagaaacaagtcgtgtatctggtgaaaggatcaatgaaaatcagaagatagatatgttgattttggtggatttgattggacataaagctacaagattcttaagtacatcacgagaaacggaaaattggtatttacgccttgccaacattgagactcgtttaaggaaccttgag

SEQ ID NO: 1550 - DNA, 965 bp, Diabrotica virgifera
  misc_feature (946)..(946): n is a, c, g, or t
agcgttggtattgtagtttgtctcctgaacggaagctttttgtttgttttcgaacatgttaacagaagataagtcacagatatttaatgtgttgcttaatggagaaaatgcttctataaaatcaagaacatctaaaaacaacaataccaaaaaaagttataaatcaaaattttaaacaggaagaacacgtcagtaatcatgaagaggaaactaaggaaaaaaaatactctttaccaagtaaacaattttcaattagagaatcgtttatactgcaattatttgaacaaaataaaacgctaaacactatttataatatatttgttgcaaattatgtcatatttatttttgcatatacattaaaggaatatatgaatcaccaaaggttacccaaagcattacttataattcctcgttcgtttggaaaaatgcatttagttgcactggtttggctgggaaacaactttgcaacattttcaacttattacttctttcttctgtggggaaaaactagacaaaaagtgatttttcaaaaattgtgggatgctttatggattcttctgctgataacttattacatgatgtcatttgtagtgatcacaaaagtagtttttgctttgaatttaccattcgcatcggctgttattattacaatggagtcggtacgctttttaatgaaagttcacgcctttgtcagacataacgctccaaagatgttacataattctaacgacaaaacaacattgctttcattctccagatttatatatttcttgtatataccaacaataatttacagagaccagtatcccaggctaaagaagataagatggggttttgtgttttccggttattcgaaatagctaatataataatttttttggcgtattggtacgaatacgtcattactccatatttccaagaatcttgtttaaaacatggaacgggntggaggtgtttctactttt

SEQ ID NO: 1551 - DNA, 696 bp, Diabrotica virgifera
  misc_feature (589)..(591): n is a, c, g, or t
  misc_feature (624)..(624): n is a, c, g, or t
gtaattttgtatgagggcgggcaagcagtaaaatccggtaataactagtttaaaactgtaaaaaggagagcccagaaaaaatcagttttagttcgttttagttttacatcagttacaatgagttctacaggtatttacagcggtttaaatgaaaattccagaaactccagtagggtcttaagaccgcctggcgggggccatacagatttatttggtgatgctgctaacgactccaaaccgtcacgaagagaccatggaagaaatgcttcttccattttagagggaacaaacagtccaactacatccccaacgactccaacaaagactgtagtagcacctccaccagtgccacaagccaaggaacctgttcctcaacaaccaaaaggccgggttccacctggaggtttttcttccggactttggtgaattaaacattttacatttaaatgtgttatgactgcatgttacctctttacatctaatttttgacttgattattataaaactaatcgatgttttaacgcgtactggtaatttatactgtagcatttttttaaaatttataaataaagcattttttctgtgtgtnnnaaaaaaaaaaaaaaaaaaaaaaaaataagaganaaaaaaaaaaaaaaaaaaaaaaaaaaaaggggggggggggcccccccccccccccccccttggggggggggt

SEQ ID NO: 1552 - DNA, 1345 bp, Diabrotica virgifera
cccgttacatcattttatcatatataaaatgattttaatttgtttataatgtttattaagtaaaagcatttcgccatcgtaacatgtctaagatttttgcgttatacggggaactatgtgccactcacccatgggaagttatttttactgtcatcaccttcactgtatgttttttgactttggataaaccgcaagggacaaaggcctttccacggactacctcaacatgtagcacctgcaccgaagaccattttatagccgccgatgtaatagtgatgacaataatcagatgtcttgccatactgtacagttatcatcaattcagaaatctcagaaaactaggatccaaatatatattaggttttgcaggactatttgtagtctgctccagtttcgtgtttatatctgcagtattaaacatcctccaaatcgaagtagcggacctaaaagatgctctgttctttttcttgttgctaatagatctctcaaaagctgttaaattggctcaatacgctctaactgcctcaaaccaagaagaaataagtaaaaacatagcaatgggagttgctgttttagggcctaccataacgctagatactatcgtagaaaccttagtaataggagtgggaactttgtcaggagttcagcgtctagaaatgctatcgtattttgcgtgtctgtcagtcattgtgaattatataattttgttaaccttttacccagcttgtttagctttaatgttagatttaagcaaagtaagtgattattacaaacaagaacaagttaccagaatactaggggacgaaaaagataagtccaatccagctgcacaacgtgttaagatgattatgtctcttggactcaccatagtacatattcatagtaggtggtcagtaactcaaacggaaaacctagctatttggggggaaccaaactggaactccttggaatgaatctagctcattggacggctttatactttaaaaaattgctctaagggccgattcaatagtgatactgggtgtgttggaaacttttgatgaacaaatttatttatttttaaaggagagaagagttacaaacaattaatggacttattggtgatgtttccgatcgaaggaaaagaataaagagacaagaaaaaatatattcttaccgccggggaaatgagaattggtgttcctaaataaaaaaaatgctctggtaagaagggatagaactgttccaatcccctaaaaacttaaagattggttaaattgttttttggcggataagtggatagaatttcccaaaaacagaataataaggtaaatataaaaaataaaaaattcctgccttatttttt

SEQ ID NO: 1553 - DNA, 661 bp, Diabrotica virgifera
aaataaattttatagaagttgctggagctggagaagataaattaataaaatatgggtattacagacgatgtacatcttcccactgaagaagaattaacagttcaagaaatccctttatccggcccagcacttaaagcgggtgcctttcatgtaggaaaaacttgcgaatgggaaaataatgagtttattctctgtcgcgatgagttgaaagatccaagaaaatgtataaatgaaggtaaagcagttaccagctgcgccatgaacttctttagaaagattaaagcaacttgtgcagatgaattcatgcagtatgtaaactgtcttgacaaatctagccctgatcaggcccttgtaccatgtagaaaaactcaagccgtttttgataaatgtgtaaaagataatctaggtttagacagacccccttatgattactttaatcgcgtgcatgtacataaaactgaaaggccaagaccaccagtggaaggtaaaactgtttacgaagatgctactccgggacttccagaggatgtacccaagcctgaagctaagtatggttccagatatctcttcatgtggtaaaaaatgggagtatacacaagagttgtgtattgtgtgtagtttctactttatttagttctattgtaaataaatattatgttat

SEQ ID NO: 1554 - DNA, 1237 bp, Diabrotica virgifera
  misc_feature (1166)..(1166): n is a, c, g, or t
caccgtttaatttggaattggaacatgtattaggaaaaatgccacagaaagtcttcaagttaaacaggcacaaagtagccagtaaaccactagaattcccaaaagccctttcaatctaccaatctctgctgagagtattaaggttgccatctattggaagcaagcggtacttaaccaacaaagtagatcgctgtgttacaggtttgatagctcagcagcaatgtgtgggaccactgcatacacctttagctgatgtagctgttacagctctttctcattttggacatgaaggtatagcgtcatctattggagagcaacctatcaaaggtttagtgaacactgcagccggtgctagaatgacggtagttgaagctctaagcaacctcgtattcgccggtatcaccagtttacgcgacgtcaaatgcagtggtaactggatgtgggctgccaagctccctggcgaaggagcagctctgtatgacgcatgcaaagctatgtgtgacctcatgagcgagttaggaatcgccatcgatggtggaaaggattctttgagtatggcagctagagttggaaaagacactgtcaaagctccaggaaccttagtcgtttctacttatgctccctgtcctgatattagaaaagttgtgacccctgatttcaaagcgccttctatgggaaaaacaggaaccattctgttcgtagatctttcccgaagtgacagtagacttggtggttcggcattagctcaagcatttggtcaacttggagaggaatctcccgatcttcatagcgctgaagaattagtaaatgcatttaatgcaacacaacagttaataaaagatgattcaattttggcaggacacgatatcagcgatggtggcttaatcgtatgcctattagaaatgtgcttcgcaggaatatgtggtatggaagttgatgttcaacatagacaaggcaaaccacttaatattttgtttgctgaagaagttggatgggtactggaagttttggatgaagatgttgctcactgcctgaatgtgttttcgaatcacaacgtcccagtattcaaaataggaaagactgttggatatggaattaaatctaaatttggaataatagccaaccatgcttgcctagaaagtacaattctacctttgatgaagctntgggaagagactagttataggttagaactacatcagactattaaatcctgtgccgattcgggattccatag

SEQ ID NO: 1555 - DNA, 1484 bp, Diabrotica virgifera
  misc_feature (1437)..(1437): n is a, c, g, or t
cattacgcgtccggttttttttatcactgcaaattgcgtctttgaaaaactgcatattaatttgatagacacttttctgccttcctgtaacaatttttttctaaattccagcgggattgaattcctgagattgttaaagtaaatattatatttttacggccttaataggcaattttataaataataagaaaaaaagtctgttctggaagtgaatttaccctgtactaaaggtgggattttttaaaactttttgggggtttatttttagtagtcgtataattatagaaactttcagaaatattttggtttactgagattggtgtagtatattttgagaaaaacgtctcccagttttgaaaattgtgatttcttattgaaattttatcgaataaaatggtcaaatttattttttcctctaatcagcgattcctggtgctttataattctgcaaaattttgatgtttcgctgttccttctgttgacttgagcaataccagctgcgtcaatatttttcgaccaactcatttctattttccctaatttttactcccataaggtgcatgcaacgcatccctagattttaattctttatcgatggttaattcaaaattgttctctgcattaaactgattacttttaaattgtgttttaatattaggcttatttcgaagcttccccttatttctaatgccttttaaataaccaattgctaaaggtatttttttttcgattttatattataaaacactcgctttataagttttagaacacaactgtcgagttgcagctgcatagatcaggcatctcgcgcgttgttaaataccaacgagttttagctcaggtgggtactgttataaatatagctataactttgtttgtatttcgaacttttaatgaaacacactcgctttataagttttagaacacaactgtcgagttgcagctgcatagatcaggcatctagcgcgttgttaaataccaacgagttttagctcaggtgggtactgtaataaatatagctataactttgtttgtatttcgaacttttaatgaaacacactcgctttataagttttagaacacaactgtcgagttgcagctgcatagatcaggtatctcgcgcgttgttaaataccaacgagttttagctcaggtgggtactgttataaatatagctataactttgtttgtatttcgaacttttaatgaaattttagaacagtaaacttttagattagattagatttttttaaatctaaattaaatttttaattaaattagatttagtaaattagatttttttttaaatttacaaagtatgtttccttagctaagcgacaacattccaatttatgttgcttcaatttattgatatcgttgatagttggaatataactaattgccaactttttccttacatataactagtcaaccttngccctcttttaaatttactgtaacactatacctatgcagattgtatc

SEQ ID NO: 1556 - DNA, 822 bp, Diabrotica virgifera
ccctttttttttttattttatcctataaacaataatatagtatttttacaatataaataaatattaataaaatatgtctttagttccggattatggggactcttcaaactcagatgattcgagttcttcaaccagtgatagtgaaaatgaaattatcccaaccaagaagtcagatgtcgcaagtaaaaataaactgccagcaccaagttttgggggctccaacttgacagaagaatcaacaaaatcttcagtgttcaagaatccctttatagaagcagagaacgcaaaagacgccattttacagaagcatgttaaaatggtggagtcgaaggataatatggttataataaatgggaaaaagatttgctggaactatagaaaaggaagatgtagatttggtcataactgtaaatatgcacatgattcggacgttcagaaaacacaagaacaaatagaggttgaaaaggtagctgctattaaaaattccgttgtctgtgaaaattctcaaaccggttgcatttaaaacacacgaaagtagatgaagaagtatctgatgaggatgatgacacaaaaaagggtaaacagaaacgcaagagacctggtctgactcacggtttggttcctggtaaaaaggttatgaaacagtacatgcaccaaaagacttaaaagttataagtgatgttactacaaaagtacaaattttattaggttgtttttaagctttccagctggtttcatgctttttacaaactaagaaatcgatgtgatctattgtgtaataaaattgtcttaattggtacaaaaaaaataacaaaaaacata

SEQ ID NO: 1557 - DNA, 725 bp, Diabrotica virgifera
ttcctttacgcgtccgtttttcattaatttataatatgcgacgaactttatttatttaaaatacacacaataagcaatacacgtaagtcaaaaatccacactaaaccattcttttataatacatctcttttaaacttttacatcatttagtgtagtcccatctattacaaaatttaggaatcaaatctgccaccgttcttgtaatcttagcctcacataaagcatgacggccctcattttgaagtgtgtcgtgccatttaagaccgctagcgtagttgtatctaacctctagacatcttccgagaccaacgtaaccttcgccccagttagcccaaccaattggacggcctgttctcatccatatccatctgccgctagataatgtagttcccgatgtccaaaaccaatattcaactccacctccaaggaatggtttcatccgattgtaaagaaaatcgttttcttcctgcgattctatactagctaaatccatattaagtgatttgcaatgctccatcgctcctaaccaagaacccgtatatgtatatccaaagtaatataaagtatttccattcctctcaactggaattgatggagctatggattgggctatacccgtatcgttcgtgataacataactttgagcattgatctcaacactgaataagatcgtaagtaatacacctaaaagttgttttctcatgttgctgattttgtcaagcccc

SEQ ID NO: 1558 - DNA, 1498 bp, Diabrotica virgifera
tgacattgaatatacttacgttatcctgaaaaagtgttcttacaatggaagagctatacttgtttcttcttaccatgctcgtgactctctccacacatgcttcaccagttccagatgattcgaggtatttatactacgctgatatagcacctgctattctcaacagactctttctggtaaggagacaagcggaacctgacattggatattcagatgagtcccttgatgattcaccacgaaaacattattaccgtccatacgttcgtatcagaagagtgtaccgcacccattatcagccaaggcaccccttatctaattatgcggactcttatgacagatttccaacagtagcttaaaatatattatgaaggggaaggatatctctgaacaagatattgcatatcgcagaaaaacggattattaggtaaaaacatatatccaagaatttcaaaacaattttaaagaccagagtaataagacaaaaatataccctgttcgagacactggctgctcgagtgtcatggaaaaaaccttattaccctgtactattagttgcacatcctagaatcaatagagccataaaagaaagtacctacatccgaaaaaacagtccaagaacttgtctaatttttgatgttttagggccttgcttatattatgatgtgcaatgacagtttttttatctttggatatctgtatatgcttggcataaatttatttacttaggtatacagggtgtttcattaataattggaaatattttaactgtagatttctgggctcaaatcacttggtccgaaaatgcttcctaggggagctggagttctttgaggatgccgtcttgtaattagttttttttaaatacctccagaacgcttctatttagaagaacgaaaactggtacacttatttatgttccagagataaataaattccataatttttcaatttctagtaccggtcataagcgtcccttttgtgtagagcaacggttattttatcgcataactcttatgtctttaactttttaagcattcttgacaaatgattattaaattgtgaggtactctggtactaaaagatactcttgcttcaagtcggtaggatccaccgttttctagaaaaatcgatttgaaaatttttcgttttttgaatttgaaaaaaattttcaaaacaaaaaattaattacaagacaccatcttcaaaaagctgtagttctgctagggagcattttcggactaggtgatttggatcaaacctcaatattttgagctcaataatctacagttggaaactttttaattattaatgaaacaccgtgtatatattttttaagagatctgccataatgactgcttagtttataaaatgaatatatgtattgctagtttttatgctattcttattaatttattgtttcttttaattattagtataatagtatatatttttatatcgactgtatattgtatattatttaataaaattgcgtttaaat

SEQ ID NO: 1559 - DNA, 954 bp, Diabrotica virgifera
attatgctgtgataataatatgttatttacagtgttgtatatgtacctactataaatataaaaatcagataagtaagacagttttgttgaatgatgaatttagatatcgcgtatttgttttaattttgaaattacatagaaataacagtacctatagtttaaagaatatttaacagttttgtaatacgtggtaaaatagattggtcagtaggtaagtcagtatgtcagcagaagaattggatcagtattatgaaacggctgttgctttggcaaaacgattgggggcaataatcaaagaaactgctttagtaaggaacaaatccactaccagcaaactaaacagaacagacctagtaaccgaaacagacaaacacatagagaagcttctcatcagcaccgttaataaagaatatccccaccacaaaattattggagaggagtcaacgtttgaaggagcagaatgtactctcaccgacgcaccaacctggatcgtagatccaatagacggaaccatgaactttgtccattcatttccccattcctgtatttcaatagctttgtttgtcaacaaagaacctgagattggtatcatttataatccccatttggaacaattcttctcggccaggaaaggaaaaggtgcgtttttaaatggggaacctataaacgtgtctgatacgaaaaccatggctgatgctttggtgttaacagagagtttcgctcgtgaaaattccgtcaaagaaaaagtcattttggagaactataagatgctaatgcgggaaactcatggaccgagatcactaggttcagcagctatggacatgtgcatggtagcctgcggtgctgcggacgcttactatcaatacaaactcaacatttgggacatagcagcaggtgaactcatcgtaaaggaagcaggagggtgtggtacttgatactgatggcagccccttg

SEQ ID NO: 1560 - DNA, 982 bp, Diabrotica virgifera
  misc_feature (956)..(956): n is a, c, g, or t
accacgcgtccgaaaaatcgataaatgttttaaccagctacagtcaattacaaaaactacaacataaagtaatatagctataataatatgtgcgtataatagaaaacaaacacaatgacaaatcttcaagaagtaccaacagacgaattattgtcattccaagattttcctagtgttcacatctccggtgaagacaacagaaccataccaatttcagaggctcagatcaatgtaaattatgtagatggaaatataagcccaagtcacaatccccctgggccaggagatgctccagtcactgatggaacaaatcccacaacagaaaaagcattttggactttagaatattaccaaaagtactttgatgtagacacgtcagatgttgtggagaggataatggcatccataactcctaaatgggataatcgtctaaagaatcacttaaggaccaaaccggatctatatggtccattctggatatcagttacccttatttttaccattgcaattggtggaaatatagccaactatttacaaagttccagttcccaatatcattggagatatgatttccatttagtatcttattccgctaccactatattttcgtatgtaacaataattcccttgatattgtggggattgttaaaatggagtgttcatatccaagatgtcgaagggctagatgaggaattatcacctggcattttggagttaatctgtatttatggttattccttattcatatacattccagtatctgcgttatggtcaattcaaataaacatattgcagtggaccttgttagcgtttggaacattcatatctggatcagtattattgctaacattaatgccagcattacgattttcacagaggaagtttttactgatgttctttatcataggttttcatttaatggtgtcagcaggatttatgttatattgttttcatgnacccagtgggtctgttaataacactg

SEQ ID NO: 1561 - DNA, 990 bp, Diabrotica virgifera
aaaaagaagaatttaaataccaacaaacaaattcttgataaacgataaaaacctttgtgtgttaaggatatttaaatgagtagatagtttattgtaattcctcatggagtgtaatttacgtcctttgtctcagatcaaaaaagaaacattaaacactgaacattgtccaacgaaaacctcttccgaacagattgatgtagaaaaaacggttctaaagaagtacgaagatttacatactaagttaaaagtaaatagagaattaccagaacttctaaaagacaaacacagaaactttttatatgatagtattacttatctatcctccgcctatgaggtattagatgctagtcgaccttggttatgctattggatattgcatcctttatctttaataaatattcaattagatgctagaaggaaaaaagttattgctaagtttctagcaaaatgccagagtcctaatggtggttttggcggaggacctggtcagatacctcatttggctactacatatgcagccgtaaatgccttagtcattttaggaacagaagaagctttaaatgtaataaataggaaaaaattacaagaatttctatggagggtacggcaggttgatggatcttttcaaatgcatgaaaatggggaggttgatatacgaggagcttattgtgctctttcaatagctagtcttactggaatcatgactccagaattgtttaggaatactgcagagtggatagtaagttgtcaaacatacgagggtggattctctggatgtcctggtatggaagctcatggcggatacgcattttgtggtttagcagccttggtaatactcaataaaggacatttagtagatgaacgagctctactgagatggttagtacagaagcaaatgaaagtagagggtggatttcaaggaaggactaataaactagtgacgcctgtattctttttgcagggaggcgcttttcctttatatattctcta

SEQ ID NO: 1562 - DNA, 1470 bp, Diabrotica virgifera
  misc_feature (1389)..(1389): n is a, c, g, or t
  misc_feature (1435)..(1436): n is a, c, g, or t
aaacaacaaacatctgtaaaataatttttaagtttctgtttagttgcagtttactttgatttttgatcaaatcaatatttttacataatactatgaaggaaaaaaatatggagaagataaagtctacaccaaaagaagatttatcaaaccacgaagaagaatctggggatgaaggagacgaaacctctagcgttggaagtgcttcaactactgacaatacttcacgaagtgccacaccaactaataaattacgaaaaggtcgacgaggcaagaaacgtttaagtgcttctatacccaaagttcttaaacctatatacacattttcctgcagtattaaagaagatcatgggcaacctttgtttggagctcaatttaatcatcatctgaaagaaggacaaccacttgtatttgcagccgtaggaagtaatagagtaaccatatatgaatgtccagatggaactggaataaaactgttgcagtgctatgcagatcctgatctggatgaaaactactacacttgtgcctggtcacacgatgaggatctaggaaaaccacttttagctgttgctgggtctagaggtgtgattagaattttaaacccaattactatgagttgcatcagacattacataggtcacggccatgctataaatgaactcaaattccatccaaaggatccgaatctcctactttcaatatccaaagatcattcgttgagactgtggaacattaagtctgatgtttgtattgccatatttggtggtgtagagggacacagggatgaagttttaagtgcagattttgatctgaacggtaataggattatgtcttgtggtatggaccattctttgaagctttggcgactggataaggaaacaatgaaagacactataaagaattcttactcatggaatgcttctcgcaataccaggccgtttgaatgtctaaaggaaaattttccagatttttcaaccagagacatacataggaactatgtagattgtgtaaaatggttcggagacttcttactcagcaaatcctgtgagaattgcatcgtttgttggaaaccaggtcgtttggaagacgagaatttgagaaaaggagaaaccagttccacgatcatccatcgatttgagtacaaagaatgtgaaatttggttcgtgagattcgccatggatttctggcaaaaaattttggctttgggaaaccaaactggaaaagtatttgtttgggacttagacgttcccgatccagctcaggcaaagtgttacactcttcatcaagctcgctgtaccactgctattagacagaccacgttgagtagaaattcaaacgtattaatttgtgtttgcgatgacggcacaatttggagatgggataggatatgangtgttttttgtacacctaatttttaatatacttttttactggaaannaaaaaaaaaaataaatgcaaagaacacaactgac

SEQ ID NO: 1563 - DNA, 985 bp, Diabrotica virgifera
  misc_feature (881)..(881): n is a, c, g, or t
  misc_feature (892)..(892): n is a, c, g, or t
  misc_feature (920)..(920): n is a, c, g, or t
aaactgtgactccgtatcgaacacgtatctacaattagtgtcggtgttgtgtcttattttgcctttctcaaaatgtgaggactccacgtgcaaccttttccagaagtatgtgctttttaaggatgaatgtcccactgaagagacaaatgaggtccaacaaaacagttgtagctattttcagaaatatgtattatggaggaaagaatgtaatgaggtaccgcaggccgatagtacctttacaaaatgtaatcgagttcaacaaaaattgttaggacaagattattgtacatacatcccggatcagtatttagatgtgcctcaaataattgccagacatggatatccttctgaaactcatatcgttgagaccgaggacggatatttactacaagttcatcggatcccaagaccaaaattgggtgcttctattggacagcctatattttttacaacatggtttattaggaagcagtgccgattggataattaatgggaaataatactttagcatttgtattggcagacaaaggttatgatgtttggttaggaaatgcacgaggaaatgtttattcgagatcacatatctccctaccaaatgattactcagctttttggaattttagctttcacgaaatgggaaccaaagatttaccatcggttataacgtatattaccagagttacaaagaagccaggtgaactttatttatgttggccattcgatgggaacaactatgttttatgtattcgcatcggagaatgcacgagtagccaaaatattaagttatggttgggaatgggatccgctgcttatatgacacatataacatccccaattagatattttgcacacttacgaaggattctagaagtggttacganaataccttggngatttaatcaatttttaccaaataatanaactggatgcgtgctcttttagtatcatgcgaactatttaagatagatgcgaaatgtgcgaaatc

SEQ ID NO: 1564 - DNA, 910 bp, Diabrotica virgifera
gccacgccatgatttcgaagtgtatcatcgttcttgcgctcgtcgcccatgcggtactcggccgtaccaccggtacttccgcgcaaaacgccgtacacgaagcggcgcctaaacccgaagggaactcttatatcagtgactttcggtatatgtataaagtgtatcaagaatgtgctgctaccgacgtaatgtcttgtttaaaactcaagctggtcgctgcattggaccgcgctgccaagtcgtacacagaactacccttatttgaaggaattaagttcgttaaggaccctcaagctgcttctgcccctgctgaagttaaaactgaagccgaaatcgaagcgaaccttccaaggtccttggacgaaaaagaaaatgccttggatagcatcttaaccgacagagtatccaacttcttaggttcacacacccttcagatcaagttaccaagcacttccgaaatgcaagaagagggccgtggaaagaaaaagaagggaaaccagggtctccttctcttgcctcttatcttgggaggtactctaattcccttagcccttggtgccctagcccttttggccggaaaagctctaattgtgtctaaattagccctggttctggctcattttattggattgaagaaacttctttctggacatggtggtagcgacaaccaatatgttgaagtttacagtgcaggacactctggttggggaaggtcgaacataaggaggaagggaccagaatatgggggaatcagggtatgccccgaaaacaaccacattagttattgtatataaaattaattaattttatttttattggatcctcgactcaaccttctggagacttaattataattaaaataaggacaatttttgctaaaaaaaaaaaataaggggggggcgggttttaa

SEQ ID NO: 1565 - DNA, 1399 bp, Diabrotica virgifera
agaatatcaaaataaaaaataaactatcatatccgaatattgggaatgggatatttaaataataattattattttcttaaatattgactgcataaaaaaagtaatacattatcagaaatgtaagtattaacacaaataataaataaaactggacatacatctgatatgatatttttaacatttattaatctttattaagataaacattacctaagtgaaataataacaatatcgtgaaagtatatttttatatgttatcagttacatttaacaacaaacagctcttaaaaaataataatctttatctttaatgagaaatcaaggcggcgaggcttaacaatggcaacacagcggcataggtcagctgattagtttaaaaataaaaatgttgaacaaagaaaaagaaagataaatacacataaattattctgtctacaaacaaccccaacttagggcataacataacctataatttagtttcaaattactcccgggaatcatacttaatcattaaatcaatatttaataagaaatacaaatgttaattctcagttatagaaccgtctgcaaagcagctgtagcctttcgtagtttggctcttatatcaaacaatccaaagatgtcaaatccggagaactacaaagaagcctcctccatttacgatttcagtgcaaaagatatcaaaggtgaagtggtctctttagaaaaatacaaaggacatgtctgcataatagtgaatgtagcctcccaatgtggttacacaaaaaataactatgcagaattaaatgatttgtttgatgaatatggcgaatccaaagggctgaagatacttgcgtttccgtgtaatcagtttgcgaatgaagaaccaggagataacgccaccatctgccagttcgtgcaaaacaaaaacgtaaagtttgatgtgtttcaaaaaatcaatgttaatggtgacgactctcatcctctatggaattatctgaaatacaaacaaggaggcacccttggagactttatcaagtggaattttaccaagttcattgttgacaaaaatgggcaaccagttgagagacatggaccaagtacgaatcccaaagatttagtgaagtcacttgaaaaatattggtaaataatgttacttgtatatttgctttttatctaagtcatgtaatctaaaaaatatttataagtgatacctacaattttatttatgctaaaaactgttaaaaaatcggttatatactattcaatgtcttttttatttgtttccttttaaagggttttgtttccaaaatcctggaaggaaaagctttaaaattggactgaattccctttctaaaaatttattttcttaaaaaaattggtaaacccaatttgccccaaaaaagggaattttttttat

SEQ ID NO: 1566 - DNA, 1371 bp, Diabrotica virgifera
  misc_feature (1220)..(1220): n is a, c, g, or t
  misc_feature (1273)..(1273): n is a, c, g, or t
aggtcagctgattaagtttaaaaataaaaatgttgaacaaagaaagataaatacacataaattattctgtctacaaacaagtaacaacccacagtacaaagcaggataacaacccctacttagggcataacataacctataatttagtttcaaattactcccgggaatcatacttaatcattaaatcaatatttaataagaaatacaaatgttaattctcagttatagaaccgtctgcaaagcagctgtagcctttcgtagtttggctcttatatcaaacaatccaaagatgtcaaatccggagaactacaaagaagcctcctccatttacgatttcagtgcaaaagatatcaaaggtgaagtggtctctttagaaaaatacaaaggacatgtctgcataatagtgaatgtagcctcccaatgtggttacacaaaaaataactatgcagaattaaatgatttgtttgatgaatatggcgaatccaaagggctgaagatacttgcgtttccgtgtaatcagtttgcgaatgaagaaccaggagataacgccaccatctgccagttcgtgcaaaacaaaaacgtaaagtttgatgtgtttcaaaaaatcaatgttaatggtgatgactctcatcctctatggaattatctgaaatacaaacaaggaggcacccttggagactttatcaagtggaattttaccaagttcattgttgacaaaaatgggcaaccagttgagagacatggaccaagtacgaatcccaaagatttagtgaagtcacttgaaaaatattggtaaataatgttacttgtatatttgctttttatctaagtcatgtaatctaaaaaatatttataagtgatacctacaattttatttatgctaaaaactgttaaaaaatcgttatatacctattcaatgtcttttttatttgtttcattttaatgcttttgttttcaaaaatctgttggtatagctttagatttgactgtattcgctttctagtattttatttcttacttttttaaataattgggttaacaattttgcataaagggaaattttttagtttttcctcaaaaaaaaaaaaaaaaaaaagaaaaaaaaaaaaaaaaaaaaaaaaaaaaaaaaaaaaaaaaaaaaaaaaaaacacccaaaaaaaaaaaaaaaaataataggagagggggagggaggggacgcagagggggggaaacagtggagnacaggaggggggggggggggggaagagatataatgggaggggggagaaagaanaacgggggggggggggggggtggttgtgtgggagatgttgttgtttttgtgtggggggggggggggggggtgtgggttttgttttttttttttttttt

SEQ ID NO: 1567 - DNA, 1362 bp, Diabrotica virgifera
cgatcttggtgaaacggattatgtctttacttacgacaatggagagccggtagaattggaacctgaaaacgtaatcgaagtgaaacaaaggttaatcaagaaatgttctgacgatgatttccactgtagcgtgaactcttgtatttcattgacgctactttgtgataataatagggattgcgctgatggaaaagacgaggaaaactgtcgagaatacgtcgaaagattttcagttgccaaaaacaaacgtctagtagtagtagaaaaccaacgcatcgtcaacgtatcccatgcaacttgctctgtcctttgtattcaaaacaagaagttcacatgcagatcattcacttacagaagatctgacagaaactgtttcctgtcagacaaaaacataggactatctggagctctgcagacccatcattccagcgactactacgaactgaaagatggtactatagactgttctgataagaccaagtacttcgagtgtaataacaagaaatgcttaagtaaggattatgtgtgtgacgggtataatgattgtgataatagagaagacgaaaagcattgtggggcggaaaagtttggatacaaaataaagttggccgggtcgggtcagaagaatgaaggacgagtagaaattacagcatttggcagtaccggttacatctgcgacgacgacttcagcataatcgacgccaatgtcatttgtagagaactgggattccccctaggtgcagctgaagttaaaggccaatcgtacttcgccaaagacctaaaggaaagaaacactctgtatatgatagatgacctcaactgcgttggaaatgagagttccgtcatcgattgttcattccctggttggggtatgcacaactgtagagaccaagaatagctggagttgtctgtaagactcctcaagagaaatgcgggaatgacaaatggaaatgcgatagtggaaatgagtgtattccgtttgagttcgtttgcgatgatgtcgaggattgtaacgacgattctgatgaatctgtacagcattgtgaggctcccactgaattgcgtcttgtaggaggttcttatcccggagaaggccgagttgaaatcaaacataacggtatctggggaactatttgtgatgacgacttcaatgaagatgcagctaaagttgtgtgcaagtccttgggatacaaagggaagagtttcgttaaaaaggatgctcactttggggcaggttatgggcccatatggctcgatcaagtatcttgtcgtggcaacgagactgagctgaacacatgtacacactggggctggggcgaggaccattgtgaacccagtgaaaacgtaggagtgatctgctca

SEQ ID NO: 1568 - DNA, 1745 bp, Diabrotica virgifera
  misc_feature (1656)..(1656): n is a, c, g, or t
cccacgcgtccgccatatgtgtaaattttgttctgacattgtaattagggatgaaacgtatgcttaacgtactatatatagatatttataatttttgatttctataaatttttgctggaagtatgtttagtttttgtttttattgccatcgacatatcaacataatatcttttcctatgttaaaaatattttttgtgtgaattttgtactgaaaatttgtttagtttctgttgctctgttgtgtttttattgtattaataatttattcttacagtacgccactcttctaagaatttttggatgcatgtaatagtaagtattgagttacccgggaacatttctattgtagatggaatacttttatttagaagaaatctatttgttcattttttggtaaccatgttccaaaacgggatttgtcgataaattgatcagctccctgcatcatttctttcttcttgaacactcatttgatcttcgcggatcaactcatcgtcatcatcttggtgctacgcctagagggcctcgaccttctcaagctttctacgccattttgttctgtcccttgcttgcattttccaattgccgactccaatcttctcggcatcttgtggttaccccgtccatccacctcagctatggtctaccccgacttctcattcccacgggtgtgcgctgctgtaatctttttttattatgttcgattcatgggtccaagctacatgtcctgtccactgcagggagtttcacttaattatagtggtaatatcttttccaccaaacgtatgcttgtagatattctgcagttcaaagttatatctacgcctccatattccgttctcacagaccgctccgaatatcttacgtatcacctttctttcaaaaatcgacagagaggattcatctgttttagttagcctccattcctctgatccatatgtgagaacggggactatcaatgttctatacagccttatacgagttttttgagacagacgtttgttagctaagtactttgatagactatgataacacctgtttgcaattattattcgtcttcgtatttcctctgatgtgttattattggggttaagcgatgtccctagagatatgaactctttgaccgcttcgaatttttggtcattgatgattagatctgcgtcaacatttccagctcttgtgtttgtgttagctcggttaggatttccgcagttcttgttataatgtccacgtcgtctgcatatgctttttggacagatctattgaatatgtgtgcatgttataataagtattattgtgaatgggaaaggtgcagctatgacatatagaaaatttatcccgggtacaaaacgatacaagtaattgccacccttccaaagtttcaaaacgaagaaaatttcctttgctcatcataaaaactttttaatatttgattatcagatagatttattggattagaaaaaataagcacttactagcataactattatccatcttcaacagttgatctttaaaaattaaggaaaactttaatttcgtgtgatttaaatgatgtacgaatttcaactgatatattctattacaatgagaatacgtacttttgggctctattactcagcgatgggatggtgtagacataaacaaattcttttagtnttgaatatgacttttgttcacctagctagccttgacacactgtgcgctggcatcgtttcagggtaccgggtacctccacatggtcactc

SEQ ID NO: 1569 - DNA, 1602 bp, Diabrotica virgifera
atactatactatcattgcaacgtccggaaagtttcaaaacgaagaagattccttcgtttatcatacaaagtttttttttaatattgcttgtgtatcagatagatttttaacggaactaaactgatttattctattacaataaaaatgcgtacctacctttggacgctattactaaaaaaaatgatgtgcaagcgtgtgcatgttatcatcatcatcatcttggtgctacagcccttagagggcctcgaccttctcaatctttttacaccattctgttctgtcccttgcttgcattttccagttgccgactccgatcttctcggcatcctgtgttaccccgtccatctacctcagctttggtctactccgtcttctcattcccacgggttgtgctgttagaatcttttttatcatgttcgattcaggggcccgggctacatgtcttgcccactgcaggcggtttcgcttaattatagtgataatatattttccaccaaacgtatgcttgtagatattctgcagttcaaagttatatctacgcctccatattccgttctcacagaccgctccgaatatcttacgtatcacctttctttcaaaaatcgacagagaggattcatctgttttagttagcctccattcctctgatccatatgtgagaacggggactatcaatgttctatacagccttatacgagttttttgagacagacgtttgttagctaagtactttgatagactatgataacacctgtttgcaattattattcgtcttcgtatttcctctgatgtgttattattggggttaagcgatgtccctagagatatgaactctttgaccgcttcgaatttttggtcattgatgattagatctgcgtcaacatttccagctcttgtgtttgtgttagctcggttaggatttccgcagttcttgttattataataagtattattataacagctatgacatatagaaaatttatcccgggtacaaaacgatacaagtaattgccacccttccaaagtttcaaaacgaagaaaatttcctttgctcatcataaaaactttttaatatttgattatcagatagatttattggattagaaaaaataagcacttactagcataactattatccatcttcaacagttgatctttaaaaattaaggaaaactttaatttcgtgtgatttaaatgatgtacgaatttcaactgatatattctattacaatgagaatacatacttttgggctctattactcagcgatgggatgtgttagacataaacaaattcttttagttttgaatatgacttttgttcacctagctagccttattgacacactgtgcgctggcatcgtttcagggtaccgggtacctccaccatggtcactcacagagcgaatactctcatgcactgaggctgaggaccatttgcgtcgattgcgttcgctagagaacttttgagaattattcggcagcaaatatttcttgtggatgttttgtccggaatttttggggggggattttttgttccggggatttttatccaggaataatttggggggggattatttgtccagggaattatttgtctgaatc

SEQ ID NO: 1570 - DNA, 982 bp, Diabrotica virgifera
cggacgcgtgggtttttttttttgtttttttttttttttttttttttttttttttttttttttttttttttttttttttttttttttttttttttttttttttttaatgttaaagttgatgaaaaaaatgtaaattttttcaaacaaaaatagagttcttggggcatgttgttgatgttaatggtatccaccctactcaagagaaggttgatgcaataaaatctgcaccttcaccaaattcattaacagagttaaagtcttatctagggttactaaattactatggaaaatttatccccatgttgtcgagtaaactaagacctttgtcagtctggtattgatttcactaaaaactggacacaagaatgtgaagattaacatttcaattaagtaaagaacttttaacctctgaaagtgtcttaacccgttataatcctaatctgccaatttatgtaacgtgtgatgctagtggatatggtgtaggatgtgttttaagtcataaaataaataatattgaaaaaccagtaatgtttgggtcaagtactttgtctgtaaacgaaaaaattatagcaatttagagcgtgaggcccttgcaattatttttgcaataaaaaaatttcataaatatctgtatggaagaaaatttgtcttaattacggatcatcaacctttacagttcatatttgaaaaaaaaaaggtatcccgacatctgctgcatctagaatcacacgatgggcagttacattatctgggtatcaatatgacattcaatatagaaaaggttcgtctatcagtaatgctgatggattgtcacgtttaccttgtaataataaagcagaaatttctgattttttatattcctttaggttggttaatcaaatacctccttaaatgcaaaaaatatagtcaaggaaaaaaataaagatcttaattttatttaaggtaaaacattttattatttttggtatttaaatacgacata

SEQ ID NO: 1571 - DNA, 881 bp, Diabrotica virgifera
aatgaacataaccaaatttgttgaaatctattaaaattatatatctaaatctaattttctaaaaacttgtcaacagtatatagtacaatgtcttcagatataaatacttttacagttttaccattggtattgtctacggagtgcacaagcagtcatgatgtattcataaaagaacactccattagagctgttagcgaagacaaacctcctggtcagactctctttatgttaaatgtgcctcccacagcaacagaagcaggtttaaggaacgctttttccagtgtgggcaacataagacgaataattttcgaaaacaacacaaaggaagaaggagatggttttaaaagagcgtatatagtttttaacaaaagagaccagttagttagagccctgcaattgaaatcgttgaagcctatgtcaactgataatgaaccaatagagactggacttaatttgtgggttaaaaattataataattctatctgtgaccgggacgttttaaggaaaaaagtggaacaatttatggccgattttgacagccaagagaagaaagacaaaacagaagaaaatgtggatgatgaaggatggacggttgttacaaaaggtggtagaaaaccgggactatccaggaaggagagtttagccaacaaattgaatgaaaaggtgcaaaaaggtgcgaagaaaaaggagctaaagaatttctacaccttccaaataagggaatctaagaaagagcagattgcactcatgagaaaagagttttgaaaaggacaaggaaaaagttgcactcatgaaacaaggggagaaagtttaagccttattaaaattttattacattgactgtgtattttgggataaataaatttatatttgtacatact

SEQ ID NO: 1572 - DNA, 1123 bp, Diabrotica virgifera
agacgcaagtgggtttgacagtttgaaaaaatattgaattttgaattgaatgtaagatggacagccaagtagcaatcgaaggatactttgttgatttaatagacgacgcctggagatcagatacccttccagaagacgacattgcagtaccaacctgggaactagcagatccagaagctgattcaggagacattcatctgactttgaaagaacaagaacagaagtggagtgatattatgctgtctcatcttagcgagcatcaataatagtttggaatataatcattacactaattttataagtttagatataatggaattgccagatatcggcaagcaatgtgcacatccacaatgcaaacaacttgatttccttcctttaaattgtaagtgtggaaaaaccttttgttcagaccattttacaatccatgcgcaagaatgtgaagtttcaaaatttctctctgaggatgaactaaagaaaatagaaaacgtttatatttgttctcatcctcactgtaaagaacggagtattgtagctctaatatgtgaaagatgtaagcaacacttttgtgttcaacatagacacttggcagagtgcaaagaaaaagatgaagaaactttgaacaaagaaaaagagaagtatgcagctcctgtaaggatttttaatgaagctaaagcagttgttgacaaacaggtagaaaaaaatctagctgatgcgaaaaagaaaccaaaaaacagagagatggcgaacaaagtgcagcttatgaagataaaaaataaagctacaggtcttaaaacaattccaaccgttgatcgtgtatatttcagtgtatcctattgtgaaaagtcttgtcctgtgtttgtttccagccagtggagtcttggaagagcaatcgatgctatagctgaagaaatgaaattgcaaaacaacaataacaaagcaaatgagaagaaattgagacttttcacaaaagaggatagtgttagtttatcaactgatatgtctgttacgataaaaaagcttttgggagataaaattcttattgatggagatactctacgcattaaatatgtcgattcttaattttaaattatatttgtttgtattaaaatgatgcacattg

SEQ ID NO: 1573 - DNA, 948 bp, Diabrotica virgifera
  misc_feature (938)..(938): n is a, c, g, or t
gtaattagtaaaaaaagtatttatttaattgaccaatacaaacctaaattattcttttttgaattttttgcttttcctagaacaaataaatctttttacaagtcagataaactaatgtaattataatactaaaccctaatactaaaagaacaacaacatctagcaaaaaatattcatagaatggcatattgactgcagctaccctcaagtgaggtgctcccttatttcgaattatatactctacccaaaaaactgcagtgtccagtggtttgttgattctgtcatgcataagtgtagacctcagtctggcattttctgtgtactttttattatttagtatttcgttcaaagctttgctgaacctttcctctgttatcgtggagaacgacatggacactccgtaacccgcggctttagctttggctgcgttgattttttgatcaccaaatattggtaaagctaatactggaacaccgtagtagatagtctctaaagtgcttagtaaacctccatgggtgacaaatagcttcacatttggatgagctaatacatcttgttgtggaaaccattgccttattaaaatattgttactctttcctggaacatctttagaccattttatgagaaccttatagggtagtttccctaaagcgtcaaagattgctgtacttatttcttctttcattttagctggatcaatattagaacccatactaaaatatacaataccttctttggcattgtccatgataactttcaaatccttaggtaatccttttccaggagatatgtgcattccaccaacgtttatcatatttggtaccactggtaccggctggttcgtactctcatgcgaattcagcagaacaagggacacgtttgtcatcaattcctctaaacttggacttcccggaaaacctttccttagtatttctcgntgcgcaggaa

SEQ ID NO: 1574 - DNA, 964 bp, Diabrotica virgifera
  misc_feature (119)..(119): n is a, c, g, or t
tatgggaatgtaaactcttgtgacgtaaagtcaaaaatataagtctccccaccaccgtcggacaagacaaccgtaataaagtctaataaccgtgcttagtacatgtttttttctctttnttcttttctgttgaaaagcatgttttgtcatgatttttccaaaacaataaattattaaataccaagaaagaaaaagcatgtactaagcagataagttttttgctctcctgaaaagctgtagattttgacttataagttttggaatttagctgtcaattatgttctaagtatttattggcctggtccagacagtgacttgtccataaacttctttttggcaaagcacagccaccacttgcttggtttcttatcttctccaaaaaccttatcacaaactctcattcccacttcctgtctgagttgcgtcaaatacgccttcaagacatcaccatcattttgatttgctggtttactgtaaactgaattgagtggaaaacctggatcccctggtatatcaaacctagatatggcaagtgatcgcatctcgttctgggcttgaactttagtactacatttctgcagcttcttcaagcattctgttatgtagagagtaatatatatcaacaatctatcagcttcggacttaatttcgtaggttctgaagaaaacattggctttgaaatagaagagtgattcatcaatgatatcctgttcttgctcattactttgtactggaccaggccctttgaatcgagtctttattggcagaattgctatgttgcctacaattgaggagggctccaaaaaactggaatgataagccggcatttttatagttctgcgttgagttatttacatacgaaatatttttataaaacaattcaggaaataaataactaaaagctacaattttgacgctatttttaaggttaagactagttctagaactagggacgcgtaaaggg

SEQ ID NO: 1575 - DNA, 2312 bp, Diabrotica virgifera
cgcattcgttcaccgcgtggagtcgagagttatttcgaactgatctcgcgtgtttggatttaccgcattatagtaggatagtttcttgtttctcataccgagtttttttaggtggctgctgatctaatgtggtagattttccggcaaaaacgactgacaaaatggcacaaccaacagtttatagtgaaggtccgaatcaaataattcctagtgaaaattacgttgtaccgatcccagtggaagcgtccgacttagaattcccgaaaatggtaaagctatcgaaactattaaacccatatcagtgccaggactcctcgaaaaaacagccagggaataccccgataagatagcgctcgctcaaaaagttaatgggaaatgggaaaccgtcaatttcaaacagtacctcgagaacgtccgcaccaccgcaaaagcctttttacaccttggtctgaagcccaatcactcagtttgcattctaggatttaacagccctgaatggttctactcggatcttgcagcaatatttgctggggggatagcggtaggagtctacaccacaaactccgcagaagcctgctacttctgcgccgagaacagcaaggcaaatataatagtggtagaagaccagaagcagttagataaaattctggaagttaggtccaggttaccagagctaaaggcgatagtacaatacagtggagaacccacacacccagatgtgataagttggaaaagactgatggaaataggtgctcaacaaaccgacgatgccttaaataatgccttgaaacaagttgctatcaacaggtgctgtactttggtctacacgtctggaactgtaggtaaccccaaaggcgtgatgctcagtcacgacaacctgacgtgggatgccttagtaataaccgagcgcatggggctcagtgcgggaggtgaagaggtcctcatcagttacctgcctctgagtcacgtagccgcccaagtcgtcgacatatacatcactataacagtagctgcggcagtttacttcgccgataaggatgccctgaagggtactctgatcaacaccatgcaggaagttcgtcctacaaagttcctgggagttccgagagtgtatgaaaagatcttcgagaagatgatgcagatcgcagctaagagcggagctctcaggaagttcatttccggctgggcgaagaaacaggctcttcaacatcacgtggatacgatgaatggactccagtccaattcgtggggttatatgttcgccaaaaacgtcctcttcagcaaagtcaaacaagccttgggtctatctcggtgtacattcttcgccagtgctgcagcaccattagcacctgatgtaaagaggtatttccacagcatcgatatacctgtgatggactgtttcggtatgtcagaagccagcggtggtcactgtcttggtatagagggcgccacgaacttcgacaccatcggtatgacgatgcccggaatgaagactaaactgttcaatgaagaaaacggccaaggcgagctgtgcatgtacggtagacatgtctttatgggatatctaaacgaaccgggaaaaactaccgaagctttagatgaagaaggttggttgcactctggagatctgggtagaatagatgacaaacagttggtttatatcacaggtcgatacacggagcttttagtaacagccataacacatcccagacccagatgccaccaaacctgatgactgggacgatgaaatggatggcgaatgggaaccaccaatgattgataaccccgaatacaaaggtgaatggaaacctttacaaacaaaaagaaatctgtggaatcggtttcgatttatggcaagtcaaatctggtaccatcttcgataatgtcctcgtcactgatgatgtagattatgccaagaaagcactatcaggtcttaaagataaacaagagggtgaaaagaaggttaaagaagaacaagacaaagccgaaagagaatctaccagtgaagatgaaaagaaagaggatgacgatgatgatgatgaggatgatgatgcagaagaacatgtgccacaagtagaagaaggcgatcacgatgagttataaaaatagtgtaaagtgaactaaagagactttttttatatattacaggtgtgaagtgttttgttcgatagtgtgtactgttccttgactgatttttgttatttttgatcgtattacttctaataaaacacaaaatcgaaaacggacgcgtgggcggacgcgtgggcggacgagtgggcggacgcgtgggcgcgagcggccgctcgccggac

SEQ ID NO: 1576 - DNA, 1775 bp, Diabrotica virgifera
  misc_feature (22)..(22): n is a, c, g, or t
  misc_feature (25)..(25): n is a, c, g, or t
  misc_feature (27)..(27): n is a, c, g, or t
  misc_feature (31)..(31): n is a, c, g, or t
  misc_feature (63)..(63): n is a, c, g, or t
  misc_feature (78)..(78): n is a, c, g, or t
  misc_feature (108)..(108): n is a, c, g, or t
  misc_feature (150)..(150): n is a, c, g, or t
  misc_feature (175)..(175): n is a, c, g, or t
  misc_feature (189)..(189): n is a, c, g, or t
  misc_feature (207)..(207): n is a, c, g, or t
  misc_feature (213)..(213): n is a, c, g, or t
  misc_feature (216)..(216): n is a, c, g, or t
  misc_feature (274)..(274): n is a, c, g, or t
  misc_feature (304)..(305): n is a, c, g, or t
  misc_feature (309)..(309): n is a, c, g, or t
ttactaagggaagagagtgttntgngntttntagtaatagttccttaataaattttataaatnaaaatgagggaaatngtttagatataaggtggataatgaggtaantaaattggagccccattatgggaaataatgtatgatgaatanggaatagaagaaatgggagtatagnatggagaatgtganatataatttgaaagaatnaatgtntantagaaagaggtttatggaggaaaataagtataaggtgttatgatagttgaattggaangtggtaatatggattgagtaaggttgggtnncttnggaaaaatgttaagaatagagaaattcgtgtttggatagtatggagatggaaaaaagtgtgtcaagggagattacacagaaggtgctgaagtagcttgattcgtataaaattgacgtgaggaaagtacatgaatgcttgtgttgggtaccaatatttgtggtgtggtactcgcgagtgctggattcattccgtccgtctatcgtgtagaaaggtggctgctgatctaatgtggtagattttccggcaaaaacgactgacaaaatggcacaaccaacagtttatagtgaaggtccgaatcaaataattcctagtgaaaattacgtgtgtaccgatcccagtggaagcgtccgacttagaattcccgaaaatggtaaagctatcgaaactattaaacccatatcagtgccaggactcctcgaaaaaacagccagggaataccccgataagatagcgctcgctcaaaaagttaatgggaaatgggaaaccgtcaatttcaaacagtacctcgagaacgtccgcaccaccgcaaaagcctttttacaccttggtctgaagcccaatcactcagtttgcattctaggatttaacagccctgaatggttctactcggatcttgcagcaatatttgctggggggatagcggtaggagtctacaccacaaactccgcagaagcctgctacttctgcgccgagaacagcaaggcaaatataatagtggtagaagaccagaagcagttagataaaattctggaagtgaggtccaggttaccagagctaaaggcgatagtacaatacagtggagaacccacacacccagatgtgataagttggaaaagactgatggaaataggtgctcaacaaaccgacgatgccttaaataatgccttgaaacaagttgctatcaacaggtgctgtactttggtctacacgtctggaactgtaggtaaccccaaaggcgtgatgctcagtcacgacaacctgacgtgggatgccttagtaataaccgagcgcatggggctcagtgcgggaggtgaagaggtcctcatcagttacctgcctctgagtcacgtagccgcccaagtcgtcgacatatacatcactataacagtagctgcggcaggttacttccccgctcaagatgccttccgggactctctttaaaccaatgcatactccccgcctcccccccatctaaacaaaaaagtacatgttatccttaactacaaggataaaaatgtccttattaacaaggacatcagatgcaaggatgatatctacactcacgcctacactcttattgttcgcccagataacacttatgaagtacaaatcgatggagaaaaggcagaatctggagaactataaagtgactgggatcttcttccaccctaggaaaattacagacccagaacccataaaaccagaaaattgggaagagcggcctattattccgaaaccagattaa

SEQ ID NO: 1577 - DNA, 1248 bp, Diabrotica virgifera
aataaacaacgaccgggaaagttcttgtgtgtatcgttaacgttttctgttaagtagatcgtgaaaatatatattaaaaatgtctgaagtggactcagtaaacactaataatgctgtaaatgaagaaaatagtcaagaagaaaaaagttccaaaactaggaaatccaagtccaagtctcctagactaacaacaattgagagggctcgagaagaaagcgaagctattactaagggcttgggacctgaggttgaaggcaggcgcagaacgaggtcagcagctaaaggtgtgacagccactcctccacctccagctaagaaagaaagaaaaagttctagcacaactaaatcatcgagaggcaggccgaagagaactgtagaagaaagtagtgattcacatgatgaaaaatctgaaacctcagtagcagaaagtgaagaacaagcaaaaagtatcgatgaatccaaaagtgaagctgacactacagaaaccaattcacatgatgacaaagaagaatctggtaacaacaatgctgatgcttctaagtgtgaagatcaggcaatgagtgttgacgaaaagagtgaagctgatggtaatgaaactaattcacatgatgacaaggaggaatctgctaataataatgctgatgctaaggatgaagcagacgcagatgcagaggaatctactcctgcacctgctgccacagagaatggagcgaaagaggatagtgtagatgctcccgcctccgaagaagaaaagaaagacgaggaagaagagagcaaaagtactgccgacgaacctgaatcggcaagcactgagcagacggaagatgaaaagcctgctgaataaagatttttatattatttccaaattttattatcagctcgtttttctatttcattaattctactgtaggttaacaaagaattcatttttaaaaagtttttggaaaagtgactcgtcaaaacacaaaattttcctgaaatatttgatttgggattgaaagtgtatttagtttttttttcttgaggttagtttttgtatgagctcccgcccagggaagtttgcgagaaaaatactgttattaaaaaaatattatatttataagaagtcagggtttctttttttttttttttttttcttttgttttgattttttttttttttgtttttggaaggggaaaaattaaaaaatttttaaaaaatatttttccccttctttttcaccctacccggggggcattattgtttggg

SEQ ID NO: 1578 - DNA, 1996 bp, Diabrotica virgifera
cgaccggaaaagttcttgtgtgtatcgttaccgttttctgctaagtatatcgcgaaaatatatattaacaatgtctgaagtgttactcagtaaacactaataatgctgtaaatgactaaagacgcgtgggcggacgcgtgggcaaaactaggaaatccaagtccaagtctcctagactaacaacaattgagagggctcgagaagaaagcgaagctattactaagggcttgggacctgaggttgaaggcaggcgcagaacgaggtcagcagctaaaggtgtgacagccactcctccacctccagctaagaaagaaagaaaaagttctagcacaactaaatcatcgagaggcaggccgaagagaactgtataagaaagtagtgattcacatgatgaaaaatctgaaacctcagtagcagaaagtgaagaacaagcataaagtagctttttgcatttcatttttaattattattattttgatgaggtattagtacttggttcatttctacacacctcgagttgttttttggcatttctagaaagaacttgtcgaaggtttgacgtatcggagaaggtcctaacagtttagaataatgaaatatcttgcagtttttgtgatttttgcgtatttatacgcagctcatgctagtgtttatttagaagagaaattcagtgatgattcctgggaaaagaattggatatacagcaaaaacccagataaagaatttggaaaatttgttaggacagctggaaaattctttaatgatgaagaagaagataaaggtcttcagacatctgaagatgcacgtttctatgccttaagtagaaaattcaaatccttctccacagaaggtaaagatctagttatccaatttactgtaaaacacgaacaaaacattgattgtggaggtggatacgttaaagtatttgattgttccttgaaacctgaagaattacatggggaaactccatacaggcttatgttcggtcccgatatttgtggacctggtaccaaaaaagtacatgttatccttaactacaaggataaaaatgtccttattaacaaggacatcagatgtaaggatgatatctacactcacgcctacactcttattgttcgcccagataacacttatgaagtacaaatcgatggtgaaaaggtagaatctggagaactagaaagtgattgggatcttcttccacccaagaaaattaaagacccagaagccaaaaaaccagaagattgggatgacagggctactattccagacccagatgactccaaacctgaagattgggacaagccagaacacatcccagacccagatgccaccaaacctgatgactgggacgatgaaatggatggcgaatgggaaccaccaatgattgataaccccgaatacaaaggtgaatggaaaccaaagcaaatcgataaccctgcatacaaaggtgcctgggttcaccctgaaatcgacaatcccgaatacactcccgatgcaaacctttacaaacaaaaagaaatctgtggaatcggtttcgatttatggcaagtcaaatctggtaccatcttcgataatgtcctcgtcactgatgatgtagattatgccaagaaagcactatcaggtcttaaagataaacaagagggtgaaaagaaggttaaagaagaacaagacaaagccgaaagagaatctaccagtgaagatgaaaagaaagaggatgacgatgatgatgatgaggatgatgatgcagaagaacatgtgccacaagtagaagaaggcgatcacgatgagttataaaaatagtgtaaagtgaactaaagagactttttttatatattacaggtgtgaagtgttttgttcgatagtgtgtactgttccttgactgatttttgttatttttgatcgtattacttctaataaaacacaaaatcgacaagttgttttcataatttcacattttatttgtacaaaattacaataaattatattttgtaataag

SEQ ID NO: 1579 - DNA, 911 bp, Diabrotica virgifera
cggacgcgtgggaaaagaagtaaataaaaaagatatgagtctgtcaaaatttgctattttaaataacgtttactggtagttaatacttcttgtgattaacatgggtgtcatcttatcaacgttaggtatacaggaaccaaaactttcgttaaggccacaaaaagtggtcgtcggaactatacatggaactcaaataacattagcttatgtgcttaacacttttgtaagcatttttgctgtattgatgatcgttctcttggagtttggtacaatacctgcagtacaacaaggtttttattgtggagatcctcttatatcacataaatataccggtgatacaattactccagtcacattgggattaacagctcctcttctagtgatagtgatggtactagttacagaactgctggcccatcagtcgataaagcaaatcaacctgcatgctgtagcattctacgttagtgaatcttcagtaggcgcgactttaactttactggttacgtcaatagggaaagtattagttggtgaacacaggccccattttttggatacctgtgagccggacactgcgaagaactgttctatagggacgtttatagaaacttatacctgtacgtcaacagaatttgaaccttcatttttggttgactcctctttgtcattcccatcgggacactcttcaattgcttggtttattggaatattctcagcatacgtagttcacgtaagaatgacaactgtcaactctggttacatcatgcgaccattcctaatttctgtttgtcttacctggtccatggtgtgctcattgtccagaatcaccgacagaagacatcattggtgggacgtattggcagggagcgggctttgaattttctttgcggtatacccgataaaagtgttgcatg

SEQ ID NO: 1580 - DNA, 1453 bp, Diabrotica virgifera
ataagaaatagtattacactgaaaataaagtataactcacaagaactacctaattctaatctccactcttaacgatacagatattggtatgaatatttataaacaaagtgatatcatatacttaaaaataataattaaccgtaatacatatttttttttgttattttcgacattttagacattttttttattttacgcatttttgttgaaggggcttaataaactttccgcactaaatctagtatttttcgtcttgttttgttcacattcgttggatatctacataagcatatactatacttaacacttaacctaagctttgaatgtaccacacagtaccgattcggttaaaaatttacaaaaataagtaataaaataaaacaacccagtggaacacaaacattaaattgaacaattttaaattttcacaacacaaagtataaaagttttgatttatgtcgaatctagatactgtgtttacgttttaaatttaaagagaaacatcacaaaagctacaaaacaagttaaaaccattgtctgctacattttcttcaagggtaatcttctctaacctaaaatagttcttctgtaccgaccgtccttttgatgttgttaaacatttttaaattattttgttctactgcaactacaataacgttaaaagagcgaatttctgaaggaagcataagggaaatgcaaaaaaatataaaaattatgacgaaacgggttaaaacaaagtaaacccaaatgaatctcttcaaaatatgtagttgaagcactataactccttcaaaaaatgtagcataaaaggagaagcaatggtggtgtacaatttcattacagattatataggtaaatatttagatcgtttaatgtatcatttgaaattactcaaattttactgttacagaaatacttaaaatctacagctagagaaaaacaaatttgaagtttaagtttaaaaacgaatgcagcgtattctttagtcgttgtatagtctaacacgctatctaagagactcattcatattcagctgagtgggatgctgttgttctaggtgtgaaattccataaacaagggatttacctgttttatgaaatggtcttgttttatgaaatattaacgagtcgcttaagctgggatccaacagaacgtgccgtggcacgccttgcgaaacaaaaaatatgtaatagaaaaagataaaactaaatacggtaacagcgcaacgtgaaatagcgttatttctctcagaacgtgtgatttactatccttgaacttgaacaaagaccaaattctttatttatggcctgagcggaggggggtgacttgtccggtcgtttgtcggtaaatgagcacagttcaaagttgataattttgtggctactggcggaacgtttactacttaacaacgaattcgatgtactactcattatagcaggcattgcttcgtcac

SEQ ID NO: 1581 - DNA, 790 bp, Diabrotica virgifera
ggcggacgcatccaaggcacagaagctgaagttggcaaattcaaggaaaaggaacatgagcaatctaccttacattatcagcaatacacagaagagctgaacacacaacttctaaccatccaagaacagtaccaacatatacaacaagaaaatgacaaattgtctgcagaggtacaaaatagagtacaccatatctgtgatcttgaacggcaactccagaacaagcaaaatgaaaaggttacatttacctccagcaacggaacgggtttgaatgtaaaagaagaactggaagtgacgaaagaattgtgtgtccagctacaggttagattgaactatttttcttgcaaatattttaaatatttttaaatctttgcattaccaaatctgcaaaatcaagctaaatacttttaatttacatttacattaattttatttcatacttttctttgtttgaactttttaatttatttttaaaatgcactaagtaactacagatttattagagaaaccaaattgtgtctggcagaacgaatattacaaatcagctgttccaacaaaaacattctgaaaagtcttatcagtaatttaatatttttattacaatccaatataatgtactttagatatatgtatgtaaagaaatagcagcaatattcacatttttatcagtctattcggctttgatctagtatacatgtacatactgctgtttgttggagtggatgattgagaggagtaaacctctagaaaatccccattactaaagtgtgagtcatcgtgctgatggaat

SEQ ID NO: 1582 - DNA, 1723 bp, Diabrotica virgifera
gaaaaaaaaagaaaaatgatccctccccacaaaagagtttctctattttttttcttttctccccttttttaggatgacccagatttttgggttataaatattttataaaccaaaaggggttttactattctgtaaaaaaaaaaaaaaatttaccccgatattccctttttttttttttgttttttttcgacattttaaacaattttttttttttttaggccttttttttgaagggggttaaataaacttttcagcaaataaaataagaatttttattctttgttttttccccatgcggtgggattttcacataaagaataatttttacattaccacttaagcttaagctttggaagggccccctccgttcttgattgcgttaaatatttccaaaaataagtaatcaatatactatcacagtggaacacaaacattaaattgaacgattttaaattttcacaacacaaagtataaaagttctgatttatgtcgaatctagatactgtgtatacgttctaaatttaaagagcaacatcacaaaagctacaaaacaagttaaaaccattgtctgctacattgtcttcaagggtaatcttctctaacctaaaatagttcttcagtaccgaccgtccttttgatgttgttaaacatttttaaattattttgttctactgcaactacaataacgttaaaagagcgaatttctgaaggaagcataagggaaatgcaaaaaaatataaaaattatgacgaaacgggttaaaacaaagtaaacccaaatgaatctcttcaaaatatgtagttgaagcactataactccttcaaaaaatgtagcataaaaggagaagcaatggtggtgtacaatttcattacagattatataggtaaatatttagatcgtttaatgtatcatttgaaattactcaaattttactgttacagaaatacttaaaatctacagctagagaaaaacaaatttgaagtttaagtttaaaaacgaatgcagcgtattctttagtcgttgtatagtctaacacgctatctaagagactcattcatattcagctgagtgggatgctgttgttctaggtgtgaaattccataaacaagggatttacctgttttatgaaatggtcttgttttatgaaatattaacgagtcgcttaagctgggatccaacagaacgtgccgtggcacgccttgcgaaacaaaaaatatgtaatagaaaaagataaaactaaatacggtaacagcgcaacgtgaaatagcgttatttctctcagaacgtgtgatttactatccttgaacttgaacaaagaccaaattctttatttatggcctgagcggaggggggtgacttgtccggtcgtttgtcggtaaatgagcacagttcaaagttgataattttgtggtctaacgatggtgtgttgtaatttttctcattgtttgaattaaccaacttactaaaatatctaccgccaacactggtggtgtaccttgatactctagactctaggggacaagatggtgcaatcgattttttcaaaaagtaaatatttattaatttcacggtaacgtggtctcttttcttttcactattatgtattttctatttctctttgccgacgcaaaccggtgaagtgtgccacgccgatactccgtgggatcccgtctttagatagcttgctagactttaaaataaatattggaattattgtacagcg

SEQ ID NO: 1583 - DNA, 2557 bp, Diabrotica virgifera
cgagctgtcttctgctacctccgatgtcgtcgtatccaactgcgttaagagcttcttcctcctcttcgcgcttgattggatctccatcacaatgaatgacggtatctggagccactatacagtacggagcgggatcggtctcgacgactttgaattcaacagctctcattcctccacgtacaacgaatacgtcatctttgtgtattggtcgataggcctccaggaagtagggtttcaggtatactttgaagagatttcgtgtgagtcctttcgctgtatcatgtatgggaagtacacgtattctcatgccatattctccaataaagcgacagggcgcggcggcgcccccctggggaaacaaaaaatatgtaatagaaaaagataaaactaaatacggtaacagcgcaacgtgaaatagcgttatttctctcagaacgtgtgatttactatccttgaacttgaacaaagaccaaattctttatttatggcctgagcggaggggggtgacttgtccggtcgtttgtcggtaaatgagcacagttcaaagttgataattttgtggtctaacgatggtgtgttgtaatttttctcattgtttgaattaaccaacctactaaaatatctaccgccaacactggtggtgtaccttgatactctagactctaggggacaagatggtgcaatcgattttttcaaaaagtaaatatttattaatttcacagtaacgtggtctcttttcttttcactattatgtattttctatttctctttgccgacgcaaaccggtgaagtgtgccacgccatactccatgggatcccgtctttagatagcttgctagactttaaaataaatattggaattattgtacagcgccatctaacttgcgaatttctactcgaaataggttaaaaacgtgaacaaaacttgcgacgtccgaggctttcgttttggagcttttcattcgatgttgtagagcatgcatacgttgccgttggccatagatggcggcaccaacggagacgtgggagacaataccgcaaagcccaagaacataaaagttcggactaatacggctctgtccggtcgatcggcggcgaataccacaacgacatgctcgcatttaagttgctcctcggcggcctcgagcagcgcgacgaacgcctcgcgagatccctcgggaagtacttgcgggggaagggcgacgtagagcgtgcgtcccttaagtactgcctcccagggatggcgggcggtgcggaaagtcagccgcagcgggggcggcgaattgcccctggtttccccaggggcatcaggaccaccacagaggcccggctcccagagacatgttgtagcaatcggcctcggacgcgctactggcggaacgtttactacttaacaacgaattcgatgtactactcattatagcaggcattgcttcgtcactattaccactactttcagtacttgaatcaaaactaaaagcctcagaggcactaataaacataattaaaaaatcaaaaaatgatctcgcacgaagacttgcttatcaatgtcgaaatattttctggttcacgggttctttcctcaccccaagataacagataatatgaggcatcagcagtggaatttgcaggctagttctagatcgcaatacaacatcatggcggaaatggtttcccttaataatacaataaaaagtatgagtaaagaacatgagcaatctaccttacattatcagcaatacacagaagagctgaacacacaacttctaaccatccaagaacagtaccaacatatacaacaagaaaatgacaaattgtctgcagaggtacaaaatagagtacaccatatctgtgatcttgaacggcaactccagaacaagcaaaatgaaaaggttacatttacctccagcaacggaacgggtttgaatgtaaaagaagaactggaagtgacgaaagaattgtgtgtccagctacaggttagattgaactatttttcttgcaaatattttaaatatttttaaatctttgcattaccaaatctgcaaaatcaagctaaatacttttaatttacatttacattaattttatttcatacttttctttgtttgtactttttaatttatttttaaaatgcactaagtaactacagatttattagagaaaccaaattgtgtctggcagaacgaatattacaaatcagctgttccaacaaaaacattctgaaaagtcttatcagtaatttaatatttttattacaatccaatataatgtactttagatatatgtatgtaaagaaatagcagcaatattcaaatttttatcagtttattcagttttgatctagtatacatgtacatactgctttttgttggagtgggtgattgagaggagtaaacctctaaaaaaatccccattactaaagtgtaagtcatcgtgctgatgggatgggagggacttgggtaaaagtacaaaaaacgataccccttgggacattagggggaatccccattgaaaattaaccttggccccggcaaggggggttctgcggggattgacc

SEQ ID NO: 1584 - DNA, 2709 bp, Diabrotica virgifera
  misc_feature (63)..(63): n is a, c, g, or t
gacaaaacttgtaaataatattccaaaaactattatattaaacaacatatgaatgcgttaacnaatgtaatattgttagcaaactgaggagttactgtaaataaatacaaaaatgaaaaataaaattgaaagttggtgcttattgagcccacctgaaacatttaactatacagatcgtcttcaggatcgtcctggaagttggcctggtctcctccggtacctcctggagcagcaggtccaccagctgctgtcgggaaacggaagttggtaccgaatccgcgagattgctgtaaggtctgggcgaacatctcgtattttctgatgtcgttgtctgaaacggaacgtctggcgaaacgcatggcctcttcgaagtgggccctggtgatttctggaactggatcgtcatcgtccaaatccatagcaacattgggattcaaagccctctctctttctctcctaatttcggtttcgatgctctgcctgatggccagtttgcaagctctctggcagatttcagtcaaatcggcaccagaaaatccatgagttactttagcaatgtatacaagatctacgtctttagctacaggcgatttcctcaagttggctttgaagatggcttccctagatttctcgtcgggtagagggatgtagatcaactgatcgagacgacctggacgcaatattgcaggatcgatgatatctggtctgtttgtagcaccgataataaacacgttctttttggctcccataccgtccatttctgttagaatttgattaataactctgtcggctgcaccaccggcatcacctacatttccaccacgcgatttggcaattgaatctaattcgtcaaagaatagaacacaaggtgccgcagatcgagccttgtcgaagatatctctgacatttgcttctgattcaccaaaccacatagtaagcaactctggtcctttaactgagataaagttggcttggcattcattcgcaatagccttagctaataacgttttaccgcaaccaggcggcccatagaacaacactcctctggacggttgcataccgaacttaaggaacttatctggatgttcgactgggtattgcaccaattcttgcaattctttcttgacattagccaagccaccgatatcgtcccaagtgacatttggtacttctactatggtctcacgtaaagcacttgggctgctcttcgtcatggcgtaacggaagttctccatggtaactgccagtgagtttaggacttctgcgtcaatttggtcgtcttcgaggtcgatgaggtccattttttctctgatttgttgaagggctgcttccgaacacagtgaagctaaatcggcacctacgtgaccatgagtttccgcagcgatctgttccaagtcgacatcatcggccaatttcatgttcttggtgtgaatacgtaaaacttcaagtctgccagttgcatcaggtattccgatatcgatttccctgtcgaatcttccgaatctacgtaaagctggatcgattgagtttggtctgttagtagcggccataacgataacgtgggaactcttcttcataccgtccatcaaagttagaagttgggatactatacggcgttccacctctccgtgtgttttctctctcttgggagcgatggcatccaattcatcaatgaaaataatagctggggaattcttgtcggcttcctcgaaagctttacgaagattgctttcggattcaccggccaatttgctcataatctcaggaccgttaatcaagaagaagaacgctccagtttcgttagctacggcacgtgcaatgagtgtcttaccagtacccggtggaccgtaaagtaagatacctcttggtggtttaactccaatagccttgaaaagactaggatgtctcagtggtaactccaccatttctttgatttgagcgagctgttttctacaacctccgatgtcgtcgtatccaactgcgttaagagcttcttcctcctcttcgcgcttgattggatctccatcacaatgaatgacggtatctggagccactatacagtacggagcgggatcggtctcgacgactttgaattcaacagctctcattcctccacgtacaacgaatacgtcatctttgtgtattggtcgataggcctccaggaagtagggtttcaggtatacttcgaagagatttcctgtgagtccttccactgtatcatctatgggaagtacatgtattctcttgccatactttacatcagggcaagcttggatagaaactacatctgaaagcctaactcttaaattatttctaacatttctattcatacgaattttttcatcgctacatgtatcatcagataatactatacaaacagtttctttccttcgcttgcccttcagtaggactgtgtctcctctgaaaagttgtagttcatccatttttgcttgtgacaaagcaaccacggagttatcatcgttaactgcttcttctaccaaaagtctatttggacgatctttcttacggagaattgcggtggccaaatcctctggatttttgttttcggccattatttagtaatgaatatgtacttaatgtagaaacttttgaaaaatcagttcacaatagaaattatctcttttatatgatttcagtttttactcaagcacaaagatgacgatcgttattctgacacaaaatgacgga

SEQ ID NO: 1585 - DNA, 3679 bp, Diabrotica virgifera
  misc_feature (3665)..(3665): n is a, c, g, or t
caaatatgaacaacggcaatcagaatcagattccctctttgttttcggtgtcatcaagttggtcagacacaaattctgcatggtcaagatttcaaagtgcacctacaggaaataatcctgcttggttaggcaaccaaaacggctttcaacctaattggtttcaatcaagcaacgtccggtcttggaatcctcgatctaattttcaaaacggttctccaagacgtatttggaaaagagctccaaaacgagcacgaagtaaaagtccgaaggcatcagctcctaacatcgataaatctgcagttggaaagaaaaaaccaacttggctccgaaaacgtttggctaaaaaaggtgccacaacagggtctaatccctctacaactccacctgccaaaacagcaaaacctggtaccaaagatgctgataagaaatcagacaaatcaactgtacgtgatggagtgctagctgtagttgtcatgaaagaatttccatttaaaaggttcgacccagaagagcataaacaattgatcgaagcatttaatgcagaagaaaagaaacaggacccaactggaagtctaatcaagacatttttgaagaaaaagggttcattatatgtggtctgcaaagataaagatggcgtcgaatgtgtaaagaaaataacggaaaatttaaatccttggcaggaaaaacatttaaaagttatacttcctgtagaacgtgatgccaaaaagtggtcggctgttgtcccagaaagttttccttctagatggttttctctagatgaaatgagattgatgcaaactgcattggaaaatgaactaaccaaaatggatatcgatgctgaaatgccagagtttttagattattataaacggagaggatctatgctactagcttgcaacaatgaattcagtgccgagtggttgaagaaaatactagaggaaataaacgttgattgtgaaaaagcaaaaattataaatgcaaatgaattacctacatgctataaaatcgagttaacattaccatcaactactttggacgatgtagaaaaggtattagagagaataaatcgtcaaaacgatgatttggagacgaatcgttggtacattattaggaaaactgaaatccccgaaaaggggatacaggttattgcatctgtggaattacaagtgcaggaacagttgaaaaagataaattacaaacctttcttaaacttcggtactgtcgacatcaagtatctaggaatcatgaggagtaaacctctgtaaaaaatccctaatactaaggtgtaagtaatcgtgccaatggtatggatagtactgaggctacagtactgctaacggtaccttcagggatattggcgaattcctggagtatttaaaacgtctttctcttgtaaactgggctctgcaagggatgacttgttttcccagctactcgtgggatcattaatggatatttcaatgaataaattaaatttaagtgctacaaaagttaaactttctggggctcaaaagagaaaactcaaaaaagaaaaaaacaacactgaaaatcctacaccaaaacacgatatcgaaatcaacaaaagtaaagatgttttggagtatgttgttgttccctttgagtatccagagaaaaggctgtcgaattggcagtttgaacaagtaaagacggaaattttaagaattttggatttgtcacaaattcgagaaggtattaaattaaaaggtggattgaaatttgcttgtgacgaaccaacataccaacaactactggtagcagtaagcaatataagagtattaggttggccactaaaaatattgaatattaaagaattgcctgtttatacgaaaatattgataattttgaaaggcattccagaagatccacaaaaagttcttgaaaagttagaggttgacaacaacaagataacgaccaaaaattggcacttaattcaccgtgaggtcaaagaggattcgcaacggatctttttttccattgaccaagagagcgtaaaagtgttagaaaccattgattacaaacctctttttaacaatgaaagagtcaaattacatattatggctaagaaaaagcatgagaattaggaactttttctggattgatggaaatctaaatttttgggaggggtttcaatttttttcacacgtgtctgtgtttagaataattaaaaagctgattaggttaagcactcaattcaagtgtagaggtacgtatgttcaagttagcgtgtttaaatgttagcataacgaaacttctgtattttttaggttatagtttataattatcacaattttgccgtgtaacagataagtcaaaacagttttggaaaagtacttggtcctgtacaatatgaagctgctctacataacaacatatgagatggaaaaaaccgaactagaagaaaactatactaaagccctaaacgaaaaagaaatgctgatgaaagaactagctgccaaaaacgattccttgaatcaactagaaaccatggtggaacagttaaaaggaaatcaacctgatacagctaaattactggctactatggaaagtgacaaagtcgctgctgctcgagctgtccagcaaaatatggaactcaaagagcagttagagagtatggcagaagtatttgccaaaatgaacaatgacaaggtggaactgacagaaaagctaagcattcagcagtctgcaagtaaggacctacttgaaaaattgcaaaaaactgaattgcacttacagatgttaactgatgctatcgaaatcaaagatcgagagctttcgcatctccgagaggcatctgaactaaatgaggtgctggatcacgaagagcaacatacagatgaatcacacgagacttgttcacatactctacagaatgaactgaaagaagctactgaaacaattgttaaattaacaaatgaattaaacaaccagagaaatcaaatgtctccgtctccacaagtatccgtaggtgatgatatttcatatttattgaagcaactggaagaactgaaacttaaaaatcaagaactggaaactaaactagaaaatcacaccatcgatgataattacaacaataaattgttaacagaggaagagtctgaaagcattttgcaaaaagaagaagcgatgaagcgtttggaagagaaatttaaacgtagaatgcaagatattgctgatttgactgaggagaaacaacgattggagcatttggtgctgcagttgcaaggcgaaaccgagaccattggagagtatgttgctctttaccagcaccagcgaatgatacttaaacaaaaagtaagtgaatttatattttttcataaactttttcttatgcgctactttattttatcttgtcaagacatgtcattcatattgatagtttaacacataaaccaccacgttaaaattttttgtttttgccttcaggctccacgttcagaatctccaatgaattatatttaactcactgagcgcctgggccaaacaaggcgtgagttaaatacaactcgcgtgccgtcgcaatgtgttacagctcacttattgtatgtccttacatgtactttttgagaaaatcggttttgaatggtgaagctctggtagcacagcgcagttttgaaatgtcatttataccacacccaaacatgtangacatgcaatgtcc

SEQ ID NO: 1586 - DNA, 2159 bp, Diabrotica virgifera
caatacaacatcatggcggacgcatccaaggcacagaagctgaagttggcaaattcaaggaaaaggaacatgagcaatctaccttacattatcagcaatacacagaagagctgaacacacaacttctaaccatccaagaacagtaccaacatatacaacaagaaaatgacaaattgtctgcagaggtacaaaatagagtacaccatatctgtgatcttgaacggcaactccagaacaagcaaaatgaaaaggttacatttacctccagcaacggaacgggtttgaatgtaaaagaagaactggaagtgacgaaagaattgtgtgtccagctacagatggaaaaaaccgaactagaagaaaactatactaaagccctaaacgaaaaagaaatgctgatgaaagaactagctgccaaaaacgattccttgaatcaactagaaaccatggtggaacagttaaaaggaaatcaacctgatacagctaaattactggctactatggaaagtgacaaagtcgctgctgctcgagctgtccagcaaaatatggaactcaaagagcagttagagagtatggcagaagtatttgccaaaatgaacaatgacaaggtggaactgacagaaaagctaagcattcagcagtctgcaagtaaggacctacttgaaaaattgcaaaaaactgaattgcacttacagatgttaactgatgctatcgaaatcaaagatcgagagctttcgcatctccgagaggcatctgaactaaatgaggtgctggatcacgaagagcaacatacagatgaatcacacgagacttgttcacatactctacagaatgaactgaaagaagctactgaaacaattgttaaattaacaaatgaattaaacaaccagagaaatcaaatgtctccgtctccacaagtatccgtaggtgatgatatttcatatttattgaagcaactggaagaactgaaacttaaaaatcaagaactggaaactaaactagaaaatcacaccatcgatgataattacaacaataaattgttaacagaggaagagtctgaaagcattttgcaaaaagaagaagcgatgaagcgtttggaagagaaatttaaacgtagaatgcaagatattgctgatttgactgaggagaaacaacgattggagcatttggtgctgcagttgcaaggcgaaaccgagaccattggagagtatgttgctctttaccagcaccagcgaatgatacttaaacaaaaagcgatggaaaaagaccagcaattcaaacaacttgcgacagatagagaacaaatcaaaataaagttagaaaaattaaaccacctcgtaggcgaattactaaaatctaaaaccttgagttcagaaattttgggccagtgtgagcgcttacacgaaagcgaaaacaaagaagtagaaactacggaagacttcaataaagaagagagtccgcacactgaaacagccgaagaaatcttgacgttactctcagagataaaaagcagcaatctagtcgaacctaaagaaagtatccaccactgtccattttgttcagggcaactaatcaccgtatagtttttcggaatatccatctcattgggcttcagaagaatttgtattttgtaagcttttccaaaacatatttgacttattttatatatttcaatgagtgatagattattttaaatatttatattttttatatttagttagatctgtaagtgattcattatccccggtcatttaataatgtaacttgctaccaaaaagtgttataactttacattgttcaagattgggttattctggagtataattaaatactttgtgatggataaccgagtagcttcatgtcttaaaatatcgattttataaaaaaaacatttttcttatttggataattattcaattatcgttgacttcaatttaaagttttaatactttttggtagcactttcaataggttttcatattcatcatttaaatattttaagagttcatgatttcacgttttaagtgaatgtttgtcatcaacatgttttgaacacagattgtatgtaacaaggtattttttatggtaccggtaaaaatgtgatttttgtatataaaacgaataaaactactataataacactaaataaaaaaaaggggggg

SEQ ID NO: 1587 - DNA, 1199 bp, Diabrotica virgifera
cttgtcgcaatacaacatcatggcggacgcatccaaggcacagaagctgaagttggcaaattcaaggaaaaggtttaaagaattacaagaacttaagaaaaagaaaaatgccactgcttcagttgataattctgaaaaagatctacgtgaaccaacaccagttgatagcctagtaagttcaacacacagttcaattaatgcagaaagtgaacttgcaaatgtaacaaacactcaattgccaaactatttcatgactactgcacaatcggatcctgcaacattttttgaaaatttgtctacaactaatactaatgttggtgacgttgggaacatttctgatgtagtagaaactccaatgtttgaacaacatgtaccctttgataataattatgctttgtttaatcaaacgaatcaacaaagttatataaaagaaacacaacatattattagaccaaatacagatagtttaaccatagaggatcctgaacttgtacaaaatgaaatatttgaccatcataggcacaacttaatacctgaccaaatagaaaatagtgatgctcaaacttatgaaggcagctacaatgaaaataatcctgttcacaatagtttcaaacagaatgtgagtgatacaaatttaagcgacttttctactcaagtggctcatataatcccagagtcacagagtgactcaaatctaataattgatctggaacaaaggaacgcagagttgacttcatttttagagcaggagaaaattcaatcacagcaacaacagcttcaaataaatgaactgcaagcaagaatataccacttagaacttgaaaatgcaacaaaagataataattcagtaataaataaattagaagaagatttaaaatgtcatagtcagaccatcaggcttttagtagctgaaaaaagcgaactttctaatgctgtagctcaacaggaggttacttttaaaaataaaaattctgagtgtgaagaactgcaagcgagactaaaggcttctagatctagagcttttgaattagagcaagaacttaacactttaaaatcagaacgaatacacaaagaaaccaacaatcatgatcagaacaaagttctagaaaatacattgaaggattttaatgagttacgtgattcaaaagaagaacttgacaggatatcctcgaagttccgggaaaaactaaaaagtgcta

SEQ ID NO: 1588 - DNA, 1409 bp, Diabrotica virgifera
caaactgttgcccttaagaagaggttatgtaggtgtcataaaccgttcacaaagagatattgatggacaaaaggatataaaattagcgctggaagctgaaagaaaatatttcttggggcatccgtcctatacacatatagccgacaaattgggtactccatacctacaaaaagtgttaaacgagcaactaaccaatcacatacgaaatactcttccttctttacgagatatttacagaaacaggtgattattctggaaaaggagcttggcgatttcaagaacttctctcctgatgatccaagtatgaaatcaaaggctatgcttcagatgatccagcagttcgctctaagtttcgaaaaagttctcgaaggctccagatcggacgatgtgaacacaactgagctgtcgggaggcgctagaatcaactgtgtctttcacgaaagattcccgtttgaagttgtcaaaatggagttcgacgaaagcgagctgagaaaggaaatagcaatcgccattgcgaacattcatggaattaggataggtctttttacgcctgatttagcatttgatgccatagtaaaaaagcaaatctctagattgaaagacccttgcttgaagtgtgtggatctagtctcaaccgagttgttgaatgttgtacacaactgctcagaacagatgtcgaggtttccgagattaagagaaatcgttgaacgagttataacgaatcacgtgagaaaaagagagcaagaatgtagggatcaactatcggtatacattaactgccaactttcttatatgaatacaaatcatgaagactttataggatttgccaatgctgaatcacaagccaagaagaccatacctacccacaacaatcatttaggcaaccaagtgatccgaaaggggtacatgacgctgcataatctcagtataattaagggtaggagcttctggtacgtgttgtcctcggatagtttagcttggtaccgagacgagactgaaaaggagatccagtacatcctacccctcaataaattgaagttaagggatgttgagactgggtttataaatcggaaaccgacttttgcgttgttctacccgcatggttctaatgtttataaggattataaacagctagaactgagctgtaactctgtggacgacatggattcctggaaagcttcttttttgagagcgggtgtctatcctcagaaacttttgaataacaacgaagaatctgatgacgaaagtatcgatattcaagaaaatgtagaccctcagcttaaaagacaagttgaagtgataaggaatctagtagagaactacatgtctatagtaaccaaggcccccaaagacttagtaccaaagatattacccttatgatcatttaaacccccaaaaagtatgttttt

SEQ ID NO: 1589 - DNA, 1349 bp, Diabrotica virgifera
gcaagccatgatatggacgttcgttaaatctcttcgttaaaataggaaattttgagcagttttgtagaataacactattgtgcaacattttgcaaaaacctgtttttattttagtaaacgaatgggcttgcaataacttgtgatagcaacttaaaataggattacaacacaatataccataagtacaagaaagtaaataaagatgagcaatgctaacagaatgtctactggagctcttccaaaatctaatccaataactgaagactatgaaatatctagaacagtcctgggattaggaataaatggaaaagtggttgaatgttactccaagacaacaaaggagaaatatgcactgaaaatattgccagacagcgcaaaaggttggagggaagctgacttacattgcaaagctactgggtgccggcatgtcgtggaaatcattgatgtctacgaaaacacatacaaaaggcacgctgccgttttaatggtgatggaatgcatggagggtggtgaattgttccaaagaattcaggataaggctgaaggagcgtttacagaaagggaggctgcccaaataatgcatgatatatgcattgctgttaaatacttacatgatcgcgatatcgctcatagagacttaaagcctgaaaacttattgtattccaaaccaggaccgttaggagtactgaaattaactgattttggttttgccaaggaaacgtcatctttagttactctccaaaccccgtgctacacaccttattatgttgctccagaagtgttggggtcccagaagtatgataaaagctgtgatatttgggcgctaggtgttattatgtacatattgttatgcggttaccctccgttctacagcgaccacgggctgtccatgtcacctggtatgaaaagtagaatccgagctggtcaattcacatttcctgatgccgaatggaaacagattagtcctgacgcgaagcatcttataaccggaatgctcactgttgatccaccaaaagatttactattgatcaggttatgaataaccgttggatcgcgcaatacgctgccgtcccacaaactcctcttcacaccaatcgagttttgaaagaaactgttgaactttggcccgaagtacaggaggagatgacccgctcgctggcaaccatgcgtgtggactatgaccaaagttcaatcaaaacgttggaaaactcccacaatccccctgcttcataagaggcggaaaaagaacgccatttacaccccactagtgcatttttttacgtttatttatagtattttatatattacttctgatctaaattagcttagtgcattatgtattacttgga

SEQ ID NO: 1590 - DNA, 1277 bp, Diabrotica virgifera
ggagactggacaatggaaagatttgtcttatgttttataatttttccaattatatttattgggggttcggattcatgtaaagaaaagcccataattaaactttcagatggaagtatacagggcattcgagaaacttctaatagtggaaaaccatactacgcctttagagaaattccttatgctgaaccaccaatcggagaattgagattttcggaacctatttctcccaaaaaatggaaaggcgtcaaagaaactgtaaatattacgaaaatatgtttaacccaattaccaccactaattccttacgaacttcaatattacacagataacaaaagagaaaatgaagactgtttgtatttgaatgtgtttacaccccaactaccatacaaagagaatataactggttttcccgtgtatgtatacatatacggtggattttttatctatggaaatcctacaggatatgattttcagtatctcgtagatgaaggtgttgtggttgtttcctttaactacagaatgaatagtttgggatttttatcaacggaagataatgttttccctgcaaacttgggccttaaagatcagttaatggttcttaaatgggtaaataaaaatattgaactgtttggtggagatcctacaaaagtaactttgggaggtcacagtgcaggagcaatacttactggatatcacctacttagtaaaaaatcaaaaggacttttcagatcagccatagttcaaagcggtacaccgctgatgagttttggttacattgccaatccgagaaaatttgcattcatgttaggagaaaaattaagtcgagactttcattcttccatgaatacgtcacaggatctgctgaaattgttacgaagtctcccagggaaggaggtagcccaagttaatttagggaatatagaaggtttcgactacaagttagttgaattcagatcaacttgggctcctactaaagaagatccaaactatgagcatgcatttttaacagatgacacaatgcacgaaaattttaagaagggacatttcaatcaagttccagttatgattggaattacagatgaagagttcaaagactatggaaacttgactcgagctggcctgttagtggatagtaattattctttattaattgatcctgttgttcctttaaaaaaagaaaatattttacctatgggtaatgaaataaaaaatatatattgcaatactaatagatttgcacaaaacgcaacaggtatgggccagattctatctgatat

SEQ ID NO: 1591 - DNA, 970 bp, Diabrotica virgifera
ctctgttcctgttgttgatatttctgtatcagtgatttatcattttgtttttgtaaagacaatgtaagaaaatgattaacggtagcaatagttttttcttattttttagcacagtagtgtttttatgtagctctaatgccgatacgtgtatcaatcacgatccgtgcctttgtcgaatcaatgaaaacgataaaataaacatatcagcactctcagaggatattaaggccccaaaatatttgagcgacaccgatggaaacttaacttacacatttttaggttgtaaagatgagatctttccgacagatgacaaaacacaacaatataagggaactttaatattgaccaaccgcacttgggactttaataaaaccaaaaacatttatgacgttataggaagttctgctttggcccgttttagtaaagatgatgatggatatatgctgacatatgccaatggctctgaacctcaagctataataacgcttctttgcaatagttataaagaaccatatcttaagatcactgatctacaaaaactgagtctagtcttgtcgtctcccaagctgtgcatacaaaccgaagaacatggaatgagtggcggttcagtttttctgttaattttctttatagttgctggcgtttactttgtgggtggagctgccctaatgtacttcattagaggtgctcgaggagtagaaatgatccctaatattgatttctggagaaatctgccaggattgatcaaggacggattgatatttttgctctcaggttgtaagcctaattttgtaacaacggcagaaacctacgatagaatataattagtgtaattatcggtgtaaggcttgactgaatcgatcgaatgttgttatatttttgttaatgaacacaaatgaatggttgagtaactcagttaaatatattgtagcttatctttttttgcaaagtggtacacttttttatgcag

SEQ ID NO: 1592 - DNA, 1237 bp, Diabrotica virgifera
gctgcttgagtttagcacacgttttgtttaaatatctgcagaaaaccaaatttactaaaaatgacggatgttgcaccaaaaacccctaataagaggaaaagtttaggtgttaaaaataactctaccaaaaaagttaaattggaaaatggacagacacctaaacagcctggatctgcaattaaacaaaaaggacagccgtctcctaagcaacaaacaaagctagacactcctaaacagaataaacaaacacctaaaaaaaataaaacaccaaaaccccaactcaaaactcctaaacaagaagtatctgttaaaaaggagcagaaacaacagacacctaagcaacaagtggtaacttcaaataacccaagtaaaaaagctaaaaaggtacctaagggtactgcccaagtggaacaaaaagtaaagaaggaaaaaactccacagtcctctgatcaacaaaaaaagagtccgaatgataaaaaaaagaagagacggccatatttcttacttaaatccctagcaaaatcaacagataatgccgagaaagctaaagccataaaagatatagacgaaaaaattaagcttatagaaagtagaccagagttaacgaagacagctaaccgtaaactgcacttgttaaaaaagtttaaaagaatagctcaaggcctccctccaccagcaccaccagttaaatctgagtctgcccaaggcaaagctaaaaagaaggaagctgcagcaggaaagcagaataaacagcaaaagggtaaagttcagaaagtagtgaaaaaagaaccagaaccagaagaagatgatagtgacgatgaagaggaaactgtagtaagtaaagctaaaatccagaaagtagtgacgaaacaagaagctgatagtgatgatgacgatggtagtgaagaggaaagtggtgaagaagaaggaagcggcgatgaagaagaaagtggtgatgaagaggataatgatgatgatgaatcagaggaggagtctgattaaaaattacatataagatgtatatgttatacatcatgttttgtataaaagtaattttgtattgctgttttaaataattgatgtttattaagcctttttaatattaaacttatgttaggtgtaaaaaaaaaaaaaaaaaaaaaaaaaaaaaaaaaaaaaaaaaaaaaaaaaaaaaaaaaaaaaaaaaaaaaaaaaaaaaaaaaaaaggaaaaaaaaaaaaaggggggggcccttttaa

SEQ ID NO: 1593 - DNA, 1068 bp, Diabrotica virgifera
  misc_feature (905)..(905): n is a, c, g, or t
agtttgtgtttggttggtggtctttgtgttttaacaacgtggtggtaaactatttcaacttttcttttgatatgaggttttaacataaaggattgttaaaaaatggtgcagacttcaggtgtgaatatgaaataccgagatttacctcaagttttaatactcttaaatgaaatgaatgttagtgctcaacatgtagctgctttagtagacagtatgattcaaaaagtaagaaaaggagaattaacaacagatcagggtctaagtttcttagaaatgaaatataacatgttgttaacatatctcatcaatctaacttatgtagtacttagaaagtgttgtggagaaaaaatagaaggagatccatgtatagatagattaatagaaataagaaccgttttagaaaaaattaaacctattgaccagagacttaaatatcaaattgacaaattggtaaaaactgccactacaggaaaaactgctgacgatccgacacactataaggcaaaccctgacaatttgcttggaaattctgacgattctgaaagtgttgttagtgaagttgaaaaggaaagtagagacagaaaaagtgtttatgttcctccaaagttaactgccttatattacacaggtgatgaaacttctcaacaaagagcaaagactcttcaagagagatcaaaaaaaaatgttatttccagtgctattatgcaagaccttcgtgaagaataccttgatacacccttagaagtttctcagagtagtagagctcagcaagtactttcaaaacaacaacaagagcgacaagagtacgaagagaaatatatgacacgcttatcagtgagtaaatcggagaaacataaaaaacatcagttgacaacacttggaacattaggagatgaaattacaanttttggacggtcacagagaaacaaaggaaaaaagaagttttctagtaataaaaaaggcacttaaagaagaaacgttttctttaattatgtatttatgtttctcttttataaaaacatatttgatatgggagttactggaataaaaaaatatggaatcttttta

SEQ ID NO: 1594 - DNA, 2272 bp, Diabrotica virgifera
ggtcaagaggactgagatccttactcccacaatgctggttagagtgcctctatgagaaatctctttttgcgggaattgtataataattcatttttctgaacagttgtcagtatgtcaagttgccccagtcttcttcatcttgcgaatcgaaaacaaattggttcatctcaagttaattttattttctctttggctatgatttcttggtcgtgtgtaattgaatggtttggttaaaattggtcattatccttcattgaggctgagttgcctattgacgttggtaataatattttgttggttagtttcaagtggtttgatagcagtgagtggccagaagtgactttccctacgccaaatcatcgtcatagagtcttattatttccttaaccttccgatgaccaacctttttttgttacacggatgaccaactggggtaaaaaatgaccctaggtcaaaaatgacctggaattaatgttttcagcatttaaatcttcatctaacaatacatcctcgttttctaatactatttcatcttttatatcatcataaaaatcgctagcagtaacaatttcctgtaactcagcctcagtaagatatttgcgggccatatcttgtatgtacacaaaatactaagaaactataataatatacgccagaaaataataataatgactaactgtagcagacaggaatgtcatgattcttacataacaggcaccacacgcgtgggcataatttaaaatatatatcaaagaaaaaaaagttgtttttgtctttagtttggcctctaaagacgattaaaatcgagagataattcaaattatagcagccagtccaaaacacaccctcattggtcctgacgtcatatcattataatgtttgaggtccgcgccattaattcattatgtttgatattcgtttacttgttgtaatcattttatggtatatctcagttttataaatctttaaatagttgctgtgaattaaatatttcataatatttgagagtttttgttaagacgtttttttttaatgaccggagaggatttttctaaagggcagtatgataacttacccatcatgaacataaatctctattattattagtttattttaattttatagtaaaaataattccagaaaaatattgtataggcaaatatcattcaatctgtaatgtacacctaccaaaatataccaaaagttatattttcttatgttcaaaatacacttgatttattaaacaaaaaactgttaagcaggcagcagatattaaataattacattaaaaaagatgatctcacatagaaaactttgttgtactaaacgacacttgcagtgtttgcttttaggacattttccatggtaacaacacacacatttcaatactatctcttcaaaaactgtattaaactcataagtaaacaaaatggaaataattttttatgagacatgagaaatgccattaaaaatattatgatatgacgtcacaaagggtcgcgcgctttttcgatcgtttgaaatgatttaaatacacagaagattttaaatttgtacttcttattagaagttactatgaggttttgatgcgtgaaattttggaaatcttatttttaaacgaaactgaacattactatgtaataaaacaaaaatgtgcaagttccctattagacactgtctcgaccaacacaaatttttaaaattctaaactttacaaaagttcgtaaactaacaacatatttgtcataaaaatccataaaacaatcattggaagatttttaaacttaagtgtggtggtattataagcagatataacacatataagacaaagctattaatttaattttaaagtttttgggggaaattaagaaattttttttcccgaatgcttctttaagcagctacagtattttttatttttaaatatactcacaatttagtacaacctcataatagatattttgcatcaaacatttgtacacttgtaacaaaacaagattttaccaaactgattttagttggagacattctttggaaatcttaagcgatggataacatttgtatttacttttatattataaatgatgtttccttttaaatgaatctaaatatataaaatatgaacacaaaatcaacctaatttacattgaaataataataaacacctacaaataagtccaacatgactttattatgacctttaatttgccttattgtttctttaaaattttgttattgctggaaatgggtaaaaaaagctagcataattccc

SEQ ID NO: 1595 - DNA, 1247 bp, Diabrotica virgifera
  misc_feature (548)..(548): n is a, c, g, or t
tggaaatgactttgttccgatgcatgataatgccaagcctcacagtgcgagaatcactcaacagtttttaaattaggtaaacgttcctgtaatggattggccagcattgagtccagacgcaaatccaatcgaacatgtttgggacatgcttgggcgcagtggcggctcgtcagaggaggcaagggaggcttagcctccccataaattttttacacacgctacactgttttgtttatcatgaatcgcgaaaacaacaaggactctcactattatacaacgtgtaaattccatattattactaaatatccatacgcacggagcattagcattagaacgcatggtcgcgtctcagttttattattattgtaggcaaggcaggaccctggattatcccgagatgcatgaacggagccgagaagcggaacagcctccgtagctgattcaccgcgcagcgcatttaaggagacccggtctcctaacagtggcatctacggtgccatcgcacgatacccggagatataccaagggaggcaaagtagcttctcggnctccgttgcgtggttgtgtccgtctcgggacaacgaattttagggtcctgactaaaaataatgaaaaatctagaagtgcgaattttgttatgaaatttggtatatggggttagaataatatttggaacaacttgctcaaataactttttccgacatctgtaactcaaagcaaaatatcggtaatttatcgtgtttttgaattcgcagtaggccgcgtttagaattaaaaaaattcagttgagtatcttaaaaaatttgaagcttcattatgtatggactgcaaaacttcaaatctgtatttattttgatatgcataggtatctatttacaaatagatggaattgttaacaaataaacgacacaaactttggtattaaacttttactattagactaactatttttaaaatgatgatatcatgaaattatgaattaggatgatattatgaaatgtaaataaaaaatggtcaaaagatggggccttaaattacattttttggcgcatttttttgcattttgctagtgcaaatttgtctagatattttacagttaggtatagcctcccctattgtaaaaatcacgagccgccactggtatgtgttaagcatatacgcatatacttacgcatatactaagaatattcgattaagaggaaacagtagcgatcaacaggcagccaaaacgcgttccaagattgcgg

SEQ ID NO: 1596 - DNA, 2151 bp, Diabrotica virgifera
  misc_feature (2049)..(2049): n is a, c, g, or t
tttttcctccccccccttatattataaaaaaaaaaatattttttatattaaaaaaaaaaaataaaccccccccctccacctttttttttttatattttttttttttttatatttttttttatttttcccaaaaatatcctaaaaaaaaaaaaaaaaaaaaaggccctttttttttaaaaaaaaaaagggccttttatttttttccaccaaaaaaggatttttattttttaaaaacgggggttccccccccttttaacaaactgggccccccccgaaaattttttaaagtttttggggtccccccaaacccccaccaatttacaaaaactatagtccaattttccccaatgggtccaacctttcacccaaaaaagaaggatcaaatcaacagaaatcaacattagtcattgcgtatcgagattaatgcaaagcttgttgtagtttgtctgtgattaaagttcaattgcagaggtaattatagtcattttattcttaagtcctcttaaatacttcttggtctgttcctatataaatttttgtatacaatagctcaccattctgacacaagtaactagtacaaatgacataaaaaacagaatagcttgctggaagagcattgtatactcggatttacacccgatccagatagtcttctgttagatcaatgaatctttcctttaattccaactcatttggtgaagtttttgaaaaaaggatttttggtgcagtcaagtttggaataatcttcagagaaatatttattaaaactttcttgaggagattccaagtcaagaattatatcagcaactccatctggtattgaagatatttcgttttcttcaaaaatgatgatagcgtaggaaatgtagagacaatcttcctctcagtagcggctcgtcagaggaggcaagggaggctcagcctccccataaattttttacacactctacactgttttgtttatcatgaatcgtgaaaacaataagcactctcactattatacaacgtgtaaattccatattatcactaattatccatacgtacggagcattagcattagaacgcatgatcgcgtctcagttttattaaatattattgtaggcaggaccctgggttatcccgagatgcatggatggagaagagaagcccagcagtctccgttgctagcagcaggcgtttaaggagacccggtctcctaacagtggcatctacggcgccctcacacgctgcccggagatatatcaagggagacagagtagcttctcggctccgttccgtggttgcgtgcgtctcgggacaacgaattttagggtcctgactaaaaataatgaaaaatctaaaagtgcgaattttgttatgaaatttggtatgtggggttataataatatttggaacaacttgctcaaataactttttccgatatctctaactcaaagcaaaatatcggtaatttatcgtgtttttgaattcgcagtaggccgcgtttagaattaaaaaaattcagttgagtatcttaaaaaatttgaagcttcattatgtatggacggcaaaacttcaaatctgtatttattttgatatgcataggtatctatttacaaatagatggaattgttaacaaataaactacacaaactttggtattaaacttttactattagactaactatttttaaaatgatatgatatcatgaaattatgaattaggatgatattatgaaatgtaaataaaaaatggtcaaaagattgggccttaaattacattttttggcgctagtgcaaatttgtctagatattttacagttaggtatagcctcccctattgtaaaaatcacgagccgccactgccaggaaataataataatgactaaccgtagcagacaggaatgtcatgactcgtacataacaggtaccacagtttaaaaatagattttgataacgcgcagtgtaaaactactttgaattccacataatagacggtattttactaaacatcaacttcagaatatatttttttattcataaaatataggggaattttttttatttcanaatatgaggatatctagaatgatattacagtcaaataaaaaaaataatgagttaaaaattgaaaatacttttgaatttattaaagaaaaacatacgctgggg

SEQ ID NO: 1597 - DNA, 3055 bp, Diabrotica virgifera
taaatagataacttttagatgaaacaaaagtaactatacatacaaccaaagatctacactttacttaaccttccgattaccaacctttttttgttacacggatggccaacggaggtaaaaaatgaccccaggtcatttttgacctggaatgaatgttttcagcatttaaatcttcatctaacaatacatcctcgttttctgatactatttcatcttagttctatattatcataaaaatcgctagcagtaacaatttcctgtaactcagcctcagtaagatatttgcgggccataacttatatgtacacaaaatactaagaaactttaataatatacgccagggaataataataactgtagcagacaggaatgtcatgattcgtacataacaggcaccacagtctaaaaaatagattttgataacgcgcagtgtaaaactacttggaattccacataatagacggtatattactaaacatcaacttcagaatatattttttattcgtaaaatatatggaattttttttatttcgaaatatgaggatatctagaatgatattaaagtcgaataaaaaaataatgagttaaaaattgaaaatacttttgaatttattaaagaaaaacatacgctgggatccaaatttacccccttggtcatccgaaggttaaacagaaaattcgtggaatagacgtgaatttgacacataagatccactgctcattttaaccgtttatatttttacaagaggtgttggtgggatagggttttctttcctaattttgctcctttatgaactaagaggaaaagacgttctttgtttttactatttttagtttttatgagtgtcctaacacctctccaaagttatgtgacacataatatatgtgtatgaccgatcgttttcaatcattagtttgcagttcataaataaatatagtgtgcattccgactttttctgtgcaagttttgcacgagttctaaggtgaggaattccgagggttgggttcttgcaaaaaaggacgaaaatgacttcaatcttgcgtacctcgactctacttgccaaatttttggtccaaatttttaagcagtcactattccacaatttcaatgtatacaaaaaaattcaagaaattaccgttattttagtagtgtgctcctaataaatattcagatactttaaagtttgaagtgtcaatgcttatatagtcgagacatcttagtccctctttttccagcttctttttcagatcgcttgcgctctgtagatcactgatggatagtagaggatatacaatcgaagcgacataatatataagaacctttgaatgtaactattaaaacatccgctatatctatttttggaaaattaagtgtaacatgatgcagtagagttcatttgaaacttttttttaaaacagatagtcttaacatgtatttgtcaactgatacaattccaaaatatttagctttttaacattcccatcaattccgcttaacggaatattaagtatatatttataacataagaataaagagaaaaatacactcctgttcatatattattgcattgttaaaaaaaaattaagtttttatttgtggactgttttttcatttatatgtcatcgttttttcgatttttgtgataatggatacagatgaaaaagtacttcatatgatccacgaatttttctggagacgtactcggttcattcgataaataagaatagaatatattatataatattgcactctatgtctttctgatcggtacttgtagatttcagctaaatagagctgcctcaatttcactgctcagcgcttctctttttgtccagtttcatgtgacaaccacaacgttttgtggcaagattccaaagtttaaggttatttgagggcaatagggaacttgcataaaattttaaattcgaaaaaaatgctataaatcacaacaaaacataatttaaaatatatatcaaagaaaaaaaaagttgtttctgtctttagtttggcctctaaagacgattaaaatcgagagataattcaaattatagcagccagtccaaaacacaccctcattggtcctgacgtcatatcattataatgtttgaggtccgcgccattaattcattatgtttgatattcgtttacttgttgtaatcattttatggtatatctcagttttataaatctttaaatagttgctgtgaattaaatatttcataatatttgagagtttttgttaagacgttttttttaaaatgaccggagaggatttttctaaagggcagtatgataacttacccatcatgaagataaatctctattattattagtttattttaattttatagtaaaaataattccagaaaaatattgtataggcaaatatcattcaatctgtaatgtacacctaccaaaatataccaaaagttatattttcttatgttcaaaatacacttgatttattacacaaaaaactattaagcaggcagcagctattaaataattacattaaaaaagatgatttcacatatgaaaacttgaccgcctacccgacacgcgcagtcgctactttgacataatttctccaggactgtacactaccccttcacatttccatactgtctcttcaaaactggattaactcatagtaaaccaaatgaaataattttttatggacattaaaaagcctttaaaaaaaattatgaacaacccccccagggggcgcgcccttttttaatccttttaaaaagttttaaaaaaccaaaaaaatttaaaaattttttcttctttttaagggtttttgagggggggaaatttttggaaattttattttttaaaaaaaaattgaatataatattgtaaaaaaaaaaaaaagtgggaagtccccttttaaaaaccgtttcccccaccccacaaaattttttaaattttaaattttttaaaaatagttcaaaaaaaaaaaaaattttttttttcccaaaaaacaaacaaaaaaaaaaatttttgggagaaaatatttatattattgtgggggggggggggggggggaat

SEQ ID NO: 1598 - DNA, 977 bp, Diabrotica virgifera
cccgcgcgtccgagtgactttttcttatatctgtaatgcaaagcaaaatatcggtaatttaccgtgtttttggattcgcagtaggccacttttagaattaaaaaaaattcagttgagtatcttaaaaaatgtgaaccttcaacctctatggactgcaaaagttaaaatctgtatttattttgatatgcatatctacttacagagatagatttgttaacaaataaacgacacaaactttggtaacacacttttacaatttgactaactacttttaaaatgatatgatattatgaattatgatgatattataaaatgtaaataaaaaatggtcaaaaaaatggggacttaaattagattttttcggcggattttttttttgctagtgcaaatttgtctagatattttacagttaggtatagcctcccctggtaaaaatcacgagtcgccactgatgaaaatattttactcaagaaatgttgtgcgtcattgaaatattgtagatattggagaaatatattattattttaatccgggagcagtcgcgcggtttgaaaaaatctaacattttatccttttccgtgataactttttttttaatgttgtaatatttacaatctgtcctcaactaagaacaataggtaaattatttgataaaaattgaaaatttgacctgtagagggagatccagtgatcaccctctttacataaattaaattaaaacaaaaagtttagttatcacagattatttgaatcttcttgctaggtccactactttgaatctcttcaggcgtcgtacatcattgtgatcatcagtgaggttgctggctaactcgtttggatgagattctagtctcttggaatattttttgtaatattccgttattactgtttttatggatggcacattgaggtctttctctatcacatagtttggcacgtaccaaggggcattcagcattgttctgaaatctctgcag

SEQ ID NO: 1599 - DNA, 1897 bp, Diabrotica virgifera
caaacatatcgcaattgcacggtccattttcaaaacagatctgcagtgagatacacggttgtttttaattgaatttgttaattcgtgtttgtgagtgtgaaaacgatgtttgcaaatattttaggttgtcaggctttgctgctgctatttgtattattgatttcctgctttttccttacaaatggaagatatagatatttatatattctatataaaacatggcgccgagatttaagaggcctgtctaaagtatttcctgccatgtatagaatagccaaatgtgaaaaaaatcaggagacgatacccaagctattcacaaagatagctaaaagtagaccgcataaagttgccttctattttgaagacgaaacttggacattcggacaaatagaagattacagtaataaaatggcgaattattttatatctctgggttatgaaaaaggtgacacggttgctctcttattagaaaatagaccagaatatgctgctatctggataggattatcaaaaattggagttgtaacagctctaattaacaccaatctggtttccaaaccattgcaacattgtatatcggtggcaaaagttagggcgctaatatttggatcagattttgcaagtgccgtaaaagaaatttatcccgaatctggcgaaataaaactataccattttaagacttctccatctgcagaatcaagaaatggagtgctagatatcaaagaatgtatatctaatcagtcagtagcatccccccaaaaacacatggatatgtcaaataccaaggataagctgttatatatctatacatcagggactacagggctgcctaaagctgcaaaaattactcatgcaagattcaattttgctgtaactggaatcaattacttcctttcattaggcgaaaacgacaatttctataatcctctacccctatatcacgccactggaggaatgttaactgttggacaaactttaattttcggagtaaccatgacacttaggcgcaagttttctgcttctcacttttggacggactgcaataaatataattgtactgttgcaaactacataggtgaaacgtgcagatatatattagcagcacataaaggaaaaccaaccatagcacatggagtaaaaaaaatgtttggtaatggactcaaaaaagatgtttggaaagacttcgtagaaactttcaacatacctgaactttttgaattttatggatcgacagaaggaaacaccaatttaattaacttggataacaccattggctcagttggttttctgccattctatttgggaccaatattttcaatttgcctaattaaatgtgacgatgaaaccaaagaaccacttagagatgcaaacggactatgtattagatgtaaagacaacgagccaggtatactcataggaaaaatatacaagaaaattagtacacacaattttgatggttatgtggaccaaaaagagacgaacaagaagattttacaagatgtttttcagaagggagattcctattttaattctggggatatgatggtacaagatgagtttggatatctctattttagagacagaaccggagatacgtacagatggaaaggagaaaacgttgcaacgacggaagtcgagttggtagtaagtgacgtaattggaccgaaggacatcgtagtttatggagtagaggttccaaagaccgacggaaaagctggtatgatagctgttgctgatgaagagaaatccttagacagaaaagctttagctgaaagggtaaaagctcacctgccagcgtacgccatacctatatttctaagagttatggattcactgccgatgacaggaacttttaaagtcaagaaaaatgaactccagaaaagacggatatgacgtt

SEQ ID NO: 1600 - DNA, 607 bp, Diabrotica virgifera
ccctttaacgcgtccgggaggaagaagatttagatgatttgcccttaaatgctcttcctacaatcagctttaacaaaaagagtccttcatctaaacaggagtcgtgtaacgactcctgtttagatgaaagtcaaaagaaaacgagaaaacacaaaaaacgtaaaggaaagttacccaaaaactatgatgcactggttgcaccagatccagaacgttggttacctaaatatgagaggaccggctatagaaagaaaagagataggagagctaaagaagttattaaaggctctcaaggaactgcttctggacaagctgaacaatacgacttctctaaattcgttgaagattcatcagacactgcgagtacatcagtggatcccagtccaaggccttcatctaaatctgcccaaactcatcacaaaaagagtcaacaaaagaagaagggaaagagaagataaatatttgttgatattttctgttaaactttatattactttatacatactttatattattactgtaatgtaaattctagacaaacggcataaaataaaggtttaaaaaatgtgatttaaatattgtatatatagtgttaatatataggttt

SEQ ID NO: 1601 - DNA, 812 bp, Diabrotica virgifera
  misc_feature (792)..(804): n is a, c, g, or t
  misc_feature (806)..(807): n is a, c, g, or t
  misc_feature (809)..(809): n is a, c, g, or t
attttgtaaagcatatgggaaacatgtcgcaaaaagattctaaagtgaatgtggcagggcaaaatcaccatacccatagggatggtaatgttatttcagagattttaaggagtacactagacgtcaataaatacgcaactaaaaagacaattgctcaaggacttttggacattgctctattgactgcaaatgcatctcaattgaagtttatcttacaagttggagaagaacatcaattttatcttttaatgttgatattgatatcaaccagcataatattacaagttattcaagctgccctgtgtgtaattttgggaggatcatacgatataaataaagaacatcatcaagacaatgcaaataaaacaaacaatatcataatggtggtaaatattgtcatcatggcagtaaatgtgataataaattcctttgaaatgaagagtgaatatctgataaatatgtttcacgcagcaaaaacttcaacaacaacaatagcttcaacaatcaaatcataatatagatagcaagaagaaaaaattagatataaaatttttttactaatgacattttcgtagacgtgtatattaaaaataaaaataatctaggatagaagattaatcgcatatatattttcctttttaatcacttttatgtattatttggcgctagctacatttctagcagatgtacctattatttatttttgtataaaaattgttttttaataatataaaataaactttttaataagtattatttttatgaaataaagatatattattatgtacttcnnnnnnnnnnnnnannanaat

SEQ ID NO: 1602 - DNA, 1385 bp, Diabrotica virgifera
atctgtccttctctgtgcttgtcgtgagtaaagaattggaccacgtcaatagtacagtttaggtattacagttaggatttttattaccttttacctgttgtgcataccctctaccacgagtagatgcgggcttgccagtatctttaccttttagcataccctataccatgagtatagtgggcttgctagtatctttacctatattgtgtcttcctatcactgcccaagagagtagaggttaaggattatcttttaccttgctttttagttgttgttgatatccggaaccatatcatatacgtttagctgggcagcaatgtgggttcaactagtcctgatgaattagtccctcattgaactctcgggtgattaatagaatttgttcgctctagtgtcaatgttgggtaaagttaataggatttgttttagtttgattgttgtgaatggttctggtaatattgtgttaggggttgttaataaacgcctgtaatttagttttaatgatggtttattaacacatgagaatgtagatagtaagtagtgttaagagttaacttactctataaggttgtataattatatttagaatgtaagcgattaacgcgtaattgtttgttttttttcttcaatctttggttttactaaattaaaattatcgcgttgaataacttatgtcggtcagttacctatgtcggttagttacatatcccttctatgttttatactttctgcaaatatgattaaatatatctcgcgtggcctttatactgtctgtatgacttcgttcctgatttttgttccgcctcctcagcaaatagtatggctgttgagcctaccataattatggttttataccaccacgtttctcctttactgtgtccatcctcgggttcgccctagcgttagttcgctcaggaaaacttaaaaaaaaaaggaatcctttgggagttttcctttttttttttgctggagatgagggagaatgtagcagttacgctattaactaaataaatcccaataaaatttcatcaaatacccctaaataaattccgtgtgcgacgccgtcgatcgacttaagaacgatatctctctgctcacgcgcgaaaacctgggcggtcgattttgtcgatccggccatcgggacttcagttttggtcagactcagggcgaacacgctgtgtttttttcaatttgaatccagaactgatttttttttttgaaacaatttattttttttaaaaaaaacaagtctatttttttttctttacatttcacaagagtatatacgtttaataacttaattcagcacatttttttttttaaaaatggggattaccctcatgtctccttgtattaaatatcgagtgctcgactgaccactgatt

SEQ ID NO: 1603 - DNA, 1010 bp, Diabrotica virgifera
gagatatgtatacaagtatatttacaggcatgcagagagataaaaaattgtgataaatatatcaaaattggttagactttgaaatatttatcaaagatggtatcagtaaactggagatacatttatcccattacgactatatatctgaatttaacagtgcaagtgttatcagatttaatatttgaaaatcgttatcggattgctattggtagagttaccattctaatacaagatttggagggcgaacaagagcattgtaattacaactataatcttacgtatataggggacgaatcttgtccatttaaaatgctacaaagtacaatgtcatttaatgacatagcacaaaaaacaataattaaaaatgtaacctgtattacattgcgagacgatacgagatactatactttaataaagcattcaaatagttgtaacgtactaacattagaaataatacaaactgaaaacataaacgtatgcctagaaaaattaagtcagcaaattaataatgaatatgagaaaaaaaataacgtcaaatatttaggtaaacaactcaaaaatattaaaattgttggaagtggtgcaaatacgtcacctacttcttatattttatctgttagtaaacagacatctacagaatctgatctaactcacaccacaatcacaacttggcattggaataaatcagaactacatgcattagcacttttattgtccggcactcttatacttatcataataattttaataagcttaatatacatgatttggaaaatgtgtaaaccttttaaagccgatcaaagaaaacaatatggctatataaatatatatagagaagacagtacaactagtgacggatatctaactccaaagcttgttcagccgccccaatacgaggaacttatctacagttctccaaatctacaagccaatattgatattagagcaatgcgtgacggatacttaaagtcaagaatagtttgagccccacaatatgaagaaatatctat

SEQ ID NO: 1604 - DNA, 600 bp, Diabrotica virgifera
gtagcatttcaaacgtggttaattataggtgttaaattgattgaaaattgaaaatggctgcctactactgggtggattgtcatgcaaggggcgcactaccatctacagcacttcgaggaggtgtggatatagatggagctgaaatatttgttggtaggtcttaccacgaaggcgactggcttccagctaaagttattccaagcaaggatgttgcttatgtagcttataacggaggcgaacacgctaaagatcagtttcaggttctttgtgaacaacgctttgattgggtaccttcaggcaatggtcacgttccctttggtgctgtagaaggaggaagaacttcagatggagaaccactgtacattggcagggtgtatcatttaggatctcacaccgttggaaaggtacatccaagtcacgggacatgctatattccgtttgatggtaaagaaattggatatccccattacgaaatattggttttgagatcttgatgagattaacgttttctcatttgagcaagtgttagcaggaaatgagcttcttttatatgtaaaagaaagaacaaattaattatcttatatgtttaagcaacataat

SEQ ID NO: 1605 - DNA, 898 bp, Diabrotica virgifera
catatttgtatcgctatcactgtgttatattcagttctggtggtcgaccatcattatccactttaaccaaactttgcacaaaaatgagtatatacgaagataaaactcagagagatccataccttatccatagggaaatatgtatacctaatacgctatctacctgtaaagaatcggtctatcaattcgcaattatttcaattaataaaaaattgaaatataatatttcaacatctgaagtaacgcagtctacatgtactaatgggacctacgaaataaacacctacgacaagatcatagtgttactcatcatactctatacgtcccttgtcttcatttcaacatattttgataaatacaaaagaaataggtttagaggttatccagataagttcctattgcatttttcgttatatcgtacctggaaaaatagaacggatatttcaaaaaatgaaaattaccaaaaactattatctatgcaaggattaagagtttatatgatgctaatagtgatgttactacagcttacgctattatatattaatattcctgtaaagaatccgaactatcatcgagaccttctttacactggagtgtcacaggactggagcaagtattgacttgtttggggcacttttagaggtttctacttctttgtagaatcgtctgggcttgctactttccaagtatacgaaacgttcgaaaatagagttaaaataactttaagaaacgtcgtcgttataatagttaacagatatttcaggtttatatcagccgccatatctattagcatatttatatcaaactggatatacttagtgagcacgtcattcaattttgatgtgatgcgatatgctgagaatagttgccagcaagatttatattaacatattaatga

SEQ ID NO: 1606 - DNA, 985 bp, Diabrotica virgifera
ctctacgacaatttcccggcccggcatagatagataatttggcggtttgtactgaatactactaaacatattttctattttcattactggatagtgctggaattgctgaaattgaatatcggaacttggaattacagagaagtgatatagactaatcatcatcatcagcccctctcgatccactgctggacataggcctcccatgtttgtagacaagtagaagagacaagtagactaatagaatagaataacaggtatagtgtaggtacatgtaagtaggtaggttaataccttggctaccgtgtgagatgccagcatttgacacaaaatatcgactgtaatatcgtgtgagacgctggcttccattgttattaaatgatttaaaatgctctaaagcgagagtttttagtttctcatattggtttcaaaataaggataaaatggtacaaaattacatcttattagtttaagtgatcgctaaccaaggtgttaaacgttaataaaggtatggtagttatattgtatgtaggtacagttgagtccatggttctcattaatacctggagagataaaacacatacttgtcacttagcaccattgtgttccacgcatgacactaacgacaaaccagctactgcctgttattaagtaaacacacatgttatttttatgaacattttagactcagtacatcgaaaaaatagaggtacaaaaagacgcttgtggacgttttcagatttaagtacaatttgcaacattttctggtttgtttattgtttgtttttcacaactaattttattttggcattaatttacatacaaagttcacctcattcacacagattgtcataaccactttctgccaatgtactcaactgtaaaatagtttatcattttatagtgtaaatacaaataaaaactagtattgtaacaaaagtcagtggttttgtaagaaggtaaggtaaaaatatcaataaaggggtct

SEQ ID NO: 1607 - DNA, 1068 bp, Diabrotica virgifera
gcttaaaacatcttagttgctttgtttttatattgtatgaattgtattgtatatcctatccattatctccaatattcttgtatttctgattttatgtattcttgatattggagcagttcttctccagaattcggattttcggatttttcttttagtggtcaaaattcgctgctatatgttacaatgctgttatagatgttatgtttattttctttggagatacttttggtcccataggattgtgtttaataatgccatagctttccttccttgcgtgcacttttcttggctattcttgtccaatgttccatcttgtgtaattttaagacccaagtatttatattcctgacagtgattaatagttatttcattttccaatgatagatcctgctgtgtacctccaacacacatatattccgttttgttggtattcatttccaaaccccagtgcaggtactcttctaagattttgtgtgtcatataatattcaatatcgttataaccctaggccgtaagaatctgatcatacgcaaaacagagtgtatagcatgttatcatcagttttatttattgacttcttaattcataccattcaagtttaaattataggtctctatgcataccatatctctttattgatttttagttttcattaaaagaaaattgatttgttttttcgttctaggattgggagtatatacagactcgacaaagacatcaacttttcaaaaggataattacgaagtacagcaacattgaagataacattaatgtcattaggtgggtaaataattattttatttataataaatatttttactttaatccacatagacataagataaaaaagaactttgttggtaggtaggtatatgacaaatattttgtgttttatggacctcgataactaaaatctctgtttcctgcagtgggttcggtggactttttaaattaataactatgtccaaaaatgtaccgttaaaatggtggtcaataaattttaataattattgtacaaaattaacatacaaccaaatttttaaattacattcatgtggtgttcacaac

SEQ ID NO: 1608 - DNA, 449 bp, Diabrotica virgifera
caactaccggcaccagccgatcagtgtagccgtgacctccaagtagaaacaacgataatacaacaaccggcaatatggcgaacggcagtggtcctggttacgctactccacttgatgccatgaaaaatggcccaaaagaaaagcttatgtacgtagtttgcattaatccaaatgaaggggaagataaaaccgatcttttggcgacggtagacgttgatccggagtcaccgacatattgccagattatccatcgtttaagaactggtcacaagaacgatgagcttcaccactctggttggaatgtctgttccagctgtcacagttccacaggctgttgtaatggtcttgtcagggacaaacttattctaccggctttgggatctgacaggatttacgtagtggatgttggaaagaatccaaaggcaccagaatttcacaaaattatagaa

SEQ ID NO: 1609 - DNA, 1287 bp, Diabrotica virgifera
tgacaaaccgagaaaaactattaaagtttattaaatggtaaaataaaaagtatattactattttcgttcacaaaatatttccttcattcaagtggtcagtttaaaaagaatgattaacacatgtatttatcaaataaacatgcaccgataaagtaccttagatctacaaatttcatattccagggcatttaactgatatattataagaataattatggcttttaattatgcaaatattcattcaaatcaaaaacggcacaatgcggtgcctccgccaagcagtggcgtttccaaacagggatattctaccatgaatgcaattagtcagaatgcactatctgcagcttggggaggtagcaggaagagagttgccacggaagatgaatattttgatgatgacgaagaggagaccgttccagatttggcatatattccagcaccaggtagtcctactaggctggagatgatgcaaaagaaaaatgttgaggatgatgaagatgatcccctcgatgcttacatggcaggaattgaacagcaggtccatagagaatctcttcaaaaatcggaaccaactcaaggcatccgtaatgatttagaagaagaggatgtagaagaatcgtattatcgatatatggaagaaaatcctaatgcaggagttccacaaacagatgacgaccacccggaggtagaatatgatgaggacggaaaccctatagctccagacaagaaaaaaataattgatcctctaccccctatagatcactccacgatcgagtatcaaccgttcgaaaaagtcttttatgaagaacattcagacataaatgagcttactgacgaacaagtaaaagagttaagaaaagttttggacatttctgtaacaggtagtaatgcacccaaacctgtatcgtcttttgctcacttcggctttgaggaaaaacttatgaaagctataattaaggctgaatattcgacacctacacctattcaagctcaggctgtgccttgtgcattactaggacgagacgtcctaggtatagctcagacaggtagtggtaaaactgcagcatttttgtggcccatgatgaagcatatagcggtccagaaacccgtcgaggaaggggaaggtcccatagctatgattttggccccaaccagagaattggctcttcagatctacaatgacgccaagaaattcgcaaaagtatatgacctgagagtaatatgtgcgtatggtggtggctcgaaatgggaacaagtttggcattaaaaactggagcaaaatcgtag

SEQ ID NO: 1610 - DNA, 1153 bp, Diabrotica virgifera
cctcccgcgtccgatcgggactagaatcaacttattggttcctacacatcaaatgtatattagccggagcattgcgtatagtagataaggtagagagccacaaaacgtcagtcttagttcattgttccgacggttgggaccgaaccgcccagttgactgcccttgcgatgttattgctagatccgttctacagaacaatcaaaggatttgaaatattaatcgaaaaggaatggatgtcgtttggccacaagttccaacagagagtaggccatggagatgaccaccactcagacgctgaccgttcccccatctttttgcaattcatagactgcgtgtggcaagtaacgcaacagtttccaaacgcttttgaattcaacgaatctttccttataactatcttggaccatttatattcatgtagattcggcacatttttatttaatagcgaaagagaaagagttgtagagaaagttaaagaacataccatatcactgtggtcttacaccaacagccatttgaatctgtacagaaacccactttattgggcgaatcctttgcagcaagttgttttggtacctatagctagtattagacacattaggttatggaagacttattattgtagatggaatcccagtatgaggacgcaggatccagtttatcaaaggatacgagaattacttctgctgaaggagcagctggagcgcaccgtcgaggattaccgcaaagaacaacaagcccgagtccagagaagcagcgcttcgcccacttgatccataattgtcgagacttatgtctaaacgagtctgatgtagataagcctaaataattccactttaagattaaacgcctggtcactccggccgtttattactctttaagagaaccactttgcatttattaatgtagggaatcatttgtaaaaggttttatagcagatttgttcgggaagttgatcactggagtggccgccaatatttagtctttgtccagtttgcgcacgtttatttcatggcatatcggaaatatgtaatgtgctaatgtaaatgatattttgggatactattttgtatgtatatgtatgatataggtatatcggtatttcccaaactattcgtaggtttctagatgcttccaaaatcactaattcatc

SEQ ID NO: 1611 - DNA, 1766 bp, Diabrotica virgifera
  misc_feature (829)..(829): n is a, c, g, or t
  misc_feature (1691)..(1692): n is a, c, g, or t
cttcacgcgcgggagcgaacggtaaaaactatttaatccaaaaatagaaagctggagtttatttctctagtagtaagtgaaactaaataaccatggctcccgttgatgtggatacagttcctgtggaacctcaaataaggaacttaaacttatcaggtcatgttggctttgattcattaccagaccagttggtctcaaagagtgtccagaatggttttatctttaacataatgtgtattggtgaaacaggtttaggtaaatcaacattaatggattccctttttaacacaaactttgaatcatcaccgagtccccattccttacctacagtaaaactaaaggcacatacctatgagctgcaagaaagtaatgtaagattgaagttaacaatagtggacacagttggttatggagatcaaattaacaaggaaaacagtttcaaagccatcgtcgactacatagatgcacagtttgaaaattacctacaggaagaattaaaaattaagagatctctttccacattccacgacacaagaattcacgcctgtttatattttatatgcccaacaggtcatggactaaaatcaatagatttggtatgcatgaaacagctggatcagaaggttaacgtcattcccataatagccaaagctgacacaatatcgaaaacggaactacaaaaattcaaatctaaaatcatcgctgaacttcaaaacaatggtgtttcaatttatgaatttccagtagatgacgaatccgtttctgatatcaattccaccatgaactctcatgtaccttttgcagttatcggcagcaccgactttattanaagtagaaataaaatggtcagagcgagcaatatccatggggtactgttcaagtcgagaatgaatctcactgcgatttcgtaaaacttcgcgaaatgctgatccgcacaaatatggaagacatgcgtgaaaaaacacattgcagacactacgaattatacaggaagaaacgtctcgagcaaatgggactaagtgatgtagacgaagacaacaagccagttagttttcagcagacattcgaagccaaaagatccactcatctgcaggaattgcaacagaaggaagatgaaatgaggcagatgtttgtagtgagagtcaaagaaaaggaatctgaattaaaagaagccgagaaagagttacatgccaaatttgacaaactaaagaaggaccatacggaggaaaagaaaaaaaatagaagattcccgcaaaaagcttgaagacgaaattgtagaattcaacaggcgaaaatcacagtaccaacaaatgggtcagagccatcacactctcacccttggaaaaagtaagaaaaagtaaaatgccagtgttcgtttttgtacttttatacagattcttttatgtttttaagtattattttagagggcagtcctaatttaactaattaaccaaaataagttaaccataccataagccccctaattatattttatacagataattgaaaattgaaacgttcaaggatcattttcagcttgcatatttaaatgatcagttctctgattcaacgatacacaaattcaccgatttttactgaaagactgaatctataataagactgatatgatattcctgaaatatacaagctaaacattttaatcaaaactatttgacgaaatacacacgcgnntagaattggtcatcgtacgctaaagatcatgaaactccccgatttttttcacaaatggatattttacattttct

SEQ ID NO: 1612 - DNA, 1790 bp, Diabrotica virgifera
  misc_feature (597)..(597): n is a, c, g, or t
attatagaatagaatagtttatttttttattcaagacaaagaaaaaaatacacactggaataattaccagaataaacattgtttttgtttaaatataacgcatgacaagtttatttaagacaataaaaaccttgtatggatataagtgacaatctttactacagtcttctgagccttgtaattcttccagtatatttattcttcactttgtggagttggttaggttgggaactatttaaaaacaactgaagaatgagtcaagatctaaacttatcgttcaaaaacatgaaaaagaaccttacgcttgacctaaaccaaaagaagctaactttgcctaccacaagcggtctattgtcttcccccgatctcaatctacttaaagttgatactccagaattagagagtatgattttagctaatgggatgactaacacaccaacgccatcattactgtttcccagagctgttacagctgaacaagaaaaatttgctggtggttttgtcgaagcattaagtcacttacacaacagtaattcacagcaaggttcagacagtaatagtagcacaatctacaatgattcgtttatacctcatatncaagaagaacctcaaacagttcctaatatgaatcaatcacctccaatgtctcctgttgacatggaaataccagaacgaatgaaactagaaagaaaaagcccacgcgtccgcggacgcgtgggcaaatgcagatcaagaaaactggaaaggatttcaaaattggaagacaaagttaaattgctaaaatgtgaaaatatagaacttggatctattgttaatcaactcaaagaaactgtaggacttcttaaacttgaggccgttgagtttgtccatcagaattgaaaaggacacggtgacccctctggcacctagactaatatccctatccaatatattccaaaatctttgtggtcaagaacaaatgaatgatttaaaggaaaacatgactaaaattcttggtaacctttggaagtctacagaaagtttagtacagtaacgaactacgtgctttatctagtagtatgagtttttaagaaataaatccaaagttttctcatactagatgaaatcttctctttagacctttggttttctaaaagttactgtattatttttacttgaccatgattattgaatctgtttaataattttcaactggaatttgacaaaaaaacacaaatatacaattttcttagtcatattaaactgaaatgtgattttttgaagcagttttcttgtgcttaaaaataatttgtcaacaatacaaaactatgttagattgactacaaaaattatattttggtacgatttgtacaagattgtaaaaatattgcaaaaataaactatgtatatgtatatatttgaatgccattcttgtgatatcaagttaagtacactgaataacagaggtttcaattggaagtactctgttaacctttttcattcattttaatgcttcacctccattctctggtttattcattgatacaaatatgataattaacactgaatgacagaggtttcaattggaagtactctgttaacctttttcattcattttaatgcttcacctccattctctggtttattcattgatacaaatatgataatttctgaagtattttgtatttacaatacagtttaaacatagtaagtattgactcaattactatatccaattgtataatggactcgcatcggcaaccctttcatcatagtaagtatagtttataattacactgtttttatgcata

SEQ ID NO: 1613 - DNA, 846 bp, Diabrotica virgifera
  misc_feature (828)..(828): n is a, c, g, or t
cccacgcgtccgaagctaaagctcaagaacgtttcggtctttcgatgtcagaagtcgtcagacgggtgtcaaagaagaagaattaccctcagtaaaagcattggtattcgaactgtgttgcaacgattccactggtgaagacgtggaagttccatatgttaaatacaatttatgttgagccgactcagttcaaaactcaacttaaaagacttaagagttttgttaggtcagtttctggattaagagtacgggaaaactagccacgttttactatttacacattgtgagattgctgaccaatagttggaatacatattagcagcaagagcttgtgtcttttattatttattatttatcagctgttttttaatatttgcagacctttaaatattttttataacttttaaatgtcctttttgtattaacgtcatggcaaccactgttagtatttaaccctttcagctccgctgtaatatgtccagcatcatgacgcacttacgcgtcaaatacactggccaatagtcatctttggacgcgcgtatgcgtcaccgtagctgaaagagttaaatctctgtaatttctccaattttcgtttacccaaaaactgatctataatgaatttgggtacttgactggaaagtgtgatctaaattattcttctctcaaagaaattgtttgctgtcattttgagataggttaatgaaattaataacggaaaggattagcatttaaacacgttgatgcaatatacttataataacttgtaggagtatgtttatttttatgaaaatagtagttttcaggtaacagttattattttcttaaganattttcatgtgtgagaat

SEQ ID NO: 1614 - DNA, 1508 bp, Diabrotica virgifera
gatgagttggagtgttttgagtggttacttttgaataaaaagttaaagtatatccatataaatttgtttttcgaacttaagaaagttacaatgaataaaatgcagtacaaatttctgctgttgctatttttaatgctaatttgttgtgagttttccgatgaaaccttgcaaggcccttccgaggtatcggaaaaaaagagtaaagacagtaaaagtgaaaatgagactccaaagaaacgggaatttattgcctccattgaagaacgtgacggggcaactgcaattcgaatagaaccagctcctgatcttactaatgaacgagaaagacaaaaaggtgataacattgatagtgaaatatcagaagcagttgacttgttcatgttagatcaagctaaggttatacaaaaaatggttcaacacctggatattgtcaatagcctacaacaaaatacagcttttgatgaaccgattgaagtaccaccaattcctacaagttcagaagaagacattttaacggatgaagaacttgaagctaaaaaactatttcaaactgctcaagagttgctttacaaaaccaaaccagacaaagaagagatttttcaaatgttcatggaagcatctaataaaggcaatcctgaggcgaaagggatgttagcctgggccaaactctttggagtccctatggaacaggatatatatgtggctaaagaaatgttttctgaattggcagcaatgggtaaagcagatggacatgcaggcttaggggttctctatgctactggtttagcagtgaatgtaagtcagccaaaagctttaattcattacacttttggtgctataggtggtaatcactttgctcaaatggctctggcgtatagatattggtcaggtattacagtacccgctagttgtgagaaggcattggattattatcgccaggtagcagacaaagttagtcaaggcgtatcatttggtggcggttctgcaatacaacgaataagacttttcgatgaattagaaaatggttttgcttctggaattcttgacaacgatcttattgaatattaccagctgttggcagagaaaggagatgttcaggcacaggttggtttgggacagcttcattaccagggaggtagaggtgtagagctggattatcaaaaagcccttcactactttactcaagcggctaatgccggcaatgctttggctatggcatatttaggaaaaatatatttggatggtagtgatgaaattcctgctaataacgatactgctttcaaatactttaaaaaagcttcggatttaaataatccagtcggattaagtggattaggcttaatgtatctctatggaaaaggcgttgaaaaggattatacgaaggcacatcaatattttttgcaagatgctgaacaaggttggggtaaacgaacatcgcttctgcttattcgagcatacgaagtgatttatttttgtacactatccgttgccgggcttatggggtttat

SEQ ID NO: 1615 - DNA, 944 bp, Diabrotica virgifera
  misc_feature (860)..(860): n is a, c, g, or t
actttaacgcctagtgtcgagtctcgtgtggcatatttcaacagatactcaaatattgtcatctaagaagctggaacagggatagtcactacgggcataactgcacaagcttgagaaggctaaagaaacctaactggtgtcgcctgataccaggaattgggtatactctccatctatatttgtttgcgcctttcaagtagacttgcacctagtctcgtttggcttctttcaatagatactcaaaccttttcgtctaagcaccacaaatgcacaccctttggacatttttcggccaatgttgagctctaccacggttttctgttctgttcctattctattcttgccccacaagaagctggggaattgatgatctctacggcataccctcacatgcgggaaaaggctaaagagatctatgtggtatcacctgcaagatctttttgtggataccctgcttcttttagaattaaagcgtttatttgaggcttttggatagactttaacgcctctagagcttttttgttttgtttcaacagatactcaaaccttttccaaattgaacttcttagcagtttttttattcgttcctagtctacacatgtcccaggagaagttactgagtcgcccctagcttcaactcgaccgtgcgcaccttataaatggcgcgtatacgtataatcctttcccgggcctaccacatcgaataaaaatgtttcttgattgatcgattacatgtttcttacattgtctgtgtatatgttgtaaatgcttgtttgtttgatgtgcctaaatccgttctatgtataaatacattcctagatacttcttatgagtgatgaaatcatagtgatcgaaagtgntaacgtggggtttggtttttgaatattgtattgataacactttacctatcacagagtggtattcgattaactcaaatgaaattg

SEQ ID NO: 1616 - DNA, 1269 bp, Diabrotica virgifera
gtagaaatttagttggattgaaaattcaattttataatattaaattgacagaatattcaggttatgagtaatcaaatgctcttatacaatcaaaagtagaaaattaggtattttatttatcaagatctacaactaattttattaattatgcctgtacctagtcaagaagaaacaaataatgtaaaccaaccagaaggcaatcaagctaccacttcaaataatgcagcagatggagatcacaatgaaggtaatagaggtcccacaacaaatgatataacaataattgatccagaatgtctagaattagatctaaatcatggccgggtagataagcttcaaaactttgagccacttacatgcattgagaggttgtatttaagatggaacctaataacaaagattgaaaacctggacaccctaacaactctaattgagctcgagttatatgacaatcaaatcacgaaaattgagaatttgggatgcttagtaaacttggagattctggatttgtcgtttaacaggataaaagccatagagggattagacaatttggtcaagctgaagaaactctttctttcttcaaataagatcgctaaaattgacaatttgagtaacattccaagtttggatttgctagagttaggagataacaaaataagggaaattgaaaatcttgatgaactgactacgcttcggcagctatatcttggcaaaaataaaatcacaaaaatcaaaaacctggacagtcttaaaaacttgacatggcttaagtcttcagagcaatcgattaaccgctatagaaaatctggaaaatttaaaagagttgactggagctgtatttgtccgaaaatggtattgaaaatatagaaaaccttgacgcaaatacaaaattggaaacattagatttggcacaaaataagatcaagtcgatggacatattgcacacttgactgaattgggcgaattctggatgaaaaaaaaatgagtatctgagtttggggaaaaaggggaaaaaaatggcagcacctaaaaaatctgggggaaggatttttttggaaaagaaaaccagtttgcccaaaaaccctatgtataaaaaaaaaaggggaaaaaggactccccccttcctttgacccaaaattggtggcgaacttttttgccccttaaaaaaaattttatatttagggttaaaaaaaaaaaaaaaaaaaaattaaaaagggggtttaaaaaaaaaaaaaaaaaaaaaaaaaaaaaaaagaggggggggggggg

SEQ ID NO: 1617 - DNA, 779 bp, Diabrotica virgifera
atcaaaatggtgtttaaaaccgggttaagacttttttcaaggataaaccgatcaacaattcgtttcaaccaagcaagaatgatgagcggaagccacagtaacttcattttcagacagttgttcgacaatgtcagcagcacgtacacctatctgttgggcgatgcagttagtaaagagtgcattattatcgacccggttctggagcatgctaaacgagatttccaattgaccaaagatttaaatttgaatttgatttatgcggtcaatactcatatgcatgccgatcacatcaccggatcaggatatctaaaatgtctaacaggatgtaaaagcgtcatttcgagagctagcggagcacaggcggacatattcgttgacgaaggagattttgtacgatttggaaatcataaaattaaagttctgagcactcccggccacaccaacggatgctgctcgttttattgccaggaacaggaaatcgcctttacaggagacgctctcttaatcagaggatgtggcaggaccgacttccaagagggcgacccttccactctataccacagcgtgcataataagatattctctctgccagcaaccacgctactttatccggcgcacgattataaaggcatgacagtaacttctgtggccgaggagaaacagttcaacccccgtttaacgaaaagcttggaggaattcgtccgcatcatgaacaaccttaattttagctatcctaagcagatcgataaagccgtgccggctaacaaagtttgcggcat

SEQ ID NO: 1618 - DNA, 521 bp, Diabrotica virgifera
aatccataagaagacgtgtctacatgtgaagcgtgtccgtgaatgtgttaagttaccttttcttgataaaaacgacgagaagtgattagattttgattttattaaccaaatactgtatttcccagaatgagcagtgctgggactgggacacggatgtgtttttgtgggcgctgtcatgttcaaattgactagtatagacatgtagagtggtctttgaataattgcttattggggcctaattgttggaagtggtgttgagtacagaggagggggtgtttctcgtggagcattgttttcgctcgtgcggaatctgccgacgacttagtgtgggtttgcgatacgggggagactactacagattgtagagctaaatattaaactaatatctgctccgagtatctcacaccacaattagacagagctgagtgggtaatacctggtatgttttgaattgccgtattataaaagaagtatgcaatcactgcataatttaagatttctttagttcttattcgagggac

SEQ ID NO: 1619 - DNA, 907 bp, Diabrotica virgifera
gccgccctttttttttttttttggaccataactaataataattaaataaaaattttacatttaaaataatagagtatctaatcctagtttaaaatttaaatttcttaacttcaatttaaaaatataattttataaaaatttaaaatttcacctaataaattttattatataattataaataaatatttaattaatataaataaaattaaattatattatttgtataaccgcaactgctggcacaaattaagtcaatattatttaaaatttctaattccaaatttctttaataattaaatttatctactgcaatctattctcaaataaaatttactgcaattttaagtaccttcggtatcttgatgttttttatatttttgctacgtagattagatttttcgatggtaccaggctgaaaagccgtcgaataatttgttattgacagtttatttgtttaaattattgtatcttctaaaccattaaagatatttaattttaccaaaatgaaaatggttccttgtgaaaaaattaaaaaatggcgtctggtaaactttgatacgattgttagaaccggaattataacagatttcatgaaaaacaattgcaaaataggcatttgatgtagtagtacgttctttaacggtaaaatattgcaaaacctctaaattttacagaacttcttggattgacattaaatttggaaaacacatagccaacaagtcgaagaaaaagtgatattgtggctggggggtgggttcacctctttcttggggggttaaaaaaatatacgtacaaagtaagtccggaaatggataacctgattaattttaagtaacttttgttttatagagttttttcattaagtcaatacttttcgagttatttacgagtaaatatgttcattttt

SEQ ID NO: 1620 - DNA, 952 bp, Diabrotica virgifera
taattttcaacattggaaattgaaaaatatttcacatatgttattttatgtaaaagaatatttatatttattgtttgttaattttttatgaaaatagaagtatgagtttcctgcaggagtttcaggtagtcgtgctagctgctggtaaaggctcaagaatatcagaaattaccacaggaaagcctaaatgccttttgcccataggaccaaaacctcttgtttggtatcccttgtacaaactacaatcatcaggttttcacgatgttattttggttgttctggaacatcaaaagactgaaattcagagtacattggaaaagagtgatttggaaataaaaatagactatttcaccataagtgacaatgaagatctaggtactgctgacagtttaagactcatccatgacaaactgaaatcagatgtgttagtagtatcttgtgattttattagtgacgtgaatctgaagggactcctagatcagtttagagcaaataatgcatctgttgcatctttattaatacaaccccaaagcaatgaacccattattgtgccagggccaaagtctaaacacaaaccagaacgagacttgattggtgttgacacacagacaaacagaattgtatttttggcatctgctagtgatttcgaaaatgagatctcgttacccatgtctctcctaaataaacacacaagcattaaaatgtacagcaacctaaccgattctcacatatatgtactcaaaaattgggttataaagtatcttaaaagtgaagatagttttacttcattgaaaggcgagctgttaccacacattattaaaaagcagctaggaaggccaccgaaaccggtagacacaaaagaatccatactaaatacaaaagattcaggagacatatttgcatatgctaaagaagatgaactgaaatttacaattaaaaagctatcattttt

SEQ ID NO: 1621 - DNA, 943 bp, Diabrotica virgifera
  misc_feature (910)..(910): n is a, c, g, or t
tcttaaaacattattgataataataatcgtcgtacaagtgcattgtaaaagccaaaccttggacgccattggtaattttgttagacaatttagggaatccttaaatgtaagcgattctaaatttaaccaagattctgatgtgggacttgatatttatcagtttttgcgaaagtataaatatccagtggaaactcactgggtagaaactgaagacggttatgttcttcgaatgcaacgattagtaggcggtaaagatggagtttactctgacaatagtaataaaccggctgttcttctcatgcatggtctattaagtagtgctatggattttgttaatgttggaccaaatagatcaatcgcgttgatgttggcagatgcaggatacgacgtttggttggggaataatagagggactacttggtctacgatgcataagacattagatcctgataatgatccggaatactatgactacagctttgatacgtgtggatattacgatctaccagcaaaaattgactacatcattaagcaaacaggccagaaaaaaatattctacataggccactctcaaggaacatcgcaattttttgccatggcagcattaagaccagaatacaacgaaaaaatcgctctaatgacagcgttagcacctgttgcatatatgacgcatatggcttctccattactgaggctattagctcaataccaagagatttttgagtttttgttagtggatgttttaaaatttcataatttattgccttattcatggatctatagagtatttgctgaaatctcagaaagagaattcgaaaagatgaaaccagaagacaaagacaaatttggtataccgctgtttcttctctgcggatttattacagacaattcgatgcgaatcttcttcccnatatagtatccaatgcgcctgctggtatatcta

SEQ ID NO: 1622 - DNA, 2529 bp, Diabrotica virgifera
  misc_feature (2497)..(2497): n is a, c, g, or t
agaaaaggtgggaaatgttgactgttgtagctgattaaggggtgtattctatatttcggttgaatttgagaggcttttaaaatttaacgtttagcagtcttctttttagaataacattgacattctataaagacgttagagaggttcactaaaaaatattaggaatccactacaaggttttcaatagggcattctaacatgtcaaaattaaatcaatatggcggctgacgggcaaacaaatgttatttgtcagttcttaatatggttttagattcgtttttagttgcctttctttgtaattttgttttgtacaatgattaatttaacattttcagtggaagaattaatttaaaaagataatattcctcatttctgttgtgttttgaggtgtggaatgcgaagtaattgtgataaagttcagttttatcagttaccatgagtgcaaattttgagtgaaatgagagaagaacagtggttaaatgctataaaaggtcctataaaaatgctaaataactacctgtgccatgctagtagtctaccaacaactttcaaaaatattcactcatgttcatttattcaccggttaaaactaaataaagtcgttcaagtaattctacaactaaaaacttcacaaaactgacaaacaaaatgttcggaaaatacaactagaaaactattaaaggtaaaaaacaaaatgtggtacaaatataaacagagacaagttttgtatttccgaccatattggtgtcatcaacgtcaggtctcgaaatgccctgttagatacagcaaattgatcgtgtttaaactacttgtaatgtagaagttgtccaaaaactgtcagaggccaaaacacttaaaaataagaaattgacatgaagtgaagacttcttttttagctaaatctattgtaagaaatcctttcgcaaaaaacgatcgcagaaacttttccatccacatcggggcggatatcagagaataataacttaaatagtagtagattttgcgttgtggtgaaaaaaaaaatagagattggaacacattaaaaatattcataaatctattagagctagaaattttaagtgtaacacatgtggtaaaacattctttttaaagggaatcactctggagcatcctagcatgtgttctacgatagttcatcatagtactctcttttttttgtaactcattttcccattaatcatttttatttatcaaactatttaattataaagttacgattttaagggatatagaatacaaaaatattgtaacagacggtaaaattttagaggcctcttaaatttaacgaaagtgttacagaatacacccctaaggcaagattaaaaaacggaaacgaaggaagaggaaattgctggaaattttagtaattctcacattgtttccgaaaactcaggaaattatctgaaaaactgcaaccgatatttcataatgttgccagatttctgcaaatgattgtattttaccctccagtattcgcgtagattttcaggagaagcatagttgcatcgagagaccgatattaattgaacgttagtttttgaaaaaaaaaagccccaacaacttgggcttttaggatgaataatacgtacatattcttcaagaaacagaaattttaatcagataaactaaatgtggtattactgttaatgcagagaaggttcctatcttcaatgagatgatggcgaccacattgacccatcttattctattcacatcagtcttgcctattcacaatcttgccttgtagaatcaactgtatgaaaattaaaaatctaatttttatattgaaatggtgtagaagacaatgcttaaaaattgagaaaattgtcattacaaacaacggtatttgaagatggatcgtatgaagacgaggataccgaatacacagtaaatatgtgtaaataagatcacgagaactagacgaaaaacacagaaaggaacttagtgaaaacaatagttgatcagaaccactaaatgttagtatggaaaacagggaagaagatgaaagtgaaatgactgaagatcaaccagtaggaaatggcattaataatacatgtatatcttgagcgcagaaacgacgaaataaaaaggaactcgaagcaaaggaaaggaaaaatctaattttagagcaagctaagaagaataaagagggacccagaattgttaaaatccttaaaatcagctgtagacgcagtactaccatacaacgtgacacagtgtgacaaacaaaatttcgaccaatcacgtgccgaattttatacaattttcgatacaagaacttgcatattgtcatacagggcacaaatgtacgtacaagaaacgatacaagaaaatgtatatcagaaacgatattagaaatgatacaagaaaatgcatagtgtcatacagccataagttggtaaattatttaaagttgcagcagattttatgagacaaaacaaagatgacttcataccatttatgtgcaattaattangtaaatccgaagttagtagcgaggagcagttt

SEQ ID NO: 1623 - DNA, 1173 bp, Diabrotica virgifera
gtccgcccacgcaaccgcccacgcgtccgcccacgcgtccgcccacgcgtccgacgacacgatcatcatgaaggccttgattgtccttagcgtttgcttttgcttaactctagctgccgaatccgagaaaaaggaagtaacgcaggagagtaaaaaacaagagaaacgcggtctttacggccttggtgatcatggtggaggattcggcctaggcggccacgattttggaggcggccatgattttggaggcggtgattacggaggtcatcaagaacaccacgaacacgtaaaaacggtcgtagttgaaaagaaaattccaactccttacgaagtagtcaagcatgtgccttacaccgtagaaaagaaagtaccatacgaggtcaaagtaccagtaccacaaccttacgaggtgtacaaaaaagtaccatatccagtaaaggaaattattaaggtgcctgtaatcgtaccacaaccgtacgaagttattaaaaaagtaccatatgaggtaaaagtacctgtacccagaccttatgaagtcaaaattcacgtaccacagccttataccgttgaaaggaaagtaccagtgcctgttaaagtaccagtcccacaaccctacactgtctacaaaaaagttccttacccagtcaaagttgaagtaccagttccccaaccttacaccgtagaaaagaaagtaccctatgaagttaaagtaccagtcgacaggccatacacagtccatgttcccaaaccttacccagttacagttgaaaaacacgttccttacccagtcgaaaaaccagttccttatgaagttaaaattcctattgataaaccataccctgtgatcgttcccaagcctgtaccttatcacgttaaagtaccagtacctcaaccttacactgtagaaaagaaggtgccagtagaagtagaaaaacctgttccagtgccagttaaggtacatgtggacaaaccatacccagtcattaaagaagtaccagtgccagtagaaaaaccagtaccctacccagtgaaggtaccagtacatgtcccagtccacattcctcaccatcacgaagaagtcggtcatggtggtggtggtgatggcggttatgggggttatggcggaggtgattatggcggtcaggattttggaggtcatggtgactaccactg

SEQ ID NO: 1624 - DNA, 1005 bp, Diabrotica virgifera
gtgaaatctattaatgcatgtttagtagatttacctgactggaatccatattggaattttggtatgatattgtggttttcgagaaagttgttgagcctctcttttaggattagctcaagaactttacccagagtattgattaatgaaattggtctataggattccacgtcggttgggggtttgccttttttcaaaagcatgatggtgttggccactttccaaggagtaggaaagtggctgtttttgagacatgcattgaatattttagttagaagaggaatgatactctctggaagttttttgaggcaccttcggttgatgccatcaggtccgggagcgctgtttttgccgatttggcaaaagctctccgtttccctgtctgtgagggggtccatgataggatcatagactggaatgtagtggttgagagtaacatttacaatgtattctgtgttgaatttaaatatgcgatcaaagtacgggttatctggcgtttgaaaattgttttgaagcgaatttctgaatgcttcggctttcccttctggggaattgactatgtgattgttgaccaacagatgagatggttgagataatttttgttttgttaggactttgaatttttgccagaatttacctccgtctctgtagtccagttttgaggtagcatcttcccaccggcgagccgttaggacagatatctccctctttatcctggcacagatccggttgtactctgttttgattagtgggtttctgttggccttgtattgacgtagaagacgtcgtttttgttgaattttggcaatgatgtattgtggaagtgccggtgatgtataagttatttgtttgagtggaattgcgtgcgtgatcgcctcagtgatgaggttctcgatatcggttgcacttgtgtcgatactatcgttagtatcgagttcgcctaacattgggagattttgtgtgatgaagttttggaattcagtccagttagcgtgacgatagtctctt

SEQ ID NO: 1625 - DNA, 2062 bp, Diabrotica virgifera
  misc_feature (1962)..(1962): n is a, c, g, or t
  misc_feature (1975)..(1975): n is a, c, g, or t
gaactattttattagaaatcactaaatttttaaattttacctgtgactagagaacattgttatattaaggtatttttatgtaggtattttttctataaattcctgttactgtaaaggaaaaataacacattaataagttgtaggttcatatcattattattaatatattttgatgtttatattaaataccgatatagttcgacgttcagatgcttcctgctcggatacttggtcatatacaaagaaatgagcaattaagaaatgaaataaataggtataatatagaggagaataatgagaagggaaagtgatgcatttactttaggagtttgtagatctatttatatcaacaacagacatagtgaactatttaattattaattattattaatatattttgatgtttatattaaatactgatatagttcgacttttagatgcttcctgctcatatacaaagaaatgagcaattaagaaacgaaataaataggtataatatagaggacaataatgagaagggaaagtgatgcatttactttaggagtttgtagatttatttatattaacaacagacatggtgaactatttttttgagaggcttatacctcataatatgtgataatccgttcatccaagcagtgttgagccttcactgtaaatttttacctcacttatttttatgcaataagttcctatcaaagagtagtcggtcagagctatcagttatttttcgtccgctataacttttcccacgtgtagcgattcattttcaaacaaattaagtcaaaacataaagtgaaatgaacgttgatgtgtatatacattttgtatactaatatactaagcacatcggcgtacgtttcactttatgcctatatataactactatatcaattgcctaaaatactgttagcaaccgtttaaatgatgtaacaaatttaacaattgaacatctaagtgaagagtcgattatctttcctactacattcgttcaaaaagagaattttaaaagaaaatttatgcagaagtttaactttcctggctgtgtaggggccatagtttgcacacatgttgctataattgctccaacggaacgggaacataactatcttaatagaaaagttatctttctaaaaatgtccaaattgtaacactcgttatataacactacttacttgtaatattatattatgtactatatgctgccaataatcaatttataaaaataatgtattatcacataatatattatattgcaaatatcgcaaaaatttgtagtatttgttgatatttgtgttgaaaaaactttgactaacaaaataaagaataagtaaaaaattacaatcttttaggcgtgtgatccagacttaaaaattttaaacatcgatgctagatggggaggtgcaacacatgatgctggagaaactcaaatgtaaaacttttttgcagcagatcgtttaaaatagagatcaaagcattttccatttctattctggcaaagattactttcacttcttagttatctttgctggacggtgaagctttatatcttattatgaagtattttgaacataaaacttttgttttatggatgcattgatcaaatatcttaaagaaatgtttatttaaagtttcataataatttttataagtagtttaatattattacttatttttgcactagaaataataattgtaaagcttcattgactaatggccagtttcaccaaagatgaatagtagtttattcgatgaataaaattattcaactgataaaactgacacaactatgtttctctaacgtcaaatagtacttattttatttatttatcaaataaatatttactcttcaaatgaattgacgagttaatctcactttaaatatctatataaagaaaatttgtcaatttaattttaaattatcaaactattcactgatttatttgttgttggtgaaactgnccatagagagtanaattgcattatttttcaatttacataaatttgtggtttatttgtgatttattctttgttcttattttagtcttggtatgaaacaatg

SEQ ID NO: 1626 - DNA, 1091 bp, Diabrotica virgifera
ctcctcgcgtccggtaaaactggcaataaagaaaacgatgagtgtaagaataatgtcataaaagctttggatggtcaaaaatctagtattaaagacatttcacaagatctgaaaaatctccatggtcaggtaaaacagctaccaccaaaagacgtaattaataagttacaaaattctattaacaactgtcaagacgcttcattaaaacaagctttacataagatcgaaggtatattgaataagagccacgatgagtctacgaaaactcttaatgtactgacaaaatttactaatacttttaacaaaagcctggataacaccaattacgcgatcaattcccagaaatctagtgcgaaagatatcttacaaaatattaaaagtatacaaaatcaacttcataaactaccccagatagaagaattggcaacaagtcagcgagaaactaataaaaaattagaaattaccatgaaaaacattgataatgtgagagacgtcagtaacatggttgttggcacaaccaacaatatcttggataattgttctaaaacaaataatggtttagattctcaaaagtctttacaagaaattttaaataatgttaaaaacctacaaagccaacgtcaaaatattccacagattgatcaattagcagctgctcaacgagccgctgtgaataaattagatgatgctgtgaaaaatatccatggtttaacggaagtcacagctactcttatgaaaaatattgccaacacaaacagtgctttggacgttcagaaatcaaatacacaagaaattttaaacaacattaaaaacgtacaaaatcagcttccacaaataaatgaactgtctgctggacagagaactgccattaacaagttggaagatacattaaagaatatcaatggtttgacagaaattactggtactcttatgaagagctttgctaatacaaataatgcattagaccttcagaaatcaagtatgcaagaagttctaagcaatattaaaaacgtacaaaatcacccttccacaaataaatgaactgtctattggacaaagaaatgccagaaacacattggaagatatatttg

SEQ ID NO: 1627 - DNA, 1030 bp, Diabrotica virgifera
tgattatataggtttttaagtttataactgttccttactgttttaaaaagtgattttataatttcagtggaagttggtgaagattaatcataaaattaagtaactgagtacaaatcttcaataaaaacaacacacctttttactaatataagcaatattaaaaaacggaatatgggtaacgaaatgtcttcaactgctatggaaaagcacctcttcaacctgaaatttgccgtgaaggaactagagagaaactccaagagatgcgaaaaggaggaaaaacaagaaaaggccaaaaccaaacaagccatccaaaaaggaaacatggaagtagctaggatacatgccgaaaatgcaattcgacaaaaaaatcaatccgtcaattacttacgaatgtccgctagggtagatgctgtagctagtaagattcagtcggctgttaccactaggaaagtaaccaattccatggcaggagtggtgaaagccatggatgtggctatgaagagtatgaatctggagaagatatctcaagttatggataagtttgagcaacaattcgaagatctgggtgtgcaaacggatgtattagaaaataccatgggccaaactactactacgcttatacctcaaaatgatgtggattcacttatgcaacaagtagctgatgaagctggattggaattgaacatggaactgccagaaggacctcaaagctccgcagtgagcacctctacggtggttcacgaacaggacgaactgacccaacgattggccagattgagacagggcgaatagaaccgccgcgcttaagtgatatggacaataaaaatattatgatctactattttatattctaagcttcgataatttgtcagccattttgctggagattatgaactatcatgaaaatatttttgtataatgatgtgtaaaaagggatattgatatttggatattataataaaaattggaaaaaggttcggtgataaattacttttttggatttgggaaaaaaaaaaaaaaaaaggggggg

SEQ ID NO: 1628 - DNA, 943 bp, Diabrotica virgifera
ccggacgcgtggggaaaaaagtttttctgtcgtatcgtgttcaaacttttggtatttttaccaattattcaattaaattaattgtaaatttttttagtactcaagcataaatcataatggagtgttatgcaaataaattgaaagagtttgccaaagaattatattccattaacgctataaaatttggagaatataagactaaaattgggattatgactcctgtttactgtgatctaagagttattgttagctatcctaaactactggtgactctatctgatcttatgattcagaaagtaaataatataaacaattttaacctactatgtggagttccatatacagcattgcccattgcaactgtactgtctacaaaaacaaacattcccatggtgatgcgacgaaaagaagccaaagattacggaacaaagaaactcatcgaaggaatattcgagcctggtcaaaattgtctcataatagaagatgtcataacttctggcagttcaattttggaaactgtaaaagatcttaaagacgcaggtttgaattgtactgacgctcttattttattgaatagagaacaaggaggtgaagcttttttgaataataatggtattaaggttcattctttgctgggtatgatgcagctaatggaaatgttgaaagaagcaggttgtgtggatgagaaaatggtagagaaagtaagaagctatttggcttcaacgaaagttgataaaacagctttgaatcatattacagaaaatcggcttaatgtgtcattccgatccagagctctgaaagccaaaaaccctgttgcacaaaagctgttccaaataatgcagacgaaacaatcaaccctatgcgtagcagcaaatctgttgcattcaactgacttattaaacttggcagaaaaaagggggtccaaagcatatgtgcccttaaa

SEQ ID NO: 1629 - DNA, 916 bp, Diabrotica virgifera
gaatcattcaaaataataagaatacgattgattgattgtaaatgtggattcgccaatgttcctatttttcataacaacaaattggtttattacttaatcattcaaaaataaacactcaagagaagacaaatgtacaatcgacgactgtcatttctactaaccaggaagcctccgctatttaatgtactttaggtactgaacatttctagaagtctaaataatgggacctgtaagagtacaagcgaaatattccagtaacagtgctaatttgttcaatctcattgaaaaacgggcttctggttttgttaaagatccactaaatatacgtgattctgtggcttttaaactatacagtaatttttaccaatatgatgggaataatgtaggatattactccaaaagtggcctaggtggaattttcaatttagaattcagtcttgatgggagattattggttgctgcatgtgaagggaaacagataatactatttgatgcagcaaatcaaaaattaatgtataaaatttctgatgcccatcagaactgtgttaattgtgtgaagtttctcgatgataaacagtttgccacatgttcagatgatacatcgataaaattgtgggatatacgaaatttaaaaaaatgtacgaagactcttcatggacactccaattgggtaaaaaatattgaatggtctcaaaaagaacaaatgatggttacatcagctttcgatggcagtatatatgcatggaacttaaaaactccaaacgattctaacacgatgtatgataaagtttttttgatgaatggtttaatgaggatgaaattaacaaatgatggttcaaagatggttatatctactactaatggttttatgattattatttcatgatttgacctgctttacttagctacagactta

SEQ ID NO: 1630 - DNA, 479 bp, Diabrotica virgifera
gttttcaaataaaacatattcataatcttaaaaaagtgtacagtcaagcaataattgtttaaattagaaccgtataaatattgaaattattttcaagatgaagggttttatttttatttttcttgctattgctgcagttcaagcattaagtgataatgaagaatgggtacagtttaaggtaaaacaaggcaaaagctacaggaattacgtcgaagaacaaaagaggttcacaatttttcaagaaaatttaagaaaaatcgaaaatcacaatgaaaaatattaccatggactatccacttttaaattgggagtaactaaattttcagatttgactgaaaaagaatttgccgatatgttaggactttctaaaactgacaaacccactaaaccccgtatgacacattcactcactccagtaaaagatcttccatccatgtttgattggagagagaaaggagcagtcaccgaggtcaagaatc

SEQ ID NO: 1631 - DNA, 990 bp, Diabrotica virgifera
aatttataaacaaaaatggcacgtcccgcagcaacaagacgtggacgaacttttcgaaataaaaaattatttttacattggaaattaccaacaatgcataaacgaggcacaaaaactcagaaagccgtcaacgcccgaagtagcagtccaaagagacttctacacctaccggtcctatatggcccaaaataaattcctagtagtattagacgaaatccacggggcatctcccccagaaatccaacccctgaaatacctcgctgactacttagcaggcaaaatcaagaaggattctgtggtggctcaagtggagcaacaagtccaagcaaatgctaacaatgatactctaattttggtagcagctactatttatgttaacgaaggcaatcttgatgctgcgtataaagttttgcacgctacagaaagcctcgaagcaatggcctttattatagatatacttttgaaattggatagagtagatttggcaaggaagaagctgaaagagatgcaagataaggacgatgatgcaactttaacacaactggctcaagcttggattaatgtatccactggtggagataaactccaggacgcctactatatttaccaagaacttgtagacaaatatggatccactccattgttgctaaacggacaagcagtgactttcattggccaagccaaatatgaggaagccgaagcagctcttcaagaagcacttgataaggatgccaactatcctgatacacttgttaacatgatcacccttcagagacatatggccaaagcacctgagattgctaatagatatctgtctcagttgaaggatgcaaatcctgatcatccatacattcgtgatctgaagataaaagaaaatgattttcacaggatttgccagcaatattccccttcagtttctaccattccagcttgattgtattattttgtatagaattattaataaatatttaataaatgtaaatttcagat

SEQ ID NO: 1632 - DNA, 967 bp, Diabrotica virgifera
  misc_feature (908)..(908): n is a, c, g, or t
cgaagacgtcttcaatcaagtttgtgttgcgattgtgatagtgtcctgcaggaatatatataaaaaatggcgccaacagtatttccgtacgaaaacttcagagacgatgaagacgcacaagcgttaaaagatgccatggatggtctaggaacgaacgaaaatgctatcatcgagattttagcaaggagaacaaatgaacaaagacggcaaattgaacatacttacaaaaccatgtttggagaggacctaatagaaactctaaaaggggaactaggaggcgatttcgaggacgtaatactggctctgatgaaagagccgttggacttccaagttgaagaattacatagagcgatcagtggaatgggaacagacgacgattccttggtagaaatattggttgtacatgacaacgaagagattcaacgtctctccgagaggtaccaagaattgtatgaaacttctttagaagacgccattagaggtgatgagtcaggcacgttacaaagacttctcgtttctttgtcaacgggtggtagagacgactctggattggttgacaaaaactcagccattgccgatgcccaagcactatacgatgccggtgaatcatcgtggggaactgaagaatctgttttcaattccattctttgcctaaaaaataaaagacaacttaaactcattttcgacgaatacgaaactatgatcggacattccattgaagacgccatcgacaatgaattctcaggaagtaccaaaaatgcttacttagccctagtaacgtcaattagggatagacccgtgtacttggccaccaaactccacgacgcaatgcatggtatgggcacagacgacaaaacacttatcagaattatagtatctagatcagaaatagatcttgaagatattanagaagcctatgaggccaatacgctaagactttgtacggacgggtgtcggatgatgctac

SEQ ID NO: 1633 - DNA, 1606 bp, Diabrotica virgifera
cgtgctctggtgtaggataggggtacacaaagttattggaagatacaaatacacataaacattaataagtaatattttaaggcacaggcaattatggggttgacaaaacaatatttgagatacgttccatcaggcaactttaacattattgccacccaatcctgtaatgtgtgctttataacgttggaaggacaggtcggaagatttgtggccgttggagcttgtgaacacattattatttgggatttaagattaggagaaaaggctcaaattttacctggagaaaaggctgttgtaactgcaataactgctagtcctaataaacgtcatctagctgcaggttattcaaatggaaacatacaaatttatgatttaaaatcatccgagatcatcagtatattttctggccatagatcagaaattacaactttaatttatgacagatttggccacaagttagcttctggatcaaaggataccgatgttatagtgtgggatacagttgccgaggtagggctatgtagactgactggacataagggaatggttacacaattgcagtttatgaaaggtcacccaatcttaatatcagcttcaaaagacagttttgtcaaattttgggacttagagacgcatcattgtttcaaaactttaacaggacaccaaactgaagtatggactatagcgttaatgaaagatgatgaatatcttgtaactggatgtggagatgctgaactaagagtatacaaactttcatttaaagatccagatagtgaaaataaaaatatagaatatttgtcatcaagattagaattaacgtcacttgaagaatcagaatattttacgcatcctttacaatgtcataaagtaggtgcacttcttagacgcggacggggaagggttatatcaatgtatagtgatattacaggacaaattcttggatgccacggtacagatatgcagatagaattttttcagtttttatatgaagaagatgcacagttaagacttaagaagaggcttaaaaaggaaaaaaagaagaatagatgtgaagaaaatgcaaatacataccaagataaaaacttactaagtttacgagacgaagttaaaagatttcatccgttaaagctgtctgacaaacctaaaagtttccatttagttcttggtagtggaggagaacttcgtgttgccgtcaacctcaccaataatatagtcgaactgtatacaattcaatcgtcagtgaaagattcagacccgaaacttctgagatctatttcaaatcaaggacacagaacagagataagatcagtttgttttagtagtgataatttggcaatagcgtctggaagtgcggagtcagttaaaatgtggaataggccatcacaaacttgtttgaggactattaggactgagtatatattgtctactgtatttgcacctggcgacagacatcttctagctggattaaaaaatggaaaatttttgattatggacatttcaacaggcgatattttagaagaaattcaagcacatgctaccgaactatggtctgtacatttgacacctgatttgagagggtgtgtaactggaggtggtgagattacgg

SEQ ID NO: 1634 - DNA, 975 bp, Diabrotica virgifera
ataaaatgaattgatgtaagaactaaaaatataacaatgaaaataaggcaaaagatgtaaaatttatcttaaacagataattaatatagaacatgaacataaaatatgaatactttatcagaagagtttgagagaagttgggtaacttctcttataggaatatttttgttatgttttggaatttggctactcacttggaatgagggtagggcagttcatcatgctcactccttggatgaaacatacaataacgcaataattctgaatttatatgaaaaaccttcagaggaacataatggtaaagtagttcatgtaaccggcagtcttcaaattgaagagcctttgactgaggttgactatggtatagccatccaagcagttaaattgaaaagaagggtgcaaatgtaccagtgggtagaagaaagaacaccaagaccagatgatgataataatatggaaaccatgggtacaatgacaaatgattattactatataacagagtggagggacaaattggtagatagcaatggtttttatatcagacatggccatgaaaaccccaaggaaataccattaacatcagtaacatatgtttctcctacagtaaaattggggcacttacaagtaggtaatgaaataaaagataaattcgatgattttattgaagttaccagtgatgaaagaccagacagaagagatgttaaacttcatatgggtatatattaccactgtgacgatatttggaatccagaagtaggggatatacgggttcagttttattatgccggtggctcaggtgaacctgtcactataatagcaaagcaagaaagtggggatgttaattccttatgaaacatcaaaaggtcacaaaattgctctactgagaccagggaacttaacataaatcagatgttttctggcgagcattttgatgcgagattggaaacatggaaaatacgaggaataaggtttttt

SEQ ID NO: 1635 - DNA, 864 bp, Diabrotica virgifera
agcagtaggagagaaagagaaatgccgtctttgacaatatttttagtgggtgacagtttttgaatttgggagtgagactttgtagtaaatatagacaagaaggaaagcagtttatctgtattggagtagtatcaaaaactcattagtcattgttgagcaaaaaaatcactaaatttacaaatggatcagaaaacctcgttcacttgtgcatctaaaaataaccaatggttcaagaggtagaatagtccaacaatagtaagttttttctttcatattgtcaatcatggaatccataactacaaaatgtgcaaaaatgtgcctcagtactaaaaaaattcgtatgttttaggtcgaatccagtgtttcacaacagagccagttcgcaacaggaggtggtgtgttttacgttcctccaaggagaatcaagttggaaatggaggaattcggcgacctatcgtcgttcgtttccccccaacggataatatccaatgctgtagatgaactcaatactccagtcttcgataaggatgcttttgatttcgacatcagcagttatcagacaaatgttcaggcgcacctcatgctgaagtgcgatgctgcgttcttccgcgaaaacagctcccttaatccactaaacaaccaagaggacgttttcatcaacccggagaacatgcatcgaaacgcagtagcatttaataatcaacaactatacactgacgccgatatttattcgcccacagcgtcagaaaatggtacatacattgttaaacagtccccggacaactcatccatgttcgacatggacataaacagtagtgttagtgttagaagtagtagtagtagacattcttcttatccatcggt

SEQ ID NO: 1636 - DNA, 2197 bp, Diabrotica virgifera
ttctacgcgtccgcggacgcgtgggcgactataccagagaacagacgtgtttctgctttggttctgacgggaatttttgaaaatagtttttaaaaaaagttttgatcgctagtagtgtttaattgtgttcctttttgcgattcaactacctacatttgttaaaaaggttgttgatcaacaaagtttttgagtgaaggcaacgaaaggcgttttgagttgagcgttcataaacctcagctcaattcctggtaaaggaagttcagaagtcaacatttctagaagaagacaaggcgaatctaattccctgtcaacatggtccctgccagcaaagttcaccacctttgtggatcctatcgagaaatacctgtcgcatacccggcacgaggtcggggtaagcttgcgcgagcaaatcgaggaggacttgatgacggcgacggagaaaaggcactcgttcgaaagcagtgccatagatccagtttcgtttatgtatgtggacccgtacgacgtgaatccattatccagaagctcagatttgccccccgcaacgatactagcagatataccgctcaaggtcgaatccagtgtttcacaacagagccagttcgcaacaggaggtggtgtgttttacgttcctccaaggagaatcaagttggaaatggaggaattcggcgacctatcgtcgttcgtttccccccaacggataatatccaatgctgtagatgaactcaatactccagtcttcgataaggatgcttttgatttcgacatcagcagttatcagacaaatgttcaggcgcacctcatgctgaagtgcgatgctgcgttcttccgcgaaaacagctcccttaatccactaaacaaccaagaggacgttttcatcaacccggagaacatgcatcgaaacgcagtagcatttaataatcaacaactatacactgacgccgatatttattcgcccacagcgtcagaaaatggtacatacattgttaaacagtccccggacaactcatccatgttcgacatggacataaacagtagtgttagtgttagaagtagtagtagtagacattcttcttatccatcgtcgccggtgggctccgtcgtccgccctgcggcgacggagacccccgacgatagtgaaatgtcgttccagtccagttcttcgtcgaagcctaggctgtccttggatctcggtctggtacaccagaccaactttttagatgtcaatacgcctagcatcatcgccgaagtggttagcttggaatcgactggttttaacatcttggatctcgttaaagaggacgatatacaattcgtaaatgacgtttttcccgatgcgtcaacctcaaccccaccatccaatgtgtcgcaaaaagttgccgtcaaacaaccgagaaggcggcatagaatggccgatgatgacgacgacgaagactacgttccgccttctatgaagacgagcagatatcccgtagctcatgactattcctcagacagcgaggacgagaagcctctgaagaagaaggcgagaggcagaccccctaagaggacgcagtctatttcgtcagactgttccaaagatagcgacgtttcaaaatatagggaattgagggacaaaaacaacgaagcttctcgaaaatcgaggatgaagagaaaagtaaaagaactggaaatggataaggaagcagatgaacttcacaacaaaaatattaagttaaaagcacaagttgaagaactagaaaagatggttaataatttcagggataaccttttcaagataatgataaataaataagtagttttagtcatttagattatataataatcgttgttgcacatacaaattggaatattagttatatgttattatatcgacagagaaaaatttgtgtgtgcttttaaatatttaatgtgatttaacaattttttactattttttttatattatattatatacgtgttagtttatatcacctagagactaagggtgttctgtggtgggatttttattagttgtttttggttccaccatatagaccttataataaggtcgaacttgtgtttttttgtgagtgaagagactgcaaatgttttagtataacactaaagattactatttttaatactaaaaagatggattggaccctggattttacttatttattatggaatcaataaaaaaaaaaattttttgggg

SEQ ID NO: 1637 - DNA, 909 bp, Diabrotica virgifera
  misc_feature (26)..(26): n is a, c, g, or t
cattacgcgtccgcaaccaacataantggaaaaaatataaattattattttgaattatttatagtgtaatatactatatactgccatggcaggacagttagcaaatgtagtaaaaacctttcaaaaattaacaatagcctcaagatgtagaattgtcggtactattattaatcctgtaaaagagcatgaaccccaaattttgactcaaacttctacaagaaatactaacttctttaataaattacctgcacaagatttatggaaaggtataacttctgtcagtaatgctggcaagaagagaggtagagctaaaaatgtatcgaaatccaaaattaaagacttaaatcgtggtcaggtcattggtgtaggtaaagcaaatattgtgtggccaggtctctcagcccccataattagaggaaaagaattagtggaacaacatcaactacctgaagatccagaaagagagaagaagctaattcaaattagagatcagatgggcaccataaagaggccaaaattaagtcccattgagagaggatggtcaggttctaagttacctggaagaagtattggaccaccagatcctgttgaagaagataactttgaaggttttgatacaaaagtgttggaattaaaaactgtgttcaacatgaaaggcaattttggcagaacgagaaggcagtcagctttagtggtaacttagtgtcataatatttgtgccggttttgctctagcaaagggttttgagggtagagcagccttaagaaaggctaagaatagatccgctcaaaaattaatggcatattaagttgttcagaaaccacacagtgtgacatgatttcttcacgcagtttggtacaacaaaaatttacgtatcacagaaacctgaaagaccacggttagtttgtc

SEQ ID NO: 1638 - DNA, 1439 bp, Diabrotica virgifera
gattgaaaatcgaaaaacgtttttcagaatgggtgcaacaaaacctatatttcgtgatcttaatccagatgatccagaacctgaagcaacagaaattgaatcactttgcatgaattgtcatgaagatggcataacaagattacttttaacaaaaattcctttcttcaaggagttggtgctgatgtcctttacttgtgaacactgtggttatcagaataatgaaattcaatctggtgcggctgttgcaaagaaaggagtgcgaatatctttaactgtatcaacaaaaagagatctaaacaggcaagtggtaaaaagtgattataccagtgtaaagttagtagagttagattttgaaatccctccaaaaagccaaaagggagaggttaccactgttgagggtgttatcaataggagtataacaggcttggagcaagatcaacccgttaggaaaattcaacatccagaagctgcagagcaaatagaagagtttataaagaaattacaagaactgaaggaagtaaaaactccatttacgttaatactagaagatatttctggaaatagctttatagagaatccaaatgcacccaggattgataactcctgtacaactacacattttatcaggaccaaagagcaagaccacgaattgggtctttttagtcaaagtgaaataacagcaaaggaggaaagtggtatactgcatcctattcctgaaggtgaatttacgttagaagatttacaaggggaagtattacaatttccaacgaattgtccttcctgtaattcaccttgtcataccaatatgaaaatgacaaatattccacactttaaagaggtagtgattatggcaacgacatgtgacgcatgtgggcataaaacaaatgaagttaaatcaggaggtggaatagaaccaaaaggtcttaaaattgaagtcgatataaaaaataaggaagatttctctagagatttactgaaatctgatacttgttcccttggcataccacaattagacctcgaggttggtccccatgcattaggaggtagatttaccactgtagaaggccttgtactagctattaaagatcaactgagtgatccaaaacattctcatatttttggtgattctgtagatcctaagtcaagacacgaatttgaagcatttatagataagtttgatgacattctttctggaaaattatttgttacattggtattggacgatccagctggtaatagttacatccaaacaatgagggatgataatgagcctgacgagggtttaaggattactcattatgaaagaacatttgaacaaaatgaagagttaggacttaatgatataaatacagaaaattattaattttattttatgatttaatgtatataggcctgttaatatttttatataagtattgtaaataaattatttactagtt

SEQ ID NO: 1639 - DNA, 927 bp, Diabrotica virgifera
  misc_feature (693)..(693): n is a, c, g, or t
  misc_feature (900)..(900): n is a, c, g, or t
aagctacaataacgagaatttgccataagatgtatcacatataatgcgacatatagtgcaacatatcgcgaaagagtgtctgaacatcctaacgagttagccaagcggttgtttgaagacttacatgaacatgaagaaagaagattaaaaaaattcaaaccaagagacttaattaataggtttaagtaattagtaatgtacatatctttgtaaataataacatattgtaaatattagaggtaatgccacaaagttagcaatagctacattataaaacagggtgcttaatggagcatcatgtacatgtcataattatttatcaacaaagacgcttattgtcattactgatagattgcagaataaaggagttaaaaaaaaatatatataatgcgagggcaaggtatcgaatctgaataacccgatttttcacattcgatggttggaaatggtagggacgatattgtttcaaagtcttcttcttcttcttcttatattaggtctcttgacctgctcgtaaccgattttgagcttgtatttgtagctgtaatgttgactgccagcgatctcgccactttttaaaaggccttcccttgcctattggctttgaatctctggctatacgggctattctctcgctgtccattctcgtcacctgctgattcctctctcgtcttctctgtcttccccacagtnactatgtcttgtatgtttcaaagtggatgtttcaaaacctcttatcacacaaaaccaaaaaagaccagagcttaacaatcaggcatggacagaaaaattggattattatcataataataagactgtatgtattcacaaaattataccaaaacataagttgttttatgtaactgtataaagttcttgtttattcttaagttttcttanaaatgtaaataaaattcgtttattttt

SEQ ID NO: 1640 - DNA, 1135 bp, Diabrotica virgifera
tcggacgcccacagttagcgaaggacgttacgtaatttgttgaacggcaatcatcatggctaaggtacccaatgtcaagttcaacaacggagaagtttttcccgcctatggtctaggcacatggaagtcaaagcctggtgatgttactcaagctgtgaaggatgccctcgacatcggctaccgtcacatcgattgcgcccatgtctacggaaacgaaccagaagtaggtgctgccttgaaggccaaacttgccgatggcacagtcaaacgtgaagacatctacatcaccagcaaactctggaacaccttccacagacctgacttggtagaaccagccgttagaaccacattgaagaacttgggtcttgagtacttggacttgtacttgattcactggccttttgctcttaaggaagacggagaccttttcccagtaaatgccgatggcagcacagcctacagtaccgtggattacgtggacacatggaaagccatggaggctctagtcaagaagggtcttgtcaaatcaattggtatttccaacttcaacaaacgtcaaactgaacgtattctcgccaactgtacaatcaaaccagttaccaaccaggttgaaatccacccatacttaaaccaacaaaaactcatcgactatctcgaatccaaagacatcgtcgtcacagcctacagcccattgggatcacccgacaggccatgggccaaacctggtgacccacaacttttggatgaccctaaaatcaagaagatcgccgataaatacaataagactcccgctcaggtagtcttgaggtacgccgttcaaagaggattgatcgtcattccaaaatccgtaaccaaatccaggattcaacagaactttaacatctgggacttcatctcaccaacgcagacgttgctgccctcacagtttcgactgcaatggcagaatctgcccatatgacgatgccgttacccacaaggaccatccattcgtcaacgatgaatactaaactggaaaaacaactaacattcatcattacatttattcaaaatgtaaccaaaatctttaattttatattaaaatttattttgttttaataaaaaaaaaaaaaaagggcggccgctcgcgatctagaac

SEQ ID NO: 1641 - DNA, 881 bp, Diabrotica virgifera
caaagatgtttatttttatacattggtatttttttctttccttttaaaattaaaaaaagctgtatcttcgccagtcgaatgtatttctttaacatttttgttatcaaagttattccaaacttgttcttcgccactaccaaatatgcaaaatattatgttggtgattaaaaatataaagaatgtaatccagaaaattgttctccattctttcagtgtgtggttttcagttaaggttcctgccaaatagggtgcgattattccagtaattgcaccaattccattaaccaatgccattaggattcctgcataattcggagctaagtctagagcgttcacttttttgctactatagtatgctcctaaaaatcccatagccattgtaaacatggtcacagtaaaatatcggtgacaaccggaataggaagctgccatgataaatatgccaggtcccagagaagctattgtggtaaaaaatttacgagcctttgtcaccgtcatacgtttcgaggaaattaaccagtcgcaaagccatccggagcccatagaacataaccacataacaaggtatggtactgaattccaaattccgttgtctttgacattaaactttaacacgtcgctcatgtaagatggtagatctgttatcatcgtataaaagccccagtcgtggccaatttgagcaataaccagagcccatactggtactgaggttaaaatagatctccatggaatgctgtgtgattctactgatatagattctaattcactttttaggtaactgaattcctctttggaaataaacgggtgactaactggatccgagtagcaaaatatctgccaaaatatatgccatataattcccgctgcctccaatacgtaaa

SEQ ID NO: 1642 - DNA, 1039 bp, Diabrotica virgifera
gtaaaatcattctgtttatggcaggatcacatgattactgtagttctgagttctattggtattaaaacttactatctattaatcttcgaagacctttagctgtatttaactagattattgattatatgtccgcatacacatagccatcttctatttcttcgagtgcttccctgaataattgattagtagtggcgacagagtagaacgttgaagcactccaattttttacggaaatctctctatatagagatggatattattctgttatactggattattaatccagtattttggtcatcaggctcattctataagtttttaatgcttgactgtatcgaatatctttatgaagtcaatgcaaatgtgtctcacgtcctttggatcaaaacctgaataccaacagtgcgtcttgcgtgccaagacgtttttataactaagttttgtttcagaaatattttgttctaaaattaagtattctttatttgatcaaaagtcgtaaaaaatagtttatgataaaattgcactagcattttcattgcgtttgtttaaatgatgatacagaattaagaagtaatattgagctgcgtttatcttgtgtcgcctttaataaccacagcaaaatttatcaaaacaaagactcattaagacaaagtgtgcagtatattgccacgcaaacacatttctatttatatattcggtaattataaactttttatcggttaaaatattcgctatgattagttaaccgaacttacgaaaatatgtagtactttcaatttatctacttatacatttttagaggtgttctttatatataaataaaaaaattgtacatacactttattttttcaaatgtagggaacaaactgttcgataacaagtatctaccaaaagttttgcatgtttttattttttgaaaaaaaaaactaatgtattaccaccatttttcataaaaaaaaaataaatgattttaaaaaaaaaagaaaatgtaaatacattaggtttgagttttatgatcatgtacgcttttctgttttat

SEQ ID NO: 1643 - DNA, 815 bp, Diabrotica virgifera
tcgacccacgcgactggtgattttacatcatgagaccgtttgtgttattatccaccttgatggctcttgccagtgccagacctgaggcaggttacagttacagcccaccctccggctcctacggagctccatccggtggcggtggaggctttggaggcggaatcgggggtggccacggaggcggtggcattggcggaggtagcggattcggcggtggtggattcggtggcggcggtcacggaggcggtggaattggaggaggcggtatcggaggaggcggtatcggaggaggcggtattggaggcggaagcggaattggaggcggctttggcggtggatccggaggtggatttggaggtggatccggaggtggatttggaggtggatccggaggaggctttggaggtggaattggaggcggcggtgacggtggattcggaggtggattcggaggcggtttcggaggtggcaccactaccatccagaagcacatctacgtccacgtacccccaccagaacctgaagaattcagacctcaaagaccaatctccgttggacaagcccagaaacactacaaaatcatcttcattaaggtcccaagcgcacccgccccaactgctccagtaatcccactacaaccacaaaatgaagaaaagaccttggtctacgttttggtcaagaaaccagaagaaggacccgaaatcaccattcctactgcatgcaccaacacaacccagcaaaccagaagtatacttcatcagatacaagacccagagaaccgccggaggtggaactggattcggagggggaagcgg

SEQ ID NO: 1644 - DNA, 1280 bp, Diabrotica virgifera
cccacgcgtccgcccacgcgtccgggagattcgtttgtttctaaacccgtttgtacttcgagtattcgagtctaatagatagaaaagtttggaaactccgtttgtatttaactatttatacataaaatatcgtggaagtatccgtagttctaataaaagattaattttttcgccataacatttctgtcaatatggttgtcgaatacgtgcaggtagccgaaaatgaagatgaagatccagttgaactacctagtgaggataatgggaccttgttgttaagtactgtcacagcacaattcccgggagcatctggtttaaaatacaaagtatccgctgaaaataagaattttagaggggttcgactttctgatggtatcctccatccaccaccagacggtgaaggatggggtgaaacagttttctgttgcgtatatcccaaagagaataagcgtaagtatagtgaatctgtggaaagtccagcttctaaagtcaaacgtgtagagtctaagttgaaatgtactgatctgattgtgcttggtttgccttggaaggcaactgaggaggacttgaaagaatattttgagaagtatggtgaaatagtagtagctcaagttaaaagagatagaggaggaaaatcgaagggatacggtttcataagatttgaaaagtatgagtctcaggtgaaagttactgggcaaagacatatgattgaaggcaggtggtgtgatgtgaaaatacccagttctaaagacggaaactcacagctacttccctgcaaggtgtttgttggcagattaactgaggaaatatcagtggaaaatctaagagattatttcagtgaatacggttcagttacagatgtatttataccaaaacctttcagagcatttggttttattacctttgcagatccagaagttgctcaagctctttgcggagaagaccatataattaaaggagtttctgtccatgtctccactgctgctcctaaaaatgaatcaagaaggccatttggtaatgatagatctggaggtggtaactttggaaatgtatgggaaggaaatggatattccagtagaaacggatttggtggaggtaaccagggatcaggtggttggaataaccaaggaggaagtaggggtggtggtaacaatatgaatgatgtgaacaatttggcacctttcatgaatccagctttcattgctgcagctctgaatctagctgctaattgagggttaaagggaagtggaggcagaaataaacaagatggacaacttaac

SEQ ID NO: 1645 - DNA, 676 bp, Diabrotica virgifera
cccacgcgtccgcccacgcatccgctctcacgtcgttctctagccgcgcacagtgccaaactcatcctcatctcgcagcagcatgttcggaggtcttgaccccactgggctatattgagagattttgtgccatttttaacaagttctttctgatttttcgtaaatttaaacacgacattttcgcaatcatggacggagacaagttagatcctaccggacagtactagtgtgtgacagttaacgaaaaaaagacttttaacgatgcagaaaacgggaggcaagggcctagaccccacaggactatactaaaattaaggatgtggccccaccgaggcaacggtggacgacaaacttccagttgccgccgtaaaagactatgatcttgtttcgacaaatacacagattaacatctcactgccacacaagttaccgttgatacttttgtccacccaacaattctggatacttgaagactgatgtttgttgttttttattacttttaagattgtttttttattaaattatatgtaggttaagttccttgagaacatcatccattataatgtatgtttctcttatatttttgtatataagacaaaatgtccaaatgtatatgtttccatcccgtgctttttatactattatatgaagtttttcattaaatatttttatattt

SEQ ID NO: 1646 - DNA, 987 bp, Diabrotica virgifera
  misc_feature (840)..(840): n is a, c, g, or t
gttatgttgttcagtagaaattttcatttatattttataatttgtaatatttacaattaaaacaaccatgccaatttatgagacgttgagcagtgataaattaactgtagttcttgatataggatctgcatatacaaaatttggcttttctggtgaatttgctcctaggacaattataaaatcggtagctagatgtaagaaaactggtcagctaagaagaatatgggattacgaatctgctgaagatctgtatgatctgttggtagaattcttgcatgtaatttattttagatatgctctcttaagtccaaaagacaaacctgtgatcattgttgaatccttgctctgtccaactctgtttagggaaactttagcgaaggttttattttcccactatgaaatttcaatgatgcttagtttaccttcacatttagttagtctggccagtattgcggttgatactgctgtggttgtagatattggatacaaagaagctgtggtgattccagtttgccatggtttgccaatgatccaagcatggcaagcactaccgataggatctgaagctatacacaacaaattgagaacactgcttagtagtaacaacacaggaatacaaaatttatcagaagaaacattggaggatattaaagttagatgttgttttgtaacagagaaaaatagagctgaacaattagcacaggcaaaacctgatatagtcgcttgcccagatgtgaaatatcctatagggggaacagagagtatagtagtgactggaaaagtcagggaaagaacttttgagatattgtatgaggaagacaatgatcatttctgtctgtncacgatgatacttgacgcaattttacaagtagatctaaatcttagacagaaattatctgagaaattgtattaatttggtggaacactatgataccaaggttcaaagccaaattaaagaagaactagagcatccattgaaaaatgaac

SEQ ID NO: 1647 - DNA, 704 bp, Diabrotica virgifera
ctttggggtgcgtaaaaaaagtcacatggaagataactcacttccatcttcgacgcagctaacagggatgtccaaactatcgtccgataatccgttgctaagtgcaaccaaacccatcgataacacacctatgttatcatgcaccaaaaaggaacctcaagaaccagaatattatcctcatataactaaagtatccgatgacggttccggatggtactcaaagaacaattcggttcatgtaaagaaagaaaaagaaaatgaatacgatacagaactacaagacttcgttaatttatttaagaataagatagttgtaggtgttttgtctggccgttcgatgagacagcctagttcgagtgatgaagtcgattgtagggcccaaaccaatggtaaaaactttaaaaagtttaaaaagataaagcctttacatcctcaaattaccgtcataggtaatgacttcttcaacaattcacaatttggcaatacaacaggaatacacgattcccggagacgcatactttacgactcagacgacgaacaaccttcaagaaaacagagaaaaacattaaaatcttttttgatataagtcaaaattattgttgtatttgatattattgataaatgttattgtttttgtaataaacatcatctttagttattcaaaaaaaaaaaaaaagggcggccgctcgcgatctagaactagt

SEQ ID NO: 1648 - DNA, 1140 bp, Diabrotica virgifera
  misc_feature (918)..(918): n is a, c, g, or t
  misc_feature (1099)..(1099): n is a, c, g, or t
  misc_feature (1106)..(1106): n is a, c, g, or t
atgttcttctacggaaacgaaaccattttgccatagaaaagaaagtatccattatccatttttgaatagtgtagtgaaaaacaaattttgtgacatttggtggtatatttacctatattttttaagatgcaggaaaaactgattgtgaatgttaatcaaacagtgggaagcaccttttcaacgaaaatgaatgattccattccgatgtcctcagtcggactgttagagcttgctcatcgtgagtaccaagctggagattacgaaaatgcagaaaggcactgcatgcagttgtggagacaagatcagacaaatacaggtgtcttattgttattgtctagcattcattttcaatgtaggagattagagaaatcagctcaatttagtagtttggcaattaaacaaaatccccttctagcagaagcctacagtaatcttggaaatgtatataaagaaagaggtcaactcagtgatgctttggaaaattacaggcatgctgtcagactaaaaccagatttcattgatgggtacattaatttggctgctgccttagtagcagccggtgatatggaacaagcagtacaagcatacattacagctttacaatacaaaccagatctctactgtgttcgtagcgatttgggtaatcttcttaaagctctaggccgtttagatgaagccaaggcctgttatttgaaagctattgagaccagacccgatttcgccgtggcctggagcaatctgggatgcgttttcaacgctcaaggagaaatctggttggccattcatcactttgagaaggcagttggtctagatcctaactttctggacgcctacatcaatcttgggaacgtattgaaagaagctagaatatttgatcgagcggtagcggcatatctgcgcgccctcaacttatccccncaacaatgccgtggtccacggaaacctcgcctgtgtctactatgaacaaggacttatcgatctggccattgatacttacagacgagcaatcgaacttcagcctaatttcccggacgcctactgtaatttagccaatgcactcaaagaaaaaggccaggtttccgaagccgaagaatgttancacacgngcattacgtttgtgtccttcacatgcggactctc

SEQ ID NO: 1649 - DNA, 454 bp, Diabrotica virgifera
atccgccacattaaaaaacaatataatggatcctgaaacaatttattccaatagacaagtgtgtcatcaacatttcggacctatatatttttggaagtttgtaaaagattataaggtaatatttatctaaacaatcatccaacaagcctctttcaaaaattttcattcaactcgatacagatcagtgctttcacgtgacacatagcagatagtgtttagcattttgaaaacaaattggaatatttgaagttttcagtaaaatatggaataaaacattgaattgtctttctgttgttttaatttcctgcgaaatttcatcaaaaatcccgcaaaatttataatttgaaattctgacgtaactaaaaatgaatcatttagttcacattccaatccagagattgggttaatttcgttcggaagattaaccatgtcgtgaaacgtctgtgagtatgta

SEQ ID NO: 1650 - DNA, 868 bp, Diabrotica virgifera
  misc_feature (690)..(690): n is a, c, g, or t
  misc_feature (834)..(834): n is a, c, g, or t
  misc_feature (843)..(843): n is a, c, g, or t
  misc_feature (860)..(860): n is a, c, g, or t
gatcatcccgtgttgtgtttcttcacattaaacaaaaacaatataatagatcctgaaacagtttattccaatagacaagtgtgtcatcaacatttcggacctatatatttttggaagtttgtaaaagattataaggaattacaagtcatagaaccaaggttagtagctgtaagcaaaacaaaaccagcaaacttaattgtaacagcctatgaagaaggccaaagacattttggagaaaactatgtccaagaacttgaagagaaagccaacaatccactaattttagagaaatgtaaagaaataaaatggcatttaataggtcacctccaatcgaataaagttaacaaagtactaggtcttcccaatttgcatcttgtagaaacagtagattctcaaaagttagcatccacactaaacaaaagctggccaaaatttgggccacctgaatcaaagttaaatataatgattcaagtaaataccagtggagaggatgaaaaaagtggaattcttcctacacaagtatctgatgtagctcaattcgttttaaaagaatgtaccaacttagaattaaagggactaatgactataggtaaatatggttatgatcctgctgatgggcccaatcctgattttctacgtttgaagcaatgccgtgatgatctctgccagagtttaggtctcgattggaanaatattgaattgtctatggggatgtcgactgattatgaacaagctgttgaaatggggagtacaaatgtgcgagttggatcatcgatatttgggtacagagcccctaagcattcttagaatgggttgtgaatttctggatgtatngtagaactntattgaaaataaatgcntgtgattt

SEQ ID NO: 1651 - DNA, 1621 bp, Diabrotica virgifera
  misc_feature (169)..(169): n is a, c, g, or t
agacatgacaaagcaagagatcaaagagcactagcaaaaatatgtctctgcatccaaccaagttgccacgctcacgctcacaatgccaaatgtagcaaagaagcacgggataatctcaaaaaagcctttgaaggcaatagtatggcgacgaaacacgaactcacacganaattccccaatatgcgccaaaattcatgttcctcaatggaagaatattcaaacaacactttagcaacagtacaaaagttggcagacataggcgaggccatagaagacaaatggatatcccctgctatgaggaacggagcgtctgaggagctcgaaagttccattgctgcaccaaatcagcaattaagtgacaaatcaacatctgaagatgtgaaaaatgctccacctggcgaaagtgagagacgaagagctaaggaagaaccaccacaaacgacagctcttccattgcaaaacaaaacctttaagaagaaatacaacaagcacaaagcaaccaagaaacttgcatgttatgagtgtggcgaccctaatcataaaaaatctgactgcccaaaattgtgtcaaggctccactccaaatttccaccaaaagaagaaggaagaaaacaaagacagctcaaacaaaagtgcaaagaacactactcccctaaccagagcaatgatgacatcagtttccccttcatcccggacaaccgacagtggtgccacctcccatatggcctgtgatgagactgccctccataatctgaactccagcacaaccacttctatctgtgccgctgacaattctgaagtcaagtcaaaaggtattggtgaggctgtcattcagtttgaacaaggtaacaatccaaccaaaaccgctactaatgtttcatatgtacccaacccgtcagccaacttgttgtctgttggaagaatgacagaaaaaggttatgctgttgtttttgataaagatgcatgcacagtatatgctagttctgatttttcagttaggggtgaagtagaattttcatgtaataaaaaagacggtttgtatggtattcataatttgaaacaagaatcaatgatggtagtaaaagagggatttttatcagaccaagaattatggcataaaagacttggtcacttgaatcgtaaagggttaagattgctaaaaaatacagcaggtgggattaattttgttgacgaaccaaaccaggtatgtgttacttgtcttgaaggcaagcaaactgtgaaaccttttccgaaaaggggtaaacgggcaaaggatcttttaggtatcgttcacagtgacctgcaaggaccttttgaagtgttatcatggggaggtgctgcatattgtcttatatttgttgatgattattctaggaaggtttttgggtacatgctaaaatataagagtgaagttttttcaacatttcgcttatttaaaagtatggtggaaaatcaaaccgggaaaactataaaatgtcttaggacagatggtggtggtgagtatacttctagggaaatggaaaattttcttaaggaaaatggcattattcaccagttaacagtatcctatacacctcaacaaaatggggtggcagaaaggactattagaactataactgaaa

SEQ ID NO: 1652 - DNA, 1034 bp, Diabrotica virgifera
  misc_feature (894)..(894): n is a, c, g, or t
  misc_feature (906)..(906): n is a, c, g, or t
  misc_feature (1001)..(1001): n is a, c, g, or t
atctttatttataagttaaacgtgtaactcgattataataccaagtttgtagtgctaatttaatataaaatattttcgaatcagtggcccccacgatggctactacagcggatattgaaatttctaggaaattatccatactctcagttcttagtgataaatttgcagaagaacgaaaagtatctcataaacatgacaatgcaaaaggaccaaaagattttatgtttgcagtacacatcgcctgttttttttgttggatttatgaatgttatgccaatggtattttttagtacagcaaattcttattggatgtacaaatttagaaacgtaacgcaaggagatgaaataacacaaggacaagatcgaactagattgcaggtatatttccagcctgcactcatggctggtggtacaataccatcggtaatttgtacattactgtggacattttatggtcacaagatagcatccatgttaagaagtctggctgcgttagtgttacttggtttagtgtttgccatatttgcaatattcactcaaattaacacagattcatggcaaactggattttttgcgctaactgtaattttgttaatgatgaatagtgctggagtagcaacgtttcaaatgtcatcagttatattaattgctaaattacctccaagctatatgttctgctaccttattggtcaaaatggaacagttctgactactagcttacagctcgttgcggtggctgttaccaacaacagcatcacatccggattaatttattttactgcaggaaccacgcttataacaatctcgttaatgtttgttatgattgcgaggagatcacatgtttttagatattacgaggttgaaaatataaaagataaacatgctgaacacatncaatttgacganatgaaaaaagtgatagtgcaactttggcctgtccctggtagtattggaaattttgtcttcacgtttagtttcgtccatccttcgatcacaccttnagtggaatctgaatatgcatacgaaaagactgc

SEQ ID NO: 1653 - DNA, 1109 bp, Diabrotica virgifera
gaactggcaagaaccacgagttcttaacgagcagggaaccatgttgccctttgagcactcctagcacatttcatcttgtaacatcgacttggagtcgctacaaatatcacttaattgttatgtaaaccatttatatcgatgtaacctttctaaataagttgcttgtttcttttgtgaagcagaacataccagcacttctatttggtgcttcaggaggagaagaagactggcagtaccgaacggaaccctctccactaaattgtctaggattcaaggacgaacagtgtatatggccaaggggcaaaggtcttggaggtagcagcattttaaatgccatgatgtatatcaaaggaaataaaagagattacgatacatgggaggaactgggaaatactggatggggttggaacactgttaaagaatattttaagaagttggaaaatatgcaaactaaaggagttagtgatcagtatggaagggatggttatatgacgcttaatagatatccttcagatcaaccaattgccagtgcattagaagaagccttcaaagaaatgaagttacctctactcaacgaggaaaatcccgtgaatcctctaggagcactgacagcttttcaatgtattaaagatggaattagatttaatacaggaagagcatttttgggtcaggttaaaagcagatcaaaccttatgactgctttgcactcttttgctcagaaagtaataatagaccgaaagagcaaatcagccaccggagtgcaagtcgaaattggaggaaaaattataaacttaaaagctaagaaagaggttatagtttccggtggaactatcaactctccacagctgttgatgttatctggtctaggccccaaacatcatcttgaaaaagtaaatatcgatctcattaaagatctgcccgttggtgaacacttagaagatcatgtattgcacctcggatttttcgtgaagtttaatcccgaaatacaatcgatagaaaatcagctagatacgatctacaagtactttgcccatcaacaaggagatttaggaactctcatgatcaccaacatcatgagtttcattaacaccaaaaatgattcgcagtat

SEQ ID NO: 1654 - DNA, 934 bp, Diabrotica virgifera
cggacgcgggggggcaccgaactatctgagcaaagtatatttcaatccacaaagaccgatattgtttaacaaaataaaagtgaatagacaactaactattgatttttgagcataaacgcacagaagctaacgatggatatagggtcccttttgcaggacacatgtcctggaaacctacagggcatgtcaggatatttttttctgactttactcaatagcttattgagttccaaatgcaagttagcaaaccccaatgactatacagaagattatgcgccgagattgaaagatggagatgagtttgactttatagtggtaggttctggatcagctggagcagtggtagctaataaactaagtgaaaatccaaactggaaagtgttggtgctggaagctggaggttatccatcatcaaccagtgatatgccagcacttctatttagtgcctcaggacaagaagatgactggcaataccgaacggaacactctccacattcttgcctaggattcaaagacgagcgctgtatatggccaaggggaaaagctctagggggcagcagcattttaaatgccatgctgtacatcagaggaaacaaaagagattacgatacctgggagaaactgggaaatacaggatggggttgggacactgttaaagaccattttaagaagttggaaaatatgaaagttgaaggagttagtgaccagtatggaagagatggttatatgacgctaaatagatatcattcagatcaaccaattgtcgatacgttacacgaagccttcagagaattgaaatatcctcaactacaggaggaaaacccggagaccccctaggaacattgatagcttttcatgtatcaaagatgggattagatttaatacaggagaagcatttctgggtcaagttaaaagcagagcaaacctcctgact

SEQ ID NO: 1655 - DNA, 3379 bp, Diabrotica virgifera
gtctcgtgtgtgtaaagggtgtgtgcccgaaaaatatcgcgtgtgaaacttcatgcggtggactaaagtgtataaactctttaattgaaaaatttccgataggattgtttgacagcacaaacaaacaagatgcctaaacaaatgaacgtacgggtgaccaccatggacgcggagctggaattcgcgatccaccaaacgacgaccggaaaacaacttttcgaccaagttatcaaaaccgtcggcctaagagaagtgtggttcttcggattacaatataccgattctaaaggcgatcttacctgggttaagctgtataagaaggtgctgagtcaagatttgaaaaaagaaaacccattccagttcaaattccgtgccaaattctaccccgaagacgtcgccgaagaactcatccaagatatcactttacgcttattctacttgcaagtgaagaactccattctctccgatgaaatctactgcccgcccgaaacttccgtccttctggcttcgtacgccgtacaagccaggcatggagattatgataaatcaactcacacgccaggattcctagccaacgataggttgttacctcaaagggtaatggatcaacataaaatgtcaaaagatgaatgggagaatagcatcatgacctggtggaaggaacatagaggtatgttaagggaagatgccatgatggagtacttgaagatagctcaagatctagaaatgtacggagttaactatttcgaaatacgtaacaaaaagcagacagaattgtacttaggtgtcgatgcgcttggacttaacatttacgaaaaagatgaccaacttacacctaaaatcggtttcccgtggtcggaaatccgcaacatctctttcaacgataggaagttcatcatcaaacccatcgacaagaaagcacccgatttcgttttctttgctccacgcgtgcgcatcaacaagagaattctcgctctttgtatgggcaaccacgaactgtacatgcgcagacgtaaacctgataccatcgacgtgcaacaaatgaaagcgcaagcgcgtgaagaaaagatggcaaaacaacagcagaaagaaaagctccagtctgaaatagcggcaagagaaagggccgaaaagaaacagcaagagtatgaagatagaatcaaagccatgcaagaagagatggaaagaagtcaagctaactatatggaagctcaagagatgattagacgattggaggaacaattgaaacaattgcaggctgccaaagaagagatggaaaagagacagaacgagttacagtccatgatggagcgtttggaagagagcaagaacatggaagccgccgagaggcaaaaattggaagaggagatcagggccaaacaagaggaggttctacgtatccaacaagaagtcgaggctaaggacagcgagaccaaacgtcttcaggaagaggtcgaaaatgctcgtcgcaaggaggaagaacttaaacaactgcaactcgcccaagctgccaaaggtcatttggaagaaaatgaccataatgaagatgatgaaatggtcaatggtgatgttagcaaggatcttagcactgacgaaaacatcgtcgatccaatcgaagatagacgtacgcttgctgaaagaaacgaacgtcttcaagatcaattattggctttgaagaaagacctcgctcaatctcgcgacgaaaccaaggaaactgccatggacaaaatccacagagagaatgttcgtcaaggaagagacaaatacaagactcttcgtgaaatccgcaagggcaacaccaagcgcagagtcgaccaattcgaaaatatgtaaattgtttttaaccttcatatcaaacaatctaggagtcctacctattatttcgagttaaaaaaaaccaatattactaaagaacctttcaatgctcaacgcgagatgatcattttttcaaaatacttttaaaaaatatttttaagtttttcggttcagttattacttaacacgttaagtattattcttatattttctttttgatatgtattagagccctattggctcagttaagtggccttagaagttaactactttttgctttgttagattattttgctttttatatatatttaactaatgttatacgaaaattgttttccattgtttttgtgataactaacaacaattttgggtcaatttgaaaatcggatcctcacattaaacacggatccgagctgaactgataaaaaaatatataacactccagatctgcaattagtccagataccgagtaaggtacactgaagatttgtagcagtttttcaaaatcttgcaactaacttctacaatttttcatcgaccttctttttcttttctatctctggactaataatttttattcaaaattttcttattcaaggacgcattccaatattgagtagttttctgtttttaatgttagtgtgccattcggtgatcaaaaaatcaaaaccttgtttaacatactttaaaaaatcttccttgtcttcacagatttaaacaaattattaaatatcttttacatcaacatgtttgagtcattaccttccaatattaaacttttgaagaaaatattttaaaaaacaataacaaaacatttaccttccaatattaaacttttgaagagaatacttaaaaaaataacaaaataataagtggcgcggcataatatgctatcctgtataatacagcaatatgtgattgtgaattaaaaatatttatttgcgcctgcgcattagactttttaaatttccaatttatggatgtcaaaagtcaatgtgaatttcaaacatgtcaactgccaaatggaggttaatttcataaaaagatctgcacgagatacgctctaactacacaaaatacagattttaataatttgttgtaagtctttttaaaactgtacacttttaaaatttatttttctattatctagaactatcaacgagttttaatcgcaatatgcaatgatgagatactatatttttacactgttccttcttggcctggtgcttcctaaaataattgagcagcagttaacaatattttaggtatttttgtattctatacaattccaaaattataagaatttttgattttctgcaaatctaaactgattaatccaaatttatttgatataaagtgaaattatttaaaacgtttgttgaattttaagactttttaatctttcactcgtttgtaagtacaataagtgtttcataaaaaaatattgtttaagaaagagggcgagaaaacattttgaataacaaaaaagtagtagttgcagtagcttacttgatttatatgtcagcatccatggtcaaaccaaaatgggggcttgaacaatcta

SEQ ID NO: 1656 - DNA, 1206 bp, Diabrotica virgifera
cgatagtaccttagatatagatcttttaattaaactaaaataaaatttgaatgtttattatattttatgcatttacttaataaagtgtaagatatctttacagttactacacatagatattaagtgcgtaaggattagttttaaatcaaatttaaacaaacaagataagtgcgtaggttaatgaaaatgaattttttctgtctcgtcagtgcggacctcctaacctactctttgtgaagctcatcagcgacaatgattgattatataaaaaaattaaaattaaatgatagcaataaagttttaattaaagatccagatgagattaacaggaaaatagaaaaacttatcgaaggaggctataccaagttgcaagtgatttctgattacgataaaactattaccaaacagcatgtcaatggaaaaacacagtttcacgcgttcgatttatttaagcaatgtccctccatatcccaagaaataagagattttcttactgcattaacgaataaatatgcagtaatagacaaagatccgaatctttctcatgcagaaagaagtaaacacatggacgaatggtggaataaaaccatagaagcttataagggattgaaaatttcccaggaggaaattgagaaaacctgtttagagtttggaccaccattgagggataacgtgaaagaactttttgaagtgctgaaacaaggtaatgtcccggtactacttttatcaggcggaattggtgattgtttggagccttctttacggatttcgggaattaatggttcaaatatagagttagttgcaaattatattaaaagagacaacgagggcagaatacaggattataaagcaccccctattcatacagtcaataaaaatgaatacatcaaaaatacgcaacattacaaaaaacataccaacagacctaacgtacttcttatgggagaccatttaggggatgcacaaatggtaaacagcttggaacatgttgggactgtaataaaaattggattttcttataatgaagctgaagtagtgctgccaacctggttaaatacatttgatatcgttcttaaagatgatcagtcgatgaatgtcccaaaagctatagttgaattactccagaaagaatgatttacaagaatttagttttttaagacaaaccggttgttggaatacgtatatattaaaatttttatttccccc

SEQ ID NO: 1657 - DNA, 1121 bp, Diabrotica virgifera
agatggtagggtgacgagcagtgtgactcatttttaattttatattgtcaaatatttaggtgttttgctggttattattattatattatttaaaaatggagtggttatttggaaaaaaagtaacccccgaagaaatgcttcgtaaaaaccaacgagcattaaataaagccatgagagatttagatagagaaaagcaaaagatggaacagcaggagaaaaaagtaataaacgatattaaaaaattagccaaggaaggtcaaatggacgctgtcaaaataatggctaaagatctggtcagaactagaaggtatgtgaagaaattcatgttgatgaaggctaacattcaagcagtatcattgaaaattcagactcttagatcccaaaatacaatggcacaagctatgaaaggtgtcactaaagctatgcaaagtatgaataggcagctaaatttaccacagatacaaaggatattacaagaatttgaaaagcagtctgaaattatggatatgaaggaagaagttatgaatgatgccattgatgatgcgatggaaggagatgatgatgaggaggaaactgacgcagttgtcaatcaagttttagatgaattgggtcttcaattgaatgatactctttctggactgcctcaaaccgctggatctcttcctgcctctgggcaaaaacatcctgcagctgcagctgctgttgcaggaggaggtaatggtggcactggtactggaggcagtggtggaaacagtggcggcggaggtggcctttctgatgccgatgcggatttgcaagctcgactagataatttacgcagagagtagatattaagtaagataaaagggcaattaaaaaataaggaactttgtatacacattatattttaaaatcgacaaaaacttgatcttttacaaagttaattcttgtagcttattttttccacttactaacggtgtaattatctgtgattttcttaaatataacaattctcaaatataacaatcttctgttataattttttttatcaatttaacaaattaattaatgcgaatatatttctgtatatacataattaaaatattatcatataaaaaagtattttaaaataaaagtatttt

SEQ ID NO: 1658 - DNA, 1276 bp, Diabrotica virgifera
tggtagtgtgacgagtgacgagtgtgactcatttttaattttatattgtcaaatatttaggtgttttgctggttattattattatattatttaaaaatggagtggttatttggaaaaaaagtaacccccgaagaaatgcttcgtaaaaaccaacgagcattaaataaagccatgagagatttagatagagaaaagcaaaagatggaacagcaggagaaaaaagtaataaacgatattaaaaaattagccaaggaaggtcaaatggacgctgtcaaaataatggctaaagatctggtcagaactagaaggtatgtgaagaaattcatgttgatgaaggctaacattcaagcagtatcattgaaaattcagactcttagatcccaaaatacaatggcacaagctatgaaaggtgtcactaaagctatgcaaagtatgaataggcagctaaatttaccacagatacaaaggatattacaagaatttgaaaagcagtccgaaattatggatatgaaggaagaagttatgaatgatgccattgatgatgcgatggaaggagatgatgatgaggaggaaactgacgcagttgtcaatcaagttttagatgaattgggtcttcaattgaatgatactctttctggactgcctcaaaccgctggatctcttcctgcctctgggcaaaaaaatcctgcagctgcagctttttttgcaggaggaagggatggggggactggtactggaggggggggggggggaaaagacggggggggagggggtcctgatgctgcccgggggttgcacgctcccctcaaaaatttttcccgcaaaaaaaaattttgtaataaaaaaaaggaggttaaaaaaaaagaatttgttttacccccttttttttttaattcgaacaaaaattgttttttttcaaaaaaaaattttttttgtctttttttttttccccttaaagggggggaatttttgggggttttttttaaaaaaaaaaaaaatttcccaaaaaaaaaaaaactttggggaaaaaatttttttttttttttttttaaaaaaaaaaataaaagggggaaaatatttttttgttccttaaattactttaaaatattttcaaaaaaaaaaaaaattataataaaaaaaaatgacttttttgctttttttttttttttttgtttaaaataaaaataacttatcaaaaaaaaaaaaaaaaaaaattaattttttttttttttttttctcccccccccccaaaaaaaaaaaaaaggggggggcgggg

SEQ ID NO: 1659 - DNA, 391 bp, Diabrotica virgifera
ggaaaatctcgctgtgaatcgcccaactcgcggcagtgcgattttatatattttttcgaataccacaaaaacgttgctatgacagtaagatcatcagctgatagtgagcttatccgtgaatttctagtgataagagatgccatctgtatcggcccatatacttttcagtatataagtaataggatcagtgtcaatcgggtagtgtagctttgcgcgactattatttttttgttttgtagtgctcaaaaaatggagagacaaaattcggtggcgccccccgacgggggttgggggtggatggtggtgtttggcgccgctctcattaacatggtgaaccaagccatgtttgccaacttcggattgatattcggagagtacctagaagaaatcg

SEQ ID NO: 1660 - DNA, 844 bp, Diabrotica virgifera
cacttcacttctttgctttgaataattcttttgataaaatagggagttattacaagtaaatatgggtattttaaatttaactaaacttttagcggatgtagctcctcaagcgttaaaagattatgaactaaaaaactattttggaagaaaagttgctgtagatgcctctatgtgtctttatcagtttttaatagcagttagagcagaaggagcacaactaacctctgcagatggtgaaactacatctcatcttctgggggccttccatagaactatccgtttagttgaaaatggtattaaaccagtctacgtttttgatggaaaacctccagacctgaaatcaggagaacttaataagagacaggagaaaaggaacgaggcacaagcagcacttgccaaagctacagaagctggggatgcagctgaaattgataaatataacagaaggttggtaaaagtcactaaacaacattctgaagaagtgaagcagctgttgacattgatgggaataccttatgttaatgctccatgtgaagctgaagctcagtgtgctgcattagtaaaagcaggaaaagtatatgctacagctacagaggatatggatgcacttacatttggctcaaaggtcttagtaagacacatgacatttagtgaagcaaggaaaatgccaattcaagaaattcatctagataaagttttaacaggattagatttaactcaagaacagtttattgatctgtgcatattattgggttgtgattatactgatagcatagaggcattggtccgaagagagcaatagaattgattcaaaacacaaaagtattgaaagcatcctcccaaa

SEQ ID NO: 1661 - DNA, 920 bp, Diabrotica virgifera
ccaaagtgtcacaacaagaaacagctttaaaaacctgcaaggctgatcttgtcaataaaaataaggaattatcggagttatcttcggttctgttggacagagatactaagatcacaagcctattacaacaagaatctgatttgaaaacgtgcaaggctgatcttgccaataaatataaggaattggcagagttgtcatcggttctgttggacagagataacaagatcgaacacctggccgctgctgtccatgcgaatgagattaaaatgtctaatgttttattggaaattgcagaaaaaaatgaggctaacttaaggttagaagaagaacttcaagttgttagggataattttgccaagaccgaaagcatgttggaaaatacattagtaagttctgaacaaaaatccaaaaatgaatttgaggaactaaatggaagtgccaaaattgataccacactggagactatttctagctttactgacattattgcagactgttgtcaagagctacagaggactttcatgaactttattcaacaatggaagaacgaaatcgagtcacatccaagttttaaactgttgccatctataaagctgtgccattctttagatgtagaagatattttatccgttttagtcgataatattaaggcagtcgttttattactcaacatcatgacttctaaagcaccaaaaaagatgattgacaagtcagacccacgcttaatatgcccagcgcctctgaaattcactgaatataacgagtcaaagcttgtgaagagatttacgttaaaatcgccggatgagttacgtctgactagatcagcaagtccagattctccgggtatggagacagattcagacatgtatatggacgagtgcgaaccaaggaaacattagtcccccgatagtcaaactttc

SEQ ID NO: 1662 - DNA, 2040 bp, Diabrotica virgifera
cagcaagagtggtggtgacaggctgtgtcggctacagaaattacaggttagattaggtttgggttgggagttttctttgatttgttcgtgtgttgtgcctaaaaacttcagtacaatgtcggctaccagactggagaacggtgcgggtgattatattcaaacagaattgatatcgggcatcgatttcgttaataaaaacaattctaaaggacattgcgccaatggagaaactgggttaaatgaacacactaaatacaagaatggatttaaaaagtcggtcatttccaatggacatgtcacatcatcagacgaagaaacgacaaaaaataggacaaaaaatggttacaaaacagacacatcaacagacgaaccaaaaatccgacaaatcaaagaatccttcgaaccgcctacgttgatcaccaaagcactcacccacatcagtttctacatcctcatgttcttaggatacctcagccaggcgctgtttccacctaagttggtcaaagaaaaaaatcgggaaggctatcgaccgttgtctgatcgttttgccgctttctattcccagtacgtctacaggcgtatcaaggattgttggaacttacccatttgcagcgtaccaggggatgaagtcgtacttaaagataggattacgagagatcattgctggacctttgaatttacggggtccaaaacgaaatgcataaatttggcttcctacaactacttggggttcgcagaagccacaggtccctgcgcagaacatgcgattcggacgatttacacggatggcattagtaccggaagtaccagacaacagtacggaacgtgtgcactccatgacgaactggagcagctgatagccgaattcgtaggtgccgaagattccatcacctttggaatgggtttcgcgacgaactcactcaacattccaacactcgcatcgcctggttgtctgatattgagtgacgaaaagaatcatgccagcttgatattgggtatcaaacttaatcatcccaccgttagagtatttaaacacaataatgttaagcatctagaaaaactcctccaagaagccatctactatggccaacccggccaacccaacaacgagtacaaaccttggaagaaaatcattatttttatcgaaggcgtgtatagtatggaaggaaccataggccgccttccggaaattatagctcttaagaaaaagtacaaagcttatttatatttggacgaggcccacagcataggggccatgggcaagcacggcaaaggtgttgtagattatttcaactgtgatcccaaagatatcgacattttgatgggtacgtttacgaagagttttggaggcgcgggaggatacattgcaggttcaaaggaattcatatctttcattcgcgaacatagtcacgcgtctggtcacgcttgggcgatgtcgccgccagtcgcagcacagatcatatcagttctaaagataatcatgggcaaagatggtacaaacgaaggacaaaagagaatcgaaaggttagctaggaattccagatacgtcaggttgcgtctcgaacagatgggtttgatcgtacacggtaaccaagattctccagtagttcccattttagtttatcgttactcaaacgtagcggtagtggtaagaactttaattaaagaaaaaatagcaacagtaggcgtaggatatcctgcaacgccgcttgcggaatgcagaataagaatctgcatatcggcgggccacacgaaagagcagctggattatgccttatcagttatagaaaaagtagcagatgaaataggtattaagtattctagaaaaccgagagatccaaaaccgattgattacaataaaatcaaaatatatcaggatttgttttagagagagacttttagatgaagcttcaagagaacaccagcctgcgataggaggttttgttgtttttataaattttataaatgcatttaatatttgatttcaaaagctatttattaagaatcgtttttggcttctgttttattttaatactttgc

SEQ ID NO: 1663 - DNA, 932 bp, Diabrotica virgifera
  misc_feature (873)..(873): n is a, c, g, or t
gtcgatttcaatatcagcctgtggccgcccttttttttttttttacgaaaaatgagtaaacagctgtggttactaaaaagtactttgtttaattgttgttttgtgtgtacgtaattatatcaggagtgtattaataaatacagattcctgatgtccacatgtgaaaaagaatgatgggttaatacaagcaccatccaatagaaaatcattaacaaacaaaagtatttttattcctgtatagtttaaatacctgatcaaaaatgttcctgaaatttgacacgtttggcaaagattatgcccaaatggctgcaattgctattggatgcctcagctcatgcatcagcggaatgacaatagcctggtcatcaccctacgtcgtaaagataactcaagacaaggaaacttataacatcacagaagaagaagcatcatactttaccatgataaacgttataggactagttgtatctttaccctttacatcactcttaccagacaggcttggcagaaaacctgtcctgatgctatcagctttaccatattctctctgttggttgctcaaactgttcttcacgaatgtttatatcctgtatctggctaggttttgtgctggaattggagatggtttactgtttgcttccttgcctttgtacatcggagaaatagctaccccagaagtcagaggcatttggggaaacgggttgatgatttttggattcctaggacaatttttaataaacgtgttcggtatttttctaacagtaccacaaacttctattgtaagtctatcagtgcctctaatatttgtatcagcgttttatttcatgccagattcgccgtatttttttgctatgaaagatagagatgaagaangcaaagcagcactaaggttctttagattaagagacgacgttgacgatgagtacaaatac

SEQ ID NO: 1664 - DNA, 1662 bp, Diabrotica virgifera
cagaagacttgttattctaatctctgaacaggctactttacaagcccaatcagaagcttcaatgagacaagcccagagtgcaactactgcagctaagagcttgttggcccaacgtggagaagtagcacaaaatgagagcaatgaagctcatgaccaggtaaacgaactcaagacaaaaattcagaaactcgaggacgaattaaaaacagaacagaaagataagactgccataaagagccaagctgagaacttggccaaggaatacgacagattggccgaagagcacagcaaactacaaaagaaggtgacaatccagggagccgagaagaaaggagaataatgtacattaaaaaacgttgattgcacatcctataactatttataataaaaagctttggttgtaacaagctctagtgtaaatatgataagatttggtgattggctatagtgagagatatgctattttttaataatattcgaatagtagatgaaaaaatttgtcttaaaattagttcttcaaaatctttgtttccattttcattagaggtcactggagaaagttttttattaacaaggggaagaattttgaaagactgcactgcttttcagccaagaaaacgccacttcaaccatttacattaggtaaacatacattaaggggatttgtatatctattctatcatatattagatctcttctgccgatctggatagtcaagccagatcaattcaaaaccacataaatatctttgatatgcctcatatgtgaacagacgattaagtaattgcaaaatctttttcattttatcaaacgtaacataaagctctctaatagggcattccacaatgctgtaaaaattaaatcaatatggcggctgggaggcaaacaattttgttttttacatgaattaatttaatattttcactggaagaatccactttaaaaagataatatgcctcatttctgttgtgttttggaaaagtatggaatgcgaagtaatcgtgataaagttcagttttatcggttaccattagtgctacattttaagcataaaaccaactgaactaaataagttatgatctgagagacataaacaatggttaaatgctataaatgtcctataaaaatgctaaataactatttccatgttacttacgcttggaaaactgtctccactgtaggttaagtcagactccttgatggaaaatgaatatatattatttattttgccaatcttttgcttgtacctaccagcaacatctgtattgtctagcaacaactttcgaaaatattcacgtaagtttatttaaaactaaataaagtcgttcaagtacttctacaactaaaaactacacaaaagcaacaacaaaatgttgggaaaatacaacgaaaaaactattaaaggtaaaaaacgtaagaaacacaatgtggtacaaatataaataaataagtatgacactgcctctcagcatagtcataaacgtcaaagtctttgaatgccctatacctgagtgacgcctgtcaattcaaataagagtactgttatcttctatattttatatagataacacaaataatccctaaactctgaggaacatactagtatcaacagtccttgttttacttatccagcagaccagacaaatcttttaaaaatctact

SEQ ID NO: 1665 - DNA, 1345 bp, Diabrotica virgifera
cttctcacagtccgactgtttataataaatagcatatctctctctatagcctatcaacaaatcttatcatatttacactagacccacgcgtccgcggacgcgtgattagagccacatcagagattgttcagctctttaaatagctgtaattttaaatctcgtcattttgatttcgttttagttaacctcattccaaatcgccaagatgagtttgcagtggacgataatcgccgggtttttgtacgcagaaatcgcagtagtacttcttttggtactccccgttgcttccccaagaagatggaactctttcttcaaatcgaagtttttgcaaggtttacagaagcaagccggattttacttcttgatgcttctgggcattctggtattgttccttcttgacgccattagggaaatgagaaaatattctaatctagaagctgaagaacatggccatgcccacctcgatcgtgagatgcaaggcagcatgagactcttcagagcccaacgcaacttctacatctccggtttcgctttgttcctgtcacttgtcatcagaagacttgttattctaatctctgaacaggctactttacaagcccaatcagaagcttcaatgagacaagcccagagtgcaactactgcagctaagagcttgttggcccaacgtggagaagtagcacaaaatgagagcaatgaagctcatgaccaggtaaacgaactcaagacaaaaattcagaaactcgaggacgaattaaaaacagaacagaaagataagactgccataaagagccaagctgagaacttggccaaggaatacgacagattggccgaagagcacagcaaactacaaaagaaggtgacaatccagggagccgagaagaaaggagaataatgtacattaaaaaacgttgattgcacatcctataactatttataataaaaagctttggttgtaacaagctctagtgtaaatatgataagatttggtgattggctatagtgagagatatgctattttttaataatattcgaatagtagatgaaaaaatttgtcttaaaattagttcttcaaaatctttgtttccattttcattagagtcactggagaaagttttttttttacaaggggaagaaatttgaaagactgcactgcttttgcttttttcacccaaaaaaaaaacccccccttttcacccctttttcccttttggggaaaaaaatttccgttttagggggggggtttttctatttttcttttttttttttttcttatatcatttggaaaattttccctttctcccccccccagccctcgcgaaatatacacccccaacccccccaaaaa

SEQ ID NO: 1666 - DNA, 1899 bp, Diabrotica virgifera
cgtcgtttgtttctttgcgctagtggccaaacagaagcaataacaatgaaattgctacttttaccaggttttcttctcgcgctgtcggtattagtgaaaagtcaacatgaacatcaccacacccacgagcagcatcgggtgaacgtatctgtttattacgaatcactgtgtccagattcaaagaaattcttcactcaacaattatatccatcacttcagccgcaaaacaacatttccgacttcgtcaatttaactctcgtgccatatggaaaatcaacaagaacatttgacataaccgattggaagtttgaatgtcatcacggagagatcgagtgttacggcaacaaaattcaagcatgtgctttgagacttatcgacaagggtttacccagcgaaggcaaaggctttaacaagggtgccgtaggtttcatcaactgtcttatggataaagctgacaaaacagccaaagtggtcttcccaacaactgaatgcgcattaatcaatccagtttccaatcttcaggatattgaaaactgtgccaatcataccgatgctgcaaattaccttgctcttctcggtaaggctacagatgcaatccaaaagccgctaaaatctgtacccaccatcgtattcaatggagagtataaacaaagcgacaatgatttagcgcagaccaatttcattaaagctctttgtcagtatatccaagacgacaagccagatgtatgttcaagtgctggcacctttacttttagtttatctttaatatcaatggccgtattatttacattatactagaagagtagttttgacttggttctgcaaccgtagaaatccaagatccatagttttttttagcgattttgtgccactagttgtattagccataccataacttaaatccgtcccaccttttccttgtaagcttgtagataaccaaaccctaactttgaaattactgtaccctaattaaactaaggaaacatttcctcgcatcgtctagtaggtgattgaacataatgaatatatatacagtaacagccacgttagtaggcacacgggtacattgagctaataaatgtacctacaccgctaagagtcctggaccctgcacttgttgcactgtttacttttatgtctagctagtgacgtctcaaacgtcagaaaatgtatagaaaccataggccattccaacatgctgtcaattttaaatcaatctgacagcgtagaggcaaacataaatgttttgtatcagttcttaatgtgttttagatcattttagttgcgtttatttgtaattttgttttgtacaaggattaatttaacatttttactaaaagaatcgataatatgcttaatttctgttgtgctttgaagtgtgaaatgcgaagtaatcgtgataaagttcagttttattggttaccttcagtgctacattttaagcataaaaccaactgaactaaataagttataatctgagagacaaaaacaatgattaaatataataataaatctataaaatgtcctattaaaatgctaaataactaactactgtacctactagcaacatctgtattgtctgccaacaactttcgaaaataatcactcatctttatttattcatggcttaaaactaaatatagtcgttcagttacttttacaactaaaaactacacaaaatcaacaacaaaatgttcgcaaaagacaactaaataactattacagatgcaaaaaatttaagaaacacaatgtcaaaaaatataactgacgcggactttaagtcatggcatgctccagttgtcgactagtcccttactgtctctgcgaatacacttattaattagtgattccatgagctgtcagtgggtggtcggtggatggctaaactgacatggcata

SEQ ID NO: 1667 - DNA, 1331 bp, Diabrotica virgifera
tcttgatcactttatgaagatactatggctctgttcactagtatcttctgctttcactcaagatcttgatcagctgtacagctatgtgagtgcaaagatagcggaaacaaattcgtaccagacaccgataaataatgaacgtttatttaaaacgaataattctactatctacgattttggacaatatgactttataattgttggagctggagctgctggttgtgtcttagccaacagacttacagaaattagcaaatggaacgttctacttctagaagctggtggagaaacaaatgcatttagtgatatcccacgatacagcaatgctttgaaacagaccgacatgaactggggctacttaacaaccccacagaaaacttgctgtcaaggtatgaacaacaatcaatgtatataccccagaggaaaggtaataggaggttcaaccacaatcaatgctgcaatatacgccaggggtagcgcatcagattacaaccattgggcagccatgggaaatttaggatggtcttacaaccatatccttaagtactttaaaaagtctgaacatgtcgctcttaagtcatatgacattaattatcatggaaaaaatggagaactttacgtcaaccaaacaacacctccttcaattgtttcgaagtattatatagatgccaacaaagagaaacatctaaaagaaattgattacaatggaagaaggcaacttggtgtgtcaaggattcaatttaatcaaaaagatcgtgtacaccaaaatgctgcgcatgcgtttttggatggtataaagactcgatctaatttaaaaattgtacttaatgcaggagtgaacaaaattcttctaaaaggtaaaaaagcaactggagtaacgtttatattaaatggaacaatatataaagccacagcaggcaaggaagtgatattatcagcaggagcgatcaactcaccccaactgttaattttatctggtgttggacctaaaactgatttagaaaacctcaacattcctgttcgaaatgacctacctgctgttggaaggaacatgcaagaccatcctttgtttggtaatctatacttcagaaccaacctatcatctcctgtactctctcttaaagaaaatctggcgaactatttagaaggaaaagcaccctttactaacggcaatggcctggaaaatattgcttttattaactccgatcatataactacaggagaactcgatatcgaattttttacatttgctcctcctttaggagtaccagcaaagaatctgcagaatttacaagacgatgttgcaaaagtatttagtgagtacaatactt

SEQ ID NO: 1668 - DNA, 1116 bp, Diabrotica virgifera
atgaggaattacaacttagcaattagattaagataagtacttagcctacaaaacaaaaacgaacattacgaataaacatagacctccggagagaaaatgatctgttcatccggcttaaatttctgccatgacaaaacaaaaacaactgccaaaacaaaaagaagtcgcatgatgtcaaatctggagaatacggtggatgaagcagcagtttgtagcccagttcgactaatttggtcatggcgacgtgaagacgtcaaccgttgttatagtagaagggcattttttcttaatataataatagattagcatagtagaatgctgcgaccattttgcatttataaaggtagttgatgtaaatcaacttgtgaatcgcataaacggtagtttatgagcctgattttgctgaaattttgacagtagccgtctacgagaatgtacatcgtacacaatagaaaatttttcatgcgacagtggcgccatcaggcggtcaggctagatacttatcggatcaccctcttacaccttctattgaatagaaattttatattccttcaattaaaaaaactcaaaagaaatgcaaaaaattccacaaaagtatattcttacacgaaaatcattaataattctttttaaggtaaacccttagctgatttgatttttcttttttgatttactcgaaattttgcggtattacatacctctacattctcagttctgtctttatcagtcactgcattgccttttgatgcatgaccttcacttttgttcgtattctctctgtcttttcttttgcttgcttgattaaaagttataccatgtttttgttttaagtgggcgtacaaattgaatgtatttcccaatgtttttaaaactctggagcaaaaattgcagcaagattaataaatagcaaccaaacattgctttagggaggagccatttttctttctagttttgttaactaaaaaacaatattcacactgtacccaaataccgatatgtattaaatgtgcatgctatggaccatttgctgggaattttttagagagtaataaatgacagaaactaagcatgtgcgaggaatactcatacagcttaagaagacctttcagagacaac

SEQ ID NO: 1669 - DNA, 1005 bp, Diabrotica virgifera
  misc_feature (979)..(979): n is a, c, g, or t
ggttatggatgagccataaagtaaaggtactcatatacaattctttatcaaaggataaaaattgtcaatttacacgtaagcttcttctacgtaaacactttcgtgtatttattacgaggtttcgtatacatgtgtgccattcaattgttagtaccattaccattagcaattgatgttttagtgaaaaatggctagtggtgaaattaggaaagttgctcttcttacgggagtaaatgggcaggatggttcatatttatcagaattccttctaaacaaaggctacgaggtacatggcattatacgaagagccagttccttcaacaccggaagaatagaccacctccactctgacccctacgcccacaaagggggccgattttttctgcattatggcgacatgaccgactctagttgcttggttaagatcatcggacaaatcaaaccaactgaaatttacaacctagccgctcaaagccacgttaaagtttcattcgacttgagtgaatacactgcagaggtagatgctgttggaacgttaagactgttggacgctattaggacttgtggtttggaaaactcgaccaaattctatcaggcgtctacttccgagttgtacggaaaagttgtagagactccacagaatgagaagacgcctttttatcctagatctccttatgctgcagcgaagttgtatgcctattggatagtcgtaaactacagggaggcttacaatatattcgcctgcaatgggattttatttaaccacgaaagccccagaagaggagaaacattcgtgactaggaaaattacgagagaagttgcaaaaattcatttgggactctctgagtatatagaattaggaaacttggattcgaaaagagatgggggacatgccagggattatgtagaggcaatgtggttaatgatgcaagaagaatcgccagaagacttcgtaatagcgtccggggaacacacagcngtagagaatttgtagaagcggcattt

SEQ ID NO: 1670 - DNA, 868 bp, Diabrotica virgifera
  misc_feature (792)..(792): n is a, c, g, or t
  misc_feature (806)..(806): n is a, c, g, or t
  misc_feature (812)..(814): n is a, c, g, or t
cgaaaaacggcatcacagatgaaaatctctccaaattggctacccatgcccaaatcaaggacaaacagaccatcgccaaccttcagttacttggagtcaacgttattaatgatggaggaccaagaaaaaaacaatatacagtaccgcgcaaagaaagaattacagaacaaacgtaccaaatgtcaagatggacacctatcattaaggatataatggaggattgcatagacgacaaactggatcagaaacactacccgtatttgagcggacgagcacagtctacgggataccatgcagcgccctctagtgcccgttatggccagtggcacaaagacagaggtcaacaagccgtgaagaacgttcctcgactgctcgtcttcgtcgtgggtggaatcagtttttcagagatcaggtgcgcctacgaagtgaccaacgcgcagaagaactgggaagtcatcatcggctcgtcgcacatactcactcccgaggacttcctaagcaatctggcaacgttggccggctagaatcagatgaaaaaggttacttttaatgtacccgagtaaacagtttcgcagtcgtagtttaaaataatgtaatgagtctttttaatcccaatttaaacatatttatatagaatgactttcgatcagtatcgaaccgttttctttgttacgagagttaaagctgttcaaattatcttgaaatttgtgcagaattgtcatacattaaattgttgcgcttctgaaattgttgtgcaataaaagaaatgtctaaggtgctcaaaactcaagnccttcgatgagttnatgatnnnataatgagaataaaagactcatgagcttaaaagtatatttctaccccctttttt

SEQ ID NO: 1671 - DNA, 899 bp, Diabrotica virgifera
atctacttcatcgacaaagaagtgagctatccattgagagatttcatgacagaatcctgccccaacttggtcggtttggttaaccgtatgaaggagcgatgcttctctgactgggacgacatttgcacaacattggacttgaattctcatttacccaaacccaaagcggaagaatcaaaagacaacaaagaggaaagcaaagacgagaaggagagtgacaaagaaaaagaaccagaggagaaagatattgagaaggaaaaggctgacgaaaaagaaaaggataaggctaaagaaaagtcagaagagaataaggagaaggaagggaaataggaaggtggttgtcttacacgccccactgccgaggctcattaatttctcttttgttgtctttcgtcttatagattcattttcatttaatatatacgattataaactatgtgcaacaaatcttagtttataagattcattcacttttaattgaaatatatttaaaatactcttgtcagtgacagttattgtagctttttttataaaatatataggacacttattcgcaagatatattcattaacagttaagacaattgtttgtataaaataattttagctaggttttttattgtaagcaaatgtatgtctaaaaaaattgacgggcaggaaagattttatgaagacaccgagttcatcactctttcagcctctcaaggtttattcatgttagtgcagtctcaatgtatccactatatgtccagttagtagtacattatatttcattcccacatttttagcagtcgcgagtgacaatactatcactcgattattacattttcccagataataatgggcgtctattgttaagttcaactatatcttttattactttgccgctctaattttttt

SEQ ID NO: 1672 - DNA, 1565 bp, Diabrotica virgifera
cgtccgcggacgagtgggcggacgcgtgggcggacgcgtgggcggacgcgtgggcggccggagagattgctgtacgagacgactcttctattctagagagctggaagctattgcagggaaactgctttttgtcccttgattagtcgagtattagttttatcttgttgtacattgtttgttgtggtgcttatcgcgtgtgttgttgagtgtttatattacttgaaatagaactagcgatggcaactgaggtcgaaaataacgcacccgaaacaaaggaaattaaggaggagataccgtccggcgacaacaaagccgatgaggccggtaaacaagaaaatgccggcgacgcgcctgcctcggcaaaagaaaaagaaccgactcctccaaaagtattggtacacaaaccaaatttcgaaaaagacgtcgtttatttgtatcagttttcgcgtacaccactgctaccatccctttcgccctattgtttgaaagtcgaaacatggttgagactagctggcgtcaaatacgagaatgtcgaccacaaaatgaaataccgctcaaagaagggccagctgccctttatagaactgaacggagaagaaatagctgacagtgccatcatcatcaaggatctttcgcaaaaattcggtcatgatctcgatgtgtgcttgacagcggaacagagaaatctggcccacgccacaatttccatgatcgagaaccatctagcctgggttgtaatgtggtggcgcacaaaatatcctgatcaagtgctcaaggggtacaaagttaatttgcaacacgcacttggaaccaggatacccaacggtattcttaatttcttctttaaatttgcttttggtaggaagtggttccagggaaccaaaaaggtcaaagcacaaggaatgggagttcattcggcggaagaaattaacgaattcggccaggaggatttgaaagtgctgtcagaaatgttagccgacaaaccattcttcttcggagacgaacccactacattggacgtcgtcgttttcgcacacctggctcaaatctacttcatcgacaaagaagtgagctatccattgagagatttcatgacagaatcctgccccaacttggtcggtttggttaaccgtatgaaggagcgatgcttctctgactgggacgacatttgcacaacattggacttgaattctcatttacccaaacccaaagcggaagaatcaaaagacaacaaagaggaaagcaaagacgagaaggagagtgacaaagaaaaagagccccaagggcaaaaaaatttaaaaaaaccaaaaagggacaaaaagaaatttttaaagggttaaaaaaaaggttaaaaaaaaaataagggaaaaggaaggggaaaaaagaaagggggggtggttttttaccccccccccccgcccccggggcccctttaatttctttctttttttttgtttttttctcccttataaaaatattctttttttttttttttataaataaaaaaaaaaaaaaaaaaaaaaagggggggaacaaaaaaaactttattatttttttttaaaaaa

SEQ ID NO: 1673 - DNA, 1383 bp, Diabrotica virgifera
gaagactttcatttgtttattttttactgcgcagaaactcgcgcagtttactcagaaaactttctacaatatagaataggtattcaatatcggttgatagataaacagaacaggaagaagtttattataggcggtggattttattacagcactattctcgataaccacacagatgttgggaatttctgtatacagcagttggggtatttatttatagccattacaccgttaaaaacagaggtgttacagctcaataggaatttcatgggacatctaatgtacctcgttacaagcgaaacctcgtaataactgtgtttgttatagagacagttcgactgtatagctaattcccatttttttcgttgaatcacactgattgtttcaaggaacctcatctctgtatgttgtactagacatactgtcatgcttattcggaatacgccagtttggatgatgagtactgcatggtaacacttgttttgaggttagctccggttcgtgacatttcgtagagattctttgattacagtttgttgtattaaatagaaaatgtttaattctgctgctcctcctttgtggcataacggccccgtacctggagaattttacaattttcccggcaaacagaccagctattccaaccctataacacatacacagtctcccgttacaacatcaacttctgtattagctattacttacgataaaggagtattgataaccggagatctggttgcttcatacggatctttagctaggtacagaaattgcccgagggttattaaagtcaatcagaatatcatcttgggagccggaggagactatgctgatttccaatacgtcaagagtttcattgagcaaaaaataattgatgaagaatgcattgatgatggactaaaaatgaaaccaaaatcattgtactgctggcttactagagtaatgtaccaacgcaggagtaaattagaccctttttggaataatctggttataggaggaatccaggatggagtcccctttcttggaaccgtagataaattgggaactgcatatacagacaaagttatatgtacaggttatggagcccacatagccttgcctcttctgagagactctttagataaaaatggagctcttaacttggccgatgccaagactctgattcacaaatgcatggaagtgttgttctatagagatgccagaagttttcctaaatatcagcttggtgttattgataaagatgatggtgttagtattgaggggcctatttcagtcgaagagaactggagcattgcccatatgacataatttttcttaatttcgtttattttgtattgaaactatattatacatttcatggaagtctgtgtgaataaattttttgat

SEQ ID NO: 1674 - DNA, 958 bp, Diabrotica virgifera
aacgataaggtgcttgttcgagatgaactttttgattacaattttggctgtagctctggtaggttctactacaacgagagctgaaatatcaggaccaccaggtcaaaatcttgttagatatgtcggccaattacttggaaaatgttttccaaaccaaagcaacgcagaagatcaaatgtatacaggaaacaatatattggaagttttaaacgcacaagctggtgttgacatctttgtcaaaacacaaaatggtataaaaatcaatgctgatatttttgctgcaatactcagtgattgtattcaatcctccttacaaggccaaggtagtacagcaattcgcataaataaacgagatgtgacaccagctattaacgctcttttatacaaccaagaaatgagtgttcaagacatcgacatgttcgtcttttccagacaattaaatccaagatttagaagagatctagcatttccattaaatctatttcaagaagttatttccaccatcatcttgcaaccactaattgctcatgtaaactcaatttttgacggtattgataaactcattctttcttactacgtcgatcccgcatccgtaacagatcccattcaaagcattgttattaacactatcaacaacgcagttcaaacagtttcaggcataataaagaatattaaagcacaaattactgaattattttcgactgtaatcaaggaaggaacttctaccactacagcatcgatacaagctaaaagtaaaatcttgcaaacaaaagatgcgttttctgatagttatcgaaaatttgctcgaccagcccataatttatctagaaaatgatattcttatattactgagagctctgatgatatcagtctgcccaaatagtgtaatatttaagcctatcattacaaacgcataaaatacatttcatccaatagcattttccccagtatatgaaaa

SEQ ID NO: 1675 - DNA, 238 bp, Diabrotica virgifera
atcagttgtaaaagcaacatgaagattgtaagttatattttatttgtgcttggtcttgttgcattgggagtattccaagcggaagctgcaaaagctcctccaattaaacccattcttaaacacgttcatgtagacattcaccatcatgaccatgactaggaccataattaacacatttttcattaactttgttataacatgaataaaatatattcttacattgaaaaaaagagggaag

SEQ ID NO: 1676 - DNA, 1632 bp, Diabrotica virgifera
acatattagtcattgaaataatatataaggagaagaagtatatctttctctctagttattaaaaaaattatgtctagtcttgccgtcttcataaacaggatctaactgtgtaaattatgaggattttggatgccatgtaatagaactgctgtgtgggaaatcttgaatttattggtgttactaacaaaatttgcagacaccatcatcatacaatgtactcttgttggtgtggacattttaatactttgaattggtcctcaaaaatgaaaaatcaattaaacagcattgactgtacgacgccagaagtgtaggccagactaaaatgttgttcgaggactgttttgactttttgaaacaatacatagttatgtaacaattcttgatggactgaaagaactctaagttaataaaacgaaaaggtaaaaagcatggaactggaaaagaaggatctaactgtggtggattatgaatgaaagttggttaatatcataaaagctgatgaaaagaaaaacattattatattctaatacaaaaacaagaacatcaaaaacaaattttaacatttcttcgagaaaaaagcatttaaagttggttattttgcgcagtagtaccgcgccgtatacgtataatatataaaacagaacgcatttaccgatctcgcgatattcaaatctctataactacggtaatattgctccaatgtactttaaatttggcgtgaatccttttgaagtactatacttttatacgaaataatataaaataccaaccgttaaccattttcacgtgaaactgtactccagaagttggttacatttgtccacgcttcgcttttatacaaaattgaaaatacttaagtctcttttaacattggtagtcgagattccatgattcgatcgttctttaaacccaattgcggaataaaagcggcgtggcacctgggtggcttgccgatttcgttgcctgttagggtgtgccactgaggcgctacgcgttgttcgtcgacttcgtgcagaaagagaatttttagtactatttaggctttgaacacttaggttagctagattgtaactgtgttgttatcgtattaagtgtcaaccagtcgtgctcaatacacaacatgactataactctcacaattgtaaacattacattcaaaactacagttacatgtagagtgctcttaaatcccttctttaaaagtctttacgttattaaagagttgatttttaacaaaaataacatttaaacgatacatttaacactactatattgctctgctgaacatactagtaccaattttacgcgtgtctctataaaaactcatctgtttcatcctcaggcatgcgcatagctcttactaacgataagtaagacagttagaccattgattccacagtatgttccttcatccatttaaacagctcgcaatatagtattatcaaatattccaaaactttattatcgttaaactttttagttaagtattgttccacgcaacgtacccataaaactcatataagttatcgcttttctgtaggtaatgagtcgctaaacagtgggaaaacttatgtctcaatagcattacaggccccactgctgactccgtttttgacatgagagctaacgcat

SEQ ID NO: 1677 - DNA, 988 bp, Diabrotica virgifera
  misc_feature (884)..(884): n is a, c, g, or t
  misc_feature (917)..(917): n is a, c, g, or t
  misc_feature (958)..(958): n is a, c, g, or t
  misc_feature (965)..(965): n is a, c, g, or t
aggacgcgtgggttcgtatttttttcttaacaaaagggcaaaatgagcttttttggaaaattgttcggggggaaaaaggaagagatagcccctagtcctggggaggctattcaaaaactcagagagactgaagaaatgttaataaaaaaacaggattttttagaaaagaagatagaagaatttaccatggtagcaaagaaaaatgcgtcgaaaaataaaagagttgcactccaagccctcaaaaagaagaaacgattggaaaagacccaactacaaatagatggaacccttacaactattgaaatgcagagggaagccctcgaaggagctagcacaaatactgctgtattagattctatgaaaaatgctgcagatgcccttaagaaagctcataagaatttgaatgtagatgatgttcacgatatcatggatgacatagccgaacaacacgacatagccaacgaaatcacaaacgctattagcaatcctgtcggattcaccgacgatctggatgacgatgaattagaaaaagaattagaagagctcgaacaagaaggattggaagaagacctgctccaagtgccaggtccaactcaactgccggctgtgcctgctgatgcagttgctactaaaccaatcaaaccagcagctaaaaaagttgaagatgatgacgatatgaaagaattggaagcctgggcctcgtaaaattcctgaaatctggatatttgtaaacgaaatcacccatctaagatgaaaacattataaatatataggtaataacagctaaaaacgtttcaatgtagaacaagcttttgctgaaaaggcgtcttgcaaaaaatgttgataatttagaattctctatatattatatatttgccctttangaaagatttcttttatagtcatagttcaaccanacgtttcataaatagaattacaggggtgtcagaattctacngtgattnattgaaaaaaaaagacttttcct

SEQ ID NO: 1678 - DNA, 699 bp, Diabrotica virgifera
gactagttctagatcgcgagcggccgccctttttttttttttttgatatttatctaaatataaaaattattttatatatttggttctctccttttagaaaaaatgtaccgttatttagcccgtcgtacaggggccaaattcgataaaatactcctgaaaagattgtttatgagcaaaatcaacagaccaccactatctttatccaagttagtgcgtttgatgaagaagcctggccgtgatggacttattgctgtcgtagtaggaacaattactgatgatgctaggatttttgaaattcccaaattgtctgtatgtgcccttcgcgtgacacaaactgctagggccaggatcttgaaagctggaggtgaagtcatcaccttcgaccaattggcactcagggccccaactggcaagaaaactgtattgctacaaggacagacgcaatgcccgtgaagctgtgaaacactttggccctgctcctggcgtaccccaccagtcatgctaaccctttggtcctttcgccagggacaccaatttgatgagagcaccaaggccgtacgcgcccatgtgatcaccagacaatagacttaagttaatcattttgcttcccgctggatttctaatttgctggtctaccaaatatgaacttcgtgtaccttgagaaaaaaaaaaaaaaacggcgggcgctctgcgggaccc

SEQ ID NO: 1679 - DNA, 849 bp, Diabrotica virgifera
accaaaattatacacatgcgtgccgcgctcttttcttttcccaaaacttgacaaaaatgggtatcgacatcaaccataaatacgaccgtaaggttaggagaacagaacctagaagtcaagatgtatatttacgtcttttagtaaaactgtaccgttatttagcccgtcgtacaggggccaaattcaataaaataatcctgaaaagattgtttatgagcaaaatcaacagaccaccactatctttatccaagttagtgcgtttgatgaagaagcctggccgtgatggacttattgctgtcgtagtaggaacaattactgatgatgctaggatttttgaaattcccaaattgtctgtatgtgcccttcgcgtgacacaaactgctagggccaggatcttgaaagctggaggtgaagtcatcaccttcgaccaattggcactcagggccccaactggcaataaaactgtattgctacaaggcagacgtaatgcccgtgaagctgtgaaacactttggtcctgctcctggtgtaccacacagtcatgctaagccattggtacattccaagggacgcaaatttgagagagcacgaggtcgtaggcgctcatgtggttacaagaaatagacttaagttaatcattttgtttctgctgtattcatatttgttgttcaataaataggaattgcagtacattggaattttgttttgtattttatagaatataacaaaataaaggaatttaatatagttctttttatcaaaaaaaaaaaaaaaaaggggggtcccctttttttaatttgcaaggtttctttttacatcccgctttgtcgcagtctatagcttcttcttt

SEQ ID NO: 1680 - DNA, 398 bp, Diabrotica virgifera
ggactaaatatgaaggctttcgtttgtctgcttcttgtagctgctacagccagctatgtacaaggtggcttccttagcggcggaggcggtggcggctggtccggaggtggcggaggcggaggctggaaatcaggaggcggcggcggttggtcaggtggcggcggaggatatggaggcggcggtggatacggaggcggcggctggtccggtggcggatctagcggctggaaatctggaggaggcggtggatggataggcggaggtggtggaggatacggaggcggcggcggtggaggatacggaggcggcggaagcaccgttaaaataattaagatcctcgtaccaagcggcggaggcggcggcggcggtggccacggaggttggtccggaggcggcgg

SEQ ID NO: 1681 - DNA, 1115 bp, Diabrotica virgifera
cccacgcgtccggtttggggttaaattttgttaatttcaagaattaaaatatttaacataaaaatggtttctatattaaattcaatagatactggtcatgaagatatgatacatgatgcagaagtagattattacggtttaaggttagccacttgttcctcagataacagcatcaaagtttatgatataaaaagtggagcttccacactactggatgatctaaaaggccactatggacctgtttggcaaatagcttggagtcatcctaagtttggcaacttattagcttcgtgttcttatgataggaaagtaataatttggaaagaacagcaaagaaaatggataaaatattatgagtatgcaaatcatgattccagtgttaactctgttcagtttgcacctgctgagctaggtttaattctggcttgtggaagtagcgatggttcaatttctcttttaacttataatgttggaagtaatatttgggatgccaagaagattcaaaatgcccatgcaataggatgtaatgctgtaagttgggctccagccataacccctgtttttggagatgagactacacctgtgaaacgtcttgtttctggaggatgtgacaatttagtaaaaatatggagggaagatggtgacaggtggattgaagagtccaaacttgaagtacactctgattgggtaagagatgtagcttgggctccatcagtaggactccacagatataccattgccagctgttctcaagacaggagagttgttatatggactagcaatgattgcatcaattggaattcaacagtcttacatacatttgatgatgtagtttggaatcttagttggtctttgaatggaaatattttagctgtatctggtggagataataaaattacctttgtgggatcaaaactcagaaaggtagttggcaatgcattagtgatattgccaggggccagggcaaaatcatatctatgtgaattcgctatttaaatagaattcgaaagggtaaaattttgcatttccttctgaattaagttttaattgaatgaataattttactactcctaattttaaaaaataaattaaaaaaaaattggcctaatttggcc

SEQ ID NO: 1682 - DNA, 922 bp, Diabrotica virgifera
atggattgcacagaagtagaggaaggatacaaagtcagatacactccactagccccaggagactactacattagtattaaatataacaatcaccatattgttggttcacctttcaaagtaacaagtaaaggtgacaaaaaggtagcggatattggtggccaggaatcatcttcaacggtggtagaaacagtagccaaaacaggaaaagccaataacaacaaaggacctgttttgccagccttcaaaagtgacgcatccaaagtgctgtcaaaaggaatgggattaaagaaagcatatctaggaaaacagaatcaatttacggtttcagcacagaatgcaggtgtgaacattcttttcgttggaatccacggaccaaaaggcccttgtgaggaagtatttattaaacatcaaggacataatcagtatgctgtcaattatatggttagagatagaggtgactacctagtaatagtaaaatggggagacgatcatattcctggttctccttttaaagtggaagtatagatattaaatttatttttttacatattattgttgatttgttatttttttactttagccatatttttgtgcgtaaaggcaaagtggtgtatgttttttggatactcttcatatatagtcataccaaatataataagttacaaaaattgtaacacgaatagagattattcaaaataaacaacactttgactttaagcatagtatttttaactgtttcgtgtcatttttattttgtacataccaggttattaaaaatttatgtttctttattagaattatggattcacaaaatttttgtaagattcgtaagtaagatatccaagtgcctttacacctaagtgatttatatgctgcataagcaatataaattgtataatattttttaaaatggaatttacat

SEQ ID NO: 1683 - DNA, 945 bp, Diabrotica virgifera
  misc_feature (9)..(9): n is a, c, g, or t
  misc_feature (14)..(14): n is a, c, g, or t
  misc_feature (16)..(16): n is a, c, g, or t
  misc_feature (835)..(835): n is a, c, g, or t
  misc_feature (877)..(877): n is a, c, g, or t
gactgcggnagagngnatattcttgacttgacgatgaggttaactgtacatatatgtttgtgtttgactgtgattagtttgaaggtatatgctgaagatgatttggaaggtgttgtagttgaagcagctgcgctacctggagaaacaagaagtagccgtcagttctatttcagaggaccttccattcctgtttataatcccttcatgataccacaagtttggagctccttcagtacaaactctttaaacattccaaccattggtcaatgtttcacagctaaaggagttgtaggaaaatgtacatcgttccgacaatgttatcccttctttaaaattgcagagtttggcaactttgaaagctgggtgttagggatgtacgatacatgtagctattatacagcacaaggcagacagatgtttggagtatgttgtacaaatccaaatcctggaaaacctgctgagtcttccccaggatcatctacggaacttccaatagttgaagctgaagatactgttatagatgcactacaaacaaatagtagcgcaataccttattttccacaaatatttaactggcctcccccattacctacccattcccctgataataccattccaccactaccgacacatcctccttcacttggcttgcctaccgtatcccctacagcctggccgccaacttcccaataaacctgtaagtccaatctatcagccaactgttaaacccatttaccaaccttcttttccgacgtacaaaccacctacgtacaaacctccaacacacaaacccactagtaaaccaacaatagctaccgttgctactcagcccttncccagtggtgcctgtggcgccaaaaatggatattcagatcanaaaagggattgtcgggggacacaacgctgagggtcatgaatgggccgtggattgcagcacttttttaa

SEQ ID NO: 1684 - DNA, 919 bp, Diabrotica virgifera
gcaaaatgtgaagtttctagagagaaaaaaatgttttaaactttggcaaatatggagactatatctgtaaacattaaaccagaactggaagaatgcagaatgcatgtttgaaaataattgcacagaggattctttatcctcgtatatattaaaatagaagaacacgtgttacaatgtgaaataaatagtccatttacccatttcccatcatcagtaatcaagaagttaaaacagaaattaaaaaagaattggatgaacataatttaggagtaaatcatgggtgtgaaattcgatttaaaagaaccgatccaaaagatttagactcagacgaagatgtaaaattaccgataggggcttcagctgagatacatcatgaaaagcattgtggaactatggaaacatcaaaatcactgtccaacatttgtaaacgaaggatacgtcagaacgagattaaaacgaaattcgaaagttcgttggtaacagccactggagaaaagcgttaaagtgcgaaatttgtttcaaccaatttagtcgagcaggtcatttcaaagagcatttgagaacacacactggagaaaaaccttacaagtgcgaaatttgttttaagcaattaagtcgagggggaaatttgaaaacgcatttaaggatacacactggagaaaaacctcacaagtgtgaaatctgttttaagcagttcgttcatgcaggtaatttaaacgtacatatgagaactcacactggagaaagatcttacgagtgtgccatttgtcttaagcagtttactcaagcaagtcatttgaaacttcataacagatcgcacactggagaaagccttacaagtgtgaaattgttatgagcgattcgttaaagcaagtattttaaatgtacatttgagaaaacacactgtaaaaagagctca

SEQ ID NO: 1685 - DNA, 1011 bp, Diabrotica virgifera
  misc_feature (815)..(815): n is a, c, g, or t
  misc_feature (908)..(908): n is a, c, g, or t
cggaatgccgggactatccacgagtccgcccacgcgtccggcagatttatgaagaaataagtttttttttctgcttttgatttgaatgcttcgcgcattctaggttaattaaagttacatcttgataataaaaatatcgtaattatgaagaggcccaactttaaagtcggcgataaaatcttcgccaaagttaaaggatatccagtatggccagcacgcattgtctccgaagctggaaaaaagttcaatgtcttgttttatggcactggtgaaactggatgcattagtagtgaacacttgttctattacttgaaaaataagaaaaagtttcagaaaccattgaaaagacaagactacattgctgcttttaaagagatagaagacgctataaaaaaggatggcggagatggggatgaatctccagataaaaacgattctctagcagctgatgtctccttggacacttctactgccaacaatagccctgtagtaaaaacggaaaagaaaacaccagctaaaaggaagcggtcctctgtggcagatgacgctgcagcagccgagacgagcacacctaaaaagaaatcttctcgtctttcaaggaacagtgaagaaccaccgaaggtagaaaaagataaagacatagtcgaaccagaaacaccgtctaaaaaaccggaggaacctgaaaaagtagttcctaaaaaagaaaaagtggttcctaaaaaaactccaaaagctaaagttaaggaggaaaagaaaaaggcagataagaaagaagaggagacaccagtagaggagaagaaaacaagtgacgctgngattaaggaagagactgaaactgtaactgacatgagtgtagaagatgaaaaacctgaaaataaagaaaaacctttagaaataattgctgagcnatgtctaagacataatatcctttatgcaaaccatgtaaagaagacagagtctgattataaagaaagccagtagaccgcgagacgattctcctgatcaaatatt

SEQ ID NO: 1686 - DNA, 836 bp, Diabrotica virgifera
  misc_feature (713)..(714): n is a, c, g, or t
  misc_feature (741)..(742): n is a, c, g, or t
  misc_feature (749)..(749): n is a, c, g, or t
  misc_feature (764)..(764): n is a, c, g, or t
  misc_feature (804)..(805): n is a, c, g, or t
gacagtttggtttaggattccgataggttgttggtgtaaatttttttgtataagttagttttaatgtaataattataaaaacgtgaataagaaagtctcgcgattatcccctacagcagtacttgtcctgtagatcataatgatggcggaagcagatgcaacggtcgaagcgaccagaagattaaatgtaaagaaacaaacgttggatgatgcttatgcggcaccagctaattttttagagatcgatgtcgttaatcctgttactacaattggggtgggaaagaaaagatttacagattatgaagttaaaatgagaacaaatctacctgtttttaaagtaaaagaatccagtgtacggcgacgatacagtgattttgaatggttaaggaatgaattggaaagagatagtaaaattgttgtgcctcctttacctggaaaagcttggaaaagacagctaccttttagaggagacgatggaatatttgaggaagattttatcgaagatagaagaaaaggtttagaagtttttattaacaaaattgctggccatcctttggctcaaaatgaaaggtgcctacacatgtttctacaagagcctcagattgatagaaactatgtacccggaaaaattcgcaatacataaattaacaaaagcctagctagaattccatccttgtctctactattttatttctattttattttatatgttnnattcgtgtgcattacttctcatagttnnctagttnggtttgaatatattntgtatatttttctaattaagactttagaaatttcggtggnntatattatatcaaattattttttaatagtat

SEQ ID NO: 1687 - DNA, 1031 bp, Diabrotica virgifera
  misc_feature (974)..(974): n is a, c, g, or t
ctgggccgatatagcaaaagaacttggaactaataggacttgcttcagtctttttattaattatatcaacaatttccacagtaaacttaaaaagggaggatttacacctgctgaagataaaaaattagccaatttggtaaggaaatttagagtaggtgattacataccatggacaaaaattgccagacactttagatacagggaaagatcacagttacatcataggtttaaatattttttgaaccatgttgataagaaacaaggaaagttttcattggccgaagattgcttgatttacatatgcgtagaaaaatttggaatggcctatcatgaagttacagaacatttgaagggtagatctcgtacccaaatacgaactagatatataacttgcttgaaattagatgccaaaaagaatacatggacggaagctgaggacgatactttgatacgcctaagagaacaacagactaaaatggattggacaactattgcacaaacgttaagaagaaccccgggtcagacgcgtcaacgttatcacgtaataaaaaaatatttagagaagaactcaggaagcaccattatgaatgtaccaagaagaattcatgttaaggaagaaaataatgcagtactcaagcaagtggcgaatatttttggagcacaaaatgtgatacctacgttagaagaaataggagaaatattaagtaattatttaaatgaacccctgtctagccaaaatgacagcgttgaagatattgatgttttattatacgatttctttttgagtacctccgatcaatctcttgaaattttatcagatccacttgcagtcaaaacgggttgtagattatgtagaatatctaatgaattttctttaaggtagacgtggacattcctaaaattttggcgaaatgtccacatataaatagtctcgacaaaaaattattgtcacaaataagacctagaaaagcaanaaaacctggttgtgtctcttcgaatcccattaaagattgcattgcaccaaatttcta

SEQ ID NO: 1688 - DNA, 459 bp, Diabrotica virgifera
ccgggtccacccacgcatccaacaactaaagaccagcgtcagcaatgaaatacttttacttgacatacgtcttgatcacttacttctactatataaatgccgaagagtctccaagtctagcagctcttgcaccaaaatgtgaatgcggggacatcattgacaagattctgtgccaattgacagaaaactctaaagaaattctcacactccaggtaaaactagtgtcaattagaaaagaatcaacagaacttcaaaacaacgtagctgagaacacgtgtctggttaactcgatcgaagcagacgtcacagtcattgaacaacaacagaaccaaactgtgaccgttgtcaataaccatacagctatcatcgtcgacattgagacaaacctagaagtcatcatccaggaacaaaatgtactcgagaccaatatcgaggcaaacagttgcacacttgccgata

SEQ ID NO: 1689 - DNA, 948 bp, Diabrotica virgifera
cccacgcgtccggtaggtattcctagttcaaggcgacgcgcgacgactcactagtatttgacgttccgtccgagtgaaaatattggtgtaccgttatcagcaaaagaagatggcaaaaactgtaccatgtggatcacttaatatgccaacggtgggactaggtacatggcaagctaccgatgaagcagagttggagaaagcattgaacgtggcattggagactggttaccgtcatattgatacagcagctgcatacgaaaacgaacacataatcggtaaagttttaaaccaatggatatccgctggtaaattaaaaagagatgatctttttattgtgaccaaacttccaatccagggaatacatcgtgatcgcgttgaaaaatatttaactgagtctctaaaaaaactggaattagactatgtagatttgtatttgattcactttccagttggtcttgcaggaactgaaggcggtatagtctttgaaaaggaagaccatttgggagtatggaagagtatggaaaaacaagtcgaagctggcagaacaaaaactataggtttatccaatttcacagttagccaaatcgataatattttgaagaattgtaaaattaaaccagcaaacaaccaagtcgaattacatgtttttctacaacaaccagaactggtacagttctgtcagaaaagtggtatttccgtaacagcctattcgccaattggaagtcctggcatgaacatatttttgaagaaaatgggtgtgaaggagaaaactttggtcaatgtattagcaaaccctgttgtcttggatatagccaaaaaacacaacaaaaccactgcccaagttgctttacgattcctgttacagcaaaacatcattgttatacccgaaagcgtcaatcctgaaacgataaaaagtaattttgacatttcaactttaatttagacgat

SEQ ID NO: 1690 - DNA, 928 bp, Diabrotica virgifera
tactcgcacgtaaacaaccgccgccggaacctcgtatgtgtgcaatgatgagcctccaatactgtggattggtccttttggcaggtcttttgttggtttccgcccaccctggaaccgactctaaggctgaagccaaggtatcttcagtagccgagaagaaacaggaaaaacgtggtcttcttgatctaggctacggtgggggacacgactttggaggaggacttgaacttggagggcatggtttggatttgggtggacatggtggtttcgacggaggatatggtggagggttaggtggagggtatggtggattagacgaaggtcatgttaagcacattaccatcaccaaagaagttaaagtacctgttcctgcaccatatcccgtacacatcgaaaagaaaataccagttccagtgccagtcaaagtacctgtaccagtagatcgtccatatccagtacacgtacctaaaccatacccggttcccgtagagaaaccagtaccatacccagtaattaagaaggtaccataccctgttaaagtaccatacaaagtaccatacccagtacctcaccccagtacctgttccaaaaccagtaccatacccagtccacaagccagtgccatacccagttaaagtacccgtaatcgtagagaaaaagtcccagttattgtccacgtccatgacgatcatggatttggagggggctttttgattggggtttgcatggtttttggaagggggcttagacctgtcctgcccactatttattaaacccaacattaaaccacgtgcccgctgtttctatttccactgacttattttcctctatggtttggtggaccgctggttcttcctcatccttttaccttgaaaaaaaaaacatatttaaaaccttttttctcaccttattaaaaacattttttatt

SEQ ID NO: 1691 - DNA, 1238 bp, Diabrotica virgifera
  misc_feature (994)..(994): n is a, c, g, or t
cgatatctatgaatttatcactgttgacttttggttttcaaattagtttgttaatttttatatatatatttttatatataactgcagcccaatggcaaaaaacacgtttagttctgcctttcgtaaaattgatgtagaccagtattcggaaaacaactttaaagaagacgaaaccgattcagggggctcagttggtccagacgaaactgaagtcaataatttacttcaaaaaggtaaaaattttgatgccttaaaggttgtgctgaacaatgcaccactaggaataaaaaatcagcaaattaaagaaactgcattcaatgtgacttttaaagttttattggcaatcaaaccatcccaaatagaagagacagtgaactccctagatatcgaatcattagatactttgatgaagtatgtgtataaaggatttgaatacccatcagaaggaagcagtggtcatttacttttgtggcatgagaagatctataaccttgctggagtagggtgtattgtaagagtattatcagacactagaagaatatagagattttaattcatatttcgagaaatacaaagcaaaactattatagagaaatgtcttcaaaaaacggggcaattgtagttgatattttgttttgtattactgtgttacttttatcctgcaatggaaaagacttaagctttatttgttcctgtattaatttgtacacttatgatattacgatttcaagtcatctttagtgctatatttcaattatttttgtggctatattatactgaattcatgattttatttctcttgattataaatctacagtatagcttgaaccaatcatccctattgtattataaaaaacaagaattgtttagaatgatagttttcaggaagagatagactaataaatggatcttttcccccaaataaactccattgtgatagctaatgtatgtatacatctaaaaataagccagttcttctatcatattattttgntgaaatgtttcacatagttcatcattaagagaagtactccaaaacacactcaggaagacttaaaagcatagtaatatttcatactaaaagaaataaaataaataaatatggccttaggaaaccgtggggaaggttttgtattctggagttaattttattggctttttaaaaaaagaaatcatttttttttatatttttcgttaaaaaaaaaaaattttttttttttttttcttttggttggggc

SEQ ID NO: 1692 - DNA, 1281 bp, Diabrotica virgifera
ctctacgcgtccgcacgaacatgacaattttaagaaatttggctgtgcttactctagtagttgcaacgtttgctcaagactattatgatgatgaacctcagcctgcgcctagacctagacctgcacctgctagagttcaacctaattactcaggaccatcagcacccagaccaacaccagttccaattcttaagcagataaataggcacaacgaagatgggtcatatacttatggatacgaatcagcagatggtacatttaaaatagaaaccaaattaccaactggagatgttaaaggaaaatatggatatattgacgacaccggtaaagtccgtgttgtagaatatggtgccaccaaatatggtttcgatcccagtggagaaggcataactgtaccaccaccaacactagtcgatgaatctcaaaaagaaggtccacaagatgccgactattatgaaccacaacctcaaccacaaataccaataagaaaagcagcaatcgcaagaccaagacctcagcaacaacctcagccacaacaagctttcgaagactattctcctccacaacagtttgaacctgcaccagctccccctcgtccagctccagcacaatcaaatttcgatttcgactttggaccagtagctcgcccatccccagcaaggtcattcgctccagcaccagcccccgcaccccgtccacgacctttgcaaattcctggtgctcggccctctcctatcgatgatgggtttggtccagctccagcatcagtcactagaactcaagttccaagagtaacctacgctcaaccagctccaattccttcgagaccagcaccatcgtatgacataccctctgccaggttcgctcctgcccctgcccctgcaccaaggcctgcacctgtttatcacccaaggcccgcaccctcaattccagtcgcaggaaggtcaggaggaattttggaccagttaagaaaggactacccctttgccggcaaaaggaactggccccccttcatgaaattaactcttgggctctttttaaaattaaaaaagggaatatttatttaattctaaaattgtgaaaaattttttaaacccacagggcgttatttttttaaactgggaccttttcggggtaaaaactctcccaaaaaacttggaaaattttgtcttttccgctttttttttggagaatatttttttgtttttacataaataattaaacttttcataaaaaaaaaaaaaaaaaaaaaaaaaaaaaaagagaggcgggggggcgggc

SEQ ID NO: 1693 - DNA, 1081 bp, Diabrotica virgifera
ctcctatagggaaactggtcgcctgcagtacggccggaattccgggtttttacgcgtccgggaaacaccggcaaccggcactcggcatttcaccggttcgattccaactatagaaatgatgtaaaattgataaaatcattatcatatttacaatttgtttaatgtttatacacaatgtcaaatatcttttgaattattaacgaagatccaccatgaacgtagaacaaaattcattatcccactaccacaaggcactactagccaccagtgcaagcaccatattgcagtcaggattactactagatgaagatttacaaattctgataaacttttacaaacacgatccctcaatcacatttccagtctatactccatctttattttttagaataggcctagcctcatttgtgggaagccttgtgttagctaacagattcacaaaatggctcgtattaccttcaacaatgatggcgactgtagcaactgtggtagaagtaaaacagtctcgcaaaatcacaaacagaaaagaaattgtggaaaatgtagtaaatatttcgaaaaagatcaacacactgaatagttctataaaaaaatatttaaaaacgagaattgatataaaagacaaaagccaaaatgagttctttcaaggctacaacatacaaactcacgaatttttgaaaaatatgagggacgacgaaaaaatgtttgtcgtaaccatcatgaataatttggaaatccttacgaactattctgataacctaaaagacgattttaacttatttaaagacttcaaacctttagacaaagtacaacttgaaaatatagaagatggattaaaattcataattcaagtacaggatcttcatatttggataatatcaaagttacttagctatattagtaccgtatctcttggtccaaataacaagcttgatgcagcagctgtaaataccttatttgatgtaacactagattctttgttgcgttttttaaaaaatcactacgaagtaacgagaaaatcgtttgctagtttgcgtagttctgttcatacattacaacaaatcagaaacggccaaaaatg

SEQ ID NO: 1694 - DNA, 1169 bp, Diabrotica virgifera
tgaaaaagtaattgatattattttgatctcttaatattcatatttttgcggataattttctgcgtatatttcgctttgaacgatactccggtctcatctaagaatttccgggtttattaatattgtgtggacattacataaaattttaaaatgccttttaagccaatattcaaacgtaattgataaaaatttgctttttcgaggaattcagtgtaaatattgaagagtttatgagttacagtcttgtaacgaaaccctaaaaaacaaattatatagttagcctttttgtttaagtttgttttttagtcttttattactgtaagcaaggaaatgttgctatcaattttatatattcaataaaatgtcaaattgcaaaaaaaaaaacccacgcgtccgcccacgcgtccgacaaaaggccttcgacaaaatcattggaggatggaaactcaaggttgatgacttggctgctgaactcgatgccagtcagaaagaatgcagaaactactccaccgaattgttcagacttaagggcgcctacgaagaaggacaagaacaacttgaagctgtccgccgtgaaaacaagaacctcgctgatgaagttaaggatctccttgaccaaattggagaaggtggccgcaacatccacgaaatcgaaaaggcccgcaagcgcttggaagctgaaaaagatgaactccaagctgctcttgaagaagctgaagctgctcttgaacaagaagaaaacaaagtacttcgtagccaacttgaactttcagtccgtcaagaaatcgacagacgtatccaagagaaagaattgaacacgcaagaatcccgactccatgcaagctgaagcttgcacctgtcaccctcaaacaacccccgtcgcacgagctcgaagaccctctaccgattaagcaggagccagctgagaaacctaaacaatccaaaaaagacaaaggcccaaacaaagaggaagatcctaagaaatttattactttaatagaagaattttgcaaaggcgaagcagaccttaagcaccccattaattcttaccaagagcaccgagttcccgataagcttgccaaagagatggtactgaccggcctgaccaatgcttcagagaaatctgatgcccaaccagaaacattgatcacactttctgacaaccccaa

SEQ ID NO: 1695 - DNA, 4294 bp, Diabrotica virgifera
cttctgcatacaaggaacaattgaacaacttgatgaccaccttgagatctacccaacctcacttcgtacgttgtatcatccccaacgaattgaaacaacccggtgtcattgactctcacttggtaatgcaccagctgacatgtaacggtgtacttgaaggtatccgtatttgccgtaaaggtttccccaacaggatggtctaccctgacttcaaacttcgttacaaaatcctcaacccagccgcagtttccaaagaatctgatccaaagaaatgcgcagaacacattcttgatgcttccggtttggatgctgaattataccgtctaggtcacactaaggtcttcttccgtgctggtgtcttgggtcagatggaagaacttcgtgacgaccgtcttggcaagatcgtcacctggatgcaatcttgggtccgtggttatctctcaagaaaggaattcaagaaactgcaagaacaacgtttggccctccaagtgtgccaacgcaacttgcgcaaatacctcaaattgcgcacatggccatggtacaaattgtggcagaaggtcagacctctcctcaacgtcacccgtatcgaggatgagattgccaaacttgaagagaaagcccaaaaagcccaagaagccttcgagcgtgaagaaaaggccaagaaggaattagaagctctctatgccaagctcttagctgagaagaccgagttgttatctaacttggaaggagaaaagggatccctttccgaaactcaagaaagggccaacaaactccaagcccaaaagaacgacctcgagtctcaactttctgaaacccaagatcgtttgagccaagaggaagatgctcgcaaccagttgatgcaacaaaagaagaaactcgaacaagaaatgtccggtttcaagaaagacatcgaagatttggaactcaacctccaaaagtctgaacaagacaaagccaccaaggatcaccaaatcaggaacttgaacgatgagatcgcccaccaagacgaactcatcaacaagctcaacaaggaaaagaaaatgtctggtgaaaacaaccagaaggtttctgaagaactccaggccgccgaggacaaggtcaaccacctcaacaaagttaaggctaagttggaacaaaccttggacgaactcgaagactctttggaacgcgaaaagaaactccgtggtgacgtagaaaaatctaaacgtaaggttgaaggcgacttgaaactcacccaagaggctgtagctgacttggaacgcaacaagaaggaactcgaacaaaccatccaacgcaaagacaaggaaatctcatcactcactgccaaactcgaagacgaacaatccgttgttggtaaacaacaaaaacaagttaaggaactccaggctcgcattgaggaactcgaagaggaagttgaagctgaacgtcaagcccgtgctaaagctgagaaacaacgcgctgatttggcccgcgaattggaagaactcggcgaacgtcttgaagaagccggtggtgctacctcagcccaaatcgaactcaacaagaaacgtgaagccgaactcgccaaactccgtcgtgacctcgaagaatccaacatccaacatgaaggaactcttgctaacctccgcaagaagcacaacgacgctgtttctgaaatgggtgaacaaattgaccaactcaacaaactcaaagccaaggctgagaaagaaaagtctcaatacttcggtgaactcaatgacctccgtgcttcagtcgaccacttagccaacgaaaaggccgctatagaaaaggtatccaaacaattgggacaacaactcaacgacgtccaaggcaaacttgacgaaaccaaccgcactcttaacgacttcgatgccgccaagaagaagttgtctattgaaaactccgacctcctcagacaactcgaggaagccgaatctcaagtatctcaactcagcaagatcaaggtatcccttaccactcaattggaagataccaagagattggccgatgaagagagcagagaacgcgctaccctcctcggcaaattcagaaacttggaacacgacttggacaacatccgtgaacaagttgaagaagaagccgaagccaaggctgatatccaaagacaactcagcaaagccaacgctgaatctcaactctggcgccagaaatacgaatctgaaggagttgctcgctctgaagaactcgaagaagctaagaggaaactccaagctcgtcttgctgaggctgaagaaaccatcgaatctctcaaccagaaggttgtagctcttgaaaagaccaaacaacgtttggccactgaagtcgaagacttgcaactcgaagtcgaccgtgctaacgccattgccaatgctgctgagaagaaacaaaaggccttcgacaaaatcattggagaatggaaactcaaggttgatgacttggctgctgaactcgatgccagtcagaaagaatgcagaaactactccaccgaattgttcagacttaagggcgcctacgaagaaggacaagaacaacttgaagctgtccgccgtgaaaacaagaacctcgctgatgaagttaaggatctccttgaccaaattggagaaggtggccgcaacatccacgaaatcgaaaaggcccgcaagcgcttggaagctgaaaaagatgaactccaagctgctcttgaagaagctgaagctgctcttgaacaagaagaaaacaaagtacttcgtagccaacttgaactttctcaagtccgtcaagaaatcgacagacgtatccaagagaaagaagaagaattcgaaaacacccgcaagaatcaccaacgtgccctcgactccatgcaagcctcccttgaagctgaagccaaaggtaaggctgaggcccttcgcatgaagaagaagttggaagctgatatcaatgaattggaaatcgctttggaccacgctaacaaggccaacgctgaagcccaaaagaccatcaaacgctaccaacaacaacttaaggacacccaaaccgcccttgaagaagaacaaagagctcgcgatgaagcccgtgaacaacttggaatttcagaacgtcgtgctaacgctcttcaaaatgaacttgaagaatctcgcactcttctcgaacaagccgaccgtgctcgtcgccaagctgaacaagaattgggagatgctcacgaacaattgaacgatcttggagcccaaaacgcttccttgtctgccgccaagaggaaattggaaaccgaattgcaaaccctccactcagaccttgacgaacttctcaacgaagccaagaactccgaagagaaggccaagaaggctatggtagatgccgctcgtctcgctgatgaactccgcgctgaacaagaccatgcccaaacacaagagaaactccgtaaagctctcgaagctcaaatcaaggacctccaagtacgcttggacgaagctgaagccaatgcccttaaaggaggaaagaaggctattgccaaattggaacaacgtgttagagaattagaaaatgaattagacggtgaacaaaggcggcacgcggatgcccaaaagaacttgagaaagtctgaacgtcgtatcaaggaacttagcttccaagctgaagaagaccgcaagaaccacgagaggatgcaagacctcgtcgacaaactccaacaaaagatcaagacctacaagagacagatagaagaagccgaagaaatcgccgctttgaacttggccaaattccgtaaagcccaacaagagctcgaagaagccgaagaaagagccgacctcgccgaacaggccatcgccaaattccgtgccaagggacgttcaggatctgcagctagaggagccagtccagcgccccaaagacagcgccccaccttgggaatgggagacgctctaggtggtccattccccccaaggttcgacttagcacctgatttcgagtgaacatgcgcgctgtgttagaatcttaataaacaaacgaactgtttaggtcgcatcaaaaccaactctatgcgattttacttttattaattttttattttcgtttttgaatattagagttgtatgattccgtaaatgttcgagaaaaaggagaacgaagggagtattcagagacacgtatttaccaccaagacagccctttgatctcttcatttctcaaaatgccaattattttgttatgaaaatatgtaggttgtataatgatattgtatgtatgataatgttgtatgatataaggcaccaataaacataaaagttatattgttaaaaaaagggcggccgctcgc

SEQ ID NO: 1696 - DNA, 968 bp, Diabrotica virgifera
  misc_feature (943)..(944): n is a, c, g, or t
aaaaagagatcaaacttgtagaggtggaaaattgtcgttagacacctatacatttacattacatagtagtttctcacatttagacgttatcttaagtgcttgttgacttctgtcataattaggtataaatatgtatgacgtttagtatgaccaacggtatgacgtttagtaaaatattttagttgggatatttttattattaatttgatttataattaagatgactactaattaatgtttttttactaatttactcaatcatttgttctctctccaaccatttttaattgaaggcgactcatctacaaattgaactgagaacagcaacaatgttaaattttaaaactaaatttataccggggtcatttttattgggtatgccttgccaatgtgcataagggaaaaaggaagatgatttcataaaatttgcctcggtaacaatatacctccggtctatgggtcatatttacgggcggctaagttgaacaaattccttgaacactgtgaatcattggtaaccttatcaatacttcgctggtctatatatttacgtccaaggcagggtgagaatccaagaaatattttactcgttaacaggtgtccttatctgcatagacgtagacgtggtgtgtttttttttcttgtgacaggggatcaagccacagtttaagttttaaattaaatttatttgacgtttcaatttccaacttggaaatcattatcaaaatacaaaactttaataatttaatcaaattttgtttttgatgcttggtaaaaaatttttctctaataatttaattttatctcactcattcatattgacaattcagatataatatattatatgtacattttaaagtagatttatttattaaatcttaatcttcgattcattgtcttcactcttggtcgtattctcgctgtcttttctttcgtttacttnngattaaaaaactccaccatgtttt

SEQ ID NO: 1697 - DNA, 422 bp, Diabrotica virgifera
ctcacgggtcgatacacgcgtctaacttcatgtcatatactcgtattttattattaaggaatttagcaattatttcttaaaaatgatgggtaacaaattaatttgtttgatgatttgctttgcctgcatttcactgtatctgatggaatctgtcgaggcgaaaaattatgaccctaatcctcctcaacgttcgccttcacctcaagaacgaggtcgttcacgtaccgttccagcccatctgcaaaatcaaggacagaatgggaatggtcaccaaaatgggaacggacaacagaacggaaatggccacactaatggtaatggacaacaaaatggtaatggacatcataatggacgccgttaacaaaatagtactgacagttcgtttgtgaatttgttaattttgtatatgacaaaggcataat

SEQ ID NO: 1698 - DNA, 377 bp, Diabrotica virgifera
accacgcgtccgcggacgcgtggggtgatttctacaaaggcaagtgaaaagacagtaatttctacaagagtatcgtaaatttcttcaatttggtatctgatggtagtaattgcatcaattgtactttcccatctagtctcggacaaaggttttgatgttatactagaaatatgatttttcagtatagcccaacgataattagaagctcagaaaaagttgtaaatttttgccactaaggaaaagaaaggaactgcaaactgagtctttagcagcattgttcacgactaagttgagtgaatggctaaaacatgggacaaaaatgggtcaaattttcaaaagagctcaacaagctttaaaagaattacattgttgtgacg

SEQ ID NO: 1699 - DNA, 430 bp, Diabrotica virgifera
gggccgacccacgcgtagatagaaaagtgaaaatttaggattatatgtatcttttgcttctgaatcatatacaattaagaaaaatcggtttgtcgaaaaataaaaaaaaattattaggggggcagagccccttttagacgtacggctatgaaatatagataacaacctactccatgttcggtcgagtatacctgccaaatttcatgaaaatcggtcaagtggtttcggaggagtttggcaacaaagcctgcgaaagagaattttatatatatagatgttaaaccacgaaatttttttaaaaaaataacggttaaagatagaaaagtgaaaatttaggattatatgtatcttttgcttctgaatcatatacaattaagaaaaatcggtttgtcgaaaaataaaaaaaaaatttagggggtgcaaaaccccc

SEQ ID NO: 1700 - DNA, 1026 bp, Diabrotica virgifera
tcagccattccgagaatgcttcagcgctttcaatttctatcaatttagagtatataaaatatgtagtatgttgaaataagtacaagaaataacagaaatacctcaagatggatccggaagccttcttagacatcgccaaccaggtggtgaagctcaaaatgtttccgtattttgatatagcccattgtaccttatgtgccttgtcagtcagagaagaccttggaagtggagctcaagcattttcccgtaaacacccgctatcatgttggttgtcctacatgttggtggtctttgccggaggtatggttgccaacggactcctcgcagaaccgattttagcccctttgaaaaacacgcctcaagtgctagtagcaacagcagtttggtatgtagtattttacactccgctggacttgggatacaaactagccaagttcctaccagttaaaataatattctcggcgatgaaagagatctatagatgcaaaaaagtgtacgacggagtgactcatgctgcaaagctgtatcccaacgcctacctcgttatggtgataattggaacgatcaaaggtaatggagccggttttacaagactcatggagaggttgatcagaggtgtttggacgcccacagcgatggaattcatgcaaccaagtttctacaccaaggcctgcttagtaggctccataatcttcattctagacaaaaagacagaactgatttcggctccacacgccttagtctactttggaatcgtgatattcttcgtctactttaagttatcgtccattatattgggcattcacgatcccttcgttccatttgaaaatctcatgtgtgcgttattcttcggaggcgtgttcgatacattggccaaggtcttcggtagaggacagctcaaggaaggagaaaataaagacgttaaaaaaactaattaatagttcacgatgttaccacgaagaagtaaatttaataatagtgcggattattaagtttattttactgtgatttaatcatcctacacat

SEQ ID NO: 1701 - DNA, 879 bp, Diabrotica virgifera
gctttgtaacttcagatgaggatagatgtgttaggttttggcagaataatgagaataaaggctgtattgaacttccagctcagcctgtgtgggctgtagactgtttacctaatggagatattgtaacaggttcgagtgatggaattgttagaatatttaccaaagatgattcaagagtagcagatgaagttaatttaactaaatttacagaagaagtaaatgccctgaaacgacaagctgttcaagaaataggaggagttaaagtatcagacttacctggcaaagaagctctttacgatccaggaaaaagaaacgggcaaatgaaaatggtcagagacggtagcagcgtagtagcctatacgtgggtagaagatggtgaaaacagtcattgggataaagttggggaggtacttggaggcactgacaaaaatgacagtggcaaaacgatgtatgaaggtcagtattatgattatgtgttttctgtggatgttgaagatggtaagcctccattaaaattaccattcaataaaggagatgatccataccaagcagctcataaatttttagccaagcatatgttgccagcagaatatttagaacaggtagtagatttcatacttaaaaatagcaaagaacaatatgtacctcaagttagtatggaatatcaggatccgtttacaggaggctcacgttatactccaagttacggatctgctaatcaaggacaaacaggaatgaatctggatccctttactggtggtagcagttattcaacatccggaactagatctccaccacccgctgcctccgctggtcaaaatagcgacccatttaccggcagctcgagctattcgaacggtaaatgcggaatcaggagca

SEQ ID NO: 1702 - DNA, 1028 bp, Diabrotica virgifera
cccacgcgtccgcaaaaaacgtctgtttttaaaaatttaatttaatttatttattttctaattatgtctctctgcgaggctgaaaaaacgtttgtgctacatggagtagaggaaaattttagagtagatggaagagaacgagaggattacagacctatggaattagaaactgacattgtctctcacgcatttggttcagcaaggctgagactagcaaatactgatgttctggtagctgttaagattgaagttgatgtaccttttccggaaacacctaacttaggaaagctggaattcttcgttgattgttctgcaaatgctacaccagattttgaaggcagaggtggtgaagatcttgctatagctatctcaaacactttaagttcagcgtactcttctccgctggcattcgatttgaagaagctttgtattttgaatggaaggaagtgctggaagatatatgtagatattttgattttggaatgtggaggtaacttgtttgatgctgtttcactagcagtcaaggctgcactttggaatacacaggttccccttgttaaaaatgttaatattgatggtaataatgttgaaattaatgtctcggatgaactgtatgattgcaagagactggatgtccaaaatgcacctattatggtgacagtttgtaagattggagaaaagtgcatagtggaccccaatgcagccgaagagcaatgttcagttggttcagtggtagtagctgtctctggagataatttagcacagtttatcaaacaggaacaggatcgttacatcccacaaccctcattgaaagtttgcagttaggcttgagtgtagcgcaaagattggatgaagcttttgggggggactttagcagaaatcaagtcggatcaggaaaatgggatttcttaaaaaaaatctattattctggatatattttccgtttttttggtatttccttacttaccccctaaaaaaaaaatttttaagtttatttctaaaaaaaaaaaaaaaaaaaggggggggcc

SEQ ID NO: 1703 - DNA, 954 bp, Diabrotica virgifera
cgcaggtctgtgacatcgcgatacgcgcaactttcaggtgattcagtgaaaaattttctttcgcacattcttttatacgtagaatttgtgaaactcttaaccaatgatgacggaaacggttgtaaatgtgcaagaagcacccaacaacaatgccgccaaacctccgccaccgaggcaaggaactgccgaacagcccttggggtggatcaagatcaatgtggcttacttcaaaacgacacctggaatactaaagggagtggaatttctctttgggatattatgtatggcattagcgtctcccgcatactattctggtacacatttcttcctattcgtagcaaccacgagctttattttgacagtcctatggatttttatttacctcttaggaattagggaagctctacaacttccaatcaattggattctatcagaattggtcaacactggattttgggctgtgatgtatctcattgcatttatcgttcaacttatcgtagcaactggcgtccatcctcttctttcatttagaggatcgtatatagctgctggggtatttggactgttcaacgcaataacgtacgcatttgcctcgtatctcctctacatagaatggacacgctcgagaacaccaaattaagctcgaattcgttgtttcgtcaaatattttattataagaactgtttataagtactgttttaggttaagacacaaaatatctcgttaggcttttcgtgcaccgtcgcaacacaaactacaactatactgcgatacaactagcaccaataaatcgtttgttttttgtctaccaacgcgactgatttgcaatcagttgtattgcgactgacgactgacatgccagttgaatcgcgatcagtttggagtcaattatatttacgctgcgtgcagttgctttcttgagtgaactttgtactaaaagcacgtctttgactc

SEQ ID NO: 1704 - DNA, 389 bp, Diabrotica virgifera
agtcaaaattgatcatttttttagaaatgatatattttttacataattctgatttttaatcccttttaacaaatttttgtgtaatagaaactttacagaaaatatgaagcgaggtcccctcaatcgtccccgcttatttaacgaagtgattgaagctattgcttctctaaaagaatcacatggctctacgaaggatacgatcatggatcaagtggaaaccatcctgagtaaaagaataactcgtttgtagaatgacaaaacacagatacatatagctttgaaacatggcttaacaacgggcctaatcaaagttaaaaaccgaaaatatgttcttggtatgaaacaaaaaggttaatggagcttttaagaaattaaaaatgcttggattc

SEQ ID NO: 1705 - DNA, 555 bp, Diabrotica virgifera
ccccgcccctttcctccgtttaaagagaagacattaattcttatcaaaatgaatcggtggtgtctatcggccttattggttacagtcttagtggcggttgtgtatgggaagagtttccaggacaacataaaaatccttaaaaaaattgatattgagacggtgataaagaatgacagaattattaagggttatatcgattgtgtcactggtaagaagggttgtactcctgaaggtgcagcgttaaaagaaagctggaaagaaggaatcgacaaaggctgtgatgattgcgatgaagaagaaaaatagaaaaataaagaaagttgtcaagcacatttacttaaaacaccctgattggtatgaggaagtagccaatgcgttggataaagacaagaaataccgaaaaaaataccaaaaatacattgatgaactcgttgccgatccaaccttgtaaatgaatgttagtccctaagaaacatgttaccaacttgttgttaagaatttttttataactgtacctaattatatacatctgaataaaagtcagtattagaagat

SEQ ID NO: 1706 - DNA, 416 bp, Diabrotica virgifera
gggccgacccacgcgtccagcctgggcatcactcggaaaactgtcttttattctaaagaaaaaaaaatacccccaatacctaaaatcaagagtcttcaatcaatgtacactccctctcctcatatatggctcttagacatggacacatacaaaggaaaatatggaaaaaataaaaatatgaaacatgaaaaattccattaattacattatccaatcagcggactgagcaaattgacgtcattaaatctcgcataatatatgggacatcctgttaaaacaatacagtttctgtataatacaatacaataaaatttaaaattgatcattaaaagtatataatacttacaaatgcaatttaatgtgcttattcattttttaagtactaaagaaatgagacaaaaaatgtattattaaaa

SEQ ID NO: 1707 - DNA, 1282 bp, Diabrotica virgifera
gaagtgaatagtggagaagtggagtgactgtggcatttcatttatattttgttcggatgaagttttgttagaaattccaaattacgaagttaccaaaaatcaaaatctttagtacaactaatatgttcttatttgcaatagtattctgaaatgatttttcattgttattaaattaaagtgttcggtaaattgttgacaataaccatgagccgtcatgaaggtgtaagctgcgattcctgtctaaaaggaaactttagaggacgcagatataaatgtctagtttgttatgattatgatctttgtgcaacatgttatgaaggaggagccactaataccagacatactactgatcatcctatgcagtgtatattaacaagatctgattatgagctgtactatggtggtgaagctcttacgagtttggaattaccccaatcttacacgtgtccatattgctctcgtatgggatttactgatgttacattgcaagagcatgtaactgctgaccatcaagacattaattttgaagtggtctgcccactttgcgctgcaatgccaggcggtgacccaaacttaatgactgatgatttctctggccatttaactttggaacatcgtactggtgcaagagatttaatttcttttttggatgagccagtaggaactagacataatgttagacgcattccacataatacatctcatggtaccactcatttgggtaggggttcaaccactgctttaagaccaaggagaagcaatatgcattttggctctggaggattgtcatcttcatccccttcttcaagagattctgtggatccaatagcggaactgctatctcaattatcaggagttagaagatcagcaagcaatactaatagcagcaccccaacccaattacaacagctacaaatgcagttacaattagaaagacaacaagtaaatgctgcgagacaacaactagagcggtatcccagacgacaaactcagagccaaacattgagagaaccaaacacatcaaattgctcttcgtctacattgatgctcaacgcatctccagttgttgttcagacatcatctaatacaccattagcgccatcgcaacaatcacaatttttgctaacaggcttattagaagagctttcacttcagactgcatctgaacaagttcgaagagagcgaagcagatttgtccaggaattagtaatagcatccgcagaaaggaaaaatagagatcaaaaaaacatcggcacacccaataccaagtccatctacaagc

SEQ ID NO: 1708 - DNA, 418 bp, Diabrotica virgifera
acccacgcgtccgcagaaactgggcaattctgtaactatcagtccgaaatctaaggaaccgtcactggcagacattcaaagacatttatccaaaaatgatagtccgactaaatcgatagctgaaaaagaaatcatccggacaaaagtacattgcagaaccgttcgtattggctcatacagatgtattcctttagaagatatcgtgatagattcggaagcggtaaccataaaggttccgcatccgcacaaggaaaaaggcgtaaagacaataacgttcgcgaaatgtgacaccgtcaaagtattggtcagcttcaacagttccttgcctgtgatcttctactacctgaatccgtcagcagcctcccaagtacggacagtgctggatatgatgacagacagtgactattactatgatccg

SEQ ID NO: 1709 - DNA, 1056 bp, Diabrotica virgifera
tttgcgtccgataccggttaggcagaacatcagtctttagttcgtcaagatgaagtcagctttggtattcctttcagtcatcgcactcagctgtgcccttacctttggtaccggcaagcaagtcaccatcaacgacgatggcactctcaccatcttgggagaaaatggtaagaaaatcgtcatctcaaacgccattggaggcactggaccaaaagacattgaaatctcaatcaatggaccatacggagcagtcaagaagatctcagtaaatggcgaaaccaacgaaagaaccatcagcctagtcgaaccaagcttgtctgagcaatacaacactgacgaagaagacagagccaagagaagcagctccaccaaagacaaaaaagacagcaaaaactccaaagacaccaaagagtacaaaggaaaggaaggaaaatcgaaaactcaagctcaattacttcaagaaatcttcagcgaacaccaagaggcaaccgatgccaaatcctatggagaactcttaaccaaagtcgactactacgtaaaatctggtcagcttagcgctggtgtttatgacgtcatccgcagcttaagagacttcaacaacggtgttactcagtatggaaaccaacaaccacttagaaatcctggataccccgtagacaccacagtaccctcatactaccaatcacctgagcagtacccatacccttcatactccccttacggatatggatacaacaactacaacaatcttggtggatacggaggagcttacggtgttaaccaaggactctacccatcaggaattagtgccactcctgccaacccctggtccaacatgtggtcctccttggcccaacaaaaaattgctggcaaatcatacactccctcaaccgacaagacctactaaagactgtagaaaaatatacctctttaattattaagtcaaaaaaagtaataaaagttaaaaatactttggtaaaaaaaaaaaaaaaagaggcggccgcctcctagaaggatcccaagcctaccctaccgcgtggccatgccaacggccat

SEQ ID NO: 1710 - DNA, 645 bp, Diabrotica virgifera
agcgtgagagcggtaagttcgagtgagaataatatcagctgtgataaccggtaaagtcttgtacagttactttttataaatctttttacgtatttcaccttttggaaacactcatcatatcaaagatgtcttgcacagtaccagctgccccagccccaccagcactcaaagaccttcccaaagtagcaggtgacctcaagagtgaattagaaacattcaaatcaagcaatcttaaaaacgctgatacacacgaaaaagtagttctaccatcagctgaagatgtagctcaggaacgtacccacaatgcgcttatggacggagtggaaaattttcaaacgtccaccctcaaaagaacagacaccaaagagaagatagacctaatgcacaagatgtggctgctgagaaaaccgaaaacgctcttattgaagatttttatatatattaatattaaatatttctagggatgagcttgtaaaataatgtgctattagagtttactttataaataataattatgattaagaattttcatattttgaaatatgtcataatttatctttatgtattattattcgtattacctctaattattttattagattatcgaattgaatagttacgatttagtccggaagctcattctag

SEQ ID NO: 1711 - DNA, 1092 bp, Diabrotica virgifera
aggaaagcggtaagttgaccgagtgagaataatatcagctgtgataaccggtaaagtcttgtacagttactttttataaatctttttacgtatttcaccttttggaaacactcatcatatcaaagatgtcttgcacagtaccagctgccccagccccaccagcactcaaagaccttcccaaagtagcaggtgacctcaagagtgaattagaaacattcaaatcaagcaatcttaaaaacgctgatacacacgaaaaagtagttctaccatcagctgaagatgtggctgctgagaaaaccgaaaaagctcttattgaaggaattgaacgttttgatactagcaagttgaaacatactttgacgcaagaaaagaatccgttgccagacaaagaagctgtacaacaagaaaaaacacaccagacactacttaatggcgtcgaacatttcgataagactaccatgaagcacacagaaacagaagaaaaagtagttcttcccgataaagcagttatcgaacaggaaaagggacaaatgaaccttatctctggcattgaaaatttcgacaactccaaactgagacatgcagaaactttggaaaagaaccccttaccaactaaggaaattatcgaccaggaaaagagcgcttaagatagttatattcctggggctcaactcaatgccaatttttgtattattttatacttttatataatatttgatacctatttatattgtaagataactatttaaggtcagatacagattcgagaatttttattaaacaacaataatcaccaaccaaaaaaattccacatttacagcacacgtggatttttccaaagatatcaatgatccaaaaatatcaattttggatcattgatagctttggattaccaaagatatcaatgcatttgaatgcagtttggtaaagaaaattgttgttgttttataattgttctagctttttatttctttgatattgtaatcatttgtacttattctgtttagacattatatcactagatctagtttatgaaagaaattaattttgcatgaattatggtgcttcaataaatcatctcggacgcgtggg

SEQ ID NO: 1712 - DNA, 1231 bp, Diabrotica virgifera
actagttctagatcgcgagcggccgcccttttttttttttttttttctgcttccagcgggagagcggtaagttgaccgagtgagaataatatcagctgtgataaccggtaaagtcttgtacagttactttttataaatctttttacgtatttcaccttttggaaacactcatcatatcaaagatgtcttgcacagtaccagctgccccagccccaccagcactcaaagaccttcccaaagtagcaggtgacctcaagagtgaattagaaacattcaaatcaagcaatcttaaaaacgctgatacacacgaaaaagtagttctaccatcagctgaagatgtggctgctgagaaaaccgaaaaagctcttattgaaggaattgaacgttttgatactagcaagttgaaacatactttgacgcaagaaaagaatccgttgccagacaaagaagttatcgaacaggaaaaaggacaaatgaaccttatctctggcattgaaaatttcgacaactccaaactgagacatgcagaaactttggaaaagaaccccttaccaactaaggaaattatcgaccaggaaaagagcgcttaagatagttatattcctggggctcaactcaatgccaatttttgtattattttatacttttatataatatttgatacctatttatattgtaagataactatttaaggtcagatacagattcgagaatttttattaaacaacaataatcaccaaccaaaaaaattccacatttacagcacacgtggatttttccaaagatatcaatgatccaaaaatatcaattttggatcattgatagctttggattaccaaagatatcaatgcatttgaatgcagtttggtaaagaaaattgttgttgttttataaatgttctagctttttatttctttgatattgtaatcatttgtacttattctgtttagacattatatcactagatctagtttatgaaagaaattaattttgcatgaattatggtgcttcaattaatcatcctccctggaaaaaggaagaaagataccgaagaaatagaactaccaaaaaacattccgaaaataaaaaaaaaaaataaagagaaaaaaaaaaaaaaaaaaaaaaaacaaaaaaaaaaaaaaaaaaaaaaaaaaaaaaaaaaaaaggggagaaaaaaaaaaggggggggggggcgggcgcctgggaagagagaaagaaaaaattaatcaca

SEQ ID NO: 1713 - DNA, 1057 bp, Diabrotica virgifera
  misc_feature (561)..(561): n is a, c, g, or t
  misc_feature (573)..(573): n is a, c, g, or t
ggaagtacagtttctggtggttgaatctaccactataaaaagtaaacaaacatattaacgtattcaaccgaaatatctacctttgactaccagtgggcgcagtttttctttatacggtacgtatattataactggttggtacaaacttataaaacaaaagaacgtatttgcaattttactttgatatttcccatttatcttttaatttcattttacttattttattataaacggacgcgtgggcacactataaaacaagttgtctgatcagatgtgggcaaatggatagggtaacttcatacataacatggggaacatttaaaaattaaatggattttattctagctgaatgtcgaataattcccgaatttttctagtgacttaccataatcaacatcacgctgattgaaaatctatgttcacgttatacttacggtctcataatttataatatagtcagactcattataaagaaaaatttccgaatatacaacagacaccgcagcatctatgtaccgtacttgtaaaacacaaacaaagacaattataatagttactatnatatatttctcnaaacggtcataagaaattcacatttaatattcaaatcagaagctaagaaagtttacgaaacgaaatgtatccctacccatatgttttttggtggtggtcagtttaacaaacaccaatccccataaataaattaccttatcagactttatgtcaataacgcactcaggacagagactcgaagacgtatctatgttctacagatctctgctaagctttatacgagccacaggcgtgcgaagcaggaagatgtaattttaagattggcgacatgctttaattactatttttgctaattttaatttttcataacttttctcaacacacaataatatggatcgtataaaactcacatctaatacacaaacccgatgtttttggtgtgttcagtttgacaaactgaattccccataaatttattacgttatcagaccttatgtgactaactcactttggaaatgcattcgaagacgtttgttaaaactgt

SEQ ID NO: 1714 - DNA, 763 bp, Diabrotica virgifera
tatgaaaattgtcgattttattcctataaaagacatattgccatgcgcatatggtcgttatatggttcgctctacttttctcaaaaaatgcaagaatggagttcattcgttgcaattgtggagacacgctttaattactcttttagctaattttattttttaataacttttcttaaaacggtcatttaaaattcacatttaatatacaaaccagatgctaagaagttttacaaaacgaaatgtgtccctaaccataatatgtttttggtgtgttcagtttaacaaactgaattccccataaattaattaccttatcagaccttatgtcaataacgcactttggaaatgcattcgaagacgtttcttaaaactacagaaaggttcttaaatttaaaaacgccacatgtagtaatttattgccttttctagccatattgtaaaaccgcaaacatgatgaccgtgctgtggtctccgcagtatcgtcacggcaggcacgcagttcagacgcaccgtcgctgccctcaaacaataaacaaccctcttatgagacgaataagcacgccttttaaccaaaaataaaataaatatcactgttcgttatttacacttatttttaattgattccgttaacacccacaccatcggaacatatgacacactcttaatatgacaactaaagaatttttttttaattgtttatctttaattatcactttaagttattatgcggcgttaggaactctcgcgttacgaaatgtcttgt

SEQ ID NO: 1715 - DNA, 2788 bp, Diabrotica virgifera
attatgatatatggcatcaatccatccacggtcaaggttgtgtggcgatatgtgcagccatcattagaagaagaaccattacagggttataagattcgtgtatgggaaagtgatcaagatttgagcacagccaatgacacaataattccgtttggaggaaagctggagggatatgtgaataacctatctcctggaaaagtctacaaattgagagtgttggcgtactccaatggtggagatggtagaatgagctctccagcaaaagaattccaaatgggaaaacctcaatattttcgcagcgcagctactgacgtacaaaacagtgtaattatacttgctattgctctagcagcacaccacacctctactttacggagtcgtgacagtataacaaattactagttctagatcgcgagcggccgccctttttttttttttttcgatgggaaatttttatttaatattagaaactttatttctatatttacagttttgtgctgactaagttccaacttaaaaagcacccttattgtaataaaattttacataactaattacaaataaataaatttccatgggcataaattattaaattctaccagatgggcattttctggccgagaagataaacaaatcaataacagaagccggtgtagaatgatgccatataaaaaaaaaaaaggacggcggttctacaggatccacgctacactaagatgatttgctgagatctaaccagaggcgttggaagactgcagacagagatcaagatggtgaattaagcaaagaagaattcgctgctttcttacatcctgaagaaaacgactatatgcgtgatctggttgtacaagaaactatggaagatattgacaaagacaaagatggcaaaatttcagtggaagaatatattggagacatgtacagaagtgacgagaacgaagaagaacctgactgggtaaagagcgaacgtgaacagttcaacacctaccgcgacaaagacggagacggatacatggacgaggaagagatcaaaaactggatattaccccaagatttcgaccacgccgaagccgaagcgagacatttgatctacgaggcagactccgacgctgacgaacaactaaccaaagacgaagtgttgaccaaatatgaccttttcgtcggatctcaggctttagattttggcgaggctctcaccagacacgacgagttttaaacgaaacttcttacggagtttctgaggtgaaattgatttatttttagctgaatatgtgaaaatgtggtggaatgttgatctagaagcgaaattttatatctagtattaaacttataaaagaaaaacttcatatacaaattcggaaaaagtttatggttagtgttacaaaattagcgacatatctaactaatatgctaatattacgttttcatttaatagacaaagatcacaatcatatttcattgagatatgaaacctttcaacatgaacccaaaggcaagcactttgtcctggtgtcttagaccagtacaattgtagttgattgagttcccaggtccggagttcctctctgatgtggctttttgatagtccacaaaagggttctggactttggaatggggtataagccccatcttttgcgaggctgtctgcttccttatttcctgcaattcctttgtgacctggcacccacattaaagttactttgttgctctccgatagcttcttgaggggttttttacagtctcaaaccaactttgattcacaagtaattgactttggaacctttaaaacggcttggctgtctgataaaataaagagttttgccatatgagtgtctaggtggagacattcctggatactaatgtctttagcatttatttctgccagaaagatagttaggggcgttcccaagagatttggatagcctgaaattgggcccagcagctcccttcctgtccttccagtagcctaaaagtggccccagtaacttccactcctgccctttcatctatctgtggcgacacgctttaattactatttttgctaattttattttttaataacttttctcaaaacggtcatataaagttcacatttaatatacaaactagttgctaagaagttttacaaaacgaaatgtatccctagccacatttgtgcttttggtgtgttcagtttaacaaactgaattccccataaattaattaccttatcagaccttatgtcaacgcactttggaaatgcattcgaagacgtttcttaaaactacagaaaggttctgagcttttacaacgccagatgtagtaatttattgccttttctagccatattgtaaaaccacaaacattatgaccgtgttgtggtctcttcagtatcgtcacagcaggcaggcagttcaaacgcaccctcgctgcccccaaaacataaacaaccttcttaccgagatgaataagcacacattttaaccaaaataaaataaatattgctggtcattgtttacacttatttttaattgatcccgttaacacccaccatccgaacatacccttaaaatccatcccgaataccatactaatggaacccttcttcccggttccggttcaaccttcttccgcccatttggtgggttttttttgaaccggtttaaaagggggggtttccaaaatccgaatttgaattgggcaagaacatcagcccggccctatccttaaaaaacccaagggaaattccttcccaagattttttttgggggggccccccttaaaaatccccaggttttctatttatttt

SEQ ID NO: 1716 - DNA, 1257 bp, Diabrotica virgifera
cttcaatttccaacaattttaatttaacatccagaaataggtcttccttcagtggcagcagaaaatcactacaaaatggaccacaaactttgttttgtagttttctgcttaatttcagcagtattagcagtgccaaaggaggaagttcatggggaaaagagggtacataataaggagttaagtgataaagaacacttggaaaatgggcaccacaatcctgaatatgaccacgaagctttcttgggagcagaagaagcaaaaactttcgatcaactgccccctgaagaaagcaaaaggagactgggaataatagcagacaaaattgatgtcaacaatgatggatttatcaacagagaagaactcaaggattggatcagatttactcagaaacgatacattactgaggatgttgacagacagtggaaacaacaaaaccctgatgataagccaaccctaccatgggagaggtaccaaacattggtttatggttttctagaaaatatggatccagcagaaatagaaaatgatagcacaggtttctcctacaaaaagatgatggccagagatcagaggcgttggaagactgcagacagagatcaagatggtgaattaagcaaagaagaattcgctgctttcttacatcctgaagaaaacgactatatgcgtgatctggttgtacaagaaactatggaagatattgacaaagacaaagatggcaaaatttcagtggaagaatatattggagacatgtacagaagtgacgagaacgaagaagaacctgactgggtaaagagcgaacgtgaacagttcaacacctaccgcgacaaagacggagacggatacatggacgaggaagagatcaaaaactggatattaccccaagatttcgaccacgccgaagccgaagcgagacatttgatctacgaggcagactccgacgctgacgaacaactaaccaaagacgaagtgttgaccaaatatgaccttttcgttggatctcaggctttagatttcggcgaggctctcaccagacacgacgagttttgatcgaaacttcttacggagtttctgcgggggaagtgatttatttttagctaatatgtgaattttttataaaaaaaagatctataagcgaaagttatatctagtcgggggtacttatataagttattcttttatacattttcgaaaaaaatggaagaaaaaaaggggcggggtgggcgacatatctaacttgtttgtctaaaaagacggaaa

SEQ ID NO: 1717 - DNA, 1660 bp, Diabrotica virgifera
tgtgtcaactgtttaacttttgaatggggtgcaaaaaatcgaaaaaatcacgttttttgcactaaattgttaataaaaaaaaacggacgcgcactctaggcaggaaacaggtaggtcttcttcctataggtctgcaataggtaaaggagtagtcagttacctggatatttcagtgtcctgagaaactccttatttctctggactacaaggcttgtagctttaatgcgattgcataatgtagactattgtatatgtaatgtaatatatgttttatgtagaatttctaaagctttttgttgtagttattatgttattgcttgtatataataaaacaatctattggacctcttgtctaattatatgtatgtttcaggaaaacctcaatattttcgcagcgcagctactgacgtacaaaacagtgtaattatacttgctattgctctagcagcacacttcttctttacggagtcgtgacagtataacaaatttgtatgaatcataggatttaattgttataatagtattatactaagattgaaaggaagcagctgagctcatggttgattaagtccacttatcggttccatgacagatcgtaacgcaacagttcataaccccacacatggttatggacaattcgtcgcgccgacgattcgtaacggtataattcgtaacgccaacatttaatttttttagcaaattagtattactgaatttatacaaaaatttattttgcatacattcctatactagaagtaatggtacttttttaagaccacttctttttaaatatagtttacacatatttttgtatatatttgtggcgacacgctttaattactacatatttttgctaattttattttttaataacttttctcaaaacggtcacataaaattcacatttaatatacaaaccagatgctaagaagttttacgaaacgaaatgtatccctaaccatatgtttttggtgtgttcagtttaacaaactgaaacttccccataaattaattaccttatcgatcttatgtcaacgcactttttaaatgcattcgaagacgtttcttaaaactacagaaaggttctgagcttttaaaaacgccagatgtagtaatttattgccttttctagccatattgtaaaacccgcaaacatgatgaccgtgctgtgttctccgcagtatcgtcaccggaaggaacgcaggttcaaacgcacccgtcgctgcccttcaaacaataaacaacccttcttatgaaacgaaaaagcaccccctttttaacccaaaaaaaacaaaaaaattccctgttcgttatttaccttatttttttaattgatccgttaacaccccccccatcggaacaaatacaccccctcttaataatgaaaacaaaaaaattttttttttaaatgttttttttttaattattcctttaaattatttaagggggggttacaaaaccctcccggtaccaaatgggtttgtgcccccccccgcaatcctcttaaattgggccttaaaaaaaataaaacttttttaataaaaatttacaaaaaaattggttttttttttaaaaattttttttactttggttttttttttaaaaaatttttttttttattggaacaagggggggagattgagccccccccccccccacc

SEQ ID NO: 1718 - DNA, 898 bp, Diabrotica virgifera
catcatttgtcaattaatagggcttttcctcgaatgtcatttgcttcgaccttctgtcatgagtcctctaatattaatatatctacgtcatatgtatagtgacacgcttcatttattattttttttaattcgtttttttttaataaaacgaaataatatgggtgatataaaattcacatttaatatacaaaccagacgctaagaaggacccgttaagttttacgaaacgaaatgtatccctaaccagatgtttttggtgtgttcagtttaacaaactaaatttaacaaactaaatttttacgaaacgaaatgtatccctaaccagatgtttttggtgtgttcagtttaacaaactaaattccccataaattaattaccttatcagaccttatgtcaataactcactttggaaatgcattcgaagacgtttcttaaaactgcagaaatgtttcaacttttaaacgccagatctaaataatttatcacctttctggccagatggtagaaacacaaacatattagcgtttgtggtttctttcagtatagccacagcaaccatccggcgcggacacaccaccatactcgcaaaagaataacaaaccctctttcgagaaatattcacgctattttaccgacacaaataaatatattattgacaagttgttgtttttacacttattttaatttaagttaatcgttcccgaactcccatggaacatacgttattcgtatataccaatgatacaaaccaaaaacgtatgacatagatatcttaacttgtcgtatgttgtataatctgtgtataatattaatatacgacatatgacaagtgcccgaaataaatgagaaacattgaaaagccctattcatacagaaccgttttttccccacgcgtcct

SEQ ID NO: 1719 - DNA, 423 bp, Diabrotica virgifera
gggccgcccacgcgtccacccacgcgtccgcccacgcgtccgggttgttggaaatcagatcatggcgaccgttttgccaggtattcaactaattattggattaaggcactccacatcaagtgacaagaaacaacaaaatcctccaccatctaaaagcgatcacgaccatgttctggaacattctttacatcaacttctaagggaagtgcaccacaaaaatacgcaccatcctttcccccatcctgcaactgggccgttgggtccatccaagaagagaatgcttgcaggtcctatggcagctgaccggtacgaacttcttgaaatgacgaaaacccaaacacttctggaacagatagttcaacaagcccaacattttattatgaggatgagaactgagtatgtgcttgacaccataacaaaaga

SEQ ID NO: 1720 - DNA, 853 bp, Diabrotica virgifera
actttagctactgactaactagctcctatttaacaatggtgtcgtgcaaacttattgctgttttcgtttcattgatagcagcggttttagcgtcaccagtgccaggaggttggggctcccatcacaaacatgtcattatcaaagttccgtaccatgttcataccgtccaccatcaccatgttgagaaggtgcacgttccggttcacgttcctgttcatgttcctgttgtgaagaagatcgtcgtccacgaacccatccaccatcacgagcccatcatcgaacacggaggatggtggtagatgcaccagcatcatttaggcaatttatccagatatgtatgttcatgtaaataatagttataatttttgggatactaaaagacaaaaaaaaactaaagaagtacctataagatattgtaatagaagtacaaattatcggtagtgagatcagaattttagatcatcatcagcccatatgcgtccactgcaggacataggttttcctcagctctttccagagctaacattttagacaattccttccaatttaggctaaaattatttttaatataaaagttgttgttgcaaaagattgttcacttactactttcttaaatttaggaatttgatgttgtgtggataaggtcaaaaattttgtcactcaagtatctttgcttaacactcgttaatattaattggtaaattgtttacagatttttagatcctatcctagcaccaatggtttcaattatttaaaatgtttactgcttctccttaactaaaccttctcgagtaccgaagactttttgcttttggcttcctagttctattttttgctgcagatacatattttc

SEQ ID NO: 1721 - DNA, 1226 bp, Diabrotica virgifera
gggccgacccacgcgtccgcccacgcgtccgcccacgcgtccgcccacgcgtccgcccacgcgtccgcggacgcgtggctgtgtgacataagctattggaacagcacagtctcttaaacgaacagatgaaagtgaagttctgtcaatatctttttctaaaaagtgttttgaacatactcctctattaacaaatctgatctatacttcatgtcttcttcgcaggatcttctggaaagctaaaaatacaaaatatatgcattactaagcattattaacaaattttagttttaaataaaaaatatgattaatggactcacaaaatattataaaacagcttagaaattgtttattagtatagtcggttccccagttgtgtctgagactcagtagtacctactgagactgagtttagcaaatcaactataatattctgtgtattcattagttggtactgcatattatagtgtgtggtctaccatctattttataaaggcatacattagcaaaacgcaaaaaagaattactttagttttacaaatcctattgttattatctctatttactattttagttaggaataagcgagttttgtggcttattcacaattattattaaaataataaatggatatgaccaattattaacttataaaataaaataataattcttctgatttatgccttttattcactttgttatatctaggttacttaaaagattttttatgaatagtattattagggtattaatagtattaatttattttctgaaatacagggcatgccttcgtttacatatttgcatactaaccttttaatagggcttttcattcacagtcatttgtttggagcttctgtcataattgaaacgttattcctgcagattttttttatctacatttgtttctgctactccaactgcgttaaaaacaggacaccattttattcactatgttaataatactattaaagctattataaaagtatccgaattaaaaaaatattcttaaaaagcacaaataatacaaacacaaacaacgatccacccacggtaaagcaaaagcaaggtggccaagatgaagatgccaagatggccgaagcgaggtcgttggttggtcgtttttagtcacgtgatgccctctcaagcgccatgcacaaaaatatatgcacggcgaatttgaaaatgaacgcaaaagaaataaatataaatgcctctcttgggttttg

SEQ ID NO: 1722 - DNA, 420 bp, Diabrotica virgifera
gggtcgaccacgcgtccacaaattaaaaagtttttcgttttcagtttgttggcgtaaaagtttaaaaagttttcagattgtacgtgtgtatcctcttatgtttaaaacagttattaaataggtatataattcagtgaaaaatggtttaagttcattgtgtatttggatatagttacaagaatttttttacctactgaaataaaatggactccaccagtaaatcaaaattaccaaaaaaatccaagattcctttgcaagaggtccaacagaacatcaataaacctgtaaaaattccttcatctactccgagaactgctggacgtttgcaaagtacgaatatctctgcgaatgttgccacatcaagcacatctacaacaagtgcagcttctaatagatatgtctctggaagactaacaagaa

SEQ ID NO: 1723 - DNA, 1275 bp, Diabrotica virgifera
ttaagagtttatgtagtgtagttttcaagatccttatgtgatttttctgactggattaccatgaagtctcaacagatatctgttgctattatatgcatgtttataacatggcaacaagttgctgctgtagtgaacaataatccgttgaaagtagaaaaacaaaacgaatcttctgcagaaacgaccgacgctaataaatcaagttctacaatagaagttgtagattccgtagcagaagcttcagaagaaagtggaaatagaagagaagcttcactcggtgataaatatggagtgccattaccaggaggagttccaggggactcgtatttaccagtagaaccgagtaacccaaaccttcctatacctgtgtatggagttcctgatggatctgctaataatgtcgtttatcctgcgcctcctccagacattccacctactatagcattgccttctcttggtttcggtttatcacctttaggaaacacttacggaccacctaaagtgaatttcttgccaccaagtaacagttacggtcctccaaataacaactttatcccacctggtcctccgattagtacatatggtccaccaagtgtaagccacggaccaataaacaataattttggacctcctatcaatacatttggacctccacgtccttcctttggtccgggaagaccaaagcctcaatatggtcctccaaggttccaatacggcccaccaggaaaaccaataccatcaaacgttaaatttggatttaaacctccatataaaaactttggaggcccaaaatatccctctaagcccgtttggtacttatggaccacccgtaggatactttaaagataattacaatcccattaaatttacttcaagttataatgggaataatattatttctaatgaaggttcatttggcggcgggggtggtctaaacaataagtacggagtaccaaaattggaaatagacttatcaagagtaatttctagtcaatacggagtgccgaatgttggtcatacctatcatggaggtgttaatctgatttctacgcaatatggtgtacctgataatgatatgttgggagggcctagatctcgatatgatcctcctcgacccacgtcacgtccacaacctccacgtcctggagctccagctcctccaacacccccagatattaaatatgatggttggcaacctataccaggactaatttctagaaagcctactccagtatatggagcaccaactggagaccaacccattgagattgactt

SEQ ID NO: 1724 - DNA, 434 bp, Diabrotica virgifera
ctcctcgcgtccgactcaagccagctatcctttagtttaaatttataaataatgctcagtttaaacaaaaaaccaaaaagtagagaaataaaaacaagaaagtaaatttttagtaatgtaattaaaatagtgaaagtctcgaatcatgttttgagtttgtcctgaaagtatctgtattgttcggttaggttaggttaggatgtatgttttttaatattggtgatattacaacttaaaatatagtaaataaataaaaaaaacaaaataggtgtgccattttattttcttttatgatttttaccaattctaatagctatatattgaagtctgtatattttagaataaaatttgaattcgaaaaaaaaaaaaaaaaaaaaaaaaaaaaaaaaaaaaaaaaaaaaaaaaaaaaaaaaaaaaaaaaaaaagataaccca

SEQ ID NO: 1725 - DNA, 982 bp, Diabrotica virgifera
ggagaccaaagggtgccgttactgctgtaagcggacgcgtgggtgcggatcttgctggagtttcagtgctactggatctctcgaaggacaacactacaggaaaacaggaaaattggtttccctttctgaacaaaacttggtcgactgctctactaaattcggcaacaacggatgcaatgggggtttaatggataacgcctttcgttatattaaagccaacggtggtatcgacactgaagcaagctacaaatataaggccgaagacgagaagtgccacttcaatcccaagaaggtgggagccactgacaaaggtttcgtagatatcgaatctggaagcgaagatgcccttaaggctgctgtcgccaccgtcggaccagtctccgtagccatcgatgctagccatgaaaccttccaactctacaatcaaggtgtatattatgagcctgaatgcagctcagaagaattagatcacggtgtcctcgttgttggctatggtactgaagacgaccaagactactggcttgtcaagaactcctggggtccatcttggggactagacggttacatcaaaatggccagaaacaggaacaattcctgtggtattgcaactcaagccagctatcctttagtttaaatttataaataatgctcagtttaaacaaaaaaccaaaaagtagagaaataaaaacaagaaagtaaatttttagtaatgtaattaaaatagcgaaagtctcgaatcatgttttgagtttgtcctgaaagtatctgtattgttcggttaggttaggttaggatgtatgttttttaatattggtgatattacaacttaaaatattgtaaataaataaaaaaaaacaaaaaagggggcccattttatttttcttttatgatttttaccaattctaaaaactaaattattgaaagccggaatattttaaaaaaaaatttgaattcaaaaaaaaaaaaaaaaagggcggccgct

SEQ ID NO: 1726 - DNA, 1685 bp, Diabrotica virgifera
gaactagttgatatcgttctgggaaggaccactgccattattaataaacagttgaatttacagtttgaaaatcatttgttgtcaagaccttcaagttaatagttttgttaaataggatacatcatgaagtttttgctgctttttgttgcattttttgtgggttgccaggccatttcctttgttgatttggttcaagaagaatggactgctttcaagatgacacacagaaaaagttacgaaagcccaaccgaggaaaagttccgtatgaagatctttatggaaaataaacataaagttgccaaacacaacaagctctttgctttgggattggtttcttataaattaggactcaacaaatacgctgatatgctccaccacgaattcatcgatactctcaacggcttcaacaaaacgaagaacctgttgagacaatcagagttagaagattccgtcactttcataaaaccagccaacgtagagttaccctccgaagttgattggagaccaaagggtgccgttactgctgttaaggaccaagggcattgcggatcttgctggagtttcagtgctactggatctctcgaaggacaacactacaggaaaacaggaaaattggtttccctttctgaacaaaacttggtcgactgctctactaaattcggcaacaacggatgcaatgggggtttaatggataacgcctttcgttatattaaagccaacggtggtatcgacactgaagcaagctacaaatataaggccgaagacgagaagtgccacttcaatcccaagaaggtgggagccactgacaaaggtttcgtagatatcgaatctggaagcgaagatgcccttaaggctgctgtcgccaccgtcggaccagtctccgtagccatcgatgctagccatgaaaccttccaactctacaatcaaggtgtatattatgagcctgaatgcagctcagaagaattagatcacggggtcctcgttgttggctatggtactgaaaacgaccaagactactggcttgtcaagaactcctgtggtccatctcttttggggactagacgtacatctaacaaaaagccccaaaaaaacagaagcaatttccctgggggtattgcaactcaagccagctatccttatacttcgaatttataaataatgatcattttaaactgaaaaccaataagcaaagaaaaaaaaaaaacaaaaaagaaaattttaaataaagtgaagtaaaaaagctaaagtctcgaatcatgaattgagttagccctgaaagaatctgtattgtatggtttaggatacactaggaggaatgctttgtaatacagcaaagttgacgcctggaaaatcatactataagaataatacttttgacgctacgtttgctgcgacattaccatgattgtccacgaactaattgatttctgaagaacaaagactccatcaagaaggatatcaattatcctgcatcgtggaacgtgactttatctgggcgaatgttcgttatctaagcatgattgtgtcctctgatacgtaactagctgtgttaaaccgcgaagaatatcagagaaactgtacgagtcgtctattgggcagtgggaataaaaaaatccatggggaaagaaaattaagtgggggcagcaaaacaaaacttccttggattccttttttttattttttca

SEQ ID NO: 1727 - DNA, 867 bp, Diabrotica virgifera
acccacgcatccggtgaatgttatggtcataattaagctaaatttaacaacacgctgaacattgaatattaagtaaaattgtgaaagaatcatggccggtgttgtaccaaaaaaatcagcatctggtcgaaaacaatggacattacgtgacaattcccaatattcactcaaaagattaagaagtcagctagcatcagatggttgtcccgagtcccaagttgtcttagctaaacaactattggatgaagaatgcgaagttgaacctgataaaaaggaaaatgcttgcctgggagtttattggttaattaaagcatccaaacaaggcaacatcgaagcaactaatcttctaaaagcatgccttcaaagtgggaaaggcattacagagcacaattacatggatgtaaaatcatgtatcaatatgacccaggatgagaaattggcccgaaaagctgctagagaaatgtttgcaagcctgtcaaatggaggagaatacattacgtcctaccaattgaaaaggaagatgttagcgattgatcgtggggaaacgtgctcaaaatctacagaaactaatgacatcgaccgaagataattggggactaggtaaattaacccaatgagtatgaagagtttagtagcgaatctgaaaaagaaacagattggtcacaaaagatccgatagtaccaatgaaaaaactaacccaggatcatctactagcagccgctgtcgactactcacatgggcagttaccgggaagtgaatcgccatactatggttgtcgaaccccgacccaaaagctttagaccatattccttacgttcatagggcaatactaacatcccttgttgggtttttaaataactccttttt

SEQ ID NO: 1728 - DNA, 843 bp, Diabrotica virgifera
gctgcacgcagtgacagctcagtgtttaccgtcagaaaattttaaattaaaagaaataaaatttagaatatgttgaaattgttcaaagaaatatcttcaagtttggggaaatctcttaccaaaaggggacttcaaactacttccactttacaacatgatagcttatttgtacatcgagatactcctgaagataatccagatattgtctttgaattcaccccggaaaataaaaagagggctgaagctattctagccatatatccagaaggccacaagagggctgcaatgattccattacttgatttagctcaaagacagtatggatggttaccaatttctgctatgcataaagtggctgaaattttaaacttgccaagaatgagggtgtatgaagtagctactttctacactatgtttatgaggaaacccacaggtaaatatcatgttcaaatttgtactacaactccttgctggttaagaggatcagatgagattctggaagctattaagaaaaatcttaagttagaagttggagagacaagcaaagacatgttatggaccttatctgaggttgaatgtctgggagcatgtgttaatgcccccatggtacaaattaatgacgattactatgaagatttaactgttgaagcaactaatgaaattttagatgaattgaaaagtggcggtaaacctgcaccaggtccaagaagcggtagatttgctgcggagccccataggagaaccaacctctttaaaagctgagcccccaggtccaggagtaggtgttagagcaaatttggaaatttattttatttatataaataaacacgatagttaatatcg

SEQ ID NO: 1729 - DNA, 875 bp, Diabrotica virgifera
gatctctctccttgctccacttctgattagttcttactagaaggcaagttagcagttatactaacacaatgtccgatctaagtgccagagacgttgaaagggccaactttgtcttttccatctacgactttgaaggaaatggcacagtcgatgctgttaacttgggagacatgctcagggccctcaaccttaacccaaccttggtcacaatagaaaaagttggaggaaccaagaagaagaacgaaaagaaattgaaactagatgaattccttcccatcttcagccaagtaaagaaagacaaagaacaaggtaacttcgacgatttccttgaatgtctcaagttgtacgataaagaagaaaacggtaaaatgatggctgctgaactttcccacacactcctttctcttggtgagaggttagctgacgcagaaacagaacaagtcttagccgattgtatggacaaagaagatgatgatggcttcatcccttacgaaccattcctcaaaaaactgatggcgtaagatgtattttactttttttatttttaatcacctgagaagtgctgtcaaattgaaatggcttttcgaacaacagaaattgaacaccagaagtcaaacaggagtgtgtactaccaccaacattcataggcactgcctttaccaaccacatttcaaatacgctgaaatacaatgtatttatttttaaattattttattatatttaattaaaattataaaaactgtcctttattgttacgtaatattgtcattaataaatggtaagttcacagtgtactttgatatataattatgtacataattttccaaaaaatatattagttttgttttactctaaaaaaaaagggcggccgctct

SEQ ID NO: 1730 - DNA, 993 bp, Diabrotica virgifera
gtttatcctgatgctggttcgttacatagataaacgtaatttcaattttaactgtaataaaatttacctttaacgttaacaaaactaaacagaataattcaattttgacgttacgaattgtatagttacgaatatttatagttacgaactgtcgcggttgcgaattgtggggttacgaactgtggcgttattagatgtcttgtcacgatcttcagtttttaacgcataatcgatcgcatgtaattaaactagtgtttatctcttcaggtatcgtaataaagagcttcaaatactaccaactaaccataagagatggctgtgatatgttatgttaagataaatctatataaacaataaaactatttattgccgttagttttaacctgtattaacaagttgaaatggaaataattgggaatgcaatgccagtcgacacaagtttataattaaaaatggcggatcatctaataatgcctcccggcactcaagcgcgtttggtctgcgaatggccgcacctcaacctgggggacttagtcacaatcatccgctacgacccaacccaaggatattttgtccgaaccagctctagcctggaagagttttggattcctgctcacgttctagccaattacagtaggaaactatggtcttttaggttaaagaaaccaagaaaatctctggaaggaatcctctcggagaactcggaccgttgtgtaccagaatttcgtgatagactgaaagatattaccgttcagagtggatccaaggtggtgtttaagtgtagagtgaagaattggaataggaacacgaggcaaacttggaagaagatggaaccaaatgtcgtagtcctacataacggcaagtttgtgcaaggtgataaatgaaggagcatagcgttgatggtgatagaaaacgccagagcttctgacgcaggtacctattgcttgacagtatccaacgaattcgggagtatcacctgtacggctaaattgt

SEQ ID NO: 1731 - DNA, 1066 bp, Diabrotica virgifera
gcatgtggagaatttgccatttttcggtaacagattgttgagcaaaatatttatttttaaatacattatacacttatgataatatttagagaacttctacacctagaaagtatatatattaacaataaaaaatgggtaaatctaagaaaatccgcaaaggaggtgatgagagtgaatccgataatgaaaacagtacccaggaggtaattgacaaagccaaaacaaaaaagaccaagccagctaaatcccaatctaccagtgatgaaactaaagaggaaaaagcagatgccaagaaggcaaaaggtaagaaagaaaagaaacaagtggactctgaaggatcagacactgaagtggtttccaaagtgaaaaaatccttcgctcttcttcaaatcgatgatgaagactcagacgacaactctaaacccgcggtggaggacgacgatgatgaaagtgagacaaaaccagctaaaaaggacagtaaaaagaaatctagtgatgaaaggactacaaaaaaccaggggggtaaaaaggggaaaaagaatagaaaacgtgatgatagtgatgaagatatagagaaagtgttagctgaattagaaatggagtatgcaggtattaagaaggaacctgaaccgtccaatgaggagaagcctgtagaaaaagtgaaggaaaagaaaaaagacaaaatcgatgaaccaaaaggtgaggcagctgaagaagattcgaaacaagaagagaccagcactgtgaaaaccgcggcacaaaagaaaaaagaaaagaaagagagagagaaacagaaaaaattagcacagaaaaagcaagacgtacctaaggagggttcagaagaacctgccgaacaccaggagcaatccaaaccagaatgagctgaaaataaacctgaagcaaaagacaaagatgataagcaggaagatgatgagcaagatggtgataagaagagcaaaaagaagaagaagaagggcaaagaagatgatgagaaggatgccaaagacgcaaaagatgccaagaaaggtcccggtaagaaagccatagcagctatgcaagaagctct

SEQ ID NO: 1732 - DNA, 292 bp, Diabrotica virgifera
aatttaagaaaaatctttattgaatgctgttagcatccagtattaagtgcgttcgcggtgcctgtcggcgtctagtcggcgacaaattagcagcaaaacgcatgcgcactttaaaatgatataaatattatcgttagtagataaatatacaaagtatatttacctagtataatttaataattaattattaatattaattaaaagtaaatataccttgtagatttatctattaacggtataatttatattaagtgaggttagaaattgtcggcgaaaatttgtcaactgtacc

SEQ ID NO: 1733 - DNA, 1450 bp, Diabrotica virgifera
caagaaagctccaattcaaaatagtaatatcgctcccgatcttcgagctgttatacagactttttaatattattgtgaatttgtttagtgtttatttgtgcaagactatgctcattcatgagaagatgtcccaggggatcatttcccctccatctacaccgcccctaaagaatatttctgatgacgaacacatgcagcaatcaacgattctgcaactcagaaacttcttgggccagaaaagaactatacaaacatctggactgcttacaccacaaccgtcagattcagaacctgaagaacatgatattcctttgaaaaaaaggtaccggatcagcaatctagaaatcccttacccacccccaacaataaccccacctaaatcgccttcaaaaacaccacccctttatcctccacccactccttgtcctattcctttaattaaatcaacttcaccgattttccccaaacctaatgtagttcctcaacaaacatatgctccagttcaaatatttttcccaccctctccaccagttgcacctgttgcaaaaccacagccgacaccaactagatcagtttctgttattatgaaagccaacaaaactggtatctgcacatccttgccaattcctcaactgaaagaaaaaggggaagaaaacttactgaagagtttgaagtttaagatgggaaagaacaaggaacgagtaaaaagctgtgaaaaagatgtctcgagggaggagaaggaagaagccaagccggagccagtagttacccagaaaatatccctgcctattctagctcctaaactgatatctcccgccactccgaacacaatattcatctcagcagatggtacagttctacctacgcagttcgttctcatcacccacacccctccagctacagtaccgacgagaagaagagtctacgaatgcaaatatgaaggttgtgggaaaaactacttcaaatcctctcaccttaaggcccacaaccgcatccacactggggaaaaaccgtttgtatgccaatgggctgactgtggaaggagattctccaggtctgacgaactctccaggcataaaagaacccacactggagaaaagaagttcaagtgctcccattgccaaaaggaagttcatgcgatcagaccattttggcccaaaacgtcaaaagacacaccaaagaaaggctgaacaccccaaaagttaatggcatgcctgtactgagaccgaattcacctgcacctaagctgtctaattttgacaaggaggccaattttttgcataatcttcgtatttttttttgggaggttatttacaggaatttgtatatttttccggatgttggaaaatgttgggataatggttctatttcttttgaaacttcattataaaaaaatgaagaaaaatttgcaacccagaaattttcaaaaaattgggggataaaacaaggg

SEQ ID NO: 1734 - DNA, 1029 bp, Diabrotica virgifera
  misc_feature (1014)..(1015): n is a, c, g, or t
gattgaccgaaagatcagcatgggtcatcaacaaatcaacttttaaacttgtttagtgatctcttcatttttaaatcggctgttaatgaaagactgtgatttttgtagttgttgtgatatcaaaatgaggcgttcttttggattactgctagtttttctaggattgtggacactgtgtatagcacaaacagaatattgtatgaccccaagacaggaaggaggagattgcaaaataattacacaatgtccaagtctatttaaaattttaaaaaatcgtcctattagatctgaggacgcggattatttaagaaaatcacaatgtggtttcgaggggacgttaccaaaagtgtgctgtgctctgcaagaaactgttcaaactaccacgcagcgtcaagtagactatgacacccctaaacctgcagatagccccctgttaccatcaaaagaagactgcggtattggaagtataccagacaaaatttatggaggcaacacaacggatctcgatgaatttccatggatggcactccttgattacgagaaagataatggcaatcatggattttattgtggaggggtactaattaactcaagatatatacttactgcagcccattgtgttaaaggaaaagatttaccaagaaattggaaactagttggtgttagacttggagaatataatttagaaacagacacagattgtgtacagacagtaagtggtcaaaaatgtgcacctcctccagttaatgttgctgtagaagaacaaattgcccatgagcagtacaagccctacgatcaaaaccaataccatgacattgccttacttagacttgcaagaaatgtaaaaattaccggattcgttagacccatttgtcttccaaaaactgctgatgaccaatctaaaaattacacaggcaaaaaactaacagttgctggatggggtaaaacggaaacacggtcggaaagtaacataaaactcaaattagatgtaccagtaaaagctaataccgagtnngtcagaacctaccg

SEQ ID NO: 1735 - DNA, 411 bp, Diabrotica virgifera
cgggccgacccacgcgtcaagaaaattttacgtgctcacttcgacatcaacaactctccgtcggaagaccaaattcacgagatggcatcacaaagtggcttaccgccgaaagttataaaacactggtttagaaacacattgttcaaagaacgacaacgtaataaagatagtccgtacaattttaacaatccaccttcaactacattaaatttagaagaatacgaaaaaactggtgaagctaaagtaatgcccttgaacagctcggggagcagcattgaagagaataagtcaaaagaatcaccaaaactttcgcaagaaattaaacacgaattaaaagaggaacctgtcgatgactttcccaaactaaacgaagagaaaatacaagaacctatagacgaaaaacctaacata

SEQ ID NO: 1736 - DNA, 966 bp, Diabrotica virgifera
cataaataaaaaaatagtctataaatgaattacgtgtgtatggacacgtattttgacacaaagtagtaaaaaatataaatagaattaataatcatatcataacctagctttagctggcctggcctggctaaaaacagacgatttttgagtaatcctagtttaatttctaggacgttgatctatctatggaaattgaggattataagtagggcatatacttaaatgaaatcagtgttcaaaatatcatcttttacctaacttaatttaatccatcaaaagaatatatcaaccaactgttcagttaaactaatatgcacaagccatggcgcccctcaaaaaatatcaaaattatagaaaatacctggaaaaggattatattatgaaattaatttttgaccctcattatttgtggccagtatgtattgttttgttaatattcgagtttctgttaaatttaatgataatccatagagtaaagtacacagaaatcgactggatcgcttatatgcaagaggtggaaggatttctcaatggaacattggattacaaagaattaaaaggtgatacaggacccttggtgtatcctgcaggattcgtgtacatttacacccttttctactatgtaacgtcaaaaggaactaacatattgctcgctcaatatatttttctatttttatatctattacaaacatatctaattcagcgcatatttagaaaaaccatgaaaatacccccatatgctttagttatagcaactttgacatcataccgaatccactctatatttgtcttgagattgttcaatgatcctattgctgtactgttattttacattagtttaaactctttatggatgatcgatggaagctgggtagcattttttactcactagcagtgtccgtgaagatgaatatttttgctgcatgctccatgccttctcttacctatttagaaaatttaacgaat

SEQ ID NO: 1737 - DNA, 1177 bp, Diabrotica virgifera
cagtgttttatttcaatttcttaaatacaaatctactacaaaggtaccattagtgacccagaagtgaaatcacgcaactaccagaagcaattttacaagaaatgtgagttgggtgattttacttcattgatagctccaaataaatagatagaaataattaacaataagaaaaacatttgaaataagtagtttatttacaacaattttctagggggattttctgtcaggaactaggaggatttcatctccggaagtaaatatggttaagcgatgtaattcatttcttctttctttggccgacggcataggttatattggctttgagggtaattgtgatttggaccttggttgttagagtgttggttgattgtttactgaaccagtggaatcaaatttgcccaccatacttcgaatagtcttctcggtagaacaagggcgattatatttacgatttatcttctcggtaggacgattatatttttattttctattaacgtcctttcagaatgttggttaccatcatagctattttaatcttattcgccgccactcgcggttgcaatctcgcaatttcttcaaccatgaggactttcttcgtcctggaccgcatttgcctgtcattttcccttgcttaatattttgtagcaatttatatttggggagatccgttgtccccattgttgtttaacctggccttagaatatgtcatgcgaaaaatgtatccaaaactcaaaccagatataactgctcggggagcaaaaatcatactcgcctttgccgatgacgtagatgcagtagcacaatcaacgttagaaattaaggatattttctcgagctctgaagaagctgcattaaacatcggtctaaaaataaatgaaaacaaaacaaaatacatggtggtctcaaaacaagaacgacggcgaataaggcaaaatattactataaacgatcataacttcgaagtggttaaagaatttaaatatctaggagcaacaatcacaaatgacaacaaattagagcgagaagttgaaacgcgaataatggcaggaaacagatctttctttgcaatgaaacatctaatgaagtcaaaacttctttcacgaggtggaaaaatccagatatataagaccataatatgaccagcagtcgcgtatggaaacgaaacatggacgctaac

SEQ ID NO: 1738 - DNA, 738 bp, Diabrotica virgifera
acggacgcgtgggcggaggcgtggggcggcatgagacaagcagtcctggttctagccttaataggcatttcagcatgcgcccgcctcgactacctacctccaggacgcggtaatgcaggtggtggtggaccaggtggttacccaggggccgtagcgcctggaactggcggcggtagaggcggcggttatcaaggtggatccggaggtggatatcaaggtggttccggaggaggataccaaggtggttccggaggtggatatcaaggaggccaaggaggcgcaggcggtggttatcaaggcgggtcaggaggtggaagctatcaaggtggttctggaggtgggtatcaaggaggtagtggaggcgggtaccaaggaggtgcaggtggataccaaggaggcggcggcggtgctggaggacaaggtggatacggacgagacgctgctgcatatcctgcaaatatgccatattttaacatgaacagcggctgagttgatccacacctgtatgctatgcagatggagtgcatgcaggatgcttatttccagtatataagccaatatgtgcaactgatagctgattcttatggagccgatggtaaagcaataccaaataatggtcatcgagttttcaaccacacatatcctcctgcagcagctattgcagaatcttacgccgttgatagagatccctataaacccgaaagagattgtcttcaagcacctcatctaatccccaga

SEQ ID NO: 1739 - DNA, 877 bp, Diabrotica virgifera
  misc_feature (767)..(767): n is a, c, g, or t
  misc_feature (791)..(792): n is a, c, g, or t
  misc_feature (817)..(818): n is a, c, g, or t
acggacgcgtgggtggacattttatgtcaatgctgaattagtgaagtgaatagtgttaaaaatatcttaaagtgattttagacttattttttacgcaaattaatatatttaagagtcggtttacttacttacatattattttttagtgtttaattacgatttttaaggctacagtgcagttttattttctaggtcattaaaaatgaatgatacagaattagcatcaattccacctccaccaggtaccatcgacaatccaccgttgcctccagagccaccttccagtccaccgccgcctccgccagctacagaacatcctcaaacacccaatatgtttttacctaaccaaaattgggctaattacaataattatatgaattactatcaacaatatgctcaattttatccatatctctttatgtcaagcccctatcaatcttataaccaatttaataaaaaggatgaatctgttcagccacctttgcctccaggttctccgaatccgccattgccctcccctatgtctcataatattagatctcctcttttgaattcgccaaagcaatttggccatattcggtttcagttaaatagtaaacggttgcctaatcctaatagtaatcccataatgaagttacactcttcaactagtggcgctgctaagaagagaaggaaaaggaacaagaataatcaaaacaatgctgtcaataatcaaaacttgaatatgaataacactcctcctctgcctccaccggagttatctcttncccaacctgcacctcctccacctnngacttcaccggaatcaccattaccnnctatgccggttgatgtgaatccgccattgcctccctcagaatcaggactgtatggcaca

SEQ ID NO: 1740 - DNA, 1139 bp, Diabrotica virgifera
  misc_feature (1052)..(1052): n is a, c, g, or t
  misc_feature (1075)..(1075): n is a, c, g, or t
cgaataccacgtgccaattttcttggacctagttaatttattgttaggtacagtgttaagtagatatagtagtgtttacagtttgtgaagatacacaaattatcttgccacacaatgtatcacagaggaaaagaaaaagaaaccggtaacaaggaaacagatgttcccaatcagaaaccaaaacaaaatgtaaatcataaaccaaaattaccggagaagatatttgaagtaagaaaatcaattttaactgagctctatgaagacaatattcacacaagagctattattaactttattattggattttctgtatttaatatggttactctgatattaaaggactatgtttattatggcaggttgtcgtcagcttttattttaatttttaatcaatttgccaaactacctgttacttttttaatttggatattacttaatttactaatatttgcctgctattacgtatacttattgtggggtaaacttagaaggaaagttccaaatacatggttttgggatagaatatggctcgtagtttttattggatatattatgataatgttttatgccacaacgattttagttatacatttagaactgcagtttgccacaagattgctaattttatccgaatcgactagattactaatgaaattatactcatttgttagaagtaatgtgcccagagtaaccaacacccgttcatcgaatgattatgtacacattcccacatttggaaagtatttatattttttatacgcacctacccttatctacagagatgaatatcctaggactggccacattcgttggagttttgtattctacaggctactggaagtgtttggaattattgtagctctggcctttttggcagaaaatattgaaaatatgatttttatggacacgtgtaaacaaccaattacggttcctcaatttttggtactcattctggcagggaagtttaatttccaccgtaatgtcttatacactatgggtgggtagttttacattctggtcaaaacgctggttggagagatgctcacatttgngagatagattgtttcattcaganttggtggaattgcatttgaatgccagagtattatagaaaatgaaaatattgttgttgggagact

SEQ ID NO: 1741 - DNA, 1505 bp, Diabrotica virgifera
cactgatgaaatgatggagctgctaatcaactctgagaaatacctagctgtactcttctatgacaaagacgataaacaagacatcagagtattaaatgagctagaaaatatcgatgacgatctggaaaaagaaggaattactatgatcagaatcgataatgatgcagaagccaaggaattcggtatagatcacttgccaactttgatctacttcgaagataaaatcccttctttatatgaaggtgatctaatgaatgaagatgaggtattaaaatggttaattgaacaaaagcaaacagcaactatagaggaagtcactgatgagattcttgaggatctgatccaggaacatgagtacgtagttgtttacttcagtggaaattgtgaagaaggtcaagaatgtgataatatcttgaaagaactagaaaacatcgatgatgagttggacgaaactggtatcatattcgtcactacggaagacttggtgattgccaaaaaatacaacatcaaaacgtatcctaagttagtattcttcagaaacaaagaacctttggtgtacaccggtgacattgaagatgaagatgaagttcttgcttggttaactgatgaggatactttggaaataccggatagaattgaagaagtgaactccaagatgttggataaaatccttggggaaaatgaacatgtagtagtttacttttataaagaaggcgacaagagatcccaaaagattctgcaagagctagaaaacatcgacgacgaatgtgaggacaaagacatagatttcgtgaaaatctcagacgatggcatccagaaggaatatgatctcccatctctaccagctgttgtgttctatagaaatagatttagagaaatttacacgggtgacttgatgcacgaagaagccattttggattgggtattgaacctgagagactctgatccggacgttatcgaaaatgtggacagaaaaactttacaggtactcataaacgacgttgaacatctagctgtcttattctatagcgacgactgcgaggactgcaaacaaatcttagaagaactcgaaaccatcgacgatgacactgataaacacaacatacaatttgtcaaatccatggatgccaaattggcatccgaaatcggcattttcagttttcctgctttggtttactatgaaactggggttccgatcatgtatgacggggaccttttaaacgaggacaaagttttggaatggcttgtagaccaaaaaagtgatgatcatgatgacgacgatgatgatgacgacgatgacgacgacgacgacgatgaggatgacgatgatgatgatgacaacacactgatgaagatgatgacgacgacgatgatgaatatgacgatgatgacgacggtgacgatgatgatgatgatgataactgctacgtcatcctcgcaacagaaagagcacgaagaagactccccacccctgactgcttcttccacagctagccatcccatca

SEQ ID NO: 1742 - DNA, 953 bp, Diabrotica virgifera
cggtgttgtaaactattcgttaaatcaaaaagttcagtgttattaaattattttgaagtctacaattatccaaaatgccatttattcctgtagtgtttcgtgaaaaccagtgggcccctcattgccctcgtcgtcaagttgctgtgcccaatcgaaattttgttgaagacatcacccatgacgtcctgaattccattgccttagcccaggcgttatttggcccagaacaagatagaggagatacagaggtaataagacagaattctaaattattgaatcaatccagatcatctgttacaattgatgaacacaaattccaagccaatttcgatgtacagcatttcaaaccggaagaaattactgtaaaggtaaatggtgacaggtccattactattgaagccgaacatgaagagaagcaagatgagcatggtggaatttacaggcattttgttagaaagtataagttgccagaaaattgcgatatagaaaaggtagattccaaattgtcgtctgatggagtcttaagtattacagctcctaccattggacagaaatcttccagtcatagaaccattccgattattcaaactgggaagccaattaagccagcagaaaaaccgcaggttgaacagaaatcagcttaaatagtaggttaatattatttaaaatatattacatcaaatgttctttaatttcaagactgatttttgaatgttttattaattccatttttttgtactgtataacatttttttatttaaataaatacatttgtgaataattaatttttgtaattactatgtgaatattagctttaggataaaaaaaaaaggtaatgaattctaaaaagaaaaaaataaaaaaaaaaaagaaaaataaaaacaaaataacaaaaaaaaaccacaaaaaaaaaaaatgggggaaaaaacacacaggggggggggcccccttaa

SEQ ID NO: 1743 - DNA, 856 bp, Diabrotica virgifera
aacagagatatcaaacttctaaagtacaaattgatcatcctctatgtatttgtgcgccaatttgatataacatgataagatgtaactttatgatgtgtaatgtaagggttatatatgttatgttatggttatgagagtatagactgtaagcaaattataaaaaattacaaaagttattaaaagaagtaagtcatttggctcagtgctataactcttgataatctttaattatgtttgagtaaagctattaataaaatagttagaaatactctggaaacagacttagttgtataaattccaatatttcatgtaggtatcttacgcatatatgaaatacttaattgtcatattgtgagtgactaacatagcagaatgttggtataagttaattgttacaaatattatttcggaccctaatattaataattagatattttatgtttattcatttttaaagctagtattcgctaaccgttttctgacaaaatgcacgtgtatctttatattgtcagagaatgaaatcaagttagttgttctctctagatgcgatgcaattctgatctgctgatcaaacactttttttggtgattgatttctgtattccggaggcttcactcttctttttatttaattgaatatttaattctttttatgaatgcgtttttagttctgtgtatttacataagtaggattcatatttaataatgttatgcctctactttgaattcggaatcaataaacatatacacaaattagtattaaaaaaaaaaagaaaaaaaaaaaaaataaaaaaaaaaacaaggcagcaactcaagaaagaatatgcaaaaaagtataaaagttgaaattttatata

SEQ ID NO: 1744 - DNA, 2655 bp, Diabrotica virgifera
ctgaacaatctggcttcccgaagcctaaagatactatggacaaacctgtgcaacagcctcctactcagattaaacctccatctacaatccagggcgtacgttctaaggacaaattgctatatttggcccagctgatgaatatccaagtccagttttcggatttcccaaaagcaaaccacgaaatgtatttgacattggtgtctcttagcaccaacccacctcaagtttgtcacggtgaaggtccgacaactgaagcttcgcacgaaaaagctgcccttgaggctttgaaagctctttctgaactgggtctcgatattgcccccaaagatggttctggtggacctaatggcaatgaaaatgcttccccagtggtgtctaacaaggggccggtacaccaaaacggcgtgaagaactaaacttgaactctgcgtaggctgtaccaatggccttaattttttaggaatgcatctcccttagtgactgcttttttttagtcattggtacagaacatttatacatgagttccatgtggccatgtaaaaaatttgcataacttatattcaaataactacgaattattttttttcttatttaatgtgatttcattaacatatgttatatgaaatgatatcatatatatatatgtaattctggttattgcttgagcactgtgtatttcaagtcagtgctacccattttcgttttcgtgggcagaaaacgaatttgggagacagtagttcagaattggtttacaaaattgtaagtcgtgtataaggtatacacatttagggttcgaatatttatcatgttttcaaaatatttctaagtattttaaacacagaaccctccactatatatatagaaaaagacgtcagattctcatattatatcatggtcaaacaaagcagcagcatcaaaggtgaacatagccgtaatgatagctaaccttcttaaaggacacggcaacttaaggaagtaaaagaatgcaaacaaatccagtggatattctagctgtgccagtaaatggattgtagacgtaaagaagacgaacgttcagctaaaaataacttttaaaatgtgaaactacacccgacgtggtaccactattagcggtaccaccaggaaataggagtaaggtttgtagacgcaaagaagacgatcacctcaaagtagctttaaaacgtgaaactatacccgacgtggtaccactattagtggtaccagtaggaaataggagtaaggtttgtagacgcaaagaagacgaacattcacctaaaagtaactttaaaatgtgaaactataccccacgtggttccactattagcggtaccactaggaaataataaggtttgtagacgcaaagaagacgaacattcacctaaaagtaactttaaaatgtgaaactataccccacgtggtaccactattagcggtaccagtaggaaatcggagtaaggtttgtagacgcaaagaagacgaacattcgcctaaaagtaactttaaaacgtgaaactatacccgacgtggtaccactattagcggtaccactaggaaatagtaaggtttgtagacgcaaagaagacgaacattcacctcaaagtaactttaaaacgtgaaactatacccgacgtggtaccactattagcggtaccagtaggaaataggagtagaggtagtccaagactgcgcaaggaagatcagcgcagcaaactggcaacggttcaactagggatgtagcatcagtcctgatgatacccgatgtggcggacggagttcactggctaggtactggcttaccaaatttttcaatttctaaagtaactgggttgtcaccatgcttcggagggcatgtgaagccgtcagcaccggctacgtagtagtcgttacactaaaacctgagccagaagattgacaactacctcacaacagagatatcaaacttctaaagtacaaattgatcatcctctatgtatttgtgcgccaatttgatataacatgataagatgtaactttatgatgtgtaatgtaagggttatatatgttatgttatggttatgagagtatagactgtaagcaaattataaaaaattacaaaagttattaaaagaagtaagtcatttggctcagtgctataactcttgataatctttaattatgtttgagtaaagctattaataaaatagttagaaatactctggaaacagacttagttgtataaattccaatatttcatgtaggtatcttacgcatatatgaaatacttaattgtcatattgtgagtgactaacatagcagaatgttggtataagttaattgttacaaatattatttcggaccctaatattaataattagatattttatgtttattcatttttaaagctagtattcgctaaccgttttctgacaaaatgcacgtgtatctttatattgtcagagaatgaaatcaagttagttgttctctctagatgggaagaattctgatctgttgatcaaaacttttttttgggggttggtttctggtttccgcgaggcttcccccttcttttttattaaattgaaaatttaaatcttttttatggaagggggtttttttattccgggggatctaacaaaaagaagagaatctcaatttttaaaaaaagggggcttggcc

SEQ ID NO: 1745 - DNA, 1944 bp, Diabrotica virgifera
gaattcaaacatccaccaccaaaaacggtaagaaatcgtccaggaacacgaccaactaacccaggggttgttactccaactgttgaactcaatgctcttgctatgaagaggggggaacgtacagtatacgttgttgaaaatgggggtgctccaccacatcagaactacgtaactcagccaggttattatccacggcataatttgtacaacgctcaaactcagccgcaaaggtacacctacgatgcccgccgtaacatcagaggtcactatccataccacgagaaccgctattacggccagtttagacctggagcgcctcataatccaggagacccatacacagtgcgtttaagagttggcgaacgggagtatccgggacaagggtacacagtacaggctgcccgacacgatgctgcgtccaaggccatcgaacatattaaacaactaggtacttcggaccaaagtgatggggatatatctcctgatgttactcagcagatatcgaatgactctgctcagggaagcctatctgacattaattcagatctgaagtctcctatttcactggtatatgagattgctttgaagagaaatttgaacgttcattttgaggttctaagcgagaaggggcctccacatatgaaagtatttataacacaatgctgtgtgggctccttcatagccgagggcgaaggaaacggaaagaaaatctcaaagaaaagagctgccgagaagatgctggagcaactttcgaagcttccaccgcttccaaacgtcacgaatatagctcagctgaaaaagaaacgtgttacaaacaagaagaagacacgtaacttgatcaaagttaatacagaccgatctacggaagtggttgaagaaattaatccaatatcgagattaattcagatccaacaagccaacaaggaaagagaaccagtgtatacagttttggaagagcgtggtgcaccaagacgtcgtgaatttgtcatcgaagcttccgttgctggccattcctgcactggcgtggggcccaacaaaaaggtagctaagcgtaatgcagctgaagcattactgatcgatcttggctacagtaacactaacatcaacaatgtcaagcccatcgccaaagacaaggaagaaggcgtcgctccaaacatccatcctaacatggacaaaaatcgcaaggtaacttttgttgaagaagttcctgaggttcaacccactcaatcggttggtggcagtggtggtagacaattggtaccagggattctcttggttactgaacaatctggcttcccgaagcctaaagatactatggacaaacctgtgcaacagcctcctactcagattaaacctccatctacaatccagggcgtacgttctaaggacaaattgctatatttggcccagctgatgaatatccaagtccagttttcggatttcccaaaagcaaaccacgaaatgtatttgacattggtgtctcttagcaccaacccacctccagtttgtcacggtgaaggtccgacaactgaagcttcgcacgaaaaagctgcccttgaggctttgaaagctctttctgaactgggtctcgatattgcccccaaagatggttctgggggacctaatggcaatgaaaatgcttcccccgtggtggcccgccaaggggcgggtaacccccccaaaaaggagaaaaaaaatttgaacttttgcgtagggcttgtccccaatggccctttacctttttgcccttaaatttttttagtttattagaattgcccctttttttgggcccttctttttttttaatccctttgggaaaaaaaaaatttttaataagtgggggtccccggggggggccacgggaaaaaaaaaaattttgcccaaaaaacttaaattatctcaaaaaaaaaaaaaaaaaaaaaaaataaatattttttttttttt

SEQ ID NO: 1746 - DNA, 935 bp, Diabrotica virgifera
aaaagtgtcaaacctgcggcttttcgtcaatcgtgtaaacgtcaaaacaaaatgtagaagggtttgattaataaattgtaatttaacgataataaaattgttgaatcaagataaaatagttaacgctataatcatgtcgtcgagagtgttgcgaaaactacaaggcgataaagagaaagaactcgccgaagaaatttcggacacagaaactgacacaccagtaagtggtggagctagaagaaagcagctaaatattaatcgctatgatttgctaaatcaacaatctcattctgagagtgaagtcaaagaggacgacaatgaaacagaagcagcaaaatcttgtgaaggagagcatcacgagataaaaagaaaaaagaaaaagaagaagaaaaagtctggaaaacataccaatactcaaagaagtagtgaagataatgctgatgtcgatgaggtagaaaaatccctgagagaagtaaataagattctaggggaaaactatgcttctaaggcttcaactgttccgaacgtaaaacatgaaaaagttaacttcaaaaagaaactttatctgttcagcataaacacttaaacccaaacaatgaactcaaaaggatatttggatcaaagattgttcagtgtgatcataaacgtaaaaaccgaggcagaggccacgtcaaacaaacaacgatggtcaattgcaaggaaaactacccaaacgccggaaaaatccggtctttcgatgtcatatctagagaacaaaaacacatccactatttcacgtacgagcacagccagagttacagacaagtacaaaataaattcctggacgccgtggagagtctcaatcccgacaacataattggcatattgaacgaacatcagtaccatgtggatgccttgattcactgtctgacgtctgcgaattaagcgaacatctg

SEQ ID NO: 1747 - DNA, 970 bp, Diabrotica virgifera
  misc_feature (824)..(824): n is a, c, g, or t
  misc_feature (875)..(875): n is a, c, g, or t
  misc_feature (918)..(918): n is a, c, g, or t
tgatcagtgtcagttcccagcccctacaattcaaagatgatcgttcttgtggccatcctcagtctggtagcagtcagctcggcgagaccggaagctggatacagctacagcgctccaagtgctcccagcgcccctggaggaggttatccctccggaccatctgctccagcacctcagtatggagctccagcagccggtcccatcgtccagaaacatgtctacgtacacgttccaccaccagagactgacatcccagctcccaggaagcccatcactgtagctccaccacagaaacattacaaaatcattttcattaaggccccaactccaccaaccccaactgcacccatcattccagctcaaccacaaaacgaagaaaagaccttggtctacgtcttggtaaagaaaccagagcccgaaccagaaatcgttattccaacacctgcaccaactcaacccagcaaaccagaagtatacttcatcagatacaagacacagaaggaagaaggtggctacgctcccagcggtaccccagacagctcctacggagctcctcctgctggcggtcctccttctagcgaatacggtgctccacgaagcttctaaaccagctcagcctccatcaggaaagaactgtacatttgtaaatatagtgaataatgccagtggaatgtttttatacaatgtgatttttatacgctagttctaaggttatatagtactgataaaaaacggttgacaaatgtttaggatagagttatgtggaaagtatttttaaaacagatgtgttgatgtattggaaacagtaccagatatataaaggngtatttttaagtacatagatagatagtagcaaatatttgcagacctctcgnatatatagtattatattttacaattatctcataaattagtaanttatctataaaaaaccacttttctttcagtgctttttttcaccaagatgctt

SEQ ID NO: 1748 - DNA, 462 bp, Diabrotica virgifera
aacgatcgcaactcattacagaacactcaaataaaaatgtgtagttctttaacagctgattatgacatgtatgtgataacctacaacttttttaataataaaaataatatattactaatatgagttagaaggagatcttttatatattaagaagaaaacaagagtttgaaataccaaattatgacgacatgcaatttttaagaggcacacatgtgttacatattcaaaatagtttcaggcagtttagtacttctactagggaaaaagtttacaatgcaagaaaattaataggattcgcaaatcaggatatttatgaagtaatagctgacgtaaggaactatgaaaattttttaccattttgaaccaaatctacagatcctaaaagctgagcctaccaaacttaatgcaaatttacaaattggctttccctccggattgttgaaaactaatacttccaataag

SEQ ID NO: 1749 - DNA, 785 bp, Diabrotica virgifera
atcagtttttttttttttttttttttttgaacatttacgttttattgaaatgtacaaaagatatttatttcgaaaataaacttatgacgcacaacttaaaacacaggtgaaaatatatgtatatataatttatgaaatatgaaacttttggaatgcttacagataaaagcaatctgaatctcttttgcagtacatctagtttgcaaaatctggtcattaacatttgatacatgaatggctgtaagagtagaaaatactgtccaccaattaggcaagaataagatctaaacaaaaggtacctatgggctttttacaatatttttgatgactaataattttgatgcaatgataattattattcacacaaatatctgctgatcttatcatcactagattatagaaatgtgatgttgaacacaggcatattacaaaaatttgtcttcctcgatttcgcagaaaaaaacactaatataaccaacaacttatgatgaaaccaagcagctaaaattatttatggacttgatttgacctctaataaaatttagattcaacaaataaatgtatttgagccccctttcaactttataccacaaaaattccttggaaagtgcgaacaaatgtattaagatgaacgagcactttctctataatattgtgtagtaagtcgacgatacagtaggaatgaaataaatggagttcagttagaactcaataaatatttaaaataaaggacggcaaactaaatttaggacaaaaaccatttagaagtagcgcttcgatttcag

SEQ ID NO: 1750 - DNA, 878 bp, Diabrotica virgifera
gagttataatatttaggatgatctatttttccaaaccgtttttaaaatcgagaaagttttttttaatagtaactggagttgttgttggtattgttctccttattataattatagtagcagcgtccgaaacacatactggaacaaaaagtagcaacgtcgaagatcatacagacgaaccgaatgatccttcaggtccctgtgaaattaaccaaattcagtacagaaatacccatcctcttctgctatctcctaagacagacaatgttatttatccacaaggaaaagcaaatacaatctttgccagtaacgaagaagtagaattttcatgttctcaatcagaagtacgagcaaatggagtcaacctaggttctaatattacggttgtttgtaagtccaacgaaacatttacatataatggaacaaatatagagtggaaaaacgttgcatgttcaaagacattagtaccaaccatcaaagaggtaccagttcaaaatttgagttcagatgatcctaacaaaccctgtgatattggcgacgacagtacaattttcttaaatttgggctacacagtggacttaaatcgttttatcaacattgttaatatttgttttaatacaacaaacaaaatagctctgtattctcactacattttgacaagtgttacaatttttggatccagaaatgttacgaggtctaatattcgacaagaagattcgctttacaaattaggttactctgtaaaaacggtctatgatgatagtaaaaaaacaatgaataatttactaggtttaccagatgattcggataatatattaacaacaagatatttattactccgcaacaacttgtttctgaaaatgatttttattttaacaacg

SEQ ID NO: 1751 - DNA, 967 bp, Diabrotica virgifera
cccacgcgtccgcccacgcgtccgcggacgcgtgggtgcaaatctagccaaaagctagtgttatagtcacatactcacaccatggcttctcgttttttgattgcttcattccttgtgttaacccttctaggactctgtttagcaggtggtcacggaggaggagaacacaaacgagtcatcatccacgtcccattcaaagtgaagcacattcaccacacccacacagtcgtcaagcacgtcggccatgaaggaggcggcggcggtggcggagaagaatacaaagtcatcggttactccggaggcatcgacgacggtgaagttgtagcccatggaggtggaggtggcggtgattttggcggacacggacacggatgggaaggtggaatcggaggaggcagcattggaggcggtcatggaatcgaaatcgggcacgcaggaggtcaagaaggaggaattggtggaggtcacggttatggccatgctcttgaatcacaaggaagcgccttaggcggtcacggagcaagcttaagcgccttaggcggacatggagcaggcttaagtgatgggggtatcgattactcagcatcaagtcatggtcttggatcatacggcggcggcggcttcgaccagaactccatctctcaagacggaggacacgacttcagtggaggcctaggagcagaaggaggcggttacgaaagtgcgggaagcgaaggacatggtggctacgaataaaccctaagtagttattatttcttgttacaagtaccaagactagtcttctttgtttttgttgttgtaataattgtaaatgttttttgcgaatattcgtgtttggagctgcaaaaagtactgaggatattttcgaaaaatatttgcagatattatggttgttgtataatattattttattagttgttaagctattacctctgtacctaaaaaagctatttatgtttctctttta

SEQ ID NO: 1752 - DNA, 1002 bp, Diabrotica virgifera
atggtcacctcaattgtctccgctgtttccgtactcgggttgctagtgctccggctgtctgctctgcccttcgaagaagacggccaaagggacaccaaggccttgtacgatgaagtcaggcagttgctgcaactcaaccaagggtatttgcaggatgcgcctcaatcagaggaacaaacgaccgtagctgacatatcagaaaaacctgatgtaccaaaagttgtacaaaactggccagaggaacccttaaagttggggcaggtctcaggagtatcagttaattctgctcttcaacctgttatattccaccgagtagatcgagtgtgggatgaaactacattcaatgaaacgcaccactaccaacaaacgcatctgggaccaatacgagaacatacagttcttactctagatccacaaacaggaaaagtgcttggaagatggggagctgatttcttctacatgccacacggcttaactattgacaggcatgacaacatttgggtaaccgacgtcgctctgcatcaagtttttaagtttaaacctggagagcttcagccgtctcagacttttggccaaagattagaaccaggagcagataaaaggcatttctgtaaacctacatcaaccgctattgcctctacaggagagatcttcattgctgacggatactgtaactcaagaatactcaaatataatgctgctggtgttttacttcgaatatttcctactgcaccagaaattctatcccttcaagtgcctcacggactggccctcatagaatcattggacaggatttgtgttgctgacagagaaaatatgcgggttgtatgtcctagagcaggattatacaccttgcaaggaaagaaggaaccgcctctaacgatcactttacccgatatgggacgagtctttggagtttctgccaaaggcaagctcgtttacgcagtgaatggccccacgtccactcttcccgtccagggtatgaccatcgacccacagaca

SEQ ID NO: 1753 - DNA, 1086 bp, Diabrotica virgifera
atccttataaaaactcaataaatattctttaagctagtattcggaatgttttgtatattgtgattgtataattttagtagttatggttttgtagtccccttagagtttcttttttaagagaagttcaattataattgtgcataatttatttataatttaggcattgttgatccaatataaatatcttgttttataaaaagcacgcgtccggaaaacctcccggtaactgcaaagtataaaaatgaagcaaatacttattctttcaattgtgtgcgtacttgcagtccattttgtaagttccgttagtctccaaaagggtacacttgatatcatagagggcaattgcaccagtccaaatccaaaacaggcagtattgaaagattatgtccacaagactagcattccttttgtcaaaagagacgaaacagttgaatggcacggtgatcaaaaaatttactgcgtaacagccatcagtcttaagagcgccgaaaaaggttcaactgcttggatctcagatggtggagttaaccacacctacatcgcaatcgaactggaatctggtagagggcatggcttggaatacaacgttaccatttatgctaaataatgttattgaggtgtttaaaagagtttgtgtgattataaaataaacgaaataaaaccaaactagctactgctaactttcagcatgaacctgaaaaagaacttacccttttgaaaaacttccaacctgataagcctttaatggttatggaatactggacagggtggtttgaccattgggcagagagacatcatactagaactgctgataactttggagaggtgctagatggtattttaaactttggggcatcagtcaacttttatatgtttcatggaggaactaactggggatttttgaatggagctaatttaaaaaataagtcagttacagccaccgacaatggaagttttcaaccagatattacatcttacgattacgatgcccccttatcagaagctggtgattacactgacaaatattacaaggcccaggaaaatcatcgccaaatataagcaaactaaaaatcaaaataccttgcg

SEQ ID NO: 1754 - DNA, 900 bp, Diabrotica virgifera
  misc_feature (744)..(744): n is a, c, g, or t
  misc_feature (887)..(887): n is a, c, g, or t
gcgagcggccgtcgcgatctagaactagtgtgatttgtgattaggagtgttgtgtttgtgttgttctggaagaagtagagaatacatacgatcatacgatatacgattttagttcgcgttagtagaacaaagcatctaaatttatattacactgagaacgcaaaaagtttattatacttttcaaaaatagtgattttgttgaaagcggtattgtatggttaaaatgaagattttaataatcgtagcggtgtttgctgcatttgccagcggggtatttgtcccaccaagaccagggcacaaaaaacatctgttgggcgcggatttatgcacacgaggaccgggacattggtgccaaaatttgactactgctgctgactgccatgccactaaacactgcattcagaccgtttggattcatcaaaccttgccaccagatgacagcagcgtttgtcaaatttgtttggatatggtaaaacaggcacgggatcagctagagagtaatgaaacacaagaagagattaaagaagtttttgaaggctcttgtgccttactttatatcaaacccattgtaaaagaatgtgacaaactggccgacgattatattcccgatttgatcgatactttggcatctcaaatgaatccccaagtcgtctgctctgtagccggactttgcaacaacgaaagagttaaaaaattactagaggaagctgatgacgaaccaacaactgaagtaatgccaggtanagtagataaatgcaaagggtgtcaccaagtggttgatattttggacaacaaatttaacaagatgtcgagggatgaattcctgcatggactcttaaatttctgtggtaaattcagcagcttttcggatggatgcagtaatctcngtatcacttattt

SEQ ID NO: 1755 - DNA, 2568 bp, Diabrotica virgifera
gagaataaatacataatacatacgagagtgcgtatacatacatacgatataggattttagttcgcgttagtagaacaaagcatctaaatttatattacactgagaacgcaaaaagtttattatacttttcaaaaatagtgattttgttgaaagcggtattgtatggttaaaatgaagattttaataatcgtagcggtgtttgctgcatttgccagcggggtatttgtcccaccaagaccagggcacaaaaaacatctgttgggcgcggatttatgcacacgaggaccgggacattggtgccaaaatttgactactgctgctgactgccatgccactaaacactgcattcagaccgtttggattcatcaaaccttgccaccagatgacagcagcgtttgtcaaatttgtttggatatggtaaaacaggcacgggatcagctagagagtaatgaaacacaagaagagattaaagaagtttttgaaggctcttgtgccttactttatatcaaacccattgtaaaagaatgtgacaaactggccgacgattatattcccgatttgatcgatactttggcatctcaaatgaatccccaagtcgtctgctctgtagccggactttgcaacaacgaaagagttaaaaaattactagaggaagctgatgacgaaccaacaactgaagtaatgccaggtaaagtagataaatgcaaagggtgtcaccaagtggttgatattttggacaacaaatttaacaagatgtcgagggatgaattcctgcatggactcttaaatttctgtggtaaattcagcagcttttcggatggatgcagtaatctcgttatcacttatttcaccgaaatatacaaccatcttcaacaacatttgaattccgaggaagtttgcctcttctctggagaatgcagtgctcagttccatgctcacagagctagagttgaaatcacacccaattctcatattggctacgttaatgtgggagatgataaagatgacgttccgtgccaactttgcgaacagttagttgaccatctcagaaatttattggtagctaataccaccgaagatgaatttaaacgggtaatggaaggtctttgcaaacaaaccggtaaattttcagaagagtgcgttgagctgatagaccaatattatggcgaagtatacaccttcttagtagatcatctgaatgcaacggaagtatgtgacgagattggaatttgcaaagcgagtaaggaaaaggaagacctttacattgcaccacttttggaaaaaaataatgcagaaaaagcattggagatttcttctgaaagaaaaccggagaaagttgatatgagtgcattatctgaagttaacttggaacagcaattacctattgatcttttgatgccaccacatactcaaattctttacaataaggaactctgcgcattttgtgaatatttcttacattatgtccagatcgcacttacagatcctaaaactgaaacagaaattaagtcagtaatagaaaaagcctgcaaagaactaccagtttcagtcaacgctacttgtatgagcttcgtagatatgtatgaaccagctctagttgctctgctagatcaggcaatagatccttcccaagtatgtcccttgataaaagtttgcccttcttcgaagagtggtatcgaagtgtttatggaagctaagagcgattccaaatgtcctttgtgtcttgttgctgttaccaagttggaagagatggtatctaataacaagtctgtggctcaaatcaaggctgcgcttgaaaaattgtgcaatgttcttccaaaatcgatcgacaaccaatgcgaagcatttgttgataaatatacagatcatatcgtcgacatgttactcgctgatttgactcctgaagaagtgtgtgtagcattaaaactctgtactgatgatagaaaagttaattccttaccaccatatgtagtcaggcaaataggtggaaatatcgaaactaacgttatacccgacaacactgtcaatggtcaaatagtcgttgatatccatactggttctattggatccaaaccagagtgtatattatgcgaattcgtgatgaaggaaatagaagatcaattgaacgataagtcgactgatgctgaaattgaaactgtagttaaagacatttgcaagattatgccatcatccgtaagacaagattgtgataagtttgttgatcaatatgctgacactgtcattcagttattgattgctgctctggaaccatcaaaaatatgttcgtacataaaattgtgcgcaggatcacagatggacatgattaaagttcaaattttggagtgccctgtttgcgaaatgaccgtggaagtgatggaaaagattttgtccaatccgaacgtagatcacgatattgttcatgtaattgaaaaaacttgtagaggtcttcctgcgaaatacagaccacaatgtatccaaatcgtagaagcttatggtaaagagatgatcgacttaatcgtccaccagggtggcaaaactgtgtgccgaaaattcggatattgcaaatct

SEQ ID NO: 1756 - DNA, 443 bp, Diabrotica virgifera
accacgcgtccggttagaacatgaagtacttagtgttagttagtgtaatttttttattatccgacgtcaggaccgaaacgacgcccgtgtatggtggattgcagattttgacgaaggtgtttcggcagtatttgaagagtcagccagatgatgtcaaattgggagatggcgttcatattgtcagcgtcaagagtgaaaacgatgcgagggctagtgtggatgatggaaccgtcttaggggtcattgaacattaccttgaaaatcatgagttgagaattcgactgccggaactgatgccgggtgaaggatttggtagagcgtttaagacggcgatggaagaagtggatgccaaagatgaaagtactggaagaggcaaacgaggaaaatgtggtggaggaatgggaggagtcatgatcatcggtctaatgatgggcaaactacta

SEQ ID NO: 1757 - DNA, 443 bp, Diabrotica virgifera
acggaaatattggttagccattgcaatagcaataaattttgctactgccaaatatacatataagctaggagacacagaaatagattttacagcaactagcaatggaatagaaatatacatccgagacgctgaaataggaagccaactctacggtacaattggcgttggtaaaaatgccagttgtatcgattttccccgatgcaaagtaggagataatgatgtcgcttttagattcctgcctggaacttccctgtcagtcatatcgaccaccaacaacacgcaaagaggtgcttaaagactgtttcttcacggcgatacccagtgcctccccacaatggtatcgcaacgcccagaaaggagggtcccaaacgtgccccgtacgcacatgagggttttctcacccagccccctatatcaccagaaaggacgaccatccatgctgt

SEQ ID NO: 1758 - DNA, 1181 bp, Diabrotica virgifera
acatattgtagtttttaagatttgacagtgatctcagttatttttcactcttttgaggaccttctcatagatgttgctgacatctacctggaacctgagtatcctattgatatttatagctctgtatgtactatataaatactttacaagaaattttaattactgggaaaaacgaggaatattctacataaaacctttacctttctttggaaacttctttgatacatttacttttaaaagtaccatagcacatggattaaaagctatttatgaccaatcaaaaggagattttgtgggagcttttgtatttgatactccagttttaattctaagatctccaaaattgatagaacatgttttgataaaagatttcagctttttcaaggacagaagccttgcatctccaaaacataaccctattgtggccaattggttgttgttccaggggtattcggactggaagaagaccagacccaaggtcacttcaatcttcagcagtgggaaaattaaaggaatgttttatactgccaaacctataattgacgacatgtacgcatttataacaaataaagatgtcgttattgaagttaaagatcttagtaggagatactcaacagaggtggtttccagatgctactttggtatgggtggtaggtgtttcgaaaagggtaattccgagatccaaaacattgcaacaagattgtttgagttttctgcaagaaatgcaataattcaagggctacacgtatttaagccacagtgggtggagttatttaaacttgactttatgatccggagtgatcaagattacatgttggatgcatttatggacgtggttaatgaaagaaaaaaagttaaagcacaggatggaaaagcttttgattatattgatattattttggagacgcaagaatctactaacaatgataataaaattggaatgacggaagtgatgtccaatactctgcagtttttcatagcgggaacggaaacaatgagttctgtacaatccttttgcttgtatgaattagctattcatccagaaattcaagacaaagcacgtaaggaagttaatgtagttgtgaagagacatggtgctttaacttatgaggctatacatgacatggagtatgtacatttttgtgtactagaaaccttgcgcaaatatgtgtccctacaaa

SEQ ID NO: 1759 - DNA, 445 bp, Diabrotica virgifera
aggttatttctttttatttttgtgttggattagtactgtattagactgatatttatgtactattttaacttctttctcggtcttttttattaacttttctattattagtatactaattttctttgtatattttatgattattctttctttacttttgtacttccaataatgcttaatttcattgctttatttcttctttttttactaattacatacatacttatataggtttatcttattgcatagtttttacactttaatattgctgtatatattatacccttttttcttcctctattgcccctgtagtttattaaaatctactcttaaggggaaaggcgcaaaatgtcgcttgcaaaaattttcaatgtgttttaaatgtattcattattttcgaatcctgagagggctaatgggtatttttgaaaaatttgaacgcaaaatg

SEQ ID NO: 1760 - DNA, 865 bp, Diabrotica virgifera
caatgagtacatactaagaaaagccacaattaaagttctttagagaaaaagaaaagcaacaatctacttttataaaaacctaaaaaaatggagaaaagggataaaaaatatagtataagtagcttctgtaggattttgcctaaaattgaactgcatgcccatctcaatggttccttaaatacagatattttaaaaaaattaggatgcaataatgatgctatagcagaatatcaacttacggacattatgagtaaatctagtcgtactttggaagaagtgtttcaactctttaatgttgcccataatgctacaaaaaccaaagaaaacgtatatcttgctgctaagagtgttatcgaagactttgataaagaacatacaatatatttagaacttagaacaactcctagatgtgaggaggcaatgagtgaagaagaatatgttgaaacagttattaaagcaattacagattgtaaaaagacttgtaaatacgtattagtgaaacttcttttgtcgataaatagacgagccaataaagagtcttctatgaaaacgttagatgtaattattaaaatgaaggaaaaatatccagacattatcaaaggtatagatttgagtggaaatcccatggtcggtactttcgatgaagatttatttgaaaaggccagacaggcgggtcttaagactgccatacattgtgctgaagttaaaaatgacgaggaagtttccaagatattaaaatttggaccggatcgaatagggcatggtatattcttgcatccagaccacggtggttcacgggaaaactgggacctttattgcgagaaaaaaattcctttagaatgctgtttaacttcaaatgttttaa

SEQ ID NO: 1761 - DNA, 1551 bp, Diabrotica virgifera
gatgatattatttcttgaagttattttttcttgacctcttgacaatgatatggataagagagttctatctagatgtaggccgaggtattccagaatcttgtcaagccattccacctccagtatccttgaaacatgcttgttactaaggtggaaaatacacacctctatttttgcggcattgaatttcagatggtttttaccagtatagtgtctagaatatttgtcagtttttcttcgaccacgttaaaggtgctacctgagctgccacagctgtattatcagcgtaaataaattgtttagtttgttggtttatgggttgctagttggtgtatacgttgtatagaatcctacatcgaatgttcctggactgggactgtagtgttacgtagaagcgtatgttccgaagaacagtgatacacactgaaaaacatatacctttaaataattgtgtacttaattgtgtaatggtgttaaatgcctttcttaaaaattgttttggagcacaatttgtgttttttcaaatttctaattttcgataaatcccaataagtttttccgctcccttaattagtagatctgcactgtatggaaacaaacaataatattaatgagtttttaactaaaactgccaactatttttaactaataccgaataatgtaaaactgccttctaaataacaatttaaaaaaaaatagcaaaacgattttactatcgtaggtatgagtaattttatttttaatgttaccattaccatgaaatcgatattaaaaattctgagtagaagaacaaaccgaatacgttcggtgctatatttttttaacgtttttatgtatttcatatatttataaatcttcattaggcgcaaatgctagcaaatatctcaaactacaaacgaatgttcttgatatgacatcgaaacaaaaaatataatactggttctgaattcaccatgatttaaatatcggagaccaccgtggttttataggcataagacagcagaagtaattctggtgtgaactatatattactgaatttcagctttgtttagctctttgccttggatctatgatctatctgcactattttatccagtagcttctctgtttggccacaaaatatagcgctgaaataataatactgcataattttgtagcagtatgtctacccttattgctgttacggactgatgatggcttattttcgtaacctctttttctgtgcatactcggcttaatcgaggttttctttactacagtatgcggcaaaataagcagtattgaaatgaatattatattgaaattattgaatattatattaaaatgaatatataccagtaactgaattgtagagacaaaagggataccaactgagacatgggaaaaatatttcagagaactctacaaaggtgaagactccaatgacgaacacgattacaatacagaagacacgtatatcactaaagaaactgaagtagaagcgagaatgaagatcttaaaaaatagacgatcgccaggtactaattctattccccctttaaatttttttttttt

SEQ ID NO: 1762 - DNA, 1216 bp, Diabrotica virgifera
aatggggttaaacgtgcatggtgattttttgtaaacgcgtccgtctagaactacttcaagaatgtctgcaagagcttggttcctttggtgtctcctagctttggcttcagtttttggagttaatggcggaggacatggtggccaccatcacgtagtattcaaaatcccagaacacattcacaccgtcaaacacacacataccgtctataaaaccatccatcatcatacaaaaggtcacgaagagcctcacagccatgggggaaaaccattccattggcactgaagaaatttcacagttgaaatttagataagataattttttgcaagctttaattatggggtaacattccagtatgatttttttttcaaaacctatagattttctatatataagtaatatggaaaactgctgaggtcgccaaactaaaagcaaaacgcttcgggatacaccacaggtgcctctgaagacgctaaaaagcagaaaccatggtcagccgatggtggtagccccgaatcaattttaatctaaagatgtctttccttaaaagtaaaacattgaagagttttcattgttgactttttataaatgataattttcttgttactctctttccattctcgctttttgatataatccttttattaaaggtacattctacctttctttttatgatatttctgatattaatttcaagtcttcattattacattttacgatataattattgaaaggattctttattgaccatcttcagatttgacaaatttgtcagtaaatctaagggaagggctccaaaatttacttaccacaataattttttttgtaagttcgtagattccattatggagcagtttttaacgctataaaaaaagaaaaccacagaatcatcttgtaaaacatttatttttgaaaatatattgacacatttgcaaatttggtgaaagagccttcaagtggttatattgtctttatttttttctggttctctcagatattctatgttttttttttgtttttttccgtcttctacttttacattatcatttgtaaagatatttttgttttttatttaaatttactggaatgagttctccgatgaaatttcacttgtgctaggctaagagcttatcaaattgtttccctttggcatttttctgggatatttttttcttttaataaaaaacgcttttttccctacagcctacacaccccacc

SEQ ID NO: 1763 - DNA, 467 bp, Diabrotica virgifera
agaatcaatccgtcataataaattggtgacatcaacattttttaaattcttggatacttatttgtatatgaatcataaataactacaaataccacgtaaaattctccagtaatcatgtctaaagttcacgaatttaatgtaaaaatgacctgtgatggctgttctggtgcagtagaaagagttttaaataaattaaaggacaaaggagtcgaagactttactattaacttggagactcaaaaggtgaccgtaaaatcgtctctacctgcaaatgacattttagaagttattaagaaaacaggaaaagaaactaccttgctatcttcgtcttagtggagatctttttgtgaactttacgatttgcagctaattttatatacttatgtgaacgatttatgttaagtcttattgacatattatttacaattataaaaatctatattttatgaatataaaactataactct

SEQ ID NO: 1764 - DNA, 862 bp, Diabrotica virgifera
aggtcctcttccgcgtccgatttatataattaatacctatcctatttgaaatcatattaatataaaagatgagcagtttgttgaagcatagtagagtaaatagaaataaacggcaacattcaaagaaagataaaaaactaataaaacttataaaatccaaatctgaatctgaagatgaaggcagtgaacatgaattatccttctatttaaatgatagagtcaaattaatgaaagaagtgttaaagatcattaaacctagaaagattaaaagtatggcaccggattgcatgaagagtatggacaatgaagaaattaattcaatgctgttggaagaactcctaggcatatctaataaaaggctaaaatatattttcaatggacaaaatctgaatgaggaaagtagttcaactgatccagaggaccagcctgatgatattatatctttagatgacattagtgatgatgatttggaaattatagaattggatcaagattctgaaatgaagaagggtaaaaaaacataggaccagaataaaagaagaacataaacacaaaaggataaaaaaagaaaaacaggacaaggatcatgcttcagaaaagtacagaaaggacaaaagcaaaaaagaagaaacagaaccgaaccccatgagtcaaaagaatttgatgagtgtactagaactactggaacttcaagccagggctagagctataaaatctcaactagttttggaatccactaaacctgctgaaacagccccacctagtaatgaaatcgaggatgaagagggtgatgaagaagatgcaattatagtagaaagtccacagaatgaaagaaatataatatcatctagtgatactgagg

SEQ ID NO: 1765 - DNA, 524 bp, Diabrotica virgifera
caaataacaaaggtggttctcagaaaagtgttttggttataaaagttataagacaaaatggctaaccattcgcttctttgtgtcctagttttagtagcagcattaaatatattggcgattatgggtgccccccagcacgatcatcatcatgtcaatgaccaccatgaccaccatgaccaccgacattacgataaccactaccttcacattcttgatgacgaacaccacctttatggacattacaatgactgtaaccaccatcacatctagagttatctaattatgtcaaaaataaattacccttatgtattagctattttattgtatgatatgtatttttatattattaatattaaatattcttagcgctgcgcttaaatataaaatcttatagaatttaatttttaaataacaattatgattaaaactttccatattttaaaatatgatctttacttgatttcatatattaatcaccttgatttcttataaattttatattaaaatataaagtttaaaatact

SEQ ID NO: 1766 - DNA, 901 bp, Diabrotica virgifera
  misc_feature (864)..(864): n is a, c, g, or t
  misc_feature (871)..(871): n is a, c, g, or t
ggaaggatttgaattatattgcagtaccaggggggttgcatgcagtagtatagtcaaaaataaaggcgtctactgtaagtaaaattaactcgaaaatatcgacctcacgacaaaaattgttaaaaagaaattgtaataattgtaaatacgatttatttggaacaatttcagttcctaccatttttgtcgaaaagttaaaaatggcggagatattgagccaaacaggttctcctttaaaatcaagatggcggctaacgtaacggaggaattcattcgtgattttaaatttaggctactattgactcccttaaagatcagaaaaataaaattttgggcagctcggcattcaaggtcaaatgctatcccgactggactaatatatacttttgagtctgatattactgcatgtaacttttttggtgttgtaatgtaattcaagtccttctgaccacttgaagttctgtcttttggatatctgtgggcaaattttcggccaaatcgatgatgatgtgttttgggaatggaggaaggtgtaaaaagcggtattttggcgttttttggactataaaatttgatcggagacttgttttggttcaaagtaacttgttgtaatgccatatagtgacatttttgagtcctttctattaaaatattatgtattattttaatattacttttgattttattgaagtaaaactttcgcttgttgtaagcacatgccgccactgcgtccgtatctctttgttttgctctaattcggtactaagtgtcggatttgttttagttcattcagagaaagtcatatattccctctctgatgatatctaactagcttgaaacccgttagggtgtttatggaatttnaatatangacgtctctagatttcgtttacagcaaaat

SEQ ID NO: 1767 - DNA, 866 bp, Diabrotica virgifera
cggacgcgtgggctaaaagttaacctcaccattttttttggaaatttatagatttaaatttaaaataatatttaggatcacttaaagatgagaaaaagccctgtattattacggcaacacattggttggcatttttataaacattgggttgtccaaggaaagcgtaaacctttggatactggtgctgaaaaaattcttaagagcaagaatatacctgtatatgattcaaaagacttcctaatcgagaagagagaatttgaaaaagtagaagtaataggttttaaggatcaacctaaaccattagatgaaacacacccagaatggaatgaaaaaccgttattatcatataaggaccatagtgtattattggaaggtcttgatcaagctagaattataacaaatacagtacaactacaagaaggacttccagatagttttgaaattaaaaatttgcccaaggaagttgataaagcgtccaaagatataatttttgattcacatttatttgatgccgaacagaagaaattgcctaaaataaaaaatcctgccaaacctgcatggaattttcctagggtatatggtgttactcaagaaagaagaaataaactgataacccatagattaatgaagcttttagaatctattaatgatcgtcaattagtaaaacaaagatatatatttgaagatcttttattttcatttccatttcaaagaaatggaaacttgatacaattggaactttctggagattttgtactttcctcagaaaaaactttgtcacccataacaaactctgctacagaacacttagaattaccgaacattcccccaattgatcctttaattacattgaataaggagaatat

SEQ ID NO: 1768 - DNA, 961 bp, Diabrotica virgifera
  misc_feature (893)..(893): n is a, c, g, or t
  misc_feature (899)..(899): n is a, c, g, or t
gtttcgacttatacagttcaaatcggctagtaaagagtggtattttatgtgttagttttactaatttcaaattattgatctttaaaatgatctccactcggaatcaggaagttgtcaagaagaagatggcaagtagaacttcagtgccttttccactagccagttatgaactggaatttgccgaatccattcaacacccagaaagattttgggccaaagtaggtcaatatgtaacatggtccaaaccatggaagagggtgttggacaacacgtacgaaccttttacgaagtggtttgtgggaggagaactgaacgcttgttataatgctgtagatcgacatgtagaagcaggcaaaggtgacaaagttgccttaatttatgactcccctctactgggtattgtacgaaaaatcacatactttgagctacaagaaaaagtctcaaaacttggtggtttgctgcaaaggttaggggttagtaaaggagacaaagtcatcatatatatgcctctcatcccagaaacgattatggccatgttagcagttgcgaggataggagcagtacactcggtagtctttgggggtttcgccgcaaatgaattatgtataaggatccagcacgcagaaccaaaagtgataatagcagccagttgtggaatagaacccagtcgcgtagtcaattacataagtgaactgaacgaggccattgctttatccagccacaaaccgtcaaaatgtataatttatcaaaggaaaggagtagagatcggagatcttgatccagacagagatatggattgggaagaagcaatcaaaaattgtgaaagtgctccttgtatacctgtagatgccaacgatcccttatatatactgtatacatcaggaacaacaggngaaccnaaaggtatcatcagaccgattggagccatctctgcactcttgtatataacttaaagacttta

SEQ ID NO: 1769 - DNA, 913 bp, Diabrotica virgifera
cggggggagaaccaccattgtcactgagaaaagccgtcgctaatgttgcgcaagattataagaaaaagaaattcgtgtttaggctgaaattggaaagcggtggcgaattcctcttccaatcacagaacgacacagagatgaacacgtggatttcaaaaataaattctcacgcagacaccgaatctgccggtccttctcgctcacatacattacccgcatctgggcagaaggaggattccaaacgtcgcagcttctttactttaaagaaaacataaatttctacttctactcttgatcatacctgtatctttacgctttacctgagaggactcctgtccagacttcgcccttctttttttatattagcataaatatttaatatatttttcttgtagtttgcacattatattattaaatagtaattttaaatgtatagtaatatattatactatgtgattaaaaatttacttgactggggcacaaaactaccaacctcagcgagagccagtgttgtattatttattaaaaaactatttggatatatacatagttgaagaataagaagaaaataataaaatgtacgatgtaaagtcccagcataaccgtattacagttaactgttcggcagtttttcgtctgccctgttccctttttcatttttacgtttgatgtaactaaatctaaacccgttatttttaagttgcaatatattttaagctttgcttagcaaaggtcgacggtcggtgacaagtcatttattatatttcaatattatttgtagagttatttctattttacataaatgaactgtgtgcttttaaaaatggagttataataaatattgtttttagtaaaaaaaatataattggaggattaggaaaaataaaatgtacccttaaaaaatgagagatca

SEQ ID NO: 1770 - DNA, 364 bp, Diabrotica virgifera
agtaggacattaccaatcggtctagcgagtctcttcatgttttattaaacgaattacagtatgcaacaaaataaacagtctatctatctaatgagccctaaacatccattcttggatataagcctcctcttccttcttccatgcctctctatattgggcaatttgcatccaatttgacccagtgtgtttcttcaggtcatccgaccatcgcatctgtggccttcccctttttcgtttgtggttccacggtctccattgtataatcatcttagtccaaccttcaaccttctgccgtagggtgtgtccggccaacttccatttaagctttgctacttgggtagagacatctttcacttttgttttg

SEQ ID NO: 1771 - DNA, 2263 bp, Diabrotica virgifera
caacattttcacttgcaataatatgcgccatgataattatttttcattactgtagaacgtatagaattcatcaagtggctttctaaccaaagatattctttctttcgtttgtttccacttgttgtcttgctacagtaagtgcgataatctgttaatatttattaataatgataaaaaagcggtcttataaacttttttctgtaatttgacaaaactgctatggtggtagctgactcttattggaagaaacttactgattacttcccctgactaggtcgaagtcgaaaatgcatataaaaataaacggtttgtcggttttgtaatatttgaaacagcggctcgaaagaattcagctataagatataaaattgttcgaatattgttcagttacatttagaatcaagccatgtaagcacaggatagtataatagcagcagaaatagtagtgatcacgtacaaaagtagtaatttccaacatttttaagttgaccttgaaaactctttgaaaatggctgtcaaaaattgatgtttgacagtcgtgacgtttgacatgcgtcaaaaattgatgtttgacagtcgtgacgtttgacatgtgtcaaaaaatgaaaactccagtaatactaagtatggatggcacatcaaaatcatcaaatttgattactgtattataactctaatcaagcaacacatagaatatcggaaaaatattatgaataaatagtttcgtcatgtagttagtttacatgtactaatttatttgtttctgtgtataatcagtcctttagtgacccaaaaggattaagtttgaataagcaatacaaggcactatctatcagacatatatgtcatttaaaaacatgatttatatttgatacatcaagtttgtccaatttaagcaagcctatacatgtagagacatcttccagaatacgtcccatattatattatcaaaatatcacgaaaccgactataattctttattttaagttattatttacgattcagatagcaccggaatggctgtcgtgtatacaggcgtttccagttctatccgcgcggttgtcttaaggcccaattggtttttgatatgactgatgatgtcttgatcggccgggcagctctggatgaaggcttcgagttcgtacatgttcgccatgtagttccacaaagctttgaatgttgaggggatctcgaatttgcggaaggctttggctcctatgcggatgtgttgcagtctaggcatcaattcacagtcaaaacaggacatagtgtcaccagttaaaaatctcgtgcctctctttgccatgaagtcgttgatcctctccaaatgcgaatatagaggttgcctattttctgtggtgtcagtcgattcaaactttctaacgtacgttttgaactttgtgtagagattttcaatcaatgttgctacttctttgtcctgtacaaataaattatgacctcctggcacgttcttcatgatatgtctttcgattttctcgttttccaagatggccatccctctgtctatcaggatcggtgggggcgtcgcttcaaaattcgtacggaaatcaggaggaggtttctgcatgtctactgtcgtcaccttcagactaatagttttcagttcggccaataagtacaactccatgaagtattcctgacagaataggcaggctcctttacgtctaccgtctattgtcgaggccctaatgataagctcgatttctggtacatctccattttctgcgtgaccattttcagcaacttcgtcggccattgttgaaaatttctaccgggaaaaggcactgaaaaactttgttgaaactccggacgcgtgggcaaaaaacttgtcatcgaacttccaataacctttggagatttaagattccactatcaccaccgcgccaaagtattattcattagcatgagtggagaagttgacggcactgttaaacatatacaagtatctgctatagcaagtttcgattttaattctaacactgtgtttttggatcattatgacatgaaacattctggagatgtgacggttcatttttctggaaatccagtggtggactggttagctaacgcaattagtgcggtagtaaccactttcatgggacaagttattattaacgttatggccaaatttattagagataacctgagagctgttattgaaaatctcaacaaagctatagctcaaattattaatcattaaaaatattttctttattctaattatattctaagccgaaagaat

SEQ ID NO: 1772 - DNA, 853 bp, Diabrotica virgifera
  misc_feature (851)..(851): n is a, c, g, or t
cccacgcgtccggttaaaatgaaagttttaatttgtggaataatctgtttattcgcattttgcggagctaatccagtaaatccatctgttcatgatgtagtgtcaagagctttagagaggattgattataataatatcattcccaaagaattgatcactagactgaggtttttaactgaagctgatatcttaggaggcagcgaaattacagtatttttaaatcaatatgcagatacaattttcaacaatttacaaaatttcataagacaacacaactggcagaatgtcgatattccagatacacacttgaagatatctggtggaagtgtggatttaactagaggtaatttaaatgaccttgatacaatttccagaggcggagatgttattcttacatacgaaggggataacaaaaaacttgtcatcgaacttccaataacctttggagatttaagattccactatcaccaccacaccaaagtattattcattagcatgagtggagaagttgacggcactgttaaacatatacaagtatctgctatagcaagtttcgattttaattctaacactgtgtttttggatcattatgacatgaaacattctggagatgtgacggttcatttttctggaaatccagtggtggactggttagctaacgcaattagtgcggtagtaaccactttcatgggacaagttattattaacgttatggccaaatttattagagataacctgagagctgttattgaaaatctcaacgaagctatagctcaaattattaatcattaaaaatattttctttattctaattatattctaagccaaaaatgataatatatgtttactanat

SEQ ID NO: 1773 - DNA, 844 bp, Diabrotica virgifera
cccacgcgtccgagtttgtgtttattcgcattttgcggagctaatccagtaaatccatctgttcatgatgtagtgtcaagagctttagagaggattgattataataatatcattcccaaagaattgatcactagactgaggtttttaactgaagctgatatcttaggaggcagcgaaattacagtatttttaaatcaatatgcagatacaattttcaacaatttacaaaatttcataagacaacacaactggcagaatgtcgatattccagatacacacttgaagatatctggtggaagtgtggatttaactagaggtaatttaaatgaccttgatacaatttccagaggcggagatgttattcttacatacgaaggggataacaaaaaacttgtcatcgaacttccaataacctttggagatttaagattccactatcaccaccacaccaaagtattattcattagcatgagtggagaagttgacggcactgttaaacatatacaagtatctgctatagcaagtttcgattttaattctaacactgtgtttttggatcattatgacatgaaacattctggagatgtgacggttcatttttctggaaatccagtggtggactggttagctaacgcaattagtgcggtagtaaccactttcatgggacaagttattatcccacgcgtccggactagttctaaaaattggcgagcggccgcccctttttttttttttttttttcgttgacagccgaagaagaaggaactaaacaatggcggacgcagctccagccggtggacgtggtggattccgaggaggttttggaggtggtggccgtggaggc

SEQ ID NO: 1774 - DNA, 977 bp, Diabrotica virgifera
  misc_feature (954)..(954): n is a, c, g, or t
acaagaatctaatttgatactgaccagtgaagaacatctctgaagatgatcgtctacaattacacgatctatatcaagtatatagctttcgctgtgatcgccatatcactaccgttcatagcgttaatcgttttaaaatttttccaaaagttcagtgccggaaaagtgcggagtttggtttgcttaagtggtaaaacggccattgtgactggagctggctcaggaataggatacgaaaccgccctccacctcgcctccaggggatgtcgagtaattctcgccgacagaaaagaagctgctaaagctaaggcaaaaataatagccattacgaacaattcaaacatcgaaacgaaaatcctcgatttaacttcattgcagtcggtgaggaagtttgccaaggaaataaactcgacagaggaaagattagacattttgataaataacgcgagggtgctgagcaatggcaacaaacacaccgatgatggtctgcactcgaccatgcaagttaatcacttcgggccctttttattgacgcaccttttgacagatttgctcaaaaagtcagcaccaagccgcatcgtcttcgttagttcagcactagctttctgcagcaacctcaatctagaaaccctcaactaccctgttgaccatcctctgtccatattccgccaaggtatcatatacgcaaactcaaaactcgccaacgtcattaccgccaatatattcgctgaaaaactgaaggaatccggtgttaccagtaactctctacatcctggtttggtcaatctatacctctttagaaaatctgccagatttgatggattgaagactgtttatagactgatcagatatttcttcctctacatttatggccagaccccagaggaaggagcccaaaacactcttcacttggcattagctaacagcgttaaagatatcactggcaaacacttnctgggattgcagagtcttcccta

SEQ ID NO: 1775 - DNA, 373 bp, Diabrotica virgifera
  misc_feature (313)..(313): n is a, c, g, or t
agacgcgtcggatcaaaagaagctttcaatttttcaatttcatactttatattataatttgttaatttgtattgtgttcgtccttcgtgaaagatgaataataatatgggatataataataaagcatgggggagaactaacaactcctccaacttaatgaatcagaatcaattacaatcacaacaacccggtggtctaagaaacatggtcccctttccgggaaatcaacaaatttttcaaaacccattgggacttcaacagcataacctggggctagggttacaacaaattaacaatgcaattgacggtgcanctgcactcagctcccaaattgctagcaacccaattttccaaacaggtatcgtacccgaat

SEQ ID NO: 1776 - DNA, 913 bp, Diabrotica virgifera
  misc_feature (818)..(818): n is a, c, g, or t
  misc_feature (881)..(881): n is a, c, g, or t
tctacaacacaatattcaaatcagtatgggcatatggtctgcagctctggggaacagcatccaagtcgaatgtatccataattgagagattccagtccaaggtgttacgttcaataatcgatgctccgtggtttgttactaacagggatatttacaatgatctggaaacgaaaaccgtcagtgaagtgatagtggagttaagtgcaaaatacatcgtacgtcttgaaagccacgcgaatgtgcttgcaattaatttgttagacaacagtcaggaaacaaggcggttaaagagacagacaccattagatttaccgcatagacattaacattgttacagtagctaagttaatatattgatgtaatacagtaatttaatattatctctgtagagatgtgtgacgctggtcacaatctctcttcatgtcattatttctaagataaaatgtgcctattgttatatgttataacagattgcctaataaacatgtaaaaaaaaaaattattatggaaaaagtcactaagtgccattaatgagttttaacgcatatctctacaatttattcgtatgtaaaaagttactaagtcaggtatttttggctacttaatattttctgtattaacgggttagtgatttttcaccacacagaaataatcatttagaaacacatttagcaagtagtgacttttataatagaaagatatagtgaatttcattcgatcggtgaaattaatgagttttttcacaaaatgtcagttagtgacttttcgccgggaagatgaaatttttacggtcgtcgactagataaacgagactgtanatttgtcggacaagaggtcgacaatatttagtaagtttatcatactttcatttgaaaattaangagttttgtaataacaaaactataccgcgcta

SEQ ID NO: 1777 - DNA, 1652 bp, Diabrotica virgifera
gcagcgttacacagcgaatattttcctttcctcatcagttcaatattaacaataaattgttttgttgaaattgaaatcacaaattactttataaaatggtaactctcgaagacgttgaaatgaaaaatgcagacagtcctccaggattagaagctggtgatacaaagaaagataccgacctacaaagtgtaatagaaattcgtgaacatgcaagacaaatagaaaaatcagtcacaagtaaagaaaaccgtttcatcttacgagttttacgttgcttgcccaacactagaaggaagcttaatggactggtgctgagaagcctcattactcaaatatatcctgtagctgaacgtgatgccctccttagtttcgtcgaggaagcttctggagaactcgacgccacccagtcacgagcaagatcagctgttaagtcacctgttcccgaggtagatacatatataaatcttttaatactagtacgtttaattgataccaataagttagttgaagcagagcgctgttctcaagctcttatgaataaaataactaaccaaaacagacgtactatagatcatattgctgccaagtgttatttctatcactcaagagttgctgaattgaccaacaaattggattcaattagagggtttttacattctcgtctacgtaccgctacactcaggaacgactttgaaggtcaagctgtgcttataaattgcctgttgagaaattatttgcattattcgttgtatgatcaagctgacaaactagtgagtaaatgcgtatttcctgaaactgcaagtaacaatgaatgggccagattcttatactacttgggcagaattaaggcggcaagattagaatacagtgtagcacataaacatcttgtgcaggccatgagaaaagcaccccagaatgctgccattggtttcagacaggttgttcaaaagcttactgttgtagttgaactactgctaggagatataccagaacgacagatttttagacaatctagtatgaggcactcccttgccccatactttcaactaacacaagcagttagaatgggcaatttgcaaagatttggtgaggtgttagagaacttcggcccacaatttagacaagatcatacatttacactaattttgagactgcgccacaatgttattaaaacagctataagatccataggattatcatactccagaatatctccccaagacatagctaagaaactggggctggattcagctgaagatgcagaatttatagtagcaaaagcaatcagagatggggtgatagaagctacacttgatccacagggaggttacatgaggagcaaagaaagtactgacatctactgcacaaaggaacctcaactggcgtttcatcaaagaatatcgttttgcttagatttgcacaatcaaagtgtcaaagctatgagatatccccccaaggcgtatggcaaagaacttgaatcagcagaagagagaagggaaagagaacagcaggatttggagttggccaaggaaatggctgaagaagatgatgatggttttccttaaagtggtgtagttatcaatattaattttataacatttttgcttttgtatggtatttatagacagtagatttatcaaaatatactgagt

SEQ ID NO: 1778 - DNA, 1104 bp, Diabrotica virgifera
ggtgggtatcgagacacaatcaaaagatggactattggggtggggccttagcaggttcaagaaaatgcgagtgtggaatattaagcagttgtacggattccacgaaatggtgtaactgtgatggtgttcaaaatgccgatatttggcaagtggacgcaggtgacttaactgacaaggagacccttccggttaagcaacttcgttttggtgacacaggcagtgccctcgatgaaaaagaaggacgttatacgttgggaccactgatttgtgaaggagatgatttgtttaacaacgtcgttacattccgggtggcagattccaccatcaacttacctacattcgacatgggccatagcggtgatatatatttcgaattccgaactgcttcagccagtgccgtactattccattccacaggaccttcggattatattaagttaagtatagttaacggaaatcaacttcagttccaataccaagcaggttcaggtcctattgctgtgattcgagaggtttcttacagattaaacgacgatgaatggcattctgtatcggtggaacgtaacagaaaagaagctatgattgtaatcgacggtgccctcaaagctgaagtaagagaaccaccagggccagtaagagcattgcatctgacatctgagctctttattggagcgtcgacagactatagagatggttttactggttgcatccgagctttactaattaacggtcttcacatcgatcttcgtcaatacgcaagaatgggtctttacggtatacaagagggctgcgtgggaaaatgccagagcggcccatgtttgaacaacggtacgtgccatgagagatacgattcctatatgtgcgattgtcgttggaccgcattcaaaggaccgatttgcgctgatgagatcggtgttaatttgagacaaagttctctcattcggtacgacttcgaaggttcatttaggagtactattgcagaacatatacgaagtgggatcactactaccaatcctaaaggttttctttttggggattaatatcaaatatgacccgggaatacatgaccatcatggtatccaaattctggtcatttacgtatcg

SEQ ID NO: 1779 - DNA, 385 bp, Diabrotica virgifera
aacatttttgcaacaatgttctcgaaaaaatatctgacttttctgtcggtattgtgtatagctattgccgtgttcgcggacgacgaaatacctgaacctaagccaaaaagtgaatacaaaaaatctttgtcaagagattgtgcaactagttattcgacgacatgtttaaaattggacatagtgtcatgggtcgataagttaaacgaggaaaataattatagtgttctaccgggagtttcggtgataaaggaagagcaaagtgataaaagttcgacggcagatatggtgtctgaattagcacgagactttcccaatgatcccgacgcccgcctggacgcgttcctcttgaaaaaagtgacttcttatttaaacagtcattccttac

SEQ ID NO: 1780 - DNA, 391 bp, Diabrotica virgifera
agtagctttaatttttgtgttaactgttaaactttatcaaaaatggtacaaaaggaatctcagaaagtaaatttaccttgggttgaaaaatatcgtccaagtacacttgatgatttagtgtctcatgaggatattataaaaacagtcagtaaatttattcgagatgatcaggtaccccacttgctcttctatggacctcccggtacaggaaaaacaagtacagttttggcatgtgcaagacaattgtatactcccgcccagtttccatcaatggtcttagagttgaatgcttcagatgaccgaggaataggcattgtcagaggccatattctgacatttgccagtacaggaacaattttcaagtctggcttcaagcttattattttggatg

SEQ ID NO: 1781 - DNA, 1026 bp, Diabrotica virgifera
gtctggtgatttttagttttttgacctggcaaccttgcgccctgtgcctttacacttacagaacaaaaacagtcttacatcgttctcaaaaatatttattttaatgaatggttttcttgattgatattgacaatatatcatggatttcaatttggctgtatttcaagaaccccgaggggtaatgagaattgtgcagttcattttctcaatctgtggatttgctacaataactggttatacaggatatattaatgttgtttgcggaacactcactaagcacacattcgtttacccatttgaagtgattatccaaaatatttcatcaaaatgcagtatagatattgtgggagacttttcatcagatgccaaattttttgttactaccggggtgttgtctatgttatattcactagctattatggttgtatatacgaaactggataaaatgtataagagcaatcccaagatcccgttaattgattttgtcatcactgttattatggcagttttatggctgtctagtagtgcagcttgggctaatggattaactggtctgaaaactgatacaacattggactcatcaaaatgtcaaaattgcacaataacgacaagtagttacaccacacttaacatatctgtgatcttcggatttttaaattttttcttatgggcatcagatttatggttcctttataaggagacatcttggttccaaggaaatcaaagacagactggtgatggagtgtaaaaaatgtgcactgtgtacaatttgttcaagttgaactagtcattctacacaacattgttgatgctaaatttcaaattattttactctcatttgtacaaaccagtatttttgaatgtttttatattaatattttgtatttacagctacaagggtgtcagttaacatataaaaacatgtacaacaaaacattttcgatgcacactgaaatggaaatgaaataaaattctgtatgtttataattacatatattattatattaagtaaattatatattttcc

SEQ ID NO: 1782 - DNA, 1318 bp, Diabrotica virgifera
aatttgtcgtgtctggtcgttcatttgaaaacatggccaatctctttaacgttattgttgctcaagcgtccgaaaatttaacagaaaatgccaaaaatgctactcaaaagactcctagtacaccagaaggaacggccgttgcatatattagtttagttgtaatggccttacttccaatattctttggttcttttagatctgtgtcctaccataaggataataaagtagaaaaaatgaccaaaagagatgcagcagtatttccaattgtagcttcatgttccctttttggactctacatagtatttaaattattttcaaaagaatatataaatcttttgttaacaggatatttctttttcttgggtgtcttagctctaactcatttattaagccctgttgtaagtaaattagtgccagcagcaataccaaacattccatttcatataatgtttacacaaggagagggtgacaatacggagtacttaatagactataggttttccacatacgacattgtagcattgatagcatgttcattagtaggagcctggtacttggtccagaagcattgggtggctaataatttgtttggactggcgtttgcaattcatggcgttgaactgctgcatctcaataatgttgctactggttgtattctactcggaggactgtttgtctatgatatattttgggtatttggtacagacgttatggttactgtcgccaagagctttgaggctccaattaaacttgtctttccacaagatctactccaaaacggatttgcggctaacaattttgccatgttaggtttaggagatattatcattcctggtatattcatagctttattattgagatttgataacagtttgaaacgccaaactagaacgtatttcaatgcctccgttatcgcatattttcttggactgacagcgacgatgttagttatgcatgtattcaaacatgcacaaccagctttactgtacttagttccagcatgtataggaacccctcttggattagctttaattaaaggagatttgactgctatgtttaaatatgaggacgccccagaagagaaaaaagcaggagaaaagaaaaaaggaacagaaaataaacaagaagtgaaaaaagtaaaatagttctacaaattgatgttacaatcaatgtgttaccagacacattcttccatattttttataattgtttctctgcacattaaaaatttgtttaaaacatctttgatctagtgcaatttacgttgtttttaaattattttatgttttctattaaaatgtttagaaacctatttatc

SEQ ID NO: 1783 - DNA, 2494 bp, Diabrotica virgifera
tagactgacaagatgaaccaatttacagttcactttaagaaattacaatgaaagcactatttttattgttttttattgtaaattatgcgaattgctgtggtagaacaccaagtatatatcaatctaggaagataaaaacacctggtgataatggatatgaaattaagattaatgaaaaccctcaaaaatatgttccaggaaatatttacacaatgtatctaatggctccaacttacccgaatacaaatcgcctaaggaagtttacgagatttacaataaatatcgaatctacgagtaaccgaacggacgccccccaaaatgtaggtagctttcagctatatggagataaagttgcaagtttcaatgaagaatgtattaatacaatatcagaagtaaatacttccccgaaaagtgaagtattctttatgtggtctgctcctcctccaggttcaggatgtgtcacattcagagccatggtattggaaaattctgatgtttggttttcagaagatggaaacttaactaaaaccatttgtgaacaaaaagatgaagatttaccatcagatgatgaatgttgtgcatgtgacgaggctaaatataagcttgtgttcgaaggaatttggtccagtaaaactcaccctaaagattatccaactttactatggctaactcacttctcagatgtaatcggagcatcccacgagaaaaacttcagtttttggggagagggacaaatagcgtcagaaggatttagaagtttagctgaatggggctcagttagactcatggaaacagaactaagagctaaaagtaaatacctgagaacaattatcaaggcttctggactgtggtatccaaacgttaattctaatacgtcaacaacttttagagtcgatagacgtcatcatttgatttctgtagcttctatgtttggaccatctccggactgggtggtagggattaatgggttaaacttgtgtttaaagaactgtacgtggactgaaaaattggctatagatttatatccctacgatgcaggaactgatggaggcataagttatatgtctcctaatgctgaaacgaaccctagagaaagaatgtacagaattactacaacttatcctgaagatcccagagcgccattttatgaccccagtagaaaggaaatgccagcattggctagattgtttttaacaagggaaaaactaataccaaaaaattgtgacgacaatttcctctcttcgcaacttgatattagtgaaaatactgaagaatctacaagacctgaatgtgctgttagtgaatactctcaatggagtgattgttccgtaacttgtggaaaaggactcagaatgagaactaggcaatatctgtttccacaaaaggctagtgtaaataattgtaaccggcagttgatatcaaaagaaatgtgtgttgcggctgtacctgaatgcgatggagacgcagaaaaagattcacaagaaatagattctcttgacaacaacggtgtttgtgcgacaaccgaatggagctcctggtcgtcatgttctgaaatttgtggccctgggcaaaagatgaggacccgaaaattcttgaatagaagtggactaaaaaaatgctcccacattttaaccatggaaaaagaacagtgtataaaccgccagtgcaaacccgatgaaattgactcagatgatccttcgtgtccaacaacagcatggagtgattggagtccatgcagtgcatcttgtggaaaagggattaaaatgcgcacaagacttttgttggtagatccttcgaggcagcaagaatgtagtagtcgcgtcgaattgatccagcaattaccatgtgaggatattcccaattgcatcattgagatgaacactgccaaagttgtatgcatgcaggatggagatcctggaccatgccaaggatatttcaaccgatggtggtttgatgctaccaaacttaaatgcttcccgtttgtttatggaggatgcagaggaaacagaaataactttttgacacaggatcaatgtatggatacttgcaaaattgttaaagatgctataaccggaactctagactccactactttattgagacaaaatactcgtttggagccaactgactgcattttatcccaatggtcagattggagtccgtgtagcgccagttgtggcagagggtacagagagaggtttagggtggtgaaacaccagctaccaatggtggtgcttgtccaaatggtctcttccaaagaggatgtttcaagctactagcaaaaaaaaatattatgcagttacacatgagtagaatgcatgacatggtgatgggtcgaaatttgcccacctgtatgaatgcctacatactccctgttgatgccttttccgctcttattgtgaaatcgagcttaatatgccgacacattctcttgcgtggattttccagttatacctttagttactggactagtcttggctccccagtataattt

SEQ ID NO: 1784 - DNA, 1154 bp, Diabrotica virgifera
accacgcgtcagcccacgcgtccgttgtatagttggttttggcaaagcatagactgacaaaatgaacaaatttctagttaacttcggtttatttgttcttgctgcaagctgtgtagtttgcgctccaaacgatggtggaagaactaaaggagtgatcgaggaagcagatattcaaatcggtgaattggtcaaaccatacattggcgaacgtagagtggtatcgaaagcactgcaaaagtatcttaaagaatccgattatcaagtaataaaagaccttactcgtgaattcgacagacacaaggacaaatgcgcagatattgaaaagaaaatgaatgctaccatcgaggacctcgccaactgcattgaagatattaccattggatcaagtaccgtgtgcgctactgcccaacgtacaattgaaaaatgcgccaagccagtcattgaattagttagcggttgtttgccagaagaatccaaagaacttcccgccttagctgagggaattgttcttgctgttttgaaacaagcttgtgcttctacagtagaagaagtattagaattatttaatccatgccaatggaaagctttcggaagcattgaaaaagtagattcctgcaaagccgtcgccactgaagttgacagttgggataacaaaaaacccgttcccacaactgaaaatatttgcacagttttgcccaaactcaagaaatgttcctctgacttccacggacagtactgcaagagcccagtcacccttagctctttcgccaaattccacaaagccgttgaaaccgaaactgaaaaaatttgccacaatcctgtcaaaaacgaagtcgcttaatttatgaatgttactttttgttaaataaattttatactcatctttttaaaaaaaaaaaaaaaaaaaaaaaaaaagggggccgcttcaaaagaatccaagtttacaaccccgggcaggggccgccaaatcttttcttaagggggccctaaatttcaattcctgggccggcgtttttcacccgctgggatggggaaaacccggggggtaccccattaaaatccccttgagaacacccccccttttcccgctgggggggaaaaaaaaaaaaaccccccccccgcaccccccctcccccccatttggcgacccccta

SEQ ID NO: 1785 - DNA, 432 bp, Diabrotica virgifera
  misc_feature (402)..(402): n is a, c, g, or t
cgcgtccgcacacgcgtccgcggacgcgtgggtttatctttgtgcagtacttgtagtgtgacataatgttgacgaaggtgacagtattaatagtattagtggcatcaacgcaagctggactcttaggcgctccagctgcatattcaacagtcacttcccacggggtcctaggtggccacgccctagcagccccagcagtttcatacgcatccccagcagtgtcatacgcagcgccagcagtctcatacgcgtctcccgccgtttcctacgcagccgccgctccagctttatcctacgctgcacctgcaatcgccgcaccagcgatagctcatacgtacgctgcgccgacaattgttaaagctgctcccgtgatcaaagctgcaccttctgtggattatgtancgtatcccaaataccaattcaactatggtg

SEQ ID NO: 1786 - DNA, 968 bp, Diabrotica virgifera
ttcgcgtccgcggacgcgtgggttcaaaaccgctgaagtcaggtcaggttcaccgcgggacagaccactttctaatattcgcgacacatacactcgcacaaatgattctgaaaagcgtaattctggtcagcgttttgtgtatatcgggagtgatctcacagctccaggatgtttttgaatggaaagagttgactttcgcgtggcctaacgaagaggctaaaaacgcagctttgacgaacggtgattatgtgccgaaaaataatctgcctctggggctcgcgaggtggaaagacaagttgttcgtcaccgtacctagatggaaaaacggcgtagcagctaacttaaactacatccctctgaacacaacagaaaaatcaccatctttgcacccttatcctgactggaaagcaaaccagattccaaaagaaggagaatcgccagccgaaaaccaaattgtatctgtgtttagacttaaagttgatgaatgtgatcgattatggttgatagagactggattatcggaaattttaggaaatggaaggcaagtcatacctacatcaattgctatctttgatctgaacacggatcagttgatcaggaggtttaatttaccggatactgatattaaaggggcagattctttcttcgctaatatcatcgtagatacaacgaaaagtcaatgtgacaaagctttcgcctatctaccagacttgggaggttatggaatagtcgtatattctttcgctgacaacatctcttatagagttaagcacaactatttccactttgatcctcttaaaggaaatttgaacgttggcggagtcaatttccagtggactgatggagtgtttagcattgctctaggaccataaatgaaacaactggctacagaacagcttatttccatgctctagcaagttgcaatgaattttccgtccagcacgggaagttttgaaaaatgaactact

SEQ ID NO: 1787 - DNA, 401 bp, Diabrotica virgifera
  misc_feature (5)..(6): n is a, c, g, or t
  misc_feature (8)..(8): n is a, c, g, or t
  misc_feature (11)..(11): n is a, c, g, or t
  misc_feature (14)..(14): n is a, c, g, or t
  misc_feature (17)..(17): n is a, c, g, or t
aaatnnantcntantanataaaaaaaaaaaaaaaaaaaaaaaaaaaaggggcggccgcccaaaaggttcaagcctaacttacccttcaatgcaacgtcaaaccccttcaaaagtgccaccaaatttcaattcacgggccttcttttaaaaacttcttaacgggaaaaacccgggggttacccaatttaacccccttgcagaaaaaccccctttcacaacctggcttaataccaaaaaggcccgaacctttcgcccttccaaaaatttgcccaccctaaatggcaaatggaaccccccctgtaccggcccattaaccccggcggttttggtggttacccccaccttaaccgcaaaacttgcaaccgcccaaccgccggccccttccgcttccttcccttcct

SEQ ID NO: 1788 - DNA, 2198 bp, Diabrotica virgifera
  misc_feature (2106)..(2106): n is a, c, g, or t
gggaccggacaggaatgcccggccccaccgtcgcgaaaaagttccaattgggacgaatctgtcgttggtgttagttttgtgaaaaaggtgaaaatacaaaaattacgaaaaatggcattgttccgtcgactaacacctacaaaattatcagaaacaccaaaactaaaatctcaagttgcagtcgtcctcagacagctaagtgatagttcaacggacctcaaagctgtactcgcagctaaaataccaaaggaacaagaacgggtcaagaatttccgtaaacaacatggaggttctaaagtcggtgaagttaccgttgacatgatgtatggtggtatgagaggaatcaaagccttagtaacggaaacctcagtgctcgatcccgacgaaggcatcaggttcagaggcctttccattccagaatgccaaaacgttctccccaaagcaccaggcggcagcgaaccactcccagaaggtctcttctggctcttgctcaccggcgacgtacctaccgaagctcaagttaaagcactatccaaagaatgggccgaaagggctgaactgccttcacacgtcgttcaagtcttgaactcactgccgacgtcagtacatcccatgtcacagctttccgcagctattaccgtgatgaacagcgaaagtaaatatgccaaagcttatgccagtggagtacacaagtcaaaatactgggagtacacatatgaagatgccatggacctcatcgcaaaactccccgtagtagcagccaccatctacagaaactcattcagggacggttccggaatcggcgccattgacacatccaaagattggagttataacttcacaactatgttgggatatgatgatcctaaattcatcgaattaatgagattgtacctgaccatccacagcgaccacgaaggtggcaatgtttctgctcacactgtacatttagtaggctcagccctcagcgatccctacctctcattctctgctggtatgaatggattagctggtcctcttcacggattggccaaccaagaggtacttgtctggctccaaaaattgcgtcaacaagtcggtgacagggcgacagaagaccaactcaaagatttcatctggaaaactctcaaatccggacaagtcgttcctggatacggacacgccgtgttgaggaagactgatcctcgttatacttgtcaaagagaattcgcgctcaaacatttacctgacgatccattgttccaattggtctccaacgtatacaaagttgttcctccaattctccttgaacttggaaaagtcaagaacccatggccaaatgtagatgctcactccggtgttctcttacagtattatggacttaaagaaatgaactactacaccgttctcttcggagtatcgagagctcttggtgtaatggcgtcactcatctgggaccgcgctctcggcttgcccatcgaaagaccaaaatccatgtcaacggatggtttgatgaagctccttaaggctaagtaagagactggaagagtcgattcatcgttaacatttacagcggcattgtagtttgaactattacttgagagccatatgtatgagttttaaaaagtgagcacaagaccaaaattatcacaaaacgcagatacatttaaagaagacgtaattctatgaatataagggcatttttgttgtattatttgcattttgtgacaattgttttgtacatattactccaatatgtatttttttaatatttaagaatgttcgtgtatatttttgttactacttgaagggtttattcatttttatacgaattacgaatttatagataatttaggcaaccggtgtctaaattttaactttaattataagtgttctttatttaacaattgttctgtttatgttcgatgaactgttcaagtagctcttagattcttctaggctctcaagtatcagtttccccatttttgttgaacattagtattttatttatttataattgtacaaaggaattaggtgtacattttattctgaggtaatttatttctctctactacttatttctcgtacacattttaaagtaaatattataaaagagactttctttgntaaattatttaaacttttgtaaaatttgtcagatgtatttgaacattatttttgtttttatttttttgcaaagtacaatcacctggtcttgt

SEQ ID NO: 1789 - DNA, 917 bp, Diabrotica virgifera
  misc_feature (910)..(910): n is a, c, g, or t
ggtaggcacgagtgagtggccaacatgaaaattgtaatattgttttgcgccttgagcgttactgtgtccagtgtaattggacaaaaagataatcacttcgctcaaggaagaaacaccattgtacacctgtttgaatggcactgggatgctattgctagtgaatgcgagaacttcttgggacctaaaggatttgctggtgttcaggtatctccaccaaatgaaaattccgtaataggagacagaccatggtgggaaagataccaaccagtaagttaccaactcactacccgatctggagatgaaagtgcatttgctaatatggtacaacgttgtaacaatgtgggagtcagaatatacgtcgatgttgtcttcaaccacatgtcagcgacatctggtggtggtactgctgggggttcatgtgacgttggatctctatcatacccatcagtacctttcggatcaaatgactttcattctaaatgtgatgtcaacaattatcaagatgcgaacaatattaggaattgttggcttagtggattaccagattggaccagagccatgattatgtccgtcaaaaaattgttgaatacctgaaccatttggtagatttgggagtagcaggatttagagtggatgctgccaaacatatgtggccagctgatctagaagctatttatggaagcgttaaggatctgacaggaagcggtttgagtggaagacctttcatatatcaagaagttattgatttaggaggagaggccgtaaagaaaacagaatacaatagctttggaacagtactggaattcaaatacggtaccgaattgggtaacgccttccaaggccacaacgctctccactggttggaaaactggggtccagcatggggattattagcaggtactgatgcagntgccttt

SEQ ID NO: 1790 - DNA, 1047 bp, Diabrotica virgifera
tctcatccggaagtgggtgagtgtacactgtaaagtaaacgattcaagtgaaaaaataatgacttctctaactaaaggaatttttattgttggtgcgaaacgtacaccttttggtacatttgggggcaaattggccaaatctcacatcaccgatctccaagtaattgcttccaaaggtgccttagccgctgctaatgttaaacccgaactagtcgacactgtagtcattggtaacgtcattccgtctgtagcagctgatggtggtttccttgcaagacacgtattgctcaaatcaggtattcctttagaaaaacccgccttttcagtgaataggctatgtggttctggattccagtctcttattaatggattacaagatataaccacgggtgtcgcggaaatagctctaacaggaggtgtagaaaacatgtcagcctccccctatatcgttcgcaacatccggttcggcaacattcctttaggcgttagccccgtactagaagacaacgtcacagtcagcggattggacactatgtgtggcttaaccatggccctaacggccgaaaagcttggagaacagttcaagctgtccagagatgaggtggaacagttttcgtttagttcccaacagcgctggaaagcagctcaagatgctggaaagttcaaagatgaaatcgtacccgttccaattaaggagaaaaaggagatggtcaactttgaagttgatgagcatccaagaccgtggactaccctggatatgttaaaaaaactgcccacaatatttaaaaaggacggattggtcacagctggaacagcttcaggtatcagtgatggtgcaggcgctgttgtagttgcaagtgaagctgcttcatccaagcacaacctcaaaccactagccaggatcgttgctcactcagtggtcggtgtagacccctccattatgggattcggaccagctccagcaatcagaaacattctcaaggccaccggaaaaacgttggacgacattgacttgatagaaatcaatgaagcttttggtgcacaaac

SEQ ID NO: 1791 - DNA, 409 bp, Diabrotica virgifera
agaataaattcactggttataccttgactgagcttattaactgtcataactaaaagatcaggataaagctctatatagcagcagacatattatgaaaatatttatttaccttattcttattaaaagtaaatcattcacttttagctttattttgttattagaaaaatgtcttgtagcaaattcatcttagaaatgactttgttgtattacaaagaaaaactttgagtccaactgtaatgactggtttctaataagaactttttccaaatattgtatatttaggaattaaaaatactattgtaattatttgtttaactcaaataatttattttcaattaactgaaattttagtttgtagacttttaaaagtattgtgtaataataatatatttacgcctaaaaacattat

SEQ ID NO: 1792 - DNA, 1179 bp, Diabrotica virgifera
tgttactcaaatcaacaaggcaattaggttgatagaaagtggtgcagtggtgctgttattacaagaatgtcaaataaaaagattggaattattggaagtggcctcattggccgatcatgggccatgatctttgccgccgctggttacaaggtctctctctacgacatagattcccaacaaattgaagtagcccttgcagatatcaatcaacaattgcaaactttggaaaaagaaaaagtcctccggggaacacttacaggaaaacaacaatttgctcttatttcaggtacaaccagtctcgcagaaactgtaaaagatgctacgattgtgcaagaatgtgttccagaagtgcttgacctaaagagaaaggtttggaaacaagttgacgatatcgcttcaccaaataccattttgtcaagttccacttcgacttttatgccatcactgttcagcgaccaccttaaaaataagaaaaatataatcgtatcccacccagtcaacccgccctactatgttcctgttgtagaagtagtacctgctccatggaccgaccctgaagttgccaagaaaactagagcaatctgggaagaagttggacaaactccagtttccctcaccaaggaagttcccggatttattatcaatagactacagtacgccgtccttaatgaagcctggcatctagtaactgaaggagttttggacgtaaaagacgtcgacaaagtcatgtctgaaggtttgggtatgagatatgcctttttgtgtactttagaaaccactcacttaaacgaacaaggttttgtcaactactgtaagcgatatggtgatactatctacgctgtcagcaaagattttaaaccaacaccgaaattcgagggaccacatgttccttgaaattgcaaagcagctggaagctgatgttccattagaataaactaccggaaaaaagaaaacctgggtgaagatctgggccctcccccaaattggagttaattaaaagatcgaaaaaaaaaaaaactaaaaaaatttttgcctttggttcctaaaaaaaattttttttcaaaaaataattaatttttaaaaaaaaattggtactaaaaaaatttgacaaaaccttgcaccccccaaaaagatttaatttttcaccaacttaattgggcccatggggacccccccagg

SEQ ID NO: 1793 - DNA, 400 bp, Diabrotica virgifera
attattcgccttcagactatatttaagatcaatctactacacgtggccacagttaaaaagtttaaaatttgtgtctctgtttttgttgtaaaaaatgtcaaaaataggagcctaaaaataaactcaaatattatcttaactttctttggggttgcagtttaaggcaaaagtactttcctaaccttaggtgaaccaaagtcattgcgacaaaatgagtgtgtggcaataaaaacattctactactactgatattcatccaaagatccatcctttcttcacttgctgtagtggcactgtgagtcctacagggaattttaagcctacaagtatgtactcttcttctttagcagcatcttagtaggcctccccttgtgttttccatatttgtctgtcttgagct

SEQ ID NO: 1794 - DNA, 1059 bp, Diabrotica virgifera
  misc_feature (1008)..(1008): n is a, c, g, or t
cccacgcgtccgcccacgcgtccgtgctttttgcacgaaaatcacttccggaaaattaagaatgaaacctttgataacgctctggttcttagtccttgtagcagtggcgataaacgccgaggccaaggagaagaaaagcgcagaagccgatgacaagaaacagaagaaacgtggtctcctcagcttaggatacggatatggtggagattttgataatggttaccacttaggacaaggtggatacggtattgacggtggttacacactaggattaggccagctagacttaggacacactacttctattgagaagaccattactttggttaaaggagtaccagtaccatacccagtagagagacacatcccttacccagttaccaaacacgtaccttacccagtaaaggttcttgtaccacaaccatacccagtagagaaaccagtagcctacccagttaaagtacatgttaaagtaccagttccagttcctcaaccctaccccgttgaaaaaattgtccacgtccccgttaaagtacctgtcgacagaccatacccagtcaaagtactcgttcctcaaccttacccagttgaaaaacacatcccagtaccagtcaaagtaccagttcctcaaccctacccagtcgaaaaacctgtcccatacccagtcaaagtaccagtccatgtacctcaaccttacccagttattaagcaagtaccagtacccgttaaagtaccagtcgacagaccataccccgtccacgtaccacagccctacccagtacatgttattaagaacatcccagttccagttgaaaaaccagtaccctacccagtcaaagtacatgtcgacagaccataccccgtaccagtagaaaaaccatacccagtaccagttaaagtaccttatccagcaccatacccagtagaacgaccagtaccagtacccgtcgagagacctgtaccatacgcagtgaaaatcccagtcgacaggcccgtaccttacgctgntgagagacctgtagcagtacctggtgagagaccagtaccatacccagtcaa

SEQ ID NO: 1795 - DNA, 911 bp, Diabrotica virgifera
gagtcaatcaagaacagatgggcaacacttcgacaaatggaacaaaggagctttgaacatttttcctattgaaattatcagagatattttgaggtataaggatagcgatggccaataccttcttcccaaaatccgtgatacagctggtcaaaaaggaacaggaaaatggacagctatatccgcccttaactatggagttccagttactctaatcggtgaatcagtcttcagccgttgcctttcagctctcaagaccgagagacaacacgccagtaccaaacttcaaggacctaatgctaaattctccggaaatgtcgccaaattcctcgatgatcttgaacaagcattgtatgctgccaagatcgtgtcttacactcagggattcatgttgttgagggaagctgcaaaggtacataactgggaactagattacggagcaatcgcccttatgtggagaggtggatgcatcatcagatcagtatttttgggaaagattaaggaagcctttgacaaagacatgaaccttaactccttgttattggacccattctttttagacgctattaccaaagctcaacagggatggaggaatgttctaactactgctgtcactttaggtattccaactccagctttaagtaccgctttggccttctacgacggatacagatctgagcgtcttccagcaaatcttttgcaagctcaaagagactacttcggggcacacacatatgaattattgggtaaagaaggtaaattcgtccacaccaactggacgggccacggtggaaacgtttctgcttccacttacgatgcttaaggtgtattaaaagacggggggttgttgttgaatgttgttatgtatacaatatatatttttaaataaattttttattctaaaaaaaactaaa

SEQ ID NO: 1796 - DNA, 1182 bp, Diabrotica virgifera
  misc_feature (691)..(691): n is a, c, g, or t
  misc_feature (793)..(793): n is a, c, g, or t
aagacgcgagggtggtattaaaattcttcttctttgtgtaccatgtcctttcagagcgttggttaccatcatagctatgtaaattttatttactaccatcctaaatatcttgcttgtatcaataccataccaatttcacaagttcttcaaccatgcagttcttcttcgtcctggactgcgtttgccggtcattttcccttgcataatattttgtagcaacctatatttgggaccttttactacatgtccgaaatactctagctttcttttgtaaggacataatataggatatatttaactatattgagaagaataattttttttcttaaaatctcactttcctatttcatgaattattatttaaaagggttctttttcacgatttaagccactttgtatcaaggtaattaaaaataagctttccaaaacacctttcaagctggtaacatgttcccactgtataagtttttatggaatcggtgaacaaacaattggcagcaagatataatacttaaaaacaactgtacaaggatctattgacaacataatcgtattttacatttaattttgtcatctcgaactgttatttttctctctacaatccgtttttactcgaatataaaatgttttatgtacaaaaaactgtgatcgttacgaagaaaattgcataccagggtatatcgctgaatgngagagttttacaatgtttctgttacgttttttcttgaacacagaattatctttgaattcttctatattttgtgtattaataagttttgcagatttacattanaaaattacttactaatggattgcgtcaattgattctaattacttatatttctttctagttacatatttccacaatatcaatgcccacaagccataacatgattaaaaattcccctcgatgaatatcgggggcagggcctatttcggcccaagaaaagggtaggccttttaaaaaaatgtcccaagcggggcaaaaaaatccccctccggcccggggaaattaattggtattacaaaaaaattttaattcccagggaaaaaaaaaaaatttataaaaaaattttatttaaaaaaaaataaatttttccattttgtaaatttttccaaacccccaaaaaaaaaaaaaacataccctttttgtcccaaaaaaaaaaaaaaaaagggggggcc

SEQ ID NO: 1797 - DNA, 892 bp, Diabrotica virgifera
ctaaaattaactcgcttgatcctataataaaatcaaactatgtgttaaagttattctacaaatggccggtactttgtaataatgtgcaatctctaattcagaccagcttgctataaaactgtgaggtttaataaaaagaagtggtttttgatgcaataagaaattaaaacagaatgttttaaattgtataacagtgtcaaaataatcatgatacaattcatgattaatcatgattcgatttacacatttgatgttttaaagagtgcaattccagaatatactgacgagccataaacataaaagacaaagtcatcttcttcataaaatatattatgtcccttcagaacgttggttaccatcatagctatttaattctattcactgctaccctaaataacatgcttgtatcaacagcataccaatctcacaagtttttcaaccatgaagttcttcttcgtcctggactgcgtttgcgtgctattttcccctgcataatattttgtagcaacctatatttgggacctgtcattacatgtccgaaatactccactttttcttcttgatgctttttataatctcagtagtcttgctgagacgttgtagtgttgttgagtttcgaatcttctccacgcaagaattttgtaaaattcttctatagcaccacatttcaaaaaaggcgatttagatcgattttattcacagttcaagactcgacaccataaagtaagatcgagaacacgtagcagcgaagtaggcagatcatcaatgccaattttaggtctctgttacataatactttagacatccttctaaaagccgctcgggtctgctcctatgctggatctagtttcaccgtgactctctgggttaacaatttaactgatattcaagg

SEQ ID NO: 1798 - DNA, 950 bp, Diabrotica virgifera
ccgaaagactacagaaccataaaatatttgctgattctttcgatcgatttgtgattgtctctttcctcttagatcttcctcgtttttatatcacctttttagtgttttatatgagtttatttgtgaaacaatggaaaaaaatgatggtttgttttaatttttgaagtttcgcctgcatctgggcgtcttctcaaattgagtacttcgttcttcggtttctagactatttgtaaaatatttgttgctcaaaaaatattaattctgtattattttaactataagtaatcctataagtcttactggacaatgctctaatgaataaaaaaactgtatatttaatatatgagtgtgactcgtgtgcgtgtgctgaattgttttctaattcttaagtctgatagttaattgatgaaaaagtgttatttaataattaagtaaatgttaaacggcataacttgtccctccttttgacttctttatccatattctttttgatatattcctctaccactacataaatttttgagcttgatgaatttgtatgtatttcaccaatgcaagcaaactttagtagagctggctgtagacgatgtttaactcttcgtcattcaagtatttctgggttttacctccaatcaaaaacttaacagttaatcagggaatatagctgggtaaaaaaatatataagaattttgaagcattgtttggtaccgaaatttttgtgaatacgcatatgaatctagcaataaagtgagaacagacatgtacctactatacaaataaatgaatataaagtcttattgtatcgtctcataatagaaagtaaacaatagcaaaggaaagaatttggatgggaaaagtcttaagaaaatttatatgtatgtgtatcacagatagacaggcatgagctaacactaagaccaaatgtatgttatcataagggactgttttat

SEQ ID NO: 1799 - DNA, 767 bp, Diabrotica virgifera
acccacgcgtccgcccacgcgtccggtgaggtgagggtgcaagctagaaggagtcttttttattaaattaaataattagtggaaaaagatttaataacaacccgtcaaaatgtccaaattagtagcctcaattccagtattggccggaagacttgtacaagaaggacgaccaaagtttaataccttcatgaaatatgcacgagtagaattatcacctcccacaccagcagacattccgcaaatcagagctggcattggccgacttatcacatcagcaagaactggtgcctggaaaaatcaatctgtaaaagaggcttggttgaatacccttgtcggtatcgaagttttatgttggttctatgttggagaatgcattggaaaacgtcacattgttggatatgatgtttaaatcatatttaggtttatttaactttttgtagaatattctttgttcaatagataactaattaatgtctctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggggccccttaaaaaaaaaaaattttaaaagggggggggggggggaaaaatttttttttttaggggcccaaaaatttattttcggggggggtttttaaaaaagggggggggg

SEQ ID NO: 1800 - DNA, 1442 bp, Diabrotica virgifera
actagttctagatcgcgagcggccgctcgccggacgcgtgggcgaaaattctggaaggaaaggaaatttcgataccagttacaaatttacaaagcaagtgtttagttcgtgaataagttaaatatatttatcatttaccggtaaaatggaacaggtcgcagttttgaaagataaaggaaatcaagcactttccgcaaataagatagatgaggcacttaaatattacactgaagcaattaacctagatccacagaatgccgtcttatattcgaatagatccgctgcttatgctaaagcgaatcaatatgatctagccctaaaagatgctgaaaaagctgttgaaatcaagccggactggtcgaaggcttattctaggaaaggtgctgctttgtcctatttaggtagacacgatgaagctattactacgtacgagaaaggattggaaatagatccaagcaatgctcagcttaatgaaggactaaatgaggtcagagctcaaaaagctaagaaaagccgctctttcccaaatcccttctctgctcccgatgtaataccaaaactgagagcagatccgaaaacaagagctttcctcgacgatcctgaatatttagcccttttagcacaactacaggccaatccacaatcgatgggtaccaaactacaagaccccagagttttgaccaccctcagtgttctcttgggtgtagatattggatctgaagaacctatggatactgaaccagcgtatacgccacctcctaggaaacctgaaccaaaaccggaacctaagaaggaaccggaacctgacttacccgaaaataaaaggttagcaaaagctgaaaaagaacagggtaacaacttctacaaaaataaagattttgaaaatgctattgtacattacaacaaggctatcgaacatgatcctaccgacattactttttacaacaatttagctgctgtttattttgaacaaaaggagtacgaacaatgcataaaagaatgccaaagagctatagatcttggtagagaaaacagagctgattttaaacttattgccaagtcgttcatgagaattggtaacgcctataaaaaattaaaagactataaaacagcgaagacatattacgaaaagtctatgtctgaacacagaactcctgaaatcaagacgttgttgtcagatgtagaacgtattattaaagatgaggaaaggaaatcgtacatcaatccagaactagctgaaaaggaaaaagaaatggggcaatgatatgttcaaaaagggcgactacgctaccgcagtgaagcattacactgaagctattaagcgtaatccagacgatgcaaaactatacagtaaccgtgctgcatgttatacgaaattagctgccttcgatttaggcttgaaagactgtgataagtgtgtagaactagacccgaaagttatt

SEQ ID NO: 1801 - DNA, 1233 bp, Diabrotica virgifera
ctgtcatctgtcatatttctgtcattttcgatgagaggcgaaaattctggaaggaaaggaaatttcgataccagttacaaagcaagtgtttagttcgtgaataagttaaatatatttatcatttaccggtaaaatggaacaggtcgcagttttgaaagataaaggaaatcaagcactttccgcaaataagatagatgaggcacttaaatattacactgaagcaattaacctagatccacagaatgccgtcttatattcgaatagatctgctgcttatgctaaagcgaatcaatatgatctagccctaaaagatgctgaaaaagctgttgaaatcaagccggactggtcgaaggcttattctaggaaaggtgctgctttgtcctatttaggtagacacgatgaagctattactacgtatgagaaaggattggaaatagatccaagcaatgctcagcttaatgaaggactaaatgaggtcagagctcaaaaagctaagaaaagccgctctttcccaaatcccttctctgctcccgatgtaataccaaaactgagagcagatccgaaaacaagagctttcctcgacgatcctgaatatttagcccttttagcacaactacaggccaatccacaatcgatgggtaccaaactacaagaccccagagttttgaccaccctcagtgttctcttgggtgtagatattggatctgaagaacctatggatactgaaccagcgtatacgccacctcctaggaaacctgaaccaaaaccggaacctaagaaggaaccggaacctgacttacccgaaaataaaaggttagcaaaagctgaaaaagaacagggtaacaacttctacaaaaataaagattttgaaaatgctattgtacattacaacaaggctatcgaacatgatcctaccgacattactttttacaacaatttagctgctgtttatttttttctaaaaaatacaaacataaaaaattgaatgacaaaatgcgaaaaaagcttattaactttgggaagaaaaaaaacggggtttttttttaaatttttgtgcacagtttttttttggaaaaatgggaaaccccaaataaaaaaaaagaaaaaacttaaaaaaaacaaaaaaaaaatttttaaaaaaaaactttttgtcttaaaccacaaaaactctttaaaaaaaaaacgaatgttttttgtaagaattaaaacagcactttttatataaaaagaggg

SEQ ID NO: 1802 - DNA, 1021 bp, Diabrotica virgifera
accgaacaatgatcaggtattatgagagataccgtcacattggaggtacttagcgattattttgtgctaagaatagtcatctctgccacagcgatactagagcctaaaagacagctgctttcagaaagtaaaagggacattgacgacgactgttaataatgaactacaaaattattacaagtacccttaccactgccagaaatatgacactcgtactgaaggaaaattataccttagaacatgcccagacaacttatgctgaaatagagaacttctgatactgcgctcggacgcgtggggtgaattgctcaaagataattccccttccacatccagtgtgcacggattctagaacaacgttctatatttacccttacaactgcaaaaaattttatgagtgttacgaaaatgtgttgtacattcttgaatgtcccgatgacttactctggaataatgatgctaaggtgtgcgatgatagctataacgttgattgttcatacatcatacctgagaatgctgaaacggacgagccaacttcagccccaacttctacttctcctgtaactactgagcgtccaacaactacaaccgttcctccaccaccgactaaaccaccagttcaatgtgagcattcaaggcaatacattcctgacccttacaattgtagcatgtattacgaatgttcaaatggagtaccagtttcgatgagttgtccaggtggagaatattggaacccagatgaagaaacttgtgattggcctttcaatgttgattgcactgaggcacctctccccgcataaaatgccgaatacccgcagaatttaaattaagaaaatgtgtaatttaaaatttattaaatgtaattttatttacccgggggcggggttttaaaccgggggggcggaaaaacccggggaaccccaatttgacccgtggaaaaaacccccctttccccgggggaaaaaaaaaaaaaaaaggccccccccctccccccctccccaacagaccccccccccttgtt

SEQ ID NO: 1803 - DNA, 1331 bp, Diabrotica virgifera
  misc_feature (1310)..(1310): n is a, c, g, or t
gaaatagaaacgctgttcttgcaatttttagaaatttgttaagtattattgttgctgtttggagaaataacgggaaaattctgtgaatagttcgtattaaagaaatgtccatatttggacctttgatgggagatatggaagacgatcctttctttgggtgtcatatgcgacacatgcgtcaaatgagcaacatgatgaattcactattttctgatcccttctcaatgttgagaccaccaatgttgggatatgatgattatgaaaaccgggctctgactagtcgccacaacatgcacaattcactaatgtccccattttctatgccaattatgccaaattttaacagactgctcagtggatccttagactctatggccaatactggaaactaccacagctccaatactggaaactaccacagctccagtacagtgataagcatgacatctggacctgatggtcgtcaacaagtgtacaaagcaacttctagtacaagagtagcacctggaggtgtcaaagaaacccagaagacagttacagactcaatgacaggcactaagaaaatgtccataggccaccatattggtgaaagagctcatattatagaaaaggaacagaatattcatacaggtgaaagagtcgaaagtgaggacttgataaatattgaagatgatgagaaagaagaattcaacaatgagtgggaaagtaaaacacggagatctgaaattcccagaataacagcaggttcatctagaaatcgtcatggttcatacatccattcatccataccagccataacagcaggatcaagtagtcgtcgacatagggacagaaccgtaccagctacgtcgccatctgtgatatcttctcggagaggtatacgttcgccaaagttagcgctgccttcgacgagcgctcctagtgctgctggtaggcacccttatagttcccccaatcaaccacaacaaccgaagaaatcaaaatcattgaaaacttatgaagaagatccttcaccaccccaggctgacaattagatttattcttatcatcgttagattatagtattactaaaatatagatattttactagatacatttcaaactgtaataacgtaaatagttcgtttgaattcaggtctcatttattttttaaatcatcctaaagttactcactgtaattaggggttttcttttaattatattcactgtaccatgtggctgttttcttcggatttactcaagtttggcaagtaaaaatgatttaatgggcttctagaaatgtatatttttaccatatatcatatactcanaattattacacagaaagtaaa

SEQ ID NO: 1804 - DNA, 433 bp, Diabrotica virgifera
agtaaggtctagggggccgagccacgcgtccggagcagttaaaaaagtgtctttatttttataggaaagattaataaaaataccatattcacaaatggaatcggcagatataactgaagaagacttactaaaaaagcacagacaagagaaaaaagacttacaatctaaaatacaggcactaaagaaaacagttcctaaaaggtgataaaacagaaaagaaagaaataactgaggaaatcgcaaaactagaattagaactagacgaaaaacacagaacagaacttggtgaaagtaatatatgctcagaacagctcaatattagtacggaaaatggtgaagatgaaagtgaaatgactgaagatcaaacagtagagaatggaattaatagtacacgtatatctcgagcgcagaaacgacgaaataaaggggaact

SEQ ID NO: 1805 - DNA, 1454 bp, Diabrotica virgifera
gggccgggccacgcgtccggaggaggtatgggtggaggtagagggatgggtatgggtagaggaagaggtggtcccggtggaccaggtagaggtggaccaggaggtccaggaggtccaggtggccgaggaggattcaggggacgaggtggacctggaggaccaggaggacgtggtggtccaatgatgagaggacgtggaggtccaaggggagctccaagaggacgattcccaggaggtggcccaggagaaggtggtattggaggtagaggaggtggccgcggaatgggaggaagaggtggtccaggtggttttaggggacgtggaggcccaggaggtggcaggggaggacctggtggtccaggaggtcgtggaatgggtagaggaggtccaggtggtttcagaggacgtggaggcccaggaggtggcaggggaggaccaggtggtccaggcggaccaggtggaccaggacaaaaaagagcaccaggacagtttggtggtcaaggaggaccaccaggtggaattaagagacctaggtttgaaaatggacagggagctaacggattccaaggtggtcagcaatcatactcaaatcagtatggtggtggtggtggtcagtatggaggatacaatcagtatggaggaggacaaggtggttatgaaagtggtggttactcgacacaatattccaatccatcttccaactatggtagtaggggtggtgattattctggatactcacaacaaggagctgatcaatatggtggtggtggttacaacacaggtgtttttcatctgtacaatagtcaagtgtatgatgatatgagtatatgatatgccgcctaaggtgtgattatgaggattgacccatacaatttcccatgacctaccccgcatcattgttaattttttttttgcaagttggattgctgagttctttgaaaaagcatcttttacttgtgttagtgtgattctattttttactttataagcttaatcatctttaaagctcagattcccttatctgggttaaaaggtttaccaattctttttagttaggcacttttttaactttttttttcaaaatatttggggggttgaaaaataatttttaggtttttttttccctgttttgtattcagaatatttcttgggtccaaaatcttttttgattcgtcataattataatttaaaaaattgtggggttttttactatttttcctttaatactggaaggaacggggatttttttttttttctttgaatttcccaaatataaatttttttttttttttttttttttttgaagaaacttttttttttttcttccaaaaattaaaaatttttttttcttttttttttttttttttttccttaaattaaaggaataatggggggggttattatataagggccaaaattttttttttatttttctttttaataaagggggttat

SEQ ID NO: 1806 - DNA, 1038 bp, Diabrotica virgifera
accacgcgtccgcccacgcgtccgcccacgcgtccgctttcacttcatctttgtaaataaatcaataaatttcatagtacaaaacaaaatattttttaaaggtacattaaacaatgtctgaaaataatcatgatgatatgttatttgaaatgctcaaagactgcagaactctgccgaaattcctagatgacatatttggctttttggcaagaaggaccgacttttataatgtgtccatgatgaatcccggtttgggtttgccaaaaggtctttctgaaaagttagtcagacatacatttttgaaatggaaagctgtcccacgagatgtcatatacacccctaatgaaatacctgtatctacagaagaagtagtcgtgtcttgtagtgaagaatcagaccagcaggtgtcctctacaacaaaagatgaactacttgaagatggggtggaagaatttagtttttcaaagtctgaatattataacggtgctgtcttcgagcattattgctggtcgcagtctataaacgaaattgatgtcattgtgagaatccccaaagatgtcagtacaaaagatttagaggtaaaacttcagtcgagctctatttcagtaaagttaagagatggtgagtatatactgagtggagatctttgtgaaaaatgtaaagcggctgatactgtatggtctctggatggacgaaagttgctgctacatttggataaatgccaagaaaagtggtggaattgtttaataaaaagcgaaccagagctagacatatcaacaattgattgtactagaccatatgacgaactaccggaacatgctcaggtgaaaatagaagagttacagtggaatcatgaaagaaaaaggctaggtttaccaactacggaagaattacaggttcatgagactttaaagaaagtttggaatggtgaagggtcccatttaagggggccattttgctcccaccattgtgaaaaaaaataatttaaaaatttttttattttttcaggcaaaaaaaaaaaaaaacaggcgtgtcccc

SEQ ID NO: 1807 - DNA, 1013 bp, Diabrotica virgifera
gccccttaacggacggaaacttttacacaccatcatgagattcatttgcttagccattgtcacccttgccgtcgtggcccaagcagaaaaggccaaggacaaacgtttggcagtggatcccaacaccggataccatcaaggtgcctctgcgtactcccatcaatcttctcaaccacaatacgtctcagcccaaccacaacagcagcactactaccaacctgaggccgttcaacaacaagccatttcatatactcaacctattagcaagtacgcttctgctggtgcagctccagtacaaaagtacactttcgcaccacaacccgctaaacagcaagtacaatactcctcagcagctgatgtgtccagcttcagttacagcagccctatcgtatcttacaacaacttaggccttttgaaacagattgctggtcaacaagcttcaagccatgacgtccctgtgacttaccaaactgaacaatcagctaaagccgactacagttctcaacccaaagtacagtatataacatcccctaaagttcaatacactcacactccatcagcagttcaatacacctcatctcctaaaatccaatacacttcagctgccaaaacccaatacgctgctgctccatcaagtgcgtactctgccagtgctgcttcagcaaatgcctacacagccagtgctgcacctaactacgaagaaatctaccaacaaattgctcaaaaagctgcctatgctgctgcagaacaacaacctcaagctcctcaacaagccgtttaccaccaagctgccccacagaaactctcttaccaacaagctgcttctcctgtagtctaccaataccaaaaggctgctgctgctcaagcagctacccaagaagaaaactattcttcagctccttcacaaacatacacctaccagctgccacaggagtacgagtctgctgcgcaatcagccacagctttactattctcagtcagcaggttccgctgcgcaagctccacagtattac

SEQ ID NO: 1808 - DNA, 593 bp, Diabrotica virgifera
cttagtattgcccaagtgggcaaaaacaacttgcaggctcagttgatagtcggttctaagccactcagtacagcgatgaccgttcagcagtttcaacaagtaatcaggtcgccgttgaatgttagtcagggaccggtagttttggcaaaaggaccacctactagagttataccggtgaacacgcagggatcaaagcagactatacaggtagtagctgccggatcgtctcaagcattaaacaccgcccttcgaccccaagcgggcacatcgacactggccggcgctttaacaggcatcaaagtacaaggagcttcgggaaccactcaacaagctttattatctcaggtatcagcagctttgaaccagaacgtagctggaatgcgacaaggtagccccgtgcgcatccaaacctccaccggggcgccgttggtggcagttaacgtgcagaatgttcaacagcaagctgcttcttcgtcatcgaatgcggcgccccaagttaccaatccagagcaagaatgatctgtcttctgtgaagatgcaatgtatgttattttattttaaaaaatttatgtaaataaagatgttgtcttgtt

SEQ ID NO: 1809 - DNA, 963 bp, Diabrotica virgifera
gacagaggaaaatcttgagaaaatgccggttagggtggaaataacgcctcccctaccggcaaactccaaacaaccaggtgttaccaaatctttattgtacaatggctcaaaattccaaggattccagaaatcgaaaggcaatagttacgaggtggaagttattttacagcatgtagatgaagaaaactcatatctttgtggatatttacaaatcaatggacttacagatgagtaccccaaactgaccacgttttttgatggtgaaattataagccaaaaatatccttttcttaccagaaagtgggatgcagacgaagatgtggaccgaaaacattggagcaaattctcactattcagtcaatatgccaaaacctttaattcagattcttttgattacaaagcccttgctgatacggactacgtctttatgagatggaaagaacattttttagtcccagaccatacaattaaagatatatcaggagcctcctttgctggattttattatatttgttttcaaaagtcaaaagccacaatcgagggttattattaccatagaagttctgaatggtttcagtctttgaatttaactcatgtgcctgaaaatagtatacaaatatatgaatttaggtaaattggaagcacaagaaaaaccccccaagacgttgggcaaatttcgaaccagtggaaagttcttttttgttgttgttgtataaatttaaacattcggcagatttctaccaaactgatagatatgcccgaacttttacattaacttttacgtactgactacgtactagcttagtacctctagtaatttttctattgtttcacatttttgtgaaacgtttgttgtatggataatatatacctgatattttaagatgagaagtctattatatagatatttgtaagttttaaagacttttgtctttttgattaatagtattgaaagtggagaac

SEQ ID NO: 1810 - DNA, 1093 bp, Diabrotica virgifera
gtaccttagcgcggtcaaaatgtgctgtgggcattcaaattaatcagtgggcgtcaacttaaaggttcgttgaagatggctcccactttgtacctgatcacagccagtcctgctgtaaggtcggtaactctatgtgccaaggctctcaatgtagaacttaacgagaaacaagttaatcttcttgctggagaacacctttcaccagaatttctcaagatcaatcctcaacatactgtacctgtgttggatgatgatggcttcgtaatagtggacagtcatgccatcaatacatatttagtagccaaatacggaaaagatgactctctttatccaaaagaccttaaaaagagggcgattgtcgatcacagacttcactatgattcaagtactttgtttgttagaggagtcgcaatttctagaagtcttctcttcgaaggtgagaaagtaattgcccctaaattactaacagcgctcgaggaagcctataatatcacagaaaaatttttggaaaagaacaactacatcgctggtgaccaactaacagtagctgatttctcttttattacttcgattacctcatggaatgcgtttttcaacttgaaggaagctaaatatcccaaaatagttgcttggatgaagagaatgcaagctctgccttactacaaagaaggaaatcaagttggcttggaccagtattatgcaattatgaaagataaagttccaaagtaaaatacatcttgtttgctgcggatcactgtatattttcttaaaagatcgaatttttatttttaaatatattattttgacaaaaaaaaaaaaaaaaaaaaaaaaaaaaaaaaaaaaaaaaggggcggccggccgcgaatctaaaatccttttttaatggcggaccctcgttcccttgatgggggggggaactactggaaataattaataaaaaaaaaaaaaaaggtcgttatccccccccctcccccctttattgggccgaatacaattaaaaattccgagggaataaaaagggttcaaaaattttcctttccccaaattttccaggcccccccctaaacccaatgaagcaattttttttccccaa

SEQ ID NO: 1811 - DNA, 236 bp, Diabrotica virgifera
aaccgaaaatgggtcgaaatacgcgtccatgtttgatctgattaaaatacactgagcggcacatcattgtattttctactgacgtttataatgtctcacttaaaaattatatacgattttgtttactttggagtctatcacagtttttgaagagatagtattgaattgtgtgttttattatgaaaaataaaaggaaaactatgaaaaaaaataaaagtaaaaaaattgtcagacat

SEQ ID NO: 1812 - DNA, 924 bp, Diabrotica virgifera
tctcaagctgaatttaaaatgatttataaatattttcttgttttctttgcagtttacgtaatggcgaacgcaattgctttaaatgatcaagaacagtttgctgagtttaaacaaaagttccagaaagcttacgaatcttcagacgaggaaaacaataggtttaagatattccaagacaatttgcgaaaaatagaagagcacaataaaaaatatgaaaagggtgaaactacatataccatgggtgtaaatcaattttctgatttgtctcctgaagaatgggctaatagaaaccatggatataggccaagaccaaatcatcaataatacaaaatgttattaaaaatgaaaaaaaattctcttatttgaaattaaatcttctgttcctactttaaaccaaaaaccaattttattattgatgtactccaaatacttttaataaaatagtatacatataaaaaaaaaaaaaaagaaaaaaaaaaaaaaaaaaaaaaaaaaaaaaaaaaaaaaaaaaaaaaaaaaaaaaaaaaaaaagaaaaaaaaaaaaaaaaaaaaaaaaaaaggaaaaaaagaaaagaggggggcccccctaaaagaacccaatttttatcaccgggggttggggaccaaaaattttttaaaaagggccccaaaattaatttcccggggcccgtttttaaacacggcggggtgggaaaaacccgggggttcccctaatttttccgtttggaacactccccctttttccccaatgggggtaaaaacaaaaaaagcccccccccccattccccccttccccaaatttttgcaaaccctaaaaaggaaaaagggaaaccccccccttaacgggccaaataaaacgggggggggggggggggttaacccccggggggaaccataatttttgcaaggcccccatcccccccc

SEQ ID NO: 1813 - DNA, 452 bp, Diabrotica virgifera
accacgagtccgcaacaatacagcagtatccatcatgaagtgttttgtactgttcgcttgctgtgttgcatatatttcagcttcggcccttaattttcagcctttccaatcagtatacgtagacccatgtgcgtgcagaaaatgtttagaggaaatatggaacagaacactacagcttaatcaaaatttgaattcagtcaaccgcactctaaacaatttaacagtgatactcgaaaaaaatgtaacaactgaggtgacgtatcaacttgacgaactctgcaaagtggaagaaaacctcgacaacttagtagccacagaaaaaaatatcacagttgttcttcaagcacaaatttgtaacctgacagatgtggtaggtgacttggaaaaatgttgcagagatatggagtgtttgggacagaaggtcgacgaacagacatgcatcttagctaacg

SEQ ID NO: 1814 - DNA, 1349 bp, Diabrotica virgifera
tttttatcataaagtaacaaagcacaaagaacttgctaaatgtttgaaaaaagtaaactgtttacttaattggtgaaagaaaaattattttgaaacattgaaaaactggaaaattataaactgaacacaattaacagaacagatcaatattaaaaccaatcctaacctataaatgccatcggtataaaatttataaattagctattttgaagctgttttccagtaatttaagaatatattttaaatatgattcaagagattgatggttcgttattggaaggtggtgggcaaattctgaggattgccctaactttaagcgccttaaaaaagataccaattcgaataaccaaaattagaggaggcagaagtaagccgggattaatggaacagcatttaaaaggagtggaacttttaagagacatttgttcagccaaagtaaaaggtgcgcaattgggttcaacagaaattgaattttggccccaagaaatcaaaggaggctcctacagagcacaagtaaaaaccgccggtagcatcagcctattacttcaagtatctttgccatgcattatctttgcagatacacctacaactcttcttctccgaggaggtaccaacacagaaatggcacctcaaattgattatctaactgaggtatttaggcctattttagaaaaatttggagcaacattcgatctcgatctaaaaagaagagggtattttcctaaaggtggtggggaagttattattaatgtaaaacccgtggaaaaattaaatcctattgaaatgacaacacaaggatctgtaacagacatctttggatggagcttcgttgcaggaaatttgccagaaaggctctctcaccaaatggcagacagtgctgcaaatgagttaaagaaaatagcttcggtcaatattgaaaggtataaagaggatcagaatatagcaccagatagctgttcaggtattatattagttgcaaacacaagcacaaattgtgtcctaggagcatctgcacttggtaaaaggagtgaaagtcttcaggaaaccggaagaagggctgctgaagagttgcagcgatccattaaagcaggtgcttgtgtggatgaatatagccaagatcaagtaattatattcatggcgttggcgaaaggaccgtccaaagtaagagttggagatataacgatgcacacgaagactgctatttatgttatagagaaactaacaacagtaaaatatgagataacgccttctgaagcacaaatataattgagtgtagtggcagttaaacttgaaatttatttttaatttacttatttatgtatgtctttttaattaaattatatatctac

SEQ ID NO: 1815 - DNA, 273 bp, Diabrotica virgifera
cccacgcgtccgttacgattcaaccaaaactgttacatttgacatgcagcaatgccttttcattccactcgtgcatagttctgtaaccttctacaaacgccaactttggactttcaatttaacagtctacaactggagtcatgccacaatttactgtccttttgttatatataaatttatttctgaagctataaaacctgttgtaaaaagtttgaccatgtactcagatacatgcggtgatcaaaacaagaatactcatgtagctgctatgcc

SEQ ID NO: 1816 - DNA, 442 bp, Diabrotica virgifera
cccacgcgtccgcccacgcgtccgcaatatttatgttatggaaatttcctaatataatatatgcttttacaacacatcaacaagtcatgagcttcattacatcgggtgctgatcttatgctagcaggcgttgtaaccccacatcccagtactaatttgccgaaatatggaaatgttctagagaatgaagtagtttatgtaaatttatctaacaatagggcagctgtagcagttggtgtggcaagtcaaagttctggagccatgaatttagcaaattgtagaggaaaatgtgtaaatatatatcatttttatggcgaccatctttgtactgttgaaggtttgcctaatttaccaatagcaacacttggttctcctacatggcttcggatggatagttatgataatgatttcccagctctgggcggcccaacaaaaacccattc

SEQ ID NO: 1817 - DNA, 1083 bp, Diabrotica virgifera
actagttctagatcttgacacttttagccgggtataccagtttttttatagaccttaacttattattaaaactcgttctatttcaaaacttaacacgttgcgttatcgtcagtgattagaatttcattccaatatggctcaaaagttcaacgaaattaaacagcagttagatgttgctttgcgcgataattctaagccttggaccccccttctagcagcagcagaacaaaaaacaggcctagatagggtttatctagctttaggcgctgctgcgtttttgggcatttggctggtgtttggatattttgctcaactaatctgcaactcgttaggtttcctgtatccggcttacgtttcgataaaagcgatcgaatcgaaagaaaaggatgatgatacgaaatggttgacttattgggttgttttctccttgttttccgtcacagaatacttcgtagatgttatcgttaggtggttccccctctattggcttataaagtgcatttttatggtatggcttatgcttcctggagatatgaatggttcagtaatcctctaccgtagagtaatcaagccttacttcttaaaacaccagggtgaaatcgacggagttgttaacaaagtgaagaatacagttaaagacactgttaacaaagtgtcggaaaaagcagagtgaaaatagccaacatcgaaaggtctgaacttttttccattgatggaatgttttatttatataaactggatattatccatattctaagatatttatataagccaagtactttattggtattgttgtgattatatataatctcatatgaatggtattaatttttaaatatatcccaattattgaaggcttcattttttaagagtttttgtaaaattgttcaatatttgcttaagcacttgtttaaactacttgaaattttaaagggtactttttaaagatataaactattttgagactttttgggaacctatttaatacaattgttctgggcccccaaaaaataaacaaaattgtgttaacaaaaaaaaagaaaaaaaagaggggggcgcggcctctaaaagaatccaaaggtt

SEQ ID NO: 1818 - DNA, 419 bp, Diabrotica virgifera
gggcgtttttgctcttttgatgattaattagctttattgaataagattttttttctgtttgataaaatgatttccgaaaattaccttaaacgggtaaatattaccgcagatgtgtatgctatatgtgttcaacatgctttaacaactgaaaaacaagaaattatgggtctacttattggagaggtaaatgaaagtgaacgtgtttccaatatttcagcttgtgttattttacatagaagtgataaacagccagacagagtggaaatatcaccagaacagctttgtcatgcttcaatgcatgcagatcagttagctaaaaaacttaatagaccgatgagggtacttggatggtatcattcccacccacatattactgtttggccaagtcatgttgatataagaactcaagctacatatca

SEQ ID NO: 1819 - DNA, 696 bp, Diabrotica virgifera
ccatcttaaaaaatagattaaaatcagctgctgatgctaatgtgaagttgagtttgacaaatatttaatttaatcaaatttaatttaaaaaggcattcaaataaactccttatttgtaaacatgccagaagacgcagctccacgaaatattcttgaaaaattcattttttctgtagcgaacacattagaagccccaactatatgggtgagagaaaagatcgtagaacccaatcaaaaacaatctgcctggtaccatcaaaagtttcgaagagtacctaccattgatgagtgctacactgatgatatcgtttgtatttcagaagcaaatatccaatttaaaagagacaagcttgttgatagtgaaatactaagcattatgagggaacgatttgaagaatgtacactgtatgaagctcctgatcatatagaaagatgtaaacctcttttggaacaataccaagaggcttccactaactggttcattaaatatggtgacttgggagcttatggcaatgctcatgatgcctatatgaaacaaaagcataggttgatttgggaacgcagacatggtccagtgggaggtggaatgaaaagtgctactccaacagaagagtaataaacacctgtgctaaatcataatagtatagggcaccaatttgtaatatattgtagttaatgttaaaattttcaatgttg

SEQ ID NO: 1820 - DNA, 1038 bp, Diabrotica virgifera
  misc_feature (1005)..(1006): n is a, c, g, or t
agaaagtacgtgacattttcactttattttccatacagtttaaacaatattgtattcttgtagttattgcctggaaataatcactttttaagattagcaatgccagcagctgacgaaataaagtccagctgggctgacgaggtagagttagaaggaggtgccttaccaccacccagtgaagtcttcgaaaatggtttcaagattgtaactgaatataaatacaatgaagacgacaagaaagttaagattgtcaggacgtacaaaattgagaaacgtgttgtgtccaagtcaattgctctccgtaaaacatggaaaaagtttggtgatgttgccaatgataaacctggcccgaatcccgcgactaccatagtagctgaagacgtttatatgcagtacatcactagtaaggaagaagataataagcaggatgatgactctttggacaaactgaaaggaatgggtgataagaaattctttaaatgtcgtacatgtaatggtgaacattggactacaaaatgtccatggaaggacactatgtttgttggtggaaagccaccagatgataagaaaatatcagctgttggaggtgcagctgttggtgaagctggtaaacaaggatccaaatatgtaccacctaatttgagagatggaggtgtgaagagaactgatggatctggtgtagctaaacgagatgatagttcctgtgctatcagaattgccaatttgagtgaatccacaactgaaactgatttggaagatctggttaaacaatttggaccaattcaaaaactgtatttggcgaaagacaagataactggtggatgtaaaggatttgcttatatacatttcaaatttcgttctgatgcagctaaggcaatcgcaatgcttcatggacatggttatgatcatcttattcttaatgttgattggtccaagccatcaccaaattctaaccaataattgtatcaccagatttttgaataataaaaataatttctaaatttnnctgccaaacattgcatttggttgtctttttta

SEQ ID NO: 1821 - DNA, 1207 bp, Diabrotica virgifera
  misc_feature (63)..(63): n is a, c, g, or t
gagaaatgagagaaaatagtagagatcctagagtggttagagatacaagggagagagattcanaagatgtcaaagatattagagatcctagactgaatagagagggatcagttaacagagaaaatactgttacaaaacaaaccttggatgcagctgaaaagattaatagggatccaagactaaatagaggaagatcatcaagtcgtgaagattccaaatttgatcgactgtattcaagaacaaataggaatcgatcacgttcaagatcgagatcatcaactagaacggaagtgattgaaggtgacacattttcatctccattagatagtttgtataacagtagagaagaacagaaatctggtaaaggatatggagttcagagttttagaatacctaaaaagaaaaaagatgaaaaagaaaaggctaaggaaccagaggtcgaaacgagtaaagagactattagtcaagatgaagaagggcatgattattcaaataaaactattgatataagtgataatgaagaagatagtaaaacttcagtaaactgtgtagataacaaagaatctgttcccgtatcgactttaattgaaactaaaattaaatcagatcctaataagaacttaaataaagaggagatacacaacagttcggtgtgtatcgataacgatgtattagaagtaacctcaaccacaatggatatttcttctccagtatataaagaagaggaatctcagccttcggttagtgaagagcaaactaaaagtgatgtcactgatgacaaaaaagctgaaaatatttctaactctcaagatagtaaaacttcgacaaaaatcgaagaacccgttaaacctcccgtcactgaacagacaatactagcacaattttttgctaatctcctaggaagccaaaataagaaagaaaagaagactgccttatattctctaattagtactttctccgacagtttttagtccaaaggaattgggcaaaataactaaaatttattcatgccaaagaagagaatcaagacagttctgatgaagaactttccccaaaagccaagggtatctaatacccgaggaggggaatttcccaaaaaagaaacaggtggaaaaaaaaataagggaaacacaaagaagaaaaaatggcagaaggctccccgccaaatgaaaaaagattttttccccaaacggtaaatttaagggcg

SEQ ID NO: 1822 - DNA, 417 bp, Diabrotica virgifera
agaggatcatttgtaaaataagattccctacgtcgcatactttctcagcagcgttaagaatcttatttcaggaatgaccctagtaccataaacaagacgaagagagtatactaatctcattcagtattgtccattgtcacactcggtcagtacttcagatctgatggtaaaataagcagcagttatcatgcattttgtactacggtcattatttacattattccattgtttgaatgaagaactgtacgagattgaatataatcctggaacatcattccattttttacataacgttagtacataagttgtttatcaattaagcatgtaacaatgtttctaagccaggatagttttgagtactatctcgtgtgtgatcgaaattgttcctcctagtataaaattttaacttccaagaat

SEQ ID NO: 1823 - DNA, 941 bp, Diabrotica virgifera
  misc_feature (794)..(794): n is a, c, g, or t
  misc_feature (817)..(817): n is a, c, g, or t
  misc_feature (822)..(822): n is a, c, g, or t
accacgccatttgaacggtgcgtccggcacaaggcttttgaagttctgcactcggcgcgagtgattgtggtgattgtttttggttttagtgtgttttcgaaaaggatttagataacaatggtcaaaggaaaagtaatacaacttaccgacaacatgtcgaccaaagacagagtaacaatatgcgccgcagaaattggaggaacagccatgctcgtttttttgggttgcatgggctgtgttagctccttggcttccggaggtgtaattccccacgaacaaatttcctttactttcggattagctgtaatggtagcagtccagacttttggacacgtttcaggatcacacattaacccaatagtgactgtcgcagcggcaactttgggagatatagctttaattcaggttccagtttactttgtcggacaaatgattggaggattgttaggatatgctcttcttttggttgcaacccctgatgtttacatgggcaacgtatacaacaacagcactggtgccaaaattggaacaggagtatgctcgccagccattaatcccttaataagcgcccctcaagctctcttcgtagaatttatgttgtgcttaatcctcgtccttttctgctgtggtgtttgggattccagaaatagcacaaagcacgattccgtagctattcgatttggtcttctcattgctgtattggcaatggcaggaggaccgtacactggggctaatatgaacccagcaagaagttttgcacctgcgttgtttaatggcgactggaacatcactgngtctactggctaggtcactgtcngctgnattggtcggagctgttctctaccgtttgatctttcagaagactgaaacttctttctaagaaaccttactttgcccgaatcgtttcccgctcatccaaaagaatgagagttctaattcct

SEQ ID NO: 1824 - DNA, 1491 bp, Diabrotica virgifera
  misc_feature (1430)..(1430): n is a, c, g, or t
  misc_feature (1446)..(1446): n is a, c, g, or t
gcagccgccgggactcacgttggataaagactaaagactgaccagtagcaatggctgccggtttcaagatatttttgcttgtgctcttctcgtacgtctgttatacacaggcgaatcctaaggtggtttgctactatgacgaaaaaggcaactcccggcaagggcaaggcaagttcgatgttgcctttttggaaccagctttacaattctgcacacacttaatttatgggtacgcaggtattgacccaaatacttacaaaataaagctaatgaatgaacagctagaccttaaccaacacaacttcagacaagttactgatcttaagaggaaattccctggtcttagggttttcctttcggttggtggtgacagagatgttagtggagaagatactgaaaagaatatggtttacaggaatgtgttagaagcagtagaccgtagattaactttcatcaactctgccaaagatctaatcaaaaattatggattcgatggaattgatctcgcatgggaaatgccaagaaccaaaccaaagaagatattcggaactgttaagaactttttggtcggaatcaaaaggagaatagttggttcctcagttgtggacgataaagcagatgaacatagagaacagtttactgccttcatcagagaatttaaaaatgctcttcgtcatgatggattctggttgactctttctgttctccctaacgttaacagcacagtttattacgatcctcgtgcattagctccacatttggatttcgttactcttcaaaactttgatttttacactcccgagcgtaaccccaaagaagcagattactcatctccattatacaaaatttttgacaggaaagatgatgaaaacggtgacttccaagttatgtactggctcaacaacggtatgccagccaataaaatcctttacggtatccgtaccttcggtcgcagctggaaaatgactcaagcttctggtttaactggagtaccgccactaactatcgaagaggctcccggtgaagctggtccttacactcaagaaccaggcctacttagctataacgaagtctgcaccaaaattgcaaatccaaccgaaatcaaggcaggctacgtaggaaaacttaggaaagtcaatgatcccacaaagagaatgggaacttatgctttccgtgaaccaaagaacggccaagaaggtatctgggtatccttcgaagaccccgacacagctggccaaatcggtagctacgtcaaagccaaaggaattggaggagtttccattgtagatttatctttggacgatttccgtggtttgtgcaccggagacaaatatccaattttgagagcagctaaatttaggttgtaatagttttgttaggatgatttacacattactgacgagatgttgataaaatatttgtgatcttgntgatattttctattanataaattagtgtctatacaaaaaaaaaaaaaagggcgggcgctct

SEQ ID NO: 1825 - DNA, 414 bp, Diabrotica virgifera
agaaaatatgtaaggacttaaaggcttaaaagtacaaataattataacaaaatggcatactttcactatcggtgtggtgaaagaattacattaataaacgaaaattgtactgccattcgaaatgaaagtgaatttgatcatggcttggtcatttctgcagaacccctacaaaatgatgttctttttgaaataaaaattgataaaaaggtcaatacatggtctggaagtttagaaataggtgtagttgactgtgatcctttagattttgattttccaccatgtgcatcaaaaatacaatctggttcctggattatgtctggaacaacagtttttaaaaatggtgcctgtctcgtggagggctatggaatggatctagatagacttaaccaagatgatagaattggattaatgaga

SEQ ID NO: 1826 - DNA, 1632 bp, Diabrotica virgifera
taatgttcgagcttacgggcggggttaggtatatagtacctttgatggcagctgctatggccagtaagtgggtgggggacgctttaggtagacagggtatttatgacgcgcacatagcgttgaacggatatccgttcctggattccaaggatgaattccaacatacgtcgctggcggctgatgttatgcaaccgaagcgtaacgaaacattgagtgtgctcactcaagattcgatgacagtcgatgacgtagaaacactacttaaggagactgaacataacggctatccagttgtcgtatcgagagagtctcagtatcttgtgggattcgttgtgaggagagatcttaatttggcaatagccaatgcgaagaggatggtggacggcatatgcggccaatccttggtacttttcacacaaggaaacgccccccaaactctggggccgccgccactaaatctcaagaaaatactcgatatggcgcctatcaccataactgaccagacacccatgggagactgttgtagatatgtttagaaaattaggtttaaggcaaacgctcgtcacacacaacgggcgcttactaggagtaataaccaaaaaagatgtcctcaggcacatcaaacagatggacaacgaggatcctaactcagtcctttttaattaatttttaaattaatatccctttgtatacaatcattttcattcagtatatacgtttatttaagagagtaatcatttatctttatcccatttttattgcaataattatgtattatattcatgtaattatttaacgttgtttataacgttagttgtcttccttagtcacgttcatgtgtttattttgacgcaattaattttgtttgttcagcgaattctcaaagtattttcttctgatccgattttagctaattttttcttgagcttagaaataaaattttattaaaatttaatttttaaataaaaattaggattaaaaattttcatattttaaaatatgttattatttatttttatatattattatttttattttttataaattttttattaaaatataaatttaaattatttatatttagtaatgatgataatattagtattaaaaaattgtatatttagtaaaaatatataggtttaataaaggaattcggcaacatttttttcacctgtttattaaaaacatgtctttttgtattaaatataaagtctcgcctgcccactgattaatttgaatggccgcggtattttgaccgtgctaaggtagcataatcattagtttttttattgaaagctggaatgaagcgttggatgaaaaaaaaactgtctttatttaatttataaagaattttatttttaagttaaaaagcttaactttttttaaaagacgagaagaccctatagagttttataaaattattaataagtttttttagtattaaatttatttatataataaatttatttaattggggggaataaaaaaaaaatttaactttttttatattattatattaataaataaattttttgatcccaatttttttgattataaaaaaaaatttaccctaaggataaccaggcaattttttttggagaggtccaaacgataaaaaaaattgagccctcc

SEQ ID NO: 1827 - DNA, 414 bp, Diabrotica virgifera
aggcctgagtcatgatattttgaggttattttcgttgttaaatgtgtgttaagtaaattaaagcttataaaagtttcgcagttactagtattgagttcctagtgaatgataaatcatgagcatgtcagatcgcaccaaaaaattacttgatctcgctttggacaatgtaaataaacccgatgaagaaataacaactgctccgttttatagactacgacctcgtgcagagtcaagaaaaaatacaacacataatcttcctgaagacaatgaatcattcgtgttctcttccgatgactcgattattgatccagacattaccatgcaagatcttgttggaacttacagctatgaagactacgattttccagaatcaaatcaaagtcaactaatatggagacattctctggaaataaa

SEQ ID NO: 1828 - DNA, 1155 bp, Diabrotica virgifera
ctagttttcttctggtggaggttcaaggtgattttcgacgattaaaacgagacgatgatgtagataatagtatcctagagatttacaataactgtaaatgtgtttattattaccagtgtgatgaaaataatacagtgattaccagtggagtaaatttaatcgaaatacgcatgactgaaaatgaggccaaacaagaaaacagtaatagaaaattatgcaaagggggaaagttcgaaggagagatggtctgctgcaaagttggccccactaacagcagtgctgagagcagaaatcccgtgatagaagatgataattccactccagccgcaatgcaccagtgtggagtccaaagaaccaaaattaacgtcagaataatgacggacgaggatagtgatgaagaggtcaatccactggatggagagttcccatggattacggctgtttacaagataaataaaaagggcagatgggtttttcattccagtggggcgctgatacatcccaaagttattttaacagcaaatcactactttcataggaaaaatgcaaatgacttcaaaataatccttactggtgatgtggaactgagtaaagttggaaataatgtcgataacgaacgaaacgtcgtagaaatagtaaaccatccaaaatattatggaggtgccctttacaatgacggagctctattaatcctagatcgacctttcgaatctacaaaaacggacgcgtgggataccctttgcttaccacctgacaatctcaacatgaattctggtagatgcctcgttgcaggatggggaaaaggatccgaggaagaaggtatcaaagttttaaaaaaagttgaattaccaattgtaccgttccataaatgtgaagaacaactcagaaaaacgaggttgggagctggttttattttgaacgagtcattcatgtgtgcaggtggagagaaaaacaaagatgcctgcaaaggagatggaggaagtcctttgatgtgtttacttcctggacaaacgagatatttccatatgggaatcgtttcttggggtatcgggtgcgggaccgaaaatgttcccggtgtatacgccagtactataaaattgaaaccttggataatggaagaactgaagaaaagaaatttagagttataggtttttg

SEQ ID NO: 1829 - DNA, 1174 bp, Diabrotica virgifera
  misc_feature (1088)..(1088): n is a, c, g, or t
  misc_feature (1109)..(1109): n is a, c, g, or t
atttgttttgacatttccgttttatttaacctaacctatgttttgtgttttattgtgttgtattgttgtatacaaggagttgtatattgaaattgaattgattcttgtttcattgaatatagaggagttgttctgttgcaagttgttctagttttgttgttttaaaatctgcgaaaaactatttatagataatggtgaacttaaacaagaaatggacatgcagtttgctgattacttaattgtgtactcacaacacataggtacaggcattaggcaaatacataccatttagaggatacttcattcaaattggaggactctgcgatattgggcttccttaatagtttaccagacgtagacacttaccagacgtagacactgtctttttcttggtagaaaatgacacctgttccaccctttctgaattttctcaagcctcatatttggatcaacgtgaaatttgttggctttcacagccttaattcgattaatggctgtcattaaaatatcttcactgttgcatttttgacctaatgcaattacttacagtgctgagcagatagtatcttatgtaatttctatctatccctcggtttttgatttgtgcgtaggtgctgaagactccagttcttcccaaatatcactgcttggaacttaattatttagtgtgactcgtgtaatacaaaggtagtgaatgtgctggcaaatatttgattgaattaaagatttgattgaatttaatttaataaaataatcaaggcaagtacatgagtaggaatggtagcatattttacatagtatgtagctgacaagataacatacattaacagtttctctgtaacagtacatatttttgagtttgttttatttttaattatccattttttaaattcatcatttccttccacactttcagtatcaaatttataatttgtggctacaattaatggcagtcaatcaatcagtcctttttcctgaaagccacaaaaatgttgacaaaattaaatcaaaacatatttacattacaacaaaccttttgttatctgaattagtctttccacttgtttatctcgagtgtagtgtatcanattatgcatgcttttatctangtgtttcaccttttttcttctagatatgcatacttaataatactgtgcatactctccaagtacat

SEQ ID NO: 1830 - DNA, 534 bp, Diabrotica virgifera
tatttgatctatttttttatgtattttaagggactttcggccctcactaataatttagtctttcattctgcgtttaaatttttcaaaaatatttattggttttttcaggagcgtgggtttgaaaagaatatacacaatgtccgtggtaatattttccaaatctatgtttgtcatacaacgcactcagtcgaatagaatattgtcagcatattgtcagtaagacagtgacaatcagtgacaattttaaatatttgacatggcatcgggaataaatttaagttgttggttaaataatattgatgcctatacagggtgttcagaggctctgccgacaagcgaagacgggagattttttatatagttttgagatagtttagcccaattcacctagtccgaaggtgcttcctgggggagctagggctctttgaagatggcgtcgtgtggttagtttttcttgaatgactccggaacgcttctatttggaaaaactaaaattggtaccatttcgtctgttgtggatttctagtaccggtc

SEQ ID NO: 1831 - DNA, 1017 bp, Diabrotica virgifera
  misc_feature (927)..(927): n is a, c, g, or t
ggtgaaaagcagaagagtagaatggaacgaccacataagccgaatgacaacaaatagagtagtaaggacggctagagacggttccccaataagaagacgatcagtgggaagaccacgaaaaagatggaatgacaacttactggaggcacattgaaaaacagacagagtaatgtctatacaaaaagaagaagaagaagaagaagcatttttgtttggagaaagcgagatttgaagcaaacttttggagaaagcaagttttgaaacacactcgttaggagaaagcaagttttgaaacaattccctttttttgcatatggaattttacaacttgtgttttttggcgattttaatagaataaaagtaatttgcttgataatggtacaacagatctgatcgattccaatgacgatatagttcttggaagatcatgcctaaaatacgcaatttatccgttttttttttgtttttgcccattcatttttcatcggtgttctttttcttgcctttttatcaggtcctaccacttgaacatccattacgaatagacgaaaaatattactgtaatactacttattttaaaagaaaaaactatacaaatagttagtattcaaagttaatagctaataaaactagtaacaaacactgacgttgcattagacaaatagagtaattaaagctgcgtgggtcagcccactcgctttacacgcctcctattggtcggttagagaaagacgggtttcacgcagaactgtcatatgagaaagacgggttcgattcaaaagtatacttttaacattgaatttatattggataaagctaattttgagtcaaactaggtctggattcgtgtagagttcaacaaacagattcagaaattataaacaactcaatttcggccatggatggagtgttacgttggtgctacgntggtagattgccatgataatcttgcagggttggaatgtcgagttgaaaactgactctaacttataactttattttactgtttacaacatc

SEQ ID NO: 1832 - DNA, 921 bp, Diabrotica virgifera
gcggaatcaagtgtgcgaattaaggtttcgtgacaaacagaccaactttcaatttgctttttttaattttttattaaaaaaagaaaagttgttgtgaaagtgcagacaagacagaatttaggaccgagttcaagttcagtctcagtcactaactcaactcactactcccacgagtgactacccagacttaataaaagttttgattaaatttataaaggggataacaatggagcattatctcgaccccgaagaacaaatacaatgtccttacaacagtgctcatctaatacgtagaaaagtatttaatacgcatctggtaaagtgcagaaaggctaatccagatattaagttggtcccatgtgacttcaatgtcacccattgggtagaagaaccatgcttacagcatcatcacgaaaattgtcctgatcgaaagaaaattgagacaaaattttatgtagatgacaaaactgatcttaacaagtatccagttcgtaatacatatataccttctgatgaaaattgggatgatgaaaatgtcccaacatataatcctcagaaaacttgcctaagcaaggaagtgattagacacctggatgttgcctctgccggcaaaaagaagaattttaggatggaggagcgtcagagaatgtctcaatttactaataatactaacagacccccaaaatccgattttccatcttctcagaaagtggaattaccggaaactcgtcaattttctgatgctataaatgaaaatgaaaatactccaaattcagtggaacagttcttatgaaaaccgcaagggctgttgtaccaaagaagaataaaaattttaagcgataactctatggtgattttgtaaaaaatattttttatagcttcgaataatggtacaatttatgcttgtgtttaatattattg

SEQ ID NO: 1833 - DNA, 1190 bp, Diabrotica virgifera
gggagaagggggggggggaggggcgggggcgggggggtgtttttttgctttttttttcccccacgacgggggggaaaagggggggattgtgtcgcccaaaggggttattaaatttgggggaagcccgcaggggtttttcccccgccccccgccgttttttaaacggggggccccggtaaattgaaatttagggggaccctaatagaaagaattatgaggttgccatgccccgggttagtaaagcttggttccttttagaagcgggccgccctttttttttttttttttgctgcctcttgattgtaaatttagtatagaagtgcagataattcgacggagatgcaaggtagacaacattaataactgggtaaaaaacagaagagtagaacggaatgaccacataagccgaaagacaacaaataggacggcgagagacggttccccaataggaagacgatcagtgggaagaccaagaaaacgatggaatgacaacttactggaggcacattgaaaaacagacagtcatgactacacgaaaagaagaagaagattatgaagtggtttttgggtgagagattgccccgaactttaatctttggtactttggttccatctgacttaacttaacccttattcttcaaaaaggtgcagttacttttgagccaaaatgtttataccaacggtaaattaatattttggagttcttacggaatcaaacttcgacgattttacagttattgaaaaaatagaacttcgtgaaggtgattgaaagggaggatatatataaaaaacctagagggatttttgcttaaatatgtgtttgttattttatgtttacacactaaacatatgtaattcttttaatatatacttttaagacgatggtaggaaaacatttcgtattaaattttatgagatttctaattgagtacattgactaaacaagtattatttctgatttgagatttttttgaattgataattactaatagatattaatttaaccatgtgttaatattactcataaaaactaagtattgtctttttgtttctgtgtactattttagtatttaaattttgcaattaatgttgaatttacgccatttaaatttttaaccatttaaattttaaaatccatgtatggaatattctgttactcatttttaaaataaatatattattgttgcatg

SEQ ID NO: 1834 - DNA, 1540 bp, Diabrotica virgifera
  misc_feature (1474)..(1474): n is a, c, g, or t
  misc_feature (1481)..(1481): n is a, c, g, or t
gacagggtcacatttaaggacgttatccatttgttatactcgagagaggtacctctaggaataattaaatcgatagaaaacatctaccagaacaacacaataaaagtaaaagtggaagatgaactaacttactcaattgaagacggcaatgggataagacaggggaaatccttgagtcctttattgctcaacctgatcatggacgaaataataaaaaatgtaagaactaaaaaaggataccaaattggagaaaaaaacttaaaataatctgctattcaggcgatgcaatactaatctctcaaagtgaaggtgatttacaatgtatgctgcaccaatttaatataaccgccagaaaatttaacatgttaatttcctcaaaaaatacagaatgcatggttctaacagcagatccaataagatgtaatttgtagctagaaggtcagataatagaacaagtgatggagtttatatacctacacatcacactatctagctacggaaggctcgaaacagaagtggaagattaagtgattagagcaaacagaaccgcaggttgcctgaatgacacaatatggagaaataaaaatgtcggaaaagaaataaaaggcagaatttacaaaacagtcatcagaccaataatgacatacgcgggagaaacacgacccgacacagaggaaacaaaaaattgctcgaaacagcggagataaaaacccttcgaataatcgatggtaagactctatgggacaaagctagaagtacagatatacgacggagatgcaaggtggataacattaacaactgggtaagaaacaggagaatagaatggaatgaccacataagccgaatgacaacaaatagggtagtcaggacagcgagagacggttccccaataggaagacgatcagtgggaggaccacgaaaacgatggaacgacaacttactagaggcacattgaaaaacagacagagtcatgtctatacaaaaagaagaagaagaagaagaatttcgctacttacggaattattgtgattgatttctgtacccagatacgtgaaggcattccacacgttcaatagtatagttgtctattgctatattattttcattctctggtgttctgttgatggtcatgtacttattttttttttcgtttattttaagccctcctttttgtgcttcaggatcaatttccttgaacgcttccattaatcgtgtcttgcttctactaataatagtatttatatggccggttacattggtttttctgatgactgcctcaataactaggttgaatagcatggttgaaagtgcgtctccctgtctcacccccatgttgatgtcaaacaggggagacagttctccatctactctaactgtcactttaaccctttaatttagtcacttggcaacctcaaaaataataatttacatacgagttttcaagcatcgaaaatgcgtatttcgcattttttanattttanatcggttataactcgaaaactatcaacttttgagaaaaatggaaaccgaccctttttgt

SEQ ID NO: 1835 - DNA, 1449 bp, Diabrotica virgifera
ctccatattgtgtcagttagaactgcgagctttgtcgaatattcttacttgtcctattaaagttatccaggccgcgggtcctcccacactacagggtgaacaatttaaaggccaagaactgattttgacctaccatagacacttataccgcttaggagaacattataactctactataccaattaccggggacgaagatgtatgaaaatcactgccaatagctttaattaggaaatttaataaaaatatatgacatctacatgtgaaactgattaaaaagcgataatattttaatagggaagtcaatatagaacaaaaatatgcattgtttcgaaaaaattcaaacaggcttatatttttctaaaaccttttgttagtttatatacatcttaaagtaaaaagttctactcacagattttgtcgctaattgtttaaacaataacaattgttttatataaatgattttaaaaatatcgtttaattcatcattttactttgatcaaaaatcgtctgctatgcagacgatgcaatactaatctctcaaagtgaagatgatttacaacgtatgctgcatcaagttaacataaccgccagaaaatttaacatgttaatttccccacaaaagacaaaatgcatggttataacagcagatccaataagatgtaaattggagctggaaggtcagaaaatagaacaagtgataaagtttaaatacctaggcatcacactatctagctacggaaggttcgaaacagaagtggaagatcaagtgaatagagcaaacagagccgcaggttgcctgaatgacacaatgtggagaaataaaaatatcggaaaagaaatgaaaggcagaatttacaaaaacagtcatcagaccaataatgacaaacgcggcagaaacacgacccgacacagagaggacaaaaagattgcttgaaacagcggagatgaaaccccttcgagaaatcgatggtaagactctattggacacagctagaagtacagatatacgatggagatgcaaggtagacaacattaataactgggtaagaaacagaagaatagaatggaatgaccacataagccgaatgacaacaaatagggtagtcaggacagcgacagacggttccccaataggaagatgatcagtgggaacaccacgaaaacgatggaacgacaacttactagaggcacattgaaaaaacagatagagtcatgtctatacaaaaagaagaatagaagagaagaagaagcattaggataaacattttttacacatgtcatatgtcgtggagaaatatattttgaaaattgtgtcttaaaataaatataatccacctgtaacaatagttttactactttaaagtgataattcaagatcttcttttccagccttaagtaatccaactttagacataagcctcccccaattcaatccagtgttttcta

SEQ ID NO: 1836 - DNA, 1610 bp, Diabrotica virgifera
gtacatgaagaactaactggacccaatcttccccctggcaatgaggataagacagggagattctctgagtcctctgttgttcaacctgatcatggacgaaataataaaaaaagtgagaacaaaaaaaggataccaaatgaggagaaaaacaacttaaaataatctgctatggtgacgacgcaatactaatctctcaaagtgaagatgatttacaacgtatgctgcacgaatttaatataaccactagaaaatttaacatgttaatttccccaaaaaaactaaatgcatggtatataacagcacatctaataaggtgaaaattaaatgctggaaggtcaaataatagaacaagtcatggagtttaaatatctagggatcacactatgcagctacggaaagctcgaaacagaagtggaagatcaggcgaataaagcaaacagagccgcaggatgcctgaatgaaacaatatggagaaataaaaacatcggaaaagaagtgaaaggcagaatttacaaaacagtcatcagaccaataatgacatacgcggcagaaacacgacctgatacagcaaggacaaaaagaatgatggaaacagcacaaatgaagacattgcgaaaaatcgatagcaatccgatgtggattagagctaggcgtgcagatagataatagagcaggtaatggagttaaattatctactcatcacatatctagctacgaaaagctcgaaacagaagtggaagatcaagtgaatagagcaaacagagcccacaggtttcccgaatgacaacaaatagagtagtaaggctggctagagacgattcttcaataggaagacattagtgggaagaccaagaaaacgatggaacgacaacttactggaggcacattgaaaaaacaggcagagtcatgtctatacaaaaagaagaagaagaagaagaaaaagacaagaaagtagttttagaaccatggtaaaatattatcgttgtagttcagctcaagctgttatgaattatataagataagtatgtataatgtagaacagctaatactccagatgtttcgtgtggttgatgaaactctcgaagaaaacacgacggaaaatagtacatacatagaatagctagaatgtttgagaattcaaatgttcaaataagtataagagtaacagtagttttaaataactaggatcacattttctaatcgtactattaagaaaatagagaaaaagttatataatagcactagaacagaataatatcaataaaacaaaagcaacgtctaagattgctatactaaattagattaaattataggtactaaaatcactatgaaatctacagtttaaaactttggtaacctatacaatagttaacacaaaaaatttaaaataactattttagtatctaatctacttgtaattgtctaaaactaccagctacgcttcctattccagtttcgtctaccgctggtggttttcttcttctaataatacctctatcactgagaaggttcatctcatcgtagctaagaagacgttttcttttcgattccaattcttgcttccagagctttatcatttcccccccggtcatatcacctccaagttcagc

SEQ ID NO: 1837 - DNA, 2012 bp, Diabrotica virgifera
actagttctagatcgcgggcggcccgccctttttttttttttttcatatttaaatatcttttattttgtattgtcattacttaaaaaacttttatatacacaataattatttaataaataaaatatattgctaaggtgtacaatgctaccagaggatagcgctatttttccttattgtcttattttgagtcacactgagattattcagctctaccttttgtatttatcgcagtgctagatgccgggttttattgtaaaatatcagcaatccgtaatatcaacaataataatataagtaaaatgcgagagttgacttaataatcacttactagtatttgacaaaaaatttaccataaatcataaatcaaacaaatgtgtcaaactgacatatgacaagtgacactcaaaagaatatttcacgtgtaatatgtcacttaaagggtacagggaaaaaagggggcatgtcagaaattttcattttttgttttaataattcattagataggttataatatattctgtactgtaatatacgtaaataacactggttaaaaatggattgtgtcatgagataacactaataataaattacctatacagaagaagaagggctcgaaacagaagtggaagatcaagtgaatagagcaaacagagccacaggttgcctgaatgacacaatatggaaaaataaaaatatcggaaaagaaatgaaaggcagaatttacaaaacagtcatcagaccaataatgacatacgcggcagaaacacgacccgacacagagaggacaaaaagattgttcgaaacagcggagatgaaaacccttcggaaaatcgatggtaagactctatggacagagctagaggtacagaaggtggataacattaataactgggtaagaaacagatgaatagaatggaacgaccacataagccgaatgacaacaaataggatagtcatgacagcgagagatggttccccaataggaagatgatcagtgggaagaccacgaaaacgatggaacgacaacttactagaggcacattgaaaaaacagacagagtcatgtctatacaaaaagaagaagaataaaaatgtactgagatacttaggatatattggtagaagaaaagaagatgttaaaataatgatagtagaaggcattgtagaggaagctctctatcgggattgtcagaccaaataaagaacacgaccagttacttattttcaaaagcaaaataacaagctggttatgatttatggagaaaaccagtaaaattattatacagagaggtagaagaaacacatcgaggaaaatcctgccgtcacaggatagacgtcttgaacaaattctgaggaagctgagagtcacaaggtggagaagagtggctaagcatcgatacacttaaaaggcagatagttggtcaggcccaaagctcctatgagctgtagggaagtagagaaataatacagtaatgagtgctttaggcctacagcatatgttgtgtactgtaaaaaaataaaaaatatagtatgaaataacacgataaggagtttaagaagcaaaagaagatcgtaaggagacgagaagaaaaaacaacaaatagatgcaaagataagtcctttttaaaaaagatagacaatttccagccgaagaatctttgataactgacgtacagggattcctccttcaaaaggaagcgcactttatttttgactttattttttttcaccgggaaacaagggaaaaaattgctaaaactttaaaaaatgggaacaatggaaaacttaaaaaaaaaaattttctctaaagggaaaaaaactaacaaaaaaaaccgaaaacttttttgggggggaggtttttttggcccaatccgggggttttttggaaaaggggcggcgcattcccccccaaatacccccccccctcccccaaaaaaaaaatgtgggggggcggaaaaaaaaaatatactcctctccccccccccccctcgtggtcccccccttcttttttt

SEQ ID NO: 1838 - DNA, 2209 bp, Diabrotica virgifera
  misc_feature (1411)..(1411): n is a, c, g, or t
cctttaaaaaccggtaaaaccaaaaaaaattaaaattttttgtaggtaaataggagttttggcattttttctagtttttctatattatttcccccagttttttgttgggaccacctaatagcattatttttacacccaaattagaaatgttttagccgagtttaaaattgattttagtaaaaaaaatacaattacttgcaaatttcctttaattttagaaccagaaaacatttttacagagaaaattaaacagttttccgccttcaatttccctgtaatgtgtatattatgtacattgagtgattcgcgcttaaaaattgccataattggatccagtacagttagtggatttatggttggtctatagtctttaatttactttagattgtgttactacctcattattagtcagccttttcatttgatctcatatccagaagggaaccattctcgtttttagaacttgtagaaatagtattttatcatcaaatgtgtcacaaattgagtcataagaatgttctatgtctagatattgatttaatgtggtgaccgagattaaactttttgaaaagtcatttgagattatactggtcactgagtgcttgcagattgtgattgtttgttctctcttcttgcaaaactggaccaaatttcctccaagcaagtgaaaatttgcgagacacgcaaaatgaaccgttcatagatcaaattttgactgatcgcttccatttgtacactttgttcgcattattggctgatgtgttacggttttttatgcaaccttcacaaatcatttaaatattacaaaacccccctggttacgcctatgctagttgctataagatagttggttcgttcgcaaaacggttctgttttaggaatgtctgagattgtagaaatgtgctgtcttttcctcgctcatggaagttatggactaagtactttctttttcttcgatattcggtttccacagtgaaaataggtcccttttcatttttcattcagtgattatctttcttccgtagaactttattattttctaatgtacgtaaaataataatacgtaatagtacgtaaaaacagaaactgataatcattggggagaaactgtaaatagagttggatacgaattacttaaacaattccaaaatcctaataattaaatactgtggaatggctcaattttattaagaattgagagtaaaataatatcatcatcatcaatctgtacgcgtccactgctggacataggtctctctcagcgctttccatatgtgtctcttttgtgcggcttgcatccagtaaataatatagtacgtaactaccaaacgtttattgtggatttttctaatagataatactgaaaacctttaaaaaatacagtctggcagaaatgatttttggaaataancaagaaataaatagcattgatattcgtaacaactgcaactaggactttcgagtttctttttaaaccaagccctggtatctgggctaccgagtcatcttcttgtggtgctgtctcctataatggaggttagcgattacactggcaaatctgtctctgtccaatgtggctctaaacaaagatgtttaatcagtctttgattaaacaaagatgtttattcaaaggccggtccagtctttgatgtttctaagccatgaaatctggcgtctgccgggaccccgttttccttcaatcataccctggatgatcagttgcgggaggcggtacttttcgtttctcattatgtgtcccaggtaactaacttttctaactttgatgatcttcagcagctgcctatctgtaccgattcttctcagaacattttcgttggtggtgtgggttgtccaaggtattttcaagattctcctataaaaccagagttcaaaggcttctaacttattcatcagcgttatgttgggcgtccaggcctcagaacatttttgttggtggtgtgggttgtccaaggtattttcaagattctcctataaagccagaggtcaaaggcttctaacttattcatcagcgttatgctaagtgtccagacctccgttccatacaaaaatgacatctaaggctgatattaatgctactgttacaaaataggcttttcattttgataaagccttgtcgggctacctgtattctcgctcttacttcttgtttataatcaagttgattgttgaaccagcagcgatatctgta

SEQ ID NO: 1839 - DNA, 1798 bp, Diabrotica virgifera
ttttgcgtccgaggcggagaaaaacaacttagaggaatctgctattttgacgatgcaatactaatctctcaaagtgaagatgatttacaacgtatgctgcaccaattcaacataatcgccagaaaatttaacatcttaatttcctcacaaaagacaaaatgcatggttataacagcagatccaataagatgtaaattgaagttgtaaggtcagataatagaacaagtgatggagtttaaatacctaggcatcacactatctagctacggaaggctcgaaacagaagtggaagatcaagtgaatagagcaaacagagccgcagggtgcctgaatggcacaatatggacaaataaaatatctgaaaagaaatgaaggtcagaatttacaggacacgtcatcgaaccaataatggtattacctggaagaacacgacccgacacggagaggagaaaaagatttctcgacacgggagactcaagaaccttgaaaaatcgatggaaagactctatgggaattagataaaaaccgtggcagccctccagaacttaaagcagtaatacttagctttaagaataacaccgtagatttcatttaaatgaattgaaatcaaatgtgtacacgtgcaggcattagctttgacaagtgtactagccttggtagtatttttacacctcggctaaagttcttatttcacgtctgaggtttctcgattgatatagggactcatctcttctgttttaggtacaacactatcgtaaattctctattttcactaaaagaaaaatgtatacattccatggtatatttttagtaatgaattgctagttcgtactgcagaagggatacaacagcatcagggacgcagttggggtaatgtagaagtatccgattacctctactctccttaggtggcaacactgcaacagtaacaacattgtttaaaaattccagaaattaaattgtgaatttttaaatgcaaaaaaattcagaaaatcttaaaaaaatcataaaacaaaaaaagtacaagaacgcaaaacatcttaatatatttttgaaacatctacataatttaaactaatttatccattccaattaatatttgtgttcttgacaaaaaaaatgcaacagttccaatcaacattcaaagttctcgctactaatggtaaaaagtaatatctctttcgattttgcattaaatcttaaccatttaagacgttttccaattgctccgatataaaaatgatacacccttcttgatataacgttcataaaagttaatgtttacttccctcgccccattggacctacaataacacagaacaagtttcgttgcctgtcgtagattcattcacgtcacaaatgacacaaacatcagaccacattcgtcaaaatggttgaaatgacataaaatgttgccctacaacttatttttatgttacaatgttgcaatgctacaatgtaggtcaaacagtggaaaatggcattaatagtacacatatatctcgagcgcagaaacgacgaaaaaaaaaaaaaaagggcggccgtcgcgatcttttttccaaaaagcttaaaaaaaataaaaaaggggcccaacattttaaaaaaccaaagccttattaaaacaaagggctttaaaacccatgaaattttaaaaatttcccaaaaattttccctggcaaaaggaaaaagggtttttttttttttaccgtgtaaaaactcttatcagggtggaaaaaattttacggggaaaaaaaacaccaaaaaaataaagctcggtttaaaaaaggggatttttttt

SEQ ID NO: 1840 - DNA, 3019 bp, Diabrotica virgifera
  misc_feature (2979)..(2979): n is a, c, g, or t
ggtgtgagttcgcagtttgtgaattttcttagctgtactttggtcagaaacttaagccaaaaaatgggtttgcccagggtatatttcgacatgactgctgaaaacgagcccgttggaagaatcattatcgagctaagaaacgacgtagttccaaaaacagccgaaaacttccgggccttgtgcaccggcgaaaaaggctttggctacaaaggatccaccttccaccgtgtcattcccaacttcatgtgccaaggaggcgacttcaccaaccacaatggcactggaggaaaatcaatctatggaaacaaattcgcagatgaaaacttcacactaaagcacaccggacctggagtaatgtcgatggccaatgctggtccagacaccaatggatcccagttcttcatcaccaccgtcaaaacttcctggctggacaacaggcacgttgtattcggtgccgtagtcgaaggaatggacgtcgtcaagaagatcgaggctttgggctctcaatctggaaaaacatccaagaaaattgtcgtagcagactgtggtcaattgtaaatttatataattcttttttaaaaatatgttttagaataaaatgtcttacatggttaagaaaattattgtagttggtagttattatacaattcctagctatttgtggcttagtatatgaactgttggaaataataatatagtgatagagcatgcccattctaatgggtgagatgaaatatactaagcagtttcttaaatacaaacgaaatgctctgaagagaatgtcatctgttagaatggttcaaacaccttcacaggaatagttactgaatgaaggtttcatttttttaaacctctgaagtaatacttagctttaagaataacaccgtagatttcattcaaatgaattgaaatcaaatgtgtacacgtgcaggcattagctttgacaagtgtactagccttggtagtatttttacacctcggctaaagttcttatttcacgtctgaggtttctcgattgatatagggactcatctcttctgttttaggtacaacactatcgtaaattctctattttcacttaatagaaaaatgtatacattccatggtatatttttagtaatgaattgctagttcgtactgcagaagggatacaacagcatcagggacgcagttggggtaatgtagaagtatccgattacctctactctccttaggtggcaacactgcaacagtaacaacattgtttaaaaattccagaaattaaattgtgaatttttaaatgcaaaaaaactcagaaaaacttaaaaaaatcataaaacaaaaaaagtacaagaacgcaaaacatcttaatatatttttgaaacatctacataatttaaactaatttatccattccaattaatatttgtgttcttgacaaaaaaaatgcaacagttccaatcaacattcaaagttctcgctactaatggtaaaaagtaatatctcttttgattttgcattaaatcttaaccatttaagacgttttccaattgctccgatataaaaatgatacacccttcttgatataacgttcataaaagttaatgtttacttccctcgccccatttgacctacaataacacagaacaagtttcgttgcctgtcgtagattcattcacgtcacaaatgacacaaacatcagaccacattcgtcaaaatggttgaaatgacataaaatgttgccctacaacttatttttatgttacaatgttgcaatgctacaatgtaggtcaaacagtagaaaatggcattaatagtacacatatatctcgagcgcagaaacgacgaaataaaaaaaactaacgaaagggaaaaactaattttcgagcaagctaagaagaataaagaggggtccagcattgtagaagccaacgctattaaacaagtgcttaaaaccatgaatttgaaacttcacaatattcctgcagatggaaactgtttttatttagctgtaaatcatcagttgtaagttactggaagaccaactaagtctgtaaatgatttaagaaaagttacagcagattttataaaacaaatcaaagatgacttcattccatttatgtgcaatgaattagatgaatctgaagtagttagcgaggaacagtttaaaaattattgtaaacagctttgttgcaacaacaaagttatggggaggtcagttagaactgtgagctttatcgaatattcttacttgccctattaaagttatttaggccgcgggtcctcccacactacagggtgaacaatttaaaggtccggaactgattttaacctactatagacatttaggagaagattataactcctataccaatcactggggacgaagatgtataaaaatcactgccaatagctttaattaggaaatttaataaaaatatatgacaactacacgtgaaactgattaaaaagcgataaaaaaatttagaatttaaaaatattcagtaatcctaatattttgataataataatcctattttgacaacggaatccgatttggatgtcgaaacgttaataaaatcatttttttttagtaaaattgtggcttatttcccattgaaaatagttgattagaaacatgccacaaggaaataacttcagaacaacattaatcctaatagttttgaaattaaacgttgacttaagaaaatttgttgcatatgcggaaaattttcgtctggtcatcaggcggggagttattgtacagtaaaattgtggcttatttaccatttaaaatagtttgattataaaaatgccacaaggaaatagcttcagaacaacattaatcctaatatatagttttgaaattatgtgttactcgagaaaatttgttgcatatgaggtaaatattcgtctggtcatcaggcggggagttatgtaataggattttcaatttatgtacaatgttggtccagtgtgactttaatgtgacccatttanggagcattatctcgatcacaaaagacaaataccatgccct

SEQ ID NO: 1841 - DNA, 3685 bp, Diabrotica virgifera
cccgtcaagccggtttacaaagcgcattcgccggtagaggtgtgagttcgcagtttgtgaattttcttagctgtactttggtcagaaacttaagccaaaaaatgggtttgcccagggtatatttcgacatgactgctgaaaacgagcccgttggaagaatcattatcgagctaagaaacgacgtagttccaaaaacagccgaaaacttccgggccttgtgcaccggcgaaaaaggctttggctacaaaggatccaccttccaccgtgtcattcccaacttcatgtgccaaggaggcgacttcaccaaccacaatggcactggaggaaaatcaatctatggaaacaaattcgcagatgaaaacttcacactaaagcacaccggacctggagtaatgtcgatggccaatgctggtccagacaccaatggatcccagttcttcatcaccaccgtcaaaacttcctggctggacaacaggcacgttgtattcggtgccgtagtcgaaggaatggacgtcgtcaagaagatcgaggctttgggctctcaatctggaaaaacatccaagaaaattgtcgtagcagactgtggtcaattgtaaatttatataattcttttttaaaaatatgttttagaataaaatgtcttacatggttaagaaaattattgtagttggtagttattatacaattcctagctatttgtggcttagtatatgaactgttggaaataataatatagtgatagagcatgcccattctaatgggtgagatgaaatatactaagcaatttcttaaatacaaacgaaatgctctgaagaaaatgtcatctgttagaatggttcaaacaccttcacaggaatagttactgaatgaaggtttcattttttaaacctctgaagtaatacttagctttaagaataacaccgtagatttcatttaaatgaattgaaatcaaatgtgtacacgtgcaggcattagctttgacaagtgtactagccttggtagtatttttacacctcggctaaagttcttatttcacgtctgaggtttctcgattgatatagggactcatctcttctgttttaggtacaacactatcgtaaattctctattttcactaaaagaaaaatgtatacattccatggtatatttttagtaatgaattgctagttcgtactgcagaagggatacaacagcatcagggacgcagttggggtaatgtagaagtatccgattacctctactctccttaggtggcaacactgcaacagtaacaacattgtttaaaaattccagaaattaaattgtgaatttttttatggcaaaaaatttcaaaaaatctttaaaaaatttataaaaaaaaaaacagaaaagcgtccgataatatttcaaagagagtggtaaatattattattattatttaatgaaatatgtacgcaattaatatttgtgttcttgacaaaaaaaaatgcaacagttccaatcaacattcaaagttctcgctactaatggtaaaaagtaatatctctttcgattttgcattaaatcttaaccatttaagacgttttccaattgctccgatataaaaatgatacacccttcttgatataacgttcataaaagttaatgtttacttccctcgccccattggacctacaataacacagaacaagtttcgttgcctgtcgtagattcattcacgtcacaaatgacacaaacatcagaccacattcgtcaaaatggttgaaatgacataaaatgttgccctacaacttatttttatgttacaatgttgcaatgctacaatgtaggtcaaacagtggaaaatggcattaatagtacacatatatctcgagcgcagaaacgacgaaataaaaaaaactaatgaagcgtccgaactaattttcgagcaagctaagaagaataaagaggggtccagcattgtagaagccaacgctattaaacaagtgcttaaaaccatgaatttgaaacttcacaatattcctgcagatggaaactgtttttatttagctgtaaatcatcagttgtaagttactggaagaccaactaagtctgtaaatgatttaagaaaagttacagcagattttataagacaaatcaaagatgacttcattccatttatgtgcaatgaattagatgaatctgaagtagttagcgaggaacagtttaaaaattattgtaaacagctttgttgcaacaacaaagttatggggaggtcagttagaactgtgagctttatcgaatattcttacttgccctattaaagttatttaggccgcgggtcctcccacactacagggtgaacaatttaaaggtccagaactggttttaacctactgtagacatttataccgtttaggagaagattataactcctataccaatcactagggacgaagatgtataaaaatcactgccaatagctttaattaggaaatttaataaaaatatatgacaactacacgtgaaactgattaaaaagcgataaaaaaatttagaatttaaaaatattcagtaatcctaatattttgataataataatcctattttgacaacggaatccgatttggatgtcgaaacgttaataaaatcattttttttagtaaaattgtggcttatttcccattgaaaatagttgattagaaacatgccacaaggaaataacttcagaacaacattaatcctaatagttttgaaattaaacgttgacttaagaaaatttgttgcatatgcggaaaattttcgtctggtcatcaggcggggagttattgtacagtaaaattgtggcttatttaccatttaaaatagttgattataaaaatgccacaaggaaatagcttcagaacaacattaatcctaatatatagtcttgaaattatgtgttactcgagaaaatttgttgcatatgaggtaaatattcgtctggtcatcaggcggggagttatgtaataggatttcaaatttatgtacaatgttggtccagtgtgactttaatgtgacccatttagggagcattatctcgatcacaaagaacaaatacaatgcccttacaacagtgctcatctcatatgaagaaaggtatttaatacgcatctggtaaagtgcaaaaaggctaatccaaatattaaattggtaaaatgtgacccattttgtagaagatacatgctctcagcatcatcacgaaaattgtcctgatcgaaagaaaattgagacgcatttttgaagttcaagtgtatcacatcttcgttagaataaacaaatagtttatttgtttagcagggattgtaattgaagtgaaattattaattaaatctactggatatttgacgttagagaaatggtaagtgaagtatgacatgcagcgaaatctgttctgtgtttagtgtattcgtaattttttgactgttaagtataggtgtatcatcttggaaaaactgttataatagagttttgtgatctgatgatttatccgttaataatatttatattaataatgccattagagataggtatgactttgcatttaaatgtttctttatttttttttggtggtaatcatcgtatgcgaatgcaactgacgaaagattggcgggtcagtcgttcagaatttcttaatgttttttaccagaattgttaagaaggaatgaataaatccatcataaccagc

SEQ ID NO: 1842 - DNA, 1358 bp, Diabrotica virgifera
tgcccacgcggacgcggcttctgctccgcatattccatctaaaatgaaactcctgggttattcagcgttctgcgcactcttattgttggcgaacgctgaagacaagtcatcggccacagacacgaaatcagcagagtctcaaaccaaggaaaaacgcggtttgtctctgggatacggtggcggtggacacgacttcggtggcggcggagatttcggaggtggcgactacgggggacatgattttggaggtggttacgaccaaggaggacaccatgaacaccatgagaaaacagtcacggtggtcaagaaagtagcagtaccttaccctgttaccaaggaagtaccatatcctgtagaaaaaacagtccatgtccccgttaaggttcacgttccacagccatacccagttgagaaaaaggtaccctatcctgtgaaagttccagtgaaagtgacagtaccaatacacaagcctgttcctgtggagagaaccgtaccctatccagtgaaagtccatgtcgacagaccctacccagtcaaggttttagtaccacaaccctacccagtcgaaaagcacgtagcagtaccatacaaagtcatagttcctcaaccctatccagtagaaaaggaagttccatatccagtgaaggtgccagtacatattcccaagccctacccagtagaaaagatcgtaccatatccagtgaaagtacatattgacaggccttacccagtacatgtacccaagccagtacccgttccagtagaaaagaagattccatacccagttttcaagcccgtcccagtcccagtgaaagtaccagtagaaaggcccattccatatccagttgagaaaccccaaccttaccctgttaaagtaccagttccagcaccttacccagtagaaaagaacattccttatcctgttgaaaaaccagtaccatacccagtcaaaatccccatcttcaacccagtaccatataccgttataaagaaagtaccacacattgttgaaaaaccagttccagtaccagtaaaggttgccattccagttccagttaaagaacaccatcacgaagaaagcagtgggggacacgattttggaggtcaagattacggtggacaggattttggaggacatgacattggaggtggacaagatttgggaggacatgatttgggaggacacgattttggaggtggagatatcggagggggagaccacggagatctaggaggtcacggttaccattagtgatatagtctattagttataattttattttgtactgtttctgtcagtattactgtacgcttcttgtgatttttgttataaattgtatataaagttatatttatgt

SEQ ID NO: 1843 - DNA, 417 bp, Diabrotica virgifera
acttcattctaacagagtccttcatagggacctgaaacctcaaaatattcttcttgatatgaacaacactgctaaactatgtgattttggatttgcaagaaatatgagtactgggacacatgttttaacatctattaaaggtacaccattatatatggcccctgaactgatagatgaacaaccatacgattatacagcagatctgtggtcattgggatgcattatttatgaacttctgatgggctccccaccattttgcactccgtcaattctacatctgataaggcttattaggcatgaacaaattcaatggccaacatttttgtcagacagctgcatctctttcctaaagggattgctgcaaaagaatcctacgaaaagactgaaatgggacgaaattttagatcatccttttgt

SEQ ID NO: 1844 - DNA, 2196 bp, Diabrotica virgifera
tattctaattctattcattcagtccagtcgatacaagcaagcaagatgagaaagtaaaagtaaaaagttaagatgtgtttcacgccaaatatggtttttttgtactttttcaagtggcctgataaataattattgttccatatatatatgccagtataaggatataatcgaatataaatattaatttcttcaatcggacgtaaatacctacccgtattggaattcaagttttaaattgtaattataaaacttcaaacacaactggtgctgcaaattacttcaaaatgagtgaaattacactatatctttggaaaccgaagctgccatgttccgttggccatattgcaatgcagcttccagatggcgaatatatcagcttttggccaagcacttgtaaatcatttacagctaaaggcaaaggctgttctatgtcatacaaagaggacataaaaaaggagaaacgggaagctgataaaacattgaagcttcccagcagcataattagtcaaaaagatgcaatcaattggtggaaccggtatttgtgctcttcttctactaattacaacctggtcgccgtcaactgcgctacctctgtgttcaattgcctcgttcagggtggtattttatcgaactgtgcctaatctttatcgtccgagttactgcagacattgcagaccattgctatgaagtaaaataccgaatggcaaaaggtggcagtttagcagcaacatgacgaaaggcaccatgaagacttgtgaaaaaccaaagaacaatgagactgagtccgaagtgggatgtgtttggccgcagattgtagcaattttggcagcctgcttgggtgccttcaacgacggagtactgtatgcctggacatcacctttcctagtaaaattagttaacgacaaagaacactacgacatttctgaaagtgaggcaaacaatatgacaattgtacagcccttggcgatggtacttactggttacttcttttccaaattgactaatctaataggaagaaaaaagactatgctgctggtaggcgtacctcaagtattatcgttgttaatttgcgcattcgccagaagtatatatgtgttctatgtcggaagggtctttgctggtatagggagtgcgataatttggtcagcctgccggcttatgttggagaagtggcttcaccagatgttagaggagtatggggcaattccctcacttccgtaatttatgctggacagttctttatcaacgttgctggaagttactgtgatatattaacagcttcttgtatatttagttctgtttcagttttattttctgtagttttttactttatgccagagtcacctttctttttcattatgaaaggagatgatgagtctgctaagaagtctttgaggtttttgaccaggaaaaccaacgttgataaggatttttcgatgcttaaaaatgatgttgatagacagatgtcagagactggtaattggaaagatctgatttgtattaaaagcaacagaaaggctctaacaattgctctatttttaagaataacccagacatttagtggaaatgcaatactgactcaatacaatcaatacattatacaaaaagctggaggaaatgtaagcccggaaactgcatccattatttttagtggtctttgtatagtttttaacattttcgtaatcagtttcatagttgacaggtttagtaggaaagtcttgtattcatcctcattagtcctttgcagcatggccatattggcattggctgcttatctatacttcgatgaatttgtccctaacacggatctggactctgtggcttggttgccattaacttgtctcattacattccagataggatggtcctatggcttggcagtcattccaactctaatgatgggagaactgttctcagttagtataaagtcaaaggctatgcttattatgatggttgccttgggaggaggaatatcttttgtaaatgtattgttcaatattttgaatagtgttttgggaacttttgctccatttgtcttctttgcgttatgtagcattggagcagccatcgtgtccttgtatattattcctgagactaaaggcaagactttggaggaaatacaaatggatttaaaagcatcttctaaagataaaaagaaaaacaatataatacctgctattgaagcttagtacagtg

SEQ ID NO: 1845 - DNA, 1012 bp, Diabrotica virgifera
attcattcagcccacgcgttacaagcaagcaagatgaaaaagtaaaagtaaaaagttaagatgtgtttcacgccaaatatggtttttttgtactttttcaagtggcctgataaataattattgttccatatatatatatatgtatatatatatgtgtgtatatatagtgtatatatatatatgtgtatatatgtatttatatatatatgtgtgtgtatatatgtgtatatgtatatatatatatgtgtatatatatatatatatatatatgccagtataaggatataatcgaatataaatattaatttcttcaatcggacgtaaatacctacccgtattggaattcaagttttaaattgtaattataaaacttcaaacacaactggtgctgcaaattacttcaaaatgagtgaaattacactatatctttggaaaccgaagctgccatgttccgttggccatattgcaatgcagtttccagatggcgaatacattagcttttggccaagcacttgtaaatcaattacagctaaaggcagaggctgttctatgtcatacaaagaggacataggcataaacaaggagaaacgggaagctgataaaatattgaagcttcccagcagcataattaatcaagaagatgcaatcaattggtggaacgattatttgtgctcttcttctactaattacaacctggtcgcagtcaactgcgctacctctgtgttcaattgcctcgttcagggtggtattttatcgaactgtgcctaatctttatcgtccgaattacttccagaagataacacctaatggggtatttcgcttggcttgtaaagctgaacatttgatgaatgaagcttaaaattaattttatattttggaaaatattcaatacctgtattcttactttatatatgcatataatatgtaattcaagtatgtcccataaaaagcaaaaaaaattattaaaaattatatgtagttattttaagataaaaaaaatgttttcaactga

SEQ ID NO: 1846 - DNA, 1013 bp, Diabrotica virgifera
aagcaagcaagatgaaaaagtaaaagtaaaaagatgtgtatatatatatatgtatatatatgtgtatatatatatatatgccagtataaggatataatcgaatataaatattaatttcttcaatcggacgtaaatacctacccgtattggaattcaagttttaaattgtaattataaaacttcaaacacaactggtgctgcaaattacttcaaaatgagtgaaattacactatatctttggaaaccgaagctgccatgttccgttggccatattgcaatgcagtttccagatggcgaatacattagcttttggccaagcacttgtaaatcaattacagctaaaggcacggacgcgtgggtgtcatacaaagaggacataggcgtaaacaaggagaaacgggaagctgataaaatattgaagcttcccagcagcataattaatcaagaagatgcaatcaattggtggaacgattatttgtgctcttcttctactaattacaacctggtcgcagtcaactgcgctacctctgtgttcaattgcctcgttcagggtggtattttatcgaactgtgcctaatctttatcgtccgaattacttccagaagataacacctaatggggtatttcgcttggcttgtaaagctgaacatttgatgaatgaagcttaaaaattaattttatattttgaaaaatattcaatacctgtattcttactttatatatgcatataatatgtaattcaagttatgtcccataaaaaaagcaaaaaaaattattaaaaattatatgtagttatttaggataaaaaaaatgttttcaactgatttttcagttgatttataacgaaatctttactatttccgtactattgtatttttggcatattataattagttatattaacgtatttaaggttttatatttctcatataacgcagtaggagacaatgttataaataaacatcttgaaattacaaattataatacataataaataaatcaggtcaatcagt

SEQ ID NO: 1847 - DNA, 890 bp, Diabrotica virgifera
ggaaaaggaagtgggggtgaataggccaaacaatgacaatggttttagctattaaagatgacgacaacaagtttgatatgttggtaaggaactgtatggctcacgatggaaaaagagctcccatacagttagtcgaccaaagaggttgtgtcacaagaccaaaattgatgtccagatttactaagattaaaaactttggcgcaagcgcttcagtgttatcatatgcccacttccaggcatttaaattccctgactccatggaagttcacttccagtgcaccatccaaatctgcagatatcaatgtccagatcagtgttcagattcttcaggacaacatctccacggcttgcttgatttggtgcatggtccacctgatactggttatggtgctcctccaccgctacctatcgaagcatatttacatcctgggcgaccaagggatgaaaggagatcaaagagagctctcgctgtcgacccggaaaaggaagtgggggtgaataggattattagggttgtatctacaggagatttgacatttacacttgacgaaaacagcaatagcacaactccacccactatggtctttcccgccaaggaggaaattaacaacggaggattaatatgtatgactactccaggttttgcagcaaccttagtagttttattagctatattaatagtatcttgtcttatgtcagctttcctttgtgtcaaactaagaccatttgctgaaaacaactcgcaggtgtcataggatatgccaattcacagaaaacaaagtcaaggagctgcttttactcgtaatattagagcagactgaaaggggttagatcgaaaagaaaacggctacatgcttggtcatataaattaaaaatctttcgacatatgg

SEQ ID NO: 1848 - DNA, 1220 bp, Diabrotica virgifera
ggcagctcctaatgcaaggttaggcctgttattcgtctaacccgactggactaaaataaagtcactgctgcttgcctttccatcctataatcctatacccttaaaccacatcgttcgtgataagttttaatctataattgatttttttgttcatttcattattttgaaattttccctccaatggcactatagtatagtccaaatcgagtcttggcctcatctaaattatgccatcaaccttgacggtccagcgccgatctttctcaaggttctcacgtttagcaaattttgcgccccgctgctacttcttcctcatcaccttttccgtgcccttccttctggtcttccaccctgcatttaaccatctatggctcttttcaatgggctagtcactacattgaagtctatgaaagagacaagactattgaagtctgaattttaacgaattctgagatcggtgtctctttgaactgtttgtagagttcatggttgtactggatttccatactcagcttacgttaataggtccaaatatcttcttaaggacaatatcttcgaaagttttaatatcgtcctctaattcaactgtgcgcctgtttcccctagctctagcatgtgttagctttgttgtcttttgcttatttatttctagtccggtctcttttgcccctgtttttaattatgaatatatttctcccatcttttccgttctgcgagacataatgctgatgtcatcggcatatacggcaatatgtattgatttatttgtttgttagattagcttttcctatattcaactgtgttatcacatattctcgacacaggttgaataatatcatctccctgctttaatcgtttgaatcaaaagaccctacctatccaaaactactggaatttggtaaaaacatgctaagaaagaagtgcctgattcacattagtgagtagggtggtatttggacgtttcagttaaagagtgacacaccacgagtcaatattctcatcttttcttaacttctttgaagtcttgaaatattcagtagcattgatgtcgttttggtcatcaccttgaccagtaacatcccttttctgtcccaaaaatatgaacgaaatagtcactttaaagcctttgattgatgtggaattaactaagtcgttacagacgtacttaattttcatcttcagtccagaaatgatttatcacggtaaaatggaccacacat

SEQ ID NO: 1849 - DNA, 598 bp, Diabrotica virgifera
acacgaactgtagactcatggatctttttacaggtttcttgcttattctattcaaaaaccacgttcttcgtatcgtaaggggtacgtcaaggatactgtacactgtacggacacaaagtgacgaaagtcgaaacggaaacgtatttgcttctaaggattccgaaataacagatgaagatatcgatagtatattggaaaagggagaaatgaagaccgctcagctagctcagaagatggaaaccatgggcgaatcgtcacttcgcaacttcacagtcgaaacacccactgaatcagtctaccaattcgaaggagaagattatcgtgagaagcagaaaaccatcggcttgagcaactggatagaacctcccaaaagagaaaggaaggccaactatgccgtcgatgcttacttcagagaagctttaagggtttctgagcctaaagctcctaaggctccaagaccaccaaaacagcccatcgtacaagatttccagtttttcccgccgagattattcgaacttttggaccaggagatctacttttacaggaaatctttgggatataaggttccgaaaaacttggaacttggacctgacgcgtc

SEQ ID NO: 1850 - DNA, 681 bp, Diabrotica virgifera
cagacgcgtgggcgaagaaactaacgctaatatggttgccgaggaaaatagttttgtgctttatggtccaaagactgatattcccataccggaaggattattgggaaactttatgtacaactcattgctaaacacggatgtcaatcattattgtatggtagacgtatttactggagaaacgcgtacattcagaagactactggaagattcctgcacgttagcacaagcgctacgtaattttggacttaaacccaacacaattgtttcaatatgtagtgagaacaacgtgaggttctatgaagcggttttagcttctctgtacgtcggagctacgatagcacccattaatcatgtgtacacggaagatgagttaagacatgcacttacactttatcagccagagattgtattttgctcgaaaacaactattaacaagtttttgaactttcagaaggaatttagttttattaaaaaactgattataatttatggtgatgaagcttttggaatagaaaatatacaatcatttacaaaacgacttttaagatctgaaattgttcgtccagaagtggttaagcccttataatgaagaagatccccgtggatcatggtgctttttataatgagttcttctggaaacgaccggctttctaaaaggagaatgctgactgaccgaatttc

SEQ ID NO: 1851 - DNA, 210 bp, Diabrotica virgifera
cgcccgtttgaaaagaggaagaacttacaagatatcttcagtgaggaagaagtcttttgccggcaaagagcccgtgtttgtatttggcattcgctagctagtaccatagtaccattagtacggtgagttgtgaaaggttcgttcgactcaggaaaatgaagacggttttttgtgtggtggcgcttgcgctttttggttatgtcagcgctc

SEQ ID NO: 1852 - DNA, 1690 bp, Diabrotica virgifera
gatgtaatgaccgccatagacttacaaattaaagattgcttcgacagaaaaagtcgctattgtgatttattaaagccaactaaacctagtaagatgtatctcgacccccttatagaaaccccccaaacacgtgaaaacataacaaagcaaataaatagtaaaatatacaaaataacaaatataataaacgaaaacagaaccattaaggaacgttggtactagataccaacctcgattagaatcgattagaactcgattagattaggaagtaacatagtctttgaaaatacctacaatattgacaaaaagtgggtagatgagataggaaatcttgcctgatggaagttcggtgaaaacataaaaataaaaataacaaatacactgaaatcaacaaactcgtaaaaaaattaagcaagccaacgaatcttgactagaaaactcatgtaaagatatagaatatgtacttacaaaaacacgacagtttcaacctccacaagaaacttaaatatatcttcagaataggaaaactgaaaagtgcttacgttcttaaaaatgcagacggaaaattttgtaatcgccaataacagtgcggagcagtcaaagaaagcacttgcatgttgaccacgtatgcaattatcctgctgacgatattcatcctgcaagttgccatcggagtttacgctttcttacaaatcaaagacaagaactcgtttaactccgtccttactaagagcatgcaagacacattcgacaaaatatatgtaagccaggaagccaacgagactatgatggtcacacagagattcttaaaatgttgtggtgttcgtggacctgaagactatgacattgctggaagaaaaccacctaccagttgttgccgcaacataaatgttcagtgtccaagtcccaacaacgaagtcaactctgagggatgtgtggcaaaactacaaacggaattggagaagggtttgaagattattggtggagtagctattggtatcgctgttgtagagattgttggtgctatcttcgccttgtgtctagccagttcaatcaggaacagttacagaagacacatatacgcctaaaacgaaacaaaatctttatttatttgttatagttttctctcactttaaaaattttactgttgatttaaaatttttactctttttgtaccttaataataagtttattataaatgttgtaagttttcatggacggtatttgacacagaacaatgaattaacgactaacgacaaaaaaagtgcttttatttttttacggactgtaaatatgttgttttgagggcaaatatcggctgtgaagactatactcaggaactttgggggcaccagtaaactgttgaatgtatatttataggttaagaaaagacgttgttagcatatctagccaaagatatacaaacactcgaatagttttcgttaaaaagaacaaaaaaaaaaatcatttatgaatattaattatatgtgttacgatacgatggatgattaagaagtgccaggaatgaggctcagagactcaaagatctatttagtttgataagcaaaaaagtcaacaggggtcaattctggtgaccaaggagaccaaattgacgtttatgcaaaaatgataaagaagaagggcaaaatgaactgatgccattgtatatctttcctttttcgaaaaatcc

SEQ ID NO: 1853 - DNA, 1079 bp, Diabrotica virgifera
atttttatttgtgttgcggatgatcgcagtgtgctgtgctcacaaaaataaacatagtaaccgtatccacaggcgtttctctttgtgtcattcagttcgagagagacagagctataattgagtgttaaaattctttagccgcgagtttttatattcacgaaaaaatgggttgtgccactgggattgttaaatatttggtgtttttggccaatctattgtttgctcttgctggattagctttaataatcataggaattttaatcaaattgaatgttagcgaagctaccaacgttctaccaaaagacttcggtctagctccaatcctctcgatcatcatcggttccatcgtcttcatcacagcgtttctcggatgctgcggagcagtcaaagaaagcacttgcatgttgaccacgtatgcaattatcctgctgacgatattcatcctgcaagttgccatcggagtttacgctttcttacaaatcaaagacaagaactcgtttaactccgtccttactaagagcatgcaagacacattcgacaaaatatatgtaagccaggaagccaacgagactatgatggtcacacagagattcttcaaatgctgtggtgttcgtggagcagaagactacggagacacaccagttcctccaagttgttgtaatgatataaactatccatgccctgtaaccaacctgcagataggtgaccactcgtacctttataacagcattaatgatagagggtgcgtcgaagctctgaaaatacagtgggacataattgcgaggattctcttactatcacttggttgtgtcgccatagtagagattgttggtgtcatctgctccttcatactagcacgttcggccaagaatggttacagaagacacatgtacgcctaatgcgacacacaatattcatgtatgttatagtttcctctcacttcaattgttagctgattttaaatttttacttttctgtactattgtagtaagtttattgaaagtgttgcaaatgttcatatataaaatactttgtacttaaggtttgatacattaaataaataaaagtgtttcaatcac

SEQ ID NO: 1854 - DNA, 1188 bp, Diabrotica virgifera
gtgaagactatactcaggaactttgggggcaccagtaaactgttgaattaacgactaacgacaaaaaaagtgcttttatttttttacggactgtaaatatgttgttttgagggcaaatatcggctgtgaagactatactcaggaactttgggggcaccagtaaactgttgaatgtatatttataggttaagaaaagacgttgttagcatatctagccaaagatatacaaacactcgaatagttttcgttaaaaagaacaaaaaaaaaaatcatttatgaatattaattatatgtgttacgatacgatggatgattaagaagtgccaggaatgaggctcagagactcaaagatctatttagtttgataagcaaaaaagtcaacaggggtcaagtctggtgaccaaggagaccaaattgacgtttatgcaaaaatgataaaggagcatggcaaaatgaactgatgccattgtacatcttccctttttcgaaaaatccaatattttccttcttggaacctcactaagtgtgttggtaacgaaaatctcgtgtcaagtcgtggaatttgtcctataagataatttaacgttcaagataggtttttcactaccattgagacacttggaattttgtttccacttgtcagaagaaaacagtcgtaaaaacgaatgcagtcaagcacagctttgattgagtgacactatatataatgctgccaactgttgcgacgttgtcatgcattgcaaaaagtcctggagctttcacaaacctttaatattagaaattagaaaatattttctactattgaattggttaattattgtccagttaattgacacatttgatatctttttcgcttgtagaccttctgttgttgagaacttcagattaccgacacgatttctgaagtttcaacatctcgaatacctcatgacaattattctttagttaatctttgtttttattatattgtataagtgctctcaggttccgagctataaataataaatatagtttgttaaatgtgaaatgtttatccgcgtattttgtatatttaacatttgataaattggataaataaagtaaagctaccgatactaaaaaaaaaaaaaaaaaaaaaaaaaaaaaaaaaaaaaaaaaaaaaaaaaaaaaaaaaaaaaaaaaaaaaaaaaaaaaaaagggcccgctcgc

SEQ ID NO: 1855 - DNA, 1868 bp, Diabrotica virgifera
gtctcaccgagcagaacatttttatttgtgttgtggatgatcgcagagtgctgtgctcacaaaaataaacatagtaaccgtatccacagacttttctctttgtgtcagtcgggtcgagcgtggcagagtaataattgcgtgataattttctttagccgcggacccatatattcactaaaatcacaggtgacgagtctcaccgagcagaacatttttatttgtgttgtggatgatcgcagtgtgctgtgctcacaaaaataaacatagtaaccgtatccacaggcgtttctctttgtgtcattcagttcgagagagacagagctataattgagtgttaaaattctttagccgcgagtttttatattcacgaaaaaatgggttgtgccactgggattgttaaatatttggtgtttttggccaatctattgtttgctcttgctggattagctttaataatcataggaattttaatcaaattgaatgttagcgaagctaccaacgttctaccaaaagacttcggtctagctccaatcctctcgatcatcatcggttccatcgtcttcatcacagcgtttctcggatgctgcggagcagtcaaagaaagcacttgcatgttgaccacgtatgcaattatcctgctgacgatattcatcctgcaagttgccatcggagtttacgctttcttacaaatcaaagacaagaactcgtttaactccgtccttactaagagcatgcaagacacattcgacaaaatatatgtaagccaggaagccaacgagactatgatggtcacacagagattcttaaaatgttgtggtgttcgtggacctgaagactatgacattgctggaagaaaaccacctaccagttgttgccgcaacataaatgttcagtgtccaagtcccaacaacgaagtcaactctgagggatgtgtggcaaaactacaaacggaattggagaaggattcgaagattattggtggagtagctattggtatcgctgttgtagagattgttggtgctatcttcgccttgtgtctagccagttcaatcaggaacagttacagaagacacatatacgcctaaaacgaaacaaaatctttatttatttgttatagttttctctcactttaaaaattttactgttgatttaaaatttttactctttttgtaccttaataataagtttattataaatgttgtaagttttcatggacggtatttgacacagaacaatgaattaacgactaacgacaaaaaaagtgcttttatttttttacggactgaaaatatgttgttttgggggggaatatcggctaaaaagcccctactctggaactttgggccaaacagtaggctggtgcttccccctttataaataaaaaagtttttttttttttatatcccaaaaaaataaaacacaccctaaaaaagttttttttaaaaaaaaaaaaaaaaaaaatcttttatgaatattaattatatgggttaccaaaccaaggaaggataaaaaaaggccaagaaagaggtttaaaaactcaaaaaattatttaattggataagaaaaaaaaccaccgggggtcaagtctggggaccaaggaaaaccaaattgacgttttttgcaaaaaatgataaaaggggcctgggcaaaaaagaaacgggttgcccttggtaccttctttcccttttttcaaaaaaataccaaaattttttctctttttgggaaaccctcccctataagggggggggggggaaagaaaaaaaaaaccctcgcgggcgaaagggcggggggggaaatattttgtcccccaaaaaaaaaaaaaaaataaaaaaaaacgattcccaaaaaaaaaaaaagggtgttttttt

SEQ ID NO: 1856 - DNA, 1319 bp, Diabrotica virgifera
  misc_feature (1267)..(1267): n is a, c, g, or t
catttcgcgtccgcggacgcgtggggtaaaaagtgaaagaatctgaaataaaacagcaaaaattaatatttaaatgaagattttaatcatagtgcaatgtatttaaaaacaattacaaatctaacggtattctcctgggaaagttcacgctaagtcattcaataaaacagtttgaaagttcctaccggatctaccacagagctgtctttcaaaggtcaacagttcctcacacacctcttcgaaaggttcgataaagatagagataaagccttatcgccgtcagaatacgaagaactgttttcaacgtgccccactcccgcgtggggcccagacgtcagctctatggtgccaactaacgagaagggatggattacgtatcaggggtacatgtgtcaatgggcgttgatgactttggtggatctacccacgacttttgagtatttggcttacctggggtacaatatttatgaaaacgagacacaggtgacagcggtacaagtaacaagagataagaagacagatttagccaagaaacaatccagtagaaacgtgtaccagtgtcacgtaattggtccgtcagcgtcaggaaaatccaccttttgcaggagttttatcaaaagcatcctcgagtcaaatccccttcaacccgagaagactggagtcccaaattgtacagtgaacgttattcaagtgtatggacaggaaaaaattatggtacttagagatatcaatgttaggaacgtgtcggatcctcttcttcccgcagaggtgcagtgtgacgttgcctgcttagtatatgaccaaaataatccgaaatcgttcgagtatatcgccagaatatacattaaatattttgcggaaagcaaaattcccgttttagtagtggcgtgcaaagatgacctggaagaagttcgacaagactacatgctacaacctcagagcttttgtcaaaaatacaaaattttacctccccagaagttctccgccaaaggccacaataggaaagacgtgttcattaaattagccacaatggcagctttccctccgttgcgtcgcatggtacatgcgttactagtacgaccccaaccgacagagtggttagatcatttttgcaggaattttcgggaattcggagtaatggctgccgattcaaccgtttggtggaaagcaggaattagtttagcagcagtacagctatagggttcatcttagcgaaaagtatgcatacagccgataaacaagataaactgtgtaatatataaagaanataattatatttattgtaccatatgtttactgtaccttattttttgtatcta

SEQ ID NO: 1857 - DNA, 936 bp, Diabrotica virgifera
atttctcatcccacgttatcccacgtctgtcaggatattcaagaataaatacaataaaagtttaactttgacaccctgtatttcggttattatcaactttcgtactaaggtaagttagcttaaatcgacctattttaacctcaggaatgtaaggttaagctatcggcatcggcccattctttacaccctcgtgcctatataggtacgtacatattatattatacactcgtatcgtgtcgcctacccgtatactgaggtcacgagccgccactgaattggaatacctagtaaatcttataattttccgagtttgtgcctccatattttgaaaatcctccatacgatcgaggtgttgcccatgagaacttttcatcacaatgcttcacagagttttttttcccaaagtatgaactaaatccactgagacctaatttccataaggtttgcgcggggtactttatcaaaatttgtaattcagtgatgccttttttattgtgtgttttttaaagattttagacgttgttcataaagatttcttacatgtttcccttgtttttttttttcgattacctttgcccatcaaatctgctttggaatatgacctaatataaatcgttttgaaaccaaattttctaccttgatcgatacttcttggcatttgctgatggtcgttttagtttataatattcgtgtgtgtattacaagaatagagactaaattttctgtattacgcatttgggctctcgctatcaggttatcggatttgtattaatccgacttttaccgcaatcgtttgaataatacggtaatcttcgtaaaatcacttaatcgattttacgtagtaacaagtcttttactcaacacgtacacacgcacacacactgtggttactcacatcaatctgccactgatttttaggatgaatcataaccacat

SEQ ID NO: 1858 - DNA, 1749 bp, Diabrotica virgifera
  misc_feature (1667)..(1667): n is a, c, g, or t
aattttgggttatggtgccacgtaatttagaagtaatttattaaaaaaatatgggaaactctgaaagtgtagatgttcccggtggcggaacagatggatatcacgttcttaaagtccaagaaaattctcctgccagtcttgcaggacttcaaccattctttgattttattatatctattaacggcacccggctagatcgagaaaatgatacacttaggacgatactaaaaaacggcgtaggaaagcaacttccactaaccatctacagttataaaactcaaagtgtgaggactgtgacagtagtaccaagtgacacatggggaggccaaggctatttaggagtaagcataaaattctgttcctttgatgttgccaaagaaatcgtatggcacattctggaagtacatccaaactcaccagcatctctagcaaatcttagaccattttcagattacatcataggtgcagattctatattacatgagagtgaagatttatataatttaatagagaatcacgatggtgttcctttgaagttttatgtgtataattctgatgatgatacttgcagagatgtaactataacaccaaattcgaagtggggtggtgatggcatgttaggctgtggtataggttatggatatttacatcgaattcctgtaagaggcagtgcgatccaacctcctcccactacaactatatttaatcaagttccaacaatatcaccatctaatgaccaatctgttagtccagctaccactcaacccattacaactttaattcaaaaaacagaaaattttgaatttagagccaactggacaagcagtccaagaaactaatgttagcaatgttttatctacagctgccagcactgtgcaacaggacccatcagtttatacttcaaatgtaccagctccttcatcaattccgaatttcaacatgaatttccaaaaccctccagcgactagtgatattccatcatttgatgtgaataaattttctaatcctcagaatcccgtaacttcagaggcaatggtacatcctcaagtctcactacaatctccccaacctattattactccaactatgtataatcctgctgattacccggcttttagtccatcccagccccccttaacacagaccacagttcctgtgtactcatatccccaaatgcaatctagtggggctccaacaaatgtattacataccacaactaattcttcactgcctccaccacctctgtcaggctttctgaaccaacctattatttttgatcctcatatagcagcacaatcagctcaacagttgttaagtggaactgtaactacatcttctagttaaaatgtgcaatggaagaattatttagtaatacatttttacatgatatcttatattttattggacactgaggggaacttttaacagaaatgcagagctgatgattcttttcaatgtattgaaagctcttggtgggaaacattttcaaaagatatctgtcaaatcacaaaactgcaaataatgggcatttattggatatggaattgatttttgattataacattcatattatggaaataaaagcgcatgaattgacacagtgtttgtattgtcaacacggatccattttttttgtgttttattgctaaatttctcataccctgtanagctttattctagccctttcttatcctgtgatatttttctgagatcatacatttacagatattgcatgtaaaaaaacatgtc

SEQ ID NO: 1859 - DNA, 431 bp, Diabrotica virgifera
aaccacaagtccgcccacgcgtccggtgaaatgccgatggatataatgcgaaaaaaacttggcatcaaccttttagttagattgtatgaaaaaaaggcaagtttaatttccaaaatacatcaactgtttatagcagacttgacagaaaaatattggataaaaaagaaaactctaaatatggtagatttatattcagaaatgacaatatatgataaacaactttataaatatgacataaacccaaattataatattgactttaatagtatggaacaagttcaggtatactttttaagggactatagcaagttgcctatatctttaagaaaattagtgtttatctccgacagttcacagatgttcaaagattattgtatgctatatacagatgcatcaaaaaatattgaatgtgtgggatgtgcctattggga

SEQ ID NO: 1860 - DNA, 750 bp, Diabrotica virgifera
tttttcaaattgaaggaaatcttggtgcctcacccactgtgatatctatgttaacgaaaatgcacaagatactgaaagatgaaaacggcctagagctacaggccgagtattgcaatttatggccagctaccgtcagcaacgcaaattcatacaatatcgtagctgtcaacgagttactccttgaggtaatcactcacggtttaaatcaatatccgaataacgttgcgtggttacgattgatgggtgatataaactttgcaaacggtcattaccaaatatcgttaagctactacctcaagtctctcctcgtcttccacgattacttcaacactcccatcggctatgacgaccacgtattccgcagaatgataaagtgttgcaccaccctcggcgcaaacactcaagctgctgtcttatgtcaatttttagaggaaaccgactacatgttggccttccggatattgtccgaacagaaaacttgcaacgacgcggtcgatgcatactaccattgtttctgggataccagtattttggagtatctcatatacactcataataagaagggggagttccagagaaggaagattgcgatacaagtcattggaatgttggagctgaattctagtaacaatggagaaatacagagggaagcgagtaatttaagaaaaagtacgtttttgagggcgttgtgtaaacagtatgtattttaaggtgtattgtacatatttaaaaataaagtatgtagttttg

SEQ ID NO: 1861 - DNA, 459 bp, Diabrotica virgifera
ccacgcgtcagcccacgcgtccgcccacgcgtccgatttatttcgtgttgtattcaacagtttataaatggaatatatttgttacatttctttgaagctgttatttgcaatggacgtctaaaagtaattttcacttaaattcaaagggtctaaaactacaggaaataggctaaaaatagtacacattcaacaatggatgaagctagtggacttcctcatggacccccaatgaatatccttcctccaaccccagcagggttggaaagtttgtattcactatgtagaaaaatataccctgatcaggttaaccctttacaagtcacagcattactaaaattttggttgggtggtccagatcctcttgattatatttctatgtatgctaaccctggaataccacacgaaaatatacctccacattggcattatattagttttggtttatcagatttgcatggg

SEQ ID NO: 1862 - DNA, 944 bp, Diabrotica virgifera
gtttcacacccagggccggatttttgtgataatattgcaaatctttattatttttaggcgtggttctaaattttacaggaaacaaaacaaaatactgaattattaattgtctagctatggatgggaaactacctgcatgtgttatagacgtgggtacggggtatacaaaattaggatttgctgcaaataaagagccacagttcataataccttcagcaatagcaatcaaagaaactgcaaaagtaggtgatacaacaagtcgtagattaaataaaggagtggaagatctcgattttttcattggagatgaagcctttgatgccacaggatacgctgttaagtacccagttcgtcacggtcttgttgaagactgggatttaatggaaaaatttctggaacaatgtatatttaagtatcttcgtgccgaacctgaagatcactactttcttcttacggaacctcctctgaacactcccgagaacagggaatacatagcagagataatgttcgaatcatttaatgtacctggattgtacatagcagttcaagctgtcttagccttagctgccagttgggcaagtagaagtatagaagaaagaacccttactggtattgttattgatagtggagatggtgttacacatgttattccagttgctgaaggttacgtaattggaagttgcattaagcacatccccatagctggtagaaatataacgtattttatccagtctcttctgagagaaagagaaataggaataccccctgaacaatctctagaaactgccaaagcaataaaagaaaagtactgttatatatgtcctgatatagctaaagaattttctaaatatgatactgatcctgccaaatggatgaaaaaatacgaaggggtcaattctgtaacgaacaaccccttcacgttgatgtgggatatgagcgatttt

SEQ ID NO: 1863 - DNA, 559 bp, Diabrotica virgifera
actcgtccacacatcaatagctatgaagtatctatattatgtatatttcttttgcacactttcctgttatgtatcagcagaagacgtcctactaggaactgatctttgtgaatgtaatgaatgcctgaaaccaatccttgaccaacttgggggcagcaacgttacaatccagaagatcgaagctctcatacaaagattaagaaaagatgtcgtaactattacagtaatactcaacggaacctgtgaaaaaatcgaaggtattcaagaagacatcaagaatttagacgctgtcctcgacgttaacgttgaactggtcaaccaagagaatctaatcatccacgatatcgatgtcagagttagggagctcggtcttgaaggacaagaactggacgatatgatcgactctaacaacggcactattaacgatatcgaaacaattgtggacgaattacaaacttgcgcatgtgcagttacaacaccggtgggcagtgggactcctactactaccccatattatttcaatcatacgtactacgtaaaaattaaagcacgttaaaat

SEQ ID NO: 1864 - DNA, 949 bp, Diabrotica virgifera
tgcccaagcgtccgataagttcaactggaatttcaaaataaagtatttattttaattttttttaacacaatacctcaaagttttgaaggaatggttaatatagtgatattattaattagttgtcgaattaaatataaagctgtcgtatgatttggagtaatattgagatttattcattcaaagctgtcgtattccccgcacaatggctcacaatttatccaatttgaggcagttcctgccatgtagagatatccaaatcgaactgctctataatctgtttgcatataaagatgaacctcaaattgaaagcgtctacgtttatggagggccaagcagtggaaaatcaattgtggtcacctcgacactcgagcacttgggtatcaatcacgccatagtgaatattatcgaatgttactcatcaaaaattctgttcgagacaattttaaataaaatatccggtcatcagctcgatccaaagaatcctgtgccctacgcgagatgcgacaacatgatggactttttatataacgtggagaaatggaacgaggaaaataatcttaacgggtttgtttttggttttggacaatgccgatgagctcagaaatatggaacacaatctattgccttgttttttgagacttaaacaactcactggaatttctttactacttgtgatgatatctgaaaatcctgttttgaaaaatatttataccgaaatcacgaggtaatcgaaaccttttaaagataccttttccctccagtaataacaaaaaaaaaactctgggtacaaaatcattttcttttaagcattttggaggaattccttaaaaacgtttaatttaaccccaacaactctttgcaccactatattttggaaccttttgattggaaaactttttttattaaaaactaaattcttaaccctccttctcttgtccaacctttttta

SEQ ID NO: 1865 - DNA, 878 bp, Diabrotica virgifera
attgacttatttgaggatatttgtggttgtggaaataattaaaataataattattataagggctaaatctaactaaatcagttttatattgttatacaaacatcacattttaaaaccaattaatttggtgtagttgcagcttaaacaaatgtgatacaatatgtctaaagtagaatattctctatagatgctctcgtattttaggtgtagttatttccacataatttttatacaaataggacccaaatacaataaagatgtatataagtgatttacgtattgctgtaatatgttctagtaacatgaaccgtagtatggaagctcacgcttttttggccaaaaagggatttgatgtcaaatcttatggaacaggtgataaagtgaaaattccaggttcttcttttgataaacccaacgtttatgaatttggaacctcttatgaagaaatatatctagatttgcttaaaaaggacaaatctttgtatacacaaaatggactacttcatacgctagaccgtaataggaggataaaaacgcatccagagaaatttcaagaaactccagaaaaatttgaaattcttattacatgtgaagagcgagtgtacgatcaagtcttagaatatatggaaaataaaactcccactgaaaattccatagtacatgttgtcaatattgatatacaggataatttggaagaagctactattggagcctttttaattactgacctatgcctaatgatagctagagcagaggacctggataatgaaatcgaagaagtattacataatttcgaagaaaaatctaacagatctattttacatagtatagtatttaattagccaattatgttatttattttttaattgattaacctg

SEQ ID NO: 1866 - DNA, 984 bp, Diabrotica virgifera
gctacatttctcaccaccatgaatcaaatttagactcctcattagattctaatgacaaaataataaataccatgaatagaagaccgatatatttaagcgaggatgccttattggagacaccacaagttcataagtattccaatattagcttagaaatcgaaaaagaagatttcgaggaaacaagacatgtttttagttctccttttcttaataactcttcaaatgagatatctacttcggttgcaagtagagatataagttattctggattcgaaacagaccaaacgaatgtgtctgctgaggttccagtttgtaaaaaaatagtagtagataaggctagtgttcaaaacacgaaaactatgtacagttcacccgatcttaacgatataaaaagagaaataataagagatatgcaccatacaaaaaattcagcatttaataacattacgaatacgttatccagcgagcaaaagaaaaaactaaccttagtcttctcaaaagacggcaaagagaacttctttagtgttaagagaaagtatcctagtttaactccagacaaaagtataaacgacagcactggctcatttcttttaccaactccaaaaaaattcgacaacaattcaaaaattgaatccgaacatgaatctataaatgaaactacctcgtttacatcaagttctgagttatcagagtctgttagaagcgaaagtttctcccaaggcaatgaattagctgaaagttatatgcaagaaagtttaagtgtgattttggaaaatgaaagtaactttactcaggatatttcatctaataacgttacagaaagtgaatctgtctgcttcgactattcaatgagtgaaagtaaaagtgagaaattggtagaaaatgttaaaagtgggataattgaagaaggaaatcatggtagggaccatgtgactgaaaatgtgggtttacagacatgtgaacctatatctgaggtgaacaggt

SEQ ID NO: 1867 - DNA, 780 bp, Diabrotica virgifera
ccgttatccttcttatttgcgaatatttaatttattgacaagttgtgtatagttttaaagaacagttgacgctataatgaattgtaaaattgttttaatctggtttgcgtgttatatttgcagtgtaaatctacaaaaaccgagtgagagtgcctttgtttctcctattttgcaaaccaatcgaagaggtccaaattggattactcataagggaaaaacatattatatcaataatgtgtttaggacaaacttctatcgcgcattacaattttgtagacaacaaggaatgcatcttttaagtttaaaaaatcaagaagagagtgatctgatcaaaaatcatattgaagcaaacgctggatttaaacacaggggctattttacatccggagtaaacctagtaggtgatgaccaatggatctggctatctacaggtctggatgtaacatatactaactggtatccaggtgaaccaagcggaagaagtggatccaatgttacagaaaactgtatggaaattcgagaatggggtggctttacttggaacgatttaaattgtctattagaagcttattttatttgtgaaagtgctagagagtgtcaaagagtatgatactcatggttgaatattagttataatgttttgatatggattaaataatttttgtatgcaattattgtttttaactgtgaggagatatgtatggaagagatacaaatttgctaaagcagtcaaaactatactattagatcagtaaacagaaatacttaatcaatagagat

SEQ ID NO: 1868 - DNA, 1169 bp, Diabrotica virgifera
actagttctagatcgcgatctgacatcacatatcacatctgacattttcaaaacaaacattttaagcttaatttaagtatgtaattattttaattttattagtttttaaattactaattgaaggaaaagattagttaaaaagtttagtgcaagctagttatggaagaatcaacaagtagaaatttgacttccgttgataaaagttttgtatacaaactgcccagaaaactggtaagaatagaatatcctggtcttgtaaaaaatgtatcaaatgctattgagactttaggaggaatagacagcatagaaacggctatagtggatgagagaaaaaaactggaactgcgatttcatccagacaacaaatataacaaaccttgtacatctgatcgatatgacaaccctagtttattaataaaagtgaaagaaaaggatggacagtatgactatgagattattgggtatactgccacaaattttaagtttaacaggactgtagactttcagtatttacctattgtacaagatgataaaacaggatctactgaattcatttactatgacattatgccaaaaaaattggctgacttagaatacttcacatccaaagaagctgtcaaccagccactgtttctactacctcacaacttttgtcgatacgatataacacacccaaccctttactttgaagcaaacgaaaaatttaatttaaatgtacccagtgctaataccaataccatgtttaaaatgttccaaccaaagaaaaaagaacaatccgtcatctaaagcacctgccataaatagttagtttccctggacccaaatctggaaaaacccccagggacctaaagaaccctatatttaaaaattgtccaggaaagggggttaaaaaaaaattttatgaaaaaaaaaaagcagctttttccaagaaaaggccattggggacccaaaggtgcaattccaccccaaaatccgggttccccaaacaaaatggcttaaaaaatatcacacccgcaaaaccgtttacttttgggccaccgtgccccgggggaaaatgaatatgggactagggtttgggttaataaaccccccaagagtgaccccttcaaacaaaaaaaatttattcaaaatttttaaattttttccaatctcaaaaaaaaggggaggag

SEQ ID NO: 1869 - DNA, 411 bp, Diabrotica virgifera
acttaaaaatgttaaatttgtaaaaattattgtaaaaatagataaaacacattaaaaataatgataattatcatagaaaacgaagtcccaccagaggagtcccataggaaacgttttgcaatcatttcttgaattttttgagaaattttcgtatgtccgaaaaacaacatgtaatagtaactgaattagtaagaagaggagcccaaatttcgagacagatgaacgaaaaaaactttatttgattcctttttgtaaattttaaaattaattagtgttgtttaagacaatcaaaattgaaccctcacgcacaagttgtaggtacgtacaacttcagtgaggaactgagtttagtattgtataatttatttactacgaataaactccattattattaaatttacattttcacca

SEQ ID NO: 1870 - DNA, 950 bp, Diabrotica virgifera
attacgcgtccgtagaaataaaattatcttgtcaataaatcatcagaaatattgaaagtagaatcgttctaaataattagaaattgaaagtagaacagtttgttcgttttactagatagtaaagagttaaatagacaacaggacgctgttaaaagaattttcgaagcatttcaacattaaaaagagtgaagaacattgaggataaaaactcaccactggtaaaatggacccttgggactattttcaaaaatttcaagcgcaaaattcagagtcggaaaatcccagtcaacaaggtgctggcgttaaaaaacaacggaagcgaccacctcctggggaaagacgaaaggcaataatagagaaagtgttagccgcaaatagcgctttattatcagaaactgaaaagaaagtagtgggttcgatatttagtcaatctgacggtcaatcgacaacttgtataagagatccttttaaacgtactaactttgctaattctgctattttgagaaaagacccggatattagagagtggtctgaaatttatggaaaagcatcaaggacctatgatgacaaagacagaaacagaaaagcgagatatgaagaagatcgcaacggaagatattgttctgggacaaagcaacctgaaacgatggctgagtcattttcaagaaaggaatcgaatatgtatcgtagaacaagccctttgggatatgatcgtgcttcgaattcatatggacagataccttcacgcgaaatgaatactttcggcggcgaaagaagtcaagtacatcgtgatacccgcggaagaagccctttcacgagtgaaagaagtcaacagcaccgagcagatcgtagacggagtccagaaggcatcggaaagaatgacatccgccgtgaaactcatggaagaagccctcccacaagtgaaagaagtcgcttcggacatgaaactc

SEQ ID NO: 1871 - DNA, 574 bp, Diabrotica virgifera
ccggcgagcggcttatggtcaaagatttccgtggagagtcttggtttctggtttgaaaacagacgatatcgaacaattaaaaagattcgcctcaggtggatactgtgacgattccactatagtgtatatggtacatccttgtgtgatattatcagctcttgaagtcttaggatatagagtagtcgcttcatcttctactagtgtaaaacaggactacaatgagtatatgtggactatgagaaaagacttttccgagccagaaccaattagtgaagaaaaattacctgaatttaaaatagatcataagttagagaataagctctcaccttctgaagaaatttgaggttgatggatacaaaaaaaatggagataccagcaggtgtactcatgtctactggaacttacgcatatgtggccattaagggatccttatatgctaacgacagtgctgtttttggccttaacgaggtagagactaaggcgttggtgaaaaaattttcaaattcccagagagaggttataaatggaatattactatctgcgtcgccgatgcaagtagttaacgctttgggtc

SEQ ID NO: 1872 - DNA, 919 bp, Diabrotica virgifera
cctctggcgtccgggttaatgtgtgatattgattttaaaaataagtgtattacattttaaaataaagggagaaataaagtgttaaaaatttatcgatatactcttaagaaaaaaaatctacagcagttgctagtggaggtcgtacaaatacatcatgtacgcaaccaagcagccatccttgaggatcaagcaggctgatttgaagtgtaagagcggatgtggattttatggaaatgcagactggaacggatactgttcagcatgttaccgaaaccatatggatatcgagcgacagaagaaaacaacagaccagtccagatcgcaagtgcccgggttctcaaagttcgaagagaaaaagagacaacaaacagataagaagaacaagtatctgaagagcttacctgtctttagaaagtcgtcaaatgtaaaagatgctggaagacctgaaaaatacatcgacatcatgaggcagaccaacccggacgccaacaaattgatggttgaattcatatcaatgtacagccaatggggcgagctagtcagaaaagacttcttcaaatttagccaagtgttttccaacaaaatagtaaacgaactggacgtcaagcccattgaagagttagcggaaatcgcacagaatcactacaatttgtatcacaaccgcgtcaattctaacgtcatttaccaagatgtgcccagtgaggttagagagaagttggttgagttttttgagaagtacagcatgatcagtctatacagtttcctgttctgcccaccaaccacaaacgacgaggagaaagaccttatcatacaagacagaatcccgcaactcagttgggataacgcccaccatctcgattgctgcataagtgaaactagcatcgaagtacgcgacttggtctacactggccatcacgac

SEQ ID NO: 1873 - DNA, 518 bp, Diabrotica virgifera
agtaacgatcgttttgattgtgattgtgaccactgaccaccttaaaaagtttaataaaaactgagtattgtcaatttttttcgactaatattataaaaatatacacaatgtctgcttttaatgttgattcaatcgcggcaagtttggaaaatgctcgtgttagtgatagtggtgttagttttgctggaaaatctctaaagttaaacactgaggaagatgctaaacaagttaccaaagaaatcgatggttgttcaaacctgcaatttcttaatatggagggcaatacacttggggtggatgcttctaaagaaattgccaaatctttagaaaaacaccctgagttcagacgggcgttatggaaggatatgtttactggcaggatgaagactgaaattccaaaagcactgcaatacttatgagatgggttgattaaagttggaactcgtcttacggaacttgacctcgccgacattgcttttgtgaccatcgcagagaaaaacttgttctccctaactaca

SEQ ID NO: 1874 - DNA, 773 bp, Diabrotica virgifera
gtccgcaaccgacgtcccccacgcgtccggttcgtatcaaagttggtattgttcttcgcagccactgtgtgtgtgtcatccagcgtgcagggagctgatctgacgcttaccctgttttatgaaggattatgccctggttgtcatcaatttattctaacacagctatatccttcatacgctaaattggcagatagcttgaaattggactttgtaccctatggatggagtgactcttcacgtagcgcagatggaaaagtaacatttgaatgccagcatggtgatgaggaatgttatattaacagaatacacgcttgtgttcttgatcaaaatccatcctcgttagactacgttactttcatatatcaacatttgtccaagactgacgaacgcgatcgcaacgaaagacaagaattagaactagcccaaagtttgttgccaagcagcctttcctgggacagcgttagtgattgttatcatggtgaacgtggaactgaacttttattaggatatgagaaaagacaagcagagcttaatcccgtattaccttgggtaccaaatataagatttaacggcgtctacgatgaagacgtagaagatcaagctatgatggatcttacagctaccgtttgcaacttactaaaagataacaaaccagacgtttgtaaagatcatgcgacaaaggctcatccaaaaatgcttaaaaataataaatgtgaaaagtaatgtttgttgagggttaattcaattttcgtaacaaataaattatatttgtt

SEQ ID NO: 1875 - DNA, 2095 bp, Diabrotica virgifera
aaaaaaagagtttacttaaaatactatacctaaaaaaatagttgttacaatagtgtattctatgatgtcagttatttttatttaattgtaattacagcccttaaacatattgaattacattaagttgcaataatcatccaacaaaattcatagagtagtaaatgcgtttctatcaatcttcctgttctcaatcctggggttactccaacattactctggtctacgtccaactatctctttacattgataatatcgatttccaaaaggttgtggtagattagttcctttgcagccatatccaccatgcgtgtgaatacttgcataatcgtcacagtctattttaccatcaccattgcaatcctgttgaaatttattcatatatccttgaacagctaatgcagaacaatacgtatcagtagcacaagatccatatgcattattgtcttctggtgatactcctttcacggtgggctttccagcatctgcccaatatgcccaggtgatccgaaatggtccacaaacctcaccagaacaaccgctagttacattacagttggaaatagcttcacatatacatcccaagcaagcttgcgttactggtaattgttgagatgcatgttcttgtacagctacagctaatattacaactaatgtaaagtacgtagttcgcatattgaaaaaaaaaaagagttcaaaacgaggatcactaaatactgtacctactcagtaatatcgcttaagataaaaatacattgaagattttgttgaaatttgaatatccatatctgaagtccatatcagtcaatggtccatactacatactgcactcacgtgtttgtgtttaaaggttagagtctgatcacaatcatatgcatctaatactaggaagtaacagctaaatatactataaatagtagttttactacagtatttacaatattaaaccaagcatgttcgtatcaaagttggtattgttcttcgcagccactgtgtgcgtgtcatccagcgtgcagggagctgatctgactcttaccctgttttatgaaggattatgccctggttgtcatcaatttattctaacacagctatatccttcatacgctaaattggcagatagcttaaaattggacctggtgccctttggatggagtgaatcttcacgtagcgcagatggaaaagtaacatttacttgccagcatggtgatgaggaatgttatattaacagaatacacgcttgtgttcttgatcaaaatccatcctcattagacttcgttactttcatatatcaacatttgtccaagactgacgaacgcgatcgcaacgaaagagaagaattagaactagcccaaagtttgttgccaagcagcctttcctgggacaaagttagtgattgttatcatggtgatcgtggaactgaacttttattatcgtacgaggatagacaatcaaagcttaatcccgaattaccttgggtaccaaatataagatttaatggcgtctatgatgcagatatagaagatcaagcttttacagatcttacatctgtggtttgcaacttactaaaagataataaaccagacgtttgtaaagatcatgtgacaaatgttcatccaaagatgattaaaaatattaaaaaatgttgaatgaaataagtgtttcgtttaaatacatgttttcgtaatatataaataaataatacttgtgatatattactaaacgaacgaaaaaaaaaaaaaaaaaaaaaaaagaaaaaaaaaaagaagcggggggggggctcaaaagaaaattatcccgggggtgggggcggcaaaatcttttagggggcccaaaaaaaaatttcctcgggggtttttaaaaaccggcgggggggaaaaaaaaaagggggtgccctaattatctgaaacacccctcctcgggaaaaaaaaaaaaaaaaaaacccccccccccccccacaccacccccaatgaaaaaaagaaaagccccccccccccggcgccatatacaggggggggggggggggtagggaaaaaacaaaaaaaaaaaataaagagtttttgtttttaataaacaccaaaaccacccccccccccccctc

SEQ ID NO: 1876 - DNA, 827 bp, Diabrotica virgifera
gagttgttaaggtggctgtggagtggaattcagttgtttaagctgtcaaaaaaagccaaaaaggcgatgttaccgttcgatatcgctggtgtacaataaaaaacgaagacaaccgcgtacacggtggatttaaataatttgcgtgctgtaggttctcgtcgcagtggtactttaaattattcatgtgatttaattggttagaagattagacctgcagttttttttttatcataatgaggaaaattaacaacctaactgcgatgtcactgcacttaaattgtctggctttactactctgtgttactgcctccacagccattgctaccatcatcccttcgtcaacgattgcacctgaagttgcgtcggatgttcgagttcagtgcaataacgatcaaatcgttataaacatcggcaccatctcaggacgatttaatggtatggtttatcccagaggactgtccaaaaatagttcttgtttgggcgaatggatcgaaactaaaacacccattgaatacactctacctcttcgaggctgtaacacaatgagcactgatttggatgacggtggtatcgaatattataatacgattgtagttcaacctcatcttaaactagtaacaaatcagggaagaggattccacatacgatgtcgatatagcaccagaaacaacactgtaatgaacgattcgctaaaagtagatttaatgagagctgacccaatacaagctttatcgccaatgccaggctgcaatatgaaaatcttctctggcgacccggcgatgaaagaagttgcagaaaacgtaaaaataggcgatcctctaaccttg

SEQ ID NO: 1877 - DNA, 922 bp, Diabrotica virgifera
  misc_feature (787)..(787): n is a, c, g, or t
  misc_feature (809)..(809): n is a, c, g, or t
aaaaacaataataaaactgatgccgagaacgagaagcttgtgaaaaaaatattgatctaagttcaatcatgtcctccccggtaatgtctcccacgcccccacagaaaaagcataaaaaacataagagtgagaaaagagaaaaagaagacaaaccgggtctcaaattgatacttaaggttggttcacaaacgactcctgaacataacccagagtttggacctagtttacctttagttggagagggattagaagaacaaatgcagattgatcctaatgatccatattttggtttggcgagagctcatcacaaaaaatctaagaaaaagaaaaagaagaaagataagaacaaagacagggaaaagaggcataagcatcaccacaaggataagaagagaaaaagggaagaaaccgaagaaaataatgaagatattacgatttatccacaaattggaagtccaggccgtgaacaaaggacttgtgtcatcaaaaaacttcaggagagaacaccactttcataaggtttggatcatttattaagtcagttggagaagaaggatcctcagaacttctttgcctggccagtcactgataacattgctccaggttattctacaataataagtaatcctatggattttagtactatgagacagaaaattgaagaaaatcagtatgcacatttagatcaatttattgaggactttaaattgatgtgcaccaatgcaatgaaatacaaccatgtagacacagtctactacaaagccagtaagaactgctccaagctggnttgaagatcatggttcctgaanactaaagatggatgttgaacttggtgcctgaataataagtgaagatgtaggatttgaaataacagcagacctgagagctgttaagcatcaagatgattatgatgacagtgatc

SEQ ID NO: 1878 - DNA, 1865 bp, Diabrotica virgifera
  misc_feature (1591)..(1591): n is a, c, g, or t
  misc_feature (1606)..(1606): n is a, c, g, or t
  misc_feature (1626)..(1626): n is a, c, g, or t
  misc_feature (1684)..(1684): n is a, c, g, or t
  misc_feature (1706)..(1706): n is a, c, g, or t
cccggtcaaactcacgcggatatgaatctagtcgaagaagaatccaagggagcaaagccatctcgacctcctccaaaacccctgatagaaaccgctataggacaatggaccatattatcagttgtcttaggtgctgttgcagttctaacagttattgccataactgcagatgagtgtaggaaatgcttcgataaagcatcaaacttgcaaccgctagagaaaatacaaaaggcgtattgggcatatggaaaagatgtcgacggagggcatttgaaagaagttttcacgatactagatcgattaggatacaagaaagacgataattactcagagtgggatctgctttgggcccacgattatccctttacggaacttaggtcgcaattagacaatctgaaacctcatcaaaaagttaaccatttgccgggaatcggtcacataacaaacaaagtaactctagctactagcggcttaaattacataccaccagcattcaagctaccagtcgataaagacaaactactggaatattcccagaagtttaccaatgtatcgtttgtacaaaaaaataacgatcatcgtgaggttaagatcaaaaaaatttttgacgtgaatttagacgaagaaggaacttttctgcaggagtatgttgataagcctttattagttagtgggcacagatttgacattggtatttatactataattacttctgttgaacctttaagagtttatatttacaacggagaaggacttttacgattctgtccagaaaaatatcatccatttgatcccgaaaatttggataaatatgttgttggtgacgactacttgcccgtttggaaaatacctgcgttggattattattacaacgaattaggatttgggatgagagatagccttaacgcttatttaaaaagtttgggtaaagatcccagtactatttggaaccagatagaagatgcaattcgaactgtggtattagccaaagaagctgctattgttgatgttctacaaaggtacacgagcaaaaggaactttttcgaattaatgcgtttcgatttcttggttgatgaaaatttgaaaatctacttgctggaagcgaacatgagcccaaacttatcgtctgctcattttacaccaaatagactattgtaccaacaagtcctatacaacgtattgggtctggttggagttggagaaagtatatacagaagttctttagctgtaagatcaaaatcagaagaagatatggtggtatctgacaaaacgttggcagtttacccaaatgtatgtaacagtcacacctgtagatcgagttgtatggcactggaatggcaattatgcaaaacttggattaccacagaaactccccaatatttggtgacagctggtaaagaacatcttcctaagggtgactggaaaagaatatttcctcctcccatggatccagaagaagcttgcacaggtattaatgtggaccagtactcacctgaaaatcaactacagtacaaatggttcagggaaagtgtatttagacgcctcctggtgttattttttagagtacatagcagaatagagaaatgatatnaaataatatttattnttatataacaaattacatanattcagagccatttcatttagatgtgatactcacaaattttaattaagtaatgtttanatactatttctttttcaatgtngtatctacatttactataacaattgtttgattttcgggcatataatgtacaaaaatctttatattttttaggaactaaaaatttcattcaatccctatatacatacttagcagagtataaaatatgggtaaggttcatggcctaaatggaatgggcatt

SEQ ID NO: 1879 - DNA, 514 bp, Diabrotica virgifera
  misc_feature (505)..(505): n is a, c, g, or t
aggcaagaggcaagacaagccagaaccacaggcacagttcgaagaaactagttgccgcagtgaaccacacagaaccacacatacacacacagtgcttagttaacttttttctgtaaaatcgaccggagtttttgtattagttaataacgaacatggatacccagaacgttgatgaatcagccacatctcccacagctgaatctccaaaaactgagaaaccagaatccacagaatccacagaagccgctacagttctcaacggagaggcatcaaaagatgaaatcgccagcgaagcacccaaaacagaagccgctacacccgtagaggaagagcccaaaaaagaggaacctgtggtagatgagcctgcaaaagaggaagcaaaagaggagccgaagatagaggaacccaaggcagaggaacctaaacctgttgaagaagcagaatcacctaaagtccccgaacccgttactgaatccgctccctctcccccggaacaagaggaacnccgctacat

SEQ ID NO: 1880 - DNA, 640 bp, Diabrotica virgifera
aggttatatatttacatttttactaatttttagcatcatagaagagtgtttagctttagttgtgttataattaatttttaactttttaacattaaaaatgtctgaacgtaaagttttaaataaatactatccaccggacttcgatccttcgaagatccctcgtatgaaattaccaaaaaacaggcagtacacagtgagattaatggccccatttaacatgagatgtgctacttgtggagaatacatctataaaggaaaaaagtttaatgcaagaaaagaagacgtcgagaatcaagattacctaggcattagaatatacagattttatattaagtgtactagatgtttgcaagaaatatcatttaaaactgatcctaaaaatactgattacgaaatagaagctggtgcaaccagaaatttcatggcattgaagttggcagaggagcaggctctaagagaggaggaggaagcgaaagaagaggaagctaataatcccatgaaacttttagaaaaccgcacacaacaatctaaaaatgagatagagttattggaatcacttgaagagttaaaagatttaaacaaaagacagcaagtggtagattatgatacaatgttatcagcctatgataccactattagt

SEQ ID NO: 1881 - DNA, 1084 bp, Diabrotica virgifera
  misc_feature (1009)..(1009): n is a, c, g, or t
cggacgcgtgggagaagttgttgtgttttttatttaaatataaaactaaaaactagagactagtctacatctacatagtgttgtagtcgcgaatttttgtgtcggcaatgtatattagattctcgttgattttaatcgcccttaaattagaaagtttttaatacaatgatataaatataaaaacagatattgtgttattaaagggacatcctatctaaactgtgtcagatgcacagcaatttttgaaagtcactcggaatatttattggacggtaagaatgccttggataacctgcttagaaggtggccccaagagagttaaccatgcagctgttgctgtgggtcataaaatttattcttttgggggatactgcactggagaaaactcccgggagtacacatctatggatgtacatgtgttaaatactactacccttcgatggacacaacatcctgtgagtgacttaccatattttgaaaacgatgatattcttccctacaagagatatggtcatactgcaatagtgtatggggaaaaagtctatatctggggtggaagaaatgatagagcctcatgttcaactctcttctgtttcgatactgtttggcattgttggacagctcctaaaacaactggacattttcccccagctcgagatgggcacacggcttgtttatggaagcattatatgattatttatggtggatatgaagaacactctgatgctttcgctcgaattatatattacttggatttagatactatgcattggacatatgtccctataggtggaccggaaccaactccacgagattttcatacgactgtcgtaatcaatgacagaatgtatttgtttggaggaagaggtaccttacatgatcactttgttggcggaagacaagtgttgtattgtaatgaattgtggtatttggatcttaatacttttacatggcaccactgtaaagtcacgggcaccgtaccagttgggagaagaagccattctgcgtntgtttatgatgaaaaaatgtacatttttggaggatataactcagagaaagatcgacactattataatatatacga

SEQ ID NO: 1882 - DNA, 979 bp, Diabrotica virgifera
tgcctccagagaagtggaagtgattttagcttatagacgcaggcaacgtaccgcgtaacgtgcatcgcagtgaatgagtgaatcgacgattcagggccgcgtgtgatagaaaagtcgacactcactgactgctaacaaaacaaaaatagctaaccggaaaagtttagtagataaacaaacaaaatgagaaccgacaatgttcaagttatagttgggaatattatccattgcagtgatcaatttaatgtgcaattgattgataatggattcattatcatcgcaggttctaagattttagctataggtaccgaatcagatctgtctgaaacggtaaccagactgaaactaaagaactttagcacccggctattaaagaagtcacaaatcctcatacccggtttggtagacacgcatattcatgctccacaatatccaaattgcggtctcggatatgacatgcctctgttggattggcttaacaactacacctataagttggagagacaatataaggatttggaattttcaaaaagagtgtataccactttggtgcaaaaaactctttcccatggtacaacaactgcctgttactttggatgtttatttaacaacagcaccaatatcttggtagacacagtaattgaacacagacagagagcccttataggaaaaattaacatgacacatttggctcctgaagattacatagaaacaccagaagaatctattagtaatacaaaagaattcatcaactatgttttgtccaagcaatcaaacttagtgaaaccgatcattactccaaggtttgcattaagtgttgacatggcattaatgaaagagtttggtgttctagcaaaatatcacaatttacatatacaaacccatatatccgaaaatgtagatgaagtggccttagttccatcacaataaaatgaattatgcgaaagtttatgaccaagctaatctattaacagaaaaa

SEQ ID NO: 1883 - DNA, 968 bp, Diabrotica virgifera
aggacgcgtggcggacgcacgcgttgtggtcgtctgagcaacattaaaacatgttcttgaaagttttaattgccttccacgcggcggcagcactggtatcgatgtcgcaggcggtgccctccgacattcccgaaagccctttagcgtctccttgcccggaaacgtttacttatggaacgattgataaaccaggttattggacaggaaacctcatcttaagaccagatcatgacattagcggagtctgggtcaggctgatatttgataaggaagtggagaaagtgacactaaacagcgaagaattcataatcaaactctcggaggacagtaaaatggtcaaacttcaaagccccgatatgttattgaaagccgataatccaaaacttttggaagtcactgtaaactacaaaggatctgccgtccctagtctacaagaatatcgattgaatgcgagaacaatatgcccccagaaaaatcataaccgtcacgatgttttccttggagacgctaacgcagattactttttatcaagtatccaacataagccagaatcgccaaacataccattcgaatgtggtgtttcttatccatcgaaccaatacccttggcaagcatctatccaccttcattttgctaaagagaaaagatatgcttgcgaagctcttctaataagctctgagtatttgttaacaagtgctcactgtgttacttttataaatgatactgagataattccacgagcatttgtaaaagttcaccttggaagtgataaagaatcaaaggatcaacattatatccgggaaatatttgttcacccaggttatagagctggttcaatcatcgatgacattgctgttatcaagctgcttgattacgtcgatgtaaataaagtctacagacctctttgtttggacaatgaaaacgcagatattgacaaattggttattactggtttcagaatggaaaaa

SEQ ID NO: 1884 - DNA, 1299 bp, Diabrotica virgifera
  misc_feature (1251)..(1251): n is a, c, g, or t
  misc_feature (1270)..(1270): n is a, c, g, or t
ccgtttcggaacaattgtgttttgagcatttttgtactgttttcttaactgcctcgagacagaagcgcaacgtcgcaagcacatgtactacgcccaatggagaattagcaacatgtgcatcaatttatgactgtagacattttgcgaaagcaataagaaatcgcattccatcacaattaaactttgtgaaaaagtcacaatgcggttacgacacgtcacctttggtttgctgtggctctgctatcgaattttcaactactacgaatccaccttcagatccagtgggaaattcaaatccagtgggaagagtacttccagccgcttttactagaagttcagctcttcctgacagaagtacctgtggttttcagaaatctgatgagaacgaaaaggtagaaggacttatttatggaggagtagagaccgagttgaaagatttcccttggatggccttattaggttacagaacgagatacggaacaacaaagtgggcttgtggaggtacactaattagtcacagatatatcttgacagctgcgcattgtgttacaggcgaggtttcaacctctgttggacaacttacgtacgtcaaattgggtgaacacgacaagactaaagaaagagactgcgataagaatggaaattgtaacgaaaaacctgtaattactgggattgagagagtcatgttccatgaaaagtatgacgctactgacagaactagtcccaatgacattgctgttttacgcctaaatcaaaggattacatatacagacttcattagaccaatttgtcttcctgagccaaacgaaggctccactatagatgactatctaacaactgcaggatggggtttaacagaacatgatgcaacaaatgtcaagctcaaggttgatcttcctttccgcacgagagacgattggctgacggcctttagatcagccagacttaggctaactgaggcccaaatatgcgctggaggagaagatggaaaggattcttgtaaaggtgacagtggaggtcccttgatgaaaagatcaaatgaaaattatctccagtggtaccaagagggaatcgtttcatttggaaatgaagattgtggtacagcaggattaccgggaatctacacgaaggtttcaaaattcgtatcatggattcatagccgagttaaagagtagtgactgtaaaatgttccatctaaataaaacaaatgtatgcttaagaatatttgagccttaataatatttatcattnaggagtaactattttttanaataatgttttgtatatctattttgaata

SEQ ID NO: 1885 - DNA, 379 bp, Diabrotica virgifera
acctttgactagagaggatacggccttataggcgttcaggcataatcccacggatggtagcttcgcaccattacccgctcgagttataaatggtgtaactaacacaacctcgactttcttttatatatatagatgtaaaatatttaaatggctattaaaaaataacggtctgagataaaaaattgaaaatttaggattgtatgtatcttttgcttctacatctcataaaaatagtaaaaaacggtttttccaaaaactaaaaaaatatatcagggggggcaacaccccttatgacgtacgggtatgaaactccatattatcctattcccagaccgctagaatatacatgtaaaatttcataaaaatctgttcagtcgtt

SEQ ID NO: 1886 - DNA, 1120 bp, Diabrotica virgifera
gacaattccgagttccaacatcgaaaagattataatacccatgttcgtccgtctaaagatctggtctactggcaaggatcgatcccaccgtaaaccgataatctcaacggaaataagggctcgtgcgacagtcgtagcgaactacgattgcctagtaaagtcacattgttttgagcctttcgactctcggaactccaagagatatcgttgccacctttgactagatctttagacggacgaacatgggtattataatcttttcgatgttggattaaagtttataattggtgtagcagctatattattaagtctgttcgacttttaaaattttacatgatctgagtttaaaccggtgtgagccaggttggtttctatctttaatttattaatatattttagtacgaaaggaccaaatatataaaataatttttatatttagataaatattaaaaaaaaaaaaaagaaaaaaaaaaaaaaaaagaaaaaaaaaaaaaaaggcggccggcccttttgctctacgcgaggtttctgtcctcgctgagctggccttaggacacctgcgttattctttgacagatgtaccgccccagtcaaactccccgcctggcagtgtcctcgaatcgaatcaggctggaggtaagttgacgctcgaaacgaagcacacggacgctagccgagtatccgaaaggcaagccttatcggaaccacgaaaccgacgaacggcacaacgcaacgaaacgtcactccgtgcccttggctcaagaataccgtgacagtcgcagcctcgtgagcgaacgacgcacgcgtttcgccttaccgagtaagtaaagaaacgatgaaagtagtggtatttcaccggcgatgttgccatctcccacttatgctacacctctcatgtctccttacaatgccagactagagtcaagctcaacagggtcttctttccccgctaatttttccaagcccgttcccttggcagtggtttcgctagatagtgggtagggacagtgggaatctcgttaatccattcatgcgcgtcactaattagatgacgagggatttggctaccttaagagagtcatagttactcccgccgtttacccgcgcttgcttgaatttc

SEQ ID NO: 1887 - DNA, 1677 bp, Diabrotica virgifera
  misc_feature (694)..(694): n is a, c, g, or t
agtttttggtgcatttataagatcccaattaatgtgtttttgtttattttgaaaaaataatttttaatgttatattgatgccatcatattcgaaatcacctttaaaacccaataattcaagtttttggtgcatttataacatcccagtgtctcctttcgatatcacctttaaaacccagtaattcaagtttttgatgaatttataagatcccagttaatgtgtttttgttcattttgaaaaaataatttttaatgttatattaatgccatcatattcgatatcacctttaaaacccagtaattcaagtttttggtgaatttataagattattttgaagaatttattattttgaaaaagtaataatttttaatgttatattgatgccattatattcgatatcatctttcaaacccagtaattaaagtttttggtacatttataacatcccagtgtctcctttcgagatcacctttaaaacccagtaattcaagtttttggtgcatttataacatcccagtgtctcctttcgatatcacctttaaaacccttaaaacccagtaattcaagtttttggtgcatttataacatcccagtgtctcctttcgatatcacctttaaaacccttaaaacccagtaattcaagtttttggtacatttataacatcccagtgtctcctttcgatatcacctttnaaacctttaaaacccagtaattcaagtttttggtgcatttataagatcccagtgtctgttagggctggatttcgcgtgccaaaaggaggtttattgatagcaagctgaaaatttttgaagttatacttctttacgatcgagagtgaaattttataatgccgggggcatgcgcacacagacattatgtagttcgttgctaatctttcaaattatgtatgtatcagcgcaaataagtcattaaaaggatatattagtgtttttagtaaatgtattatttattataatttttgtgtctttggatttgtcttcctcgggaataagatgttttataataataataagtatatttaaagtatttttgtatacgtcacttggtccattaaatttgtcagtatgtatgagaaatcttgtaacctgtcaaagcaaagggaatatagctcagtggtagagcataaaaagaaaacagcaaactttatatagtatataaaaaaatgtttgtccgacaagtatgttgggcattttaataagtccgacacgtagaacatgtcaaatgacaggaattatgttggtggtaaatagcagtctgatttttgtatgagactttaatgaaagggtaacaaatcaactggaagttctgtccgacaaaatacatgcgacggtttcgttccacaattttcgtaatctgttccacaattaaaacttccccctgttacagtgtttccgtacatcaaagtttgtccgactagacgtggttaagtaattaacaaattttgagcttgctattaatcgagccttttttggtgcggggaaattcagggctaattttccttacatttaatttactaaaacctccaaaataaaaaaataaatcctttgaaaaatccccattctggccctaaaaatttggttttactaccaaaatttccccaagggtttaatttgattcaaacccaaggggttttttttttttaaggggacgtttt

SEQ ID NO: 1888 - DNA, 1203 bp, Diabrotica virgifera
  misc_feature (1063)..(1064): n is a, c, g, or t
tggcaaaatacaagtggacacccgctattaaaaatggagaatttgatagatctcaaatatgtcaacacgcatgggataatgaacatagagttcagtggagagattcaagtatagtcctgaaagaaacagatagtaaaaagagaataatcaaagaagcggcgttaattatgctaaatgaaacaaactgtgtcgcaaattcctcggtagaatgcagtaggatgtggttaaccatactaaaagaggaagtcaatagaaagaaaataccaagattagtaagtcaataatatcgagctagtacatattttatattttagtattacttatatatctagtattattaatattatttataatttaaacatgttacaagtcagaatttggtattattttttgagagtaaattaatgtaagaccaaatacttacaatgtcgggatagtatcacaggtttttcctggttttcccttgtgatttactatgaggtctctaacgcgagaattttactgtcgttgcatttggttgtctttttaaagacatatcacatgctataattttttatgacggatattcttgagttggggttaatttcatgtaatcgaatgaactatctttcagtaagtcgtcccaggaacgcaactcataaatattggcaatatcattttaaagtcttctactttaaaatgtataatatatatctgaattgccaatataaatgagtgagattaaataaattattagaagaatttttttgcttagcaacaacactttagtttgttttagtaatgttttgtattttggcagcggcacccgatttgggcgtcgaagcgttgatgaggttatttttttcattttaattgtggcttgtttcccgtataaataattaattcgaattgaaaacttataattcatgtatttcctcaaaactttaaataattttgttattcttgatctactgagtacacattcgatactattcttacttaggcaagagttaatcaatgtaccaattttcaaaaccctcggaaccttttgttaaaaagttataatacaggggacatactctgnncattacactattctcacccatttgatgcatttttgatgcacataaagttatggtaagtatttggtcaatacatgcattttgaatattataattttattatattttttatgatgaaaatattgaaagtaaatatttgatt

SEQ ID NO: 1889 - DNA, 440 bp, Diabrotica virgifera
gcgaaaactccggttttggctccccttgagatatctcccacccatctcagtctttgtgattttacgatccatactatgtttggttcaccatacatcctctccaattccacatttggtcttcttatccacattccattccatatctttccgccaaatatttttcttaggacttttctttcccatactttaagcatgacttgctcggatttgttcatcgtccatgtttcactggcatacaagactataggtcttatcactgtcttgtatattcttatcttagcccctctagatatgttcttatttctcaataagttgtttagagcaaagatacaacgattaccagccataattctcgcttggatttcttcttttatatttggtctcctagtgaatgtcgctcctagatattggaatatattgagaccctctatagggttgtg

SEQ ID NO: 1890 - DNA, 1005 bp, Diabrotica virgifera
tttatatacccgagttttttagaaaaaaacaatactttcgtgataaaggacaggcggaagggtttaatcaaactttgaaacaaggtgcgattgggatgctgcttcctttatcctaggaacacgctcactacagacttttataaatacatcccactattcgttgaaagtaaacgcaaattcggtcgatattaatagaaaggaaatgaattggacacatattcaaccagagcgctcgcattaaaattaataaaagtccatatcaaattcttatcaacttaaaaatatgagtaacatggtgttaacgtaacgcacggtagaataagatgacatagaacgtaaaaatctaatatatagaagacaaacaataacaataacgccatcaaaaaacagaagatacccatagattcggccaagacaacccctaagatgacgtaagataagatttttagctctaaactagaaattctgtcgttatcaataataagtaaaacatacaatgttccataaacaactcaagatacaacttctccatctatggcatcaacattaaccaattaattagcttcagagtcaatgtatcacatataacatcttgcattgtatactcggtagatcatgaagaattctggtttgatgtcattaaccaactttaagatctcttgaatgacgggttccttttggttgataatagctttatccatctcttcaatcctcctcttggtgtctacctcgattttcgctgctacatcttctctggagcccatatgcttggcctcaaattcacggaactggcgttctcgttctttacggtacttttcgatttcatcttgagcctcttccttagcctgctttagcctccttgctttgcgttttcgggcctctgtaactttgtctgctgcacgcttctcagctgctaacaattgttgaacaccctgactttgatgactagccatcctgtgagttatttaataatataataagtttaaacacccgcggacgcgtggg

SEQ ID NO: 1891 - DNA, 1599 bp, Diabrotica virgifera
  misc_feature (861)..(861): n is a, c, g, or t
taaaacagaaaaaacaactgaaatttcacttcactacttgaaacaagtaagacattttactggtaatatactgtgtcgtagtaaaactgctttaaatattacatgtcaatctataaaaataaaaactggaaacgtgcagcacattatgcacttgagagaaatactgataaatatctaaaacctatataccaccttctggtccactcaaacttcaataactattgccattattgaatccatttgagtatcctgttgatccgtttgagtaattatttgagttattaccaaatttcctataacctccgccgccgctgccgcctccttggttgttaaaccttttattgaaacctcctcccatttccccaacgtgaattacctttgccatagctgtttgtttttccagcaatttcagtcaattttggatttattgcctggttagtctcattgagaacggagatcagatctctagcttgcttatagttggaaggtgtgaaaaatgcataggacgtaccggcactgtcagaacgaccagttctaccgattctgtgaatgtaatcttctgaggagtgaggataatcgtaatttacaacatattttataccctcaacatctaaccccctggcagctacatcagtagctaccaaaatactagattttccagttctaaattccctcaggacatagtcacgttcctgctggctcttatctccgtgcatggacaatgctgaccaaccaatgcttcttattgatctcgttatcccttcaacttcttttttggtctctacgaaaatgataattttcgagccagtgtcagcattggtgttgatctcttgcaagagacttcccaacttcctttccttntcatgctcctggcagacatcaacgaactgtacaatattattatttgcagataagttctttgaacctatgttgatgtaaactgggttcttcatgaaatcggaggccaatttcctaacctctttgggccatgtagcagaccacataagtgtttgtctgtcgggtctgacttgactgaggatcttgcgaatttgaggttcgaatcccatatctaacattctgtcagcttcgtcaaggaccaaatatgtacatctctctaggttagtagatcccttttcgagaaaatctatgagacgaccgggtgtggcgatacagatctcaatacccctttgtaggtcacgagcttggggtcctttgggagcacctccgaatatacaagagttacggatgttcgtagaccggccaaaatcattggaaacctcttgaatctgttgagccagttctctagtaggagcaagtaccaaaacaattggtccttcccctttatttagaggtggttggttgttgatatgaattgcagcaggtaggatataagctagagtttttccagatcctgtttgtgctaacccaaccatatcatgaccactcattgcaattggccagccttgtgcttgaattggtgtcggagcttcataccccttattgcaaacttccgtcaagatgtaatcagggaaatttgcttcgtcgaagttctgaatggggttaggtgcttccccttcgactgtaatttcttttgctttg

SEQ ID NO: 1892 - DNA, 850 bp, Diabrotica virgifera
aagggggatcggggggggcctttttcttttttcccccccgggggaaagggggaatttttccaaggggattaaattggggaacccccgggtttttcccccccccccgttttaaaaagccggccccggaatttaattttggggccccttttaaaaaatttttgctttccccccccccgttcttaaacttggttccttttagggggccccccccttttttttttttggggtttttttttttttttttttttttttttttttttttttttttttttttttttttttttttttttttttttttttttttctgttttttttttgttttttattaaccatcagtgaaatgatgatacaatgtttaaagaatattttagttacatttaaccaaatataacaacggtacatttgcgatccgcacaactcaaaatgattaactctacatgaactcgacaaagaaacagcaatattcgcagtctccgaatgacaaaaatatagtctatacttcgcccgggcgaggatgttgaacttatttacggcaatcaaaaaaataaataaatgtacaactatatacattctcctccaagtcgtgctcagcaaggggtggggtgacagcaaaaccatctcagtgagctctaaaggtctataaaatggtccgcctccacccggaatggtttgaaacaagcacggctagaagaatatatcatcgaatttggctaaatatttcctaggaaaaatcgattggagtgttgatcattttgagttgtgcggatcgcaaatgtaccgttgttatatttggttaaatgtaactaaaatattctttaaacaaagtatcatcatttcactgatggttaat

SEQ ID NO: 1893 - DNA, 887 bp, Diabrotica virgifera
taattatcaccagcctcttgaggctcatcagcttcgccctgcgtgtcactcgtccaaagtgtgaggttatctcggagaagctgcataataagggtactgtccttatatgagtcttcgttaagtgtgtccaactcggctattgcatcgtcaaagggctgtttagctaactggcaagctttgtctggtgaatttaatatctcatagtaaaacactgagaagttaagagccaatcccaacctgattggatgtgtgggtgtcattttcgccttagagatttcgaatgcatcttgataagctttttgtgaataatcgacgacagtgttcctagtgtcgccggtggctacttctgcgaggtacctatagtaatctcccttcatctttttttttttttttcttttttttttttttttttttattaacttggattttattcataaaaataaagatctaagtactacaacagtgagacagataaatcacacaagttatcttggcttatcattgcagagatcatcataacacaatttacatgtataatcgtaagtaaagggaacattagcttccgttctatagaaatacgaacaaacatcttctccttccatctctgtgtagtagcatcctctttcggttatcggatgacccaaccaggtagcggtaacagtatagcataccacgtctgaggttgtattcttgtttgtgggtatatctgagcaactttgttttgtaattttagatagatctgggtcattgcaacgggttccatcaataagtgaacagtgataacattctgtaggttctttttttgcagccgacaaaactgcaacagccccaatggtaaacaaaacagtcactattttagccatattttcggacgtgtgggtggcccc

SEQ ID NO: 1894 - DNA, 756 bp, Diabrotica virgifera
acagacaattccgagttccaacatcgaaaagattataatacccatgttcgtccgtctaaagatctggtctactggcaaggatcgatcccaccgtaaaccgataatctcaacggaaataagggctcgtgcgacagtcgtagcgaactacgattgcctagtaaagtcacattgttttgagcctttcgactctcggaactccaagagatatcgttgcgccatccacaaaaatcaacgtgttcctctcagtgaacaagaattggtagactgtgacacatcaagaaatgctggttgtaacggaggtttgatgacagatgcctttaactatgttaaacgccatggtctctcttccgaatctcaatatgcatacaccggcagagatgatcgctgcaagaatgttgagaacaaaccactctcttccattagtggctacgtagaacttgaaacaactgaagatgcactcgcgtccgctgttgctagcgtaggtccagtttccatcgctgttgatgctgatacatggcaattatacggaggtggacttttcaacaacaaaaactgtagaaccaacctcaatcacggtgttcttgctgttggatacactaaagatgcattcattgtcaagaactcatggggaactagctggggtgaacaaggttacatcagagttgcccgtggtgaaaacttgtgtggtattaacctcatgaactcttaccctaaattgtaaatgatttaatgcaaatgaaacaccaaatagaattc

SEQ ID NO: 1895 - DNA, 571 bp, Diabrotica virgifera
atttactctgtgtacagtcgtgttctggaaacgtactcaaataagcaggtgtcatttataaacatgtgaaaataatgtttctatatacccttaataaacctaattgattttttctaaatattcaatattttaagacttatggtacacatcatcataagatttaaatatatgaaatatatcatttatataaacaatttataataaatgaaaataataatacataacaataagttataacataatttaaaataggaaaatttctcaacctaatcataatctaaaaactaatttttaatagaccgatattattaagctcgtacctcaaaatatttaatattaataataaaaaaatatatacctctaaatatgcggtgctttacgcgttccaaaccatatctccctgctagaggattccatggaactcgaacgcttatacagaaaagaaaactcttcccggatctctcgacgacgtctccaggtccttttgggttaccccgacgaactctcttgcgagggcccgactttttgacggttccgctaacgggttccggaataggaaccggattccctt

SEQ ID NO: 1896 - DNA, 945 bp, Diabrotica virgifera
gttgttttgcattgtattatcatagtcatccttctgcgccagtgagtgtaaaggccgactataacggacaaaatcttcttatttttcgttatttttcattttataacaagttttgaaaactgaaacaacatgaagtccgttagtttgtttgtatttttggcttgcattgcaggtttatatgctattcagctcaaatgtgcccaccaagaactagacattcctaatgaatggatcgatatgcacaacgactgtgtgaacaaaatgagaggccaagttgaagaggaactgaaagcttcaatgcaatacatggccatgggtgctcatttctcaaaagacaccatcaacagaccaggttttgctgagttattcttcgatgctgctagtgaagaaagagaacatgccatcaaattgattcattatttgcttatgagaggagaacttacatccaacctgagcgaactcattcaaagaaatcttgtgccttcagttacaacttggggcaatggtgtaagtgccttaaaacaagctcttcagttggaagcttcagttactaggaagatcagagatgttaccaaagtttgtgaagaagctgaatctttcaacgattatcatcttgtcgactacctggcaggcgacttcttaggagaacaataccatggacaaagagacctcgccggaaaagtatccgatttacaaaagatgatggcagaacacggagctcttggagaatggctttttgacaagaaacttcaaaataaagccatcgtataaatgttatagttctatacttaagtatttaaactagtttttcttttaccaacataaaactccgtattagatcatatcacaagtctatcttttcgtaaatcttaaatgtaccattatgtattattaaaaaaaaagtttcggaaatataacaaaaataaaagacaattttatttgaat

SEQ ID NO: 1897 - DNA, 952 bp, Diabrotica virgifera
  misc_feature (63)..(63): n is a, c, g, or t
tagctgtttgtttttccagcaatttcagtcaattttggatttattgcctggttagtctcatgnagaacggagatcagatctctagcttgcttatagttggaaggtgtgaaaaatgcataggacgtaccggcactgtcagaacgaccagttctaccgattctgtgaatgtaatcttctgaggagtgaggataatcgtaatttacaacatattttataccctcaacatctaaataagaaaagacatattagaaatcggtcaaatactagccaacctgaagaatttttattcaaacaaaatttaattattatttcgttgaagtattttttatagattgttaggtttcttcagattgactaattatattgtagcctatgtaacatgattaagaatttctttttgatagtcaaatccaaatttatttatttaattttactaaaaaaattgctgtcaaattacgaagtaattcttattcatacctaataaaaataaaaactagatgttacacacaatttcaatgaaattttttctaaaaaaaatcaagaattgataaacaatcacttgttttactataaatagtagtgcgaactgctagttttcgagatgtccatgaatttgagtgcttcgtcttatagatccaacacgatttcaaattcgaacatgtatatatgttttcttaaagtattctattaattaaaaaataaaagaaaacataactaaaaacatactaaccagtttcaaaggaaattccatgagttgtgatctgagtgaataaacgatttaaaggaatagtagcaaaaatattatcctgcttgcttcagttgacctcctgctaccttacggcaattttgtggtctactcaaacatcgcagtaaattgaccaatgggaagacataaaaatgacatatgtttttgtattgaagtgcacaaaaatcccacgtcgtagaaacctag

SEQ ID NO: 1898 - DNA, 1093 bp, Diabrotica virgifera
aaggaacaggtgcatcactatggaattatcaaatgtccaaaaatttaattttgtctggttagcactgtataatgtaacggtgctttgacattttggacaagtatttacattttccacagtaagttttcggtcacctacttcataaaatgtttcaaaaccttcattttttcctagattgagccttaaattagcactggagttgtaatatttagctttgatgtcttctaaaagaacttcataggttaccaagtttcctggcatttgtatacatcgatagctgatggagtatgtattgcaagatgccaggcttatagatgaacacgttgatggtagttggatatttttgagagcttgacctgtttttccagatattatcaaaaatccgcttttcttgtatattgccagcaattcacttacaccgtccttgtttaaatcttctattttaacaggcatatctatttctggtatagatttttcttctaaactgtgagcatgccacagcgcttcaccagagatagtttccacaacttttaaacctctactgtccaccaccaaacagtcattatatccattattgtcgacatctatgatactacagttcatttgtattggaaagctttcttgttgaaaatcccaagctatcgcaccagttgttcccattatagataagattccattcttgaatggtttggtattagtaaaactgcccttgtacatcaatgcaagatttaaatttttctgaaaaacacctcgaactaaattcacacttcccaagaattcgagattttcatgtagagattcccagtttggtatttttaatgagcatgtattgaagtcgttgcaaggtagaatccagaggaaagtaattattggtaaaaagcagaacactatcgaaattgccagagctattttacgttttgttgatagtttatgccgaaaagtcttgaatttgtcgatgtcctcaccgtagtctttcgtgatgtgaccatttttaggctgagaaaaactaactttggtttgattgacaccgtttgttatgtaatgcgaattgccttctaatctgtcctctttttccgaatctgaacggacgaaa

SEQ ID NO: 1899 - DNA, 667 bp, Diabrotica virgifera
atcgcgagcggccgccctttttttttttttttgataacaaatcctttattatcttatataaaaattatacattaatttactttttggatttaccctccaggaattaaaagctgcaggtcttaaccccagatttgcaaggactgttggtattgctgtagatcacagacgaagaaacaaatcagcagaatcaatccaactgaacgctcaacgtcttaaagaatacaaatccaaattaatcctcttccccatccacgaaaagaagaagattagagctggtgaagccactggagaataacgtacaatagcttcgcaattacagggagaagttctccctatcaaacagtcaagtctcagaacaaaggttagagttccgactgatgaggaaaagaaatttgtggcatatgtaacattgaggaatgcccgtgtcgatgcaagacttgtatggattcgcgcgaagagaattgaagaagcttcacaaagctcttaggatgagacttaggttgctgcgagcccaaaaaggaaatcgaaaatgtaaattagagagtgattttacgttttgaaaacaaaggagttgccatcgagtatattagaagaaggaagtggtatgtggtcgaacggggatttgattatgtagaccgatttatttcccactaagaaagacataaga

SEQ ID NO: 1900 - DNA, 934 bp, Diabrotica virgifera
cttataacacgagaattttactgtcatcattgcatgtagttgtcttgtcaaatcacgtcctatgatctttcttaagttgatttcatgtaatcgaatgaactatcttccaagtcgtcccaggaacgcaacttataaatattggcaacataattttaaagtcatctactttaaaataatgtctgaattgtcaatataaatgagtcttaatattttgtattttgagaacgatttcctaagtggaaatcgaaacgtcaaataaacttaatttctaactatttagcttatttccaagcaaaatatgtagtaaattacataagattccacaagaaaatagtttccgaacaatattggacattcttgttctaagtgtgcctttatatcgcaagttatacaacttttttttaacatttgtatttaatcaaacattttatcatgttttattaaatacaagttagattctcattagctttgattctattttacacatgcacaatacagggtgtgacaaaactcaaaaatagttttggctcacactataaaagcaaaaaacagttcggatttattttttgtagagacatttcttaagaaaatcttgagactctaggcaattcttttaataaaaaaaatcggatttgtccgtaatgctcaaaatttgcccttagcaactatttttattaaaaaagtgcagctattttcaaatgatacataaacaaatatatctaattaaaaaacagctcatttttgaacagtttttaaaccatcttcagcatagaagtgctcctatatatttactgttattaggaatcaataatattttccaattttatataattcataatgtgatgattaggaaatagtttagctttagggtccatacatataactaactacatctccaagtgaaattaaagaactgtcgaaacacacacacctt

SEQ ID NO: 1901 - DNA, 929 bp, Diabrotica virgifera
agctgcaagtaatacatccttaaaactgaagtacgactttcctatatttctgaatttgctttctttatctgtaaaacagttactatcgagccctaatgcgcaagatactatcacatctgtggtaaacatggccaaacactctctgatatcgatgtcttgtttcttttcggccaattgttccatgaatttcgtcatttgtccacatgcgtgggttataagcggaaacatcattttcatttttcctgtcgtgaatgtcggggttagttttgttctaatatttttccaatttatttcgtccactacgaagagattttctgttgttttatcatgctttacgtaataaaatcctctgtctacgaagttactaaagtcctttaccaaaatatctctaacatattcaggatctaacaccaagagtgtcggcctggcgactgtgaagaatcctccaactttccatccttgctccctcattttcttgtagcagctgtctaccattcctacggaatatcctttcgccttagcgaaaagactagtacagtttccatatggaaactttggctctagatatggtactccttttttagaccagtatgtgtaggaatacaggaaatatgcgtagaaagatactgctgctacaagaagtagagcagtcccgtaactcaagagggtaagaaacaagctcattttgataggctagctcagttaaatccacaccagcttcatttaaattctacactatgtaccttgtaccgttttggagatgttatgttaaaaactttcaaatttcgcgtgttctaacgaattttacgcatcgtcaacactatttttttataatcttgaaggaattgtttgtgaatgtgagatttgttgtgacaatgtaataatattagcgttttcctaggtcacaatttgttgttcgtaacagattc

SEQ ID NO: 1902 - DNA, 835 bp, Diabrotica virgifera
aaagaggaagtcaatagaaagaaaataccacaattagtaagtcaatagtcgagttagtacatattttatatttttagtattacttatatacccatgtattattgatattatttataatttaaacaaaattatagtaaagtcagaatttggtattaattttgagagtaaattaaatgtaagaccaaatacttacgatgtcgggatagtatcacgaggtttttcctggttttccctcgtgatttactatgagatctctaacgcgagaattttaatgtcaccgttgcatgtgtttgtctttttaaagacagatcacatgctacgattttttttgtgacggatattcttgagttggggttgatttcatgtaatcgaatgaactatctttcagtaaagtcgtcccaggaacgcaactcataaatattggcaatatcattttaaagtcttctactttaaaatgtatcatatgtatctgaattgccgatataaatgagtcaaattaaataaattattagaagaatttttttactaagcaacaacatttttgtttatattaatagtattttgtattttgacaacggcacccgatttgggcgtcgaaacgttaataaaaatcattttttaataatattgtggcttatttcccattctaaatagttaaaaaaggcagttcttcatcaccttaaatggtaagaggagcaggtggagaaaccaaaaaatggcttttcccaatgcggttcaagatttataccaatgatcaggccacttctgtctacacaaaatatttcctatatgtagacgatctggccactacttcaagacactacttaatgtggag

SEQ ID NO: 1903 - DNA, 1312 bp, Diabrotica virgifera
gttgtcggaatacaaaatattaatgaattaaacaaaaatgttgttgcttagtaaaaaaaattatttatttactgtcaccattgcatgcggttgtctttttaaagacagatcacatgctatgatttttttgtgacggatattcttgagttaaagttgatttaatgtaatcgaatgaactatctttcaataaagtcgtcccaggaacgcaactcataaatattggcatatcattttaaagtcttctactttaaaatgtataatatatgtctgaattgccgatatgaatgagtctgattaaattattagaagaattttttacaacatttttgtttaatttattgatattttgtgttgtgacaacgacgttcgaggtgggagtcgaaacgttgaaataaaatcatttttcaagttgaattgtggcttattttccaattagaataataaattacataaatgccacaaagaaatagcttcagaacaatattggaaaattaatttaaaaaatcgaaagtctccactaaaatggaaaacttaactttattgttttaggacctaatcttcactacccaataggtccccataacgctttagtaccttcaaatttagtatcctttcctcccctactattatgtatagtaggaaaaatgaaatattacccatgagcgatcatgttaaatacatattatgttttatgttgcagaaagtagtgaaccagtaattattatatgtaggtacttgcgctggccaattttttttgtgacacggtgacagaaaaatacagcgtgttttatatattagtttatgagtattcttttggaggtgactaaacctccaaaccacgttatgtttattacatagactactacacttatcaggttttcgatgactacatataagcaaattattgataaaaagttctttttaatcaaatcatgacaaatagttttgtaacagaattgattgtgaaacagaatatattgtatatagaaaaaaaatttaattgtgcttccccaaaagttgtggatgagcactcgtttaacaatatgtacattttgattactactcacgaaattttgaactacagagtgcaccctatagtttataataattatctttaagcattttgaataacaaaaatagaaataagagttctaatcctagtttacgccatttttctaaaagatttatttactttcctggtgcaccctgtatagtatttttgcttaattttaatatttctctggctgttttataagagaatgtttttgtgaaataatttaagtggtgtgtccatttgtaccattttgaaagt

SEQ ID NO: 1904 - DNA, 1283 bp, Diabrotica virgifera
aaaaatctatgcctaaaatgccttttagatgcccttccatgaacattatacatcgtcctgttcgaagatcccagactctagcaaaagcatccatgccaccagtagcacatacagagccatcaacttgaaatgatatacaataaactggtttgacatgcccctcttgatgcaagacctcggtgcattggtgtagatcccataacctccacgaattgtcgaaacaacatgttcccagaaatctccccgaaggatgaaatcctattcttgaaaccctatggggcatgtggccttctatgtctgcaataggttcttcacttgcaaaatcccataacttaacagaaccatcggctgcacaagatgccatactgcagattttctcttcactttcactagtggcgttcggatgaaagacaatagctcccacattacaggtgtggccttttaaggtctgctttaattcgcagtcaggaactgaccaaactttgcacaatccactccatgaagcagttgccagtaattttgaatcaggactaaattgacaataggatatgggtctaacatctccaacttgactgcaatagatagacatggcatgaatctttttttgcaactcttgtgttctagctgtttttgtggcagctggcaactcacccattcttcttgcttcttcaagtcgtgctttagcctttggtagggaataatgggctatccataatctggcaactcttagtgaatctggaccttcatggtaccaagttgtttcttgatctttctcatgttgttttctttcttcttctgcctctcttcttattactgcatcctcccctattctgctcagtatatctctaagtcgtgagcgtctatcagctggaccttctccaaataaacaaattgcttcacccaactgccttaagtttcttctaacttcagcatcatctgtagacacattaattgatctagccttccttcttctttcaaattcttcaattaaagcttgtttatctctggacatagcatcttccagttccatatactcggaaggctcctgtacaggtgaagcagctgctggagccgatttttcctcattactatcttcactttgtgcttcaagtctagctttctcagaatcttccaaagaaccataatgaattgttttggtctttttcacgtactgaacttcttcttcgtcggacataatgtgtaaatataaatctaagtctaaaaccagattttaaaattttgttttgatttgtttatatcttaaggttatgttacaacataac

SEQ ID NO: 1905 - DNA, 812 bp, Diabrotica virgifera
cccaaacgtccatttcagaagaaaaatcagaatgaagctgttcatccttgccgctgcccttgtggccacaagtgccaatctaggtgccttcgaaaaatggaccagttttaaggcaacccataacaaatcttacaacgttattgaagacaaacttcgtttcgctgttttccaagacaacctcaaaaaaatcgaggaacacaatgctaaatacgaaagtggagaagaaacctactacttggctgttaacaaattcgccgattggtccagcgctgaattccaagctatgttggcccgtcagatggctaacaagcccaaacaatcctttattgcaaacacgtagccgatcccaatgtccaagctgtagaagaagttgatttctcatcagaagtaacagctgcccttcgtgtcactgatggtgcccttgtagtagtagattgtgtatctggtgtatgtgtacagactgaaactgtactccgtcaagctattgcagaacgtattaagccaattttattcatgaacaagatggaccgtgccctcttagaattacagttggaatctgaagaactttaccagactttccaacgtattgatgaaaacgtcaacgtcattattgccacctacaacgatgattcaggtccaatgagtgaagtccgagttgaccccagcaaaggttcagttgggttttgaatcaggtctccacggatgagctttccctctccaaaaatctctgaaatgaatgccgaaaaatccagattgatgaaattaaactaatgaaccgtttggggggtgagaatttcttcaacccccaaacc

SEQ ID NO: 1906 - DNA, 613 bp, Diabrotica virgifera
attattataaatatatcacttttcattaactgttatccacaaaaatcaacgtgttcctctcagtgaacaagaattggtagactgtgataaggtaaacgatggttgtgacggaggtttgatgacagatgccttcttttatattgaacatcatggtctttcatcagaagaacaatacccctatacaggcgtagatggtcattgcaatcatgtaaaagacaaacaagtctcttcgatcagtggttacgtcgaacttgatgaaactgaaagtgctctagctgatgctctcgctaatgttggtccagtgtcaatagctgtcgaagctgatacatggcaattctattcaggtggagttttcaacaataaaaattgtggagacgctcttaaccacggtgttcttgctgtgggatacactaaagatgtcttcatcgttaaaaactcatggggaacaggctggggtgaacaaggttacatcagagttgcccgtggtagcaacttatgtggtattaacctcatgaactcttaccccaagttgtagataacagttaatgaaaagtgatatatttataataataaatgatataaattacagatttggtttgaatttatttttaat

SEQ ID NO: 1907 - DNA, 826 bp, Diabrotica virgifera
tcttgtatattgccagcaattcacttacaccgtccttgtttaaatcttctattttaacaggcatatctatttctggtatagatttttcttctaaactgtgagcatgccatagcgcttcaccagagatagtttccacaacttttaaacctctactatccatcaccaaacagtcattatatccattattgtcgatatcgatgatagtacagttcatttgtattggaaagctttcttgttgaaaatcccaagctatcacaccagttgttcccattatagatgatattccattcttgaatggtttcgtattagtaaaactaccctgtacatcaatgcaagatttaaatttttctgaaattcacacttcccaagaattcgagattttcatgtatagattcgcaatttggtgtttttaatgagcatctattcaaatgtattaattaatgaagagaggcaagaagcagaaactgaagaggcaaaaaacaggaagagaaactcccaccaatatttattgccggtgttaaaaacatacaataattaaaccaactattgaatactataactagtgtccataatttgtctaggttaatagctgggcaccatttggagtttttccttacatggtagttcctcatacccaactttccgaagtatccaggatggtacttgtcgaagttgattctgtggtggtgcataccaccagcattaccacgacctccaggatgcttacggtgtttgccgatacggccgtgaccgtggcttacatgtcctcttagtttcctagttttctttctgtgtgtcgacatgcggacgcgtgggcggacagaag

SEQ ID NO: 1908 - DNA, 995 bp, Diabrotica virgifera
  misc_feature (962)..(962): n is a, c, g, or t
gatgataatattggcaattcagaatatctgtgttcagctggagggttaaattgtagtcattcaattgaagaagttattcttaaaggtcttaatctttttcgttgaaaagaaaaagcttctcaaataataaaaattaagaataatactctatagaacaaaatgaatggttttacagtagtttttgttgtattttgtgtcggagttgttgttgcagatgactcacaaatatgcccatccgatgattccgttgcttatttccccgccgaagattgctcccaattctggcagtgcacagaaggaaaaccaataattcaaaactgcccacaaggccttcgatttaatacagagttgaatatttgtgattggcctagtaatgctagatgtgccaacgacgacgatagaaataacaaaatacctgaagagaaagaggagagtgacaatgacaatgacaatcaaaatggtaatggaaacaatggtggtgaaatcaaggaggttcaaatatgtgaaaatgttgagtgtccagcagaagatccggatgtggtagttcaaaaacctggccctagtccatcgcagttctgcaagtgttcccatggcatcccgtacttacttgcctgtccagacggattggtctacaacgctgatctagaagtatgtgactatccagaaaacgaaactgatgatcgccccaataattcagacgaagaaaatgaatctaaggaagaggcaaatgatgaaaataatattacttgtcaaggggactgtccagaaactgatggaactccatttgcatcatccaattccaacaacttctgtgtctgtggagggggagttcagcatgttatgaaatgccccgatgggctaatttttaatgtcaaagaaggtatttgcgattggccataatccgcaaattgaaaaagtattaataatcttaatctatcaatattgtatttattgtatttaantgtttttgttagccttaataaataatatacctt

SEQ ID NO: 1909 - DNA, 936 bp, Diabrotica virgifera
tccagtgatttcatataatcagcaacatggatgccaaaaatgtgattcctgtggacttcagcattgaagcttttggattcgctgtcaaaaccaggggaatctttttgtagagtggggaatgtttaagcctccatcgacagctcctttcatggctccaaagacacgggcgccagtactggtacggtttaaacctgtgtccaagtaacacactaccagatcacattttcaatagattcaaattagtttgatcatatgtgaattgacaaatataaagccagacttgaatgttgagtgttcacttaggcaacagtgcgcaatttacccaagcaagcaccaatccaagatctgacagcgcccccagtgtcttaacttcggagatcttacgggatccggtgtttaacaactgaggtaaaccgttgcctataataatgttacgaaaagaatgttttgtcctgaatgctcctggtccttgttcagcagcttcaacattgtattcgtccccagtaacatcagtggtgccactgtataaattgtcaagtcccaattttttgaggagccttctggccaaaagtaaaccagtggcataggcagcagcatagttggtaagaccagttttgattccatatctgggcaattcatgggagtaagcagcacatacaatcttgtctccctcaatacgggagtaagcaatctgacaagtaatgttcctgttggagatacgtacgatcaaacggtacttgggagtgttgtatttgttcttgtcttgaacaatcaatcgtttacgggcatagtaatcagtttttccttgcctacgcctcttgaatttaacctggaacctcttgaagtactgtttgttcttcacaacctttacgaaagccatgttttaaatgtatgtacaaattttattcgtaacctacggttcaacctccaccgcgg

SEQ ID NO: 1910 - DNA, 1014 bp, Diabrotica virgifera
  misc_feature (272)..(272): n is a, c, g, or t
cccaactcaagaatatccgtcacaaaaaaatcatagcatgtgatctgtctttaaaaagacaaccaaatgcaacgatggcagtaaaatgctcgcgttagattattttaatataatttaatatatatttaataatataattcaaagaagctctaattaactatcctaaatgaaataaattatgtcgcaaattcctcggtagaatgcagtaagatgtggttacccatactgaaagaggaagtctatagaaagaaaataccacgattggtaagtcnataacatacgagttagtacaaattttatattttagtattacttattgtatatctatgtaatattaatattatttataatttaaacatattaaagtcagaatttggtattagttttcttgaaggtagattaaatgtaagaccaaatacttacgatgtcgggatagtatcacgaggttttttctggttttccctcgtgatttactatggaatctctaacgcgagaattttactgtcatcgttgcatttggttgtctttttaaagacagatcacatgctatgatttttttgtgacggatattcttgagttgggattgatttcatgtaatcgagtgaactatcttttagtaaagtcgtcccaggaacgcaactcataaatattggcgatatcattttaaagtcttctactttaaaatgtataaaatacgtttgagttgccaatataaatgagtcagattaaataaattattagaatttttttacttagcaacaacatttttgtttattttagtagtattttgtattttgacaacgaaacccgatttgggcttcgaaacgttaataaaatcatttttttggtaaaattgtggcttgttcccattgattataaaaatgccacaaggaaaatagcttcagaacaaacatttaacaaaacaactatgatatctgatttaacaaagaaaaaaggtcaacattctgagttatgtatggccctttttttttttaaatattggtcgcttttttt

SEQ ID NO: 1911 - DNA, 838 bp, Diabrotica virgifera
aatgagggtgttttgctgagaatgtaaaaagaaaaagagctgttaatcaaaataaaaacagccaaaattgaatacctcggtcacatcatgaggaacagtgaaatatatggactgctgcaactggtcttacagggaaaagtagaggaaaagcgaggaccaggaaggcgaaggatttcgtggctgaaaaatctacgtacgtggttcaacataaccactacaaatcttttcagagcagcagtgtgcaaagtacagattgccatgatggtcgccaaaatccgaaacggatagggactacaagaagaagaagaagaagaagaagaagaagaagaagaagaagaagaagaagaagaagaagaaacaaatattaacaaatttatattatttattaattaatatatattaatatatataattaatatatatttatattagcaccactttacataattcagacatattacaataatctatatttattcattggtgtacacttggattctgtagctgagcagttcggtaatggcgggagcaatgtttacggtcacccatgtactgtcaacaccaccatcttctacttcaggtacgctatcgctttggttattgtccacaataacaatgcaggtgattggtttcttcaagaacaagctgtctggtactctaacacggatggtgcttcctacaacggatgttgctacttctttgtcgtatacagctttggttgctttgtctgagttggggcagacagtcagatctctagccaaagagtggttgaccaaaaggactaccaagagtccgaaaagaacagttttggatgccattgttgattcggacgcgtggg

SEQ ID NO: 1912 - DNA, 910 bp, Diabrotica virgifera
gcacgaagatgaaggtactagttctgttttctttagtcgtactcagcgttgctctaccaacactccttggtagaaccgtaagagtcaaagaagatggaactgtatctctcttcgactctagaggataccaactcgtaatcctcaagagtgttgccgatcccagtcaagtcgaagttgttctcagaagtccaaacacaagaacccagatgttccaagttggggaaccacttagaactggagaagctatcgaccgtcgtaccctcgctggtgtttccgtttaccaaaactacaaccaagctgatattcttactgatattttccgtcagtatgaaggtattcttgacgacaccaaatactacaaccttcttaacagaattcaaatgttagttgaagctggactcatcaacgaaaccatctacgatgtcatcagaaactgggatcgtgaataccgtatgcaaggaattagggctcttgaccaaggtttgttgcaaacttattctccactcagacatttccaaactctgctcggacaaatccaacagcaacgtgtacttcaacaaggtttattgacccaacaacaatatttacctcaacaatatctatctggggaataccttcttgaagatcaaatgaacactaaccaaatcttgaaccaaatttatagacaacaacttggacaatctccattgaaccgttatttggttaacatgagacttgtaaacggagagcaagtatacgaagttcctgaagaattcgttaacgttcaacttctcgaacaactcttcgccaagcaagaattgatcaaccaagaattgactgaaatcaccgaaagaagacaaccaatcactgaagacgttcactaccagcaacaactgattaaccaacagattcaaaaacttattgaacaatt

SEQ ID NO: 1913 - DNA, 976 bp, Diabrotica virgifera
atcaatttcaagtttcaagaaaaagcaaatcactacgacttgccggattttgtagtagtgttaattttgtattaaaaaatcaaaatgagttctattggaactgggtacgatttatcagcttcccaattctctcctgatggaagagtatttcaagttgaatatgcaatgaaagcagttgaaaatagtggcaccgtaataggcctccgaggtacagatggcattgtattggctgctgaaaagctcattatgtcaaaattgcatgaaccaagtacaaataaacgaattttcaacattgataaacacataggaatggcattttcaggcttaatagctgatgcaaggcaaatcgttgagattgctagaaaagaagcatcaaattatagacatcaatatggttcaaatattcctcttaaatacctaaatgatagagtaagcatgtacatgcatgcatacactttatacagtgctgttagaccatttggttgcagtgtcatcttggccagttatgaagatagtgacccatctatgtatctgattgatccatctggagttagctatggatactttggatgtgctacaggtaaagcaaaacagtctgcaaagactgaaatagaaaaattgaagatggggaatctaacatgcaaagaacttgttaaagaagcagccaaaatcatttatttggtccatgatgagctgaaggataagaattttgaactggaactttcatgggtatgcaaagatacgaatggtttacataccaaagtgcctgaatcagtgtttgctgatgcagaaaaagctgccaaacaagcaatggaagcagattcagaatcagatacagaagatatgtaataactacatttagtttttaatatttcgctgatggtggctgttcttacaatatttttcgtgtgtatgtcatatattatgtaatactgtgagaatttccatttcagggataggtttataaacttttttt

SEQ ID NO: 1914 - DNA, 431 bp, Diabrotica virgifera
gcattgtattatcatagtcatccttctgcgccagtgagtgtaaaggccgactataacgaataaaatcttcttatttttcgttatttttcattttataacaagttttgaaaactgaaacaacatgaagtccgttggtttgtttgtatttttggcttgcattgcaggtttatatgctattcagctgaaatgtgcccaccaagaactgaacattcctaatgaatggatcgatatgcacaaagaatgtgtgcacaaaatgagaggtcaagttgaagaggaacttaaagcttcaatgcaatacatggccatgggtgcccatttctcgaaagacaccataaacagaccaggttttgctgacttgttcttcgatgctgccagcgaagaaagagaacatgccatcaaattgattcattatttgctcatgagaggagaac

SEQ ID NO: 1915 - DNA, 2829 bp, Diabrotica virgifera
  misc_feature (1626)..(1626): n is a, c, g, or t
aaatcggtagtcgaatttaaagttcctacataaagtctgtttgctgttgtaatccatctcgaatgtgccatctttcccggttgtcgatattttaagctctctgatacggtaccattatttacagatttgcttatttcgtacaaatatttttggtctgtacttaatgtattaatatctacttcaggaagttgtactgtaatgtattataagttgtattgtaatgtattaatatctacttcacttttaattttttaaattcaaaaacaggtagggttgtttcacccgaaaatccggtaggtcctgcggtttctccatctaaatacttcatctaatgtcgtaatggtagctcgtttccatataaatgacaaagagaaccactgtaatggtttcttaatttgaagttctaatttgcgaattgcaccattgtgaacgccagtatttaccgctgttccatcgcatccaattgcaaccaaagtagaaaagtcacatttcgattttaagaaattgaataaattgtctgcaatattttttgctgagccagattgtaaagtaagatgtccaaaatactcagagtttggatctgaaactaacacaatgttcttcggtaatcaactattctaaatcgtaaataagccacaatttagctaaaaaaatgatttcaattttaattcatgagaattttactgtcaccgttgcatttggttgtctttttaaagacagatcacatgctatgattttttgcgacggatattcctgagttgggattgatttcatgtaatcgaatgatcagtaaagtcgtcccaggaacgcaactcataaatattggcgatatcattttaaagtattctactttaaaatgtataatatacgtctgaattgccaatataaatgagtcagattaaataaattattagaagaatttttttacttagcaacaacatgtttgttttattttaatagtattttgtattttgacaacgaaacccgatttgggcttcgaaacgttaataaattcattttttagtgaaattgtggcttatttcccataaaaagtacgtaattataaaaatgccacaaggaagtagcttcagaacaacacaaaaacaagaatttgttatctttttgtgttttacaccggttaattggcttgttattgtcttaatacaggaccgtaatcagatcaaatgatttatttcaacgtttatttaaatggataacatcaattccgaattagcttaagaaatgaactccatttcaccaccaacacctataaaaacatattcagcagttaccatactccttctaatgctagttttcctttcagaaagcaatctgttgtatttagctcgttggaaaatgtaaaacttgaagattaccttatatcacttagatcagttatataaggtaaccttcaattttttcaataattacaaacaagaattacgcaactcataaatattggcgatatcattttaaagtcttctactttaaaatgtataatatatgtctgaattgccaatataaatgagtgagattaaataaattattagaagaatttttttgcttagcaacaacacttttagtttattttagtaatattttgtattttgacaacggcacccgatnttgggcgtcgaaacgttaataaaattatttttttcattttaattgtggcttatttcccatataaataattaatcataaaaatgccacaaggaaatagcttcagaacaacatataaaattcttaaaaggcaatgttaaagtttatcagacaaaatttgttattggtgattattaataggtgaacctaatgcaaaatcattagtatcgatgaaaattcgcgattttgcgtcacaatgacgacctctcgtggatttcggcggaactagcttcgagggagtttttattaggtttgttctagcaaacagtcaaactagtcacaaaccgtcagcaaacagttggtcagtgagagaacataatacagtcaccagtgctatcccctctactcgcactggtcgactattcgctgatggtttcaaaccgtttgaaactgatgctagaacaaacctattattaactatcgaagaaaacttgtgtacttcgaatatgtgatgagaaggcaaaaatactcatcattagagggcaaaagtacatcttttattaaatattacttccaaaatcattcaaaatcgattaataattgaaaattttactggaatgcttccaatttaaatagatcacacagtacaagactcaaaaatttactaaatgtctctaaaagttgtcattttattgaaaaaatctgaaacggtttctttttctgagtgaaaataacgttatttcaaagcactatgaaaataaaatgaagtatagccttaaaaataatatataataatctatttgcacattctgattattctaatataacaaaacaattgcatagtcaagataaaaagcttaaaaatttacataaataaaaatatcatgtatactggacaaaagcaaacaatccgacatatgggatactaccgaaaccgacaagaatatgtcattattgacatcagtagatgcaactactcagtctattaaattaacatgatttctcattactaaaaaccgaggtagaggctttaggaagaattaattatccaatgcttattgtacataaacatcttgtggcgtttgacagattgatgacatctgtcactgtcaagaagcacgccaaataccctttcccgccaaaaaataatcatcgcacaccatttatccaactaaatctcagctattaatcacaaaagtcagtttcttgagtcgaattgtttatttt

SEQ ID NO: 1916 - DNA, 774 bp, Diabrotica virgifera
cctttaggggggccccccctttttttttttttttgttttcttcttttttttttttttttcttttttctttttttttttttttttttttttttttttttttttttttttttttttttgtcagatatttccatttattagttttatagagtctgtaaaccactggactactatagtcggttcgctaaactcagacacaaccggccagtgaccccagtaagtcattttgccaatttggcaaaattggcaaaaaaaaaataatcactaaatacctagttagtaattttgccaaaattactaaccaattttggcaaaactggcaaaaaacaaaaaatgacctactaaaatcactagccagttgtgtctgagtttagagaaccaactatgtatactaatcttattcttaatacgaaattatgaacaataaaatattgtcgtacctataataataaaatgatgacgtttaattagctggtgttggtggttctgttgttgttggagggggtactgttgtagttgttctatctccacactccacgaggtcaggagtttcacaaagactcttttctatattaaagtatgttccaggagcacaagtcaacttaattggatctccgttatcacattcataaaatactgcacattccactgaatctgggagatatacgggggtttcatcggtggtatgtgggcatgttccttcaggtttgctaatagctaaagcaacacaacttaaaagaagcacaattttcaacatcattttgcggacgcgtgggt

SEQ ID NO: 1917 - DNA, 967 bp, Diabrotica virgifera
caagtggcatcttgtctcgtaagttttgaaaataattcttttaaagtttttgccatccattagtaatatttgataatttttgaaccaataaatagtaacatgaattttaatattaatttggatattatttctagaacaattcgtataattattggcaattttaacattttcaattttgttaacctgtcttttactctaagcctaagtttcctaagtttttaattagtaattaagtataaaaatttagattgttgctcaatacgacataaacatttattaaattaaacatgccacaagaaaagtgtctcagaaccttccaaatttggataggatttgaggtttatcgtaactcaaattaaacgtaaagatgtcgggaggaatcgaggctttaagccttaaagaggacgatgttaccaagatgttggcggcttccacccatcttggaacagcaaatgttgattttcaaatggaacagtatgtatacaaacgtcgtcatgacggtactcacatcatcaacttaaggaaaacgtgggaaaagattctcttggcagcccgtgccattgttgctattgaacaccctggtgaagttttcgtaatttcatctcgtccctatggccagcgtgctgttcttaagtttgctgctcacactggagctacccctattgctggaagatttactcctggtgcttttaccaatcagatccaagctgcattcagggaacctcgtctgttgatcgtcactgaccctgcttttgatcaccaacctatcactgaagcctcttacgtaaacattccagttattgctttgtgcaatactgattctccattacgttttgttgatattgccattcccggaaacaacaaagcctcacacagtattggtttactgtggtggcttttggctagagaggttctccgtcttataggaatcattccacgggataccaaatgggatgttgtagtagat

SEQ ID NO: 1918 - DNA, 900 bp, Diabrotica virgifera
cggacgcgtgggcggacgcgtgggcggacgcgtgggcgttggcgtatcgtaatttttggttgtgcttgagaaaatcgtcaaacatccaaaatggtgaactttaccgtagatgaaattagggccatgatggacaaaaagaggaacatccgtaacatgtccgtcattgcccatgtggaccatggtaaatctacattaacagattctctagtatcaaaagctggtattattgctggtgccaaagctggagaaaccagattcacagacacaaggaaagatgaacaggaacgttgtattaccatcaaatcaactgccatatctatgttcttcgagttagatgataaagatcttgtgttcatcaccaacgctgaccaacgtgagaaagatgtgaaaggtttcttgattaaccttattgactctcctggacacgttgatttctcatcagaagtaacagctgcccttcgtgtcactgatggtgcccttgtagtagtagattgtgtatctggtgtatgtgtacagactgaaactgtactccgtcaagctattgcagaacgtattaagccaattttattcatgaacaagatggaccgtgccctcttagaattacagttggaatctgaagaactttaccagactttccaacgtattgttgaaaacgtcaacgtcattattgccacctacaacgatgattcaggtccaatgggtgaagtcagagttgaccccagcaaaggttcagttggttttggatcaggtctccacggatgggcttttcactctcaaacaattctctgaaatgtatgccgagaaattcaagattgatgtatttaaactaatgaaccgtttagaggcgcgagaacttcttcaaccccaaaaccaagaaatggtccaatcaaaatgatgatg

SEQ ID NO: 1919 - DNA, 604 bp, Diabrotica virgifera
attttaatttttcctaattcctttatttatcctatattatttttctttaatatacaattttttagttttttttttttcttcttttttttttgaaaaaaaatttctatttccttataaatattacatttacttcttcttagatacaccaacagtacgtccacgacgtccagtagttttggtgtgttgacctcttactctaagaccccagtagtgtctcatacctctgtgggcacgaattttcttcatcctttccaaatcttcacgaagtttggagtcaagactggaagaagtcaactgactgtatttaccatcaatgatatctttttgtctgttcaagaaccagtcaggaattttgtattgacgtgggttggacataatggtaataattttctctacttcttcgtcggaacattctccagcacgtttgtccaagtttacgtcagcctttttgagtacaatgttggcatatcgtctacctacacccttaattgctgtaagagcgaattgtaccttcctcttaccatcaatgttcgtacctaagatacgaagaatgtgttggaacttctctggtattaccaaagacattttgtatgaccggacgaaa

SEQ ID NO: 1920 - DNA, 1418 bp, Diabrotica virgifera
aaatcattggataaatcccggctataatagcaaatacagctcctatagataatacataatgaaaatgtgcaacaacataataggtatcatgaagtacaatatcaattgaggagtttgctaaaactacccctgttaatcctccaactgtaaataaaaaaataaaacctaaagctcagagtgttactggactatatgtaatagtagttccatgataagtagctaatcatctaaatactttaattccagttggtacagcaataattatagttgctgaggtaaaataagctcgggtatcaacatccattccaactgtaaatatatgatgagctcaaacaataaaacctaataagccaattgctattatagcataaattattcctaaagtaccaaaagcttctttttttcttctctcttgcctaacaatatgagaaattaatccaaatcctggtaaaattaaaatatatacttcaggatgaccaaaaaatcaaaataaatgttgatagagaattggatcccctccaccagctggatcaaaaaatgatgtatttaaatttcgatctgttaataatattgtaatagctccagctaaaactggtaaagataataataataaaagagacgggggaagcaatcaaaatcttatattatttattcgagggaatgctatatcgggagcaccaattattaagggtacaagtcaatttccaaaaccaccaattataataggtataactataaaaaaaattataataaatgcatgagctgtaacaataacattataaatttggtcatttccaattaaagatccgggccttcctaattctgctcgtactaaaattcttaatgaagttcctaccattcctgctcaaattccaaaaataaagtataaagttccaatatctttatgattagttttttttttttttttattttagaaatttattatccttaacatcttacgcacacaatacacaggctcctccaacagctttaattttgtcttctgcattttttgagaagaatttagctttaacaataacgggttgttcaggtaggcgatcatcagggctatacgtattttcgaaactgctgaccgaaacaattcgttgttgctagagctataccattcccgtagattctttagccaggagtttcgtcttcttcctatggacctttttcctgctatcttcccctgcataattattcgtctctggacatataaaacgataattgggcccatggtcacatacacatcactcgtatggtggccaaaaacacaacaaacaactaatgccaagctgcaaaaagtgcaccggctagcttgtctgagaatcacaggggcaatgtcaacatgccccacggcagccttagaagcgatgctgaaccttcctcgcctgcagttctgcataagaagggag

SEQ ID NO: 1921 - DNA, 1013 bp, Diabrotica virgifera
taatattattaatataagtaatattgaatgcctacctagctcaggaagaatacatatcagcaatatagtctgactttactccccgttttcgcacttcatcatggtttccacctctctctcgttcttcctctttcgctcttgatagccaaaggttgaaatcatcatcgcttctttttcttacctcatcatggttaccatctctttctctttcttcctcctttgctctcgataaccataggttgaagtcatcgtcacttctttttcttacatcatcatggttaccacctctctctctttcttcttcgttggccctggatagccacaggttaaaatcatcatcacttctttttcttacgtcatcatggttaccacctctttctcgttcttcctcgttggccctcgatagccaaagattgaagtcatcatcgcttctttttcttacatcatcatggttaccacctctttctctttcttcctcgttggctctggataaccaaaggttgaaatcatcgtcacttctttttcttacatcatcatggttaccacccctctctctttcttcctcgttggctcttgatagccacaggttgaagtcgtcgtcgcttctttttcttacatcatcatggttaccacccctctctctttcttcctcgttggccctcgatagccaaagattgaaatcatcatcgcttctttttctgacatcatcatggttacctcctctttctctttcttcctcgtttgctctcgataaccacaggttgaagtcgtcatcgcttctttttcttacatcatcatggttaccacctctttctctttcttcttcatttgccctcgatagccaaaggttaaagtcatcatcgcttctcttttctagtgtgccttctttatatcctatgcttcgtttctcattaataacatctgatatttttctatacgccgaaatggcttgaaataagaaaagtgctaaaatgcaccttatgattaaatgactcatcttgcccacgcgtccg

SEQ ID NO: 1922 - DNA, 1463 bp, Diabrotica virgifera
  misc_feature (1298)..(1298): n is a, c, g, or t
gcataacaaatgttacttaaaattgtgtaaaattcttgatattgcattttaatttagttacatctaaaaaatttttttgcacccagaagtttgattggataccagcgccacgttcccgaaactttgaaatgaaagccgcatcatttgtttgaggttaaaaaattgtaaaatgtcagcgtcttcatgtgttgagattattgaagccgaaataagtccggcaaagaagaaacctaaattaaatatagatgaaaacctgatacaacaagaaagtaaaagtataaacaatgaccttacggatctgtcaaattttaatataactgaaattttatctaacaacacaaatcgaaaaactgtttgcctgagaggcagttttgaatccaaagaaggtgaggctgttgtaatattagaaaaatctgcgtttgtagaggaagatttaaagacaaaagagtatttcaacaagagtagtttattggagaagaccttccagaatgatatctatggagattaccactactttcccaatagagacttgagtgttattaaaaccactgtaattcatccagcaactgagaagcatttagttaaattctcagcgcagaagctctatattgttgatgagacacctaaattatatgaggaagtaattttgccacaattgtctgatgaacaacttcatttacagtgggtatacaatattcttgagcacaaatcagaagtagaaagattggtgtttgaagatacagatcctgtaaatggatttgttatggtgcctgatttaaaatggaatggaaaagtagatacactatatctactagcaattgttaatagacgtgatattaaatctataagagatttgacaggtgaacacttgccactgttgaagaatatacaacaaaaaggaactgaagctattaaatcaaaatattcattggacagctcgagactcagaatttatcttcactaccaaccttcattctatcacctacatatccatttcggttatctacaacatgaagctcctggtatactaacagaaaaagctcacctcctttcccaggttatcagtaacattgagctattaccagattattatcaaaaagtaaccataccttttgtcgtacgagagcaagataaatttttcaaaaagttagaagagaagggggttctgtcaaagtcttagcatgacaagcctgtataaatctgttttgttcgaaattagaccaagactacaatgcgttaatgcattcatcaccttgtctagtggtcatcaaactattgaagtaactttggatgatganattgtaataatgacgataggaacagaagtagctagaattccttgtcgaggtatcaaaataatatcaaatagtgtcagttgtttaaaagtactgatacattttgtacatttagatttttcacagaatcagctgaagaaataggtagctttaaaacggaacttttgc

SEQ ID NO: 1923 - DNA, 575 bp, Diabrotica virgifera
agttcattcagaagaaaaatcagaatgaagctgttcatccttgctgctgccctcattgtggccacaagtgccaatctaggtgccttcgaaaaatggaccagttttaaggcaacccataacaaatcttacaacgttattgaagacaaacttcgtttcgctgttttccaagagaacctcaaaaaaatcgaggaacacaatgctaaatacgaaagtggagaagaaacctactatttggctgttaacaaattcgccgattggtctagcgctgaattccaagctatgttggcccgtcaaatggctaacaagccaacacaaaccttcattggaaaacacgtagaggatcccaatgtccaagctgcagatgaagttgattggagatcaagcgctgacttgggagtaaaggatcaaggaagctgtggatcatgctgggctttcagtaccaccggatccctcgaaggtcaactcgccatccacaaaaatcaacgtgttcctctcagtgaacaagaattggtagactgtgacacagtaaatgctggttgtgacggaggtttgatgacagatgcctttaactatgt

SEQ ID NO: 1924 - DNA, 3792 bp, Diabrotica virgifera
tttgttttttgttgttttttttgttagagaagtgaactttttgggagagagggtggggggaaaatttttttaattttattgcctctttgaagttccccccccctttcaaggggcaaaaattttcaacccttgttatgtaatggtcccttaaaaatttattgtttttttttttcttaatataatttatataaaaagcgggggaataaataaatttatgcgtggttattagaaaattttttttgaaagattccctttggtcccgaaattatccaacctttccttttaccttgaaaaaaaaaattccctttttaggttttgccaaagccaaatatacctttggcaatttagggaagaaattattcaattttggatcttttggtttttttcatagaggaatgtaactttttggaatcgtagtgttgaaatagttctaccttattgtaccttcgaaataatcgacaccttcaatgtgaaaaaattgtcaaacctttatattaacctatcatttaagattttttgtagttttttcttgatatagttttataagaaacggggagtaaacaatgtatgcgtcgtatttgaaatgtttttggaagatttctttttgtaccagaaatattgcaagctttctttgtagcattgaaaaaaaatttaccttttagggtttgcttagacaaatatagctttgggaatctagcgaagaaattattcaagtttggatcttttgatttttcatagagaaatgtaactttttggaatcgtagtgctgaaatagttctaccttattgtaccttcgaagtaacctacaccttcaatgtgcaaaaattgtcaaacatttgtattaatgtatcatttaagatttattgtagttttttcttgatatagttttataagaaacggtgagtaaacaaggtatgcgtcgtatttgaaatgtttttggaagatttcactttgtaccagaaatattgcaagctttccttgtagcattgaaaaaaaatttaccttttaggttttgcttagacaaatatagctttgggaatctagcgaagaaattattcaagtttggatctttagattttttatggagaaatgtaactttttggaatcgtagtgttgaaatagttctaccttattgtaccttcgaaataatcgacaccttcaatgtgaaaaaattgtcaaacctttatattaacctatcatttaagatttattgtagttttttcttgatatagttttataagaaacggggagtaaataatgtatgcgtcgtatttgaaatgttttttgaagatttcactttgtaccagaaatatagcaagctttccttgtagcattgaaaaaaaatttaccttttaggttttgccaagacaaatatagctttggcaatctagcgaagaaattattcaagtttggatcttttgattttttatttagaaatgtaactttttggaatcgtagtgttgaaatagttctaccttattgtaccttcgaagtaacctacgccttcaatgtgcaaaaattgtcaaacctttgtattaatgtatcatttaagatttattgtagttttttcttgatatagttttataagaaacggggagtaaataacgtatgcgtcgtatttgaaatgttttttgaagatttcactttgtaccagaaatattgcaagctttccttgtagcattgaaaaaaaatttaccttttaggttttgccaagacaaatatagctttggcaatctagcgaagaaattattcaagtttggatcttttgatttttcatagaggaatgtaactttttggaatcgtagtgttgaaatagttctaccttattgtaccttcgaaataatcgacaccttcaatgtgaaaaaattgtcaaacctttatattaacctatcatttaagattttttgtagttttttcttgatatagttttataagaaacggggagtaaacaatgtatgcgtcgcatttaaaatgtttttggaagatttctttttgtaccagaaatattgcaagctttccttgtagcattgaaaaaaaatttaccttttaggttttgcttagacaaatatagctttgggaatctagcgaagaaattattcaagtttggatcttttgatctttatggagaaatgtaactttttggaatcgtagtgttgaaatagttctaccttattgtaccttcgaaataatcgacaccttcaatgtgaaaaaattgtcaaacctttatattaacctatcatttaagattttttgtagttttttcttgatatagttttataagaaacggggagtaaaaaatatatgcgtcgtatttgaaatgtttttgggagctttcactttgtaccagaaatattgcaagccttcgttgtagcattgaaaaatgagttaccttttaggttttgcttagaccaatatagctttggaatctagcgaagaaattattcaagtttggatcttttgatttatcatacataaatgtcactttttggaatcgtagtgtgtaaatcattgtaccttgttgtaccttcgaaataatctacatcttcaatgtgataaaattgtcaaacctttgtattaatgtattatttaagattttagttttataagaaacagggagtaaaaaatgtatgcgtcgtatttgaaatgtttttgggagatttcactttgtaccaaaaatattgcaagctttcgttgtaacattgaaaaaaaaattaccttttagcttttgcttagacaaatataactttgatttttcatagagaaaatgatgatcttttgatttttcatagagaaaatgatgatcttttgatttttcatagagaaatgtatctttgtggaatcgtagtgttgaaatagttctacctcattgtcccttcgaaataatatacacattcaatgtgaaatcaattgcctaaactttggattaatctaccatataagattttttgtagttttttcttgataaaggtttataagaaatggggagtaaaaaatatatgcgtcgtatttgagatgttgttgggagatttcactttgtaccagaaatattgcaagctttcgttctagcattgaaaaaaaaatttaccttttaggtttgcttagacaaatatagctttgggaatctagcgaagaaattattcaagtttggatcttttgattttttatggagaaatgtaactttttggaatcgtagtgttgaaatagttctaccttattgtaccttcgaaataatcaactccttcaatgtgaaaaaattgtcaaacctttatattaacctatcatttaagattttttgtagttttttcttgatatagttttataagaaacggggagtaaaaaatatatgcgtcgtatttgaaatgtttttgggagctttcactttgtaccagaaatattgcaagccttcgttgtagcattgaaaaatgagttaccttttaggttttgcttagaccaatatagctttggaatctagcgaagaaattattcaagtttggatcttttaatttttcatggagaaatgtaactttttggaatcgtagtgttgaaatagttctagcttactgtaccttcgaaataatcgacaccttcaatgtgaaaaaattgtcaaacctttgtactcatgtatcatttaagatttattgtagttttttcttgatatagttttataagaaacggtgagtaaacaaggtatgcgtcgtatttgaaatgtttttgggagatttcattttgtaccagtaatattgcaagctttcgttgtagcattgaacaatgatttaccttttagggtttgct

SEQ ID NO: 1925 - DNA, 1113 bp, Diabrotica virgifera
cctctcgcgtccgataattaatgataaaaacattgtctttatcaaaagattaaagaggttattaagcgattgatgatttttccataaaatattccccttccacgtaatcgtctgcgcacacatcacttttatcgtccaagttcaatgtttattattgcggctttcacttttgtataaaagcaatccagaaagaatccaaccggttgacggtttaaagcagtcgttagtcgttcagtttttggtttatttagtttaaaagaacgagtaacatggcaaacagagactcagctactaaccaattacttaactacaagaaaaagactcaagggggagagtctgtaacaactggatatggcaaccccgtcggacaattcgcttctttgagcgtcgggcccagaggccccatactattccaagatcaaatcctagtcgatgaactttcccactttaacagggaaaggattcctgaaagagtagtccacgctaaaggagctggtgctttcggatattttgaatgtactaatgatatcacaaaatactcagcagcaaaattattttcttccatcggcaagaagaccccaatcgctatccgtttctccaccgtcggtggtgagtctggatcagcagacacagtaagagatcccagaggtttcgcaatcaaattctacaccgaggaaggcatctgggatttggcgggaaacaacacacccatcttctttattagagaccctatcttcttcgccagctttatccgcactcagaagagaaatccacagacccaccttaaagaccccgacatgttctgggacttcatgtctttgaggcctgagactatgcaccaattattattcttgttctcagacagaggtattcctgatggatacagacatatgaacggatatggatcccacaccttcaagtttgtcaacaaaagaaggccaggtacatttttgtaaattccatcacaaaactgaccaaggaatacaaaatctcgatgtcaataaagctgatgacttgtctgcatccgaccctgattacagcatcagagacctggtcaacgccatcgccgatggaaactacccctcatggacaacttattgtcaaataatgacc

SEQ ID NO: 1926 - DNA, 821 bp, Diabrotica virgifera
attgatatctgacatatacttcgacagatacaacagaaaacaaatagagcttggtagcagtttttattttaatacatatacatttatatatagcacatccaaagtgagtggtttacggtaaacataggtactttaggggaaggggcagatattggcccatgtaatggagtgcaaaattaagttggcagactaaatgtaattaaataactgactcaaaataaatgatgagggtaaaaacatacccagcggcttcaacaaaagcatcaattagttggcagtgtcgaaacaaaccaaacagccgttttatttaagtgatttgtgcagtgatctatatggttttcgaaatggctgatatcatgcaataatatatttttcttacttatttgaacgctgcactaatgttttttagtattgtctatcgacttctataaaatcaagtaaggactacagatagaccttgatctgcatatttgttctacaaaatatatatttcacataacgtaattccaactcttaaaaaaaacttttggttaaaaccgctgtatttgcctttaccccgagaggtaagttctggggaaaagttcaacaatgaacaaatacaaaataaaaaagataacctaaaacaatgttattaaataataaatgtaatagttaacaagttacaacttaaaaggtgctaaaatttcaaaaaaaaattttcaaaattctagaaggagataaatatacatttaatatataaaaaattaaaaaccattacagtactgaatatatatataaaaaaaaacaaaagttgatgcagaagaattgacattgaatcacac

SEQ ID NO: 1927 - DNA, 872 bp, Diabrotica virgifera
aaaaattggcgttgttcttttttcatacttggaattcctaattgtaaagctagctccggagcataattcatcaacgatactttagctgcaagtaatacatccttaaaactgaagaacgacttgcctatatttctgaatttgttttctttatctgtaaaacagttactgttgagcccgaatgcgcaagatactatcacatctgtggtaaacatagccaaacactctctaagatcgatgtcttgtttcttttcgaccaattgttccatgaatttcgtcatttgtccacatgcgtgggttataagcggaaacatcattttcatttttcctgtcgtgaatgtaggggttagttttattcgaatatttttccaatttgtttcgtccattacgaagagattttctgatatcttatcatgcttgaagtaataaaatcctctgtctacgaagttactgaagtcctttaccaaaacatctctaacatattcaggatccaataccaagagtgttggtctggctattgtaaagaatcctccaactttccatccttgctccctcattttcttgtagcagctgtctaccacacctacagaatatcctctcaccttagcgaaaagactagtacagtttccatatggaaactttggctctagatacggtactccctttttagaccagtatgtgtaggaatacaggaaatatgcgtagaaagatactgctgctacaagaagtagagcagtcccgtaactcaagagggtaagaaacaagctcattttgataggctctgacaagataatgtacggttgacccctacacagaaatgcacggcttgaagaagaagactatagtcacagcatccgtcacacaatgtaagttac

SEQ ID NO: 1928 - DNA, 1895 bp, Diabrotica virgifera
taatcaaaaaaattggatcaaaaaattattaattaatataataatataaaaaaagttaaatttattttttaatcacccccaattaaaataaatttattatataaataaatttaatactaaaaaaacttattaataattttataaaactctatagggtcttctcgtcttttaaaaaaatttaagctttttaacttaaaaataaaattctttataaattaaataaagacagtttttttttcatccaacccttcattccagctttcaataaaaaaactaatgattatgctaccttagcacggtcaaaataccgcggccattcaaattaatcagtgggcaggcgagactttatatttaatacaaaaagacatgtttttaataaacaggtgaaaaaaatgttgccgaattcctttattaaacctatatatttttactaaatatacaattttttaatactaatattatcatcattactaaatttaaataatttaaatttatattttaataaaaaatttataaaaaaaaaaaaaagggcggccgccctttttttttttttttaatttgatgataatattggcaattcagaatatctgtgttcagctggagggttaaattgtagtcattcaattgaagaagttattcttaaaggtcttaatctttttcgttgaaaagaaaaagcttctcaaataataaaaattaagaataataccccaattaaagaaattagtgatccaatagaagatacaatatttcataatataaatacatcaggataatctgaatatcgtcgaggtattcctattaatcctaaaaaatgttgagggaagaaggttaaatttacaccaataaatataataaaaaattgaatttttaaataaaaattatttaaagttatacctgtaaataaaggaaatcattggataaatcccgctataatagcaaatacagatcctatagataatacataatgaaaatgtgcaacaacataataggtatcatgaagtacaatatcaattgaggagtttgctaaaactacccctgttaatcctccaactgtaaataaaaaaataaaacctaaagctcagagtgttactggactatatgtaatagtagttccatgataagtagctaatcatctaaatactttaattccagttggtacagcaataattatagttgctgaggtaaaataagctcgggtatcaacatccattccaactgtaaatatatgatgagctcaaacaataaaacctaataagccaattgctattatagcataaattattcctaaagtaccaaaagcttctttttttcttctctcttgcctaacaatatgagaaattaatccaaatcctggtaaaattaaaatatatacttcaggatgaccaaaaaatcaaaataaatgttgatagagaattggatcccctccaccagctggatcaaaaaatgatgtatttaaatttcgatctgttaataatattgtaatagctccagctaaaactggtaaagataatagaagaaggattgctgtaattacgacagctcaaacaaataggggtattcgatcaaaggttattcctattggtcgtatattaattactgttgtaataaaattaattgcacctaaaattgaagaaataccagctaaatgtaatctaaaaataggtaaatctactgatggacctccatgggcaatatttgatgacagaggcgggtaaactgttcatccggtaccaacccccctttctactatcctccttaataattggtgctcccgatatagcattccctcgaataaataatataagattttgattgcttcccccgtctcttttattattattattaagaaggatagtagaaaggggggttggtaccgggtaaactgttcatccggt

SEQ ID NO: 1929 - DNA, 1343 bp, Diabrotica virgifera
atttgtggagtatcatgccgtgacaccactatttttttaaaataccatataatttgttagttctagagttctagaagtaaccaataaactttgtaaatttaagttagtaattaacaccaaattatttaattaatcttattagtgctaccagacgaaaccaattaaacttaaaagaaaaataaatattttttaacttattgtataaggaaatactaatttaggggcttagattagtgaatattaagttttctcgggttctttttctatatggtattttgaaaatttaattaagacttctatccagtacaaatgttgacactccatagttaagccgcgctatttaattgaggtgctctcttcttagctacacctcccaagaagcttcttgatttcagccaatagctctacctggatttaagcccttaggacaggttcgagtacaattcataatagtatgacaacgataagctgaaaatggatccctcattttatccaatcttttatttgttgcttcatctctggaatcaattatccaacggtaagcctgcattaaaacagcagggccctaaatatttatcaccattccaccaataacttggacaagaagtagaacaacatgcacataaaatgcattcatataaaccatccaacttctgtctatcttctacactctgcaaatattcagtgtttttcttttggctgtcatcgcttctttgcaaccatggttcaattgatttatattgtcgatagaagttattcatatcaggcaccaagtcttttactacatacatatgaggcagtggataaatctttgtggacttactggatgtctcaattttgctgatacaggctaaggtatttacaccaccgatattcatagcacaagatccacaaatgccttcacgacaagatcttctaaaggttaaagtagggtctacctcgtttttaattttaatgagagcatctagaaccataggtccacaagaattcaaatcaactgtgtactcttgcatataaggtttagtgtcaggtttgtctggattccaacgataaatggcaaacgtttttggtctagctggcttctcggctcgttttgcttcagctgcagcggcgtttgaagttgcggcaacgtgaataagacgaacttgtgctaacctccctttccataatcggaataactgcatttctctagacattgtacaatgtttaaataagaaagtggtcaacaatgaatgccagatttatagacaatcattaacaaattttatcttaatgacttgactttctttaaaaaaaaataaaatacttttcttctcggacacagacactcagaccagtgacag

SEQ ID NO: 1930 - DNA, 817 bp, Diabrotica virgifera
tttcgtgcggcgagcggccgcccttttttttttttcgtttttcttttctgtcggtgcgatcacaaggaagtagtaccggtctgcacacgtggctgttaattagttctgtatcaagaatttccccctatatcatcaactaaaaatgcctgtcccatcactccaaaaaccagctccagtcttcaaaggaaccgctgtcgtcaatggcatgttcaaggatatttccttggaagactacaaaggacaatatgtagtactattcttctatccattggacttcaccttcgtatgtcccactgagatcatcgctttctcagatcgcttcgaagaattcaaaaaaatcaatacagctgtagttgcatgctcaaccgacagccagttctctcacttggcttggatcaacactccaaggaaacaaggcggtttgggcgagatggccattcctttgctctccgacaaatccggagccgtcgccaaggcctatggagtattggacgaagaaactggaattccatccagaggacttttcatcatcgacggaaaaggtaacctcagacaaatcaccatcaacgacctcccagtaggacgttccatcgacgagaccctccgtttagtgcaagccttccagttcacagacgagcacggtgaagtatgcccagtaggatggaaacctggccagaaaaccatgaaacccgaccccactggcagcaaagactacttctcaacagtaaacaaaaactaaattccctactttatttacgatgtattaggaagtatataatcttcatgtattattttttttaaataaaccgtttttttg

SEQ ID NO: 1931 - DNA, 766 bp, Diabrotica virgifera
tttgcgttggtttcttttttcatattcttttattgtatcttttatttattttctttttttttttttttttttttttttttttttttttttttttttttttttttttttttttttttttttaaaacacaatacttttaatatatcacttagtacattttaacattatataagtatcttcatgtagtaactcaaaagttttgctgtaaatagtctaaaacggctacaaaaagaaaggaagtacaataaaatggaatgaaacatctataaacagttaagtgattttagtccctattaactacatattgcacctgtcaactattgacggtagttcttgtggacttctggtttgatgtcataaaccaactttaagatctcttgaatgacgggttccttttggttgataatagctttattcatctcttcaatcctcctcttggtgtctacctcgattttcgctgctacatcttctctagagcccatatgcttagcctcaaattcacggaactggcgttctcgttctttacggtacttttcgatttcatcttgagcctcttccttagcctgctttagcctccttgctttgcgttttcgggcctctgtaactttgtctgctgcacgcttctcagctgctaacaattgttgaacaccctgactttgatgactagccatcctgtgagttatttaataatataataagtttaaacacccgttacgaatgatatgaacagggactgaaaattaataagaggaacctgcaatcagtcat

SEQ ID NO: 1932 - DNA, 1039 bp, Diabrotica virgifera
  misc_feature (966)..(966): n is a, c, g, or t
gcatcttttagtgagagaaaactcaaaatgaagctgttaattctagccgccaccctcattgtggccataaatgccaatttatctgccttcgagcaatggaccagttttaaggcaacacacaacaaatcttacaacgttattgaggacaaacttcgttttgctgttttccaagagaatctccgcaaaatcgacgcacacaatgctaaatacgaaaagggagaagaaacctactacatggctgttaacaaattcgccgattggtccagcgcagaattccaagccatgttggaccgccagatggctaacaagccaaaacaatccttcattgcaaaacacgtagtcgatcccaatgtccaagctgtagaagaagttgattggagagaaactgctgttttgggagtcaaagatcaaggacagtgtggatcatgctgggctttcagtaccaccggagctatcgaaggtcaactcgctattcacaaaaacgaacgtgttcctctcagtgaacaagaattggtagactgtgataaggtaaaccttggttgtgacggaggtttgatgacagatgccttcttttatgttgaacatcatggtctttcatcagaagaacaatacccctatacaggcgtaggtggtcattgcaaccatgtaaaaaacaaacaagtctcttcgatcaatggttacgtcgaacttgatgaaactgaaagtgctctagctgatgctctcgctactgttggtccagtgtcaatagctgtcgacgctgatacatggcaattctattcaggtggagttttcaacaataaaaattgtggaaacgctcttaaccatggtgttcttgctgtgggatacactaaagatgccttcgtcgttaaaaactcatggggaacaagctggggtgaacaaggttacatcagagttgcccgtggtagcaacctatgtggtattaacctcatgaactcttaacccaangttgtaaataacagttaataaaaaatatatataatactaaatgatataattttaacaaaaataaaaaaataaa

SEQ ID NO: 1933 - DNA, 3046 bp, Diabrotica virgifera
taattataataaaaataagttaataccacaaatactattttaaatctaacatttaacatccaacaactttctccttcaatttgatcgccccttccttcaccttatgagctccatgccgtatttttgaagcagccttcttccaccaaggtaattcttcatatacttctggaggaacagaattttcttgatctacatgaacctcctctatgtgaattacatcatgatggtgtggttcttcaacttcttggtctacagaaacactgggaacagcatttacatcgtcataatgatcatgtcttatgacttctattttttgctgttcctgagatgaagattgtagttgttcgtttggtaagggaattgattcttcttcttgggcctgatcatcataccctgattcttggcctattatttcttgttcttgttgataactatgtgagtgagtgtggtgtggtacttcttcaacgtgtacttcatgtcttgtatagtaatggctgtggggatcttctatgtctaagtattctgggtgaccgtaaccgccatgatgatggtctagggaatgactgtcacttatatcatgatgattaaaactaagcggttcgtcaaagctagtatggtggcttccactatgtatgacttcaatatcatggttatcatatccatgattgtgatcgtgatgatcatatccagaatgtgaagaacttatatgatcacgtccgccatatccagaatgtgaagaacttatgtgaccatgtccgccatatccagttatttcctgttcttgaacatcatagctagaagtatggtggttattatgattgccatatcctgtttggatttcttgttcttgataatcaagccctgaaacacgatgtctattatgacctccatatccagattggatttcttgttcttgattatcgtagcctgaaccacgatgtctattgcgaccatatccagtttgaatttcttgttcttgattactatatattgaagaatgatggctaccgcggccaccatatccagtttgaatctcttgttcttgattatcgaagccgtcattattaccatgtcctgtctgtacctcttgttcttgatatccaccaatgctactgccaccttgataaactgttgtatgtgaataactgttaacatgattatctgttggttcttgctctactactgtcttgtgtttggagttacttaagtttctaagagctgttattaaagaatcagcttcattttctgcaccctgtgtagattttggttgtgatataaattgaccttggtctgtaattccaaaggaggctccccctgatgtagtatgggtcgttatcactgttctatttcttataattgtcctatgtccactttggaatattgatccttctggttttatgtcatcaaatataccggtgtcatcaggttcttgtgatgtcttaattattgtcgttgttttccttgtttcatgttcctttttcgctctttcaacgccttcttcaattttcgctaagagtctatctaacagtatagcttgaattctagctatttgtttatcagttaaaccaagatcattttgtagatagtatctagagaatcccttgttgaattcttcagtaatgttctttttaacatcattaatgagttctgatctcatttggggaacattaagtctatctgtaccacaaaatcctatgatggcagcttctaacttgtttgatagcttatcctcaataaatttaacctttttcaaaatgtcctttggtaggtgatcatcagtaccctttactgaattcacatcaaaaatttcaacttgctgtgtgtcagttggctcttggctttggtctaatggcttttgttgtattcttggttggtcgtgccaaccactgatctgctgttccacttgttgagtgtcctgttcctgttcttgatcctgtgaaccaccaatttgaatttttccttggtttccatgaggaaagtcgtcttcaacttgtggacctatagtaaagttgacttcttcttgctcttgaccaagttcttcttgttgttgagattgatctaaaggttttaaatgcaatttgctctgatctaagtgggtttcttctatttgttgaccaaaatcaatttgctgttgttggtcgatattttcgactttctggtagactacagtggtcgtctcttcaatttcctggcctatagtggtggtctcttcttcaatttgctggccaaagtctatctgtggttgttggctaagatcttcggtttgttgatttggtcaaggtttttttgctgtatttttcctccatttgtttgatgtatttttcccccctcttcaatttgttggccaaaatctacctgttgctgttgactaaggtcttctacttgctgactttgatctataggttttaaatgcagcttctaattgttgacctagatcctcagtttgttgaccgagatcttcagtttgttgaccaatttgtgaatgtgattggcctctaataatttttgaaacacgatatttgtttctttggatttgatgttgactaaagtcatcattatcttctaattgttggccaagatcgatttggttttgtcctaattctacttgctgaccaagatcttctacttgttcttgaccgagatcttctacatgctgacctacatgtgtgattttggtaattttactatatctacttccttgctcttgacgctgacccaagtcttcatcaggttcctgctgttggccaatttgttcttgatcttctatttgttgttgatatctattcccctgtccgcggttccagggccttcttccattatcatgacgtccaggatgaccattgtttccccatggtttccagttgaatactttatggcctatatctgcaattccttcacctacttcttcagcttttttagtaaaatctttatgtccctgctcaaaatttgcttttaaatctttttgtgtctgttcgagatttgttttcatttttagaaaaccatcgccgaatccaaattctcgtttacttctggacttagctggtgc

SEQ ID NO: 1934 - DNA, 1819 bp, Diabrotica virgifera
attagttcttctttctttagtcgcattcagcgctgctctaccaacccttcttggtagaaccgctctggtcaaagaagatggaactgttactctcaccgactctagaggataccaactcgtaatcctcaagagtgttgccgatcccagtcaagtcgaagttgttctcagaagtccaaacacaagaacccagatgttccaagttggggaaccacttagaactggagaagctatcgaccgtaccctcgttggtgtttcacggtaccaaaacaacaaccaaggtgatattcttactgatattttccgtcagtatgaaggtactcttgacgacaccaaatactacagccttcttaacagaatccaaatgttagttgaagctggactcattaatgaaaccatatacgatatcatcagagactgggatcttaaacaccgtgtacaaggaattagtgacattgtccccgtccaaggagtacgtaccctccgccaatatgctgaacaagtaggagatgttatgcctcttggacaaaatttgcaatatggaaaccaaagaaactgggctcttgaccaaggtttgttgcaaacttattctccactcagacatttccaaactctgctcggacaaatccaacagcaacgtgtacttcaacaaggtttattgacccaacaacaatttacctcaacaatatctatctggggaataccttcttgaagatcaaatgaacactaaccaaatcttgaaccaaatttatagacaacaacttggacaatctccattgaaccgttatttggttaacatgagacttgtaaacggagagcaagtatacgaagttcctgaagaattcgttaacgttcaacttctcgaacaactcttcgccaagcaagaattgatcaaccaagaattgactgaaatcaccgaaagaagacaaccaatcactgaagacgttcactaccagcaacaactgattaaccaacagatccaaaaacttattgaacaattagcttaccatcaaaacctcattacacgtgaagttgaacaatacattgttaaaggacaagtagttcctcaggagcttgtctctcaacagagattggtttaccaacaagttcatgaagtaattgaacgtttgacctcccaacaaatattcttgaatcatctagccgaaagcactgaagcaactgaagtcgatactatttcaattcaaagatgggttgtacaacaaaatattattaacgagcagatccagcaattgatccaacaagttttgtaccaacaaactcacgtaaggcaacaaatccaagtactaattcaacaaggacatgttatcccacaggaactcgtcctttaccaaaaaattacctaccaatatgttgaaagatttcttcaagttttgattaaacaattcgtaaatcaacaaaccaactacaaacagttgatccaaattttgggacaacaaagacacaccatacctcaagaattggtttcccaatatttcgctatgtacacccaattacttcaattgatccaacacggagatattgtaccccaagaattgatctaccaacaaagacaaatccaccaacagatcgtactcatgctccaacaattgaaagttgttccccaacaattagtcaaccaactcgtgttcaacacacaagaccgtatgtggcaaactcaaggaacttaccaaagagtaccacttatgatgcaaagaacttaccaaagagtaccactcatgatgtaaagactggtttatttttaatatgttgtttaaaatatttgttatgattgctacaaataaataaatattttttgtatatt

SEQ ID NO: 1935 - DNA, 836 bp, Diabrotica virgifera
cccacgcgtccgacctcgtggaagtttcttttctgtctgcgaccttagcgaaaatggcaacttcaatctcaaaaaagcgtaaattcgttggagatggtgtcttcaaagccgaattaaatgaatttttaacccgtgaactttccgaagatggttattccggtgtggaagtacgtgttaccccaacacgtaccgaaattattattatggccaccagaaccgacagggtgttaggtgagaagaacaggaggataagagaattgacttctgttgtacagaagaggtttagtttccctccagattccgtagttttgtatggtgaaaaagtagccaacagaggtctgtgtgctattgcccaagctgagtcacttaggtttaaattgattggtggtttggccgtccgtagggcttgctatggtgtcttgaggtacatcatggaatgtggggctaaaggatgtgaagtagtagtatcaggaaaattgagaggtcaaagagccaaatccatgaagttcgtagatggtcttatgatccactctggagacccatgcaatgactacgttgacacagcaacccgtcacgtactcttaagacaaggagtattgggaatcaaggttaaaatcatgttgccatgggatcctagtggcaagactggacccaagaagcccctgcccgacaatgtctcagttgtggagcctaaagaagaaactcttccccaatccccaagcagcgaaattaaggcatcaaagcctgacgctcctccagcagttccaattgctgtagcttagggtttaaatatgtttttataagtaaaaaagttctaataaaacaaatccacaaga

SEQ ID NO: 1936 - DNA, 6733 bp, Diabrotica virgifera
ttgtattaatgtatcatttaagattaatggtagttttttctcgatatagttttataagaaacggggagtaaacaatgtaagcgtcgtatttgaaatatttttgggagatttcactttgtaccagaaatattaaaagctttccttgtagcattgaaaaaaaatttaccttttaggttttgcttagacaaatatagctttgggaatctagcgaagaaattattcaagtttggatcttttgatctttatggagaaatgtaactttttggaatcgtagtgttgaaatagttctaccttattgtaccttcgaaataatctacaccttcaatgtgcaaaaattgtcaaacctgtgtattaatgtatcatttaagatttattgtagttttttcttgatatagttttattataaacggggagtaaacaatgtaagcgtcgtatttgaaatgtttttgggagatttcactttgtaccagtaatattgcaagcattcgttgtagcattgaacaatgatttaccttttaggttttgcttagacaaatatagctttgggaaactagcgaagaaattattcaagtttggatcttttgatttttcatggagaaatgtaactttttggaatcgtagtgttgaaatagttctagcttattgtaccttcgaaataatcgacaccttcaatgcgaaaaaattgtcaaacctttatattaatctatcatttaagattttttgtagtttttcttgatatagttttataagaaacggggagtaaaaaatatatgcgtcgtatttgaaatgtttttgggagatttcactttgtaccagaaatattgcaagctttcgttgtagcattgaaaaaaatttaccttttaggttttgcttagacaaatatagctttgggaatctagcgaagaaattattcaggtttggatctttatattttttatggagaaatgtaactttttggaatcgtagtgttgaaatagttctaccttattgtaccttcgaaataatcgacaccttcaatgtgaaaaaattgtcaaacctttatattaacctatcatttaagattttttgtagttttttcttgatatagttttataagaaacggggagtaaaaaatatatgcgtcgtgtttgaaatgtttttgggagatttcaatttgtaccagaaatattgcaagctttcgttgtagcattgaaaaatgagttatcttttaggttttgcttagaccaatatagctttggaatctagcgaagaaattattcaagtttggatcttttgatttttcatggagaaatgtaactttttggaatcgtagtgttgaaatagttctaccttattgtaccttcgaaataatcgacaccttcaatgtgaaaaaattgtcaaacctttatattaacctatcatttaagattttttgtaattttttcttgatatagttttataagaaacggggagtaaaaaatatatgcgtcgtatttgaaatgtttttgggagatatcactttgtaccagtaatattgcaagctgtcgttgtagcattgaacaatgatttaccttttaggttttgcttagaccaatatagctttgggaaactagcgaagaaattattcaagtttggatcttttgattttgcatagaggaatgtaactttttggaatcgtagtgttgaaatagttctaccttattgtaccttcgaaataatctacaccttcaatgtgcaaaaattgtcaaacctgtgtattaatgtatcatttaagatttattgtagttttttcttgatatagttttattataaacggggagtaaacaatgtaagcgtcgtatttgaaatgtttttgggagatttcactttgtaccagtaatattgcaagcattcgttgtagcattgaacaatgatttaccttttaggttttgcttagacaaatatagctttgggaaactagcgaagaaattattcaagtttggatcttttgatttttcatggagaaatgtaactttttggaatcgtagtgttgaaatagttctagcttattgtaccttcgaaataatcgacaccttcaatgcgaaaaaattgtcaaacctttatattaatctatcatttaagattttttgtagtttttcttgatatagttttataagaaacggggagtaaaaaatatatgcgtcgtatttgaaaagtttttgggagatttcactttgtaccagtaatattgcaagctttccttgtagcattgaacaatgatttaccttttaggttttgcttaaatcaatatagctttgggaaactagagaagaaattattcaagtttggatcttttgatttttcatgaagaaatgtaactttttggaatcgtagtgttgaaatagttctaccttattataccttcgaaataatcgacaccttcaatgggaaaaaattgtcaaacctttgtattaatggatcatttaagatttattggagttttttctttatatagttttataagaaacggggagtaaaaaatttatgcgtcgtatttgaaatggttttggaagatttcactttgtaccagaaatattgcaagctttctttgtagcattgaaaaaaaattttaccttttagggtttgcttagacaaatatagctttgggaatctagcgaagaaattattcaagtttggatcttttgatttttcatagagaaatgtaactttttggaatcgtagtgctgaaatagttctaccttattgtaccttcgaagtaacctacaccttcaatgtgcaaaaattgtcaaacatttgtattaatgtatcatttaagatttattgtagttttttcttgatatagttttataagaaacggggagtaaataatgtatgcgtcgtatttgaaatgtttttggaagatttctttttgtaccagaaatattgcaagctttcgttgtagcattgaaaaatgagttatcttttaggttttgcttagaccaatatagctttggaatctagcgaagaaattattcaagtttggatcttttgatttttcatggagaaatgtaactttttggaatcgtagtgttgaaatagttctaccttattgtaccttccaaataatcgacaccttcaatgtgaaaaaattgtcaaacctttatattaacctatcatttaagattttttgtaattttttcttgatatagttttataagaaacggggagtaaaaaatatatgcgtcgtatttgaaatgtttttgggagatatcactttgtaccagtaatattgcaagctgtcgttgtagcattgaacaatgatttaccttttaggttttgcttagaccaatatagctttgggaaactagcgaagaaattattcaagtttggatcttttgatttttcatagaggaatgtaactttttggaatcgtagtgttgaaatagttctaccttattgtaccttcgaaataatctacacattcagtgtgaaacaattgccaaacctttgtattaatctaccatataagattttttgtagttttttcttgataaaggtttataagaaacggggagtaaaaaatatatgcgtcgtatttgaaatgtttttgggagatttcactttgtagcattgaacaaaaatttaccttttacattttgcttagacaaatataaccttggaaatctagcgaagaaattatttatgtttaaatcttttgatttttcatagagaaatgtaactttttggaatcgtagttttgaaatcattgtaccttgttgtaccttcgaaataatctacaccttcaacatgcaaaaattgtcaaacctttgtattaatgtatcatttaagattaatggtagttttttctcgatatagttttataagaaacggggagtaaacaatgtaagcgtcgtattggaaatgtttttggaagatttctttttgtaccagaaatattgcaagctttccttgtagcattgaaaaaaaatttaccttttaggttttgcttagacaaatatagctttgggaatctagcgagacattattcaaatttggaccttttgattttttatagagaaatataacgttttggaatcgtagtgttgaaatagttctaccttattgtaccttcgaaataatctacaccttcaacatgcaaaaattgtcaaacctttgtattaatgtatcatttaagattaatggtagtttcttctcgatatagttttataagaaacggggagtaaacaatgtaagcgccgtattggaaatgtttttgggagatttcactttgtaccagtaatattgcaagctttcgttgtagcattgaacaatgattaacctttcaggttttacttagaccaatatagctttgggaatctagcgaaggaattattcaagtttggatcttttgatttttcatagagaaatgtaactttttggaatcgtagtgctgaaatagttctaccttattgtaccttcgaagtaacctacaccttcaatgtgcaaaaattgtcaaacatttgtattaattatcatttaagatttattgtaattttttctcgatatagttttataagaaacggggagtaaacaatgtatgcgtcgtatttgaaatgtttttggaagatttctttttgtaccagaaatattgcaagctttccttgtagcattgaaaaaaaatttaccttttaggttttgcttagacaaatatagctttgggaatctagcgagacattattcaaatttggaccttttgattttttatagagaaatataacgttttggaatcgtagtgttgaaatagttctaccttattgtaccttcgaaataatctacaccttcaatatgtaaaaattgtcaaacctttgtattaatgtatcatttaagattaatggtagttttttctcgatatagttttataagaaacggggagtaaacaatgtatgcgtcgtatttgaaatgtttttgggagatttcactttgtatcagtaatattgcaagctttcgttgtagcattgaacaatgatttaccttttaggttttgcttagaccaatatagctttgggaaacttttagaaattattcaagtttggatcttttgatttttcatggagaaatgtagctttttggaatcgtagtgttgaaatagttctagcttattgtaccttcgaaataatcgacaccttcaatgtgaaaaaattgtcaaacctttgtattaatgtatcatttaagatatattgtagttttttcttgatatagatttataagaaacggggagtaaaaaatgtatgcgtcgtatttgaaatgttgttgggagatttcagtttcaaccagaaattttgcaagctttctttgtatcattcaaataaaaatagacttttcggtttgcttgagcaaatatagctttgagaatctagcgagacattattcaaatttggaccttttgatttttcatagagaaatataactttttggaatcgtagtgttgaaatagttctaccttattgtaccttcgaagtaatctacaccttcaatatgtaaaaattgtcaaacctttgtattaatgtatcatttaagattaatggtagttttttctcgatatagttttataagaaacggggagtaaacaatgtaagcgtcgtattttaaatgtttttgggagatttcactttgtaccagaaatattgcaagctttccttgtagcattgaaaaaaaatttaccttttaggttttgcttatacaaatagatagctttgggaatctagcgaagaaattattcaagtttggatcttttgatttttcatagagaaatgtaactttttggaatcgtagtgctgaaatagttctaccttattgtaccttcgaaataatctacaccttcaatatgtaaaaattgtcaaacctttgtattaatgtatcatttaagattaatggtagttttttctcgatatagttttataagaaacggggagtaaacaatgtaagcgtcgtatttgaaatgtttttgggagatttcactttgtaccagaaatattgcaagctttcgttgtagcattgaaacaaaattacgttttagattttgcttagacaaatatagctttgggaatctagcgaagaaattattcaagtttggatcttttgatttttcatagagaaatgtaactttttggaatcgtagttttgaaatcattgtaccttgttgtaccttcgaaataatctataccttcaatatgcaaaaattgtcaaacctttgtattaatgtatcatctaagattaatggtagttttttcttgatacagttttataaaaaacggggggaaacaatgtaagcgtcgtatttgaaatgttgttggaagatttcactttgtaccagaaatattgccagctttcgttgtagcattgaaacaaaattacgttttagattttgcttagacaaatatagctttggaaatctagcgaagaaattattcaagtttggatcttttgattttttatggagaaatgtaactttttggaatcgtagtgttgaaatagttctaccttattgtaccttcgaaataatcgacaccttcaatgtgaaaaaattgtcaaacctttatattaatctatcatttaagattgtttgtagttttttcttgatatagtcttataagaaacggggagtaaaaaatatatgcgtcgtatttgaaatgtttttgggagatttcattttgtaccagtaatattgcaagctttcgttgtagcattgaacaatgatttaccttttaggttttgc

SEQ ID NO: 1937 - DNA, 1056 bp, Diabrotica virgifera
gttttagtaaaagaaaaatcggaatgaagctgttgatcattgctgctgccctcattgtggccgcaaatgccaaactatctgcattcgaacactggagcagttttaaggcaacacataataaatcttacaacgttattgaggaacagcttcgtttcggagttttccaagagaaccttcgcaaaatcgaagaacataataccaaatatgaaaacggagaagaaacctactatctcgccgttaatcaatttgccgattggtccaacgctgaatttaaagctatgttagactctcaaatggctcagaggccaaaactattggttgctgaaacattcgaagccgattctaatttacaagttccaacagaggttgattggaggaataaaaaggctgatttgggagttaggaaccagggaagctgtggatcctgctgggctttcagtgccgtcggagccatcgaaggtcaacttgctattcacaaaaagcaacacgttcaactaagtgaacaagaattggtagattgtgacacagtaaacgagggatgcaatggaggtttaatgacagatgcctttaactacgttaagcgccatggtctagcaccagaaagtaaatataaatacacaggtaaacgtggcagttgcaagaaggtacacaaacaagtctcttccctcagtggattcgtaaatcttgctagaactgaaactgcactagttaatgctcttgctaatgtcggtccaatatctatagctgttgatgcagatacatggcagcattatggaggtggagttttcaataacaaaaattgtggaaccgccctcaatcacggtattcttgccgtaggatacactaaagatgcctttatcgttaagaactcatggggaacaagttggggtgagaatggttacatcagagtcatccgcggtaagaacttgtgcggtattaaccaaatgaactcttatcccaaattgtaaatgataataaatagataaaatatgtataatataaataaatatataaatatgaaaaaaaatgtataatataaataaaaaaataactgtg

SEQ ID NO: 1938 - DNA, 944 bp, Diabrotica virgifera
aacaccggtttgtttgtggcacattttgagtggtcaagtgtaacacaaccacatcccaactcggtttcgttttggagtataactttttcgggtttaggctatcacaaaactccagtaatgatgattttatttaaagtactcactatttccatgtttttccttcttggatcagccaaagaagaagacgttctagatctgggtgacagtgatttcgcatcaagaattgccgaacatgagaccgctcttgttatgttttatgccccttggtgtggacactgcaaacgattgaaaccagagtatgctaaagctgctgaagatttactaagaaatgatcctcctattgctttggtgaaagtagactgtacagaggctggtaaagaaacttgtgataaaaacagtgtaagtggttaccccacattgaaaatcttcagaaatggtgaggtatctcaagactacaatggtcctagagatgcatcaggtattgtaaaatacatgcaatccaaggttggtcccagctcaagagaactgaaaacatctgaatgcttgaaaaacttcctagaaacccaaaaagaatcagtagtcgtgggtttcttcgaaaaagaatcagaccttaaagctgcattccttaaaaccgctgataagcttagagaaaaagttaaatttgcccacacttcattcaaggaacttttagatgcccagaaagtgaaagatggtttggtcttgttccgtccagttcatctgcaaaacaaattcgaagatagcaaagttcaatacagtggatctgctgatgcaggaagcatccaaacatttatcaccaaaaacttacatggtctagtaggacaccgcaaacctgataacaaacaagaattcgaaaaccccttgttcgttgcttacttctctgttgattacgccaaaaatcccaaaggtaccaactactggcgtac

SEQ ID NO: 1939 - DNA, 1081 bp, Diabrotica virgifera
cttggcaaacgttagtaacgtgaaataaaacttaaattttttcaaaatgggtcgtatgcacgcaccaggaaaaggtattgcccagtcggcattgccatacagaaggagtgtaccaacatggttgaaagtcacaccagaagaagtaaaagaccatatttttaaacttggcaagaaaggcttgactccatcacaaattggtgttatcctcagggattcatatggtgttgcccaagtaaggtttgtttctggaaacaaaatcttgcgtatcatgaaagctatgggtcttgcccctgatctaccagaagatttgtactaccttatcaagaaggcagtagctatccgcaaacatttagaacgtaacagaaaagacaaggacagcaaattccgtttgattttggtagaatcacgtatccaccgtttggctaggtactacaaaaccaagagcgtattggcacccaactggaagtacgaatcaagcacagcatctgctttggtcgcttaaattgtgcttttatgttaagtttataaaataaaaatttctactaaaaaaaaaaaaaaagggcggccgccctttttttttttttttcaacttattttacaaatttattatccttaacatcttacgcacacaatacacaggctcctccaacagctttaattttgtcttctgcattttttgagaagaatttagctttaacaataacgggttgttcaggtaggcgacccttgccaagaagtttgtagtaaccagctttgacaatgtcaatgactggggcctttccctctggattttccttgtattttaacctagtttgttcactaactagtgtccataatttgtctaggttaatagctgggcaccatttggagtttttccttacatggtagttcctcatacccaactttccgaagtatccaggatggtacttgtcgaagttgattctgtggtggtgcataccaccagcattaccacgacctccaggatgcttacggtgtttgccgatacggccgtgaccgtggcttacatgtcctcttagtttcctagttttctttctgtgtgtcgacatgtcggacgcaaagg

SEQ ID NO: 1940 - DNA, 1153 bp, Diabrotica virgifera
attgtctttatcaaaagattaaagaggttattaagcgattaatgatttttccataaaatattccccttccacgtaatcgtctgcgcatacatcacttttatcgtccaagttcaatgtttattattgcggctttcacttttgtataaaagcagtccagaaagaatccaaccggttgacggtttaaagcagtcgtcagtcgttcagtttttggtttatttagtttaaaagaacgagtaacatggcaaacagagactcagctactaaccaattacttaactacaagaaaaagactcaagggggagagtctgtaacaactggatatggcaaccccgtcggacaattcgcttctttgagcgtcgggcccagaggccccattctattccaagatcaaatcctagtcgatgaactttcccactttaacagggaaaggattcctgaaagagtagtccacgctaaaggagctggtgctttcggatattttgaatgtactaatgatatcacaaaatactcagcagcaaaattattttcttccatcggcaaaaagaccccaatcgctattcgtttctcgaccgtcggcggtgagtctggatcagcagacacagtaagagatcccagaggtttcgcaatcaaattctacaccgaggaaggcatctgggatttggcgggaaacaacactcccatcttctttattagagaccctatcttcttcgccagctttatccgcactcagaagagaaatccacagacccaccttaaagaccccgacatgttctgggacttcatgtctttgaggcctgagactatgcaccaattgttattcttgttctcagacagaggtattcctgatggatacagacatatgaacggatatggatcccacaccttcaagtttgtcaacaaagaaggccaggtacatttttgtaaattccatcacaaaactgaccaaggaatacaaaatctcgatgtcaataaagctgatgacttgtctgcatcagaccctgattacagcatcagagacctgttcaacgccatcgccgatggaaactacccctcatggaccacttatgttcaaataatgaccccagaacaagcacaacgatcgccattcgatcccttcgacttggaaccagggttgggcccccaggcgaatatc

SEQ ID NO: 1941 - DNA, 2301 bp, Diabrotica virgifera
ctttgtccgcggacgcgtgggcgacgatgaaggtattagttcttctttctttagtcgcattcagcgctgctctaccaacacttcttggtagaaccgctctggtcaaagaagatggaactgttactctcaccgactctagaggataccaactggtaatcctcaagagtgttaccgatcccagacaagtcgaagttattctcaggagtccaaacacaagaacccagatgttccaagttggggaaccacttagaactagagaaactatcgaccgtactctcgttggagtttcagcttaccaaaactataaccaagctgatattcttactgatattttccgtcagtatgaaggtactcttgacgacaccaaatactacagccttcttaacagaatccaaatgttagttgaagctggactcattaatgaaaccatctacgatatcatcagagactgggatcttaaacaccgtgtacaaggaattaggaacctcgaccaagacttgctccaaaactattctccactcagacatttccaaactcttcttggacaaatccaacagcaacgacaacttcaacaaggtttattgaggcaacagcaatatttacctcaacaatatttatctggagaatatcgtcttgaagatcaaatgaacactaaccaaatcttgaaccaaatctacagacaacaacttggacaatctccattgaaccgttatttggtaaacatgagacttgtaaatggacaaaaagtatacgaagttcctgaagaattcgttaacattcaacttctcgaacaacttaccgctcaacaagaaatgatcaaccaaagatgggctcaaatgatggaaagaagacaaccaatcactgaagacgttcactctcagcaacatctgattaaccaacagatcgaaaaacttattgaacaattagcttaccatcaaaatctcattacacgtgaagttgaacaatacattgttaaaggacaagtagttccccagcaacttgtttaccaacagagattggtttaccaacaagttcatgaagtaattgaacgtttatactaccaacagctcttcatgactcgcctagccgaaaacataactgaagtcggtactatttcccttcaaagatggattttacagcacaatattattaacgagcagatccaacaattgatccaacaagttttgtaccaacaaactcacgtaaggcaacaaatccaagtattgattcaacaaggacaggttatcccacaggaactcgtcctctaccaaagaattacctaccaaaatgttgaaagagttcttcaagttttgattaaacaattcgtctatcaacaaacctacttcaaacagttgattcaacttttgggacaacaaagatacgccgttccccaagaattggtttcccaatacttcaccatttacagccaattacttcaattggttcaacacggagatgttgtaccccaagaattggtctaccaacaaagacttatccaccaacagattgtacttatgctccaacaattgaaagttgttccccaacaagtaatggcccagagggttcctaccacaaaacaagaacgtttgtggcaaactcaaaacctttaccaaactctaccacgcgtgtattaaaaactgctttatttgtaatttgttgttaaaatgtttgttataattgttgaaaataaataaacatttgtttttgcaaaaaaaaaaaaaaaaaaaaaaaaaaaaaaaaaaaaaaaaaaaaaaaaaaaaaaaaaaaaaaaaaaaaaaaaaaaaaggggggcccgtttaaaagaaccaaagtttacgaacgggggatgggaacgcaaaactttttttatagggcccccaaatttaatttcctgggccgccttttaaaaacgccgggctgggaaaaacccgggggttccccaattaaaccccttggaaaaactcccccttttccccggtgggggaaaaaggaaaaagcccccccccgaccccctttcccaaaattggccaaccctaaagggaaaagggaacccccccggaaggggggattaaagggggggggggggggggtttacccgaagggggcccgttacctttgccgggccccaaggccccgcccttttcttttttttcctttcttttccccccacgttcccggtttttccccgaaaagtttaaaatgggggccccctttaaggttcccaatttagggttttacgcccccccacccccaaaaaatttgataagggggaggtttcccgaaggggccctcccccctgaaaaaggttttttccccttttga

SEQ ID NO: 1942 - DNA, 1498 bp, Diabrotica virgifera
tatagtatttttcctacaaaagcgatattacgtaggtcaacatttttgacataagagaactgtcaaaacactagaatgcgacttctcattattgccatgtttataataaacatgacaataatgaaaagtcacattccaatgctttgacagttctcttatgtttataataaacatgacaataatgaaaagtcacattccaatgttccgacagttctcccacgtcaaaaatttcgacctacgcaggtctaaaaattttgtagtaaaaataatatatatcataaatttaatcttaaatccaaaaatttaattatataaaaatgtatttttggtctttagtatttgaagtctgatcttttcgaatcatttttatactcatacctaacctctatgcagatcaaagttgtttacctttgcatctatgtatgttggttaagtaacttccgcaaatattgtaattatttcaataaattaattatataataggtctctataatagatctctgactaccagccacttagcatggtagccatgctattaccgagccgtataaataaccattgcagccttatacatatttagtttttaaggctctatgtaaaaacgtgtaccttcggctttatacttacaacaatgcaggtgattggtttcttcaagaacaagctgtctggtactctaacacggatggtgcttcctacaacggatgttgctacttctttgtcgtatacagctttggttgctttgtctgagttgggacagacagtcagatctctagccaaagagtggttgaccaaaaggactaccaagagtccgaaaagaacagttttggaagccattgtttaatccccacgcgtccgactagttctagatcgcgagcggccgccctttttttttttttttaatatttatctaaatataaaaattattttatatatttggtcctttcgtactaaaatatattaataaattaaagatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaaaaaaaaaaaaaaagggcggccgctcgcgatctagaactagtcctagtatcaaaagctggtattattgctggtgccaaagctggagaaaccagattcacagacacaaggaaagatgaacaggaacgttgtattaccatcaaatcaactgccatatctatgttcttcgagttagatgataaagatcttgtgttcatcaccaacgctgaccaacgtgagaaagatgtgaaaggtttcttgattaaccttattgactctcctggacacgttgatttctcatcagaagtaacagctgcccttcgtgtcactgatggtgcccttgtagtagtagattgtgtatctggtgtatgtgtacagactgaaactgtactcccgtcagc

SEQ ID NO: 1943 - DNA, 1350 bp, Diabrotica virgifera
ctagttctagatcgcgagcggccgccctttttttttttttttctttttttttttttttttttttttttttttttttttttttttaatatttatctaaatataaaaattattttatatatttggtcctttcgtactaaaatatattaataaattaaagatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttataatcaaaaaaattggatcaaaaaattattaattaatataataatataaaaaaagttaaatttattttttaatcaccccaattaaataaatttattatataaataaatttaatactaaaaaaacttattaataattttataaaactctatagggtcttctcgtcttttaaaaaaatttaagctttttaacttaaaaataaaattctttataaattaaataaagacagtttttttttcatccaacccttcattccagctttcaataaaaaaactaatgattatgctaccttagcacggtcaaaataccgcggccattcaaattaatcagtgggcaggcgagactttatatttaatacaaaaagacatgtttttaataaacaggtgaaaaaaatgttgccgaattcctttattaaacctatatatttttactaaatatacaattttttaatactaatattatcatcattactaaatttaaataatttaaatttatattttaataaaaaatttataaaaaataaaaataataatatataaaaataaataataacatattttaaaatatgaaaatttttaatcctaatttttatttaaaaattaaattttaataaaattttatttttaagctcatccctaaaaatatttaatattaataatataaaaatatttaattataaatatattgttaataaataaatttaatttatttcttaaaaaattagatatatttaaaaacgaataacatttcattacaaaaaaattatttaaaatatttattttacaataaaaattttaattttttagctcttttaaattcgaaaataataaatatataattattaattaatcgtctcctcatacactgactacacgagatttcgttgttacctgtcaacggatttacataagtttggtcttggcgcaatccggacagatgatgtcgtcctgatcggtgatgaatccgcgtccgaccaagctggtcttgcaggaagcgcagaagaagca

SEQ ID NO: 1944 - DNA, 1755 bp, Diabrotica virgifera
gtacctggtagagcagtttccacgctgcgatctattgagactcagccctcagcttggggattcgtctacagacaattccgagcaagtgtaacacaaccacatcccaactcggtttcgttttggagtataactttttcgggtttaggctatcacaaaactcctgtaatgatgattttatttaaagtactcactatttccatgtttttccttcttggatcagccaaagaagaagatgttctagatctgggtgacagtgatttcgcatcaagaattgccgaacatgagaccgctcttgttatgttttatgccccttggtgtggacactgtaaacgattgaaaccagaatatgctaaagctgctgaagatttactaagaaatgatcctcctattgctttggtcaaagtagactgtacagaggctggtaaagaaacttgtgataaaaacagtgtaagtggttaccccacattgaaaatcttcagaaatggtgaggtatctcaagactacaatggtcctagagatgcatcaggtattgtaaaatacatgcaatccaaggttggtcccagctcaagggaactgaaaacatctgaatgcttgaaaaacttcctagaaacccaaaaagaatcagtagtcgtaggtttcttcgaaaaagaatcagaccttaaagctgcattccttaaaaccgctgataagcttagagaaaaagttaaatttgcccacacttcattcaaggaacttttagatgcccagaaagtgaaagatggtttggtcttgttccgtccagttcatctgcaaaacaaattcgaagatagcaaagttcaatacagtggatctgctgatgcaggaagcatccaaacatttatcaccaaaaacttacatggcctagtaggacaccgcaaacctgataacaaacaagaattcgaaaaccccttgttcgttgcttacttctctgttgattacgccaaaaatcccaaaggtaccaactactggcgtaacagaatattgaaggttgccaaagaattccaagaaagggctaactttgctatcagctcaaacgatgaattccaacatgaattaaatgaatttggattggactatgtgaaaggagacaaaccagttgttggtgctagagatgctaaaaatcaaaaattcgttctcaaagaattctccctcgaagccttcgaagtgttcgtaagcgatgttctagatggtgctctcgagccataccttaaatctgagccaattccagaagacgcagacgcaccattgaaaactttagttgccaagaacttcgatcaagtgattgataactcaaaagatgctttgattgaattctatgctccttggtgtggacactgtaaaaaacttgcacccatttatgaagagctagccgaaaagctcaaagacgaagatgtagtcatcgctaagatggatgctacagccaatgatgttccatcaaacttcgaagtacgaggtttcccaacaatcttctgggttcccaaaaattccaaagactctcctgtcacctacgagggtggtcgagatgtagacgacttcgttaaatatgtagccaaacacgctaccaacgaacttaagggttacgataggagtggatctcctaaggaaggcaagactgagttgtaatgtgttgtaataaatttaaaatatgtgatttttaaaaataatttttgagatgttctcatactttttaaacgaattccatgtagtgattaattttctaataaagtggttttctcc

SEQ ID NO: 1945 - DNA, 2668 bp, Diabrotica virgifera
cggacgcgtgggctggttagtctcattgagaacggagatcagatctctagcttgcttatagttggaaggtgtgaaaaatgcataggacgtaccggcactgtcagaacgaccagttctaccgattctgtgaatgtaatcttctgaggagtgaggataatcgtaatttacaacatattttataccctcaacatctaaataagaaaggacatattagaaatcagtcaaatactagccaacctgaagaatttttattcaaacaaaattcaattattatttcgttgaagtatttttttatagattgttaggtttcttcagattgactaattatattgtagcctatgtaacatgattaagaatttctttttgatagtcaaatccaaatttatttatttaattttactaaaaaaattgctgtcaaatttcgaagtaattcttattcatacctaataaaaatcaaaactagatgttacacacaatttcaataaaaatttttctaaaaaaaatcaagaattgaaaaacaatcacttgttttactataaatagtagtgcgaactgctagttttcgagatgtccatgaatttgagtgtttcgtcttatagatccaacacgatttcaaattcgaacatgtatatgttttcttaaagtattctattaattaaaaaataaaagaaaacataactaaaaacatactaaccagtttcaaaggaaattccatgagttgtgatctgagtgaataaacgatttaaaggaatagtagcaaaaatattatcctgcttgcttcagttgacctcctgctaccttacggcaattttgtggtctactcaaacatcgcagtaaattgaccaatgggaagacataaaaatgacatatgtttttgtattgaagtgcacaaaaatcccacgtcgtagaaacctaggttttcttgagcaaaacaaaaaggttgtggggggtgggaaaggttaaaaggatatgatcaccagaagcgaaatctatcaaatgtttttaaaaattgttaagtgacatttggaataactaacttaattgagtatgtaaaggtttatagaaatgtggatgaaatacgaacaaaaagacaaaaaaaaaagttatgcatgcaaaaaaaaaattgtataaaaattttgaactagttgaaaatatagaaaatttagataatctagtaaggaaatagcatataatgaacaaaattgtcccaattctttaaaacatcagaaagatctaatcaaaaatagttttttgaacattttagggatgaaatttacattgtaacagtggtttttactcattttaataggattttgtaaatcaacacttcttggtgatcagttttggtgttaaaacaagtgccatattaatatactaaaatcttccaaaggtcttcattaatattttccgagctgaaccgtcctgagttagggcgagacaacctgtaaagaggcacccgcatgaaaacagaattgcactgctaatttcactgtacgcaaaaaaggttacaacaagatcatcgtgcacgtgcctctgaaaaagaaaaaagggcgcccagactgatcagtaacaattatacaaaaattacacaattttaccaacatataacactggcaaataaatcccacacgtagtgtagaattgctaaaattacatttcaatacaagtaagccagtaaattggcttttatgacaaaacatactaaatctcccccaataatttttaaatttaagaacaaaaatcccccaaccaattatttacttattaaattcaataaaatacgtaaaccagtctgaaatccccaaatcgtactgctactataccaaatttaactttcaatactttttttatcacaaatgaacatggtataattcccaacaaaccgattttgtaactaatccccactgttcaggggggaaactcacctaaccccctggcagctacatcagtagctaccaaaatactagattttccagttctaaattccctcaggacatagtcacgttcctgctggctcttatctccgtgcatggacaatgctgaccaaccaatgcttcttattgatcgcgttattccttcaactttctttttggtctctacgaaaatgataattttcgagccagtgtcagcattggtgttgatctcttgcaagagacttcccaacttcctttccttttcatgctcctggcagacatcaacgaactgtacaatattattatttgcagataagttctttgaacctatgttgatgtaaactgggttcttcatgaaatcggaggccaattcaagcacaaggctggccaattgcaatgagtggtcatgatatggttggtatagcacaaacaggatctggaaaaactctagcttatatcctacctgctgcaattcatatcaacaaccaaccacctctaaataaaggggaaggaccaattgttttggtacttgctcctactagagaactggctcaacagattcaagaggtttccaatgattttggccggtctacgaacatccgtaactcttgtatattcggaggtgctcccaaaggaccccaagctcgtgacctacaaaggggtattgagatctgtatcgccacacccggtcgtctcatagattttctcgaaaagggatctactaacctaaagaaatgtacatatttggtccttga

SEQ ID NO: 1946 - DNA, 2820 bp, Diabrotica virgifera
  misc_feature (2678)..(2678): n is a, c, g, or t
cccacgcgtccgcacttagcacaccgcgtttgtgtagattttttcttgaaaaaagaaaaccacctcgaaaatccgaccatgggagacgtagaagtgagctccaacttcaccatcaccgaaaagaagaccaagaaggtcaagaagacgaccaaacaacgcagaggaagtaacgagcaaaccgaagttaccattcaagagctcaaaaatggcaaccagggtggagaatacaccaaggctatgaacaaggactggcacggccaacatttctgctgctggcaatgtgacgaaagccttactggccaacgctatgttctccgcgacgaacatccatactgcgtctcctgctacgaatcagtcttcgccaatgcttgcgaaaaatgtagcaaagtcatcggtatcgactctaaggatttgtcctacaaagacaagcattggcatgaagcctgcttcctctgcactacctgcggagagtccctggtagacaaacagttcggatctaaaggtgataggatctactgcggcaactgctacgaccaacagttcgcctccagatgcgacggatgccacgagatctttagagctggtaccaagaaaatggaatacaagaccagacaatggcatgagaagtgcttctgttgttgtgtatgcaaggtaccaatcggtacccagagcttcatccctcgtgaacaagaaatctactgcgccaagtgttatgaagaaaaattcgcaactcgctgcatcaagtgcaacaaggtgatcaccagtggtggggtaacttacaagaacgaaccctggcatagggaatgcttcacttgcaccaactgccaacgcagcttagccggtgaacgcttcacgtcccgcgacgacaagccttactgtgccgaatgcttcggcgaactcttcgccaagcgctgtaccgcttgcagaaagcccatcaccggtatcggcggcaccaagttcatctctttcgaggaacgccactggcacaacgattgcttcttctgcgcttcctgcaagaccagcttggtcggacgcggattcatcaccgatcaggacgacatcatctgtccggattgcgccaagaccaaacttatgtaaatccgttgacaggtgtcaacgagatcgcggctgtcaactgtcatcgatgccatattgttgacagctgtcaacgaggttgtgaggttgggaaatttgacctgtaggttgacaaaaatctcagaatactaaatacttttatttgttttaaataataaacgacatcaaatattaaataaaagtaattgtaatcattttgtatttacaacgtatggaaaatacattcttgttcatgtgggtcacatatcaattgtttagggagaatattgtaaaaaaaacgtacatatcaaagtcaaaatcaatgattttgtcaacctactaacagatttttgagtgttaaatcaaaagatatggatttttctatttaaattactgtgaatattttttaaagtaatgtcacacaaacacacactatcgtacactctagcggcgaaattgggtaccattttttagttgtaaaaaacagtacttaattccccaaacacacacacaaattcacgcacacatgacattttataaacagaaaaaattaatgaaaaaatttattaaaaaaaaggacaaatcaggtacgacgggttaaataacataaactagcacatgtattctgtctctaaaggacttcaggacatctccattcattatattccaacgaatttccttgtccaacgacatttctttcttctgttatcaaattcgtacagtttttggcaccatatcattgcgcatgaccttagtcatctcagcctgttcttttttttgcgaataggcttgaagtgcaaagttaaatgagtctttgaaacgtcctgctgtaaaggtctttatatgagtaccgttttacctgtatgttcagtaagtattaaattttttaaccacaattttgaggagcaagtccaattttgagtcaagaccataaccaactaatttttacgctattgcttatgatctgtcggtaaaaatgttcacttaccccgtcgtacctacaaattttattttatttttttgaatatgtttaacttttaaagtttttgacaatttagttatgtatctatcgttaatttcttatttagtttattgtcagaggtctattaatttagaatgcttatttatttttatttttttacatttcaagactactactactaatttttaaatcgcttctagcttttgaattttcgatgtatcacataagttggttgagcaataaatcgattgatgatgtagccatattctaaataagtaaaacattgccttattctgatatcgtataataagtgttaatatatcaaataagaaaatctgcgactaattcgacaaaacaattcaacaccttaaatcaagctggccgttgctgtttatcgtaaacgataaaaggccaaaatcggtgcgcgtacgacaaacgtcaaaaattggcatgcctgcgattaacgtcaagaattggcatggctgcgataaacgtcaagaattggcatgtctgcgataaacgtcaaaaattgactcgtcagcgataaacgtcaaaaattggtatgtctgcgataaacggcaacgatctgtaaaggctacacagttaaaaaattatcgcttanaacgtaatctagtttgcttttctgtgtggcgcaaacgagcaaatttagttgactagttcttgaatttttttgtcgacgcaaattgttagtgggcgttaatatattttatttgtaatttatggaaacttttttaagcgtttgt

SEQ ID NO: 1947 - DNA, 4306 bp, Diabrotica virgifera
ataaaatagtaggtcctaatcatttaatgtagagttatttgaaggttgtacatcatgcgatgtcaaaccttcattcatgcagcattgacctacaacatgcccaactacccctaagaatttatttctaagttaataatcccagtcatgatttcaacccgcccccaaaacgtgagctgctccccctcaaccttgagtgcggcctgctatcatgacttcctaaccttctaacttcttttgtagtttgaactcgctcgaaatttttaaattgtttattggtgccttgcttccctccggcggttttggtgaacccttagacccttagtccaaaaccttgtcccgagagttccgcaaagccccccatttcccactctcaagttcgcttaacaaagaggtttaatttatttagttttaactatttttctatccccctacgtggtcaagtgtaaaattaaaatttaaattttgaaatataaatttgaaagtataaaaacaattttcaatttataaagaagttttttttttttttttttttttttttttcaagttttatttttataacaaaggccaggcatctggaatctaatcctagccggaatttgaacaatttattttatttgaacagttacaattttttttatttataattaatatctaactacaaattaactaaatactaattctataaaatagtaggtcctaatcatctaatgtagagttatttgaaggttgtacatcatgcgatgtcaaaccttcattcatgcagcattgacctacaacatgccaaactacacctaagaatctattactaagttaataattatcccagtcatgatttcagcccgcacccaaaacgtgagctgctcaccctcaaccttgagtgcggcctgctatcatgacttcctagcctactaactactttcgtagttcgaactcgctcgaagtttttaaattgtttattggtgcattgctttccctccggcggttctggtgagccattagacccttagtccaaaaccttgtccagagagttccgcaatgcacccaattaccaactctcaagttcgcttaacaatggggtctaatttatttagttttagctatcttactatccacccacgtggtcaagtgtaaagttaaagtttaaattttgaaatataaatttgaaagtataaaaacaatctcaatttataaagatttctataacaaaagctttagggaattcgttgtatgtttcttctttgattgtagagctccagttgttttttggaaactctgtctgtcaagtcgtttagattattataaagttcttcatcatttaaaatttctgctatttgtcttgcttgtaatcgctgtcttaaatcaccgacatcttcgtaaatgtcacagtcgaaaatcgcatgctcgggtgttcctacctgtccacattcacatagatcatcctgcttgaggctgaatctatgcaaataactagggtatgggccgtgacctgttaggaagtgcactaacccaggttttggattgaagtatggtggaatttcattcaaacgtggtatgtattggtagagtcttctccctttcacagacgcatcccattcattttgcctcttcctctctattacattgtttatctcatttctggtgtgtacatgtacacccagaatttcgattactttgtcaggattatgttttcgaagccaatattgacttcctcttctggtaatttctagatgaagtggcaaaactcctgtgagcactgttagggcttctgttggcgttgtactgaaggctcctgtcattctaacaaggaagcctctctgtgctctatccactttttcccgatttttcacgttctttaacctgtgtgcccacgtactggctccataccctattatggacgctagaattgagctaaggtaaacccttacttgacggaacggtaccctgtagtccctctgcgccaggctcgctatgccatgcatcaacctcgttgccttttcacagacgctggtaatgtgcttactgaagagcctaggctcatcaataacgattcctaagtatttcgctgtactagttcttctaataggccttccatcgatccttattataggatctctttccagcctaccttttatcaaactgtaaacggttttggtttgggatatcgaaagcttaactttcgatgtccaattactaattatctgtagtacatcgtttgctttgccttctaattgccttctcgaatcagcgtctattattagcaggagatcgtccgcataagcaatgcaccctagcacgtcaggacacacagtcatttcgccaagcaactcttccagcatgagatcccaaaaaatgggaccacatactgaaccttgagggcatccctttgtgatgtgcctggtctttttggcatttggacagctcagactcgcatacctatcttggcaataatttctgaagcttccgtacaagtcccccgggcaccgcatcctccgaagtctttcaaagaacgcaggccaccagagattgtcgaaggctccagaaatgtctatgaacactgtcacaacatattttccttcactactgtcgacgatttcgtataccttgttaatagcatcttccgtggatttcccgctcctgtatccatactggtcagggtgtaacccgtttatgctccgtacatgatttagtcttgcacacagcagtttttcgaacagttttcccatagtgttaagtaaacaaatgggtctgtaggattttggctgtgtaggatctttgtcttcacctttgcttattattataacatcagcttgtttgaaattgttgggaaattttctttgccttacacattcattgtataaggccacgagagtgggtactacttgctcatgtagagcttgtaatatttcaacgtgaatattgtcaggcccaggggcctttcttttcttcatcgttcttaagttttctctgatttcgttttctgtgaattcctctgtcactggcacgccaggcgtctcatacctctgtatcattgcctctctgatctgagtttgtatttcggtctcgttttctaggtcatcgggtggcagcaacacatctaacaatatgtcagctgattcctcccaactctctgtcaacgagccgtcttccttcaataaagttgaaagcattattgggctttttattttgttagatacgattttgtatgggacaccccacatgtccagttccagatttctcgatacgaacatctcccagctcttcgccttggtttgcactatttcccttttatattcactttttatgtctctgtattcttgcagaagtctctgcctttcgagatagattccacatcgctggtaacgcttacgcgctaatctaactctgcttctcaatctcgtcaggctttccttccaagctgtgtttgttaccgatttggcggaagctactttcggtattgctatatccatagctgctcttattgctgctgttaagtgcttggcttcctcatgtacgttgcatcctctcagtataggacgcggtggcaagaactcagccttcaattgctcccaatttgccttacctagattgtacttcttcttcgatgacaagtacgtgctatttgccgtatttgcaagttcaaaaacgataaagttgtggtcgctggtggtcgcatgttctacaaccttccagtttttgaccaggttagctgccttcacatttgatatagagatatctatgttgctggctgcgcctgctctgttctggaaggttggcggattcccgggtctattatgcacaatcagttgcagttcattaataatgtcctcaactaatgcgcctctctcatccgtttgtggtgagttccacaatactgatttcgcgttggcgtccgccacaaccacaactttctcatttctatatgctagaaatatcgctctcattttttctatgtaaggttctatgtcatcgttgaattgacaatacaggtttgcaattattactttaccaaccttagttagtacttcaacgcatacgcagtgctcgtcactgaactgcctcagcaggaaaagtttcatctcgttgttgaacagtactgtgactgccatgggattatcgcctatactcgctttttgtgctttaaggggcataaactgtattttaccctgttttgtgtatgcttcttgcatgcacacaatgtccaatttctggtcttctgcaaatttccgtacttcatgaagtacggtggtacttctcatacagtttatttgccccaccttaattctcacggatgtcgtgtgtgtatctg

SEQ ID NO: 1948 - DNA, 917 bp, Diabrotica virgifera
caagtgtaacacaaccacatcccaactcggtttcgttttggagtataactttttcgggtttaggctatcacaaaactcctgtaatgatgattttatttaaagtactcactatttccatgtttttccttcttggatcagccaaagaagaagatgttctagatctgggtgacagtgatttcgcatcaagaattgccgaacatgagaccgctcttgttatgttttatgccccttggtgtggacactgcaaaagattgaaaccagagtatgctaaagctgctgaagatttactaagaaatgatcctcctattgctttggtgaaagtagactgtacagaggctggtaaagaaacttgtgataaaaacagtgtaagtggttaccccacattgaaaatcttcagaaatggtgaggtatctcaagactacaatggtcctagagatgcatcaggtattgtaaaatacatgcaatccaaggttggtcccagctcaagagaactgaaaacatctgaatgcttgaaaaacttcctagaaacccaaaaagaatcagtagtcgtgggtttcttcgaaaaagaatcagaccttaaagctgcattccttaaaaccgctgataagcttagagaaaaagttaaatttgcccacacttcattcaaggaacttttagatgcccagaaagtgaaagatggtttggtcttgttccgtccagttcatctgcaaaacaaattcgaagatagcaaagttcaatacagtggatctgctgatgcaggaagcatccaaacatttatcaccaaaaacttacatggcctagtaggacaccgcaaacctgataacaaacaagaattcgaaaaccccttgttcgttgcttacttctctgttgattacgccaaaaatcccaaaggtaccaactactggcgtaacagaata

SEQ ID NO: 1949 - DNA, 931 bp, Diabrotica virgifera
attatcatagtcatccttctgcgccagtgagtgtaaaggccgactataacgaacaaaatcttcttatttttcgttatttttcattttataacaagttttgaaaactgaaacaacatgaagtccgttggtttgtttgtatttttggcttgcattgcaggtttatatgctattcagctcaaatgtgcccaccaagaactgaacattcctaatgaatggatcgatatgcacaaagaatgtgtgcacaaaatgagaggtcaagttgaagaggaacttaaagcttcaatgcaatacatggccatgggtgcccatttctcgaaagacaccataaacagaccaggttttgctgacttgttcttcgatgctgccagcgaagaaagagaacatgccatcaaattgattcattatttgctcatgagaggagaacttacatccaacctgagcgaactcattaaaagaaatcttgtgccttcagttaccacttgggacaatggtgtaagtgccttaaaacaagctcttcagttggaagcttcagttactaggaagatcagagatgttaccaaagtttgtgaagaagctgaatctttcaacgattatcatcttgtcgactacctggcaggcgacttcttaggagaacaataccatggacaaagagacctcgccggaaaagtatccgatttacaaaagatgatggcagaacacggagcacttggagaatggctttttgacaagaaacttcaaaataaagccatcgtataaatgttatagttctatacttaagtatttaaactagtttttcttttaccaacataaaactccgtattagatcataagtctatcttttcgtaaatcttagtgttaccattatgtattattaaaaaaaagtttcggaattataacaaaaataaagacaaattttattgaaataacaatc

SEQ ID NO: 1950 - DNA, 1705 bp, Diabrotica virgifera
acaacagaaaacaaatagagcttggtagcagtttttattttaatacatatacatttatatatagcacatccaaagtgagtggtttacggtaaacataggtactttaggggaaggggcagatattggcccatgtaatggagtgcaaaattaagttggcagactaaatgtaattaaataactgactcaaaataaatgatgagggtaaaaacatacccagcggcttcaacaaaagcataaactagttggcagtgtcgaaacaaaccaaacagccgttttatttaagtgatttgtgcagtgatctatatggttttcgaaatggctgatatcatgtaataatatatttatcttaacccacgcgtccgcggacgcgtgggcggacgcgtccgcgacgatgaaggtattagttcttctttctttagtcgcattcagcgctgctctaccaacacttcttggtagaaccgctctggtcaaagaagatggaactgttactctcaccgactctagaggataccaactggtaatcctcaagagtgttaccgatcccagacaagtcgaagttattctcaggagtccaaacacaagaacccagatgttccaagttggggaaccacttagaactagagaaactatcgaccgtactctcgttggagtttcagcttaccaaaactacaaccaagctgatattcttactgatattttccgtcagtatgaaggtactcttgacgacaccaaatactacagccttcttaacagaatccaaatgttagttgaagctggactcattaatgaaaccatctacgatatcatcagagactgggatcttgaacaccgtgtacaaggaattagtgacattgtccccacccaaggagtaaatactcttcgtcaatacgttggacaagttggagatgttatgccccttggtgaaaatgtacaatctggaatctacagaaactggaacctcgaccaagacttgctccaaaactattctccactcagacatttccaaactcttcttggacaaatccaacagcaacgacaacttcaacaaggtttattgagccaacagcaatatttacctcaacaatatttatctggagaatatcgtcttgaagatcaaatgaacactaaccaaatcttgaaccaaatctacagacaacaacttggacaatctccattgaaccgttatttggtaaacatgagacttgtaaatggacaacaagtatacgaagttcctgaagaattcgttaacattcaacttctcgaacaacttaccgctcaacaagaaatgatcaaccaaagatgggctcaaatgatggaaagaagacaaccaatcactgaagacgttcactctcagcaacatctgattaaccaacagatcgaaaaacttattgaacaattagcttaccatcaaaatctcattacacgtgaagttgaacaatacattgttaaaggacaagtagttccccagcaacttgtttaccaacagagattggtttaccaacaagttcatgaagtaattgaacgtttatactaccaacagctcttcatgactcgcctagccgaaaacataactgaagtcggtactatttcccttcaaagatggattttacagcacaatattattaacgagcagatccaacaattgatccaacaagttttgtaccaacaaactcacgtaagggaacaaatccaagtattgattcac

SEQ ID NO: 1951 - DNA, 1113 bp, Diabrotica virgifera
acccacgcgtccgcaaacgcgtgggtttcagaagaaaaatcagaatgaagctgttcatccttgctgctgccctcattgtagccacaagtgccaatctaggtgccttcgaaaaatggactagttttaaggccacccataacaaatcttacaacgttattgaagacaaacttcgtttcgctgttttccaagagaacctcaaaaaaatcgaggaacacaatgctaaatacgaaagtggagaagaaacctactatttggctgttaacaaattcgccgattggtccagcgctgaattccaagctatgttggcccgtcaaatggctaacaagccaaaacaaaccttcattggaaaacacgtagaagatcccaatgtccaagctgcagatgaagttgattggagatcaagcgctgacttgggagtcaaggatcaaggaaactgtggatcatgctgggctttcagtaccaccggatccctcgaaggtcaactcgccatccacaaaaatcaacgtgttcctctcagtgaacaagaattggtagactgtgacacagtaaatgctggttgtgacggaggtttgatgacagatgcctttaactatgttaaaggccatggtctctcttccgaatctcaatatgcatacaccggcagagatggtcgctgcaagaatgttcagaacaaacaagtctcttccatcagtggctacgtagaacttgcaacaactgaaaatgcactcgtttccgctcttgctagcgtaggtccagtttccatcgctgttgatgctgatacatggcaattttatggaggtggagttttcaacaacagaaactgtggaaccgccctcaatcacggtattcttgctgttggatacactaaagatgtattcattgtcaagaactcatggggaactagctggggtgaaaaaggttacatcagagtagcccgtggtcacaacttgtgtggtattaacctcatgaactcttaccctaaattgtaaatgatttaatgtaaatgaaacaccaaatagaattcaaaattaaagataaataaacaactaaaaaaaaaaaaaaaaaaaaaaaaaaaaaaaaaaaaaaaagaaaaaacaaaaaaaaaaaacaaaa

SEQ ID NO: 1952 - DNA, 1380 bp, Diabrotica virgifera
ataacccaagtggcatcttgtctcgtaagttttgaaaataattcttttaaagtttttgccatccattagtaatatttgataatttttgaaccaataaatagtaacatgaattttaatattaatttggatattatttctagaacaattcgtataattattggcaattttaacattttcaattttgttaacctgtcttttactctaagcctaagtttttaattagtaattaagtataaaaatttagattgttgctcaatacgacataaacatttattaaattaaacatgccacaagaaaagtgtctcagaaccttccaaatttggataggatttgaggtttatcgtaactcaaattaaacgtaaagatgtcgggaggaatcgaggctttaagccttaaagaggacgatgttaccaagatgttggcggcttccacccatcttggaacagcaaatgttgattttcaaatggaacagtatgtatacaaacgtcgtcatgacggtactcacatcatcaacttaaggaaaacgtgggaaaagattctcttggcagcccgtgccattgttgctattgaacaccctggtgaagttttcgtaatttcatctcgtccctatggccagcgtgctgttcttaagtttgctgctcacactggagctacccctattgctggaagatttactcctggtgcttttaccaatcagatccaagctgcattcagggaacctcgtcttttgattgtcactgaccctgcttttgatcaccaacctatcactgaagcctcttacgtaaacattccagttattgctttgtgcaatactgattctccattacgttttgttgatattgccattcccggaaacaacaaagcctcacacagtattggtttactgtggtggcttttggctagagaggttctccgtcttagaggaatcattccacgggataccaaatgggatgttgtagtagatctgttcttctaccgtgaaccagaagaggctgaaaaggaagaacaagctgccaaagaagctgtggctgctgttgtcaaacctgtagatatcccagctcctcttgaaggccaagacttggactggaatactactgaaactactgattggaatgctgaagttgcaccagttgctcctgttgctgcacctgcatacaatgttagtgctactcaagattgggcttctgaagttgctcaagaggaatggtctacaagtcaaccagctgctcctgctgctccagctgctgctgctccaaattggggaggtgccagtgaatggcgttaaaaatactgttttggaccaataaataaaaccctttattacccgtaaaaaggggggggggggggggggggggggggggggacggagggggggggggg

SEQ ID NO: 1953 - DNA, 2856 bp, Diabrotica virgifera
ccccccgctaattttttcccaaaaggcccctttccccttgggcaggggtttcgctaagatgaggggggtaggggacagtggggaaattctcgtttaatcccatttcaattccgcgtcccctaattaggatgaggaggcaatttggttccctttaagaagaatcaaaaagtttcttcccgccgtttacccggcgcttgcttgaaatttttttccctttgccattcaggaccccggggcagaaaatccccatggggtcaacacccgctggggcccatcccaatgcttggttttaattagacagtcgaattcccttagtccgtcccagttttgacactgaccgttcaatggcggccgaagaggacatccaagcacccgaaagtaactcagagcctcgcagcaagacggttccgcgggaggccaaggcacgggaccgaactcggatccatgaaacccaactcgtaagaattaggctcacttcacctcacccaggcccggcacgtcagccatgacccacttcctcgccaagcccgacacgccccgatcctcagagccaatccttatcccgaagttacggatccaatttgccgacttcccttacctacattattctatcgactagaggctcttcaccttggagacctgctgcggatatgggtacgaaccggtgcgagcctccacgtggccctctcctggattttcaaggttcgaggagaagatccggacaccgctgcaactgcggtgctcttcgcgttccaaaccatatctccctgctagaggattccatggaactcgaacgcttatacagaaaagaaaactcttcccggatctctcgacgacgtctccaggtccttttgggttaccccgacgaactctcttgcgagggcccgactttttgacggttccgctaccgggttccggaataggaaccggattccctttcgcccaatgggtgtgtacaatctttttacataaaatgtacgtaaataaagctacaccacatcaacatcggctttcgcctagggcttaggatcgactgactcgtgtgcaacggctgttcacacgaaacccttctccacgtcagtcctccagggcctcgctggagtatttgctactaccaccaagatctgcaccgatggcggctccagacagcctcacgactagcccttctgcgcacaccaccgcgaccctcctactcgtcagggcttcatagtcgctattaacgaaccgcacatgccgctgacggttgagtataagcacgacgctttagcgccatccattttcagggctagtaacttcggcaggtgagttgttacacactccttggcggattccgacttccatggccaccgtcctgctgtcttaagttaccaacgcctttcatggtatcccataagcgtcgattttggcgctttaactcaacgtttggttcatcccacagcgccagttctgcttaccaaaaatggcccacttggcactctgattcgtttctcacggcttcataagttcgagcaagccgaagatctcacccatttaaagtttgagaataggttgaggtcgtttcgaccccaatgcctctaatcattcgctttaccggatgaaactcgtacggaacgagcgccagctatcctgagggaaacttcggagggaaccagctactagatggttcgattagtctttcgcccctatacccagttccgacgatcgatttgcacgtcagaatcgctacggacctccatcagggtttcccctgacttcgtcctgaccaggcatagttcaccatctttcgggtcccagcgtgtacgctcttgatgcgcctcttctcgcaatgagaatgagacactctgggagtgcgaagcggcaacttttaagggcaaaccgcttatcctccctcgatctacgcaaggtaaacctttactttcattacgcctttaggtttagttatatcccaatgactcgcgcacatgctagactccttggtccgtgtttcaagacgggtcctgaaagtacccaaatctagagcgtcgctgatcggcgtttcatacgaggtctgttcgagaccaccgtaccccaccatcgttctggatagaatcggcaccaggtccgatcgccatcaaacacagaacgtgcttgctacgggccgaacgctaactgaagtagcggccctgcgccattagtataccgtcgagcgagtctgtcggaacatcaagggtccgcataattaaaaattacgcgggctccacctcgagtcttagacagacacccaacggatcgcgacgtcctactagaggaaaagtgcacgcgttcgacatcgacacgaagaatataagaagcggacgacgccgaaacgctatccgtcatacaaacatccaacttcgacagtcgaaacgcgaatgaatttcctctttcgacctttcggatttctcaggtttacccctgaacggtttcacgtactattgaactctctcttcaaagtgcttttcaactttccctcacggtacttgttcgctatcggtctcgtggtgatatttagccttagatggagtttaccacccacttagggctgcactctcaagcaacccgactctgaggagagatcctcccgcaatcggcgacggtcactacgggcctggcaccctctatgggctgtggccccgttcaagaaggacttggacgcaccgcacgatctcgggataaatggaccctccctaacaccacatttcccggtgacagatgtccgccacgggattcggtgctgggcttttccctgttcgctcgcagctactaagggaatcctagttagtttcttttcctccgcttagtaatatgcttaaattcagcgggtagtctcacctgctc

SEQ ID NO: 1954 - DNA, 1789 bp, Diabrotica virgifera
ggccgcccttttttttttttttagttatatatctgtttattgtcaaacaataaaaacatttacactttaactggatgcagctgcggcaggagcagcagccttctcttcttccttaactctatctttcttgagaggacccatgaatgcagctttgtcagcagctgtctggaatctaccatgaccgaatttggatgaggtatcaatgaatttaagattgatcttctccaaagcaatacgtttagtgtggactaacaatgacttcctcaatgtaataacacgtttctttggtcccatacaacatcccttaatcataacgaagtcattgttaacttcaccataatgaggaaaaccacccattggggtaatagttttttcactaagatcataggcagtggctgcattatttttaacaaccttgccatctttagtgtggattccagcaccaattctgtagatctttttgttcatctcagttctatgatggtaacccttttgaccagcacgagcaactgtgaatgatactcttgaaggatgccatgctccaatacaggcaactttacgaagacctttgtgtgtcttacggggcaatttctttgtgtgccaacgagaagtaacacctttgtatccatgacccttagtaacacctatgcaatcaatcatttcatcttgagcaaaaacgttggcaatagggataggcttttcaagatgttctttagcccaagctactttgtcagctacactaccaccattcaattgaatttccataatatgggctttcttttgacgttgtttcaacaatttcatctgagtatgagcaataactctgacaactttacagtatttaacaatcttctttaagtccttttcgatggacttctttcctaaatcgtcactccatttcttggaagctttggtaaatgccttcttcttgctcttgtaccagttcttgtagaagcgcctgcggcaatcttcagagagatgctcagcccaaactgtggctaaagccctaagcccatgtggagtttcgatgtaaccgacaacaccaacaattaccatgggtggagtttctaaaattgttacagcctctacaatttcttttttgttgatctttgatccaggtctgtctgcctctcttaccacgtgggtcatggatacaaaggtgttgcttctcgttggcacacaaagaaattgccccgtaagacacacaaaggtcttcgtaaagttgcctgtattggagcatggcatccttcaagagtatcattcacagttgctcgtgctggtcaaaagggttaccatcatagaactgagatgaacaaaaagatctacagaattggtgctggaatccacactaaagatggcaaggttgttaaaaataatgcagccactgcctacgatcttagtgaaaaaactattaccccaatgggtggttttcctcattatggtgaagttaacaatgactttgttatgattaagggatgttgtatgggaccaaagaaacgtgttattacattgaggaagtcattgttagtccacactaaacgtattgctttggagaagatcaatcttaaattcattgatacctcatccaaattcggtcatggtagattccagacagctgctgacaaagctgcgttcatgggtcctctcaagaaagatagagttaaggaagaagagaaggctgctgctcctgccgcagctgcatccagttaaaatgtttttattgtttgacaataaacatatataaccaaaaaaaaaaaaaaagggcggccgcgcgcgattcggaacgagt

SEQ ID NO: 1955 - DNA, 1390 bp, Diabrotica virgifera
actagttctagatcgcgagcggccgccctttttttttttttttgttattttaatttatttgtgtattttactacacaatattaaatttaagaacattttaagattcttgatcttggagtttggccaagtaggacttctttttctgtgcaacacggtccttgcgttcagccaaagtaagcttcctacggttccatctctttgcaggtgctggagccttttcagccttcttttctaattcaggatttgcacgaatggcagcatgggcattcttgtacatattttcaatctggtcagcattaattcccagcttaatgtattgactgaattgcctcttgaatgcctctgggtcttcctcctccagtgatttcatataatcagcaacatggatgccaaaaatgtgattcctgtggacttcagcattgaagcttttggattcgctgtcaaaaccagggaatctttttgtagagtggggaatgtttaagcctccatcgacagctcctttcatggctccaaagacacgggcgccagtactggtacggtttaaacctgtgtccaagtaacacctgaatgctcctggtctgtgcattttggaaaatgttcactcattaacttcttttgctgaggcataaaatataagtgtttaatgagatagttccatagaagtaaaactgaatttactgttctttgccacaaattcatgttactgtcgtaatctaagaagaaatctggaaagtacgatggttcaagtggactgcctactatagggtttacccagaaacttggtccagttacaccaaagacaattaatggagcattgtaatgacattgaagaatattgagagcgtctgatttgaaattttgtacaattactacatcaaatttttcatttgagttaatcaacttcttaaaattctcatggctaagagcggcattagtaatttggctgcccataaaattgataaatccaatcattatgaaaggacttatgttgcccatttcaatagttggaccatcttttgcttctactaaacctgttaaaactacatccttataaccttttagcgggtttttatcttcataaggactaactactgttacttggtgtccagcttctacaagacctcttcctagtgcatttccaagaataaaatgactacgtgaaaccataggacaaactataaggacattatagttatgtacagaatatattaatgtggataaaattaaaatagttatcttcattatatattttagttattcattcaggcggctttccaatacactaaccttttaatatcctttataatttggagcacgaaatattgtagaatgtttcagtttctctgtgaatatggttatggtgaaggtgaaggtgaagatgaatattgtt

SEQ ID NO: 1956 - DNA, 1208 bp, Diabrotica virgifera
attatacaagattttttatttaaatcaactgaacggcttcctagatgcttaatagactagaataaaagggcacatcaaagctcacaaattagtgtgacactttctgaatcttttcacaatgtctgaaatacaatatataaattaattagttaattattcttcacaccatgatgactagatgataaatcgcccacgcgtccgagctaaaactgaaagttgttctgcttagaagtattgtatatgagaatattaagtgagagaagggttgtcaattaaaaatggagataagtccatggatttatttattggttacactagctacgctagtatatatatatactctaagcgacagttctcgtactggaaagacaggaatgtagtacacatcgaaccagtgttcttttacggtaacatcaagccagtaatgaagagaagagcccacataaccgatgttcttggagaactttacaataaagttaaagcgcaaggaaagcgttttgggggtcattatgcattgttcactccccagtttattccggttgatttggacttgattaaatgtatattacataaagattttgcctcttttacgaatcgcgggctttatgttaacgaagaaaaagatccccttaccggtcatctcttcaaccttgaagatgagaagtggaggaatcttagagccaagcttacgccaacttttacatcagggaaaatgaagatgatgttccaaactatggttagctcatcagaaggccttcaagaaatgctcaagactacttcatcgagcacagagcccgtggacataaaagacattttaggctgcttcaccactgacgtcatcggatcagtggcattcggtctggatataaacagcatgaagaacccagactctgaatttagagaatacggtaaaaggattttcagaactacactaatgggtaggattaaattcatgtttcttactatattcccgcggtggctatctaagaaaatcggaataaaaatattttccaaagatactgaaagcttttatattaatttggtgaagaaaacagtggcgtacagagaggaaaacgacgtttacagaaaagactttatgcaactactttatcagttgaagagtatgggcaaggtttctgaagaaaatgaagaccagttggtgcaaaagaccaaaatagcaacatcccagggtttgtctctaaacgaaa

SEQ ID NO: 1957 - DNA, 1824 bp, Diabrotica virgifera
ccacgcgtccgcgacgatgaaggtattagttcttctttctttagtcgcattcagcgctgctctaccaacccttcttggtagaaccgctctggtcaaagaagatggaactgttactctcaccgactctagaggataccaactcgtaatcctcaagagtgttgccgatcccagtcaagtcgaagttgttctcagaagtccaaacacaagaacccagatgttccaagttggggaaccacttagaactggagaagctatcgaccgtaccctcgttggtgtttcacggtaccaaaacaacaaccaaggtgatattcttactgatattttccgtcagtatgaaggtactcttgacgacaccaaatactacagccttcttaacagaatccaaatgttagttgaagctggactcattaatgaaaccatatacgatattatcagagactgggatcttaaacaccgtgtacaaggaattagtgacattgtccccacccaaggagtaagtactcttcgtcaatacgctggacaagttggagatgttatgccccttggtgaaaatgtacaatctgtaatctacagaaactggaacctcgaccaagacttgctccaaaactattctccactcaggcatttccaaactcttcttggacaaatccaacagcaacgtgaacttcaacaaggtttattgagccaacagcaatatttacctcaacaatatttatctggagaatatcttcttgaagatcaaatgaacactaatcaaatcttgaaccaaatctacagacagcaacttggacaatctccattgaaccgttatttggtaaacatgagacttgtaaacggacaacaagtatacgaagttcctgaagaattcgttaacgttcaacttctcgaacaactcaccgctaaacaagaaattatcaaccaaaaatggactcaaatgatggaaagaagacaaccaatcactgaagacgttcaacatcagcaacaactgattaaccaacagatcgaaagacttattgaacaattagcttaccatcaaaacctcattacacgtgaagttgaacaatacattgttaaaggacaagtagttcctcagcaacttgtctaccaacagagattggtttaccaacaagttcatgaggtaattgaacgtttatactaccaacagctcttcatgactcgcctagccgaaaacattactgaagtcggtaccatttcccttcaaagatggattttacaacataatattattaacgaacagatccaacaattgatccaacaagttttgtatcaacaaacccacgtaaggcaacaaatccaagtattgattcaacaaggagaggttatcccacatgaactcgtcctgtaccaaagaattacttaccaagatgttgaaagagttcttcaagttttgattaaacaattcgtatatcaacaaacctacttcaaacagttgattcaacttttgggacaacaaagatacgccgttccccaagaattggtttcccaatacttcactatttacacccaattagttcaattgatccaacacggagatgttgtaccccaagaattgatctaccaacaaagactaatccaccaacagattgtacttatgctccaacaattgaaagttgttccccaacaagtaatgacccagatggttcctaccacacaagaacgtttgtggcaaactcaataccaaactctaccacgcgtgtattaaaaactgctttatttgtaatttgttgttaaaatgtttgttataattgttgaaaatatataaacatttgttttttcaaaaaaaaaaaaaaaaaacttgggggg

SEQ ID NO: 1958 - DNA, 1299 bp, Diabrotica virgifera
agttatatatctgtttattgtcaaacaataaaaacatttacactttaactggatgcagctgcggcaggagcagcagccttctcttcttccttaactctatctttcttgagaggacccatgaacgcagctttgtcagcagctgtctggaatctaccatgaccgaatttagatgaggtatcaatgaatttaagattgatcttctccaaagcaatacgtttagtgtggactaacaatgacttcctcaatgtaataacacgtttctttggtcccatacaacatcctttaatcataacaaagtcattgttaacttcaccataatgaggaaaaccacccattggggtaatagttttttcactaagatcgtaggcagtggctgcattatttttgacaaccttgccatctttagtgtggattccagcaccaattctgtagatctttttgttcatctcagttctgtgatggtaacccttttgaccagcacgagcaactgtgaatgatactcttgaaggatgccatgctccaatacaggcaactttacgaagacctttgtgtgtcttacggggcaatttctttgtgtgccaacgagaagtaacacctttgtatccatgacccttagtaacaccaatgcaatcaatcatttcatcttgagcaaaaacgttggcaataggaataggcttttcaaggtgttctttagcccaagctactttgtcagctacactaccaccattcaattgaatttccataatgtgggctttcttttgacgttgtttcaacaatttcatctgagtatgagcaataactctgacaactttacagtatttaacaatcttctttaagtccttttcgatggacttctttcctaaatcatcactccatttcttggaagctttggtaaatgccttcttcttgctcttgtaccagttcttgtagaagcgcctgcggcaatcttcagagagatgctcagcccaaactgtggctaaagccctaagaccatgtggagtttcgatgtaaccgacaacaccaacaattaccatgggtggagtttccaaaattgttacagcctctacaatttctttcttgttgatctttgaaccaggtctgtctgcctctcttaccacgtgggtcataccagctttgtaacctatgaaggccgttaagtggacaggttttgagggatcatcttttgggaaagcctttacctttccacggtgtctctgggatctctttttggggtagaatcccatcgatccatgacgtggtgcactgaactttctgtgagacatcacgcggacgcgtggg

SEQ ID NO: 1959 - DNA, 1862 bp, Diabrotica virgifera
  misc_feature (1298)..(1298): n is a, c, g, or t
cggacgcgtgggcggacgcgtgggcgaagatgaaggtactagttctgttttctttagtcgtactcagcgttgctctaccaacactccttggtagaaccgtaagagtcaaagaagatggaactgtatctctcttcgactctagaggataccaactcgtaatcctcaagagtgttgccgatcccagtcaagtcgaagttgttctcagaagtccaaacacaagaacccagatgttccaagttggggaaccacttagaactggagaagctatcgaccgtcgtaccctcgctggtgtttccgtttaccaaaactacaaccaagctgatattcttactgatattttccgtcagtatgaaggtattcttgacgacaccaaatactacaaccttcttaacagaattcaaatgttagttgaagctggactcatcaacgaaaccatctacgatgtcatcagaaactgggatcgtgaataccgtatgcaaggaattagtgacattgtccccgtccaaggagtacgtaccctccgccaatatgctgaacaagtaggagatgttatgcctcttggacaaaatttgcaatatggaaaccaaagaaactgggctcttgaccaaggtttgttgcaaacttattctccactcagacatttccaaactctgctcggacaaatccaacagcaacgtgtacttcaacaaggtttattgacccaacaacaatatttacctcaacaatatctatctggggaataccttcttgaagatcaaatgaacactaaccaaatcttgaaccaaatttatagacaacaacttggacaatctccattgaaccgttatttggttaacatgagacttgtaaacggagagcaagtatacgaagttcctgaagaattcgttaacgttcaacttctcgaacaactcttcgccaagcaagaattgatcaaccaagaattgactgaaatcaccgaaagaagacaaccaatcactgaagacgttcactaccagcaacaactgattaaccaacagatccaaaaacttattgaacaattagcttaccatcaaaacctcattacacgtgaagttgaacaatacattgttaaaggacaagtagttcctcaggagcttgtctctcaacagagattggtttaccaacaagttcatgaagtaattgaacgtttgacctcccaacaaatattcttgaatcatctagccgaaagcactgaagcaactgaagtcgatactatttcaattcaaagatgggttgtacaacaaaatattattaacgagcagatccagcaattgatcaancaagtttttgtaccaacaaactcacgtaaggcaacaaatccaagtactaattcaacaaggacatgttatcccacaggaactcgtcctttaccaaaaaattacctaccaatatgttgaaagatttcttcaagttttgattaaacaattcgtaaatcaacaaaccaactacaaacagttgatccaaattttgggacaacaaagacacaccatacctcaagaattggtttcccaatatttcgctatgtacacccaattacttcaattgatccaacacggagatattgtaccccaagaattgatctaccaacaaagacaaatccaccaacagatcgtactcatgctccaacaattgaaagttgttccccaacaattagtcaaccaactcgtgttcaacacacaagaccgtatgtggcaaactcaaggaacttaccaaagagtaccacttatgatgcaaagaacttaccaaagagtaccactcatgatgtaaagactggtttatttttaatatgttgtttaaaatatttgttatgattgctacaaataaataaatattttttgtatatt

SEQ ID NO: 1960 - DNA, 1661 bp, Diabrotica virgifera
aagcagatataaacaatttattgataatctcaaaagcaaatacaaagctatataaaagtatgcaacagtttaaataaaaattctcgttttttcacatatataataacctcataaaatttctttaaaagtataaattgtagcctaggaagagttataatataatcttcgataacgacaaggacaaaagtttcattatatgcaaattctttgcaatcgaaaaagtaaatgttgtttctacattgtatttcgcttttttaacacaatcaattgcactcatcttatactattttataaataatctcatttaaaagtaaggccatacaatatctagaatatacaaataaattagattttctttccctttttggtatttccaatccattttttaaaatgcgttcacacgtacagcttacactatataattgaaaaaatacataacttacagagcattattgtttaaatttatctgctgcatagattgattcataaggttcattctaataactgtacagagcagaaatatacgtcacataatcttgtatcgagcaaagcattgaacaattttgaagctgttaattctagccgccaccctcattgtggccataaatgccaatttatctgcctttgagcaatggaccagttttaaggcaacacacaacaaattttacaacgttattgaggacaaacttcgttttgctgttttccaagagaatctccgcaaaatcgacgcacacaatgctaaatacgaaaagggagaagaaacctactacatggctgttaacaaattcgccgattggtccagcgcagaattccaagccatgttggaccgtcagatggctaacaagccaaaacaatccttcattgcaaaacacgtagtcgatcccaatgtccaagctgtagaagaagttgattggagagaaagtgctgttttgggagtcaaagatcaaggacagtgtggatcatgctgggctttcagtaccaccggatccctcgaaggtcaactcgccatccacaaaaatcaacgtgttcctctcagtgaacaagaattggtagactgtgataaggtaaacgatggttgtgacggaggtttgatgacagatgccttcttttatattgaacatcatggtctttcatcagaagaacaatacccctatacaggcgtagatggtcattgcaatcatgtaaaagacaaacaagtctcttcgatcagtggttacgtcgaacttgatgaaactgaaagtgctctagctgatgctctcgctaatgttggtccagtgtcaatagctgtcgaagctgatacatggcaattctattcaggtggagttttcaacaataaaaattgtggagacgctcttaaccacggtgttcttgctgtgggatacactaaagatgtcttcatcgttaaaaactcatggggaacaggctggggtgaacaaggttacatcagagttgcccgtggtagcaacttatgtggtattaacctcatgaactcttaccccaagttgtagataacagttaatgaaaagtgatatatttataataataaatgatataaattaaaaaaaaaaaaaaaaaaaaaaaaaaaaaaaaaaaaaaataaaaaaaaaaaaaaaaaaaaaaaaaaaaaaaaaaaaaaaaggaaaaaaaaaaaaaaggggggg

SEQ ID NO: 1961 - DNA, 1665 bp, Diabrotica virgifera
gttatatgttcaattatatttatattattttatcaccctttaacttgtggtttaatattattaatacaaacaattttcacatcagttattacaggagtaataaattataattactgattttcttatattttatttttaattatagaaggaggaatattaattctttttatttatataaccagaattgcttcaaatgaaaaatttaaatttaattttaatataactttaataataattagaatttttattattatttctatattaagatttattttagattatttttattttaattcttttataaaaattatagaaatgaataaccaatttaatattattaataataaattatctttaattaaatattttaattttccaaataatttaatcataataataataattatttatttatttatcactttaattgcagtagtgaaaattacaaaatttttatatggcccattacgacaaaaattttaatgaaaatacctttacgaaaaattaatcctctattaaaaattattaataattcattaattattttaccaaccccctctaatatttcttcaatatgaaattttggatcattattaggactatgtttaggaattcaaattattacaggcctatttttagctatacattactgcccaaatgtagaattagcatttaatagagttgctcatatttgccgagatgtaaattatggttgattactacgaacattacatgcaaatggagcatcattttttttttatttgtttatacatccatattggtcgaggaatatattatagatcttataatataattgaaacttgaataattggagtaacaattttttttcttacaatagcaacagcatttctaggatatgtattaccatgaggtcaaatatcattttgaggagcaacagtaattactaacttaatatcagctattccatatttaggaaatatattagtccaatgaatttgaggaggatttgcagtagataatgcaactttaactcgattctttacatttcattttattttaccttttattatttttgcatttataattattcatcttttatttttacatcaaacaggatcaagaaatcctttgggaacaaaaagaaatattgataaaattccatttcatccttattttacttttaaagatatccttggattcttaattttattattattattaacaacattaactttaaaagacccatatttattaggagaccctgataatttcacccctgcaaatcctttagttacaccagttcatattcaaccagaatgatatttttttatttgcatatgcaattttacgctcaattccaaataaattaggaggagtaattgcattaataatatcaattgctattttatatattttaccctttattaataaaaaaaaatatttaagaactcaattttatccaatcaataaaatattattttgaagattactatccattgtaattttattaacatgaattggagcacgaccagtcgaagacccatatattttaactggacaaattttaactattgtatattttttatattatttaataaatccattaataagaaaatgatgagattcaattatttttaattaaaaaaaaaaaaaaagggcggccgcacgcgatctagaacgagt

SEQ ID NO: 1962 - DNA, 2161 bp, Diabrotica virgifera
  misc_feature (2135)..(2135): n is a, c, g, or t
gcgagcggccgccctttttttttttttttatatttatctaaatataaaaattattttatatatttggtcctttcgtactaaaatatattaataaattaaagatagaaaccaacctggctcacaccggtttaaactcagatcatgtaaaattttaaaagtcgaacagacttaataatatagctgctacaccaattataaactttaatccaacatcgaaaagattataatacccatgttcgtccgtctaaagatctggtctactggcaaggatcgatcccaccgtaaaccgataatctcaacggaaataagggctcgtgcgacagtcgtagcgaactacgattgcctagtaaagtcacattgttttgagcctttcgactctcggaactccaagagatatcgttgccacctttgactagaaaggatacggccttagaggcgttcaggcataatcccacggatggtagcttcgcaccattacccgctcgagtaagtgcgtcaaccaaatgtccgaacctgcggttcctctcgtactgagcaggattactatcgcaacgacgagtcatcagtagggtaaaactaacctgtctcacgacggtctaaacccagctcacgttccctgtctatgggtgaacaatccaacgcttggcgaattctgcttcgcaatgataggaagagccgacatcgaaggatcaaaaagcgacgtcgctatgaacgcttgcggacgcgtgggcgacgatgaaggtattagttcttctttctttagtcgcattcagcgctgctctaccaacacttcttggtagaaccgctctggtcaaagaagatggaactgttactctcaccgactctagaggataccaactggtaatcctcaagagtgttaccgatcccagacaagtcgaagttattctcaggagtccaaacacaagaacccagatgttccaagttggggaaccacttagaactagagaaactatcgaccgtactctcgttggagtttcagcttaccaaaactataaccaagctgatattcttactgatattttccgtcagtatgaaggtactcttgacgacaccaaatactacagccttcttaacagaatccaaatgttagttgaagctggactcattaatgaaaccatctacgatatcatcagagactgggatcttaaacaccgtgtacaaggaattagtgacattgtccccacccaaggagtaaatactcttcgtcaatacgttggacaagttggagatgttatgccccttggtgaaaatgtacaatctggaatctacagaaactggaacctcgaccaagacttgctccaaaactattctccactcagacatttccaaactcttcttggacaaatccaacagcaacgacaacttcaacaaggtttattgaggcaacagcaatatttacctcaacaatatttatctggagaatatcgtcttgaagatcaaatgaacactaaccaaatcttgaaccaaatctacagacaacaacttggacaatctccattgaaccgttatttggtaaacatgagacttgtaaatggacaaaaagtatacgaagttcctgaagaattcgttaacattcaacttctcgaacaacttaccgctcaacaagaaatgatcaaccaaagatgggctcaaatgatggaaagaagacaaccaatcactgaagacgttcactctcagcaacatctgattaaccaacagatcgaaaaacttattgaacaattagcttaccatcaaaatctcattacacgtgaagttgaacaatacattgttaaaggacaagtagttccccagcaacttgtttaccaacagagattggtttaccaacaagttcatgaagtaattgaacgtttatactaccaacagctcttcatgactcgcctagccgaaaacataactgaagtcggtactatttcccttcaaagatggattttacagcacaatattattaacgagcagatccaacaattgatccaacaagttttgtaccaacaaactcacgtaaggcaacaaatccaagtattgattcaacaaggacaggttatcccacaggaactcgtcctctaccaaagaattacctaccaaaatgttgaaagaagtcttttcagtttgattanacaattcgtctatcaacaaacctact

SEQ ID NO: 1963 - DNA, 2234 bp, Diabrotica virgifera
tcttcgtccgtttttttttaaatataaacttaaatttatttcaaaaatacaagttattcttcttgtacaacagttgttttttcagatacataaagcccatctaagaatttacggatatccttatttttaactgttgtagattgttgaataagggcagctgactttgaaacatcctccaatgagtttccttcaatgataagttcatccttttgtttggtggagtttactactgtaacacctggggccatctttactcttctgatgtatttttctcccaagaaatttctaatttcgataactgtgtttccttcagtggtgacacagttaatgggaaagtgagcatatgctgctctcatcttgtattggtatccttttgtaacaccctttaacatgttttcatacagcacgtgtcggtgaaatcggtgctgttatagtaaaaaacaagcacaatggctcccaaacgtaataatatgattccaaatggccatttccacaaggattggcaacgattcgtcaagacttggtttaaccagcctgcccgtaaaattcgcagaaggaataatcgtattaagaaggctcgtgctattgcccctaggcctgctgctggacctttaaggcctgtcgtaaggtgtccatcaatcaggtaccatactaaagtacgcgctggacgtggatttaccctccaggaattaaaagctgcaggtcttaaccccagatttgcaaggactgttggtattgctgtagatcacagacgaagaaacaaatcagtagaatcaatccaactgaacgctcaacgtcttaaagaatacaaatccaaattaatcctcttccccatccacgaaaagaagaagattagagctggtgaagccactgaagaagaacgtagaatagcttcacaattacagggagaagttctccctatcaaacagtcaagtctcagaacaaaggctagagttccaactgaggaggaaaagaaatttgaagcatatgtaacattgaggaaggcccgtgccgatgcaagacttgtaggtatccgtgctaagagaattaaggatgctgcagaaaacccagaggatgtgacaaaagctgctgcaggcaaagaaaagaaatccaaaaagtaaattaatgtataatttttatataagataataaaggatttgttaccaaaaaaaaaaaaaaagggcgccgtcgcaataacccaagtggcatcttgtctcgtttatcgtaactcaaattaaacgtaaagatgtcgggaggaatcgaggctttaagccttaaagaggacgatgttaccaagatgttggcggcttccacccatcttggaacagcaaatgttgattttcaaatggaacagtatgtatacaaacgtcgtcatgacggtactcacatcatcaacttaaggaaaacgtgggaaaagattctcttggcagcccgtgccattgttgctattgaacaccctggtgaagttttcgtaatttcatctcgtccctatggccagcgtgctgttcttaagtttgctgctcacactggagctacccctattgctggaagatttactcctggtgcttttaccaatcagatccaagctgcattcagggaacctcgtctgttgatcgtcactgaccctgcttttgatcaccaacctatcactgaagcctcttacgtaaacattccagttattgctttgtgcaatactgattctccattacgttttgttgatattgccattcccggaaacaacaaagcctcacacagtattggtttactgtggtggcttttggctagagaggttctccgtcttagaggaatcattccacgggataccaaatgggatgttgtagtagatcttttcttctaccgtgaaccagaagaggctgaaaaggaagaacaagctgccaaagaagctgtggctgctgttgtcaaacctgtagatatcccagctcctcttgaaggccaagacttggactggaatactactgaaactactgattggaatgctgaagttgcaccagttgctcctgttgctgcacctgcatacaatgttagtgctactcaagattgggcttctgaagttgctcaagaggaatggtctacaagtcaaccagctgctcctgctgctccagctgctgctgctccaaattggggaggtgccagtgaatggcgttaaaaatactgttttggaccaataaataaaaccctttattacccgaaaaaaaaaaaaaaaagggccggcc

SEQ ID NO: 1964 - DNA, 2716 bp, Diabrotica virgifera
agggtaaacccttttagaccagcaggagcaactgggaaggatactcttgaaggatgccatgctccaatacaggccactttacgaagacctttgtgtgtcttgcggggcaatttctttgtgtaccaacgagaagtaacacctttgttatgcatgagccttagtaacacctatgcaatcaatcatctcatctggaacaaaaacgttggcaatagggatagaattttcaagatgttctttagttcacactactttgtcagttacgctagcaccattcaattgaatttgcataatatggggtatattttgacgttgtttcacacaatttcatctagagtatgaccaatagatcggacacccttacagtatttatcaatcttttttaagtccttttcgatggacttctttcttaaattgtctctccatttttgggcaaaaatgtataataaacttttgaggctattgtgactttcatagtaatttgtctcacataagtctaaaactgtgcatatttctacaggcgaggcgtcctcaaatcggtggtatatgttgtagactgctggaatcagtttattcttgcatatatctgcaagtggatctggtaatgcactgcacccttcccttactatttcttcaagttcgtccaatggcaagtcttgttctaagtggtcctggatcacttgtgtcaatgctacgcagccatcacacaggacgtcgttctttgggggagcgctgacggttaaaccgacgcaagctaaaatagctaaaacaatggaagtcttcatactagttctagatcgcgagcggccgctcgcgatctagaactagcccacgcgtccgataacttgcgaagatgaaggtattagttctcttttctttagttgcactcagcgttgctctaccaacactccttggtagaaccgtaagagtcacagaagatggaactgtatctctcttcgactctagaggataccaactcgtaatcctcaagagtgttaccgatcccagacaagtcgaggttgttctcagaagtccaaacacaagaacccatatgttccaagttggggaaccactgagaactggagaagctatcgaccgtcgtaccctcgctggtgtttcagtttaccaaaactacaaccaagctgatattcttactgatatttttcgtcagtatgaaggtactcttgacgacaccaaatactatagccttcttaacaggattcaaatgttagttgaagctggagtcgtcaacgaaaccatctacgatgttattagaaactgggatcgtgaataccgtatgcaaggaattagtgacattgtccccgtccaaggagtacgtaccctccgccaatatgctggacaagtaggaaatgttatgcctcttggacaaaatttggaatatggaaaccatagaacctgggctcttgaccaaggtttgttgcaaacttattctccactcagacatttccaaactcttctcggacaaatccaacaacaacgtcaacttcaacaaggtttattgagccaacaacaatatttgccccaacaatatctatctggagaatcccttcttgaagatcaaatgaacactaaccaaatcttgagccaaatctacagacaacaacttggacaatctccattgaaccgttatttggtaaacatgagacttgtaaacggagagcaagtatacgaagttcctgaagaattcgttaacgttcaacttctcgaaaaactcttcgccaaacaagaattgatcaaccaagaattgactgaaatcaccgaaagaagacaaccagtcactgaagatgttcactatcagcaacaaatgattaacgaacagatcgaaaaactgattgaacaattagcttaccatcaaaacctcattacacgtgaagttgaacaatacattgttaaaggacaagtagttccccaacagctcgtttaccaacagagattggtttaccaacaagttcatgaagtaattgaacgtttgacctaccaacaaatcttcttgaatcgcctagccgaaagcactgaagcaactgaagtcgatactatttccattcaaagatgggttgtacaacaaaatattattaacgagcagatccagcaattgatccaacaagttttgtaccaacaaactcacgtaaggcaacaaatccaagtattaattcaacaaggacatgttatcccacaggaacttgtcctctaccaaagaattacctaccaacatgttgaaaggtttcttcaagttttgattaaacaattcgtatatcaacaaacctactacaaacagttgatccaggtcttggcacaacaaaaacacaccattccccaagaattggtttcccaatactttgctatttacacccaaatacttcaattgatccaacacggagatgctgtaccccaagaattgatctaccaacaaagacaaatccaccaacagatcgtactcatgctccaacaattgaaagttgttccccaacaattactcaaccaactcatgtctaacacacaaggccgtatgtggcaaactcaaggaacctaccaaagagtaccaatcatggtgcaaggaacctaccaaagagtaccactcatgatgtaaagactggtttatatttaatatgttgtttaaaatatttattgttatgattgctacaaataaataaatattttttgtaaaaaaaaaaaaaaagggcggccgctcgcgatctag

SEQ ID NO: 1965 - DNA, 2725 bp, Diabrotica virgifera
attgatatctgacatatacttcgacagatacaacagaaaacaaatagagcttggtagcagtttttattttaatacatatacatttatatatagcacatccaaagtgagtggtttacggtaaacataggtactttaggggaaggggcagatattggcccatgtaatggagtgcaaaattaagttggcagactaaatgtaattaaataactgactcaaaataaatgatgagggtaaaaacatacccagcggcttcaacaaaagcataaactagttggcagtgtcgaaacaaaccaaacagccgttttatttaagtgatttgtgcagtgatctatatggttttcgaaatggctgatatcatgtaataatatatttatcttaattatttgaacgctgcactaatgtttttaagtattgtctatcgacttctataaaatcaagtaaggactacagatagaccttgatctgcatatttgttctacaaaatatatatttcacataacgtaattccaactcttaaaaaaacttttggttaaaaccgctgtatttgcctttaccccgagaggtaagttctggggagaagttcaacaatgaacaaatacaaaataaaaaagataacctaaaacaatgttattaaataataaatgtaatagttaacaagttacaacttaaaaggtgctaaaatttcaaaaaaaaattttcaaaattctagaaggagataaatatacatttaatatataaaaaattaaaaaccattacagtactgaatatatatataaaaaaaaacaaaagttgatgcagaagaattgacattgaatcacacaacaatcacagaaatgaatatatgtaatcatattgtttcgatcactaaactatatgactacatttggtttttatggcttaaattacttgttgcgaaaagtatgacggttgtgtgataatgtgaaatataaatttaacgatttacatatctcctaaaacattttaaatatcgaagtttcagcaggatgaaacttaaaactgtcaatgaaacttcacaaccaagttccacgaatacgtcaacttacatgaaatttcattattaacgaataattgtttaaaaaatgacgctccacacttttaattatcaccagcctcttgaggctcatcagcttcgccctgcgtgtcactcgtccaaagtgtgaggttatctcggagaagctgcataataagggtactgtccttatatgagtcttcgttaagtgtgtccaactcggctattgcatcgtcaaaggcctgtttagctaactggcaagctttgtctggtgaatttaatatctcatagtaaaacactgagaagttaagagccaatcccaacctgattggatgtgtgggtgtcattttcgccttagagatttcgaatgcatcttgataagctttttgtgaataatcgacgacagtgttcctagtgtcgccggtggctacttctgcgaggtacctatagtaatctcccttcatcttgaggtagaatactttggactctgcattgcttgctttagggataaggtatttgtcaagaagtcctaagacgtcatcgcagatttctcgtaactctttttcaactttttctctatattctgtgagaacctccgtcgtcacttttcagagcgatcagtctctcgttcagtggatgaaacccttagcccatgatggattttctacgtccacgcccactccagcaattggcatggggggagtttctaaaattgttccagcctctacaatttctttgatgttgatctttgatccaggtctgtctgcctctcttaccacgtgggtcatcccagctttgtaacctatgaaggccgtcaagtggacaggttttgagggatcatcttttgggaaagcctttacctttccacggtgtctctgggatctctttttggggtagaatcccatcgatccatgacgtggtgcactgaactttctgtgagacatctcgacttattatgtatttgttttagaaatcactaaccatgatataataaaataaaaaagtcctattgggtatactgctaatagcttcctatttggcttctggctgtcccctaagaaaatcattgaagcgtaagttgcccaaatgaatcctaccatagacacaacaaatcttatgaaaaatacgagaggaatttggtgaagtaataaaagaattctacagacgataagggcaattgacgtgggaagcagacagtatcctagaacacatacactttggaagaaagatatgtttcctcccagtaacttagaatttagtgttacaatcatggatccaatccatacaattacaaatacttgtgcaaattcaggaccaccatcatttttgcttgtgtcatcactggaaccttggagaaacatcgccatgagggtgcacaacagcaaaggtccccataagtcccattctttcaacaaagtcttcttctcttttgggaacaatacataagcaaattttattccgacagcttttaagtcccttaatattgtatcgcgaataggctcatttaaagtattgaaatccggctctcctatctgagtggtgttttttggttttggaatgttcatttccccatccacgtattcttccccttcgtcaaacatctctagctttgccgtatccatttttgtgctagttattctaatgtaatcattaataatttctaaattgatgaagatttgccatttcagtttgttt

SEQ ID NO: 1966 - DNA, 3169 bp, Diabrotica virgifera
caggcggggagtttgactggggcggtacatctgtcaaagaataacgcaggtgtcctaaggccagctcagcgaggacagaaacctcgcgtagagcaaaagggcaaaagctggcttgatcctgatgttcagtatgcatagggactgcgaaagcacggcctatcgatccttttggcttgaagagttttcagcaagaggtgtcagaaaagttaccacagggataactggcttgtggcggccaagcgttcatagcgacgtcgctttttgatccttcgatgtcggctcttcctatcattgcgaagcagaattcgccaagcgttggattgttcacccatagacagggaacgtgagctgggtttagaccgtcgtgagacaggttagttttaccctactgatgactcgtcgttgcgatagtaatcctgctcagtacgagaggaaccgcaggttcggacatttggttgacgcacttactcgagcgggtaatggtgcgaagctaccatccgtgggattatgcctgaacgcctctaaggccgtatcctttctagtcaaaggtggcaacgatatctcttggagttccgagagtcgaaaggctcaaaacaatgtgactttactaggcaatcgtagttcgctacgactgtcgcacgagcccttatttccgttgagattatcggtttacggtgggatcgatccttgccagtagaccagatctttagacggacgaacatgggtattataatcttttcgatgttggaactcggaattgtctgtagacgacttacgtacctggcagggtgttgtacctggtagagcagtttccacgctgcgatctattgagactcagccctcagcttggggattcgtctacagacaattccgagttccaacatcgaaaagattataatacccatgttcgtccgtctaaagatctggtctactggcaaggatcgatcccaccgtaaaccgataatctcaacggaaataagggctcgtgcgacagtcgtagcgaactacgattgcctagtaaagtcacattgttttgagcctttcgactctcggaactccaagagatatcgttgccacctttgactagaaaggatacggccttagaggcgttcaggcataatcccacggatggtagcttcgcaccattacccgctcgagtaagtgcgtcaaccaaatgtccgaacctgcggttcctctcgtactgagcaggattactatcgcaacgacgagtcatcagtagggtaaaactaacctgtctcacgacggtctaaacccagctcacgttccctgtctatgggtgaacaatccaacgcttggcgaattctgcttcgcaatgataggaagagccgacatcgaaggatcaaaaagcgacgtcgctatgaacgcttggccgccacaagccagttatccctgtggtaacttttctgacacctcttgctgaaaactcttcaagccaaaaggatcgataggccgtgctttcgcagtccctatgcatactgaacatcaggatcaagccagcttttgcccttttgctctacgcgaggtttctgtcctcgctgagctggccttaggacacctgcgttattctttgacagatgtaccgccccagtcaaactccccgcctggcagtgtcctcgaatcgaatcaggctggaggtaagttgacgctcgaaacgaagcacacggacgctagccgagtatccgaaaggcaagccttatcggaaccacgaaaccgacgaacggcacaacgcaacgaaacgtcactccgtgcccttggctcaagaataccgtgacagtcgcagcctcgtgagcgaacgacgcacgcgtttcgccttaccgagtaagtaaagaaacgatgaaagtagtggtatttcaccggcgatgttgccatctcccacttatgctacacctctcatgtctccttacaatgccagactagagtcaagctcaacagggtcttctttccccgctaatttttccaagcccgttcccttggcagtggtttcgctagatagtgggtagggacagtgggaatctcgttaatccattcatgcgcgtcactaattagatgacgaggcatttggctaccttaagagagtcatagttactcccgccgtttacccgcgcttgcttgaatttcttcactttgacattcagagcactgggcagaaatcacattgtgtcaacacccgctggggccatcgcaatgctttgttttaattagacagtcggattcccctagtccgtgccagttctgagctgaccgttgaatggcggccgaagaggacatccaagcacccgaaagtaactcagagcctcgcagcaagacggttccgcgggaggccaaggcacgggaccgaactcggatccatgaaacccaactcgtaagaattaggctcacttcacctcacccaggcccggcacgtcagccatgacccacttcctcgccaagcccgacacgccccgatcctcagagccaatccttatcccgaagttacggatccaatttgccgacttcccttacctacattattctatcgactagaggctcttcaccttggagacctgctgcggatatgggtacgaaccggtgcgagcctccacgtggccctctcctggattttcaaggttcgaggagaagatccggacaccgctgcaactgcggtgctcttcgcgttccaaaccatatctccctgctagaggattccatggaactcgaacgcttatacagaaaagaaaactcttcccggatctctcgacgacgtctccaggtccttttgggttaccccgacgaactctcttgcgagggcccgactttttgacggttccgctaccgggttccggaataggaaccggattcccgaataaattaccttagggataacagcgtaattttattggagagttcaaatcgataataaagattgcgacctcgatgttggattaaagtttataattggtgtagcagctatattattaagtctgttcgacttttaaaattttacatgatctgagtttaaaccggtgtgagccaggttggtttctatctttaatttattaatatattttagtacgaaaggaccaaatatataaaataatttttatatttagataaatattaaaaaaaagaaaaaaaaaaaaaaagggcggccgctcgcgatctagaacta

SEQ ID NO: 1967 - DNA, 3040 bp, Diabrotica virgifera
cgtggcagagagtcggtctctttctttcacgggagtgcgccatcgttggcgtatcgtaatttttggttgtgcttgagaaaatcgtcaaacatccaaaatggtgaactttaccgtagatgaaattagggccatgatggacaaaaagaggaacatccgtaacatgtccgtcattgcccatgtggaccatggtaaatctacattaacagattctctagtatcaaaagctggtattattgctggtgccaaagctggagaaaccagattcacagacacaaggaaagatgaacaggaacgttgtattaccatcaaatcaactgccatatctatgttcttcgagttagatgataaagatcttgtgttcatcaccaacgctgaccaacgtgagaaagatgtgaaaggtttcttgattaaccttattgactctcctggacacgttgatttctcatcagaagtaacagctgcccttcgtgtcactgatggtgcccttgtagtagtagattgtgtatctggtgtatgtgtacagactgaaactgtactccgtcaagctattgcagaacgtattaagccaattttattcatgaacaagatggaccgtgccctcttagaattacagttggaatctgaagaactttaccagactttccaacgtattgttgaaaacgtcaacgtcattattgccacctacaacgatgattcaggtccaatgggtgaagtcagagttgaccccagcaaaggttcagttggttttggatcaggtctccacggatgggctttcactctcaaacaattctctgaaatgtatgccgagaaattcaagattgatgtagttaaactaatgaaccgtttgtggggtgagaacttcttcaaccccaaaaccaagaaatggtccaaacaaaaggatgatgataacaaacgttcattctgtatgtacatcttagatccaatctacaagatttttgactccatcatgaactacaagaaagaagaatatgaagcactccttccaaaattgggtattgccttaaaacatgaagataaagacaaagatggtaaacaattattgaaagtagttatgcgtacctggttgccagctggagaagctttacttcagatgatagccattcacttaccatcacctgtggtagcacagaaatacagaatggaaatgttgtacgaaggacctcatgatgatgaagcagctgttggtatcaagaactgtgatccaaatgcacctcttatgatgtatgtatctaaaatggtacccacttctgacaaaggtcgtttctatgcttttggtcgtgtattctctggtaaagtagctactggtatgaaagcccgtatcatgggacccaactacacccctggcaaaaaggaagatttgtatgaaaaggctatccaacgtaccattctcatgatgggtcgttatgttgaagctattgaagatgtcccatctggtaacatctgtggtttggttggtgttgatcaattcttggttaagactggtaccattaccactttcaaggatgcccacaacttgaaggtcatgaaattcagtgtatctcctgtagtacgtgttgctgttgaacctaaaaaccctgctgatttgccaaaacttgtagaaggtttgaaacgtttgaccaaatccgatcctatggtccaatgtatcattgaagaatctggtgagcacatcattgctggtgccggagaattgcatcttgaaatttgccttaaggatcttgaagaagatcatgcctgcattcccattaagaaatctgaccctgttgtatcctaccgtgagacagtaagtgaagagtctgatcagatgtgcctctcaaaatcacccaacaaacacaacagattgttcatgaaagcttgtcctatgcctgatggacttgctgaagatattgatgatggtaaagttaacccacgtgatgacttcaaagtccgtgcccgttatcttactgagaaatatgactatgatataactgaagcccgtaagatctggtgctttggacctgatggtactggacccaacatccttgttgattgtactaagggagtgcaatatcttaatgaaatcaaagactctgtggtagctggtttccaatgggcaaccaaagaaggtgtcttgtctgaagaaaacttgagaggtgttagattcaacatttatgatgttaccttacacgctgatgctatccatcgtggaggtggtcaaatcattccaacaacccgtaggtgtttgtatgcttgtttaatgacagctgcacccagacttatggaacctatctacaagtgtgaaattatgtgtcccgaagttgctgttggtggtatttatggtgtattgaacagaagacgtggtcacgtatttgaagaagctcaaatcgctggtacacctatgttcttagtaaaagcttacttacctgtaaacgaatcattcggtttcactgctgatttacgttccaacactggaggtcaggccttcccacaatcagtcttcgatcactggcaaatcttacctggtgacccaatggaacccagtaccaaaccctatggaattgtgcaggacacacgtaaaagaaagggtcttaaagaaggacttccagacctggcacaatatctggataaattataaacaactaagaaacttaatttatgtacagattatttaataaaattatttcaatttactcaacggtttttatagttaattgtatttttgatatttttattctgataagttttcagttctctcaaattgatggcaacactagaaatgaaataaactaaataatctgactaatattttatgtttgttatatatatttttgttaacagtccagatatttgtatatttattaatttgacatcaaaagtaaatctgatgaaacatttttgagtatttatttgtggatacaaattcgtcttgttttatttttactcccttgaaacattttattagtgtaatttttatttgagcagtactgattaatgttaagtatattttttggatatgtgtataataaaactcagtttttttagg

SEQ ID NO: 1968 - DNA, 1956 bp, Diabrotica virgifera
atgcggtatccctttttgttttttattttttttgattacttctttgtttttttttttttttttttttttttttttttttcttttttttttttttttttttttttttttttttttttttttctattttaaatttatatattcaagtaatatataaaatgtataatataaaacatcagttcccttagacaaaaagtgtaaaaatctgctaaaatagagataacagcttaaccaaaaaaatataatttttaacaatcacctcgcattgctataccagacacaacgtaaaaaaatagtttaacagaaatattcattttaaacttaatttaaagtgacgtttacagtttagcattggtcttaagaagaggtgctaatttttgtgccaacatgatgtttccggtgaccttgagttttcccttcatgaaagcttgttgagggttaagttttccttcagccatttgcatgaaatcatcatctgagatggtcaaggttgtgttgggtttgccttcaggttttccttcaaagaccttagcatttttcaaatccatggtccattgtttaacttgtttgccatcctttgtaatattgtacaagaagactccaccaacagatttggctttgctgggatcagccttgacttggtcaatgataaattcgaagatagcgtcgctttttaagttggacatactgagtgattttaaagttgctgttgtggattcgttaggtttgacagatttaaggtctatgtaggcacctgattttgccttgacgtgacaggagaactgttcgtttcgagttccgcgaagcccacgcgtccgcccacgcgtccgcccacgcgtccgcccacgcgtgggttcagaagaaaaatcagaatgaagctgttcatccttgccgctgcccttattgtggccacaagtgccaatctaggtgccttcgaaaaatggaccagttttaaggcaacccataacaaatcttacaacgttattgaagacaaacttcgtttcgctgttttccaagacaacctcaaaaaaatcgaggaacacaatgctaaatacgaaagtggagaagaaacctactacttggctgttaacaaattcgccgattggtccagcgctgaattccaagctatgttggcccgtcagatggctaacaagcccaaacaatcctttattgcaaaacacgtagccgatcccaatgtccaagctgtagaagaagttgattggagagatagtgccgttttgggagtcaaagatcaaggacagtgtggatcatgctgggctttcagtaccaccggatccctcgaaggtcaactcgccatccacaaaaatcaacgtgttcctctcagtgaacaagaattggtagactgtgacacatcaagaaatgctggttgtaacggaggtttgatgacagatgcctttaactatgttaaacgccatggtctctcttccgaatctcaatatgcatacaccggcagagatgatcgctgccggtgtatgcatcttcagttgtttcaagttctacgtagccactaatggaagagagtggtttgttctcaacattcttgcagcgatcatctctgccggtgtatgcatattgagattcggaagagagaccatggcgtttaacatagttaaaggcatctgtcatcaaacctccgttacaaccagcatttcttgatgtgtcacagtctaccaattcttgttcactgagaggaacacgttgatttttgtggatggcgagttgaccttcgagggatccggtctggaaatattaaagtaaaaatttagaagcaactattaaaatttgaatgagtacctaaaatattttgttaattcatttgaaaaaaacttaggtatacagctctttacagattaaaacatttgttgttgtgagtgatgtaaaacagtgatgttttacctactagcctaacttttttgctaacttgtatatatgttatag

SEQ ID NO: 1969 - DNA, 2359 bp, Diabrotica virgifera
ctagatcgcgagcggccgccctttttttttttttttgtttttttttgttttttattaaccatcagtgaaatgatgatacaatgtttaaagaatattttagttacatttaaccaaatataacaacggtacatttgcgatccgcacaactcaaaatgattaactctacatgaactcgacaaagaaacagcaatattcgcagtctccgaatgacaaaaatatagtctatacttcgcccgggcgaggatgttgaacttatttacggcaatcaaaaaaataaataaatgtacaactatatacattctcctccaagtcgtgctcagcaaggggtggggtgacagcaaaaccatctcagtgagctctaaaggtctataaaatggtccgcctccacccggaatggtttgaaacaagcacggctagaagaatatatcatcgaatttggctaaatatttcctaggaaaaatcgattggagtgttgataatgatgcgcgattcttgtagcaatgaaaaacaaattacacaatcaagtttttgatttcgtcgtacatgaccaatacaatagctccaccagtaccacggaggacgttggagaaagctcccttgaagaaggcaccggtaccttcggtcttggcgattgtggcccagcagtgagcagtgcttttgtagatgatttcggtcttcttacgtccagactgcatcatcatacgcctacggacagtatcgaagggatatgagatgataccagcaacagtggttacagtctgtgcaatggcccatgaaactacaagaggagtgttcttaggatcgggcaaaatacccttggcagtatcgtagaaaccgaagaaagcggcacggtagataatgataccttgtactgatacaccaaatccacgatataatcctcccaagccgtcagctttgaagattttgactaagcagttacccaaaccagagaattcacgttcaccggcacctttaccgacgtcggcggccaacctggttctggcgaaatcaagtgggtatacaaagcagagggaggtagctccggcggcaccaccagaggccaagttacctaagaagtaacgccagaattgtgtctttttgtctactccgctcaagaagatctgcttgtatttgtctttgaaggcgaagttaagggcttgggttgggaaataacggatgacgttagcggtgttaccacgccagtatgcaagaacaccctgttcctttgggatacgtacgaagcagtctaccatacccttgtaacgctgatcctcagcgatttgcttggagatgtgttgtacttgcaaaagcaactttacacgttcgattggagctacacatgtttttgaaatagcggcggaaatacctccagcgaggaaatccttcataaaggcaacgggatcagcgagagacattttgttttattcttttaaaacttttctcaaaagaatatggtagagtacttgtaatcggactagttctagatcgcgagcggccgccctttttttttttttttaaattggttttattagaacttttttacttataaaaacatatttaaaccctaagctacagcaattggaactgctggaggagcgtcaggctttgatgccttaatttcgctgcttggggattggggaagagtttcttctttaggctccacaactgagacattgtcgggcaggggcttcttgggtccagtcttgccactgggatcccatggcaacatgattttaaccttgattcccaatactccttgtcttaagagtacgtgacgggttgctgtgtcaacgtagtcattgcatgggtctccagagtggatcataagaccatctacgaacttcatggatttggctctttgacctctcaattttcctgatactactacttcacatcctttagctccacattccatgatgtacctcaagacaccatagcaagccctacggacggccaaaccaccaatcaatttaaacctaagtgactcagcttgggcaatagcacacagacctctgttggctactttttcaccatacaaaactacggaatctggagggaagctaaacctcttctgtacaacagaagtcaattctcttatcctcctgttcttctcacctaacaccctgtcggttctggtggccataataataatttctgtacgtgttggggtaacacgtacttccacaccggaataaccatcttcggagagttcacgggttaaaaattcatttaattcggctttgaagacaccatctccaacgaatttacgcttttttgagattgaagttgccattttcgctaaggtcgcagacagaaaagaaacttccacgagggcggccgctcgcgatctagaactagt

SEQ ID NO: 1970 - DNA, 6017 bp, Diabrotica virgifera
cggacgcgtgggcggacgcgtgggcaaatattttattttaaataaagaaaaaaattctaacataaaaactttatagtaataatatattgggtaccagtaagtcacaggaaaatattttagtcacatttatttcaaatttaaacatctaataatttcacattgtaacggatgcgttactggatcttaaatagtaagaataaataaaaaaattaacaggcttgaataaaaacgaaatcttacaataagaaagggagtggtcttaagaaattagaataaaatttttgttgtaaaaaatttcgatcaatttctaaagaccatttcctgtgatacagtaagagccaaaaaatattaacatttccatacgcatcacaggatgacaataaaaatgtgcttactttccagcaaattcaaatcctagactaaaaatgtaaaacctacagtacaagaaaggggaaaaatgaatgaacatgtcaaaaaaggggatacatactatatagtaagtgcacagatcagatgtaatttacatcacaaagtatgaaaaaaattgaaagtgtctaatgctgtatcccctaaactaacatcaaatagaacgattttttttatcttcattatatatacgtgttttcatactttgtgactttgtaactctttttaaacttcaactagacatgtagcacagaatttgatacagtacaagaatcgccagcgactagatctcgccaacgactcctgcgaaagaaaaacaaatatattacaaaaatttacacaattatattaatttataaatatatttattaattaaatttgtcttgtaaatcaaataacggttaagttattcactttagtggacccggccacaaagcaaaaagttcgaggtgttgaaaaatgtagacaatgagccgggatgaaacaatggaaagctgaaaatgcaactctggtttcctcactttgaagtcatcatggtgacgaactcttcgtaattgacttgaccatcaccatcgatatcggcctcccgaatcatttcatcgacttcttcgtctgtcaatttttcacccaagttggtcatgacgtggcgcaattctgctgctgagatgaaaccattgccgtctttgtcgaacactcggaatgcttcacgaatttcttcctcactatcggtatctttcattttacgtgccatcatcgttaaaaattctgggaaatcgatcgtgccgttaccatcggcatctacttcattgatcatatcctgtaattcagcctctgttggattttgtcctagagatctcattactgttcctaattctttagtcgtaattgtaccatcaccatctttatcgaatagtgagaaagcttctttgaattcagcaatttgttcttcggtgagttggtcagccattgtaatatttgaagattaatcggtacactaaacagaaaaatgtcgacacaacgaagtaactaacaacgcctctcgtcatactaaccagtttcaaaggaaattccatgagttgtgatctgagtgaataaacgatttaaaggaatagtagcaaaaatattatcctgcttgcttcagttgacctcctgctaccttacagcaattttgtggtctactcaaacatcgcagtaaattgaccaatgggaagacataaaaatgacatatgtttttgtattgaagtgcacaaaaatcccacgtcgtagaaacctaggttttcttgagcaaaacaaaaaggttgtgggggggtgggaaaggttaaaaggatatgatcaccagaagcgaaatctatcaaatgtttttaaaaattgttaagtgacatttggaataacttaaatgagtataaaggtttatagaaatgtggatgaaatacgaacaaaaagacaaaaaaaacgttaatgcatgcaaaaaaattgtataaaaattttgaactagttgaaaatatagaaaatttagatgatctagtaaggaaatagcatataatgaacaaaattgtcccaattcttaaaacatcagaaagatctaatcaaaaatagttttttgaacattttagggacattttaagtggtttttactcattctaataggattttgtaaatcaacacttcttggtgatcagttttggtgttaaaacaagtgccatattaatatactaaaatcttccaaaggtcttcattaatattttccgagctgaaccgtcctgagttagggcgagacagcctgtaaagaggcacccgcatgaaaacagaattgcactgctaatttcactgtatgcaaaaaaggttacaacaagatcatcgtgcacgtgcctctgaaaaagaaaaaagggcgcccagactgatcagtaacaattatacaaaaattacacaattttaccaacatataacactggcaaataaatcccacacgtagtgtagaattgctaaaattacatttcaatacaagtaagccagtaaattggcttttatgacaaaacatactaaatctccccccaataatttttaaatttaataacaaaaatcccccaaccaattatttacttattaaattcaataaaaatacgtaaaccagtctaaaatccccaaatcgtactgctactataccaaatttaactttcaatactttttttatcacaaatgaacatggtataattcccaacaacccgattttgtaactaatccccactgttcaggggggaaactcacctaaccccctggcagctacgtcagtagctaccaaaatactagattttccagttctaaattccctcaggacatagtcacgttcctgctggctcttatctccgtgcatggacaatgctgaccaaccaatgcttcttattgatcgcgttattccttcaactttctttttggtctctacgaaaatgataattttcgagccagtgtcagcattggtgttgatctcttgcaagagacttcccaacttcctttccttttcatgctcctggcagacatcaacgaactgtacaatattattatttgcagataagttctttgaacctatgttgatgtaaactgggttcttcatgaaatcggaggccaatttcctaacctctttgggccatgtagcagaccacataagtgtttgtctgtcaggtctgacttgactgaggatcttgcgaatttgaggttcgaatcccatatctaacattctgtcagcttcgtcaaggaccaaatatgtacatctctctaggttagtagatcccttttcgagaaaatctatgagacgaccgggtgtggcgatacagatctcaatacccctttgtaggtcacgagcttggggtcctttgggagcacctccgaatatacaagagttacggatgttcgtagaccggccaaaatcattggaaacctcttgaatctgttgagccagttctctagtaggagcaagtaccaaaacaattggtccttcccctttatttagaggtggttggttgttgatatgaattgcagcaggtaggatataagctagagtttttccagatcctgtttgtgctataccaaccatatcatgaccactcattgcaattggccagccttgtgcttgaattggcgtcggagcttcataccccttattgcaaacttccgtcaagatgtaatcagggaaatttgcttcgtcgaagttctgaatggggttaggtgcttccccttcgactgtaatttcttttgctttgcgaaactgctcaacctcaaagggagtacggcttgccacagaaggatggggcacgtagaagtgtttctctactggacgtaactttttgttagcccattcgacctgtctcaaccccccgttgccaccatatccttgattgttcctgttgaaattattttgataccctcccccgttgcgattattgtaactgttatccccgaaagaattattaaatctgccgttattaaatccacctccggtcttattatagccaccgccatttctgttgttgtaacctcctcctcctccactgtttcctccacttttgaaattggagaaaccattggaacgagcctggtaaccatcatcaccgttttgtggataagtcatttttagttttcttttagctctgaagcgttgaacacgaatttaaaatatcactactgtaaataatcgagcaaaaattacaatcagaaaaaattgtaatttgctagttctagatcgcgagcggccgccctttttttttttttttatttttttttttttttttttttttttgtttcctttcatatcttatgtagtcaatttcgttcaccaacaggtttctatgaaccatcgtcaaccctacagcgttagtgacaaagctggacatcaaacatctgctgaatcatggggtactggacgtgctgttgctcgtattccccgtgtaagaggaggtggtacccaccgttctggtcagggagctttcggtaacatgtgtagaggtgggcgcatgtttgcaccaaccaagccatggcgtcgctggcacagacgtgtaaacatcaatcaacgtcgttatgctttggcatccgctgtagctgctagtggtgtgccagccttagttatgagcaaaggacatgtcatcgaccaaatccctgaattgccattggttgtcagtgacaaggtacaagaaatgagcaaaactaaacaggctgtccagttcttgaggagaatcaaggcatgggctgacattcaaaagttatttttctgattaggtttacaagagtcaacgtttccgtgctggtaagggaaaaatgcgtaataggagacgcatccaacgtaaaggaccattggttgtttactacaaagatcaaggtcttcgtcgtgctttccgtaacatcccaggcattgacctcattagcgtacagaagttaaatttgttgaaacttgctcctggtggtcatgtaggtcgctttgttatttggactgaatcagctttccaacgtttagataaattgttcggcacatggaaaacagcatcattggaaaagaagggttacaatctaccccagcctaaaatggccaacactgatctatctagattgttgaaggctgatgaaatcaaagctgtattacgtgctcctcaaaagaaggttgtacgtcgtgtacgtcgtctcaatccattgaccaacgctaaggccatgcttaagttgaatccatatgctgctgtactcaaacgtgaagccattttgaagaatcaaaagagacagttaaacagggaagaacttttggccaagaaacgtggtattaccgtgagtgccgacaacgtcgtgattagatccagagtttagcaagaggagttaagggaacttttcttgaaagataagaaataaacatgtctttttgtattaaatataaagtctcgcctgcccactgattaatttgaatggccgcggtattttgaccgtgctaaggtagcataatcattagtttttttattgaaagctggaatgaagggttggatgaaaaaaaaactgtctttatttaatttataaagaattttatttttaagttaaaaagcttaaatttttttaaaagacgagaagaccctatagagttttataaaattattaataagtttttttagtattaaatttatttatataataaatttatttaattggggggattaaaaaaaaaatttaactttttttatattattatattaattaaaaattttttgatccaatttttttgattataagaataaattcccttagggataacagggtaatttttttggggagttcaaatcgataataaagattgcgcccccgatgttggattaaagtttataattggggtagcagctatatttttaagtttgttcgccttttaaaattttccatgatttgggtttaaaccggggggagcccgggtggtttttatctttaatttattaaaatattttagtacgaaagggccaaatatataaaataattttttttttttgataaattttaaaaaaaaaaaaaaaaaaaaaaaaaaaaaaaaaaaaaaaaaaaaaaaaaaagaaaaaaaaaaaaaaggcggccgccca

SEQ ID NO: 1971 - DNA, 1456 bp, Diabrotica virgifera
gggggggggaggggggtttgtttttccccccaaaaaaaatttaataaaaaaaggtggattttttagaaaaaaaatttttttttatgtttttccggaagaaaaaaggaaattcatgggataaatccccgctataaatagcaaatacagctcttatagataatacataatgaaaatgtgcaacaacataataggtatcatgaagtacaatatcaattgaggagtttgctaaaactacccctgttaatcctccaactgtaaataaaaaaataaaacctaaagctcagagtgttactggactatatgtaatagtagttccatgataagtagctaatcatctaaatactttaattccagttggtacagcaataattatagttgctgaggtaaaataagctcgggtatcaacatccattccaactgtaaatatatgatgagctcaaacaataaaacctaataagccaattgctattatagcataaattattcctaaagtaccaaaagcttctttttttcttctctcttgcctaacaatatgagaaattaatccaaatcctggtaaaattaaaatatatacttcaggatgaccaaaaaatcaaaataaatgttgatagagaattggatcccctccaccagctggatcaaaaaatgatgtatttaaatttcgatctgttaataatattgtaatagctccagctaaaactggtaaagataatagaagaaggattgctgtaattacgacagctcaaacaaataggggtattcgatcaaaggttattcctattggtcgtatattaattactgttgtaataaaattaattgcacctaaaattgaagaaataccagctaaatgtaatctaaaaatagctaaatctactgatggacctccatgggcaatatttgatgacagaggcgggtaaactgttcatccggtaccaacccccctttctactatccttcttaataataataataaaagagacgggggaagcaatcaaaatcttatattatttattcgagggaatgctatatcgggagcaccaattattaagggtacaagtcaatttccaaaaccaccaattataataggtataactataaaaaaaattataataaatgcatgagctgtaacaataaacattataaatttggtcatttccaattaaagatccgggccttcctaattctgctcgtactaaaattcttaatgaagttcctaccattcctgctcaaattccaaaaataaagtataaagttccaatatctttatgattagttctagttctagatcgcgagcggccgcccttttattttattttcgacgcccaggaaaaagtgattatttatttatttttttaaagtcgtcccaggaacgcaactcatcaatattggcaatatcattttaaagtcgtctactttaaaatgtataatacgtgtctgaattgccgatataaatgag

SEQ ID NO: 1972 - DNA, 953 bp, Diabrotica virgifera
ttaaaatgcccctcccgttaaacttattctttttaattctcaattccccccttcaattttcggcttaccaacttttccttccattagtttttgtcctttgttggcccaaaatttttttatgttaaaccattatttttttaacctttttttttaaaatattattaattaaaatatgtcgctcctccggaagaaccccgcacaactcaaaaaacaacttttttgataaataatggaagaacatggatacgtgaatgttcataactgtgtaagaacaaaaacaaacacattttgagttatgccacttttcttttaaaatattggtaactttgttaaattttttcgaacaatacctaggacacttctcgaaatacaacggttttcatgataaataacgatacgttcacgccaaacgtcagagcataatcaaaagtgtcagtgttccagagtacaaatacacattttaccgccaaatgaataatgacactaccaccatcttacgaagttggaagtaaacatctatgtgacacttttcctggtaaaagtatagaattatttgggttgtgccacttttcttccgaacgagcgaatgtgttaaaatattattaattaaaatatgtgtttaagaactaaaaattgtaacgtttttgataaatgtgtatggtgtattaaaatgttgttttgctactatatttgtccgaaattattcataatgatatgaagtagctacttaaaaaaaccacatacgcatagaaattgctttacttgtaagacctattacgtgaattaagattttgtaagatgaaaaataagtatgtagaaggaatttgtattacctcaggtcatttttcaacgagatatttttctttgtaaataaagtttttaatattacagctgatgaattcaataaatataattattattaattaaacgaacacgtgggcggcctgcgttga

SEQ ID NO: 1973 - DNA, 1196 bp, Diabrotica virgifera
  misc_feature (1193)..(1193): n is a, c, g, or t
gttgctgtatttaatgccgtaagcgcacttgattgctacacttgcaccgacgatgcctgcaaaaaagatgtaaaagaaatgcaaaaagttacctgtggtaaacccgctgaccaaaatcaagaatccgtttgccaaaaagtaacatacaaaggcaaggatggcaaggaacacatcgaaagaaaatgtgcctatgctcccaagaacggagaagctcagtgtcccgcatccataaacaaagctgatgtaactgacctaaaatgcccatcctgtaaagctgatctttgcaactcagctaccaccatcaacttcagcctaacagcattcgctgcagtagtttttgccatcgtaggccaaaaattcttaatgtaaaacataatttttaaacatttttttatataagtacatgtcgctcctccggaagaagtggcacaactcaaaaaacaacttttttgataaataatggaagaacatggatacgtgaatgttcctaactgtgtaagaacaaaaacaaaaacattttgagttatgccacttttcttttaaaatattggtaactttgttaaaatttttcgaaaaatacctaggacacttctcgaaatacaacggttttcgtgataaataacgatacgttcacgccaaacgtcagagcataatcaaaagtgtcagtgttccagagtaaaaatatacattttatcgccaaatgaataatgacattaccaccatcttacgaagttggaagtaaatgacattaccatcatcttacgaagttggaagtaaacatctatgtgacacttttcctggtaaaagtatagaattatttgggttgtgccacttttcttccgaacgagcgaatgtgttgagatattattaattaaaatatgtgtttaagaactaaaaattgtaacgtttttgataaatgtgtatggtgtattaaaatgttgttttgctactatatttgtccgaaattattcataatgatatgaagtagctacttaaaaaaaccacatacgcatagaaattgctttacttgtaagacctattacgtgaattaagattttataagatgaaaaataagtatgtagaaggaatttgtattacctcaggtcatttttcaacgagatatttttctttgtaaataaagtttataatattacagctgatgaattcaataaatataattattattaattaanaaa

SEQ ID NO: 1974 - DNA, 1510 bp, Diabrotica virgifera
tgatctgagtatgacagactcaatgaaactttattgctggatttattattatcaggaagtgctagtgagctggatatctcaatagcttcttaccctaacttgtttttgttttcctcaatagattgtaccggttagttatataaataattaattgaagtatgtacatataaaaaatttgtgaaaatatggaattgacatatcacagtttgagcctcatcgacttaacgcaacaagtcatgtttaaccaagagggggaaatacccgcgcgtcccactttgtctacccactagcgcagcgcaaagttaagatctagccgttctttctatttttgaatctgtgcttctgaattttttcttccattaaaaaaaccgcaaaaaatggcaaaattggtgattttgttggcatgtgttgctgtatttaatgccgtaagcgcacttgattgctacacttgcaccgacgatgcctgcaaaaaagatgtaaaagaaatgcaaaaagttacctgtggtaaacccgctgaccaaaatcaagaatccgtttgccaaaaagtaacatacaaaggcaaggatggcaaggaacacatcgaaagaaaatgtgcctatgctcccaagaacggagaagctcagtgtcccgcatccataaacaaagctgatgtaactgacctaaaatgcccatcctgtaaagctgatctttgcaactcagctaccaccatcaacttcagcctaacagcattcgctgcagtagtttttgccatcgtaggccaaaaattcttaatgtaaaacataatttttaaacatttttttatataagtacatgtcgctcctccggaagaagtggcacaactcaaaaaacaacttttttgataaataatggaagaacatggatacgtgaatgttcctaactgtgtaagaacaaaaacaaaaacattttgagttatgccacttttcttttaaaatattggtaactttgttaaattttttcgaaaaatacctaggacacttctcgaaatacaacggttttcatgataaataacgatacgttcacgccaaacgtcagagcataatcaaaagtgtcagtgttccagagtaaaaatacacattttaccgccaaatgaataatgacactaccaccatcttacgaagttggaagtatgacaaacatctatgtgacacttttcctggtaaaagtatagaattatttgggttgtgccactttttttccgaaagcgagcgaatgtgttaaaatattattaaataaaaaatgtgtgttttaaaaaaaaaaaaaattgtaacgttttttaaaaaaaaggggggggtgggttaaaaaaaaggggaggtttttgcccaccgaaattcatttatcaagaaaaagttatgaagaaagtaaaaaaaccccctacgcacaataaaaaaaatcaacccaactcccccttcccgtgaaaattcttttttttatttttttataaaaacacctaatcttccgtcggaaaaaatataaaataaattttttttac

SEQ ID NO: 1975 - DNA, 760 bp, Diabrotica virgifera
cgcgtccgagttaatgttcttgtgtaattgacacgtgaatgtcagttcagtaatgaaatatgtactgaacttaattaatttatgaaactatttaaatacattctacaaaatccattaataagaagtgttagcgcaactcacattacctcaactacatcaattttgagacgtacagccatggctactccacaatttgaaatactaccctcacccattcagggcgagagtgatgaaaaagaatatagggtaataaaattaaaaaacaatttggtagcttgtttaatatccgacaaagcacctatccccaaagaagagatggagatggaagactctgaaagcgagtcagacaacaaattatcagagtcagaatcggactctgaaggtagtgatagttcttctgaggctggtgaaaccacttccactccagatcagaagatggctgctgctgcactttgtattggtgtgggaagttttagtgatcctaaggaagttccaggtatggctcattttttggaacacatggtttttatgggtagtgaaaaatttccagcagaaaatgattttgattcatttataaagaaatgtggtggaactgacgatgcttcaacagacatggaaacaacatgttattattttgagtgtcttgaaaaaaaattacatgaaaccgtagaaaaatttgctcaattctttatttcgcccttttaatgaaaaaaaggggcaatgacatagggaaagagaggctatagagtctgaattttca

SEQ ID NO: 1976 - DNA, 873 bp, Diabrotica virgifera
gagatgattcgagtgtacttgttgtgttgtgctgtggtactcgctagggcccagattccaagtctgggtttctgtcccgattatttgcccatgtcggaatttgacatcgagagttttttgggaaagtggtatgaggctgagcgttattttcaattcacggaagtcacatcgaggtgtgttgtgacagattatgctaaaggacctagtgggaaaatttatgtttccaacgaagttacaagccgattgactggaataaaacgagtcatagatggccagctagaattgtcaggaagatctggtgaaggaaaatttaacattagatattcaacacctttatcttctcaagcacaactcacggtacttgacacagactatgataactatgctgttatatggagttgcagtggctttggaccaattcatacacaaagtgtatgggcaatgacaagagagcgtcttccatcagggccagtcctccaaaaaatctacggagtgctagataaatacaagatcagcagaaatttcttcgtaaaaacagaccaggaaggatgcgcattggcagcttcggacatcaatgcagctaatggaataacagtcatttcaacagtagcagaatcaagtggaataccccaacgaaagtcacctagttcgaataaaaagaaagtaacagaaaaagtaccatcagtacaggcagtgaaggtttctgataatgacgtaaacgatgatcccaatgttcaagcagttaaatcaatagagattgatttaaaagctccggaagatattttacctgaaccatttgcgtctaatgtaatatacctgaagttgctacagctgaagaagtcttccagaagcttttgttcctaagacataata

SEQ ID NO: 1977 - DNA, 723 bp, Diabrotica virgifera
  misc_feature (27)..(28): n is a, c, g, or t
  misc_feature (40)..(40): n is a, c, g, or t
cttaactggtccgaatcacggatgtanntttttttgggtnacctctaacttttaatacgttagaaagaaatcgaaaaactgtgacgccctgaaagatgcctctgagaaagaggttagtccggaaaattaacgtattaacttaaatgtaccatcagtttaagctatttttcttcagaaccgttgattcgatatcgattttttttcacattataggtctatttgtaagttatgactctaccaatgttttctaagaaatgtcaacgatttcctcatatacggggtgtaaaaataaagtaatagacataagtttgaacacaaggttaagcttctctatgtaggttgactgaaatccaacaagtagtctatgatacatcatctagttttagaaaacactctccacgttgaatgggttcactttcttgaatatatgtagtaaatatatgtagttaagcgattcaaaatcacgactgaatattgttaaattttggttgtacataatcattagatataaatagtgagcaacgattgacatgggttaagggaaaagtttttttgaagcagttaacgcgaataaaaaatctacagggtgttcacaatacgggctgtaatttttacgggtcgtatacacggttttaactaggtgttttcaataaaactggggatgcatactttctcggctttaaacatccttgatttaatttatgatttatttatccctataac

SEQ ID NO: 1978 - DNA, 1394 bp, Diabrotica virgifera
aagtaaagttacataaaatagagaaaaggcagaggtttaaaaagtatatgtgtttttcttaataccctcagtatgtctacctttgtaagagtcggctttggcagagttaaccaaggcttatgtaatgtgttaaacaaaacccaaaatgtaactttaattcgagcaatttctagtaagaatacaagaagtgctgaagagcgatcacccaaaccagccccatggccgtatcaagagaaaggattcaatttgtttaattatttgtatgataagacaactgcgagattagatgaaaattctaagataatagttgttgagggcccaccagccgcaggcaaatcaaagcttgcaaagcaattagcagcagaatttgaaatgttatatttacctgaggctaatttagacatggaatatattaacagctatggctttgatttaagaaagcttgattctgagataccagaaagctgtaggagttgggatgttatggatttcttgaagaatcctaaacataggcatactcttaggttccagatgcaacagtatcaagtaaaactttcccagtatgttgacgcattggcacatgtattgagtactggccagggagtcatactggacagatgcgtctattcagactttgtatttactgaggccatgtttagtcaaaattatttacacaaacttgctcgtaaaacttactacgaactccgtgataatacgattggtgaactgttaagaccgcatttagttatttacttggatacgcctgtacctaaagttatagagaacattaagaaacgcgccatcagttatgaaaaggattctacagtgttgactcctcaatatttgggagttattgagaaacaatacaaacaaaattacttgaaggatatcagtaaacatgccgaattattggtgtatgattggtctgaggaaggcgacgtagaaattgttgttgaagatattgaaagaattgatttcaacagatatgatgagcaggactcatatatgaaggattgggtgtacagattagaggaagaatgggcagtcttacgacacaaatacgccgataaaaaagatccagaaattatggcttattgcaatattcctgcatataatgttcccgaactggttatcgaggctgaggacgctgataaataccataaggctatggctgaggcgcctggacaagagtacgaaattggatacaatgcggctttaggagacaccggtttgttgtttaaaatgaggagtcctcaccgtgaaactttaccattaagagaaagaaggaccgtctaaacagatgttgcttgtattcattgtatatacaaaatatagataatttaaaataaaattatttacaaaagtaaaaaaaaaaaaaaagggcggccgctcgc

SEQ ID NO: 1979 - DNA, 539 bp, Diabrotica virgifera
ctttttccgcgtgtacatgtcatcaaaaattaaattgataaatcctttttgtgagttgtgagtagcaataacgtgcgtaacgttctttgttactattcgtggaaatcgtggattatcatttttaaaaagttggatttacatattaatacatggcaatgaaaatccacaagaattcgaaaggcagtctacttaaatttgtatagaaatatcatatatatgccttcaatttcgggatatagatataagcctaacaagaagaaaactaaaatgaacgtacacccgaatgttccattgggagtacgatttttacagaagttgacagatacttgtacttgttgtccaaggtttcattttaacagggaactatgttatcgtatgagcgtgatatttctaacatatatatcgtatatgtgttatcatctatcaagaaaacccatttcagtagtgaaagcagtgttacatagaaactgcagcaatctcgtgccgccagattcgaatgagccaagcaattggtgtgattgggcacctttcgatggcac

SEQ ID NO: 1980 - DNA, 1637 bp, Diabrotica virgifera
cttctcgcgtccgccacgcgacgcatgcgcttggcgatgaccgcgtaagactactcctgaaaaattaaagcgaaatggatagtaaatcttctacagtaaccaaagttaccgtcgttaaatctacctaccgtgtctctccggcagacagtacctcgccgtcgcgaactggttttgctgaagatggagagcaggtagatcaaaaacgtaccgtgcaagcagtacatgcggccgtagtgccttcgaaaccgggtgttgcgaaccacggcgcggctgcgggaaaaccgccgggaccacctgccgggcggggtggtcctccggcgaaaccacacggtccacctgccggacgaggtggacctccggtttcgggtaaacaaacggagaagactgtgaagagcgtgcctgacactgatagtaggaaattaacatctgcagttcttaaaatggtttataagttcggtgaaaaaggatctggtacacgatcaaaaagtggagattctcaagatttttatgcgctacgtgatgaatgtttagcaaatggaacactatttgaggatccagaattcccttgcaatgattcatcgttgttcttcagtcaaagacctgataggaattatgagtggaaacgaccaaatgaaatttgtaacgaccccaaattttttgtcgaaggattttcccgattcgacgtacaacaaggaatacttggagattgctggcttttggcagctacagcaaacttaacccttaacagccgcttgttcttccaaatagtgccagatgatcaagagttcgatgataaatacgctggcatattccattttagattttggcaatatggaaaatggatagacatagtaattgatgatcgattacccacatatagaggagaattagtatttttacattctgctgaagataatgaattctggagtgctctgttagaaaaggcctacgcaaaattaaatggttcctatgaaacattgaaaggaggttcaacatgcgaagccatggaagattttactggtggcgtttctgaaatgtacgaaatggaatccagtcctccaaatcttttccaaatcatggttaaggcctatgaaaggagttcccttatggcttgttcgattgagccagacccacgtgttctagaggctcacacaccacaaggacttattagaggccatgcatacagtataactagaataaaatacgtagaaattcataccccaaatgtttccggtaaaatacctcttcttaggcttcgaaatccttggggcaatgaggatgagtggaatggcgcttggagtgacgaagctccagaatggcggtatatttcacaagaagaaaaggaagagctaggtcttacatttgacaaaagatggtgaattctggatttcgttccaagattttaatgaatactttcagcagattagaaatttgtaatttaattcctgattctctctccaaaaaccgaattacaccaaaaagcttaaaaaaatatggaaaaagggatgaccttaaagaaggatagtgaaatgggaagaaacaacctcttagatattaaaatattttcttttttattaattcttctttaattcagaggtaaaaaaaaaaattattttttaacttttttccttctcact

SEQ ID NO: 1981 - DNA, 992 bp, Diabrotica virgifera
taccggatcgtaccttccgggtgcgccccacgcgtccgcgccattttagtatttagctctgaagattgagtttttacttccgtgaaaaatttttacgagtttttattgtcatcgttataatattttcgacaactgcagttctgtatatagtcggtttgaaaatcttaaagaaaataatgagggtatgaatttaaacgtgctccaatattagcgcttagcgtgtatttgccggtgtattgtgttcaacgtcaccatcaaccatgatgcaagcaaacaatcgagtcccacctataaagttggaaaacgatatagatctttacgccgatgatatcgaggatttcgcacaagatgactttggtggtgaaaatgttgatctatatgacgatgtaatatccgctcctcctggaaataatgacaacccaggtgattcaaatcatcatgctcctcctggtgctggtgaagatggtggaggtaattttgttgggtcaggaggagcacccaataatataaattcttctggaagaagacatcagctgtatgttggaaatctgacttggtggacaactgatcaagatatagaaaatgcagtgcatgatataggggtaaccgacttccatgaagttaagttttttgaacacagagcaaatggtcaatccaagggattctgtgtcatatctttgggatctgagggaagcatgagactctgcctggaactcctatctaaaaaagagatcaatggccaaaatccccttgttacccttcccacaaaacaagctcttagtaactttgaaagtcagtctaaaacacgcccttctcctactaataattctaactcacgtcctccccatcctaataataatgttcattcaggtcctatgcagaattatggaggtagaatgcctatgaacccttccatgcgtcccatgcccccaggtatgcaaggtgctccaagaatgcagggtccacctggatttaatgaaccacaaacatga

SEQ ID NO: 1982 - DNA, 1102 bp, Diabrotica virgifera
aacttgtgcaaaggagttacttacacacatttgagttaccgcagttagtttcttatgtacttatgcccagctcaactactgcattccgtaatgttggacgattaattgaatcataagcctgtttgttaagatctctgatgcacgtcttgattatactcctaatactgttcaagcatttgtctaatagtaaatatttatttatttatttattcttcttttatagttcgaacactattcctttttcctttcttatgtattggtgcaataatactaccacaccattgtttaggcattatttcttgttgccaggccttttctgttaattgatgcattttacttaccgagttcatgaccgccttttttaattgacttggcatcaatattgtccagatcaggggttttatcgtttttaagcgtttctttgacatttctaatttcttctcgacttggtgggggtatttcaaattcgacagtttgatactcatttctgttatttccatcattttcatccttttcttcaaagaaattttggataatcaggagctcttcaaagtattcagaccatcatagttattcccctatttgccctattatattgctagaatgttccaatcaaaatatgttctaattaattatttcttctttcatcgtttgatctccatgttgccttcttttttctagcaagctgagtgagagtatagtaataaattgaaataacttatacatttactgcagctttatttttgcttctgtattttcatacactttcatatgacttctaaccttgcgatacacaggaaaatttgatactttgtgtttcttcgttctagtcaaaaatgcattactttacacttcacaaccaaagacgtattattatgcattatgtaagcgttgagcacaccatttgaagtgtttataaagtgtgtccaccaagaatgttcgataatataaaataactttatcttttactcttagtatattatcacattcctcgaattgaaaacaattatatgttttgcatttttgtaatcattgggaagctatttcgtattgtaaccaatttctctataaataaatgtatatatttataaaagaaataaaa

SEQ ID NO: 1983 - DNA, 460 bp, Diabrotica virgifera
cacgtcttcaactatgacaccatttattgaagaaaaaaacattaaaaaactgagggagtttgaaaagattgccaaaggttggtacattggttaatatctacttgttttggtgtattgtgatagagattaaaacaccgacttatgtttttttagaaaataaagtgaacagattagatgaaggattcttaaaacggtttttggttggaagacagtatgataccatcgcagctttaagagcaattcaaaatttcgaaagtttcgtccaccgacaccgcaacaaatggctcaagctaaaaaaatctcgaattgaactaatcataaatagccaaattgtcgaaatattagaaaacacaggtcttcaaggccaacatatagtgtggattcgattggaaaactgggatccccaaataattacagctgatgaaattttagaagtttcaggtctgttatgcgagttgct

SEQ ID NO: 1984 - DNA, 1288 bp, Diabrotica virgifera
  misc_feature (1221)..(1221): n is a, c, g, or t
agtaaaactagtccgaagccagaggtacttttcgcctggagatagaccatcgttcaaaccttttttgccgtatgaagacctaatccccaacgatcatcaagctaacattaggaaattattgcaaatgtctgtgaaaaaaagattaatggcagaaagaaagataggctgtatgttatctggaggactggattcttcattgatagcagcactactggtaaaagaagctaaatctgccaacgtcccatataaagttcagtcattctcaattggaatgggcgacagtccggatctcagagccgcccgcgttgttgctaaacacgtcggcacagatcaccacgaagtatcctttacagaagaggatgtagccaaggtcttagatgacgtcatatacacattagaaacaccagacattaccacaattcgagcgtcaattccaatgtatctgatctcaaagtatatacaagaaaacacagaaacgaccgttttgttgagcggagaaggagcggatgagatcgcacaaggttatatttatttcagagatgctccttcaccgcaagcagcacacgaagacagtttacggttgttaagagaaatttatttgtttgatggattgagagctgacaggacgacagcttcgcaaagtctggaactaagagtaccatttttggacctgcagttcactgactattacctgaacttggaaaaaacacttaaacaacccaaaaacaatgtagaaaagtatttattacgatctgcttttgatggtaccgatctcttgccacatgaaattctctggaggcataaagaagctttcagtgatggagtagcctcaaacacaaaatccttgttcgtgataattcaagaaataatcgacaaaagaatgccagagccgtttgatttagaaaaagccaaacataagtacccacactgcaccccgactacaaaagaggcgtactattatagggaagtcttcgaaaagagctaccccaaactagcccaaaactttttgccttactattggatgccgagatggtgcgagggagtcacagatccttcagctaggtttattaaacattacgcggccgacgaaaaaccagaaatcaacggtcactaatatctaggtgtacttaaataacaggacaatgcaaaaatatgcattttttaattaatttattaaacaaaatgatctgaaaaatcaaatttttaaaatctgtatttttnaaaacaataactttcaatataattgaaagctaaaaatgtaacaaaataaacgatctcttcattgttg

SEQ ID NO: 1985 - DNA, 1819 bp, Diabrotica virgifera
acgccatgcagggtaccgaggtccgagaatttcccgggagtcgacctcacgcggtccggcaatcgtattctcgatctcaaagtatatacaagaaaacacagaaacgaccgtttcgtcgagcggagaaggagcggacgagatcgcacaaggttatatttatttcagagacgctccttcaccgcaagcagcacacgaagacagtttacggttgttaagagaaatttatttgtttgatggattgagagctgacaggacgacagcttcgcaaagtctggaactaagagtaccatttttggacctgcagttcactgactattacctgaacttggaaaaaacacttaaacaacccaaaaacaatgtagaaaagtatttattacgatctgcttttgatggtaccgatctcttgccacatgaaattctctggaggcataaagaagctttcagtgatggagtagcctcaaacacaaaatccttgttcgtgataattcaagaaataatcgacaaaagaatgccagagccgtttgatttagaaaaagccaaacataagtacccacactgcaccccgactacaaaagaggcgtactattatagggaagtcttcgaaaagagctaccccaaactagcccaaaactttttgccttactattggatgccgagatggtgcgagggagtcacagatccttcagctaggtttattaaacattacgcggccgacgaaaaaccagaaatcaacggtcactaatatctaggtgtacttaaataacaggacaatgcaaaaatatgcattttttaattaatttattaaacaaaatgatctgaaaaatcaaatttttaaaatctgtatttttaaaacaataactttcaatacatctgctagccggtattgtttctagataaaatagataatctgtgctttggttttttagaaagatttcttgtgtagggaaaataactgctctttgttctattttttagttttattttttggcttgtaccatgagtaacaaaaatacctcccagtatattttgcccaacaaccagcctgtggtctctttggaagtcaagtctgcattcgatggcctaactacaaaggaaaaattatatgcacatcatcttagcaaagcttcatggcatgggggcctaataacactcctccaaaccagccccgaatcgggaccagtattcgtgcttttacataaactcttttcttcccagtcaccaacagacttcaaagctaaagcaataagttctggattcactgaagacgaagtgacagctgtttttgtgtacacttgtggagtttttactaactctggaaattataagggttttggagatacaaaattcattccgaacctcgagaaagaccgctttggggccttattaaaactcagtccaatttggcctgaattagaaccaatctggcttcagttcaaagatagattatatgacctagaaaatggaaaatgttgtttgggatacagccccagtggtattactacgtacttgtcacataattgtactccagaagataatgaaaaggttcagaactggctcaaatcccaggatatggaatgctataatacaagactgttcaaaactgtagtaggtgacaagattacctatgatattagactggcgtctgaagacaagaaaatattaaagacgcacactgatggcaatataacatatcagatatcatgtggagattattctcctttaataggacagctgcccaaagacctttagccagctatagaacacgctgctaatcagaatcaaagttgatatggctcaaagcctaacattttcatcattt

SEQ ID NO: 1986 - DNA, 1908 bp, Diabrotica virgifera
atcgagaaaaagtaaattacaattattgactcctttaacgaaaacctcaaagactattggtgagcttctgaatttaggataatgggaaaggtgctatgctacatggtaacgatatgacgttgttacatcagccgaatccgtggacttgttttattgtaataaaatagcggacagaatttgaatttattctcattcacttgctgtcagctcatgtggttgtggtggttaggtctgagtggcaaagaaggtttcaaacgctagtgatctttttaatgttttaagtctaactgattatagaaaataaagtaactgaactaaacaaacatgtgtggaatttgggctgtttttggactcacttctaacatacattcccattgcgcttcaactttttgccaaattggtcatagaggtccagatgcatggagagttgagtatgacaacaaacttaagaattgctgtattggcttccaccgtttggccattgtgggttgcaaatttggtatgcagcccatgaagttgcatcagtatccccattccatgctgatttgtaatggagaactttacaacttccaaaggctaggagaacaatacgacttcgattacgaaaccagatgtgacgtagaatgcattttccacttgtacgaaaagttcggcatcgaagaatgtgttaagaatctagacggtgtctttgctttttgtctgatcgatgttcccagaaggaaagttttgttaggaagagatccttatggagtgagaccacttttcaaagtgataagtagcagcggtgtcctaggaatctgttccgaagccaaaggtttggtcggtattgagaaagatctgaacggagaatcgaaaaaaatagaaccattccctcctggaacttttgaagaatacgatttactagaaaatggtaaagtaaaactagtccgaagccagaggtacttttcgcctggagatagaccatcgttcaaaccttttttgccgtatgaagacctaatccccaacgatcatcaagctaacattaggaaattattgcaaatgtctgtgaaaaaaagattgatggcagaaagaaagataggctgtatgttatctggaggactggattcttcattgatagcagcactactggtaaaagaagctaaatctgccaacgtcccatataaagttcagtcattctcaattggaatgggcgacagtccggatctcagagccgcccgcgttgttgctaaacacgtcggcacagatcaccacgaagtatcctttacagaagaggatgtagccaaggtcttagatgacgtcatatacacattagaaacaccagaaattaccacaattcgagcgccaattccaatgttttcttatctcaaaaaatatacaagaaaacacagaaacgaccccgcttttttgttgagcggggaaaagggaggggggagggatttagcgtacttcaaaaaaaaaatccccccaacaggggaagattttttttttttcaaaaaattcccccggaaaattcaagaaaaaatcgacaaaaaaatgccagacccgttggttttagaaaaaaccaaacataagtaccccccccgccccccgactccaaaagaggcgtactattatagggaagttttccaaaaaagcccccccaaactagcccaaaactttttttttccttactattggggggggggggggtgcgggggggggggggagggagtcacagatcctccagctaggtttattacattcaaaaaaaaaaaaaaggcttacgcggaagacgaaaaaaaagaaatcagcggtcactaatatctaggtgtacttaaataacaggacaatgcaaaaatatgcattttttaattaatttattaaacaaaatgatctgaaaaatcaaatttttacatctgtatttttaaa

SEQ ID NO: 1987 - DNA, 898 bp, Diabrotica virgifera
gaaaaataggtggagtgaaatattgaggtctctttgtgtattcttttaatttattggatgagcgttttttggtatacgccaaagagattaccctggtgcgtaattagcaacttgttattggttgagatttgattgattgagtgttttggatctgatgttggtagaatgggaggtaacttctttttttttaaagagggaacccaagtttgaggagatcgagttagtcagttcagttttgtaagagagttctgttggaggagttccattagggcagccatcaagttaagttttgtctggcagagagaaaagttgccggtgcctcgggccgccaatatgcgattaccggcaaagttagtagtgaagttccagttaagttttttttgcaattgtattgcagaagtaattgtgtttagttagtgtttactccatcatggcttaaacaatctacagaccaccgcgttttcaccgttttaagcaaacgcgatatctttgtactagtgttagtaccaccgttctttacaagcaagtagaagttaagaagttttctttttgtgttttcaacaccctagttaaagcacggagttgctttcattttagtatttttgatccagtttaatgaactagaaaacaaatcattttaaatatttttgttcgagtacctaagtgctaatttatttagacaatgctgaatttttctatataaatttttcttatgaactatggtttcatgaaatatgtactgttgctgtatctattaatattgtgaagtgacttttgtgcagtgatatcgcgtcttggacttaacagcaaccacaaaacgattcaaggacaatgattacacggtatttttatgggggtaaaaatactttcagtacgatgtttggtaatcccgatctca

SEQ ID NO: 1988 - DNA, 640 bp, Diabrotica virgifera
aaacgctcaaactcaaatattaataattaatgaaattacgaattattcgtaatttcaatccttaatttcagtacaggttcagtaattattaatgacaagatgaatttattattaaagcagataaaaaatattcgactagatcttaatagtaacataaaaaactttagtatatttcctgctctaaggttaaaagaaatacaagaaattcagaatgataaggaattaattatctctgcaaagcatgtaccttctggaagagaatcgtatttactgaaaaatgatcatccaactgcctgttcagtttgtgcttctggattagacataaagcatacagacgttttaatcctaagtcaatttgtaagaacagatgggtgcatgttgccaaaaaggattacagggttatgttcaagatcacagaaacgcattgcaacattagttgcgatggctcaaaaatcaggattgatgccaaacttaacaccaggttatagccataaagaccccaaaaaaagatacagatggagatataataaatattttgatgagagcaccatcaaaataagatgaattttagtaattaagttattcatagaataaaaaaatataaaatatatgtaacttttattattacacctcgatagtt

SEQ ID NO: 1989 - DNA, 297 bp, Diabrotica virgifera
aggcttgctgagctaacgtgttgtcgataacacaaaaatagttttaatataaaaaatgggtttccaaaatatatggtactctcacccccgtaaatatggacaaggatccagatcatgccgtgcctgctcaaacagacatggtctcatccgtaaatatggattgaacttgtgccgtcaatgcttcagagaatatgctggagacataggattcaagaagctggactaaacatcaagggaattttttatatacaatgttaagttaataatataaaaataaaagataatttttatattgtg

SEQ ID NO: 1990 - DNA, 1314 bp, Diabrotica virgifera
  misc_feature (1287)..(1287): n is a, c, g, or t
aatttgttaaactacgggcccgtaacatccaggtcccgatcgcagtcggcccacgcgtccgctcatttttgggtgtttctttgattgaacaaaaattacaagcgttttaaattcactaaatttgctttgaaatatacaaatagttaattctaggaaaatatataacctacatacagaatcatgtcttcccgcaaaaccgtaagccgccgtggtaccacaaagaaacgtgcccaaagagccacatccaatgtattcgcaatgtttgatcaggctcagattgctgagttcaaagaagccttcaatatgatcgaccagaaccatgatggttttgtagataaagaagatctgcatgatatgcttgcttccttaggtaaaaacccaactgatgactatctagatggcatgatgaatgaagctcctggtcccataaacttcaccatgttcttaactctctttggagaacgtctacaaggcacagacccagaagacgtaattaaaaacgcttttggctgctttgacgaagacaacaatggtgtcctcaacgaagaacgtctcagggagctcctcacgtccatgggtgatagattcactgacgatgaagttgacgagatgtacagggaggctcctattaagaatggcttgtttgattatgttgaattcacccgcattttaaagcacggggctaaggacaaggatgagcaataagagaccaattgatgatgaaaggatttgtaattaatatggaaagatgtcttagtttgaatgatttggattttcattccatttttgtgactagaaatatatgaaattcatcatactagaccatcaagtcttgtccgttgcagtatcttctgcacatagacatgtcatccttgaacaaaactgcaaaaatggatttgaaaaatggtttgttttaaatgaatcaacagtctgattatatagacatcttttttttggacttaacatctcttgcttgtatagttattaaattattttgaatgtttttaatagaatttaaattttttattaaaaaaaacaaaaattttttgttaaaaaaaaaacatcaaattttttttttaaaaggttttttttaaattcaaaaaaattttcatttctttttttttggggttttttacacacttttttgttgcaaacctttttttttttattttcattaaaaaatttttttgaaaaattaaaaaatttttttttccctttttaataaattataggtaaaattttatttctttttaacaaaaatttgggaaaccaccattaaaaaaaacnaaaaaaaaaaaaaaagggagggggggg

SEQ ID NO: 1991 - DNA, 820 bp, Diabrotica virgifera
  misc_feature (756)..(756): n is a, c, g, or t
acgcgattatatttctttcggattgttggcatttaggaaacgtaagaatattctgattacttttttcatgtttcgtcatcctaattatttattcccctttattcgccaattattttatgtaattatatattctagttactgtaatcagttacagtttttatttactgaagtcttgataaaccttcgataaaacgtggattataattgcttcccagcatcaagccagtcgtgaaataaagccatcttgatccaactttacttacagaaaattggccagaagcatttatttactataaggggcctaccatttaatggatttattggtaaagctggttctttcaatctaaaacgaatgggctagcgtacattatttttttacatattgaatttttatgttttaagatttttatttatataaacttcatcttgatacttattttgatttaattatctacgtactttttagtctgatgacgagtatttttcttaattgggtaaagttatctttatcgcgtaccaataccaattattcttttaatatatttcatctttacatacttcgaaagtatagtcaatgctaatgtaataatatataatgaaaaatagtatagacattaacattttgatacacaagtatatttgtagagtatatattttgtaaagacatctatattttagtcgaaacatgattttgatatgcatgtttttgtataaacaacttcttgcattttgtaaatatctttaagcgtaattatngggggttcagggctcattttcattattctttgatgagttgaataaaactatatctacatcatca

SEQ ID NO: 1992 - DNA, 1055 bp, Diabrotica virgifera
tgccgcttcacatataccacaataaaattatcgaatttagtagtagtaggtaacaaacgtattcctaacttctgaatttaaattagaaacaaccaactcagttagaggaagtcgttagatcgagttgtatgatagttgctatcaattgctggttaatcaagcactatccacttattattttaaacctcgtgtagcggcttttttataaagagtaataatgtccgaaaacaaacctgatacagttcctggactaggatttaaggataaagataaggcattggatacattaaaaaatttagaaggaagagatcctgattaccaaagactttctattaaaggattgataggaagagcaaaaagaactctgacattaacaaaggacaaagagaagatccaaaacataaatgatgccgtcaaagtatttgaggacttcctaagggacttcgaaatcaacaatatgtcaaaagaaaacagagcatacctgcctcttgcctcagttcaatcattactacctctaaaagaaaaattcgatattaacgatgaattagtagaagcatttttagaagcatacaccaagaaggccaaaggcgaatataaaaatctcagaactgtgtccagtggtgaaggaaagccctcttgggacatagtaagaaatgtggaaattaagaagttactaaaggccatggaagagagtcgtccagatatgtggaaagacgatttaccaaccaaagaacatcttgagctcatattgtgggcttatagtccagatgcaagtaaaattaaaaagaatgttagtaattacgaagaaaaattaggatctaaaaaaccagatagctctgaagatgaggagatggacgacgacgatgatgatgaggaggaggaggaagaagagaagcccaagaagaaacctgaaaaagccagcaaaagaagatcatcgggagacacaaaagaaggatcccctgaaaaaaacagaaaaaagatgattgaatgtttgttgtattgtgaaaaaggttttttgtattattattttcaaatatatttctattatttcttta

SEQ ID NO: 1993 - DNA, 612 bp, Diabrotica virgifera
aaaaacaattgtggtgtgaaataacatttggtttgcccttgtcgttcaaaaaattggatcttactgcaattttaaaggagactgccggcaaatctgttctttgggaaacgccccaaattaaaagagccattacttatgtgaaggatgataaattaatgcttagaacggatggtattaatattgttgaaatgtttaaatacaatacccttttagacttgccacaactttattgtaatgatatccataaagtggcagaaacatacggcattgaagcagcatctaaagtaatagtaaaggaggttaaagacgtatttaatgtgtacggaattaaagtagatcctcgtcatttgtccctagtagccgactacatgacatttaatggtacatttgaaccactcagcagaagaggaatggaaaacagcgcttcccctctgcaacagatgtcatttgaatcatcttttagtattttttaagggatgcagcaaattagaggccgaaaaagatgatttacaaaaaccccttccagtaatgcttatgttaagaaaaaacatgggggaacccggaacaggaagctttaccccttttacattaagtcctttgtaacctggtaat

SEQ ID NO: 1994 - DNA, 454 bp, Diabrotica virgifera
ataaactttgtcaaaactaggaatgaaaattctacaatcggtacacccacttgatgcgtagcaaaattactggaaattaccgtagtaaaagaataaaagaagtaaactcgacctgtaaacttcattttaaaaatcaagtagtctagtctcgacgttcatctaactctttctttctgaatactttccctgtctgtgctctgcgcagatgtgcaaaatttcgaaagacatttctggtgttcacgagtaatatgacaaatattattttatatttgatgtatggatggaatccatacatggattccatccaatacaatggtatttgatggaatttattcattaatgtactagttctcattcgttttattggaactctgatgttgcaaaagatgcagaactcaaaaaatagctttattataaatagccgtagtacatagcaaggttgtatatatataaa

SEQ ID NO: 1995 - DNA, 1205 bp, Diabrotica virgifera
aggagaaatactcaacactacgaaggaaataaaaatgagctactttggtcacatactaagaaatgaaaaatatgagttgatgcgattagttatacaagagaaagtagaaggaaaaagaggaccggggagacgatcacgtcctggttgaaaagtttaaagcagtagagtggaaaaacaacaatagaaccagggagcccaataataaagatgaaaaatttaatttgtcgtaaacagtacatgaatagcccagtaaatagtccattttttcacggtttttgctctaaattttaaagaaccgcttggattgacatgaaatttggcatgcgtatagcttacatgtcaaagaagaaaagtgatattgtgccgatgtgtgcttttgccctgggggtgactttcacctcttcttaggggtgaaaaaatatatgtccaaaataagtccggaaatgggtaaactgactaattttaagtaactattgttctatagagctttttcgccaagtcaacacttttcgagttatttgcgagtatagagtgaatatgttcatttttcaacaaaataaccacatttttagacggtttttcgcaaacaactcaaaaagtaattattttgtctaaaaaacgtccttagcaaaactatagcccataaaaaagtaaaataaatggtgtacgcgttaggtctgtgcatcccgtagaaccagagttatagccaatgaaaagtagattcacactcaccaaacttcaaatagaacatttcgacgtgaaatatccaaaaaactaagcactttttggccatttcacgccaaaatatttcatctggagtctgacgaatatgaacctacccctcactagctataactttgcctctactaggtgtagagacgatatatacaccatttttttgaattttttatataggctatatttttgtcaagaatgtttttcgacaaaatacttactatctgagctatttgcgactttctaaaagcgtggttatccatttcctaacttttcttggacaaatattttttcacccccaagagggaagcgcttctttaaaatttagaggttttgcaatattttaccgttaaagaacgtactatattcagatattgtggcttcagcaaaacgttcatagaactagaaggagaagaaaaataaatgttgagcatgtacgaaacctacaaatgtttaaaaaaagttaaatt

SEQ ID NO: 1996 - DNA, 464 bp, Diabrotica virgifera
ttagtaatagcacttgtttcatattttggaataatgtttttccaacaagtgacagttgttgtactcctcgtcctcaaaacgactcttgccagcttcgacgagcacggcctcggcgattttggagaaagtcacggatggggtgccccagccgagccttcagtcgaacacaaatatgattacaccccaactaacacgatagaacacaccaaaccagtccatatcccagtggtcaagaaaacgggagtacctcaaccgcacccagtgggtgtacccgtgccgcaagttgtcaaagtacctgtaccacagccttatcctgtacaggtgtcggtaccaacacctgtagcagtacccatctataagttggtaccgcaggaaatagagaagaagattccaattcatgtaaacaagctagtaccggtatacatcaagaaaccttacaccgttgttctagaaaaacactatcc

SEQ ID NO: 1997 - DNA, 1401 bp, Diabrotica virgifera
  misc_feature (1355)..(1356): n is a, c, g, or t
cgccagtcagcaacatttttgatattatattttgacaaatagcttgatcccattcatttatttgccaaaaacagcacttgatacgtgtttttgcaaagctgcagttacgtccgtactaaaagtcgcaccattttttgctacaaaacattgtcaaaaatttctaattataatttaggttctaagttattactacctgaactattacacgtacaactatcacaacattctaattcgagctctttacatgtacagacatccgttttacaccgattttttcctttgcatgaacaaaaacatttttgtaaaactttcatcgctgaacatccatcatagtaatctgggctcaaaacttcattttcgttttcagcaccatcaaaaacataaagctagaccaaaattggacatttacctaaccgtggtcagtaccatgttattttgggggtgcgtgccgcgcgtctattaatacaacaattttaaagatagtgaaagtagaagtgtcagaaatgttgggtagatgggcattacttttaggaattcattcacaataatcctgtaagagggcgaggttattcagaagtaaggagaagaacatttggcataaaaattgacagattattttttgaaaaatataaatataatgtataatattgatatttatgtaatgatcattaaatgtaaaataataagagtgtatgcatgatattttggaaaaatacatatgatattggacaaattttctccttattgttgaattcgcgacaggcatatagaacatttagctttgttttttattcgatgccatcttggacgaaatatcacatttcatttctttgttaaagtaaaacgttgatattaaaagttgtttattcttgtaatattgtataaaattgattgttcgattagggcaatgttaagatcaaatttctatatacctgtcgtttggttcgagtgaacaaatttgataaagtgtgtgattagtttttaaggatcgcgccgactatccttgccttttgatactgattttttcccaggatttttgttttgatgattttttacttgtgccatacacttatcgaatgaagtatctcattccagtactatgtatttaactggtatccaaaattatcttcttaatttgtaactgtttagtaaactataataaaatagtcaaacattttgtcaagttgtcatgttcacgttatgtcttacagacataatgaagtcgattgatatattattgtttattaattaaatataagaataaactaatgatgtgatgatgatcagtagatcatacagaggttttaacctctcattttcttgaagtatagtagagttaataaaccaatatgtcnncaaagaaaaaaacaaaaaaaaaaattaaagaagaattagacatgc

SEQ ID NO: 1998 - DNA, 988 bp, Diabrotica virgifera
attccaccgaaaaccggccgtaagaacgaaactcgagactcgagactgagacattctttgttcgaatcttcaagagtatttttaaaattatttgtgtgtattgtctttgtgtcttttaaaaagtatttcttcgtgtcttcgaaactttaaaataatggaaatggataaagcaactgaagtccgttgtcaagagaaaaccaaaggaggtcttcgctatgaagtgatccttggtgagccagatgtcaaagctcccccaccaaagttgtcactctctccgaagggcagcatgtccgtccaggatattgaagataaactaaaggcagctgaggaacgcagacagcaattggaatcaaacaaaatggctgcttggtctgcgaaaatcatgaaaatcgaagaggccagtcgcaaaaagaacgaaaagacttgtcaattcatatctaccactcgcgatgctctagaacaaaaaatgggcactcacgtagagaaaagggaagcatatatcaccgacttaaggtcaaaactaaaggatcatatcgaaaatgtcgaaaagactcgtttatctctggaagttcaaacagaagaagtcagatcagctattgaagataaactgaagacagcttctcaacaacgcgatgataacatcaaaaagatgttggaacgcctaaaagagcacgaagaacaagtagctaaggtgagagagcaaaataccataaaattgcaacagttggaccttgcgatcacagaaaaactagagcaggctcaatcacgaaaagaacagctcgaacaagagcagaaagagaaactcaagagttacgagaagcgagctgagctcgttcgccagaacaaggccaatctggtcgccgaaggcaagctgatcccgtcttctggttagaagaaggaaccgtcacatggttacaattatctatcattataatcttacttcgatcgaagctcatttacttcttatatcgtttaatatacatacttt

SEQ ID NO: 1999 - DNA, 982 bp, Diabrotica virgifera
  misc_feature (948)..(949): n is a, c, g, or t
aaagtgagcaaattcgtcaaagtttctcgcagtgaaattcgtattactcagtaaaccagtatgttccagaaactagtcttctttgcgtgcttgcaagttatcttcagttattatctatataatgataaaactaaccaggttatttcatatcctgcgctagacaaattgccagagggattcaaaataattcgtcctccaagaacattaaaaagagcatttatagataggtccaacttagtttgtcaagatagtggcttccactgcaaggaaccgttcgacaaatctgcaacatttcaatttgaatgtgaaatcgatgatcaatgtccccaaaattataagtgctgtccgcagaaatgttttacacataaaatatgttcacaaggaaacattcacagttatggaattggcaacggcccttctgtgaatccttttattcctagaagatccagccaacctgacaatgatttgtctaacaaccagaagacacctagacactgtcaaaaatggccatatccttgctcacggccatattcgtaccagttttcaaacccatataaatgcgacatagacgcacagtgtccacaagggtatttatgttgtcagcaggattgttttctgcataaaatttgttccaaggagctttcttcagatgagtacgtcgaggaattaagaagaaaagatgatcaatctgcagtaactaaaagaactactactttagaaccagaaatgacgtctacaactgatgcacaaaccgaaactacaactgaggaagctactactcttaccacaactgagccaaccactacagaagaaagcaattcagaagatgaagaaaatgaggaaacaaccactattatcgagaagacccacaaccaagagactgatatttaagaagagaaacgagataacaaagaaaaatagcaacgaaataaatcctgttgctattgnnactacccactgaaaaagaagacagtgagtatga

SEQ ID NO: 2000 - DNA, 860 bp, Diabrotica virgifera
ggaagaagtgactaaaaacacagctaggaatataacaaatggcattttactacaagtttgtgatttgcaaaaagtggagaagtgcgacaaatctaaagaaaaagaaaaagacgcttcacctgaaaaaatggcgaaaaaggatatcaaaggtgcaccaaatgccgttaccatgttcgcctcggagttcattggcacgggtcttctgatgtttataggctgcatgggctgtgttcctgaatttgataatcctgcagcagttcatcacatggcatcgttaacattcggattagtaatcctgcttatcattcagacatttggtcacatctcatgggctcacttaaaccctgcagtcacatttgcagcagttttcatgaagctcgtgtcgccaatgatgtccatagtatatattgcagctcaattcttaagtgctactctaggtgtcgccttactcaaagcattattgcctactgacttttataaagatggattttgaatgagactgccacatcccgaaattactgcgatgcaagatgtagcaatagaaacaattatttcaacaacttggagattaatagcttgagcagtttgggatttgaggaacgaagagaagaccgattcgacacgtttgaagtttgacgtaattatcgctgaaatatatatggatgcggagcctttaactggagcactgatggatactgcaagagattttgctccagcgttactgctaagaaaattcagagaatcaacggataaaacttgctagacaactgacgcaaggagccattctacgcatgtgcccatatcacgaagtttgatttgctcgtccggaatatgaggaaccacacagaagacgaagaagg

SEQ ID NO: 2001 - DNA, 1040 bp, Diabrotica virgifera
  misc_feature (1032)..(1032): n is a, c, g, or t
acaaatttgagtttgagtaatccctttcccttttatttgcattaattaaggaatgtttaaattgccaacctgtcataaacttgtgacagtaactaaatcttttcgtaatttaagtaaaatgtcttcaataaataaatgtaaagttgcggtttgccaatttacagcttgtaatgataaatccaaaaatttggttacagtgaagcgcttagttgacgaggcagtaacaaataatgcaaaagttgtattcttacccgagggctgtgattatattgcaaacaataaggacgaatctaggagcctagcagaaagtttggacggcgaactggtagatgaatataagaaaattgcaaacaaaaataaaatttggctctcagttggcggttttcatgaaaaaattgataacaatactatgtacaacactcacttgttaatagatgatactgggaacatatcgtctttgtacagaaaaacacatttgtttgatgtgagtattccagaaaaaaatatattattgcaagaatctgattattgtacagctggttcagcaattataccaccagttgagactcctgcaggtcttataggattatcaatatgttatgatttacgattccctgaaattagtacactccaaacaaaattcggggccaatattttgacgtacccttcagcatttacagcaacaacaggtcctgctcattgggaaattctattacgagctagagcagttgaaaatcaatgctatgttattgctgcagctcaatatggaaaacataattcaaaaagaacctcttatggacattcaatgatagtggatccttggggtgttgttgtagcagaatgcccaaaatataatgaaaataatccataaatgagagtattgctgtagctgaaataaatacagagtatattaaaaaaatcagacaagaaatgcctgtacagaaacatcgtaggactgatatttataatcttaatttgctgccaaataacaacaaaaatgacgaaagaaactcatacagttttgcagataanatataccc

SEQ ID NO: 2002 - DNA, 943 bp, Diabrotica virgifera
  misc_feature (770)..(770): n is a, c, g, or t
  misc_feature (820)..(820): n is a, c, g, or t
cacaacgatcgaggaaaaactccaactccagatcgagctacagaagcgaagccgatttgagatctatgtcggagatgacggtggacttcggaaggcaggataacttttccgaaacgtccagctactatcccgacaagagatactacgaagattccgaacatggtcacccttcgctggctagatcgctgagccaaccaagtctagccagatctgctagcgaatttacggagagatgggtagcgccgtctagatacgatacagcgagtgagtttacttcaccagaaggaactcctaaatcgcaacgcagctcgcggttccagcctccacgaggcgcaggcgagcaacgagcagtctggcagacgagccaagcgagtaccacagctggacctcgcggtaccagccaagtcgtaacccaagaattcaggagccaagcttcttccagttacgtcggtcgtagtcagcctcctaaaggctggttcggtgataacgacagcgaagctagctataaataaatcgaatacctacaaaggcagcttgtgcttgcctgtaggtctaactaaaagcagttacactgcctaaagtactcagatattcctaattatgtgctaatattaatagaaaagctgcccttttttatttagaaagaattttcttgtcgttttgtatattacctctaaattttaatatcattttttatattattattttactacagtttctaggtttgcattatgtaaaagaacaacatttagtccaacaatttggactanatatcaaagaaactcttcagaggtatgaaacaaattttgccgctaaccanggttgccaaattagatctccttcaaaaatatttgctcaagaggttaatatttttcatgttttcttacataatgcaaacattttatcgtgaaacaaaatctcattcaaataatatagtaacaag

SEQ ID NO: 2003 - DNA, 630 bp, Diabrotica virgifera
attgaaggggaactaaaagtacaaattgatagaatttaatattatcaaaatgcagagtgtaaaattgatacttcgcccattgcaaggatacagacgaatttcaaattgtgctgcattgtgccagtccgtagaggcccagacgaatcccgtagaaaaaatccaaattccaccccctagtaatgtcgaacaaccagtatcacctaaaatagataaactagccacagaaatttccaaacttaacttaattgaagtctcggaactaagttctgtcttgaagaagaggctcaatttacctgacgctcccgtcttcccagtgggaggcttcgccccagttgctgcacctgcagaagaagaggatgccgcccctaaaaaagaaaaatccgtgttcacagtgaaattgatgaaatttgaagaaaaacagaaagtagcgttaatcaaagagattaaggcgttagtagaaggcatgaatttggtacaagcgaaaaagtttgttgaaggtgtgcctgctgtagtcaaagctgatgttcccaaggaggaggctgaaaaattaaaggcagccatagaaaaagttggtggtgttgtagtacttgattagattagttgtataggttagttgtgcagttttataat

SEQ ID NO: 2004 - DNA, 416 bp, Diabrotica virgifera
cccacgcgaccgcaaatatgaaaggaattgtgttgtgattactcaaatacattctcatgaatatcaagaattaccaacagtgatgccatctgtgggtgcgattaactgctggatccatgaagatccgctggctgaacccgattccagtgaagagtctggggaagaatacacgttttatactccgtttaattttgacccacatccacgcggtcttggaaattatttgtttaatagaatgcatcaccatacacatcacatagcacaatatattgctgatactgacgaagaacaaacctatgcggaacttttacaacgttgtgtacacacagcctgccacctatcaaccagaggtttaaccaatgaccatgtcgctgagcattgttcttacaaccatatggcaagttcagtgccactca

SEQ ID NO: 2005 - DNA, 1652 bp, Diabrotica virgifera
cccccctttttttttttaataaattttttttttttttttttttttttttttttttttttttttttttttttttttttttttttttatcttttttactagtttttgatctcgattttccgctttttttttttttttttaaagttcaattattttaagaattcatttagaaaaatatttaggtgaaattctttctaatacaataggtataaatctatggtttgcaccacaaatctctgaacattgtccaaaaaaaattcctgatcgtctaagtgagaaactaatttggttaagacgtccgggtgttgcatcaatttttactcctaatgaaggaatagttcatgaatgaataacatctgctgcagtaactaatattcgaatattagtttcaaatgggacagcaattcgattatcaacatctaataatcgaaaattaaaatcatttaattcattagttggaattatatatgaatcaaattctacatttttgaaatctgaatattcataggatcagtatcattgatgaccaatagttttaattgtaatagctgggttattaacttcatctagaatataaattaatcgtaatgatgggatagcaataaaaattaatgtaattgtaggtaaaatagttcaaataatttcaattaattgaccttcaagaagatttcgatgtaaaaatttattaaaaaataaaaaaaatattagttgaccaactaaaactgtaataattactaaaattattaatgcatgatcatgaaaataagataattgttctattaatggtgatgatctatcttgtaatatgaaatttttcggacgcgtccgcccacgcgtccgaagcgaaaattgcggccaacctacaagaaaaaaacaaaaaaatgcaaaaaaaatttctcccaacaccccccaaattgccaaatggatttttttaaacccccacttaaaaatgaattcccctccatttaaagtcaaaccccccaatttaatttttgccccttttttataaatatatatccaaggggaaaaaaagaaaaaacaaaaatttctttgttctttttcaccaaggggccccggaaaaaaatcaaaagagccctaatcctcccctttattaaaaaagaaaaaaaaaaacgtctatttaaatttcccaaaattttttttcatagtcttttttaaaaaacctcaaaaatttgcccccccccaaaaaaaccccccaccctttttttgtttttataaaaatacccccacaacaccttttttttaaatatccccaaaattttgggggaaaaaaaaaaaaccacacttggccccccccccccccccaaccccaccacaaatatttttttttttttttttttaacaaaaaaaaagaggggagtttaaaaaccgggcccttaatttttaaaaggccccccttaaggggcaattggggcccgggcccccccccaggtttttttttttttttgggcagtattaaaaggggttttaagtttaaattggctggaaaaccattgaaaagtttgagtaaataggaattgtttgtttgtaaaaatgttgtttggttccccaggtcaaagaccccggttaaaaagaatgtcttttcccactgaaagtagttcaaatgggcctggtcagtaagtgttttttagttggag

SEQ ID NO: 2006 - DNA, 1090 bp, Diabrotica virgifera
ttttaaagttcaattattttaagaattcatttagaaaaatatttaggtgaaattctttctaatacaataggtataaatctatggtttgcaccacaaatctctgaacattgtccaaaaaaaattcctgatcgtctaagtgagaaactaatttggttaagacgtccgggtgttgcatcaatttttactcctaatgaaggaatagttcatgactgcataaccttttacataacaaaatgaaacaatttttagtgcttttggctttggcttgtgccgttgtggcaatgccatcaattgagtatcttaattcaaatgaatttgcacaacagtttgaaacggaggagcaactaagagattttataggcgatattatcaacagcactctaaatggggccatttctaagatgtctgatcccatgacaattgctgatatacacatggaccagaactctgaggctctagccggaaccattgatattaaagacattgctatctctggtatacataagatagtatccactgccgtatcaaccaatctcatcacgcaacaactgaacatatcagttttggttcctgatcttactatcaacttcggagctgccgtcaacgtagtggttctggagctggtaccactttacggtagtggaaaacaaaacatcaatattggagatgtgaaactatcaataaatgccgtagccgatctctcaaaaatacccaaaattcaagtttcgaaggtggacgtagttttgaacgtaggatctattacattcaacttgaatggtctcttggacaacccagaattcacagctttggtcaatactcttctcaacgacaacgtggctaaattcatcgatgagcatggtaactttttgatgccaattatcgacgatgccatcaaaactctcattaactctctttttgcttaggcactgccaagatgcagtcagaaacaatgccgaaccattttagaaggttgtggggatttttgtttccttagtgaatctgtttttgtaatttatagaacatattacacactgtattgaaataatactgaatattgtgtaaataaataataaataatgaaaaatataaa

SEQ ID NO: 2007 - DNA, 1705 bp, Diabrotica virgifera
cgcgtatcgcgtatcatacttgcaacgaaataaccacacacagtgtgaatagtttgtacgcaaatcaacttatccgcgctcgacaaaacgaaacagttcgcgttatcaatatcaacgtggttccaccatattgttagaaaaacctatctcgcgcaaaagaaaattaatttcgggatccagttctgatgctgtgccgttcccatgaccattgtcagttatgttagcatgaagttcagctatcactatacttggaacagggagattgtgttcaattcacaaaaacttgttaaaagacgctgaaaaccattggggaatacctccaaagccacccttcaagacgactgctcgattttttacacctagaactaataacttttttgtgtttgtttgttggtgaaccctagccctacgctgaatgatgtctatctgttacgaacccttccttctcgatgaaaaaatactaccaatcctggacgaagtggaacctccgcgtgccattccagtacctgttcaaaacttgaagaatgagtttgtcaactccaatgacacccaatatttcctcaaggaattccagaacgtgtacgaagtcgtggaattctcccatggcacgctcactccacctcagtctcccccgagccaaccaatgctcaccaatctcgagccacttctacagtatccagtggaaaccaagcatgtttacgtccaaccggagaagcaatttctgccagagaactacgagatcaactattccttgcccgttaatactcctcagcccgatattgctatggagctggccgtcgtggacgagctagtcagaactcgtgtggaagacatgcaatggagcagtagcggaagcagcagtcctggatccccgagcagtagtagcagtagcagcaactttggcgactgctcttctgatccggaatggatgccagagccaattgaacagtacaacgacgaacttcctgttaagtcatcccgcaaaaggaccagaccttactctaaaagcggtaccgaggacaagaaggttcgcaagaaggagcaaaacaagaacgctgctaccaggtatcgccaaaagaagaaggccgagattgaggtaattcttagtgaagaaaagggtcttctggacaagaacgttgatttgggaagtcaaatagctgatctaaatcgcgaaattaagtaccttaaggggctcatgcgtgatctcttcaaggccaagggtctcatcaactaacaaacacagaagataattaattttggattttttatatcttttttacagtaaatagggataaacatacaacttcgaggattttgttgattctcttatatagttttggcaatttatagcgtgtttttgacggcacaattgtttttatatgttgcatttaaattggacacctggagggagaatcatcaaaatgtttgctcatttgagagagatgcttgagattccttgatatcacgccttattgttgtgttctcgtcaacttgggtatcaatgatgatcgtattgtaggtagttgtcttaggaaagattttattaggcttaggaggtttggcgtctaacatgtggattgattccacttgtaagatgccatctcaataattttttattaattataatttcatacataatcattgtttcacttataacatagatataatcgaatcactaataaaaggttatcttaggtgagggggg

SEQ ID NO: 2008 - DNA, 1816 bp, Diabrotica virgifera
  misc_feature (1732)..(1732): n is a, c, g, or t
gagaatatacacctcgtccgtttaatttcggccattttaagttctctatcggtaggtaaaagtgtatgttgtgatttttctcttgctcaccctagccgccatgggattctagttgcgaaaaaccttgcacacgcaagtgtgccttacaacctagtaaatatgacagccaatatggcgcctttttcgtttatcgccgttccggcacaatcgctatctttacttttattggaaagtctttccgaagcaagtaccataagcagcaccgtcctcttccacaatgagttctgtgctggtatggaaacaggagccggcctcgccgtcgtcagactatgacgaggccgctcttctcgacgccactatctataatgcgaccccatttgaattagacatcaaactcaacaatgaactcgacaatctggcagaattcgagtcgaaggcggaagtcgcttcccacatactcgagaatctggagaatcttatggatctagatgaactgatcaaagatgaacccttccttctcgatgaaaaaatactaccaatcctggacgaagtggaacctccgcgtgccattccagtacctgttcaaaacttgaagaatgagtttgtcaactccaatgacacccaatatttcctcaaggaattccagaacgtgtacgaagtcgtggaattctcccatggcacgctcactccacctcagtctcccccgagccaaccaatgctcaccaatctcgagccacttctacagtatccagtggaaaccaagcatgtttacgtccaaccggagaagcaatttctgccagagaactacgagatcaactattccttgcccgttaatactcctcagcccgatattgctatggagctggccgtcgtggacgagctagtcagaactcgtgtggaagacatgcaatggagcagtagcggaagcagcagtcctggatccccgagcagtagtagcagtagcagcaactttggcgactgctcttctgatccggaatggatgccagagccaattgaacagtacagcgacgaacttcctgttaagtcatcccgcaaaaggaccagaccttactctaaaagcggtaccgaggacaagaaggttcgcaagaaggagcaaaacaagaacgctgctaccaggtatccccaaaagaagaaagccgagatttgaggtaattctttgtgaaaaaaaggcccttctggacaaaaacgtttgattcggggaagacaaaaaaaaaattcacataattaattcggcgcccttgctggtgtctctttctattatgattctgattttttatagattattgattaagatataaattatagattatttaaatttagtcaatgatgatcatattaggattaaaaaattgtatatttagcaagaatatataggtttactaaaggaattccgcaacatttttttcacctgtttattaaaaacatgtctttttgtattaaatataaagtctcgcctgcccactgattaatttgaatggccgcggtattttgaccgagctaaggtagcataatcattagtttttttattgagagctggagtgatgggttggatgaaaaaaaaactgtctctatttaatttataaagaattctattttgtagttaaaaagctaaatttttatataagacgagaagaccctatagagttttataaattattaataagtttttctagtattatatttatttatataataaatttatttaattgcnggtgattaaaaaatgaaattaaattttttttatattaatattataaatttattaatttttttggtcccattttttttgattaaa

SEQ ID NO: 2009 - DNA, 1127 bp, Diabrotica virgifera
cccacgcgtccggttgacgagatttcaacgttgctgctgcacatcagtcacagaaatggcacaagctaatgttatcaccacgagatctcttggtacggcatctgaaggtattagagatcagtacgccgatggaaaggcagcaaaagtttgggaagtcttcattggagacaaaaactccagaactcaaaactacaagaactttttggtgggattattgaagaggaagggatgcaaaagaattttggatgtagcttgcggaacgggtattgactctataatgttactggaagaaggatttgaagtggtgtctgtggatgcttcggataaaatgttaaaatatgcccttaaatcacgatggaatagacgaaaagaaccagcattcgacaaatgggttatcgaagaagcgaactgggtatcattatacgacgacatcgaagacctagtagggaatggttttgatgctgtcatttgcttaggaaactcatttgcccatttacttgacaactacggagaccaaagagaacagatgcgagcattaatgaactttgaaaagtgtgtaaagccaggcggtttactcttgatcgaccacagaaattatgatgatattatagataccggaaggacagcaccaaaatgtatttactataacagttatcacaccacagatattaaaacatcagtattgtatattgctgggaaggcagctttagtaaccctagattatttaattgacatatcagcagagaatggcaagcgagatactgtgatagaagactcagtaagcgaattccgtctttcctattatccacacagattgaaagttttcaacgagatgttaagaaaatcctttggcgaaaattctgaatacaaaatcctttggagattttaaacgttttggaagagatcgacgtacccaaacttttatatccacgtcatttgaaaaaggtctactatttttttaagtcttttaagaatttaaaaaattattttttaatttaattatttcttaataaaagttattttttttataagttaaaaccaaatttcgttttccttttttccaatttaaaaaaaaaattaaaaaaaaaaaaaaaaaagaaaaaaaaaaaaaaaaaaaaaaagggggg

SEQ ID NO: 2010 - DNA, 1040 bp, Diabrotica virgifera
tttttactttaattttacggtaagtacaataatttttcaacgttactgcttagtgccggcctttaaacgaatgtgattctctagactatagttgttaatttagttatctttgttgaacattgtagaaaaacaaaaccgcaatggctgaaatactgtctgttcctctgaagaaacccagtgatgtagacctcataactcctttaaagaatttaatacaatcccgatacagcacggcagacaagcctgaagattgttcagaagctataaatgagttttccaagcaaagaaataacgctatctggaaggcctttgaaaaatacgagagctcattggaaattatttatggcaagcttctggaatcttcaactatttgaaatcaacagtgatgcttgcccttcaacaggatcctactccagatctaaatccagacactcttggtgccctctctcagctgatgttggcccaagctcaacagatcttcgtacataaagccatacatgataacatgaaagacgtaattgtcgccaagctagcttcgcagtgtgaagatttatatgcagaatgtcttaaggtatttcaaagagataacctcaaacacatttgggataaggattggataccaataattgctggtaaacaagccgcacttggagctgtagctgagttctatcagagtttagtgtgcaagaccaataaaaccataggacaagaaatatccaggttgaggagatccaatgaactcttcaaagccgctcagtcccgatctggcaggtcgttcttcaatgaagtagcttctagggtagaaaggcatctcaacgaagctgtaaaagacaatgatttcatttatcacgaaattattcccgatattaaaagtgttgatccaatcggcaaagctcagcctgccaaagtgctacaagtagcccatccaatgagccaaaacttcaacgacttgttcaccgagttggtacccgtggcagttcatcaggttcttgcttcttatgatatcagaaaaaccgacatagtccaatactgagatctct

SEQ ID NO: 2011 - DNA, 1362 bp, Diabrotica virgifera
ctttaattttacgaaaaacaaaaccgcaatggctgaaatactgtctgttcctctgaagaaacccagtgatgtagacctcataactcctttaaagaatttaatacaatcccgatacagcacggcagacaagcctgaagattgttcagaagctataaatgagttttccaagcaaagaaataacgctatctggaaggcctttgaaaaatacgagagctcattggaaattatttatggatactatgatcaaatagtggctttagaaggaaaaattcccccacaggagctacaagtgccctttaagtggaaagatgcctttgacaagggaaatcttttcggaaccaggatgagtttaactatttcttccttgagtttcgagaaggtatgtgttcttttcaatatagcagctctgcagagtagtgtggctgctgcccagagtgtcgagagtgatgaaggactcaaactggcagctaaattgttacagcaagcttctggaatcttcaactatttgaaatcaacagtgatgcttgcccttcaacaggatcctactccagatctaaatccagacactcttggtgccctctctcagctgatgttggcccaagctcaacagatcttcgtacataaagccatacatgataacatgaaagacgtaattgtcgccaagctagcttcgcagtgtgaagatttatatgcagaatgtcttaaggtatttcaaagagataacctcaaacacatttgggataaggattggataccaataattgctggtaaacaagccgcacttggagctgtagctgagttctatcagagtttagtgtgcaagaccaataaaaccataggacaagaaatatccaggttgaggagatccaatgaactcttcaaagccgctcagtcccgatctggcaggtcgttcttcaatgaagtagcttctagggtagaaaggcatctcaacgaagctgtaaaagacaatgatttcatttatcacgaaattattcccgatattaaaagtgttgatccaatcgactaagctcagcctgccaaagtgctacaagtagaaaatccaccctccaagaggcaaaaatttacaacctttttttccccggggggggccccggggggacccccccgggctttttttttttattattaaaaaaaaaaaaaaaaaaaaaacaaggaaaaaacaaaaaaaaaaaaaaaaccccccccaagtgggggagggggtttttttatcccccttgttattatttccccgcgcgtttccggggggcccccggggggggggagaaaaaaaacccccccccccctttttttataaaaaaaaataccccccttctttatttttattggagggggggggggggg

SEQ ID NO: 2012 - DNA, 943 bp, Diabrotica virgifera
  misc_feature (844)..(845): n is a, c, g, or t
gagttgagtagtagaagtgcgaggagtgctaaagacttaagtcatggggtgcggggtcggaactgcgatttttgtatttgctagtgtaattttactcgcagaatctacgttatttgatttaggaaaaaccaaagaattagaaggagtaatcaacgatgataaatttatagtatctttgaggcatataaagccaagaaaacggtcaagaggaatgatagaaactttatttgcagtagattttccagaaagcaatgacaagtttgcacttctgcttgatagaaaagtcaaaaaagtaaccgttgaaactgtggagaatggcaaaaagagatctcaacattttaaagtagattctttagatgaagataatagtataaaatctctaatactagaggtcaaccaaaatgagcctggcgcgcatgctactctatatttagattgtacttcgtatggtatggtagctctaccaaagacgttaagagagatgcacaaaacacctgaccgtaaattagaagtgcaccacgaacgaaaatataccatcgaaatcgacggacatcacagagatttaagaatggttttaaatcgcaatgactgtcctctgtcgttatacacgaaccaaagcaaaagctacgacaattatctcaatgatgatctaaacaataatctcaatgatgatccaaatatacaagctcaacaacctgattatgatcagtaccgaaggggaggagaggatccatatagaaggacatcgcctggtggtgttccgtatagaggagatattcccttggtttccaagttggaagactctggtattctgcaagctcttaaccttctgatcgaacggtannatttcgaagtaaagaggtgcgaagcttcagctgcagcaatcgataacttgcgccgtcttatagaacaatgcgaactgtgcaaagctcagccaattcgt

SEQ ID NO: 2013 - DNA, 1270 bp, Diabrotica virgifera
aaagactgatcaattgatgaagttgtgtttttattttttatactaagatgaggagatggacatttatttgcggtaccgtgacagctatggcagctgttttggtcttcttgggagtaggaataaaagcaatccacgtcagtggaattcccgacagagaactgaaaatggtccatatagttatgagacacggtgctagaactcctgtcagtacttatcccaacgacccctacaaaaatgatccattataccccactggatggggacaactaaccaacgaaggtaaaaaagctttatacgaaataggaaaatactacagggaacgatatgggaaattccttggagacaaatactcacccgacgaatactacacccaatcaacagacgtagacagaacgaaagcaagtatgatgttggtaaatgccggattatggccccccaaaggtgaacaagtatggggacccttggactggcaaccaatcccagttgcttctgaacctctatcacaagacatgcttttacttgtaagaaaaccttgtcccaaataccacgttgagaagaagaaagtttttgaatcgaaagaagtcaaagatatgcttagtaaatatgaagatctctacaaagaattgacagacatcacaggtcagaaaactgaagattttgaaggggttcaggatatttatactactctcatggctgaggagaaattccacctaaaattacctgactggactaaaaattattatcccgataggatgtatttccccacagtaagaagctttgtattgaatgcatacaatgaccagatgaacaggctgattggaggtgtattggtaaaaaaacttattgaagactggtcagctaaatctgaaggcaagctagcgaggaaagctgtcttgtacggaggtcatgacggaaccatcgttaatctgatgagtgctttgaaagtttgggatgaacaggtacctgattacgcaatttcaatcctattcgaactgtctaaggatagatcaacaaatgaatatggagttgagatttacttaagaaacacaaccgtagtgcctccatttaaactaagaattcctggatgtgacagtttttgtccattgaccaaacttaaagagctcaccaagagtatcatccctggaaactgggaggaagaatgtaaagtagatgatgaaggatttgttgtacctgaattaagaggaccatagtgatattagttttaagcaaatgtgtatataatacattttttcaatacaagttttatatt

SEQ ID NO: 2014 - DNA, 751 bp, Diabrotica virgifera
  misc_feature (577)..(577): n is a, c, g, or t
cattcaagtaaatcaaaccacaaaatcagtttagttttttcagttcggttaatcaaacaaaatcgttttcgtacggatatcgctaaaatgtccaatgttaaataacggattaagtgtgtactagtttttaaataattttgtattacacatgatgagatttaaaaagcaaccatggcaacaacagagaactggtttcaaaattggcatccgccaactacgttatttacagaacagcaacctttccaaccgattcactttcaaaattccagtcctgcatttgaatacggctatcaattatctcaaaattctcccaatgttggaccaaattcctttcttccatatttagtttctctaagtatggtgaaaccgccgggttctgaatatatagataatagagcatctagacactcaacacgtggatatggtaatagaaatcaactaatcaatttagaaactactggtccattcaaaacatggtactactggaatgtgttagatttcgcttatcccagtgaaactgatagagatattgccatacagaatgaggattttattccaaaaaacaatcttccattangtgtggaggtatatggaaaccgaatatttgtatctatgccaaaattgaagccgggcgtaccggcaactttggcagtgataccaagagttccaaaagaaccgtcgccgaagttagtaccttatccaaactgggaatggcacacctcaagaggatgccaaagcatcaactccgttt

SEQ ID NO: 2015 - DNA, 842 bp, Diabrotica virgifera
acaaaagacccaaaaaagccatagaattttataaattagttaattttatttaagaatattagaatatttaagaaactttgtgtagtaaaataataaaaatgttacgcgaactacaactattaagacctctaaggatactatttgttcagtcaagtggatttaaacactttccatcaccccccaaatttgaccacattcagctaccagaaaaacccagacttaagtttatagataaagttccacaattgcctccatcgatacgaccgcccaaaatgcagaagaaattaaagctaatgcgtggtcctgaacaagtacacactttcttgttgcacaagcaatacggaattatggcaaccggaggtggtcgtttaaagtggggtcactttgaaatgatgcgtatgacaattggtaggaaaatggacaacaataggatgtttgctctatggagagtggatgcaccttggcagccagtcacaaaacaaggtttaggggtacgaatgggtggtggaaaaggagctatagatcattacgttactccagtaagagcaggtagaataattttggaattaggaggaaaatgtgaatatgctgaagtaaaggatttcctacaggatgtagcaaataagttaccattcaaagcaatgcctgtttctcaagatattctagacgaaatgaaggaacgtgaaaaatgggaggaagaaaacaatcaaaatgaatacaccatgaagtatataatccaaaataatatgggtggttgccagaagtggttgtctccgtatgaaataaaatatttttgtaaatatgtatagattttttaggtaaaataaatttatttaattttg

SEQ ID NO: 2016 - DNA, 1009 bp, Diabrotica virgifera
tcccggtcgaatgcatgggtatggtagttgttataataggaatgtttcaatattaattctttaattttatctattaaataagaagtgcattaacaaattactgccatttttaaagttttccgaacatgaagatgagtcttgtgaatagccactattaaagaaatattgatcgtacatggaaatttggtgccaggtgtaaagacgtattttaatggaaattacctatacattaaatgatcaataatgaatgaaagtgatttcaaaagtattttggctacaactgcgtcaatttgtacaattctacagtttttaacaggaacgctaacctgccaaaaaattgttcaaaataagagtaccggagatatatcttcctttccatttgtaagtggttgtttgtcaacaagtttatggcttcgatatggatttttaattaatgacagttccataatattagtgaatacagtgggcgctacattattttttgcctacgttttgaccttttatttgtacagtatcaataagaccgccatagttcgtcaatttctgggatgcttatttttcctagtgataattctactccacatccataacaatgtgactgatgaagagctggtccgatcgcatttgggactagtatgttgtggagtgactattttatttttcgccgctccgtttgtgtcacttctgcatgtaattaaaatgaagagtacagagagtcttccgtatcatcttattttcgctacgttcatcgtgtcgttgcaatggctcatttacggatatgttttaaaggacgagtttatccaggttccaaatttaattggatgcattctatcgggaatccagctgagcttgtttctgatatatccaaagaaaagtaaagtaagcgcactggtttaaatgttatagtactgataagatgtaatatattaaaatgttaacagagattaagatttaagtattaataaccccccaccaaataccagccatacctatatggccagatattaac

SEQ ID NO: 2017 - DNA, 985 bp, Diabrotica virgifera
ctcacgggccgacacaagcctctagttgaaatagtagattgttgttttacatttgtttaagagtatcataaaaaagtccagtatgtggaaatggttggttttggtgttttttcaactgtcagtttttgactgtgctgttaaaaataacaataataggtcactgcatgtgccaaattttgccaaccgtaatttaggtgacgctagttcaacctgtaaagctaaatattggacccttgtaaaatattttgatggctttccgaagaatactgatatgacaattcgggaagaaaatttgccaccactaaaaaatggagaatttttagccaaagcagttttcttaagcgtggacccataccagagagtacttgggtcttttccagatcaagtaaaacttggagaaccatttttggggcagcaaatagcacaaatagtagagacgaaaaatacaagatatcccattggaaaatatgtccgtgctccatttggatggcgaactctaaccatatcaaatggacaaataccagatgaagataaaccactggatgttctaccagattacggaaagttgccagtttcgctaggattgggagtactgggaatgaccggcatgactgcttactttggtttactagaagtctgcaaaccaaaggctggagaaaccatagtaatatctggagcagctggtgctgttggtaacttggtaggacaaatcgctaaaattaaaggattaacagtcataggaatagcaggatcagatgaaaaaggaaagtggcttaaacaagaacttggttttgatcaatttattaattacaaaaaagataatatcgatgaaaagttgaagcaggtggcacctaaaggagttgattgctattttgataacgtaggggagaaataagctcttccgttttgtaccaaatgaacgattttgggcgagtcgccgtttggggatcaaaatagcatataacaccactgtttaaaccaaaag

SEQ ID NO: 2018 - DNA, 639 bp, Diabrotica virgifera
  misc_feature (538)..(538): n is a, c, g, or t
  misc_feature (583)..(583): n is a, c, g, or t
catcattctgattcattttcagcttaatttttccatgtagtgccggttaattgaagtgatatatgatttatttatgtgattacatctaacagcagactcataaaattgtgtctttttgtgtccgatgtctagtggtagtttagcagacaactccatcgatcctccagccaaaaagcggaagcttgaatcaaagattgctaccctcgaaatggcgaacaatgaagcttcaggatcctccaccagtgatatcgatgagggactttactcgagacaactgtacgttttggggcacgaagctatgcgccgcatggcaaatagtgatgttctaatatcaggtttaggtggtttgggtgtagaagtagctaaaaatgtaattcttggtggtgttaaatctgttacccttcacgatgaggctctttgtactattaaagacctgtcatcccaattttatttaacagagggggacattggtaaaaaccgcgcagaagcctgctgtagcagtatctgactcacactatgtccccacaaagctacacanggcccctgatgagcttcatctaaagtcagtgctgtgtcttaccancagcatcgtgagagcactaagatcagcgagatacacatgaaaacacattgcattaa

SEQ ID NO: 2019 - DNA, 1071 bp, Diabrotica virgifera
  misc_feature (920)..(920): n is a, c, g, or t
  misc_feature (974)..(974): n is a, c, g, or t
cccgataaaactcagactgtgcaatatgtttcctggaatgttgttaaatttatgtgttgatctgtgtgtttattaactgtgctttaagttcaaataccaattctctttttttatgaaggtctggtggctatgccgtacaatgagcagcgggagtagccaaatatggcgtcgtcgcagtggtacagcatggatccgcgctggcctagtaatcttcatcttggtattcatatggatccagatgacgttcctgagcttcgctggttcatcccctcaatactcagaactaaacgatagtaacgcggctattctgagtatggttccagctgttttgcacaagtttctatcacccagaccaaaaaatctttctactattactttcgctaacggcagtttctcaaaatttatttctacagacgttctaaatatatctgaaattaaacgaaatatagcacaatacaacagacaacaaatcgtttacaatgaaaatatatttgaaccgcttcaaaacgactcaattgtcatactagttcaaattcacgacagaatcacttacttgcgccatttaattgtcagcttagcacaagcacctggtatttctcagactcttcttattttctctcatgattactatgacgaggaaatgaataatctagtcagaagcattgatttttgcaaagtggtacaaatattttatccctactccatacaaactcacccatacgaatttccaggagaggatcccggagactgtcctaggaatattaaaaaagacctagctttaagaaaaaaatgtaataatgcactttacccagacgtctatgggcattatagagaagcaaaatttactcaaacaaaacaccattggtggtggaaagcgaatagggtatttagtgacctggaggttaccagaaatcacaccnggtctggtagttttactcgaagaggatcactatgttgctgaagactttatccantttgtgcgattgatggaacgaccctacaagatctttgtagcattgtaatatattgtctttgggaacatactttgaaacatacaattactatgccgat

SEQ ID NO: 2020 - DNA, 502 bp, Diabrotica virgifera
cgggatccccagagataacctcacatctgaagttaaatactggttgagatccatcggatgtcccgctgaaactgtcaaagaggttttggcagctggtccagacaaacgcgtgctagatgaactcctgaagggtatagagagagttaacaagcaagccacatccaatgctcaaactataaagaagatatcagtgcttcctgctgatttctccatacctacaggagaattaggtcctacaatgaaagtaaagcggagaattgttgaacaaaaatataaggatatcatcgaaagaatgtactcttaagaaacaattattgttgctgttgttattttgttattgttgttaaatatacttatatatttatattttaatataaaaggtgtacaaaaaactccatttttgaaattattatacttaactaatgaatagtaattgttaaaatctcagatgcaccaattaaaatcctatttatcacaaacaaaaaaaaaaaaagggcggccg

SEQ ID NO: 2021 - DNA, 1747 bp, Diabrotica virgifera
ccgggccgacacacgcgtccagcaatttccgagaaaagaccacgtccacatttaagatgaaggcttactttgttttcctgattgtggcagttacatttcttcatgtagaaggttgggtagcaataacgccgtctgataaaggaacagaacatctaggtgattgctactcatctgataaaggtataggttccatgaaatttggtgaaaagaagcaacaagaaggacactgtgttcaattaacctgttcaagcggtactagatatattcacgaagcaggctgcggatctgtaggagcagaacctccatgcgtagtaacatctgaagatctgtccaagccttatccagactgttgccctggcatatcttgtcctgatgcctaacaagccttcgtacaagaaacatgaacggatgtaaataaattataaatttaaatgtttactagattataataaattttttctattctaaaaaaaccacattcgtagattgaacttgtttctccatcttttattacgtttactgttctctctctagcaacatggcagacatctcaaaagaagatcttcgcaaagaaattgccgccatcttaaaagatgccgacctttcatccacttctgccaagaaggtgagacaggagctagaggagaaactagaaacaaatctacaatctagaaagaaagaaattgacgatttggtaatggaattcgtcagttcaaagcaggacaagaagaagggcggtaagaagaaggcagaatctgaggaagaggaggaggaggaagaagaagaggaggaagaggaaccttctgaagatgagaaaaagaaaaaacgcgcctccactggtaagaagccagcagcaaagaaggcaaagaaaacatcagaagatgaatctgccagcgaacagagcgatggcgattctgaagaagaatattcacccaaaaaggcaaaaccagtcaagacacgcaaacttccccccaagaagaagaagggttccgaatctgactcagatgaagactggggcaaaaagaagggaaagaagggtggcggcggaggcaagaaaggaggtagcggttacacaaaagtaatgaacttatctccagaattggcagcgttggtcggtcaggacacgatggctcggcatgaagtcgtcaagaaagtatggtctataatcaaagaaaaagatttgtacgatcccaaaaacaaacagtacgccatctgtgatgatgcattgatgaaggtcatcggaacgaaacgtttccgcacgttcggtatgatgaagtatttgaagaatcatttcatcagctaaattttctgcgtattcgccaactagcgcccatttatcctttccggagtactcaagtttgagtacgtttttttcagtagtttggtgtttgtattattgtgctagttggtgttaaaaatataaatgttaaatagagaatttcaaataaatatttttattataagcccgattaggactgatttagttttaagttttattaaacacgagtttctttttttataataaaaaaatgtatcagaatatccgtaatggttttgtgtaactgtgcacctgtaaatgttctgtaactgtatgagtatgtgcagatttttattaaataaataaaactatggaaaagaaaaaaaagggggccaaaaaaatcgtattttctttttacttcaaaaataaaaaaaaatactaaaaaaaaaaaaaaaaaaaaaaaaaaaaaaaaaaaaaaaaaaggggggg

SEQ ID NO: 2022 - DNA, 961 bp, Diabrotica virgifera
caaaagcaaacttcggcaactgtcaaagtttattttatttaactaaaaatttaattcatattgcgtttattttattatggcagtgtactgaattctcaaagttcaacaaaataatggagaaattaccagtagaggttattgaaaatattctcactttccagaaaatatctattgaagatgtggtacatttttctctaacttgccattattttcataatattgtaacaaacaacaacaaaatctggaaaactaagctgtttcagaaatttccccagttgaggagcctcttggaaagtaaacatatcattttccagcatgaggttaaatatatttatgaactgaagaaaagaactcgagctctacttgagaaaatgcctgctaaattttacaagagatatgaaatctcagactcggatctatatgagtggagcagtattttactcgaaagagaagaagtatacaaatgtcttgtaacagatttaatggagattgtaaatacagatgtttccatcaagagtatagaagtggtaccattaaacacaccaggaaataagacgttccagtattatgccaacaaagtactcagatacatacgacagcatcatctttccaaggtatggaaggaatacatatctttaccgccatctaaacaaattcttgaagtaggtgcggtatttgttgctcagtggtgtcaaccaaatgttgaagtgacagttgagaatataggccacagattagatttgatagctgaagaggttaagtctgcactgcgaacagtatatcccgagcatccaatatttaaagcgactcaagagcaactcgatttatggcgcagacaaaacaaagagcaaaatgaatggaaagtaaacgaatgtcgtcagctaataaccatcatgcgcgaagtactctttcacagatgagattcagtggaaaacaaccatgcttactatatgccacaaaa

SEQ ID NO: 2023 - DNA, 1111 bp, Diabrotica virgifera
tggtactaaaggtgagatatttgaactgtgctgtctgtacgtcggtccgtccgaccgcgaatataactcctccgtcattataccaagtagaatgacaaaatgtgtcaaataaaagcatataatccaaggatggtactaaaggtgagatatttgacctaggctgtctgtccgtccgaccgcgaatacaactatcctccgtcattataccaggtataatgacaaatgaggtgtcaaatgaaagcttataatgcaaggatggtactaaatgtgagaaatttgacctaagctatctgtccgtaagactgctaatataactctgcctccgtcactataccaggtagaataacaataattgaggtgtcaaatgaaagcttataatccaaggatggtactaaagttgcgaaatttgacctaggacttgcggttttagaaatgcgaccagaagtattattttaacggcatcggaatagtgcaagtgatatattagtcgagaacaaatatatactttaggtttcatgactgtttgtcagtccgtccgcgaataaaactcctccgttattaatacagacagaatgacaaatgatgtgtcgaatgaaagcttaaaacccaaggatggtattaaagatgagaaactttacatctgacttccgattttagagttacaatcataggtactgttttaaagtctccgaaatagtgtaagcgatatatcatttgacgtgccttagcaagatgagaacaaatataaagttttggtttttatatcatttccggttaaaaagttctaaccagaagtgccattatagtcgcagaaatagtacatgtaacacatcaatcgaagcgtattgaaaagttgagtttcaatatttagttccggttttgaagtcatttctgtgacaatgataacccaaagtttagtaaaaatgactcaaaattagtaaaatcgtatatccatcgacgcaaagttacacgaagagttcaaatatcgaattacagttctactgacgattactttgggtgaaaacctaggacttacgaagtccaattacttgtttgcactaaaaaaatcggttcaaattaaattattctgtttattgttgttaactttgta

SEQ ID NO: 2024 - DNA, 986 bp, Diabrotica virgifera
atcggcgagaacaaaagtacttacttcgtacttaagtacttacatagtagtagttagtatcttttacgtgaaaatgtccgatttggtcagtgttttggaatttgaagagcatgctgttaaagttcttcccagaaatgctttggattattacagaagtggagctgggaaacaggagacactagcggataacaggagagcttttttcagatataaactaagaccaagatgtttaagaaacgtagaaaacatagacttgtcaactattgtccttggagaaaagatttccatgccccttggaattgctccaactgctatgcaaaggatggcacatccactcggagaatgtgccaatgccagagctgctcaagctttggggatcatctacacccttagcactctttcaacaagcagcattgaagaagtggctgaagctgcacctcatgctgtgaaatggtatcaattgtacatctatagagacagaaatgttacaaaaaacttggtcctacgtgctgaaagagctggatataaggcattagtattaactgtcgacgctcctgtttttggtctacgtttagcagatttgaagaacaaatttactctacctccacatttaagattagcaaatttccaaggacacacatctgaaatgagccaggatctagaaaaaggatcaggtcttaacgcttatgtaacggatctcttcgacgcaactatcagctgggaagatattaagtggttaaagagcattactaaactcccaattgttcttaaaggaatattgacagctgaggatgctctacttgctgttcaagctggagtggctgctgttcaagtatctaaccatggcgctaggcaaatagacggaacacctgcttcgatagaagctcttccagagatcgtaaagccatgggagacagaatagaggtatacgttgacggaggaataacagacggcattgatattcttaaagcagtagctttgggagc

SEQ ID NO: 2025 - DNA, 1096 bp, Diabrotica virgifera
gtccgcaaattcatcaagtgcaagtacctatacagtttagtagtgaaaaatattgttcagcggcaattttaataggtaaatctaacattaaatttgactttttgtggttttgtattgttttagcgttatggagacagatactcctcaaactgcagcacccgctgtgacacagatacctgcagagattgaggctataattaaagcaacagttgaacaaactgttgctactttaatggaaaaacggcttggtaaacgtaaacaccgcaggtccaggtctagatctaagagcagaagccgttccagatctcgtagccgtggtggccgttctagatcaagaagcaagggtagacatgacagatccaaaagtagaggtaaacatgacagatcaagaagcagaggtaggcatgacagatcaaaaagtagaggaagacgtgacaggtcaagaagcagaggtaggcatgacagatcaaaaagtagaggtagacgtgacaggtcaagaagcagaggtaaacatgacagatgtggaagccgcggtccctgtgaaagatttggaaacaatagagacgagtggaatggttgggtaggttttggacacccaccgcatcatcatgatcacttccaccatcatcatccaccgggttgtttcagtgaacattttagacctcatggtagacatggtagacatggtaaaaggtttccatttccttgtggatgctcttgcagctcgagaaaagaggaagaacaaaatatggaaagtgaaaaggaagaacaaaatgttcaaagtgaaaaggaaggtactccggccgccgataagagtttaagagaaaattttaaaaatttggaggtggataactgagctaactaatggaaagatgttttatatattttaggtgacaaaaattttaaaagactgtggctgtggagtcaaccaaaaattaatataaaatattgtataaatattcgcattatcagtatacatttatgggtagaaaattttatggttacatgtaggaataatttgttttataataatcgatatggtatatttacattaatagtgtataatgttataattatataaaataaatattattat

SEQ ID NO: 2026 - DNA, 822 bp, Diabrotica virgifera
gtagagggccaacagtagatgttgaactatcctggttttgtgtacacatatatcctgctgagcatattatactttcttaatgtgtttggacagtgagtctacaaaaaatcgggatggaaaaacagccttctgtttttggttcttagtatgaatgttactttttctttacagacccattaccgtacaagtgttcacgttgttggcgaagttattcagtatcatatacattagaaagacatctacggtacgaatgtggagtcgctaaacaatttacttgttccatttgctcaaagaaattttctcgtagagatattttaagagtacatcagaaaaatttcaggcatgacataaatcatggtatggttcaacctttagagccaaatcaagatttaagccaaatgcagggatcataatttgtcttgatcccccaatatattttagtaagtaggccgaatatttctcctcaagaaatattcggactgggtggaggtgggttaagtaacttcccttcaggaagttgcctttttaaggtgaattttgccatcaccttattttttaatatccatagtccttcgtttccaaatccacattcctatcacatctcatctggttcatatcatgtttcattttcaccttcgcccttttctttctcttttatcaactattccaaggatgggtggctgcaaccttttcatactaacctgttccattcccgtggccaaagaagacttacgtttttattataacaaaagtcgttaatatattgattttgttaaaaaaaaaaaaaaagggcggcagctcgagatgatgcactcgtgggcg

SEQ ID NO: 2027 - DNA, 1460 bp, Diabrotica virgifera
ctaatgaagacatccaaaaggtaagaagggggagaacggagtagaaaccaaaccgtttccagattcctattcatttgcccgttcttataaaagcactgaagatttgtcagtattagaatcatttttttctattacattacatagactaatttgactttaatatatgacactcttcatgaagttagtcactaatgaactattacttttaaatttgtgttggaaagcactttggtttcttaacagagactgaggtctcggtgtttatttattctcccacttgttacgttttatttttcttaaattatttttttgtttcctccaaatctattttgccatacaacgagccagtgcttgtttttgttgggtattgtaactttgtttgggcctgcacaaaccatattctactatttgactggcgcctgctttggcttttctaaattactttttaagtgtggagtatggtctgtacttgtcttgtaattataatgttggccttctatctcatttttattctttactttggtctaacattgtataatgcatgcttttattgtatatttgtacattttttattttttactttggcagtatggctagtttttgtcttactgcacatttaattcatttttatctaaatgtgttaaatataacagatttagaagtttatgtattttgattttgcaacaattgttgtaaaaattaaattcagttacatgatttcatgtaatgaagcacattcttctatttatattacatataattttatgtaatatattcctcaaagagatgacagcaaaaaaataaatttcacatttgtgaaatttgttttcactatcaagtcaccattatggattactattatggattactattatggattaccattatggattaccattatggattaccattatggattaccattatggattaccattatggattaccattgtgataccattatggattaccattgtgataccattatggattaccattgtgataccattatggattaccattgtgataccattatggattaccattgtgataccattatggattaccattgtgataccattatgaattaccattgtgataccattatggattaccattgtgataccattatggattaccattgtgataccattatggattaccattgtgataccattatggattaccattgtgataccattatggattaccattgtgataccattatggattaccattgtgattaccattatggattaccaatatggttcatcattatggatttaacatacatttaacaagtttctttaatgatgcttctaacatgcttgcaaaaaaattgcatacatgtttcattagcgcaagcttttcaaaatttcctggtcattaaaccttttattttttcaatttcttttttggaactcagtatttttttaatatcaggtggaggtaaaaaacta

SEQ ID NO: 2028 - DNA, 1232 bp, Diabrotica virgifera
caagatttaagccaaatgcagggatcataatttgtcttgatcccccaatatattttagtaagtaggccgaatatttctcctcaagaaatattcggactgggtggaggtgggttaagtaacttcccttcaggaagttgcctttttaaggtgaattttgccatcaccttatttttttaatatccatagtccttcgtttccaaatccacattcctatcacatctcatctggttcatatcatgtttcattttcaccttcattaaattctttctctttcatcaactattccaaggatgggtggctgcaaccttttcatgtaagtataaaacattttattaaagagctatttaaagattttgttcctaattactaaggcttttggagcctcactactgtgcaatttgtcaatatttgtgcctgttttgtccatcagctattaaaaactacttctttttaatagtctgcaagaacaaaccagggaatttttgttttactagttactagtcgttttacattgtgcagtgaacatttgtctttaaaaaagcgaagcaatggttaacacatatccaaggcactaagtatctcatttcttctgatcattgcttataatttaatctcgagtatttaaattcaaatgtattgtcagatacatatttaatgacgagacttacattattcaaaaccatgtatagaaataataccataaaaccccatgactataaccatgtcaccatccccacatatgactgacatgattttgaggaatgtaagccttcacggctggtgttctgtaatggtaaattctttttgggctttataattggtcgtgatgtggatctatttctttcttgtgcctttcaactgtgacagacatcgaagactatgcaacataggtcataactgtcgggtagaagaccgttatgaactgtcttctactcattgatagtttacacgctgcctttgacgtctcgatggaagttgcgaggccgaggaagaaataattccgagctcggtctataaaccccgaagaacgaatgtaaccgatgagaataacctactttgagttttcctactgattctgaagaaaattttaagatgatgccgaagattgatacgaagtgatttaacgaaactttttctctgttgttacggactaacctgttccgttcccgtggccgaaagaaagacttacgtttttattataacgaaaagtcgttgaatagattgattttgtt

SEQ ID NO: 2029 - DNA, 2604 bp, Diabrotica virgifera
  misc_feature (773)..(773): n is a, c, g, or t
  misc_feature (810)..(810): n is a, c, g, or t
  misc_feature (823)..(823): n is a, c, g, or t
  misc_feature (863)..(863): n is a, c, g, or t
gtaaaacgcttttttaacattatattagatataaagtttttaagttcaatcaggcgtttataccgcaaagcgctttgtttattatcgttattaatatttcaaacatttcggttttcgggacctaatgaagacatccaaaaggtaagaagggggagaatcggagtagaaaccaaactcgtttccagattcctattcattcgcctcgttcttataaaagcactcgaagatttcgtcagtattagaatcatttttttctattacattacatagactaatttgactttaatatatcgacactcttcatcgaagttagtcactaatcgaactattacttttaaatttgtgttggaaagcactttcggtttcttaacagagactcgaggtctcggtgtttttttattctcccactcgttacgttttatttttcttaaattatttttttcgtttcctccaaatctattttcgccatacaacgagccagtgcttcgtttttcgttgggtattgtaactttcgtttgggcctgcacaaaccatattctactatttgactgggcgcctggctttggcttttctaaattactttttaagtgtggagtatggtctgtacttgtcttgtaattataatggtggccttctatctcatttttattctttactttggtctaacattgtataatggatgcttttattgtatatttgtacattttttattttttactttggcagtatggctagtttttgtcttactgcacatttaattcatttttatctanatgtgttaaatataacagatttagaagtttatgtatnttgattttgcacncatttgtgtaaaattaaatttcagtacatgatttcatggntatgagcacattcttctatttatatcacatatacttttatttgatattgtgataccattatggattaccattgtgataccattatggattaccattgtgattaccattatggattaccaatatggttcatcattatggattaaacatacatttaacaagtttctttaatgatgcttctaacatgcttgcaaaaaaattgcatacatgtttcattagtgcaagtttttcaatatttcctgttcattaatcttttatttttcagtttttttttgtagctgtactttatagtacagtgaggtacaaactattgacattttaacagctattgaccaaggaaccattaattgcaaaattacttttatttgcaaggaatgttgacttagttaattctgtttttattactaatccttttaatttacagctttgattgatccaatgttaaagcatactatattgctttaaaatttcttcaatcgcattccttcttcatgacacagttcttactaatttgcaactcctacagttgccagttagtgcagacaagtcaacatattttacttaattcagtgtagctgtggattgatacaatacacagtgaggtaatatttaagtgtaattttatgctaccatgaacatatatttttccattccaacttcgctgatgcatatttttgcatacagtaatgaagtatccatctaatactttatgtgcaatatttcttgcatataaagtttgctacatacaaacaaggagaggaaacctcaagtattcatcaaatactttatgtgcaatatttcttgcatataaagtttgctacaaacaagaagaggaaacctttttttttgtcaaccttaacattcctttgtagtgaagaaactgatttatggctttatgatcatgctcagtaaagaagtgtgaacacacatttctctactgaacagtgatgcttagacatcttgaccctttctctattacaaatgaaattacctattaataaaagtatgatcattgatcacatgtatgaattatttatatccaaattgtgatataaatacttcatacacatgttcaatgtgtaagtcctatttcagataccgattgatcacatgtataaattaattatgtccaaattgtgatgtaaatactttatacatgtgttcaatgtgtatgtaaaatgatgttatatgtctgttaacttgccatcaatgtgaagcttataaacaattgggcctgctggtatggatgtgctttgttgagtagagggccaacagtagatgttgaactatcctggttttgtgtacacatatatcctgctgagcatattatactttcttaatgtgtttggacagtgagtctacaaaaaatcgggatggaaaaacagccttctgtttttggttcttagtatgaatgttactttttctttacagacccattaccgtacaagtgttcacgttgtaggcgaagttattcagtatcatatacaatcgcaagacatctacggtacgaatgtggagtcgctaatcaatttacttggtccattttgctccaaaaaattttcctcgagagatattttaagagtacatcaaaaaaaatttcagggaaggaaataaaatcttggaatggctcaatcttttaaacccaaacaagatttaaagcaaatggaggggacataaatctggtctgaatccccaaaaaattttaaataacgaagccccaaaaattcccccctaagaaaaattc

SEQ ID NO: 2030 - DNA, 1228 bp, Diabrotica virgifera
gaaaaatgaattccgaattatcttaaaacgtaaataaaaatatggaagtgcttatattataaaaaaaattgtgattatggagatatggatcctgtgcaaaaaaatgaaaaagtcacataatttgcaaaatgagactggtgaacgggatgtttcgagggaggaagacctctcttcatttagagagcagtggcagaacgaaatccgttcaacaaaacaaagccagactgatgaacagttgaagaaggtgctgaagcctacatcgtcagaaaatgttgcaagacacaatgctgatgtccagggcccaactcaagatgaggatattaatgaaagagctacgaaattatttcttaaaggtgtagaaatggagaattctggaaagttgtatgaagccattcagtactataaacaagctgttcagatcgtacctgatattgaatttataatgcataagaagactaagcctaaagtgaaacaggagaatgaggaagaggaactgaaagagaacattgaaactgaagatacatcaacagatgatgatgatgatgaggacaatgaagaagatattttccttaggattcagagaaaggcttcaaagaagatttctttgtgcactccgaaacactcaaagaatggtttgcacattggtcaaatgccagtggaattaattttgtatatattgaaatgggttgtatccgatcagttagatatgaggtcattggaaatgttttctagtgtttgcagagggttttacctttgtgctagaaatgaaggcatatggaaagttgcttgtttgagagtttggggtggaaattgtggctctactaatggagattacaaatctttgcggtcatatgttcattgaaaagaacaagagtaaactttcaatggttgttacctcagcaaaaccacatatattcaaaaacggaaaaaaaaagtttccaaaaccaagttcataaaaccatgggaatttggggggaaatttaccgattttttgaaattttttcccccatgggaccgtattggtgcctaaactcaacaaaaagaaacccgggaaagggcatccccccgttcttgaaataagaaaaaggctaaaaaatccagtttttccctgggttattaccaaactaaaaaaaaagaacaagaaaatttttatttaagggcaaaaacaaaaaaaaaaaacccccccccccctgaaattttaaaaaaaattttaaaaaaaacaagggat

SEQ ID NO: 2031 - DNA, 1528 bp, Diabrotica virgifera
cgtttgctcaaaataaaatacacaaaatatatccgttttcatcgacaattcctgattagattttcttgtaatattattaaaatattaattattagatatcaaaatgtctattggtgtacctattaaagttctccatgaagcagaaggtcatgtaataacctgcgaaacaattaccggcgaagtatacagagggaaactgatagaagccgaagataatatgaattgccaaatgactcaaattactgtaacttacagagatggaagagtcgctcaattggaaaatgtttatattagaggatcgaaaattagattcctggtattgccagatatgttgaaaaatgctcctatgttcaaaaaacaaactaaagcgggaacggcaggccgaggaaaatctgctatactgcgagcccaagctcgggggagaggtagggggcaacaacaaccgatgcgaggtagaggtaattggcaacagaaccaacaacaagcacctgcaggaaggggaagataagagctgtgttataaaaagactgttatggacagttattgtatatagttttgtgggtgttctttaaatttgaatattagtttggttttgatacaggttgtatagtttcatgatttattatttattgattatacaagcagtttgtttgtagcctgccttgttggtgactatttgacagtttggtaattgttgaataagagggtaggccttaaaaatgctaaattttttatggacagtctaaaaagtgaaaagtcaaattttccgcttttctttggggggaaatagcaaaagtgtcaaaaataaagatataagtacttaaaaaatcaaaaagttatgtgaaaaggatacaaaagtatcttaataaaaaacctaataaatatcactgatacaattaaattatgcaagaatacctatcagttaaaataattaagctttttaactcgttcggtccatattgctgtcttggtcaatatgactgagaaagtagctttcccgcaggccagctcgacccacagaccaattttttttttcattttcacactagagacacatttccacgaatttcttaatatgggtgacataaatttcttcaataagacttcgttatctgtggaaatctacttctgtgcagcttgattcaatgaatgaaaaattattcccatctgcaatataccacttaaactgaatgtaaaaaaccatacaaaacactctggcagtgaacaagttaatatataaaaataatgtgggggacgaaccccaagttaattttttcctcatttaaatttggtgaaggtttaccctttaaaaatctaaaattttattgaaattcctttaaaaaaaagggggaaaaaaactttctacttaggaggttttaaaaacaagcggggtaaaaaaagggtggtttttttttgtttttttggaaaatttcttttaatagaaaattcccctaaaaaaaccccaaaaattggttttgttttttttcccaaaaatgtggaaaaggggggggcagggcctttccccccc

SEQ ID NO: 2032 - DNA, 988 bp, Diabrotica virgifera
gtaaggtttaaagtccaaacttcatttattttatttatacagtaattgtagtcctattatttatttaagttgttaaaatggctagagttttagttggagtaaaaagagtaatcgactatgccgtaaagattcgcgttaagcccgataaaacaggtgtcgtaaccgatggaatcaaacattctatgaatccctttgatgaaattgcagtagaagaagccgttcgtttaaaggaaaaaaaagttgcttcagaaatcattgctgtatcatgtggaccagcacaatcccaagaagttctcaggactgcgttggctatgggggttgataaaggaattcatgttgaaatttcaggacctgaatacgaaactctgcaaccaatacatgtgtcaaaaattttagccaagattgctcagaatgaaaaggctgatctagtgattgtgggaaaacaggctattgatgatgattgtaatcagacagctcaaatgacagcagcagttttagactggcctcaagcaacatttacgtcaaaattggaaaaaggggacaaagatctcacagttacaagagaaattgatggaggtttggaaaccattaaatgcaaaattccagctgtaataagtgcagatttacgtctaaatgagccaagatatgccactttacctaacattatgaaagcaaaaaagaaaccaattcaaaaactaactcccaaagatttaggagttgatgtatctccaagaatcaaagttataagtgtagaagatcctccagttcgtcaagcgggagccattcttccagatgtagatgcattagttggtaaattaaaggaaggaggacatatatgatctggaaaggacacataatttttactcaataaagaataaaaaagtacaactgaaagagcctacacatattttctactccatattttgttatagccgttgttgtaaataaataatagatttgctacaaaaaaaaaaaaaaaggggggggg

SEQ ID NO: 2033 - DNA, 1364 bp, Diabrotica virgifera
gagaatattttattcgttaaaaagttggcagtgctgctccctgacccttcttaacataacctgtaaaattcgttttacaggattataattttgcttccgaaatgtctacaaattctctagaaaatgagatcgacaaaaacgaacagaaaaacgacaacgatttagaaatacccatggacttttctataaaacatcccttacaaaatgcttggactctatggtattatgaaaatgatagaacccaggcatgggagaaaaaccaaaaagaaattgccactttccaaactgtggaggacttctggagcctttacaaccacatcaaaccttcaagtgaattaaggcaaggaactgattattccttattcaagaaaggaattagacccatgtgggaagatgatgccaataaacgaggaggcaggtggctgctcagcttagaaaagaaacaaagaaacaatgatctagatagatactggttagatattatattatgccttattggtgaagcttttgaaaattctgaagaaatatgtggagcagttgttaatataaggcaaaagggcgacaaaatagctgtttggaccgctgatgcccagaacagtcacgcagttctagagattggaagtaaattaaaggaaaggcttcatataccttctagagttacattgggttaccagttacataaagatacgattcagaagactggatccgtctcaaaatattcatatactgtataatactgcagggaattttagatatcacggataagcaatagaaaattcagatgcaaccaatctaatggcacatacttttattgttatacatctaacgtttttaaacttaacttatatatcatacaacaaatcacattcttgattcaaaggtggtataaattgcattatcattgcatgcttaacttttacttaaaaatagtaacacattgattgttgttagaaagctacaaaagtagttccagtatttattttttttgccataacagacaacataatataaacatttatatcactttttgtttttctcttttgctgggtgatccatggggaatttgcttattactaacgttgcatctggacgattttttgggaaatctgggtggtccactcaattaatcagttaatgttaacattcaaagtaaatttgaaaattgtatctaataggaatttctaaaaaaaatagtttgaatgaatttttttttttaaaggaataagagtttttttttttttttaatgaaaaaataacaaattggttttagtttttttttttttggttaggttttgggaaaaaaattatatccacaaaatattttttttgtgtttttggggggggggggtttatttttttttttt

SEQ ID NO: 2034 - DNA, 557 bp, Diabrotica virgifera
atgagtagaataataatttaatttaaataatctataatgtcaactaaagaagaacaagatacaccacctaatcaaacacaagagtctgaggaacattcagctagtggtagcagctctgaagacgagcaagaggagaatatggaacatttgcgtagattctttgcagagaagcttaatttttcaaaagccgaagacaaggaaaaagtaaaggtgctaaatgatgtgtccattgatggcatagttaactacattaatgaaaagaactgtaaaaatatcattactatggcaggtgctggaatatcaacttctgctggaatcccagatttccgctcaccaggtacaggcttataccacaatctccaaaagtataatttgccacacccccaagcaatttttcgagttagacttctttcacaataatcgaaccaatcctttgagttgcaaaagaactttacccaagtacattcaaacggcattgtgccattattttgttaaaatggtagatgaaaaaggattgctcctaagacattatactcaaaatattgatactctggaaa

SEQ ID NO: 2035 - DNA, 938 bp, Diabrotica virgifera
aatctcgcaaacaagttcagcaaatccgttggcctgatctcgtccagtttgcttttgcagtgtcaacttgggccgttttgctaggaataccaacagtttctctgtgaatatactgtgttaattgctaagataaaaatggtatttaaagaacaactagctattcagatttctctgattttttctctaagtatatgcacactgtgtcagatagcatttccggaactacctacgcaaagactggatagcgaccaaacaaagggaagggtacccctttatgcaccaaatagatgtccagaaaatcaactatattatcctggataccaacaacatgactggatctgtgattgtggcccaacctacatctattaccctccaaaagatttctgttatcctgcatatcggcaaggaccatgtaaagatggcgaacatttagtcgttctacgaggagaggtcataccaagctgtaacaaaaatccatgtgaagaaggatttgccagatacaaaggaacctgctacgaaatgggaaaacctaatggaccatgcctcccaattcagcaaggcggtggtatttttgacgtaaacgctacaacacttgtcgtggaatgtcttaaaggcactgatagactgtcattattcaatttgcccaaattctgcatgcctggaagtaaaagagacagtaacggcaattgcagagtcatttacaactaatagaaacacatgttttttggtttaccggagtatttttagttgtattgatagatccacagaattgcaccagtttggtctctcttttaaatttaacataatatttaagctacgtactgaaagttatataacaacatattttctgttttgggtattggtatggaaatgctaatcttccactggtttggtacttgattgctatttaaattttcctgaaaaagatatttatgttt

SEQ ID NO: 2036 - DNA, 1030 bp, Diabrotica virgifera
  misc_feature (977)..(977): n is a, c, g, or t
gaatgcaggtagcgatataggaaatatgttgaagtctcattttcaaaagagccagtttatcatcgttttttaaggatggtatgttctctggtatgccatctcttcaaaggtgtccagaatttccttttcatcctgcattactactctatttcgtcgtattgaataaatattttatcaaagcttttcgctagagttttgttacaagttacaagtaactgtcaagcaacttaaaacttataactagttgtcaaaattatttattttatacacggtaagtacagcagacccccctctataacgagaactgaaatggcatactaattacctcgttataagctgatctcgttatatcagacaacaataatattgagcatacatatgaatatgtagttttctaaaacactaacttcctatagtgaagccattccgagcaatataagatattaaatattgtttgaatggcgctgttgaaaaatatttggtggataaacaggatgatgttgactcaataagcatacagattttaggcatttctgtatacaggcatcttgggtatttatttatagccatcacagcgccaaaaacaggtgaagaaacatgctcttcaacctcattttccctcgttataagtaaggatgcttcgttgtaaaggtgttataattcaataggaatttcatggaacacctaatgtacctcgttataagcgaaacctcgtaatacccttatttgttatatatagagtatgctgtagataattctgaaaattaagttgccacaacattttcgtttattttttgatcaacactgtaatccaaagtttgtagaaaccaagctatttcaatattttgttgttgatgatggactttgatgtattgtggatctcgttctttaatccaataagcaaggttgtgaagattaatgttctcgataaaattccgtttgtccaaccatttagttgttagagctcgtactcattntatctgtataaattctaattctaattgttactataaagactaatgtaatcata

SEQ ID NO: 2037 - DNA, 1334 bp, Diabrotica virgifera
gctgtatgccatgcagatgaccaagctagattttaacacaactgcagaaaaacaactcgtcgatgaagtcttcaacaatgccatggacgtattatcagacgacgataaacaactaccacaagtcgagaaccttctgccgttgttaagaagaggaataggcatccatcacggtggtttgttgccgattttgaaggaaaccatcgagattttattcggcgaggggctcataaaagcgctatttgccacagaaacgttcgctatgggtttaaatatgcctgcaagaactgtgttgtttactggaatgaggaaatttgatggcagtgagtacagatggattacttctggagaatacatccaaatgtctggaagggcaggaagaagaggcctggacgataaaggtatcgtaatattgatggtggacgagaaagtgcctccggcagccggtaggaacatagttaaaggttgccggaccccatcaactccgccttccatttgacttacaatatggtactgaacttgctaagggtcgaagaaatcaatcctgagtatatgttggagcgatcgttcttccagtttcagaatcaagctgcaatacccggatattatgatgattataacgaaaaattagaacttttcaattcgcttgaaatcaaagatgaagagcgaatacagtcttatcacgtaattagaacagagttagacctgttgggtgtcaagtttaggacatatctcacaagctcgcaatatttgttgccgtttcttcaacctggtagacttttaaagataaaatcgactgaagatgaatacgattggggcgctgtggttaacttcaaaaaggtccaagagattattccggggcgcaaaaataaacaaggacaaagcaaaacccaaactaaagtcaaagtggatattttgttacacgtattaccagaaaatagcgatgaaacgatgataccgaaaccgtgtttggaagaccagaaaggcgaaatcgaggtagtgactgtagattcgacgctgataactcatttatcgtccgtgcggctgttctgtcccaacgatctaaggtcgaaagatagtcgaaaaggaatgtacaaagctattaaggaagtgaagaaacgctttccggaaggaccgcccctactaaatcccgtgacggatatgaagatttaaagaagaagaatttttatctatagtagagaaaattcttcttctttaatcttcatatctcacaagctcgcaatatttgatgccgattcttcatactgaaaaacttttaaagataaaatcgactgtacgatcgaatacgaatgggaatgctgtggataacttctaaa

SEQ ID NO: 2038 - DNA, 910 bp, Diabrotica virgifera
attgaattgtcaagttagaacaaaaaattagttttacattttcaaaattaagatgattattcctttttaacattacatcatagaagaatattaaaaacagttcaagtaattcacaaaaatggcagacactgccttcacaaagaacgaagtaataggattggtggtgaggttaacccttgtctctgcagttacatttttaagtataaaatggattatgaaccaggttgaccccacgaataaaagcaagaaaaaggcaagacgacaagcagaagagcagttgaaaagattatctgctacaggacatgcacctgtacttattgagaaattaaatgattatgagatgatgatagcagctcacttggttcatccccaagatattaaagtaacttggagtagtattgctggtctggaagggcttatccaggaattgagggagactgtaatactgcctattcagagaaaagaattgtttgctgattcacaacttaccacagcaccaaaaggtgtacttctacacggacctccaggctgtggaaaaactcttatcgcaaaagccaccgctagagaagccggtacccgcttcatcaacttagatctatccattctgaccgacaaatggtacggcgaaagccaaaaactagcagctgccgtcttcacgttagccgttaaaattcaaccttgcatcatcttcattgatgaaatcgactccttccttcggtctcgcacaagttcagatcacgaagctacagctatgatgaaagcacaatttatgtcactatgggacggtctaattacagatttgaattgtaccgttatcgtgatgggtgccacgaatagaccccaggatttggataagccattctacgaagaaatgctgccacttttcacgtgccaatgcccaacgccgcac

SEQ ID NO: 2039 - DNA, 1271 bp, Diabrotica virgifera
aaaacaacaaacttaaaattttaatctaaatttaaaataaaatatgccatctaatacctcttgattaattttaaagctcttgatttgttgtcaattttttaacaaaatataagctggtattgacacgggtcttgctattcaatcaaaagatgtgtttgacttttccctttgatattgttctttatgaacctgaaattatgttaccaacctacgcatagacatatataatacttgtatgtttatgcacgtaggtgatcaaactctaaccaactaaataatttcaaatattggatatattatattgggacatgctgtatataaaatggtcaatgactggtctatttgaatgttaattaaaagccaaacaatcaatttattttatttgtaattatattcttatttagcttgtatttagattagatacatatcttatattaaattaaagagagaggaaagtcatgtacttgctccgtgaaatttttgtaaatgtattagctgttaaaaatgttttttgagaaatatcgggccaaattgtcttcattcttcaaaattcagttttaatcacagtgccagatcacaacaaactaaaattgtagttttattttgaggttcactcacacatttcttataacctcttcaattcagttctaaaaacgagttttcaaaaattagaagattcgaattttgaatgaatatattttgaatttcatgaatatatcagttaatctacagttagttaataaaaagtttttgtttgttgtgactcttaaggtatttttttgtttttaactgtataaaagtgttacgaaattttaaagaaagtataaatgtgtagaatagataaatcggccgtttaagaaatattcacagtgtgcttcttgtattttcttatataggcaactagttcactactgttttttaacctattcaataaagtaagttctttctgtttcgtttgttttatcttagataataatagaagatttttgtcatttcctacactagtagtcacagaattgggaagaagacttattgaaatatttatgctgaattttcgataggtaggattattaagacatgaatttaacttgtagatatttttgacgtttaaacgttggtaaaaacgtcagtcgtctttcttttttgatttttacgtttcacttcttatgtttcaaaaataaaaaccttatcctgtaaaaggtatatttttacaagatttctacaatataccttttacaagataaggttttattatttgtgatttatgatat

SEQ ID NO: 2040 - DNA, 2454 bp, Diabrotica virgifera
attatgtgggccaatccaagacaggatatcctttttctcttgtgatagaatatcactccatatgtctcctaattgatcatagagagcttttaggcccgggactgacataaggtggaagaaattacaaaatggtctagtggaggccccaaaaattaacaaagtgcaaattcaagatcgtacagataaaaccgaaggccaatggattggttatgaattgtttcatctatatacccttctattgattctaaagaacaactttcagatacataatttttttaaattgagtcctcccagatattttgatttagttttgcttatttgtttcaatgtcaaatacaagcaacatgttagcttactggctcaccaactattatcttgaagtccttaaattcgtgtatatcttcctttcttatcatgaaataatctattgggtaatgattttgtccacttttgcattaaaagttaagtttctctcttttaaaagaatgcattaacaatcgccatatctaataccggtgctagcttgaggaggaatacaccattctagatatttgtttcccatgtttaagtggagcgatttgttataatatctagaatggtggaggaatacaccaagaaacacttcattttcaaattgcacctcgcaatttatttatattgattccgttcataaagaagacatttcattttttacacaattaagaacatcaaaatattgctctccttgcttgaccaattttagcaatttatagatgttctgatcaagattaccatttttcaatcattgcattatgcaagattctattcggcaatgtctgtgatatatagattcacgtttgaaaactgtttctggtgaaaaatcctctttttctgtgtcttaacagaatactatcaaaaacaatttattgagtctccctaaaatctgcaggtcacttttccatctccaaattcttacgaattgagacaaaatttgaacccattggaaaaaaagattatggtacatttaagtactgatctacaaattatgtttctgtaagtgttgcctatatgagtacctttaacactttctcctgactcctgacatcttctcatgatcaaatccttaattccaagtcatgatactttcttcccacttacttttctttcttgattatctacagggatttaaactgcacaaattgggaagttaaactgatcttaaatcaaaagattaaggaaataaaattaaaaatatcaaatcattttgattgagatgtcatagaatgtataaaaaactggacatacatttgtaatgtattttataatgtaaatttaaaacttattctgtaatataagccgtatgttaaataaaaaaatataaactacccagtcgagcctaaaacaattagaagaaaaatgcctttgtggaatagaacactggaaaacctaaaaagaacaagtaaagggcctatcaaataaagaaagaaattggggaagtacaaaacatacagaaaaactcttgcagaatataactaagagacaagaagagcaaaaagagaatcttgggaaggattatttcatccagtgtaatacattaacattagctatgttgattatcccagttttcaatctagagctccaacagaaacctaagccatattgggtacccaaatttttcacgtagaacagtaaaatcttgcttcaacagaaatatttaggatatttggtactctaatgctacatcgaaaatgcagggggtaggagttttaccagaaacccaagatattgagctcatttgagagacatggaatcacagggcgtatgttaaaggaataccaaggtactcataattcatcgctgaagatgtcacaacagcagaagtggaaattctagctgagctctgcctgccttcttgaagataattcattattagagagggttgatagcctcatcaatataattgcttccttacaaaaaatccaaatgagcaattttttttttcttattgatatttggggtatatggtgaaatatataaaagaaaatagaattccccttcccccagaatcttttttttaaaatggttttttgaaccagatcttttataaaaaaggaaatgaaaagggggggggtcgctgtagggaaaaaaaccccgaggccctgggtggaaaaatgggggtcaattttttttaaatttctattaaaaaagggttccttttagaaaaaatttgttaataaattatttatttttttgtccaaatatttttttgtaaataaatatttttttttttttttttttttaaaataagggaaatacggggggggggacaaacaccttttttttttttttatatttatggggggggggtgccctttttctcagcccacaccccactcttttttgtgatttccccctacttttttttcttccaaaaaaggtggggggaaacgcaacccgccggccgggtagggagag

SEQ ID NO: 2041 - DNA, 1613 bp, Diabrotica virgifera
cccacgcgtccggtctcagcaagactattgagtataaaaaccatcaagaagagaaagctagactatttcggacatgcaatgagagatcccaaatataggttgctacaaaatattatgcaaaggaaaatagcaggccaacacagtacagaacgaaaatgaacttcatggttgaagaacttgtgacattggtacctatgctgttgctacaacctatggttttcccatttaggcccgggaccaacataaggtggaagaaattacaaaaaggtctagtggatgccccaaaaattaacaaagtgcaaattcaagatcgtacagatcaaaactgaataccaatgggttggttatgaattgtttcatctatatacccttctattgattctaaagaacaactttcagataaataattttttaaaattgagtcctctcagatattttgatttagttttgcttatttgcttcaatgtcgaatacaagcaacatgttggcttactgtctcgctaactattatcttgaagtccttacattcttgtatattttcttttcttgtcatcatttttttattggagaatggttttgtccacttttgcatgtaaaagttaaatcattcaatacttctttatcaattacagttcgctgacattattctatcactcgttcttggaccaagggatgtgtcacttttctaatcaacctaaagctgagtagggaaagaattaatcccaggggacgagttttgcaaggaccttgcacatccttaaacggtcccaagactgctgggtactcccaactagtgacaggtggccctattgaaacaacccagtggatataggctggaggtagtcgataaacaatccccatgccaagccgtgagacactgtggtgaaggcaacaaggcactagggtgagagtgtcgcgaacggttcctttggggcaccaggtcgcactccatcgtatttagaccttaccgccttggcatggtgaatctctcaaggctatggagaagaaagatctatgcaaggtgcaatggtacgatcttcgtacctaatgaacatgggaaagaatggtcaacaggatttttagtagactgacgatcagtaaccatggactcggacatgaacagatctatggatagtctgggattcgtcatttttggacaaaggggttttatgaacattcgcagtcgatcctgaatctgtattagagcttgagaaacttgaaatgtcaccctttttcggaatgggatattataacaaatcgctccacttaaacatgggaaacaaatatctagaatggtggaggaatacaccaagaaacacttcattttcaaattgcacctcgcaatttatttatattgattccgttcataaagaagacatttcattttttacacaattaagaacatcaaaatattgctctccttgcttgaccaattttagcaatttatagatgttctgatcaagattaccatttttcaatcattgcattatgcagattctattccgcaatgtctgtgatatatagattcccgtttgaaaactgtttctgggggaaaaatcctctttttctgtgtcctaacccaattctatcaaaaaaaatccaatttgtctccc

SEQ ID NO: 2042 - DNA, 941 bp, Diabrotica virgifera
tttaaaaataaacattaaagttaagttcccattaaatttaaacttaaatagtaaaagatatgtaggtgttttaaacactgctgtgcttgataaactaaaaataaagtattgtgataatttcaataagaattaaaacattgaactatttccataaataaatataacaccagttacaagttgatgttattaaaaagaatggttcacacaaaatgcagagacatattctatccatttagtgaggttaagcgattccaaataaaagatgaagaagtgccttggtcagtcagtctcaataaatatgatccacctgaatacaattcaaaagttctaattaataaaccttgggcggatccccctcttaacgatggcgttttcaatccaaagtggaatcaattagatggaaaaattaacaggcaaagccatacaggtacttacaacattgttgatggcagaccactgaatccagaaggaagaacaggaattaaaggaagaggagttctaggtaaatggggaccaaaccatgcagcagatcctattgttacaaggtggaaaatggataacaacttaaaagttataaataagagtacaaatttgcccattcttcagttctgtgctattcaaagaaaagatagtaaacattgggctataccaggaggtatggtggatccaggagaaaaagtgagcgagacactccatagagaatttcaagaagaagccctaaatagcctacaaacatctaaagaacaggcagaaagagatgctcaaataataaaagattttttcaaaactggtgtagaaatatataaagggtatgtggatgaccctagaaatactgataatgcatggatggaaacagtggcgtacaatttccatgacgatgacggtcgccacgttgggaaagtttaatttgacagcgggtgatgatgcgcaaaatgttacgt

SEQ ID NO: 2043 - DNA, 323 bp, Diabrotica virgifera
aatcgctgtgaatgtgtgtgccgtttccataataaagaacgataaatttatggataacatctttttttgataagctaaggggcgaaaatgcctgaggataagaaaatggcagttgacaatgatactctttcttccaaaaagtcttccactattatccgtagtagtggaagcaccacggcgcaggttactatgctagatggttcgattttgcctattgttatagacaaaagagccaaaggaaaggatcttctggacaaagtttgtgaagcgataaatttaatagaaaaggactattttggtctagtgtatgcggatagacacga

SEQ ID NO: 2044 - DNA, 850 bp, Diabrotica virgifera
  misc_feature (97)..(97): n is a, c, g, or t
tagcgaaaaatatgttataaaacacaaaaattaaataaatctggtgaaaaagttaggtggttgcaaataaaatgtttcagagtggagagggaatatncaggaatcatcaaatatcgctacgagcactacggtccctactttgaactaagtatttatggacgagaaagacctccaacacaagttctttgttatcgacaatttattgttacaatactttatggattacagacaattttccttaaataaagcacacctgtcctgttctacgatacgtctgaacgttggtaccagttttgtatctagatccaataacatgttttgtctaacatttatcagacaatcttgaaattcatagttggttctactgtagcatatgcagctatccaatgtctctgtagatgaatgggtcccggaagaatttaggacatatggagtataaaactctaatctcgcttcccaaatggccgaaccttggggattcaccacacagattccgtttcgtggacaattcacagtcaccgctttctggtaatcaccagaaagtccagtgtacctttccaaggtgtccataaatcgatataaaatatcatgcgattcctcatcttcaatagtaaagcgacctacgcattgagctttgatggatgatatctgatagaataatatcacacacaaaaataattgaacacatctactgaaatacattttgaaatactccaataatataattattgtttgtatctattttatgtcaatggaaagtgactcatctacatgaagtgaattcgattgtttagttttaaatgttactaaattagctgttttttaacaacctaaggttattattctacgg

SEQ ID NO: 2045 - DNA, 1027 bp, Diabrotica virgifera
gccgagcataatttctaaaaagggaataaaaaaatctgtggaatgaaaataaaccttcagacttcagattatttatagaaaaaatgggtaggcgggaggaggaatgtagaaaataggaagctattaaaagtaatagatggtaatatagcactagtaaatttagattttggcagagtatcctttaaactgcaaaattagtgcaaataccagctcccatcctaaaatgtcagtgctgtcaagaatatccaatatttattccaagtctggttcaaggcagtatccagatgaattggatatgatagaaactaatctctacctcagtggtgaggcagaagccagaaatgttgaaactcttaaaaaatacaaaattactcacatactcactatcaatgatttccctttaactggtactgtaaaaagtgccctaggatatcttcaaataaagtacattaggcttccagacttaagctcttcagacttattgtcttatttcgacgaaacctatgaatttattagagagggtgttgccaaaggagccgtacttgtgcactgtcaaatgggtgtatccagaagtgcctcagttgttatagcctatattatgaagaaatataatttaacctacagggaagctttggataaagtaaaaatgaaaagatgcgtatttcctaacccaggatttgtatcccaattgcaaagctacagagatatgggatacaccactattagaagatatgatcccagactggcacgatacatgatgagataaactgatcgtcattattacaattctctttgtatcatgattcacatatcacttaaaaatattcacaattaatggtaataattaatatacagggtaggtacaaacataaaaataagtaagatcaaataattgtgatattgttgtctacgtaatgtatgaaaacacaatgttgaataaaattttcagtacatttttttagaaaaaaaaaaaaaaaaaaaacaaaaacattttaaaaaacaaaaaaacacagcaagagccacaatc

SEQ ID NO: 2046 - DNA, 1240 bp, Diabrotica virgifera
aattgcatgtaatttcataagatagtttttcaattcagaatttaaggcagagcaatgaattttgtcaaattgacaagaattgcccaaacacttactataagaggatgtactgtacgtagatatagttacaaactttcgcaaaatactcctataacctcttacaataactcctcaagtcgattaagaataagttttcgaaaagagacggtaaaatctagtttattccaacgaaagttgttaattcctagagaaacagtagcttttagacactttgccacaaaaactcctgatggccctgaagatggggcaccagcagctgaagaaaacttcaatccccaacttccagccactgtagcagttccagaagtctggccgcatgttcctgttattgccattagcaaaaatatagtatttccaaggtttatcaagctaattgaactaacaaatccacaacttattaagctcttaagacgaaaagttaagttaaaccaaccgtattgtggtattttccttaaaaaacgagaagacaatgattcagaggtagtcagtaatatcagtgatgtttacgatgtaggagtttttgctcaaattcacgaaatgcaagacttaggagatcgtttaagactggttgtgatggcacataggcgaattaagataactggtcagatttttgaaaacgaagagcaaaaagaggaaaccgaaagtgaaaaacccagaaggaaattacgcaacaatagagtagtaaaacccccaatagaatctactaaaactaaagagcaaactgaaagtaaagacccaaaagctacccccagtgccagtgcgaaacctctaattgaaggcttactgatggctgaagtagaaaacgtagttcacaacaagttccgccaaacagaagaagtgaaagctctcacccaggaagttatcaaaactattagagatattataagtttaaatccgttgtatagagatagcttgcagcaaatgatgcaccaaggccaaagagttgtagataaccctgtatatttaagcgatttgggggctgcgctaactgcagcagagagcaaagaactgcaggaagtgttggaagaaatggatattcccaaacgactgatgttatcactgtccctactgaagaaagagtatgaactgtcaaaattacagcaaaaaattggaagagaagtggaagaaaagttaaaaagcatcatagaaaatacattttacaggagcagctcaagggtat

SEQ ID NO: 2047 - DNA, 1176 bp, Diabrotica virgifera
aagcaactctgttaaaaaaacaaaatacacgatgagatgaaattattatttataaacatttatttcaagttttttgtttgttacggtttgttgagtatttgttatactgaattgtatttaaaaaatttgattattcttttagtagctttcatgagtgttgagggactgtttattcacggcaatgttatacattgtactttatagtataggggcttatttaatatttaatctggtcttcaaaatttacgtgaagttaaatactatgtcgtgtaagaataaggtgtgtcttgtagggaaaactgttatagtcacaggagccaacacaggtataggatttgaaacagctttagattgtgctaaacggggggcaagagtaattttagcatgtagggatcatcttaaaggaactgtagctgtccaaaatattcaaactttaacgaaaaaccagaacgtagttctaaaaattttagatttagcttcgttatcatccgttaaaaactttgccaatgatattctacgaacagaggaaaaactggatatattaataaataatgcgggggccttattgcttggtgatcaattgactgaagatggtcttcagtttgagatgcaaattaattactttggaccagttttattaacacttatgttagttaatttactaaaaaaatccgcacccagtagaataattaacgtttcttcagtagtagctaagtatgctaaactcgatgtaaaaaatcttaatggaaagccaagctatcctattactaaattgtgcaacatattgttcactcaagagttggccaagaaattaaatgagtttaacattagtgtgtttgcgcttcatccaggcatgatagctactgacataatgactagacatctatggcctattgtgaactcatgtgtcattcctttatcaagagttgtgataaaaactcctgaagaaggtgcccaaacaacaatctacgctgctaccgaaccaggtatagaacacttaacgggaggatttttctcagagtgccgttatcagaaacattataaaactgctagagatccacagttagcacaacagctttgggatgaaactatgaaattattaaattataacgactgatcaaaatgatatgatatgtattttagtgtcatgaaataaataaaaatcccacgcgtccg

SEQ ID NO: 2048 - DNA, 1997 bp, Diabrotica virgifera
gtgtttatcgtttatgtaaataaataaaaaaaagttaactaaaaaacttgttaaataataaatatgataaattttggaaattgttaattaaaattcattagaagtaaaaaatgtctaagataggtgatcacgatttgtacggtaccaatttttcaacagagtccatgaaagttattgcagaaagcataggaattgggtacttagcggatgatgctgcaaaggaactagctgaagatatatcgtttagaataaagcacatcatacaagatgctgcgaagtttatgaacaacgccaaaagaacgaaactattacaaactgatgtggattctgccctgaaagttaaaaatattgagccccaatatggatttcaatcaacagaacatttgccttttcggtttgcttctggtgggggacgagagctgcattttatagaagaaaaagaagtcgatttgaatgatttgctgcaaaatatgtgtccgaaggctcctctagaaactactttaaggtctcactggatgtttattgatggagtacagcccactatacctgaaaatccacctcccgttgcaaaagttgtacaaaaattgaatcagtagatccagtaaacaaaaaaccaataaaagaaacatcaggaaaaccgacaacaggaaaacagaaactcaaaaatgtagagacagtccaaatcaaacagttggcaacccatgaactttctgttgagcaacagttgtactataaagaaataactgaggcttgtgtaggatctgacgaagctaggcgagcagaagccctgcagagtttagcgtctgatcctggtctacatgaaatgttgcctagaatgtgtacatttattatagaaggtgtcagagttaatgttgttcagaacaatttggctcttttgatatatttgatgaggatggttaaagcattgttagataatcagtcactatatttagagaaatatcttcacgaattaattccttcagttacaacatgcatagtatcaaagcagttatgcatgaggccggaactagacaatcactgggccctcagagattttgcttcaagactgatggctcaaatttgcaaaaatttcaacactagtacaaataatatacaaacacgtgtcacgagaatgtttacgaatgcattgcagcaggataaagttcctctttcttcattatatggtgcactacaggggttgtcagaactgggagctgaagttactaggatctttatcttaccaagagttagaaatattggaaacagaattgagggatacctagatggcaatccaacatcaaatatggaaaaaatcgcctctggacatatcaaacagttacttattaaagtccttgctcctgtgttgaagagcataaggaacccgccagacaatccagatgaatatagacaagagtatggatacttaggactgtcactgcatgcagctgttgttaaagcaagaacgcagccaaatattttgcccacttcagtgtcgaatgttaataatccaatcacttgtagttctccaataacgaaaactatcaatacaccaagtggaataattcagcagcaaactcctgctgggagaacaatcgtcatgaatcccagtccaagggcacaaataccacaatccaatcaaaaattcgtgttcgtgactcaaagaccacagacaccaatgagcacttcacatcaaatccaacaaagccagagcatatcgacgtctcagaacactgttgtcaaattcgtttccaacccgaatcaagcccagcctaagttggcaacgcagcaaaaattagtgatggtatcgaatccatcggcacaaggaaacttccagacccaatcgcctggctccacgctgctcctttccaacaacagaatttcgctctgcagcaacagatacagcatcaacagcagcaacaacaacagcagcaacagtctcctcttatggatgatatatctcatttagtgcagtaatatataagtgttaatatttacat

SEQ ID NO: 2049 - DNA, 877 bp, Diabrotica virgifera
ggaatatttacatgaaaaaaaagttgtgattagatataaatttgtttttgttaatgatgtatgtgctgtggaattgtgtgtgtggcttctaagatgtaggaattgtccattaggtttacaattgcgcaacactggcgacaacactcgaatgccggtagatggctccactacagggtcggattcagctagcaggcttccgaggcaccatcacaacatttatggccacccttacgatccggggtatgctcaaatggaatcttggctggatgagcatccagattttgttaatgattatttcctgagaaaagccacacgacaaatagtggaacaatggcaagtgtcgcacgccacccctacctcatccaacgtggagttagcctcaccaacgcacaacaacccttcaagagcaagttcgggtgctacaactccggtgcgcaaaatatctgcgcacgagttcgagcgcagcggtctgctgaagcctatgataaataccattgatggccaacccacgtttttaaccagcgaaaaccaaacaccagcaggaacaggtagtcctacgcctggacggcggcagaggaggtcgcggcatgaattaaggcagatggacgagaaagatttaatttttgagttggtaaaagatatatgcaacgaactggagatcagatccttgtgccacaagatccttcaaaatgtttgcatgcttctgaacgccgaccgtggttctctctttctggtcgaaggcgacaaaaccagtggttgtgaagtagattcgggtcaccgagatcgttgtctagtttccaaactgtttgatgtctgctccaaaagtacccttgtagatatagaaaaaaaggaggaaattaaattccccttggtacgg

SEQ ID NO: 2050 - DNA, 666 bp, Diabrotica virgifera
ctgcaactgaagaacaaaaaccatcaagatgtccatggttccacttcttttccgtgactggtgggatgaagaagacctcatgcgtccttccagacttctcgaccaacaattcggtttgggattaagaagagatgatcttcttaactcgataagagatatacccagaagatctgcattgtcgtccagatatattagaccatgggctacatccactgccctacaaagacaagattccggctcaaccattacacaagaccagaataaatttcaggttattttagacgtccaacaattcgctcctaacgaaatcactgtaaaaaccaacggcaacagcatcttggtagaaggtaaacacgaagaaaaacaagacgaacatggatatataatgagacactttgtcagacgatacgttcttccacaaacccacgatgccgaaaacgtggtttcctcattgtcttcagatggtgttttgacagtaagcgcaccaaagaaaagcgaaaaacctgtagcttcggaaagggtagtacctatcacacaaactggacccgccaagagcactgtaacacccgttgtagagtctccccaaccccaaccacaagtgaactaagagatcttgactaataaggctgatattattaatttaattttttatttattatattcttt

SEQ ID NO: 2051 - DNA, 2696 bp, Diabrotica virgifera
gtcgattcagtttttgttcgtcggcttttgagacgtatctccatcaatcgcgacctctgagttcgtttcgtataatgtgctttatcttcctcagggattaaaagtcagtttctgggatttgaaaaaaacataatagggcacaataatgagcgaagcagaagccaacattggtacccaacagataccagaggcgagtgagagcctcttcggcaccctagacatagttttattagcactcatcgtaggaggaattagttggtatctcgtcaataaacataagaaaaccaaaacgatagcaaatggtagatcatattcaatacaacctacctccatcaacctccaaacatcaacagacaactccttcataaagaaactccagtcttcaggtaggagtctcgtggtcttctatggaagccaaaccggaaccggtgaagaatttgccggtcggctcgccaaagagggagttcgatatcggatgaaggggatggtcgccgatcccgaagaatgtgatatggaagaattagtcaatttaaaaactctgccaaactcattagcagtattctgtctggccacatacggcgagggtgatcctactgataacgccatggaattctacgagtggctccaaaacggagatgctgatctcactggacttaactatgctgtatttggattaggaaataagacgtacgagcattacaacaaagtcgccatttatgtagataaacgacttgaggaattaggagccaccagactctacgaccttggtcttggagatgatgatgcgaacattgaagacgacttcattacgtggaaagacaagttctggcccgctgtttgcgaacacttcggtatcgaatcgaccggagaagacatcaacatgcgtcaatacagacttgaagagttcgaggagactccagacagagtatttactggagaaatggctaggttgcagtccctcaagaaccaaagaccaccctacgacgccaaaaatcccttcctctcgaaggtcaaaatcaacagagagctccacaaaaacggcgacagatcctgcatgcacatcgaattcgacatcgaaggttccaaaatgcgatacgatgctggcgaccatcttgccgtctatcctatcaacgacgtagaactggtcgagaagcttggaaaatactgcggcaaggatcttaacaccatcttcagcttgatcaataccgacgaagactccagcaagaaacaccccttcccgtgtccttgctcgtacaggactgctttgatgcactatgtggacataacgcaaaatccaagaactcacgtactaaaagaattggctgaatactgcactgatccagccgaaaaagaaaagttaaaatccatgtccacgaccactccagaaggaaaagctctttaccagaaatggatcatcgaggacaacaggaacatcgttcatattttggaagatatgaaatcatgtcaacctgctttggaccatctttgtgaattgatgcccagactacagcccagatattattcgatttcctcgtcacccaagttgtatcccaacacagttcacatcacagcggtcttagtcgagtatgacactccaactggtcgccacaataagggtgttgctaccacatggttgaaaactaagatgccggatcccgagaaagaacttcccacagttccaatattcgttcgtaaatctcaattcagattgcccactaagccacaaactcctatcattatgatcggacctggaactggttttgctccgttcagaggatttatccaggataggaatctttgtaaagaagaaggaaaacctgtaggggacacagtgctctatttcggctgtagaaaggctgctgaagattacatttacgaagaagaattagttgaataccataagaacggtctacttacactgcacttagccttttctagggatcaagccaagaaggtttacgtcacgcatctattagaacaacaagccgacgaagtatggaagattattggagagaataacggacatatctacatttgtggtgatgccaaatccatggccaccgacgtccgtgctatcctaactaaaattctgcaagaaaaaggctccttgaccgaagaacaagctaccgcatacctgaagaagatggaaacgcagaaacgtctatccgccgacgtatggagctaataaaatctgcccccttagcaattttttttaatattctattaagacatctaacatagctgcaccgacctattgtcttttcggtggataataaaattattcttgtatatttttgtgacaattgtaagctgataaattggtgcctatattgtatataaatactaaatgcaacaaaattgtgaagtttttagatgtgtagattcattccagtcgagtgcctttaaacaagttatttgaaatttttaacacgtcaagtctttcatgcttctccgtcaaggacttttcttgttctaattattcaaagttacaataggcagattgtaacgtataactttttacatgtttgatataggatttttatcgctgttatacgccagggaatttgggtttggaagggggggttggtcctctaagaacggtcaaattttagggaaaatttggtattttattgtaattatggtaaggattaaacaaaatttatttttgtttaaaggctcctttatttatttacaat

SEQ ID NO: 2052 - DNA, 1682 bp, Diabrotica virgifera
  misc_feature (1570)..(1570): n is a, c, g, or t
  misc_feature (1627)..(1627): n is a, c, g, or t
  misc_feature (1661)..(1661): n is a, c, g, or t
aacaaaataatgttctgtactgcagtcacaggagtacatagtagagatataataaaaaagctgttcaacatcactggacaccatttaatttttagaaaatgaaaagtcttgaggttgaatgggatctgtagtattgctacataatgaatgtgtttagatatggtattttttgttgaataatctatacaggcccaactaaataaatgtatacatatattgcagaaagtgcatttaatggagcagcaagttttttttgtgtttcaatgaggtattcagttttttcttttagtatatacacattatcttgtaaaatagcaagctaatacagttcgatatctagacattatagagctttcaacaggtttaccttttttaagcttttttaagttaaataaacaataacaaccgatttttcaatggccatattattggtattaattccataacccttcctataacaatagtcccattgttggaagttattgcagtagttctgctggaaatacttaccaaagttgtatgtatctacatcattcatcagaaatttcattaagatttacttgccatgccctctctatgtaccagggacataacagtctagtaggaacagaaaacattacgttcaggcattgtaaaaagtgttatgtctgacatgaaaatatttgactatataataccagaacgctcatgtattttttcagaaaaagtgggtaaataaaagtatcttttctatttgaacataagaaaacaatgggaaattcatactgtcataagttcaaagtgataggaaatgagcccatgagttccataaattgcgatttaccaaacttaattaatatttccttttgcacagcattcatggaaatacttaagacaaaaatcattattgttaaattcgggatgattatcaattagtatgccctgttggttgtaaaataatattggacatgacccagtctgtaagcattcaattacccataaatgaacactggttgcgcctacatccatctttcaaatcaatgtcataggagtgtttaatgttcgtgttatcttgtcttgtaagtaaatcagctctcaataatatttaaaaaatggactagtggtaacatttttgttttaaattatattgtgtatatgcaaatattttacttacatttttgaatatgcccataatgtgttttaaaataataaatgttactgcacaacaatcagtttgaatatttttagatatgtactagtatttgattagtacacgaaatgcagcagacatgttctctcttctatcttaagagctgatttaatctctacttgtatctgtaaagtttatcatttttcccatagccaattttaacactcccggttcctcaacgtctatatccaaacctgttacaatcacattatcatatttctcttctcgttctctaggtaatctagtctagtaattaattctcgaactgtcttgtttgtattaaatatcttaattatgtacttattttatttttataatgaaaattaataaattaaccatatgcagcacagcaaacaaatgttttcggaaatatatttatangaatttaattgcctcttttttgtataggtatgacatattaagtaaaaactactacanttattcatataaatatttatttatcatacataangtaaaaactatttttatagct

SEQ ID NO: 2053 - DNA, 1028 bp, Diabrotica virgifera
cccgcacagccagctagtgtgtgtgtttgtcatattttacataaatcaacaaatcaaccatgtctgatgacgcagcaacgacaccctcaaagcgaggacgcaaagctaatgcagagaaagctgaaaaagtagaaaaagcagagaaggttgatacaaaaaagagggggaagaaagatgcagatgatgaaggtgcatcacctgcaaagaggggtagaggcaggccaaagggaaccacgaaaaagaagagcgcagtcaaaccaaaagccaaatctgccggagcatcacgaggccgtggcagaccaaagaagaaagaagaacccaaggactccggagatgaagataatgacgacaatgatgccggagaagaggaggaagatgatgattaaatgttcagtcttaaaaaagttttgattttttgccgcacccatgtatttgggcgccaatcttacaaatatgtcgttgaaaatatttttaatatctttggtttattattatatagcaaaaatatcattccgtatgtgtctttgtgccattagaaacactaactcacctgcactgccaaatttggctggttaaatttatataggccaatttttatggttttcttgtcgataaataatacttttgagtaactagatgtttcccttcaaccagactgaattgttttttttttatatttcggcttttaaaattgaaaattatacataatcattgcctgtggcaacactgttaaccttaaagtacaaagaaagtaccatgttggttgttgtggaaatacatctagtttcataatgtttatctccaaattgagtggtgaaaggtagttagcattgacagttatttacgtgtttttgtggattggtgggcgcacaataatatcttttagtttgtaagctgtgtaagttaatatcttagatatctgaattagttagtccttttctggatcctgtgtttccagggaatagtctttggtcaaaataatttaataaaaaattacttttttaaaaaaaaaaaaaagaaaggccggg

SEQ ID NO: 2054 - DNA, 911 bp, Diabrotica virgifera
gtacatacatgccaaataactatggctacgcaaagagacgcaggcgtctttaaacctcaaaaacttctaacaccacctccaccggagactccaccggcgacaagtagaagtccattcagagttgtagatgatttacccgtaaagaaatttgttgaacgtaaacatttacgtacagatcgatttgaatatgagaggaaaggagatgatcctggatacataataatttttaatcaagaaacattctacgataaagaattgggtacaaggagaggaactagaagagatgttaacgagctaactacatgcttacagaggttaggatttaatattgataaagaaaatatattaacggataagacaactgaagaagttgagcaagtattggagaaagcttcccagatagactttacaaattataattgcctaatactgtttttcctatcgcatggcgaagaactgaacttcttacataccaaagatggccaaatattagcaaaagatatttggttaaaatttaaagatagtccaggtctcaacggtaaaccaaaaatgtttgtgtttcaggcttgtaagggagaaaactttaccaccgttggaaatgaattaccaaaatcagcggttttaacaccctcttcaacattctcaccggattatctatatgatgatctcttaatagttcattcatctacagaaggtaactgcgcattcagaaatcaatatactggctcatggttcattcaagaactatgcaaaaatttcacagcctacggaagaaaagacgaggtcataagtttgatcatacgagtcaccaaatgtgtttctaataactttactaaaggaaaagatccaactactaatttggagtactctaacgcgaagcaaatgccgttttttatatctacattaagaaa

SEQ ID NO: 2055 - DNA, 1378 bp, Diabrotica virgifera
gtcaaaacagatgtaaatggaaatgaaaattgtaaatattgtaataaaataaaataacatcgtagttatttgttatttttcataatggctaccaatcaccaaaaccttccaatttcgagtatccttaaatcaaaaagtgaggttgatgatgaaccaaagaagaaatcaagagaagattggcgtaaagccaaggagcttgaagaagccagaaaagctggtacagctccggctgcagtcgatgaagaaggaaaagatatcaacccccacattccacagtacatttctaatgcaccttggtattatggcacatctggacctacccttaaacatcaaaggccccaagaagagaaacagaaggagtactcaaacatcgacgaatggtacaagcggggtgttgacacttcaaaaatagttactaaatatcgtaaaggtgcatgtgaaaattgtggagctatgactcataaaaagaaagattgtatggaaagacctcgcaaagttggagccaaattttccggggcaaatattgcaccagatgaatttgcccagaaaaacttagcgttgagctttgatggaaaaagagatcgatggagtggatatgacccatctgagcacaaagcagtaatagaagagttccagaaagttgaggaagctaaaagacaactgaaggctgataagttaaatgcaaacgaatcttctgacgatgaagaaaaagatgaggacaaatatgtagatgaagttgatatgcctggtactaaagtagacagcaaacagagaattactgtaagaaatttgaggataagagaagacactgcaaaatacttgaggaatcttgatttaggttctgcttattatgatcccaagacaagatctatgagggaaaaccctaatcctgaaaaagatgctacgtacagtggagagaatttcgttcgttttacaggcgataccaccaatcatgcgaaggctcagttatttgcttgggaagcgtatgaaaagggtgtggatgttcatcttttagccgaaccaacaaaactagaactgctcaaaaaagaatacgagaaaaagaaggaacaggtcaaatcaacaattcaaggcagtgtgctcgataagtatggaggacaggaacatttagaagcaccaccaaaaagcttgttgttggctcaatcagaagtttatgtggaatattcgagatctggtagggttattactggagcggaaaaagaagttattagatccaaatatgaagaagatgtgtacataaacaaccacacatcagtgtggggatcgtattggagaggaggacaatggggatacaaatgttgtcactctttcataaagaattcctattgcctaggcgaggcaggaaaagcgttaacgctcc

SEQ ID NO: 2056 - DNA, 2356 bp, Diabrotica virgifera
gtcgctggtgtaccatgtgtgccacaatgtcgtaacataaggatggggatcgacctgtttcgagatttttgcttagggtcgccggtttgcgaaataacgaatttattcctttcatttgcaccatactgtcggtggagggtggtgtcgcgcatgcttgattggcaattgggaaacgaaggagttttgaatggtgtattgcaagggactttccgagatttcatcaatcgatgtttgaagagtgtctacctaccttggcaacattcagcttttcagtttttcgcatggtttttgagagttggaaatggccaattttgcaatttttcaatttttggtcgcttatatgtcaaaaactatcaacttcagagaggtgtcactggggaccttttctggttggaatgatccaaaaaacctaaaggaaactttgttccataaaaaaaaaatttgacccacttttggacctggcaacatgcaaatttgttaaaaggggccctttttgagtgggattgtgccaaggatccgaatcggaatatttttcctggcggatgcgcagtggctttctggacaaagaagaaaaggagtctgtggtgtaaggattggcttctcaaaagaagacatactctcacctaaagactatagcgggataaaatgctcaaaactacccccgcaactatcagtcccgcgactttgataaagcgcggggctgtgattttgataaggcatataaaatttgccttcatacaactttctagctttacagaggccatagaacctcttgaacagagaaaagtgcctttttccgactttattttttgtgagcgcaattttgctttaaaaaatcttaaaaaattcaaggagatgtatcttttgaatacaaaacagtctgattttttcagattttttaattgaaaattgggcctagcaaaaattattgaaactttcaatattttttgggttatgttaagaatttttggcttacttttgaatagcaatttcttgtgtatttttttttcgttcttttgaatggcagatgcagaatttttaattggtggctcaagtagccaatgcttcagccactctaaatctgaaaatacttaaataagggataactttaatgtagtaaaagcgtttaaatacgaatcagaatgaaacaggccagaagcacatttacaaaaatgaagaggcttctctgctgtcgagacttaaccttgagttaaacatatgcctgctatccacattatattacggaatcgaatgacgcgatgatacaggagccgatgtagatgtggatgtaccgaagagtgctgaagatcttatggatagatagaatatccaacgtagaggtaatgctgtgcataaggaaagataagtaagactaccaattaagagaagaaaactgagatatatgggacatgtcctgagaggagataaacatcatatccagggcattgtgcaaggaaaattccaggaaaaaaagattcataggaaggagacgtaactcatggctgaagaactttagggaatggtttagatgtaataacaacgaattatttagagctgcggtctcaaaaataaaaatcgctctgatgattgccaacctcgaagcggagacggcacccagagaagaagaaaaatacatgatctctccctgttcgagcttttcatgttacacatatctgtagatatttgcagaggaaaggtttggatcgaagtgtcacaagagtagcggttgtacatgttatactgggcgacttacagaagtattccttgattttcgtttccaatataagaaaatctgtattgacattttggacaaggtcctacattaacctatcacctatatcagcgttttggacataacaaattgaaggaaaccaaatattgattactatttacttgttgaaatatacaatagttcaaatacgttaaaattgaataatggataagatacaagacaacaaagctattagtaaaacttgtgatgaaattagtttagtattagatgaatagttgtcattaaaaatatacgttattttcactgttataaatttcaaataatgatttatgacatcacctgagacactgaaaaacaataaaataacttgtaagcttttaataaatccatttaagggaccacaaaatacacatagacgaattttctaaagcaacatttgtgaacccaaagttttactaatttaaaaccgatgctataattctcgtactatatctaaaagccagaaattattccagccttatggtatacctaattatgataataaaacttaacctgccattccaaattaatttttttttttccattttgggaaattgatttggcaaaaacaggaatatttttttt

SEQ ID NO: 2057 - DNA, 1000 bp, Diabrotica virgifera
  misc_feature (930)..(930): n is a, c, g, or t
ctcgccagtatttctcaccctattttctgaaataatttatttacgcttgattcattaaaaacaaattggaatttattcaagaaacctttactaatatcttaatgatcagcttaagctaagcttaaaatatgctgggaatccaccccaccagtcaaccagaaacctaactatcctgagaccattaaacaaaaaattagagaaaagaaaaacttgaaaagaaagacataccagataaagaattgaaagaagaagaaaaatgttaaaaaaagagaaagtgccaagcgtgcaaaaaatttcgagtcaaagaaaatcttacgaaaattgaacataataaaaataatcttgctgccgtaaatcgtcttatgctccccgatctgcatgagaggctgttattgatgggattttaaatacctcgaagcggcacatcttagtgcacttccacgtgtttctaacactcaagatggagggaggcacgtacaaaccatacgtgtaaagttagcaagaatacagaccgagatgtacgaaaagcacgaggacggcgaattctgcactattaaatagaattaggtccttggaatttctcgcgttgcttttggaaccgcagcaagtatttgttctctctcaagatgataagacccgtgtaccattagctttactggtagtgaaaagtcagtgccttcttttagtgcatatggaatacagagtacttttacgtgaccatgactgggttgtggcagagcggtatatacaaatttatttcttctgtattcgccagtacgaacgtggattttgacggttttggtaaggaagaagctgctggttacagcggactgacacacatatattctataaggaggtggaaacatcctccacatcgaacacccatgcttatgatttcgaaccatttttatcggtgactgcatttcaccntttatgatgacagatcgaacaccgtgaagctagtgatgcagcatgaacattttgctaatctcgataaaaa

SEQ ID NO: 2058 - DNA, 1077 bp, Diabrotica virgifera
  misc_feature (993)..(993): n is a, c, g, or t
  misc_feature (1013)..(1013): n is a, c, g, or t
aagaaagttagtttctacatgatccatagttctggaaggtcaacgttcttgttgaagacatacaaaaagactgaatacaatgttaaaatcgtctgtccagcataagattctaaattatttacccgatgatagacccattactgccatacaaattatagaaaatttagataagtgtccgagagggttttttgctatcaacaaaacctacgatcaagactctgatgctgacttaagagagagctcaatttttaaaagtagttctgcacgatatctgtgtttatcgaaaactgaaggtttgccaaattttgtggtgcaggaaatactagttcttgctgacaaggcaaatcccccgaaaggtttcagcctattgaacaaaactgccgacagtgaacaaaaagcttggaaaaagaaacagatttgttatagattagtaaatagaaaagacataaagactgccgttacagacattattatttgtagtagattgaaaaaggctccatctggattttcgttcgcaggcgaattaaacggagtgacactttgctacaagatgggtaacgttcaagactcacaagcgaacacaaatgaccaatttcccccagaacgaccaccgaaaccaaatgtaatacctacaggagcgccagtttatccacccttatcaaatacagatcacgattatgaaattttacgtccaggggcgtatccatcagttcttccaggaggacctggaggacccacgagacctgcccctaaacctccagctcccctacaacatcagaattcgacaaacacgatgagtgggccttcccatttcggcctcgatggggtaccatttatagttaatcccaaatttttaactacgagtaaccaaaaagggggtgcagtttcctagaataaaggcgcgaacaatgcagcaacttattaaaattacaactacccctttccagtggaaagacaaacttagaacacgcactgacccagtctctaaatcgncaaagagaggaactgaattntgagaattttctagtttattatagaatggatatagagaatcaaaaaagactatactttattttg

SEQ ID NO: 2059 - DNA, 821 bp, Diabrotica virgifera
cggacgcgtgggatcgattgttcagtcaaccgtatcgtgttttgagttctttggaattactatttttttacatttccaaaatgaaattcttggtacttgtagtagctgctttcgcagtatgcgctgctgttgaggataaaaaagaaaagagaggtctcttaggcttaggcgattcacttttggacggtcacggaggacttgaattggctccagcacctattttggctaaagctccaatctacagcagctactccgcaccaatcatcagcaaaaccatcgctgaaccaatcatctctgcacctttgatctccaaagcagtcctcccagctccaatctcgtactctgctcccctctcctacgctgcacctgtctcttattcttctcctctctcctactctgctcctctctcctactctgctcctctttcctactctgctccagtcatcagcaaatcttatgccgcccctatcctttccgctcctatcttgaaatctgctccacttttatccgctcccttgttaactaaatcttactcagcacctttgttgtccgctcccatcgctcatgctgctcccatctactcagctcccgctccaattttgagcaagtctatctcctatgcggcccctgctatctcatacggggctcctcttgctcacgctccgatctcatacgcagctccaatcgcccatgctgctcccatttcttatgctgctcctgtctcatacggacacgggctggacttagggtatggaaagctctaccattagacagaaaaagtgatattgtttaccttgtttaatttatgtgttagtttcgtt

SEQ ID NO: 2060 - DNA, 912 bp, Diabrotica virgifera
  misc_feature (890)..(891): n is a, c, g, or t
ttttctaaaaaataaaaaatatggtgttatgaattatgtggttattatccaaatataataactatgaggatttaaaattctcatgattgaaatatcatttttgttcctcatacaagaattggttgtaatttttttttactatagaagaaaaatgagtgaaataaacgaattagaacaggccttggtaatggtagcagctgatgctgattccagaaattatgaagaccagaagttatatgaaaatgaggaagaacaagaggaggaagcaacaagcaaagacccttatttttatgccaaagtctcagatgatgacagcaccaataattatccttcccaggtaattaataattcaaaccaaagtaggaaacgacaaagtgaggatttggaaaatgtaacaagagcagaaagagagagtaaaagtgtaaaacgcaaacatgaaaattctgaagatgtcacaaaatcacaaagagtctactcaaatgttgcaaatgaggacaaaccccaaaagtttaaacgtgatgatcctgaagatggtattacaaaatcacaaagaggatatgcaaatgttgtagcaacacactataatcagttagaggagaagggattagaagaaaggactaagtctcgcattgtacatttaagaaattttcataattggataaaaagtatgttgattaatgaatatttaacaaaaattaaggatggtaaaagacataatgctcctgtaagagtgcatgacatgtgctgcggtaaaggaggagacctgttaaagtggaaaaaaggaggaatttcccatctaatatgcagagataattgctgaagtttctcttgaccaatgtaaggccagatacacagacatgaaaaaatagatctgctagaggaaaaggggnntcgaatttatactcccatcga

SEQ ID NO: 2061 - DNA, 1066 bp, Diabrotica virgifera
  misc_feature (919)..(919): n is a, c, g, or t
  misc_feature (976)..(976): n is a, c, g, or t
  misc_feature (997)..(997): n is a, c, g, or t
  misc_feature (1006)..(1006): n is a, c, g, or t
aattaaactatatattatagtcgatgtttctcactgaaacgtttacttaacaaaaaggaggatggcaattgtagttgtgttaatatcttaaaatttaattttataccagtgtgatctggaactatatttggaacatttccattgtttactagaatttactatgttcaatattattcatacttagtcatgtcagaacctattaatataaataataatagtgataatgaaaatatcagttatagtcctagtgtgtcatcaacatctggaattgaatgtgacctagtgcctgcaagtctagcctctgaagagttaaaattggctcttaataaggaagcaactgaagaagaactattaaaggcagtaacacgctgtaaaagtttaattttagaaagtgaccattgttctgaagagcggaaatggctggttagacatttaatagaattgcgtctacgattagaagaatgtagagatgcaatgaatgatcctctgcatcccagaaatcattccagtggtgtatctaagagagtcatcaaagggcaccatttacatcttcaaccattattaagacatgcatcatcaaaatactgtgatcattgtacaggtacaatatggagtgtagtccaggcttggtatgaatgtgaagactgtgaatatgcctgtcatcataagtgtctagcatctattgtcagggaatgtgctcatgtcatagctagtgaaaaaggatgttttgactatgatatatgccctgaattgggactctctgctcagagatacctctgcgctgaatgtaaatcgcttttaccagttaatagagattggtcagaagctagaagatgtgattacagtggactctacttttgcacagcctgccattggagtagttctgccattattccggccagggtcgtccacaactggngactttgatccacagccagtttcacaagcagctttgcagctactaagaataacttcncgtaggcctattatacatttnaacaactancccccaagttgttcttattagtacacgaattagacctcgttagaagattgcgtcaacttt

SEQ ID NO: 2062 - DNA, 759 bp, Diabrotica virgifera
cccacgcgtccgatccactagagcacttcagcagtgaagcgacataaggttgaccgcctggcctgcttggctatcaaacccagtgttattagaaattgttgatcaatctaatgtgacgtcactcacaactaattcgtactttgaattaagtcattaacgctaaatactcatatactcaaaagaagcttatgatattattcatataattaaaatgtattctttttcccatgaggatttttcagtggcgtcacagtttttcgatttctttctaacgcattaaattgtatgtgacagaaaaaaacgtacgtcggtgattacatttcgtcggtgacatttataacatttattctagttgtcaatagatggcgccataatcgaaaataaaataatttgcgaattatataatatatctacgaatataatctgtacaatttataagactatacaaatcaaagaaaataccattttataaattcaataaacacaattgatttgattttatgcaaaattgcaaataaaatgtgataactgtcagatttaactaaaatgtcatgtcactagaatgtatattatcacggacttacctttttttctatcatttgtgacgcactgaaaaatgctcatgaaaagaagcatagctactaaatttataatgcaattttttggaagcaaatcttccttatcgcgggctatggataaaaaaaaaaaaaaaaaaaaaaaaaaaaaaaaaaaaaaaaaaaaaaaaaaaaagggcggcct

SEQ ID NO: 2063 - DNA, 490 bp, Diabrotica virgifera
  misc_feature (17)..(17): n is a, c, g, or t
atgtattttaaattttnttgtatggcgttgaagcttttgaaatgtgtaggcgagaggcacacccctaatttgaggcttagaaatcgaaagagccaccatgataggtgaatggcaaattttggtatttttttggtttcgaagtcgctgaatccgaatatgaagtttatttttatttagaattagtggaacatgttcaaaaatcaaatttgatgcaaaatgcaaaaaatcaattttgaagatttttcaacttgaactctctgtatttttcttcttcttcttctacggcactttagtccaaattgagccttggcctcctttattttttgcctccacccttgcttgtctgtggctgctcttctccatacacggactcctaaaagggcttgtgcgtcgctgtttactgtgtcttcccagcgctttcttggctttccaaccggtctctttccctgcattctagcattgagtgctctttttggtagcctatcctctc

SEQ ID NO: 2064 - DNA, 1149 bp, Diabrotica virgifera
aattcagtcaatctactaagcactgtatcttcggtcactgtaaatatcttatattgaatagataatcgtcaagtgtctacttatcaaaaattacacaaagttatttttttaatcaccatcctctatattctcctgttcgttaataggttagcttttaaacaaaagacctttcaatgtgtttattgttttacaatgttgtatttatttcccatccttttaagtttttatgaaaatccttctccatccatttcctatctactgatatttttctctaatactgtcttgtaaataatataggatctgtttttcgttcccatttgcctattgtgctagcctccttatttatgaacggcaaagaataatacttttttttatttaaaatagatgttaataaacacttttcgaatgttaataaatatcgcaatgatcacatgtaggttcatggatcataatgatacctactggttctagtttagcctcatggtaataaaataagattataacagcaaatatagacccatgcgtctatatgcgaatatgcgtctataatagttgttactaacaagaggattctactgtaatagctatttgtataacaagggaggaaagtgctacttttcctcccgagaatgaagtttactgcccgacgcgtagcggagggcagtaatcattcaagggaggaaaagacactttactcccatgttatacatatgatttttccaccttcctcaaataacaagtaatttcttcatttttacttaatttatttatgtagctaaccaacaaaatttattaaaactaaaactgacaagtaggtacaatataactgtcaactgtcaaatataagtcaaattattattgtaaacattgttaaatcaaaataacaatttactgttttttaccattctgcaaaatacacggtgttttataaataaacgttaaaatgtatagatacttacataatagaaaatagatattgtacagggcgttaataagttatatttcatgaatgaaataccatgacgtcacttttacttttcctccctagggaggaaaagtacaactttgcttcctacaatcaggtccggaaaagtatactttcggtagaggtaggtggaaaaaattattaaatagtaagtagaatatacg

SEQ ID NO: 2065 - DNA, 1135 bp, Diabrotica virgifera
taaggaatgttaagttatgatataaggcggcgattctagccaaacaataaaagtaatttacaattttatgaatagttgattctcactaataaagtttactcctagaaggaataaaagatattataaagaaatttcataaacatctttgataagcgttcattaagtgaaaaactctatctcttttcgtctctgaaagtaaggcgcacaaatagcttcaaactctgttaacattggtaaggttatttaaaaagttgttaatcgtgcggactatgagaagtagtcaattagtgaggtaacagcgtaagccagagtaagatattgaagaacctgctttttatgtatcagtacaatcagaagataaattaagttttgcacttggcagaaaagctacatatgtactgattaaaaaatgattagatgttgaaaaatagagcctcaaatacaaatttttcgtgcaaaacacagaataatagctatttgtataacaagggacgaaagtgctacttttcctcccgagaatagcggagggcagtaattcattcaagggaggaaaaggcactttactcccatgttatacatatggtttttccaccttcctcaaataaatcattttttcattttcacttaatttatttatgtaactaaccaacaaaatttattagaactaaaactaacaattaggtacaatataactgtcaactgtcaaatataagtcaaattattaatgtaaacattgttaaatcaaaataacaatttactattttttaccattctgcaaaatacagggtattttataaataaacgttaaaatgtatagatacctacgtaatacaaaatagatattgtacagggggtcaataagttatatttcataaatgaaataccatgacgtcacttttacttgtcctccctaggtacttccggacatcaggtccggaaaatatactttcggtagaggtaggtgggaaaataattatttacagttatgtcattttatatatgaagaacaattttacattcgtcgggagattttgataagattttgtcagagtgcttttctggaatacgtatttaaacatcaaacaaacagggagtatagttcacatgttccacaaatatgttcaaattatagaaa

SEQ ID NO: 2066 - DNA, 1372 bp, Diabrotica virgifera
acccacgcgtccgaaaatgtgcccatcaagtatgaaacaaaagaagcaaaaagcgctttagagcaggctcctgcgaggccacggccctggttccacggaaccatgttcagtacgccattgatctagagaactcttaaaataagctacaggtggatgctattgatcaattttctggaatgagctttcaagaaagagaaggctcttagtctaatagttccgaagctaccggctattttggtttcagtcgaataaggcaatacaataatggagagtacttaattttcccggagtggatcaggctaccaaatactgtgaccatttcatatagcaagtatttcagtatcttatgaacaaatgttaaatcagacttctaagcttcgatgacagaagacgtttacttagtaatgcgttatatgacttgaatatgtcttataggaataaggtgacacgaatgaaagacatctcttcgataaagatcttaacaccaaaagtttagcttctctagaaaaaagattctatacgctactcatactaattttaaatttgattcctttattgattcaccttcaaaatatttcatgtaattcgttaatactttccttatatacttattatatatcttcttctacggcactagagcccaaaatgagccttggcctccacctttgattatttgtggctgctcttctccatacacggactcttaaaatgcttgtgcgtcgctgcttactgtgtctttccagctcttactttgctttccaaccggtctttttccctgcattctagcgttcagtgctctttttggtatcctatcctctcccattcttatcacatgtccggtccattgcaatctttgtattttaatgaagtctgacaggggtgttttcttataaagttgataaagctcgttgttttatcgaattctgaagatttattatatatctaacgtattccttttaagcctagtaattctgccaacaagtttaatttttacttaatgtatatttaattttttgtaattcggtgattgaaacgtttatgacaactcttcaaccatgtaattatgtatatagcacatattatgtagttgtttataatatttagtgcagattgtgaaggaaggcaaaccaaataactcgttttaccagacgtttttataggacaatgttttatcacgctgaaataagacataccaaaaatgctgtttctcttaaaataaaaacccgcacatctttagtaaaagagcatgatcttgaaacgctcaaaaatggacagaagaaatttgaattgatgattttttcaaatctgaagaaaaatctatgaatttgtgatgatctagattaattagagctccgtatttagagaacgaaac

SEQ ID NO: 2067 - DNA, 1027 bp, Diabrotica virgifera
gaagaatgaagaaatacatggaatgtttaccatgaaacctaacccccgtaataatagggatttagattttgtcattgaactacatttcaagggagagttaggcgaagtgcatgaagtcaatagatatagaatgcgttaacatatttttctagtataagttttttatctgttactactattgcagttgtcaaataactgttaagtttaaaatcacttgataaagaatctttaatggatcatgtaaatgaaaaacatctgtaagtagcagtggtctaattggaccaccaaaataccttagggttcatgaaatcaacatttggttttgtcttaaaacaaacttttcccttcgttgttccagtttgtaagtccaatttcttcttcttctacggcactacagcccaaattgagctttggcctcctttattttttgcctccacccttgcctgtctgtggctgctcttctccatacacggactcctaaaagggcttgtgcgtcgctgtttactgtgtcttcccagcgctttcgtggcttcccaactggtctctttccttgcattaaagcatgcagtgctcgttttggtagcctatcctctcccattcttatcacatgtccggcccattgcaatctttgtaatctaatgaagtctgacaggggcgtttccttataaagttgataaagctcgttgttgtatcgacttctgaagattccgttttccctcacaggtcctagtattctcctaagtactttcctttcgaatgtgtagagtttgtttttggatgtttctttctgcaccccgacttcacctgccataaatatgttatttgggtccaaattataggttttattagattcctcatctttgtatttgcgggggaggcttttttgaccggaaaatatattggcaaaaggggcaaaaaaaatcccctggttggcctggcggaatttcttcataccaatttttccccatcgtcccgaaacgggttcggtacattattttcctcactcccccggggaatgtaaaaattt

SEQ ID NO: 2068 - DNA, 1551 bp, Diabrotica virgifera
  misc_feature (930)..(930): n is a, c, g, or t
gaaactactttacaactacaattgcaaaacgtcagttcatataataaataacattttctggcatttttgtttagattgtttgaaatattagagtttatagaaatatctgaatcactactatttgttttttgaatttattttcgtttaaaaaaaattatcatcagtggactgcttttgggcgcccgtgtgcgatgcacactttgcacacatggtagcggcggccctgacaatgggcttttaagaggaaacgcttcgaaaaataaaaaataaagagtgctatatacgcactttaaggtgcataccattcaattaaataaaaggctaatgttatttaaagatttttgtgggacctatttaaatttttacaagaagatgtttttaagcttttcctagtttataaataaaggcatcgattgaagtgcccttcatgaagcaatattttgacagtttgtgattgtcaacagtattttgggaattttagataaatagtagctataccttgttataaaattactgaggatcgctcgttgtgaatatacattgtcattgttttgtttcgtatacatttgaaaatagaaaactgtaaacttttaaagtaataaaagtacgggtgatgttagttattgaagttgaacaaaaacatgctattataattatgcagatgaacatgtggatatagtattaggtttcgtaggtatgctttttctcatgaggatctttcagtgcgtcacagtttttcgatttctttctaacgcattaaattgtatgtgacagaaaaaagcgcatgtcggtaattacatttcgtcggtgacatttataacatttattctagttgtcaataaatggcgctataatcgaaaaaaaattatttacgaattataataatatatctacgaatataatctgtacaatttataagacaatacaaantcaaaaaaaatacccattttataaatgcaataaacaccaattgatttgtttttatgccaaattgcaaataaaatgtgaccagttgtcagatttaactaaaatgtcatgtcactaaaatgtatattatcacggacttacctttttttctatccatttgtgacgaactgaaaaatgctcatgaaacgaagaataaccaggcctaaccttgcgatgccgagctgcccaaattttatttttctaatctaaagagggagggccgatagtagtgtaaatttaaaatctcgactgaattcctccgttgcgttagccgtcattttcatttcaaacgggaactgtttttgcctaatatctcagtcattttcaacttatcgacgaaaagtatacgcactaaaattgttgaaaatgtgattttctataatttctttcattaccaatttttttgtgcggtcggaattttcagatttatgggggaaaataataactgtcattattttgaactagaaattaaaggcactgcaaatggtcttttgttacgtggtctgaacgaaactctgctaactaactaatgaaacctccggcctgatcgggcggatgtacccgtagtaaaaccccacgcgtccg

SEQ ID NO: 2069 - DNA, 1515 bp, Diabrotica virgifera
  misc_feature (643)..(643): n is a, c, g, or t
cattatttcagaaactgacgattaaaaaaaatcttaaaacacctcaattttaatgtttggatggccatcaataattgaaatatgtgttggacaatgcgtcatcagtactcggcgtaatgatgtagtcggagatttttttaatacgaaccgagatcacgggattcctcatttcaaaagtcttaactattgcttttgcaatgatgtatatatttgaattttttttgcaaggttatccaaaactgttgatttattattgcaagtaatttatttattttataaaacaagtattcattgtaattccattttatttaaataagtacataaatttggttaaccctgtacaaataaaaattcgaataatacatcgttgcaaaggcgattaggagaccttttaaatgaggtatcccgtcaactcagtttatatttaaacaaatcgtcgattacgtcattacgccgacactgatgacgtggtgtctaacacataaagcaattaatggccattaatgtattgcaataataataatttttattatattataatataatatattatatacaatattatatcattgcaaagatttacatgtttttagattttttaaaaagtcgtctgtttataaaaaatagctatttgtataacagngggaggaaagtgctattttttctcccgagaatgaagtttactggccgacgcgtagcggagggcagtaatcattcaagggaggaaaaggcactttactcccatgttatatcatatggtttttcgacctgccttcctcaaataacgagtaatttttcatttttacttaatttatttatgtaactaaccagcaaaatttattcaaactaaaactaacaagtaggtacaatataactgtcaactgtcaaatataagtcaaattattaatgtaaacattgttaaataaaaataacaatttactgttttttaccattctgcaaaatacagggtgttttataaataaacgttcaaatgtatagatacttacgtaatagaaaatagatattgtacagggccttaataagttatatttcatgaatgaaataccatgacgtcacttttacttttcctccctagggaggaaaagtataactttgctccctacaatcaggtccggaaaagtatactttcggtagaggtaggtagaaaaataatgtttatgttctatccaattcgattttatgattttatgtaaaatcgtattgtcctactattcatcatatcactcctacatggtattagtgatggtgaagttgctaatcttaactacattccgtgattttattcgtcatatatattaaggagtattattagtagtgataggggagcccaagggtgcttatgtgttactcgagcgcgtgcaaaatcctcgcttggactcccttaccataacaaacattttgtatgagaatgaagacttataatcttacattaacttaagattttatattagaagaaaaattatattgcataatggttaatattctataaaatac

SEQ ID NO: 2070 - DNA, 1366 bp, Diabrotica virgifera
gtgaattgggttaaagtgtcttaaaattgtctgaggaatctcctgtcttcgtttgtcggtggagtttctggacaccctgtataatatatctacgaatataatctgtacaatttataagactatacaaatcaaagaaaataccattttataaatgtaataaacacaattgatttgtttttatgccaaattacaaataaaatgtgacaactgtcagatttaactaaaatgtcatgttagaatagatgtcataaatgtgtattatcacggacttacctttttttctatcatttgtgacgcactgaaaaatgcccatgaaaaggactctagaatttataaaacgtcatttgtttaattattaattaatgatggtttggacaaaattatattgggcacctcttcttttttataatttttaacatactaaattacatatcaaataatttttcacagatcggtgaaaagtgttcttatacctatcggatcttagactattagtaatccataaaattggttgaattatattgtgataatcgtaaaactattaaaaatcgagatgaaaatacttttttgaacaatcaagataagaaatagtgttaagaataccctataacgatatttactaaatcagttatgagattttttttagagaattaatcgttttggtattgtgctttctaattgtagaggtgagtaacaagtttttaaaatggttttattaaaattttaaattactgccgtaaaatataggttctgaatatcagaaatttattattcataatagaaattatgttatttttttatttcacatcaagtaatctcacattttcataccaaaccctatcttaaaataactttcataaaatgatctttaaagctactgtgcattatttacatacaaagtattggcgaatataaaaattatgctaaaataacagttccgtcagtggcatacaatatgggaagggtcaaccgttcaccttcacctgtcgtacgcctctggttgtaaccaggaacgattaattaacataatttagttcggtgtacagtacccacactttctgccgagtataatgaggataatatgtcaaataattttaaagtacataccgggtacaaataatagttcttaaagttctaaataaagaaaaaattatttaaaaaaaatactttaaaactatttgacatatccgtgtcatacttggcagaaagtgtaggtgctgtagacgcagaccctaccaaattatgtcaaacaaccgttttgggctactaccatacgcgtacgacgggggaaagtgaatggtggacccctcccaaattccacgccactgatggaactgccactttagcacaattattattatactcc

SEQ ID NO: 2071 - DNA, 1616 bp, Diabrotica virgifera
cccccccgcgcgtcccgaccccttttgcgtcccgaaattttattagtctcaagaatattttaacattgtttttgtttttattcctgcatattcgtattaatttgttaatggtgtctcgtctaaaacctattgttaacttactaatagtttgtggtcatatcataaagggcacaacattaggctatacaattttagagtgagatatacttaaaataacattacccctttagtccaatttagaaatcttagaaatccgtgcaataaatacgaaatatcaaaattgttcttttggatgagcaaatattctctacatcaacagtttggcgtacgtagttttgcaaaattaaggaaataaaatctagcacttaacttttttgaaaatatgtcacacagaaacttttctatcaaaatattttactatttggacaaatttagatgaagttggtataaatataatcgactaacaattttaagtttaatatgccctactaaaatcgtgacgttatatgaggagatggggcttataagtattcccaaataaacttctgatagtatttaaaagttcaaaacatgggctgcctctccatctgcattcagtatacagtattaaaaactactgttgaagaaaaacaaatattctttttctcatgatcatctttcagtgcgtcacagtttttcgatttctctctaacgcattaaattgtatgtgacagaaaaaaaggcacgtctttgaatactttggtaattattctaaaagaattaacaaaattataagtaacaataataaataaaatcaaacaagatgctgtatatgtccaccaccaacatctctatataacctaacttttcttgttaagttgacgtacacatagaggtataattaacatagagtgagcttacactctgtgcttcctgacgacaagatatcttcgactggtttgcggtatctctttctaccacattgtatcaagaaactaagatgacattaagtgtgagtataggcacggaaggggaggactactgtcgcagctttactatgcgtaagaataaaacagcactaatccaaagaaaaaagatggtgtcgtcacttcgctctgaatgacactccgtctatcattatttaagtctatggacgtacactgcaaagttgacgtaaactggaaagtatattaactgaattgcacatgcactgtatatctctgtcatgtaattgacatgcactgtatatctctgtcgttcagagccacctatggtgacaataattttggatcacacgttatgttattctattgtgaacggttctaaacttgtgaaaataaatgcttagtgtaggtatccggtagaatcttttggcagcaatactattgctctcaatgcttattgtgaatttaactatcctgtatacttgtatctatacacaaaatccgagatacttagtttcattagcgttgttggccaaaaggaaagcacatggttttctggtatgattgattgtttcatgtgatgtagtggtgtgaggtacatcgaaatttcttattcgttttgaagggcccctcgatggcattatatagggaatataacatcgttaaaatggtcccgtggtggctaagctgagc

SEQ ID NO: 2072 - DNA, 939 bp, Diabrotica virgifera
aacgattcaacaaaatatattttatataaaatactttataattacaaacttaaagctttcaactcagaaatatatacaaaatcattatcaactgggacatgtattctacattttgtacactatatttaaaccatagacgcatatactaacacaggctgagcagtctgtagagctaagtgactataccaccttttttcgttgttcgttctgtttcactcttacaaatagtaaagctacgactgtatcttttaagggatgggggttattgtgtgaaatcaacatttccaacacatttttgtgattgttttttgaaactatggtaaaattattttattttaaaattaaataaacatattttattatagattccttttcatgatcattcttcagtgcgtcacagtttttcgatttctttctaacgcattaaattgtgtgtgacagaaaaaaattcacgtctgtgattacagacatttacaacatttattctagttattctagttgtcgatagatggcgctataatcgaaaaaaaaatttacgaattatataatatatctcgaaaataatctgtacaatatatataagactatacaaataaaagaaaataccatgcactaaacacaattgatttgtttttatgccaaattacaaataaaatatgacaactgtcagatttaactaaaatgtcatgttagaataaatgtcataaatgtgtattatcacggacttctttttctatcatttgtgactcactgaaaaatgcacatgaaaaagactctattaacaaattaatcttcaaagaatattaaaaaaattgcaaggcaaaatattgaaaaaataagccaacggtggcaaatttttaccaaacactaaaaaaaaggattttttacaggtgggaattaaaacttgtcatttaattcttcaaaacaaaaaaacaaaaa

SEQ ID NO: 2073 - DNA, 1703 bp, Diabrotica virgifera
  misc_feature (1482)..(1482): n is a, c, g, or t
  misc_feature (1653)..(1653): n is a, c, g, or t
tttttatatcgaggaaaattttcttcttcttcggctactgattaatctgttgcgatttaattgtaccattatagttcttctattatattatactttgaattactttttatactaggtctctttttttactcacagaaactagtatagcaaaattaagccgcttgtccatagaaaccacaacgagttgtaaacaagaataaacggtacggcatgttgttgataccttgtttactataaatttagacgtttatcattttcagtgacagtcacattagtgcatttgttgtatttcttggtttatttggatttattgtttcatttggattttcatattatttaaacttttaatttttgtagatgtcattgtttttattttcaaacataattgttagaacgactaactgttgctcttttaatttgattacttccggaagtatttatttttacgctactaagacaactaatattttctaacttataaattgtcattacattgagagatatcaatgatattacatatcgacgtacgttttacttaatgttttgatttaaattgtttacaaatgaatcatgacgtttgtgcaaagatataatggaacaactataatttccgttttcttggtgtaacatcaatattcatatcgtcgccttagtaccataacttgataactccaaaattgatgtttttgagataactagttcacaagatgtattttatttgcctccatattgcgtaaaaacttgataactctctccaagcgagttttaactatttatttatgattgacgaaggttgataaaactcaaatgccactaatagtcagtgctaaaacttgacaagataagttatcaagctattatttaatcgaaataatcgtgaatacgacatacactgaatgctataactagataactcgagttatctagttttagcacgtgtttctctgaaaccattgaagttaccacataattgctatctgtttattcggttcattttaatgcaagaattcgagaattgttagcagatctgacaacccccatggcagagggctaattttcaacaaaataatgtttaaaatattagttgtgttaaaaagttcacttatatgcgacttagcacaacatgcgacactaccaaatgttaacattatggtagtgctaaaagttgataactttaatttttcatgttttcttccatattggaaaacaaatttacaccatattcctaaatagatcagttgccaaaaagttaaggaacagtattttagagccgcagagtgaattccgtatttaccaacatcatggtagcagcacaaatatatttaaaatctttaaactcgtttatctcaaaactactaatttcgagttatcaagttatagtattaaggcgacgatttgatttaacatgtctgaaaaccattttaaagaacagaggatgttctggaaagcatttcatttattcaaacatttttcatctatatnttccttttttttttcaaatagtaattccccgtaagaagtgggagttggtgatcgctgatgttcgtggtattgtctgtctccaaagatctctggtcattttttacccatgcataggtattttgcatattcttgtaattttgtcgatctaatttttgttggtgatctccctcntgaatcttcagcatttccacttttccttgcataaatgagtcctttccatg

SEQ ID NO: 2074 - DNA, 1860 bp, Diabrotica virgifera
  misc_feature (810)..(810): n is a, c, g, or t
tctcagtctaatagttccgaagctaccggctattttggtttcagtcgaataaggcaatacaataatggagagtacttaattttcccggagtggatcaggctaccaaatactgtgaccattgcatatagcaagtatttcagtatcttatgaacaaatgttaaattagacttctaaacttcgatgacagaagacgtttacttaataatgcgttatgtgacttgaatatgccttataggaataaggtgacacgaatgaaagacatctcttcgctaaagatcttaacaccaaaagttatgtaatatatcatgttcgtactaaattcgctgtgggatagcttctctagaaaaaaagattatatacgctactcgtaccaattttaaatttgatccctttattgatttaccttcaaaatatttcatgtaattccttaatactatccttatatacttattatatatgtatcttcttctacggcactagagcccaaattgagctttggcctccacctttgattatttgtggctgctcttctccatacacggactcctaaaatgcttgtgcgtcgctgcttactgtgtcttcccagcgcttactttgctttccaaccggtctttttccctgcattctagcattcagtgctctttttggtatcatatcctctcccattcttatcacatgtccgacccattgcaatctttgtattctaatgaagtctgacaggggttgataaagctgtctctttccctgcattctagcattcagtgctctttttggtatcatatcctctcccattcttatcacatgtccggnccattgcaatctttgtatattaatgaaagtctgacaggggtgttttctcataaagttgataacgctcgttgttgtatcgaattctgaaagattatgatatatctaacgtattcccggtgtcaaagttgctttcctgggaaggtaattggatttatttactaaggctgaaggtcggtgcacgcattgtaaattgaatataataacttttatttgtattcaatgtgaaatgtgtgtactgattttcagccttagtaaatggatttaattgccttcataggagagcaactttgatgccctctcagtaacccctgttctacgtttcgcttgaccggccgcagtgtgtatctctgcacaatcacagtgatgaactgtgaaggatttagctttagtaaattcaaagaaaattttcagcgctgcctctccatctgcattcagtatacagtattaaaaactactgttgaagaaaaacaaatattctttttctcatgatcatctttcagtgcgtcacagtttttcgatttctctctaacgcattaaattgtatgtgacagaaaaaaaggcacgtctttgaatactttggtaattattctagttcggtgattattctagttgtcgatagatggcgccataatcaaaaaagaattatttattaaataaaataataatattatcaatataatctgtacaatttataagactatacaaatgaaagaaaataccattttataaatgcaatagacacaattgattttattttattccaaattgaaaataaaatttgacaactgtcagatttaactaaaatgtcccgttagaataaatgtcataaatgtgtattatcacggacttacgtttttttctataatttgtgacgcactgaaaaaaggttcatgaaaaggagaataccccaactatttttactaatggatttgactctgtcgtacttgaaaaaagccctgcagaacaaaaaatggttttccgggaaggtcaaattttccccagtttccggccacaaaaaggagggggccaagaattatggaaaatttttaa

SEQ ID NO: 2075 - DNA, 1648 bp, Diabrotica virgifera
gtgattatcagtgatgactaagattgatatatacctaaacacaatttggtttggaccaatcaaactcattgtgaataaaaatgacataacattgatgtctataatgataatgatcaaataacactccttgtaatcaattaagtatgaagtaataaccaccaacgtagaggtactgaaccgaatgggaaaacaaaaagaaatctctttcacaattaagaaacggaaacttgaatacctcgttcatattatgaaacatgataaatatcatatactccaactgataatacagggtaaaatagaaaacaaacgcggacccggaagaagaagacactcatggcttcaaaacttacgccaatggtttggactaacatcgatcgagttattcagaaacgccgcaaacaaaattaaaattgctatgatgatagccaacgtccgcaacggataaggcacatgaagaagaacaatatttgttgtgtctcatttgaagaatcgttcattcataaagtttgcccatttgtcttcatggcaccaataggtgagtcccgaattgagtagattttatgagttgaatcgaggtccattcaactgatgtatattctttttctcatgatcatctttcagtgcgtcacagtttttcgatttctttctaacgcattaaattgtatgtgacagaaaacacgaaagcacgtccgtgattacagacatttacaacatttattctagttgtcgatagattgcgccataataaaaaaaaataattatttttaaattagataataatattacaaatataatctgtataatttataagactatacaaatcaaagaaaataccattttataaatacaagaaacacatttgatttgtttttattccaaattgcaaataaaatgtaacaactgtcagatttaactaaaatgtcatgttagaataaatgtcataatgtgtattatcacggacttacccttttttctatcatttgttacgcactgaaaaatgatcatgagaaatactgtacatatatttcacttaaatatagtaatatagagatgatttttgataaccgtaaacaaaattttcgttatgatattgctcgtattctcagcttgtttttggatttaatcctttcactttattataggtttgatataacgagcgatccacaattattgggatcaaagctagccatgcaaaaaattacgtatgtcttgttttaatctgaatttatatcattggtttatcaattaattttgattaacgttataaaacataaaaaatcagtcaaaaccagaactttaatcaaaaataaaaagaattaacaaaattataagtaataataataaataaaatcaaacaagatctctctacataaccttaattttcttgttaagttgacgtacactgcaaagttgacgtaaactggaaagtatatctgaattaagaatagacatgcactgtatagctatctctgtcgttcagagccacctatggtgacaataattttggatcacacgttacctatttgcctaatacaattttaaataaaaaaaatttattgtttaaatgctttctttgtgcagataataagttctcacaaccatataaacaactcaatgcttcagaatatatttactaaacttaaatctc

SEQ ID NO: 2076 - DNA, 1713 bp, Diabrotica virgifera
aaaatattaaagaaatctttttttataaatgtactatggtaaaaataaacaatttcttttctcccatttatcatttcatttagatatcctaaaaccgtcgattgatacattgtatcagtataccagtaccttgtatatgtatcaatcaacgctaaaacgttatgagcaaaatgcattaagacatttgatgtgaactggacattagacatatccagtattgtagagattttacataaacgatgagaataagaaaaatcataaaaagaaaatgtgaaagttgaaactttaaataaaaaatattttactaattgtggtatattcccaataagatattaaaaaactaagtttactcaaagaaaccttcagcacactagaagactgtcgtagaactcttctggaaattagatttacgcgttaattatgagagaaatcgtaattgcgtataaactgatcacagaaaaaatatcagaagatatacattacattctatgatgaatattcgacataaattcatagtttttggatggaataaaactagtttattgtaatggcaattctccttctccaagtgcgatctacgcgacggaggtcagcaatcatcgtagatattcggacttcagagacggctgcgctgagaagttctttgatgtacatccgcaacattttctcaggttgcgcagccatgatatgctttttctcatgaggatccttcagtgcgtcacagtttttcgattcctttctaacgcattaaattgtatgtgacagaaataaacacacgtcattgattacatttcgtcggtgacatttataacatttattctagttgtcaatagatggcgctataatcgaaaataaaataatttgcgaattatataatatatctacgaatataatctgaacaatttataagactatataaatcaaagaaaataccattttataaatgcaataaacggaattgatttgttttttgcggacgcgcgggtaaaatgtgacaactgtcagatttaactaaaatgacatgtcactaaaatgtatattataacggacttaccttttttctatcatttgtgacgcactgaaaaatgctcatgaaaagaagcatatacgtctccctatgcttctttttccttggatcttttcctgtataatcagttggagcatggagcatacacaactatatccgtgtagtgatcaagaagaaagaagaggagaaaaaacagctgtaccaacgataggggtgagagggaaatatactgtgagtagaaggcagagggaataagttttgacgggaggcgaatatatgagatatattgtatgagacagactgggaaagaagctctaataataaaaaaagcccaatcttgggaccaaaaaaggggggaatggggaaaatgaagggcctccttgcttacagtctgtggataaatgaaggtaaagtgcttcggaagcgatgtcgaccttgcagtggccattccgctttcggagcgctggatgacagaggagggtctggtttagcaggtaggcattcggcgtagcctcggcgacgagagagcgttttaaagtacctcgggaactatcgctggtactaccaagaatgaatcctgcactaaggtcagtcaggcggcgttctggactgaggtgtcttttgaagattccagacccccctctttaaagatgaaaaaagaaaaaggttggagcacgttggttctc

SEQ ID NO: 2077 - DNA, 1459 bp, Diabrotica virgifera
  misc_feature (190)..(190): n is a, c, g, or t
accacgcgtccgcccacgcgtccgcccacgcgtccgggcgtcaataagttatatttcatgaatgaaataccatgacgtcatttttacttttcctccctagggaggaaaaatattttcctccctaaggaggaaaagtacaactttgctccctacaatcaggtccggaaaagtatactttcggtagaggtangtggaaaaaaccctttcctgctctttgtataacctcaaacgtaactaccaacaaaacgtgtgctactatgtcgtaagattaacgacgttgccactcacatgtgtagctctttcgtttaatacttgcccctaaattttaaatccgttccatactgaactacacgttacaagaagaattatttttttgacgcccactttttattaatcattagatacgaagccataagaaccaaacaaaaaataaaggaaattaatttcggattaaaccaaagcttctttaattttttccacggctaactttggtcccaataattggggatcgttcgttatcatgtgtcacatattattaatatatttacgtcatccacttattgggtatatataaatgacacaaaccaaaagacgtatgactaagatatattaatattatgtgacccatgacagacgctcgaaacaaatgacaatcgatgaaaagccctattaatacattttgattcttaaagcatttttgagtacatattgttgttttgactgcattattgtaaacatattggtgagaaataagctccatatcaaggacaaaataaatacgtataaacacattaaaaaataaataaaaatattaaaaattattaccttacgtggcctagataaaaaatattctagtgtacaaatattaaacctttaggaagtgaactgaaagaaccaaattcgcattttttattcgggaaagtctgggactttgcgtggctgagagggagcccatctggcattatcgatttcgttactatcagcgttatcgtcaacaggaacatcaacaggaacttctggctcaaattcgctggtttccagattttcagaatttcgttttggttttatcatttccacatcttcactagtatcctcatcgttcataggtttattcatcatgtcattgatgtaaggatatccttccgagactcgaggtttccttgagtttctggtcaaaacaaaagcatcatcatctgctttaaattgatccttatcctttggaaccagcaacacatgtccgtctttggtctgggttctgtagaattggtcattgttattcccttgtgggcatctgtcgtttgtgcaagtgtactctttaccatttgacgaacatatgcaaaagttacagtccattttaaactttgaatttggcgaacacattgttgcaccactgaaattaacacacacaatacaacacaaagcaataacgcgccagtccatcttgcccggacgcgtagag

SEQ ID NO: 2078 - DNA, 2019 bp, Diabrotica virgifera
cgaagtgttgaaattttttttttaaattagctaaaacattttcagtttcaaaaaccgccaaattgacattttttgtctgttcaaaaaacccctagttgatggtatggaaaattgcttatatttcggtaataactttgaaattttatgtttcaggatctctattagccccaatcactgcatcagtgggtctatgtttttgttttcgcggtgccggtggatggcccatgaatcgtttaattttcaatatttttttatgagaattgttttacatgtatacagtatttctcatgatcatctttcaatgcgtcacagtttttcgatttctttctaacgcattaaattgtatatgacagaaaaaaaggcacgtcggtgattacgtttcgtcggtgacatttttataacatttcttctagttattatagttgtcgatagatggcgccataataaaaaaatatttttttttaattagataataatattacaaataaaatctgcataatttaaaagattatacaaatcaaagaaaataccattttataaatgcaagaaacacatttgatttgtttttattccaaattgaaaataaaatgtgacaactgtcagatttaactaaaatgttatgttagaataaatgtcataaatgtgtattatcacggacttaccctttttcctatcattctgttacggacagaaaaaaaaaaacgcacgtcggtgattacatttcgtcggtaacatttataacatttattctagttatcaatagatggcgctataatcgaaaaaaaaaatatttacgaattatataatatatctacgaatataatctgtacaatttataaggctatacaaatcaaagaaatagctatttgtataacaagggaggaaagtgctacttttcctcccgaggaaaccattcaagggggcccccatgtactttactactcacatgtgatatgtgtggtctgtatttttgatggaagagcgaagcaaaaggcaattggatgtgggggtttggggaaattttggaaaagggatttgaacagttaccatgtactagccgacaaataaaaagagtgtgttgacgtataataatgaatacacacgcctaatatgacgtacacggcgaaagaggactaaaaagcagagaatctgggacacaaatgattatttctggctagtttgaatcatatttgcggaggaatgagtgaattcttttcaaagcgcgcttgaagtttgcttaaaccttttcttttcgttttgagataagagtgaaaattggcgaatttttttgattggtaaaaccgggagtaggatagaaaaatggggagatggagtgagttttgggtgttagaggagttggaagtataatcgagatgagttctaagtattcgagaagagcgatcagttctagagagctagaataagaagtttgtgtctttccgtcagcaggccttgccttgctgacggagaaaattgttgaaaatagttcaatggagaaaattagttgtttgtatttagtacagttcctttgagtttttcagagccgaagtaggctcaatttgggctgtagtgccgtagaagaaaaagaaagaaaatctagtaattaaacataattcttactttattgaaacaaataaaaattcagcaaggttgttatcaaaaaaaaaataaagtttcatcaattcgccagaaaacgtaagagttcaacaataaaaaatagcgcaagtacctttacgacccatttttttgtcacgcacataatgacactcaattttacagaaaagtacaggtattaattatattagagatgaaattccattgttcgtttattgtatgtaacacttacacatatatcatttattattatttttgttattaattaaacttaattgaatgaaacgaaggacttttcgacaaaagaaaactaatagatgtgttcaatccatcactaggaacacatctattagttgtttgtatttagtacagttcctttgagtttttcagagccgaagtaggctc

SEQ ID NO: 2079 - DNA, 1793 bp, Diabrotica virgifera
ataattttttcactgatattaatatatgaaacatttgatttgttttcatgtttcatgatgccctagatctacaattctcattttgacaaattttatgtcatttttaaacaattttaggatgcgattttacacattaaatatgtgtaaaatatgactaaccatattttttattttttgttatttattttcagttgagttttggtcagaagagtcagcacactcttctgtttataatttttttctttatatttgctgctgtataggttctaagttattatttgtaaaggcacgattccgacatcgacggaaggcggcagacggcaactgcaggcggcagttagagttgtcaccataacgacgtcattactcttgcactatcaatttgtatattttgtaacgtgtgcaaagggcattaacgttttcgaattcctgatactgttgcttcaccctatatggtaaatccgtttcagaaattgtgtttgttgcgtggaaatgtgtgattatttttcatttctcatgaatttgtagtattacgtaattaattcttgattctcatgcgtattcgtatctctgtttttgtcaaaagttgaattttgctgtcaaagaattgagactcgtaaatctttttgctaatgtatttttggcgtcgaaaatatgatgctttggactgatttgtttacatagtgcataccgttgcagatgagaggctctgagtgtgtttatacaatataacgagttcacacgtgtaatatggcgtacgttgcaaaaaaaagcctgggagaatttgagctgaaacacaaatcattagaatttcgtagattgaatcatatttgcggaagaatgagttattacctttgaaggcgtgattgaagtttgcttaaaccttttcttttcgttttgagataagagtgaaaattggcgaatttttttgattggtaaaaccgggagtaggatagaaaaatggggagatggagtgagttttgggtgttagaggagttggaagtataatcgagatgagttctaagtattcgagaagagcgatcagttctagagagctagaataagaagtttgtgtctttccgtcagcaggccttgccttgctgacggagaaaattgttgaaaatagttcaatggagaaaattagttgtttgtatttagtacagttcctttgagtttttcagagccgaagtaggctcaagtggctgctgtggtcgtagagaatataaattctcgaccgtattttgtgttcctagtgatggattgaacacatctattagttttcttttgtcgaaaagtccttcgtttcattcaattaagtttaattaataacaaaaataataataaatgatatatgtgtaagtgttacatacaataaacgaacaatggaatttcatctctaatataattaatacctgtacttttctgtaaaattgagtgtcattatgtgcgtgacaaaaaaatgggtcgtaaaggtacttgcgctattttttattgttgaactcttacgttttctggcgaattgatgaaactttatttttttttgataacaaccttgctgaatttttatttgtttcaataaagtaagaattatgtttaattactagattttctttctttttcttctacggcactacagcccaaattgagccttggcctcctttattttttgcctccacccttgcctgtctgtggctgctcttctccatatacggactcctaaaagggcgggtgcgtcgctgtttactgtgtcttcccagcgctttcatggcttcccaaccggtctctttccttgc

SEQ ID NO: 2080 - DNA, 3205 bp, Diabrotica virgifera
  misc_feature (1429)..(1429): n is a, c, g, or t
  misc_feature (1442)..(1442): n is a, c, g, or t
  misc_feature (2129)..(2129): n is a, c, g, or t
tagtttaaaaatttcattaatgtcaatagtgtcaaaatttcatattttaggtctaaacttttttgcggttgaactcactaacaagcattactgcgcggtaaatttgaattactcctcctagtttaaaaacgacgtatagatttatatgaagtgattcttttatcgcgatacctgaattatgaaaattatccgcaaattttgccctaataattttttacttgtattctttttctcataggcatctttcagagcgttacagtttttcgatttctttctaacgcattaaattgtatgtgacagaaaaaaaggcacgtccgtgattacagacatttataacatttattctagttgtcgatagatggcgctatcatcgaaaaatagctatttgtataacaagggaggaaagtgctacttttcctcccgagaatgaagtttactgcccgacgcgtagcggagggcagtaatcattcaagggaggaaaaggcactttacagggatactatacaatacatatggtttttccaccttcctcaaataacaagtcattttttcatttttactcaatttatttatgtaaaccataatgtataaccaacaaaatctattagaactaaaactaacaagcaggtacaatataactgtcaaatataagtcaaattattaatgtaaacattgttaaatcagaataaaaatttactgttttttaccattctgcaaaatacagagtgtttttaaataaacgttaaaatgtatagatacttacgtaataaaaaatagatattgtacagggcgtcaataagttatatttcatgaatgaaataccatgacgtcacttttacttttcctccctagggaggaaaaatattttcctccctagggaggaaaagtacaactttgctccctacaatcaggtccggaaaagtatactttcggtagaggtaggtggaaaacaatattgtttcctattttgtgacctaatcttctactccaattttcaatcagtcgtatgagatttttcgtactttatttcacaatcttttgaacttaaacttgtatttgatactggataatttttaaaatcttagttaaggtttttggatctaagaaaaaaactatgagagatgtgctgtgatagaattagtttatggttgttataaattctttcgaaattttataaaaatgcatttaactggggtagatactttcaaaacaaatgtatactaaatagtagtagaataggagtagaatatttatagatgtaaactatcttttcactttcaactgactttgaaagttattttacttactaaggatactaggtatagattaaaattttgtcaaagatagctctctatataagttttcagtttagttacaagtatgtcaacatcatcacatttaaaagtatagaatttttagaaaagcttangttcacgtattangtgatattgatataaatatgacaatgaatagggtggtatttagaaacataagctttcaaaatgtctatactcaattcataaacttttacatcgaacaaatatgaagtacttagtgttaattttcataaatatcccatgggtattttcgatttcgcaaaagtcgttatgtgcctctatgttcgattattgtgcaacagatgaacactgcaaattcttcccttgtgatgaaccgaagttttgcgagaaaggtctcgttttgaaaaaacttccttgtaaatgttgtcgtgaatgtgtaccagaagattgcgaagtggactgttcagaacgactgtgccttaagccgaaatgtccaagaggtcaggttcctactaaggtcgattgcaaatgctgtccacggtgtgctcgagctgaatacttaccagactgcaatgtagaagactgtcctgagcttacttgcaagcataatgaaatgaagattgatgcaccatgtagatgctgtcaaatctgtaaagacagaaatcttttttctttcttagcccttctaaaataagccataatatagttatttgtatagcaagggaggaaagtgctacttttccttccgagaatgaagtttactgcccgacgcgtaacggaggacagtaatcattcaatggatgaaaaggcactttactcccatgttatacnatatggtttttccaccttcctcaaataacaagtaattttttcatttttacttaatttatttatgtaactaaccaacaaaatttattagaactaaaactaacaagtaggtacaatataactgtcaactgtcaaatataagtcaaattattaatgtgaacattgttaaatcacaatgacaataaattatttactgttttttaccattcagcaaaatacagggtgttttataaataaacgttaaaatgtatagatacttaaataatagaaaatagatattgtgcagggcgtcaataataatttattataataaatttaataaaaatgcaatatttccataaatatccgaaagtctccggaaactgtccggcgttcgaatcttcccggaaattttacattactagtcctcgctaacagtggaacagtagcaggcattctggctctgattccaaatttcctcaatctgtttctaacccaattggcatttattcgaacattatggggcgtggaaagatcatttcgcagttttctaactgtaatgtgtacacaaagtcagcagatgtaaataacgtttatctgcgaggatcgtacacctgagacgtcctggaactggtcttcttgtgtatcctccgctttctctataccttcttaaagttcttgaaacgatggattagtgtattcccatttcccataacatcagcaagatattgctgcgatcatccatctcccattaaatctacaatttgggctgctcgttctgacgttaaattacctagtcattttttctaagaacgcacttcctcattgaaaaattcttcaatacgaatatccaaaataaatattctcttttaacaacgttttgtttactgttttttttttcggcaaaaacattcttcaacatgaaataatgtaatggaatgggtttgtagacacgtaatagaaaatagatgttgtacagggcgtcaataagttatatttcatgaatgaaatatcatgacgtcacttttacttttcctccctagggaggaaaagtacaactttgctccctacaatcaggtccggaaaagtatactttcggt

SEQ ID NO: 2081 - DNA, 3244 bp, Diabrotica virgifera
cattaccagacggcatcgagaaagtagatattataatttccgagtggatgggttactgtttgttctatgagagtatgctcgatactgtactattcgcaagagacaagtggttgcagcctgatggtcttctatttcctgatcgatgctcactctttgttactgccattgaagacagacagtataaggacgaaaaaatcaactggtgggatgatgtttatggtttcgacatgagttctatacgcaaagtagctattagtgaacctttagtggatgtggtggatcctaaacaagttgttactggacctgctttaataaaggaagttgatctatacactgtaaaaaaagaagatctggatttcacttcacccttcatgctgacagttagaagaaatgattatgtgcaagctttagttacatattttacagttgaatttagcaaatgccataagcgtataggtttcaccactgccccagacgctccatacacccattggaaacaaacagtgttctattttgaaaactatatgacagtaaagaagaatgaagaaatacatggaatgtttaccatgaaacctaacccccgtaataatagggatttagattttgtcattgaactacatttcaagggagagttaggcgaagtgcatgaagtcaatagatatagaatgcgttaacatatttttctaggataagttttttatctgttactactattgcagttgtcaaataactgttaagtttaaaatcacttgataaagaatctttaatggatcatgtaaatgaaaaacatctgtaagtagcagtggtctaattggaccaccaaaataccttagggttcatgaaatcaacatttggttttgtcttaaaacaaacttttcccttcgttgttccagtttgtaagtccaatttcttcttcttctacggcactacagcccaaattgagctttggcctcctttattttttgcctccacccttgcctgtctgtggctgctcttctccatacacggactcctaaaagggcttgtgcgtcgctgtttactgtgtcttcccagcgctttcgtggcttcccaactggtctctttccttgcattaaagcatgcagtgctcgttttggtagcctatcctctcccattcttatcacatgatccggcccattgcaatctttgtaatctaatgaagtctgacaggggcgtttccttataaagttgataaagatcgtaggagtatcaacttccgtatattaagatatgttattatttattattatatattattattcttatctttcataaattttttattaaaatataaatttagattattcaaatttactaatgatgataatattagtattacaaaattgtatatttagtaaaaatatataggtttaataaaggaattcggcaacatttttttcacctgtttattaaaaacatgtctttttgatattaaatataaagtctcgcctgcccactgattaatttgaatggccgcggtattttgaccgtagctaaggtagcataatcattaatttttttattgaaagctggaatgaagggttggatgaaaaaaaaactgtctttatttaatgtataaagaattttattttttaagttaaaatagcttatattctttttacaagacgagaagaccctcatagagttttataaaataattaataagcttttttagtattaaatttatttattttaataaatttatttaatttgggggggattcaaaaaaaacttaaaattttttcttcctcaaaatatcaagtcattttttcatttttacttaatttatttatgtaactaaccaacaaaatttattagaactaaaattaacaagtaggtacaatataactgtcaactgtcaaatataagtcaaattattaatgtaaacattgttaaatcagaataacaatttactgttttttaccattctgcaaaatacagagtgtttttagataaacgttaaaatgtatagatacttacgtaatagaaaatagatattgtacagggcgtcaacaagttatatttcatgaatgaaataccatgacgtcacttttacttttcctccctagggaggaaaaatattttcctccctagggaggaaaagtacaactttgctccctacaatcaggtccggaaaggtatactttcggtagaggtaggtggaaaaaaagtttcccacataattgcaacttacaatccgacaagcgagacctggcggctgaccttgtattgtgtattttcactaaaggtcacccgccagctatcgtctgtcgaattgtacttcttctacggcactacagcccaaattgagccttggcctctacctttgcttgtctgtggctgctcttctccatacacggactcctaatagggcttgtgcgtcgctgtttactgtgtcttcccagcgctttccagccggtctctttccctgcattctagtattcagttatctttttgatagcctatcctctcccattcttaccacatgtccggcccattgcaatctttgtattctaatgaagtctgacaggggcgtttccttataaagttgataaagctcgttgttgtatcgacttctgaagattccgttttccctcacaggtcctagtattctccgaagtactttcctttcgaatgtgtcgagtttgtttttggatgtttctttcaggacccaggcttcactgccatagcatgttattggtcgaattaaggttttatagattctcctctttgtatttcggtggacacttttagaccgaaatatatgggagagggcaaaataagctctgtttgtctgcgttattctcttccatatttctccatcttctgatccgtcggcatatatttctattcccaggtatgtaaacttttcaaccgtttcaatgtctcatgattattttgttgttattgcgactgtaaattgttaatcaacaactgaattgtggctaaaacattcgtctaactttcaccggcctctgaagttagaatccataccaagaaagcttttatttcgccaagttatttaattattgataaataattacttgcaaaaaaatttatttgaaaattcgagattttgttgggaaaacccacattttctgaggaaaatttttgtcggagcaaatcgggaaaaacatgcctctatgcagaattaaattggggtgaatttttattttagtgtttttggtgtaaagttaaaatcttcggagttatagaccaataattg

SEQ ID NO: 2082 - DNA, 930 bp, Diabrotica virgifera
gacggaagactgcaagaggcattttaggctaaaaattcgtgacattttggatagactagtcagaaaatacggttgtgaatctcttactccttttgtaccaaataccgacacagtaatgtacaagaggcttagaaacttacgaaaactaaacgccagaaagaagaggaggaaagacgaagatagagaagatgagagtgatgatgaagaatttactgtaaaggctaaaccaaaaagcgtcgaagaaattttggcagattcagattcagaattcgaagatatggaaacagatgaacccaaagttaaaaataagaagcaagctaaaacatggattgaagaagatcctgacaacattgttgattttattgatccaagcgtcattagtaaaatcactgctaccaaacctggactcgtccaaccaacccttgaaaagaaaaagcccgagaaagaccgaggattcaaaacggctccggacggcaggcttataataaaagacgattcgtcgtcagatagtgacgatgacaaaaaactcaaattttctgatgactccgatgatgatgatgatactcaaagtaaagttgaaacggtactgctaacagatcgtaaacgcaaaagaagtaacgctagcgtcaaaagtggttttagttcggttagttctcaacctcccatgaaatataagactggaggtgttggtattcacaggtctttgggagctagcacttcttccgttaaaagcggatttagttcagcaggttctgaatataaatctaggaaagcgtctggagatgttaaaaagaaaggaaaactggatccctatgcatatttacctttgaaacgtacaaccttgaataaaaggaaaaagaacaaggctgctggtcaatttaagcatatcgtcaaagcagcaaaagcaggagctttaaaaggtgccaaggc

SEQ ID NO: 2083 - DNA, 657 bp, Diabrotica virgifera
gaggcgatcgttttgttaatttgtgcgacgtttgctgaaaatgctatttaccttggcaggggttatgatggagctgaagatccattaaaccttagaatcacaaaactgttggatgttaatttggaaagcaaaccaagttcttggaaaagtgacctaagtacgtactatcaacctcatagagaagaaaataatgatattgacaaaaaggatggttatgtccaggttcccatgaaattttcattcgcagtcgacgaacaacgcaatcataatattttggaagggtgtagaaatttagttggagtaagccagccatctttatgttttctaaagtcgtcttcggcagctgcagaaaagtacatcgcatatcccagaagttgtagagagattcaagaaattggtaataataaatctggaatatatgagattaagcccaggactagcagtaaaccttttgctgtcctttgcgacatggaaattcaaggcgggggatggacacatattcagaaaaggttcgatggatctcaggatttttaccgagagtggagagattacaagtttggctttggaaatctagatggagagttctggattggattagagaacattcaccatatgacatgttttgaagccagtgaactgttaatagaacttattgat

SEQ ID NO: 2084 - DNA, 1523 bp, Diabrotica virgifera
cacacgcgtccgatttgattaaggcaggaatagtcagtatgaaaacatacgtgatagtattttgcgttttaagttttactgtttccaatgtaattggacagaagaagaatcactttgctggaggaagaaacacgatcgtacagctgtttgaatggcactgggatgctattgccaatgaatgtgagaatttcttgggaccgaaaggatttgctggagtacaggtatctccaccaaatgagaattgtgtagtaaatggcagaccgtggtgggaaagatatcaaccagtaagctatcaactcattacccgatctggagatgaaactgcatttgcgaatatggtacgacgttgtaataacgcaggagtcagaatctacgttgatgttgtcattaaccacatgtcggggattactggtaatggtaccggaggaaagtcatctgatgctggttctttatcctatccaggagtaccattcgggccgaaccactttcattctcgttgtgatattaataattatcaagaatcgcacaatattagaaactgtgcacttaccggattaccagatttggatcagagtcacgaacatgttcgtaagaaaattgtcgagtacctcaaccatttagtagatctgggagtcgcaggatttagagtggatgctgctaagcacatgtggcccgctgatctgaaagctatttatgacagcgttaaggatctaacaggaaatggtttgagtggaagacctttcgtctatcaagaagttatagatttaggtggcgaggccgtaaagaaaaccgaatacaccagctttggagcagtgcttgaattcaaatacggttccgaattgggtaacgcttttcaaggccgtaatgatctccactggctaaaaagctggggtccacaatggggtctattagatggacttgatgctgtcgtctttattgataaccatgataaccaaagagatggatcgtcagctattctttcatataagaacccaaaaccttacaagatggcaacagctttcatgttggctcatccgtatggaaccacgaggataatgtcaagttatgcatttgatcatcgtgatcaaggtccacctgctaaacaagccggtttcaacactgacaacacatgtacaaacggttggatatgtgaacatagatggcgtcaaatttacaacatggtcagctttagaaatgctgtagatggtacaggtatcaataactggtggagcaacggccaccaacaaattgcttttggaagaggaaataaaggtttcattgcttttactttatacggagacatcaaacaaagccttcaaacctcactaccggccggtacttattgtgatgttatttctggtagtttagaaaaaggatcgtgtacaggaaaaactgtaaatgttgatagcagtggtaaggccgctatttctttatctactaatgaagaagatggtgttgtggctattcatgtcaacgcaaaattgtaaagttatatttttttctaaaataaaatattcaatatt

SEQ ID NO: 2085 - DNA, 1084 bp, Diabrotica virgifera
tcgtgggtcgatacaagcctctagagtgagtcaacattggtgaagagtagtactgtccaacggagcatgcgcagtgcgaaaaaagcacttgtataaataaaacgaaagtctgcgatcacttcttggctagtgcttgaaatttcagcatggctgacaaaagactatggctgtgttgttttttattattgacaattgcttacgctcaagatgaagatgatgacgattcaggggaaccacagatcgaccagctgtgtgaaaacaggcctgctgatgaatattttaggttaagcactgatggagactgcagagaagttgtaaggtgtacaaaatccggtctaaaacagatcacttgtcccagtggattggcgtttgacatcgataaacagacttgtgactggaagggaaaagtcacaaattgcgataaacttgagaaaccaagaaaagtccttccaattttgaaaaccgacgaaccaagatgtccagaaggaaagctgatgtgtggtaatgaagaatgtatcgacaaagatcttttctgtaatggaaagccagactgtaaagatgaatcagacgagaatgcatgcgatgttgatagtgatcccaaccgtgcacctgactgtgacccaactcaatgtgtaattccggactgtttctgctcagcggacggaactagaattcctggcgcgctagaaccagcaaatgtaccacaaatgataaccatttcgttcaatggtgccgttaatgtagataacatcgatctatatgaagaaatcttttcaggcactagacttaatccaaatggttgccaaattaaaggaaatttcttcgtttctcacaaatacacaaactactcagcagtacaggacctacacagacgtggtcatgaaatcgcggtgttttcattgactcataaagaggatccaaactactggtcccagggttcttatgacgactggttggctgaaatggctggagctagattgattattgaaagatttgccaacattaccgatggatcaataaattggagtgagagctccatacctcaaagtaggaggaaacagacaatttgaaatgatgacagatc

SEQ ID NO: 2086 - DNA, 1953 bp, Diabrotica virgifera
  misc_feature (1641)..(1641): n is a, c, g, or t
tgaaagtcaacattggtgaagagtagtactgtccaacggagcatgcgcagtgcgaaaaaagcacttgtataaataaaacgaaagtctgcgatcacttcttggctagtgcttgaaatttcagcatggctgacaaaagactatggctgtgttgttttttattattgacaattgcttacgctcaagatgaagatgatgacgattcaggggaaccacagatcgaccagctgtgtgaaaacaggcctgctgatgaatattttaggttaagcactgatggagactgcagagaagttgtaaggtgtgatctcaattcagatcttaagggcggtactcgattggcagcggtaaaatgtccgacaggacttgcttttgatcttttccgacaaacttgcgattggaaagtcaatgtcaaaaattgtgatatcgtagaaaaaccaagaaaagtccttccaattttgaaaaccgacgaaccaagatgtccagaaggaaagctgatgtgtggtaatgaagaatgtatcgacaaagatcttttctgtaatggaaagccagactgtaaagatgaatcagacgagaatgcatgcgatgttgatagtgatcccaaccgtgcacctgactgtgacccaactcaatgtgtaattccggactgtttctgctcagcggacggaactagaattcctggcgcgctagaaccagcaaatgtaccacaaatgataaccatttcgttcaatggtgccgttaatgtagataacatcgatctatatgaagaaatcttttcaggcactagacttaatccaaatggttgccaaattaaaggaaatttcttcgtttctcacaaatacacaaactactcagcagtacaggacctacacagacgtggtcatgaaatcgcggtgttttcattgactcataaagaggatccaaactactggtcccagggttcttatgacgactggttggctgaaatggctggagctagattgattattgaaagatttgccaacattaccgatggatcaataattggagtgagagctccatacctcagagtaggaggaaacagacaatttgaaatgatgacagatcaattctttatttatgattcatcaattacagcctctcttggacgtgtcccaatctggccttatactttatacttcaggatgccacataagtgcaacggaaatgcccacaactgtcccagcagaagccatcccgtttgggaaatagtcatgaacgaattggacagacgtgatgatcctacttttgacgaatcactacctggttgccacatggtagactcctgttctaatgttcaaactggagatcaatttgcaagactactcagacacaatttcaacagacatttgaattcaaaccgagctccgttgggtcttaacttccatgcctcatggttaaagagtaagaaagaattcaaagaagaacttattaaattcattgaagatatgttggcccgaaatgatgtttatttcgtaacaaacagtcaagtcatccaatgggttcagaatcccacagaactcagtggattaagagacttccaagaatggaaagaaaagtgtgacattaaaggtcaaccttactgttcattgcccaattcatgtccattacataccagagaactgccanggtgaactctacgattgtttacctgtatggaatgtcccaacaattatccatggattttggatccaactggggacggtttttcaacttaaaaataatttattatttatttagtttcttttttaaaataatccactgatttttttgttggaaaacagaataaaactagttcagggaactttgattctaaaagatttttggatatagctggaaactttcttctgtttcttttttaattataactggcttgccaacattccttctttgatttatatcaaagaaaaaccaaccatggtatgaaaataataatttgtt

SEQ ID NO: 2087 - DNA, 1248 bp, Diabrotica virgifera
  misc_feature (1155)..(1155): n is a, c, g, or t
  misc_feature (1170)..(1170): n is a, c, g, or t
  misc_feature (1207)..(1208): n is a, c, g, or t
ataaaaacacatctttgtcatacggtaacagaaaagttttggcatttgcatctactaaactaattcatcaattgctccaaattctagcttaaatgtctataaaaataatgtaattcaaatataacttgaaatataactgaaagcagttattaataataaatataatttaaagttaatgtctatgtgttagttcacatctaaaattagtaaaagttgaatcacagtagctactataaacagcaaaaataaactgatttttacatgccatacaaaaagcgtgttcaattttattgtacagctagttaaataaactttatccaaactgtgacgactattccttctctccaacattagtaaagtgacgtagatttaatcttgccatatgacaacacagagtccaatgggttaattcttcaaagaacaaatattttattataaagatgaaatagagtgagatatttatctaatagattccatttgttttgttttttgtcgttttgtggtttcagattaatgttcttttttaaaaaagtaaatttagaccacaaccatagcatcgttctaaatacttactaatacagcaaatcagaagtttaaagaaactatacgcaggaacatttaatgcacaattaataaaggtttgtttccttaaaaaccgtttttgatgaaacatcgatgattttaaagcaccaatgcagcttttcaaaaatgttgctgagctttgccagctgttgcataattgccttagcctctgctgacagaaattttaaaactaacactcttttgcttataaatcttgttatatacctaagtattcctaaggctcgtcagttgcctattgtttcatttattcatagtttttttcttaaaaaaatttcactatattttttatatattttatgtgttttttgttaaagttttgtttgttgttgggtaactgacaataatagtatgttggtgtggtttttcttactctttaatcagtgacctagattaaggtatgcaggatggttacttttatactcaatgttttattattatatccaaacttgtttaatataatagtatatagaatcatattatagtgacctaaagaaagtaactatatattgaaatatgacgtgtgatttgcttctaatggtctacatgtgattnagataaagtatgttnttacacctagataataatcataacaaaattatgattnnatgtatactacatgtgattagataaaaagtatgtttttta

SEQ ID NO: 2088 - DNA, 1051 bp, Diabrotica virgifera
gttctgatttgtgcataaacatctgtttatttaccacaccacagaccacgcttttaaatcatattgaatactaagattaattagagcttcttttgacaactcttacacttttttactaactctaaaactaacgtaacattatatttgtggtagtttaaaggttttttacgatgtttgtcgctatttcctttttttatcccaatttattttttttctttatgcataccattgacagttccatattcttttaagttactattaattttaaattccattgtgtttttacaacttcctcaacatagtttttatttcactggttgtaatgtacctctttgatgtgaaacctttattgacgcgattggaagcaatataacaatttggcagactgacttgtatgccatgacatcaagcgctatgatctatctggtgctgttatgtcccctttgtcgcgtaagtgtgttttagaaataatcttcatttttcttcctaacaatcaaagtctactattattatgaagccgtatttttcgcagtcaatattccaaccgcacacacattatatttgtggcgttcgtcgcttatgtaccaacacaaaactttatagtaatattgttttcaaaggaataatacgacgacatttcacatctgccacaccatctttcttgtctcttttaactgtgaaagtggtgtactcgttttcattgtcatatttccaattttattctagtttattatgttggtttttcgttcgatacatttaggatgatttatatttatgattgaagtcttcacatagagtttaagtattcacattcatagtgtggtattattaaagactataatctgacaagtcttgttaagttgatttacttctgctctgaaaatggatacgatacatgaaagtacaaatcaatttttctcgaaaatggtgcgccgtaggaacttaaaaaatgtcatgtcaaatggataaaatttttaaagacaaaaaagttatgaataaaaatgtcaaattacaatcctaaaagaaccgtttaaggcttcaattaaaacat

SEQ ID NO: 2089 - DNA, 950 bp, Diabrotica virgifera
  misc_feature (889)..(889): n is a, c, g, or t
caagaaacaaatcaagattttatgaaacacaagcaatgcaatggggatattgtcatcaaaagtgaaccaaatttattctgtgataaccaatctgtggacgaaggaaaactagaactacaaaaggtgaaagaagaattgcctagtgaggaatatgataaacttacaaattttgaagaagttatgttaactgaggaatgtaatcttccaattaaatctgaggctgacttagaagaaaaaacctccagtaattatcaccctcgagctgtatcaaatcaaaagcaagagaagtttttttatgcttcaataaaagagtatattaccaaaacaaaaaatgatagaaggaagaaacttaaaaatgcaaagtccattatcacatgtccatattgtggcaaatggtattataggaaaaatgagttactgaaacactttctaagttatcgtgtaaagaaaagtgtgtttgttaaaagatttatgcacaaaaatgacaatattttaaccaatatgaaagatggaaactccaacaacaagcctgcaacggaaaagaaagtatcatcaaaagtggcatgtaaactgtgctctaaacttgtagacaaatattatatgaatgcacacatattagttcataacaacaagcctgcaacggaaaagaaagtatcatcaaaagtggcatgtaaactgtgcgctaaacttgtagacaaatattatatgaaggcacacatattagttcacactggagaaaagaggtttcaatatcaatgcgaaatatgctttaagacatttcaatctaattccataaaaaaccatatgtatactcacttagaagaacacctatgaaatgtacgttttgctttaaacctttaggagaacccgacactttgaggcccacaantgttttgattttgaggaaaaagtatttaaatgtcatttatgttcaaaatcttttaaacgaa

SEQ ID NO: 2090 - DNA, 1529 bp, Diabrotica virgifera
gtaaaatacgaacgtatttctgatttttgtttcatcatgccccctaatcaaacatattgttatgaaaccataagctaatctgttattacaaataataaattattgaccttgaatactctcaacactacacattcttcagtatattacattttccggggaacggtaagtccccatcatgaagtgctttttaaaatatcctaaatattgtgatttccccatcgaaaaccttccatatggagtatttaccactccccaagagccttctccaagaattggggtggcaatagctgacctcattttagatttaaatgaggttgctcacttgtttataggtccggagctgaggaatcatcagaatgtatttaaagaagccacattaaacagcttaatggcactaagtccacaggcatggaaagaagcaagggaaacaatacagagccttctctctgaagataatactattttacagaatgatgtggatttacgaaaaagagcatttgtttcacaatctgaagccactatgcacttacctgccagaattggcgactacacagatttctattcttccattcatcatgccactaatgtaggaatcatgtttagaagcagagaaaatgctttaatgcctaattggaaacacctaccagttggttaccatggtagagctagttctgtggtagtttctggtacttcaattcataggccttatggtcaaacgcttgtaatggatggtacagatcccgtgtttggcccttgcaaattaatggactttgaattagaaatggcctttttcgttggtggttccaacaaattgggtgaacctataaaaatggaaaacgctgaagaccatatatttggattcgtaattatgaacgactggagtgcgagggatatccaaaaatgggaatacgttccacttgggcccttcttggctaaaaacttaggcaccacaatttcaccatgggtcgtgactactttggctttggagccttttaagactgacaattttcctcaagatccaaaaccgctaccataccttagacatactgataaatttaattttgatataaatcttcaagtggacttaaccccaaaaggtggaaatgtatcaactactgtgagtcgctcaaattacaaatatttgtactggactcctaaacaacaacttgtccaccacaccataacaggttgcaacgttaatcccggtgatttaatgggtagtggaaccatcagcggagagacatcagattcatttggctcgatgcttgaaataagttggaaaggtacaaagcctgtgagtctactagatggatctcaaagaaagttcttgcaggatggcgacacagttaccatgaaagcagtatgtgaaggacataacttcaatattggtttcggcacgtgtgttggtacactattacctgcaaaaaatcttacttggtaaaatgttgaattgtatattgtgttaataataataacatttgttctatattgaacaagtttgggcggccgctcgcgatcccacgcgtccg

SEQ ID NO: 2091 - DNA, 481 bp, Diabrotica virgifera
gcgttggaaacagaactaaataacaaattaacaaaatgaaatacttggttgttcttgcttgtgttgttgttgcggctgtggctagtaacctgcccaacctacccgaaggcgaaagacttaaactagctcaagtccacagagactgccaagccgacccaaaaacgcacgtcgacgaagacaaacttaggaaactcccaaactttgttgaagataaacaagttggtgttcatatgcgatgcatggtagtaaaagcaggattaatgaagcaaaacggaaaattggacgttcccagtattaccgaaaaattccgtttggtgatcaaggatgcttccaaggttaacgcattagtccaacagtgtgctgttgattctgaaactcccgaaaagacatctattctgttcaccctttgctgtgtcaaaaatgacattcagtattaccacaaattgtaaagaaatataggtcaataaacatattattttag

SEQ ID NO: 2092 - DNA, 1410 bp, Diabrotica virgifera
gcaaaatccccataatttttttgtggggtggccaaatttcactataattttattttaagatgttcctgccgtaagaatgatacatgtctattctgaataaaaaatctctaatagttttcgatgtattgaaagagatcgattttcattttgtaacttcaaagggctgtaactttttttacgagcacatttgtactaaggtagttaggttcaatcgaactattttgaccccagaatgtgtggtgtgatttgtgaccaatcttttcgggacaccctgtattattcgatgtaatttaacagcgtatatttcctagaaaatcttaacatctgctcatttcataattgcgtataaatttatattgttttagaaagagatcggacatcaatgattttaatatgttgacaatgagaagccgtttgacatggtaaacgacagaaaacatcattgctttgtcgtattccttgtgttaacatttcaccaaaaatgagtatttagaaagatcttagtttttactaaaaaaaaaaaacaattgcgatactctttacaatattgtctctttcatttttatgcgctttatttatattttctacaccagtttgagtaaacgtgttcattgttcatatcattctaatgtcatatcgtttcatagcactgtttaaggaaaaatcattttaatctcccttttggtttgtctaatgatcaaaattgggaaagagtgtgggcttgatcataataatactcagaattcttacattatctatgataaaaatgctgatttatgttgaggtgtacatacaacggatagttttgttttaagatcatctacacaagagtttaaaagcattttaaaaagaagtacaactgacagggacatactgtacctatattaaacggtaatctttcaaagattcttctatgcttcgatgctgcaagacactggataaacaaaaattatagtatcagaagatttacgacagtttttacgtaactgttttttatgaaactttttaaggggcgtagcccaaaaattttcgcttcaatgtgttttaaattcattcatttttcgaatcctgagacaactaatgaatgtttttgaaagatttaaacgcaaaatgaatgattacattactaccgaggggccgaaaggtccttagaataaccaaaaagtttcctttgaaagagatatttgaaaataaaaatccctaaatttttcccttcttttttgcccttgaaacctaattggaagtaaatttaaaaaagatttttatgggtcttttgggcccccggctaaaaaatggaaatttttatttttgccgtctgcgaattttagaaaaaattttatttcatttttctcccgggctcgcaaaagtgaattgaattctcccacctcttttgagagcaaaaattttttt

SEQ ID NO: 2093 - DNA, 1406 bp, Diabrotica virgifera
caaatgtcactataattttggtttaaggtgttcgtgccataagaatgccttatgtccattttcagtaaagggtctttaatagttttcgatatattggagaaaatcgagtttcattttgtaacttcaaagggctgtaactttttttgtgagcacatttgtactaaggtaagttaggttaaatcgaaacatttttgaccccagagtgtgtggtgtaatttgtgaccaatcttttcgggacaccctgtatatctatggttacaacctatgttcgacacagacactttcattgctgtagttcaggttaaacctgcgatttgggatcataaaaatgattcatatagcaacagaaatgcaaaggcaagagcttgcctgtccaaactttgaacggtctttgacaatgggatgcacccaaaatttacgtcgtttcattctttgtctgcgctttcgacggagcaacaaaagcagtgtttcttcgttcgaattcataattaatctgcttgtacagaccgcattttgttgccgttgttagctacaaaaagaagtcgaacaaaaccacaacaaacgccgatactagcgacaagctagcttctttttgctgccgacttcgacttcaaaaggtggttcgtctgtaagcagccttagttttatttatttttaccagttcatctacattaggtggtattgcaattcagagggttgaaagcagtgttcaacaaatgagagatgcatcgaaatcaaacggaacattgcactaaaatcaatcagattggcttgacgcatttatttttttaaatagttttgatgtacaagtttatttggaaaccaacgtgcagaagtacttataaactgattatgtttcccactttaattattattttttcggtacgttttgtcacatctgtaacattctactgacttctactgacttgccgtttttttataccatctttgtatttcatctccataatatatgcaatttgtttttatttttttcttggagtggtctaaggtggtatcatactttatgttaccttcatctggcttttaagtctttgtataagtgtttcccatttagaaaatttgtcctacctgtacatcctttttaatttttaaaatgtgtccttattatctggtttctatgatttggttatttgaaaaaaaggcccctttatacaaaagtttcaaaaaatttcaaaattcaaaacttttgctttgttttttcgaaaaggcttggttttaaaccccccttttttttttttttttaaattttaaaaaaaaatttatttaaaaaccccccctttttagagcggaaaagggagggaaaaaaaaaaaaaaagaaaagacacaggttttttgtgtgtggcgccgtgtgttttttgttcaaaccatttttttttatatttttt

SEQ ID NO: 2094 - DNA, 1058 bp, Diabrotica virgifera
gtattgtcgaagtaactgctggctttatttacttttgtcattatagtttcggaaattaggatctaattttgatcttagtgtattgtgacttttggtgcaatcattgcacaatgaagtttcgtcgatataaaatagaggggcctcatagcgtcctggcagatgatgaattttacgatgcgctagaatctggactagataaaatggaggaagagcaggaattgcgggacagattaaaaactggtccagtggtacctgtaactcctcctcctacctcaccagcctgtcaacatcggttatggccacagattgaaaatgttgtgaagtcccaagtgaatatggctaaaatgggaataggagaatcgggtgcggggtggcaactcttcgcagaagatggtgaaatgaaaatgtacagaagagaagaagaagtagacggcatggtatgtgatccacttaaggctgttcatgtagttaaaggaatttctggtcatgaagtttgtcactatttctttaatcctcaatacagatatgattgggaatccactttagagcacatgacagtactagagaccatatcggaagacacattagtgttcttacagactcacaaaaggatatggccagctagtcaacgagaaggtttattttggtcgcacataaggaagttacccaacgagaaagatagagatggtcccgatatttggacggttgtcaacaattctacagagtattcagagcaccctgcaaataacggtaaatgtgtaaggatcttcttaacagtatgcctactgtgtcagacgacagtggatcctccaaaagatggtacaactttaacaagagataacttatcttgtaaaataacgtactgttctgtagttaatcctggtggttgggctccagcttccgtattgagggcggtgtacaaaagggaatatccaaagtttttaaaacgctttacagcttatgttaaaaatcaaacgaaaaataaacctattatgttttaattatgtcagggtctattttactacacatctttgtttattgtataattattaattatt

SEQ ID NO: 2095 - DNA, 943 bp, Diabrotica virgifera
atctgtcagtgagttcacggtgaggtgtggagtaatgagaatcatgagtttcatcaggtgctaatgcaacttccaacaaaaacagatttttttcgtaaaatgtgaacgtgttagtcagtcaaaatagcatcaaaatgccggtcattgatggttataaagtactttacattttattacacagtttatatacaatttttgaaaatatttggaggactcttttatttatttatcaaaattgtataagggttataaaccctgaatctacattcgatgatgctgaccagttaaagaaaagactgtctagactaacaaaaaagcctcaacatttaactatcattattggtgtggaagaatattcattggtagatttggctaacctcgtatattggtgtttaggtcttaatattccgtacgttagtttctatgattataaaggtaatttaaaaaagcatgaagagaagttgcaacaaattgtagaatccagaaaatcagagaatatcaacataatttggcacacccatgcagaacaaaggcataaaaatggatttttgggtccaaaaatccacgtaaaagtgttaacacacgcggacggaaagcaaagtatagtaaatgttactaaaaaattagctctaaataaagaaaaagacattagtaaagaaaaaattagtgaattactattaaggcagtatgaatttccagatccagaaatggctattatttgtggaaagaaactgaacatttataattatcctccttggcagttaagactcacagaattctttaaagtcaacaaagtcaacaacatcacattcccagtgttttgtggaaaattggaaaagtacagcaaatgtgaacagagggtgggaaaataattgttttataaaaaaactgttttttgttttggttatctttattattaaagaaattaaatgaaattggtaag

SEQ ID NO: 2096 - DNA, 1298 bp, Diabrotica virgifera
ggtgagtcaactattctgtatttgtgtttgtgtgtctataggtacaccaaaaactaattgtgtcaaacagttggtaccagtaatgtcaataaaaattcacttagatgatccaggtattctttctccgggagctacaatatcaggaactgtaatatgccattttgaacacccggaggttgtaagagggattacgtgtgtatttaaaggtagagaatatacccactgggatgtacaacgatcaagaaatagtgttaagttccatggaaaaaatgactttgtgaatcaagtacgacagtttgcccatgctgggacactaccagcaaggacatacaaataccaattcgtgtttaacttaccagatcgtcagcttccttcatcatttctccacgattgtgcagcgaaacaatattttatacatgattcatacgttaaaccattgggatttgattatgttttttctgtcagtttgcattatttctctcccggtgacttgaatgatgtaattcgaatatatttatttctcctggttattaatataatgacattccgcatttctattttaaattcgaactgtatcactcttcttttaaatttcatataaaataagatgcccttatttgagggaaaactttttttgtaaaaaaaaaggaaaaaaaactttaattttgcgggttttaaagagaaatttgccttttacacggttaaaatttttgggggagggacccggaaaaaaaaaaagggaaaaaaaagagaaaaaaaatggggtcccccttttgggacaaaaaaacaataaaaaaaagaatttttttttaaaaaaaaacccaaaaaaaattttttttttttttttttaattgtttttaaaaaaaaacggggggggggggggggcggtttttttttcccccccccccggggaaaattttctcccctttttataaaaatggggaattttttttgggggggagagaagggggggttctttttttttttttaaacaaaaaaatttttttttcttttttttccaactcttccctcccgccgcttttaaaaaaaaaaaagagggaaaaaaaaatattcccccccccccccccccccccagggggggggttttcccataaaaaaaaagaaaaaaaaaaaaaagagagtttttttttttttttttttttttttttttttttttttttttttttttttttttttttttttttttttttttttttttttttacacgcgcgcggggggggggggggggggggggggggccacccccccccccccccccccctttcttctctatcgag

SEQ ID NO: 2097 - DNA, 1503 bp, Diabrotica virgifera
  misc_feature (1452)..(1452): n is a, c, g, or t
gcggattgtaatgctttttgttggcattagatagcgtgtttataataaagaagcaataagcgccaaatattcaattcttgagcctctcgaaccgcagtattcatttctaagacatatttatccgttttaaagaagtttgtaatacaaaacagaagagctgctgttgttttacttaaaatatatgtagggtggaagatagtgttaggttaactaatgaagttgagcccaaaatagtgacacttgcgtttttaggactaataccaccaataccgtaatgatgccaataggaggagctcctccggtgcacggctctagtagtttatcacaaagtaatacctcacaaaatgctagtttaacacctacaggtggatccagcaaatccagtagtagcttgaagccaaattatgcccttaaatttacgctagctggacatacaaaagcagtgtcttctgttaaatttagccctaatggtgaatggttagccagctcatctgcagataaacttgtaaaaatttggggagcatatgacgggaagtttgaaaaaaccatttcaggacacaaactaggaataagtgatgtagcatggtccagtgatagcagactactagtgtctggtagtgatgataaaacgctcaaaatatgggagctatcctcaggtaaatgtctaaagactctcaaagggcacagcaactacgtattctgctgcaactttaatcctcaatccaaccttatcgtttctggttcttttgacgagtctgtcagaatatgggatgtgagaacaggaaaatgtcttaagacactgccagcacattcagaccctgttagtgcagtacatttcaacagagacggatctcttattgtcagtagcagttacgatggactttgtcgtatttgggacacagcctcgggtcagtgtttgaaaactctcattgacgatgacaatccaccagtatcctttgtcaaattttcaccaaacggcaagtatatattggctgctacattagataacacactcaaattatgggactatgccaaaggaaaatgccttaagacttactcaggacataaaaatgaaaaattctgtatttttgctaatttctcagtcactggcggtaagtggatagtgagcggatctgaggataatctggtgtatgtatggaatttacagaccaaggagattgttcaaaaactacaaggacatacagatgttgttttatgtaccacctgccatcccacggagaacatcatcgcgtcagcagccttagaaaacgataagacgataaaattatggaagagcgatacttaaaatctaatctaatatattaattttaagttttctctagtaaataagttgaagttgtgttgatacagaaataagtattttttttagattttaatttttaagattattgtacaaatgcaagattgggttcataatttttttctccatgntagtttcatgttagatgttatttttgacgaaatatattttaaagtttatag

SEQ ID NO: 2098 - DNA, 931 bp, Diabrotica virgifera
gccaaatataaaattttggtttgatttttctgttttatttaattttaataaaatgactaaaactcgagcagcagaagttttatctttggaaaaatcaaaacaaaaagaagttgtcaaagagacaaaacagttaaaaaagaaaataaaggatggaaccgtcacagttaaaggtacaaagaaagctctaattgcagcccaagagcaaaaaagaggtcttatatttatatcccacttgcctcatggtttctatgaagatgaacttaagaaatacttcacacaatttggtaaagttaccaatgttatagtttgtaggtccggcaagacaggaaacagcaaagggtatggctatgttgagtttgtgaacccagaagtagccaagattgcagcagaaactatgaacaactacttaatgtttaagaagcgaataacagctaattttgttgcacctgaaaagcgaccaaagggattatttatgggcaaacctaacacaattactaggtattcctccaaagttaggaggcaaaaacaatatctggttaatataaagctggaccctaaaactcaggcaaaaagaaccgctaatagactgacaaaaataaataagaaactggaatggctaaaaaatgctggagtggagacttcattcacaccttcaaatctagaagttaaacagaagaaaagtgttccaagagttagtaatacacacaaagaacttgattttgattcagatatagagctcaagataccagttaaaaaagctaagagtgcagttactagtagtaaaaattcaccaaaagtactttcaactaaagctagtaaatcaaataaaaaattaaacaagtctgtatcgtcagagtctgaaaaaactcccatcattaaaaagaaataaataaagctagtaaaactaatatagtagaagatacatcacctt

SEQ ID NO: 2099 - DNA, 805 bp, Diabrotica virgifera
gtgatttaaatatttcagtacgatctctcgatgatttacgacgcgaattgtgtttgttcttcgatgtgaataaaatattttttcttgtggtggttcttaattatagtgtgtgagattttggaaacacaaccataaaaagataaggagtttcctgtagtcagcggtgattcccaatgtttcgtttaaggcagaaaaaacattagagtggagatggctcaattaattatcaaaaaatgtataccagtgcgagctataatatggatactgtgcttcacctgcacattattcctttacatgttaagaataaatttgtccattataattctggctatggtacagcccatgaccaaaggcaacactacttttgtaccggaatgtaaactacttaggcaatctacacacaacgagagtatcgtagctgaagctcttcattctgacccgccagattatggtactaaatttgaatggagcacagaactgcaaggattgattctgggatcttacttctggggattcaccatttccgcaattcctggaggagttttagcagaacgatttggtccgtccaaatgtatcaccatctctttcctagtttgtggatttttgaccttattaggaccatgggctgcaggttgggatgcctgggttttaatagcatccagatttttgataggattgtttgggggcgtagttttcccaagtcttcactgtttgattgcccgctgagcgccgcccgatgaaaagggcaaatttataggatcccttttgggcggtcactaggaactgtgataacctggcccctctt

SEQ ID NO: 2100 - DNA, 952 bp, Diabrotica virgifera
  misc_feature (909)..(909): n is a, c, g, or t
  misc_feature (913)..(913): n is a, c, g, or t
aatcaaataaatgtttcattatttgtgtgaaaagttatttattaacattattcatcttttgctaaaaaacagttgagattattgcaaaatgttattgcattttgaaagtaaagatgtaaatgtgttacaaatgatctatttgtagttttgtcatcattatgttttgtttttccgtccattgttgagtatatttcttcataaataaagtatcagatgatgtttatatataatacaataatttttattctttaatcgcttcaatatttgttataatgtcttcaatttcaacatattgtttttttttgtcgtattggtctttttagtgtttcctgccacctctaaccaattattaggcgattttacatgaggattaagcctacagatgtcaaaatggcgtcatatctatcgaatgacaactgacagttgaagtgtcatatttaaattatgatcatactgttccgtctttcttcgtctgtaattctaattcgttcataacgatctacctcctcttttcatttttttttgtgtagttatttaggcatttttaagtctacgactgtcaaaatagtgtcaactgacaagttggaagtgtcatacttaaattatcaccattttatcctgactccctttgtcttcaattttgatttcataataatttttatttcagtgcccacttgaacctttttttataatttacatatctcatagtcatttttaggcgtttaacttacaacattgtttccacacacattttccagcttcgatatcagttattgatttacaataatttaaatttgctcctttatacaaatgtaacaacccaattccaacccttttattaattttctttttgttttgataagatttatttgcacccaacaattctagcgaaggaagaatttccacaangttnaaaacaaacttatttcattttgtcaaccttttaattttc

SEQ ID NO: 2101 - DNA, 1198 bp, Diabrotica virgifera
gtaatgtgacacaacgtctatagacgttgcatttttcgctattctactttgcaaaatacatattgggaccgtgcaagttcggaaaagcggcacctggtttcatagctcggcaacttttttcgcacttttaattatatttgccaatcatattcgtcctcgttgctggataattgtcaaggccgtagcccaaaaaaaattataagaagaaaaagaaaattataagaagaaaagtttaggttatgttattaaaagataaacaattgtatgtagtaaataaaattagttactaaaattcagtactgcaagcaaaatacagttaattaaatatacttatatataataattgcatatcatatcaatattgtgagcaacatataattgctcttcttcaatgacagtaggtatgaaatatacgtcaatttgacaatttcagttgataatatgaattatttaagaaagttgcaagattttttcgctattagcgcacgatcgtttctcgtattccctccaagtacttgcacaccgcgaatagtgtcacaacacttgcttatacatttgacgcagtgtccgtcaacgtgttaaaaaaaactattattggtttatgattagaactaaagagtcaccgtatgtgtttttatctcacacttcgtcaaagtttgtctacttttataagttacgtactgaagtataattaatcattttgttaatcacttaataatttataaaatactaaaaaagtcttatcaaataaaatcaaatgtatgcaacttacgatacattggccgattttaaaaaaatatacccttttacagcttacctatcccctctgtggcttagtggtaagagagcctacctttcgattcaaggattgtgagttcgaatcccagttgggttgaaaactattctttattaaaaatttaataaataaaaataagttctatccttgtgggatcggtactcacctgagggaccgcagacttcggattcaattaccatgtctttgtaaagacaataaagtcaactttactaagtaacaagacacttactcaacataaacactacacattacactattgggaccgtgcaagttcggcaaagcgacctctatttctacgctctgtacttttattcgcacttttaattatattggccaattatattagtcctggttgctggataattgtcaagaccatagtcc

SEQ ID NO: 2102 - DNA, 1125 bp, Diabrotica virgifera
ttttgaaacttcgtgacagattccgtgagtgataccagagcttttaaatggttttacttgctctatgatctcatttaaactaactttagaaaatggcacccaccagccattttgaatgattacaccactaaaacacattgacatattaagcctagactcggcatactcaccaaaaaagcgtaacgcggaaacagcatgtaaacagtcgatcggtggtctatctatctcttttaaccaagcgacttttcacatgtgactgacaaatatggctagaccactcaatcctatgtcggcgttacctcgatgcattgagtggcatatccctagccaagtctatcctctttacatgtctctgctaaaacatcgtagaaaaaagtgctttaggccataggtttgttccaactcgatagacgcatgcgcaataacgaataattatgtgcagtaacacatttctcgttactgcgcatactcgtaaccgttcaagaacggtttttgtgacggtttggagcaaacctcttatagctaaaaatttattaaattttatgcttcagaaaataacaagagaaaagtaaatcaacatagctatactatggtataaaaaaatctgggcataaatttctaggtacgaaaaaaaatcaataacacaaaatatcaacaagagaataacaaacaaggacaggaataaaataataaatacaaaccaaaaagtgaaatgaaatctgaaaaatcgatgaaaaattaaaattaactcaatgatgaacgagaacatggcaccccacataacagatatccgttatcgaatatattaacttaaactatagaagtggattaagaacaagacttcaaagatcaagataaaaaattgtctagaaaaaagtgttttatcctcttctaaaaaaacttttttttattgttctgaagctatttctttgtggcatcttatggaatttactattttacttgtgaaacaagccacaatccaagtcgaaaattaattttattgacgtttcgactaaacagctgtgtttcagcgctttaaaactacgtttcagtctggtgaatggtatttttccgtttgacactgatagttggttttgttttgtattctcacctgttctatgaact

SEQ ID NO: 2103 - DNA, 1198 bp, Diabrotica virgifera
  misc_feature (1066)..(1066): n is a, c, g, or t
  misc_feature (1146)..(1146): n is a, c, g, or t
agaaaaataataagaagaaaaaataagattcaggttatgttatgaaaacgtcaacaattgtatgtagtaaataaaattagttattaaaatgcagtactgcaagtaaaataaaattaattaaattaacttttatataataattgcatatcatatcaatattgtggagcaatatataatttttctgcttcattgacagaaggtatgaaatatacgtcaatttgacaatttcaattgacaatatgaattacttaagatagttgcaatatttcgccgcgactcgcgcatggtccaaaaagtaacaacaaatgtgttcaacaaagaattaaaaaaatatagagtatgcaaaaattttatgtcttaaccacattccatatacttattgataataaagtgtctatcagtatgatgttgatatttgaaaaattttatttgttctcgacaatttatggtagctattttaagctaatttagaatataagagacctccacgtttcatagtaaatgacaataagtgccacaaaattaagtctgatctcaattccttcgattttatgtagaccggtacgtataaactataaaaagggattaaatgattacaattatgttgattttttttttttttcaaataaatgtccgaaactggtaaatgtttgatgatatcgcaaaactcctaattgaaagcgttgatatttcctagaaccacatacaataaccaaaactaaagacataatccaagactttgatataataatatagacctacataatatattacttcggacatgtaaagaaaaagacgaagatctaaagaaaaaaaagtcatgaagtcgataactgacataatcaagcgatatgatgatatatgaatcttacagtaacgtatttttatccaaaataattgagttgtaaagaaaggagagtgatatgagattccaacattaatttgttaaagtaaacaaaaaagaaatattgggaccgtgcaagttcggaagagcgacacctggtgtcatagctcagcaacatttttagcacttttaattatactactgggatgaggaaatcattanaccaataaggaactcatttccttgtccagtagtataatggactcgcattggcaacccttttagcatttttaattatattnggcaattatattagtcctagttactggataattgtcaggccatagcccaaaa

SEQ ID NO: 2104 - DNA, 1444 bp, Diabrotica virgifera
tattgaaaacagtttgtctataagaatgaagatgtctttatttaacctattcttataatcaatagtattattgtacagtgtggtatcttgtactattgtagaacatcatgatatagtcgcaattagtatagataaattttaaaacaactcgccaattttcacgcgcaaatttgatacatcattaaatctctatgataaatattatatatattattttttttaatattatgtacgcgagttgctgtgaatatgatagggtcatatccaacttggtacctatgcattttggatgtatcaaagttgcgcgtgaagttaggcgtgctgatgacagttgatcttttgggctgcaccccctagggggattattattccccctaggggaaattatttctaacttaaatcacaaggtggcgatggtgaatatctttctcgacaaaaagataacatatttcccctttttacagcaaaaaactagtataataaatcaacaccttccacagataagactagacacctatgtaggtatcacagtggagcaagaactacatgtaaagatgaaactaatgctttatatacaaatcgattaaatccttttcaaaatcttcacttatcgcaatgcttgaagtagaagaaaatatatggattgaaagaggtctcctcttctactgaaaaattttgtcaatgaccagagagtagtattgggaccgtgcaagttcggaaaagcgacacctggtttcatagttcggcaacttttttcacacttttaattatattggccaatcatattagtcctggttgctggataattaattgtcaaggccgaagcccaaaaaaattataagaagagaaagtaagatttaggttatgttattaaaaggtaaacaattgtatgtagtaaataaaattaaattattaaaatgcagtactgcaagcaaaatacaattaataaatttacttttatataataattgcatatcatatcaatattgtggagtaacatataatttttcttcttcaatgacagtaggtatgaaatatacgtcaatttgacaatttcaattgacaagatgaattatttaagaaagttttataaagtaggaagaacaagaagtcattgtgtatcattatcattggattctcattgtgtatcatgattctcattgatctttttatgttctattaccagggcgtttcgtctacggaaaacaggtggggctattcccgataggacgagaagcaggattagagataagattcttcgttctccaggattggagtgggaagcatctcaacgattcaattacaattgggaccgtgcaagttcggcaaagcgacctctatttctacgctctgtacttttattcgcacttttaattatattggccaattatattagtcctggttgctggataattgcggacgcgtgggcggacgcgtggtcggt

SEQ ID NO: 2105 - DNA, 1392 bp, Diabrotica virgifera
gatcaccctaatttatataaatttctgatttggttttgccagtgtcattaacttaggaaaaaattcatttttgattaggaaatgtttatttttatgtcttaaacttattacgcctgcgtctggtcttttatgtgcgtcagatcctgattcggtctcgaatgttgggaatttgttgtgttaatatggtttagttattggatctatattaaatttatacatttttacgtaatatttataaatttttaaccaagaagtgtaatgatgtttagtttggtatgtttacggttagtcgggatcatattgttttgattcttgttactcaatttgtttactcttggctatagctaaaaaatgaatttttgtcttaaacttatctaatattttcagattcaaagtaaagtggtcatacctgtgatgaataaaaaataaagaagtgttagtaaaaatgaaataacttgagtttcgtttgtgttggaagtttgcagttaaaccagtggcatatgcatccgacacaatgcgataatgaataaaaagtgggcgaatgggtgaacaaaaaataaaatttactattttaattgggaaataagccacaatttaagttgagatcgaaatacattttgtatttcgataacgacctccggagtggaagtcgaaacgtcaataaaatcatttttcaacttaaattgcggcttatttctaaattagaatagtaaattacataaataccacaaataaatagcttcagaacaatatttaaaaaataaaacataaattatggtaactttctgtggaaactgactctaaactctctaaaaggagtgggtaatcattctgtgaatgtaaagccaaattcgtgagttgttgtatgacttacaagattcttactctcaaatttgtttccaatgcttaactctttactcataggcgaaaaaagtgaaaattgaccgtttttgaccttaatttgttaataactaattaagttcaaacaatcgactgcagaaaacatataggatcttcttatagaggtccatactactcaaaacgactgtcgtttgcctggttgggtcagcatcacgataaaaatcttagttccttggaggaatcagctattttacgagtgcaattaatactggtgcagccattttctaaaaataagtaaatccagaaagtgagaaaattttaaactttagagaagaatttaaaacgccgcaaaatatttaaaataaaagatttgtcaagactaacaggctcaaccaaataaatgatcactattaaccaaagtcacagcgacatgcaatacacggtattgggaccgtgcaagttcggcaaagcgacctctatttctacgctctgtacttttattcgcacttttaattatattggccatttata

SEQ ID NO: 2106 - DNA, 1628 bp, Diabrotica virgifera
  misc_feature (35)..(35): n is a, c, g, or t
  misc_feature (689)..(689): n is a, c, g, or t
  misc_feature (709)..(709): n is a, c, g, or t
  misc_feature (1402)..(1402): n is a, c, g, or t
ttaaagtccgaatatttccgtgacgtcatacttcnggtgtccctaacgtactctacgccacatagtggcaaatatgacctcgcgttctgacgtttaccttgtcggagaagcctataaaatgacaagaaataacaatagttacctatcttaatatagatgtaataacaatcatattaaaggtaaaagaaattagtacctcttattgggaccgtgcaagttcggaagagcgacacctggtttcatagctcagcaacatttttagcacttttaatttattggccaattatattagtcctggttactggataattgtcaaggccatagcccaaaaaaagaataaagaaaaagtaagcattgaggatatgttatttaaaagtagacatggtactacaagcgaaataccattaattaatttcactttaataattgcatatcatatcaatattgtggtgcaacatataatttttacaattgataactcaccatttgcggaataccattttctttattgacaccttttatgaaatatacaattatttgacaatttcaattaaacatttaaattattttttaagaattacgataacacaaattatgagtttcttcgggtgattagtgtatacagggtgagtcaccactaacgcgacggaagattacagcgaaatggtaaaagattgtaaaacattttnaattagtgttttgtaagtgnataaaatctacatttaaaatttattttgaaatatacagggtgtcccaataaatggcggcgtattaaagttatattttttcttacggaacaccctgttttttattgcattttttaattgtccgcaaaaaacaaggtatagtttcataagtcttccctattgggaccgtgcaagttcggcaaagcgacctctatttctacgctctgtacttttattcgcacttttaattatattggccaattatattagtcctggttgttggataattgtcaagaccatagtccaaaaaaataataagaagaaaaaataagatgcaggttatgttcagcaaacgtaaacaattgtatgtagtaaataaaatcagttattaaaatgcagtactgcaagcaaaatacaattaaataaatttacctttatataataattgcatatcatatcaatattgtggagcaatatataatttttctgcgtcaatgacagaaggttgaaatatacgtcaatttgacaatttcaattgacaatatgaattatttaagatagatgcaatatttctccgcgacacgcgcacggtcgtttctcgtttccctttccaagtacttgcacaccgcgaagccctatgtacagagtgctccgagttacgttgacccttcttaaaatgtaaagttttaaaagaattaataatatcaaattatagngaacttgcacattttttttattagataataatgtacagttttgtttaaaaatgagatttccaaaatttcactcttcaaaaactcgtaataacttagaaatacatatttaaagtcttctacggtataaaatagttcaaacggcccgtgacgtcacatagttttgcattagttttgattatggttatatttcgctgtgtctaggtacacgccaacgtgtacgcaaata

SEQ ID NO: 2107 - DNA, 1251 bp, Diabrotica virgifera
  misc_feature (87)..(87): n is a, c, g, or t
  misc_feature (122)..(122): n is a, c, g, or t
  misc_feature (140)..(140): n is a, c, g, or t
ggatgttgcagattacttaaattgataatacagattatttagggtaaaatgaagtaaaagattatttacttaaaagacaagttaatnataaaggaatgaaagagaatatagcttttataaanagctaatagtgaacaacntgataagtatgcctgcaaacctatcttattctattagctatacggttgcttgcatttttgcttaaaagatagtctcttttattcctttatggccaaaattatatacattttacatttaactggtcatatatataatccttccactcttaacttttcaacacgcatggaattattcacgaatcaccaatatggcatgtagttgatatcttattgtgacagtgacattagcgtatttgttggatattatttcaatttattgattatttggattttcaaattattcgtcttttagtctttatacaatatgttattgtatttcttattttttaacaatttttgttagtacgactagctaccgtcctctcttaatttggttacttccggtaagtgcctaatatttttttacgtaaacgtgacaagtaatatttatgagtgtggctatagttctgttgaatgtaaaacttaattgtttatgtaggaactgttctcctgtaactttcagtcaatttagaatattttgtgactgcagttacaagatatttagattatacagtgatgagcgcgccaacaaccggcaaaataacgcaaaagacggaaaaaatattaagttgtgagataaaaagaaatgaaactagtagagtcgggaaatttagcgacaaaaacgaataaatccacattatatccactgttcttcacctctagaagtatcagaggagtatgtcaactaaaactgtcactttcacagtggcatttgccaaactcgtccgattgggaccgtgcaagttcggcaaagcaacacctggtttctacgctcagcaacattattcgcacttttgattatattggccaattatattagtcctggttactggataattgtcaaggccatagtccaaaaaaataataagaagaaaaaataagattcaggttatgttattaaaacgtaaacaattgtatgtgtagtaaataaaattagttattaaaatgcagtactgcaagcaaaatacaattaattaaatttacctttatataataattgcatataatatcaatattgtggagcaatatataatttttcttcttcaatgacagtaggtatggaatatacgtc

SEQ ID NO: 2108 - DNA, 1803 bp, Diabrotica virgifera
aaaaataataagaagaaaaaataagattcaggttatgttatgaaaacgtcaacaattgtatgtagtaaataaaattagttattaaaatgcagtactgcaagtaaaataaaattaattaaattaacttttatataataattgcatatcatatcaatattgtggagcaatatataatttttctgcttcattgacagaaggtatgaaatatacgtcaatttgagtttaatgatgcacaattttttattacttttaaagtgtttttaaaaattcgttaattacgtgtgaatattaactctttaaaatggctcgacatcgaaaaggcgttatacgacttccttttagttactagacaaaaaccaaaagcagatgaagaaaaactacaaaatggaactcgacttggaagacttgaatatctatttagtttcagacgataattggaagatattctttgatcggtcgttcgatgtagagcagctaaaaacccacttcagcactttacaagagaacgatagaatagactgtctcaaattcggaatatcttgtatccttaattttgttcagtgtaacttcactggtcctgacttatccaaagaaataaaggattatttaagtaaagatacctacgatacacttaactttgcgaaactgttgtcggttaataatgaagatattaatatcaataccagatacccggcattgctagtgacttccaagatcatttttgaacattgtgctgttgacaatatgattaataattggtggtattggcgatctattttagttcatcaagaaattttagaggaactaagtccttctttgctctctgatgctgatagattgtacaaacatttccagatcaatcctgatttaagtatcaacataaaatcctcattggacatagaagtagctcaactctacctactctttaggcatatatccaaagcaaaagaacacatcttgtcagccatagaaaaaataagatgcaggttatgtttagcaaacgtaaacaattgtatgtagtaaataaaatcagttattaaaatgcagtactgcaagcaaaatacaattaattaaatttacctttatataataattgcatatcatatcaatattgtggagcaatatataatttttctgcgtcaatgacagaaggtatgaaatgtacgtcaatttgacaatttcaattgacaatatgaattatttaagatagttgcaatatttctccgcgactcgcgcacggtcgtttctcgtttccctttccaagtacttgcacaccgcgaatactgaggtcagttactgtttaaaatcactgttattaaaaaatcatgattactgtttatggcttaattcaaaaatcaccacgttcaccattgctgacctaaacaagccacctggatgctgaccgacgaagctctggcatacagtaatactgagatggtaccactactgccactacttatatcgctaacacatggtcatatcgacccattttatcttttagatgcatctctcctacattccgaatcaagaaaaggtttttattaatctatttcccatttccagataaaatttttgatatttaatcatttagtagttgacaaattgatttaacttgaatttggtattgttaaaatataactcttcatttcagcatagatgagttcaattggtttaagttaaaaatgataaggtgctaatcgctatatcgtagctccatctttttttgctacatcatctataatactgataatataaactgtccttcataatctaggatttatcagataaataagtgctttcttc

SEQ ID NO: 2109 - DNA, 1933 bp, Diabrotica virgifera
ataattattgtcaaggccatagcccaaaaaacctttagaagaaaaagcaagattgaggttatgttattaaaaggtaaaccttatatggaaatccacttttctatttgtatttctttgtgcctagaaattggaaccgaatagaatttaaattgacaatttattgttgtattttttgcactttataacatagcatttgcgaaatcccattttcttcaatgacagtaggtatggaatatgtcaatttcaattgacaataaggaaagttgcaagatttctccgctactcgtgcacgatcgtttctcgtatcccctccaagtacttgcatacagcgaatagtgctttgtccaattattttaaggtcagacgtctctgcggtgcgccatgcaaaagttctttttcccacttggaagacttgaatatctatttagtttcagacgataattggaagatattctttgatcggtcgttcgatgtagagcagctaaaaacccacttcagcactttacaagagaacgatagaatagactgtctcaaattcggaatatcttgtatccttaattttgttcagtgtaacttcactggtcctgacttatccaaagaaataaaggattatttaagtaaagatacctacgatacacttaactttgcgaaactgttgtcggttaataatgaagatattaatatcaataccagatacccggcattgctagtgacttccaagatcatttttgaacattgtgctgttgacaatatgattaataattggtggtattggcgatctattttagttcatcaagaaattttagaggaactaagtccttctttgctctctgatgctgatagattgtacaaacatttccagatcaatcctgatttaagtatcaacataaaatcctcattggacatagaagtagctcaactctacctactctttaggcatatatccaaagcaaaagaacacatcttgtcagccattgaactgcttggcattcattacgatctaatgggtgctttaggaaaaaggacaaagtttcaagagagagaaatagcacaactatcccttaaagtaacagttactgaaaaagatattataacaagggatcgtggtatagatgatatgacgacagtgatgtacccatggatgttccaattaatgatgatgtccgtcttaataccatagaattcactgaagatttaggaaatttggctaagttgggcagtttggagcagaaactatttgttaccattataaaagatatgttaatatctaaacctccagacgaattgcaagtcgaagagattatgccatttattgacgcaattcttaagcagaaaaatacatttgctgttcgagtagttaccttattgcttagatgtaagttagaaagtaaaactagaagaaccatagaaagggcattaagtcagagcgaagaaattattaagagcctgcttagagagaaaccagtagcattaaaaagaatcacagatgtctttggaactggcatgccaccagtgtggaagattgaaacacagtatgccgatttgttgcttaatataggcctggttaagaatgccttagatatttatttaaagattaaactttgggaagaagttattgtatgctacactatattaaaattaaggcataaggctgctgaagttattctggaccaattgaaagagaagcctactgtcaagctgtggtgcttattaggagacgcaacagacgacattacgtgttacgtaaaagcttgggagttgtctaaacgccgtagtcatagagctcaacgtcattggggccagtttctcttcgcccgtaaacagaacgaagaatgcattccacattttgaaaaatctgttaacattaatccactacaatccaacgtcctggttccgactgggttaagcagcccttcaaacagaaaattgggca

SEQ ID NO: 2110 - DNA, 1874 bp, Diabrotica virgifera
  misc_feature (1036)..(1036): n is a, c, g, or t
cattgacaatgacatattaagcgtagactcagcatactcatcaaaaaagcgtatcgcggaaacagcatggaaacagtcgatcggcaatattgtgaagcaacatataatttttcttcttaaacgacagtagatatgaaatgtacgtcaatttgacaatatgaattatttaagaaagttgcaatatttctccgctattcgcgcacgatcgtttgtcaattcccttccaagtacttgcacaccgcgaatagtcatcaatagtgctttcaatgggaaggttaggaaattgagtgtatgaacgaaagaggaaattgtcagatataaatttaagggaagtataaaagttaactgtttttacttattgaacaatttgtctggctaaataggtctttaatctaagaccaaaaatactatttgtcttcctccagtggccagggctatttcatgaccgaccaaagtccactgactattagagtgtattagtgatgcaacggatatacgtattcgcattcgcgaatattcgcatatttttgcatattcgcattcgcgaataagtttgtgcgaatgttttgcaaatatgagtatcagaaaaaaaattaagataatattaggttaataaaaccaaaatctattcacttttcatctttttttattaaaaaaaggtaacttaacctggtataatcgctttatcagccttcacgttattttattattttttattatgtaataaagcttaagattcaggttgatttacactaaatatcaattaacttcttattataaaaaatattagttacaatataaaaatagagtcaaattaattactcttttgctttgatgagttttgtgcacacgattatgtcatattcatatccacgcaatatgaatttagcagtttatcaagctatgttagatatatctatagggtgactggaaaatccctttacagtaataataatgtgtcaacaccgcgccaatggccgcgttcaccagtaatactcgctttacgtttcgactaaacagctgtgtttcagcgctntaaaactacgtttcagtctggtgaatggtatttttccgtttgacactgatagttggttttgttttgtatttctcacctgttctatgaacttaacctaaaacgagattcgttgtttttgtttataactatcgttcaacgataacttggacgtgtcaaacaaatttaattcaaaaatggataatattttacctttattgttgtttgataatgaacaagaaataatttctggtgctgttaatgctgtgctggactaggcagaaccattggatgatgtattcccattagaaagaaataaataatgtcacgagaaatatgaattatgttgaaaatattgttccttaatacacagatttacaatttcgtgagcatatacaattatgtatctccttagtttcaattatgtactttataattaaaactattgtaaaagtaaatattttcaaatagcgcgccattacaataaatttcctaaacacgttaactatattaagcggtgtaaatctacgctgaataaaatggcgacggctttgtcaaaacgttgaagtttagcttaaattcacagtgacatttaccagaaaaagcttaaacagtttcgaagcgctgacacagcgcactggtctggtgaacgtgcccaatgtttgacggcgttccatcgcatgaaccgcacttgagagttcagggaactgctcacactgtttattttcaacaatatgactctccaccccattttactcttactgtccgcaaaccagggttggcaggtttaaaccaacatgcttaaaatcttggtttaaatcaactggttttttttagaaaaaaaacctgggcccggactacg

SEQ ID NO: 2111 - DNA, 2077 bp, Diabrotica virgifera
  misc_feature (2034)..(2034): n is a, c, g, or t
  misc_feature (2069)..(2069): n is a, c, g, or t
aatattccagactacaaacccttgagggactttcttaaatacgatttcttccagacattgtccgtcatcggtgggctgttgatgatcgtttacttgggacccgggggtgtttctatggacgagcacaaaaagcggtggtagaactatgtgattccaactagtgaacatcttgtgacaacaggtttataaatccagaaaaactgtcgactcttttttataccattatatacgcgttccttttttctctcaacattaaaatattgcaaatgaaaaaccaactggaattcgagagattactgttgtgttgtgtaggaacaactgcgaatgcgtggatacaagtttggctagacagtactgataatttggtaattttatataatagttcttccgtatccaatttttttaaccattttattggtgtatttatgctaatttttcccatatatttactcgtaactttggctaatactacgatatgagtagtaggcgttatgaattctgcctgttagaacatatacatatagctattgggaccgtgcaaaggaaatggcatgagtttttcatcaaaatttcaaaagacaactacttaacagagaaaattgtgataaaaaaatactaatttgtctactgcccggtctgtctgcctcgtatatatttccgaataagacatatttcgcacaagaacactctaaaaagggtaactatattatcatgttctgctacataattttttcaagaacgatatgtaggagtatatcaacacatgacagtatatgtcataggagtagaatttgtcagtctctatgtttgaattgttaaacaacacagcattttaacatcattttggcctcgcatgaccttatcagacactggggctgaatacaaaatcaaatacaaaattccaacaaccgcctcctctcactaagtaaatatttcctacttaaagtaatatcatacaaatactactattgggaccgtacaagttcggaaaagcgacacctggtttcatagctcggcaatattttcgcacttttaattatattggccaatcatattggtcccggttgctggataattgtcaaggccgtagctcaaaaaaaaattataagaaaaaaaagtaagatttaggttatgttattaaaaggtaaataattgtatgtagtaaataaaattaattattaaaatacagtactgcaagcaaaatacaattaattaaatatacttttataatataataatagcatatcatatcaatattgtgagcaacatataatttttcttcttcaatgacagtaggtatgaaatatacgtcaatttgacaatttcaattgacaatatgaattatttaagaaagttgcaagatttctccgctattcgcgcacgaccgtttctcgtatcccctccaagtacttgcacaccgcgaatactgtacttgtgctcttatgacatgtactgtcttaaatacatcaaagaaatagcaagcttttgctagaagacgtaaatttttacatattagtacactacaactgcacctgtcaactaccctaccatgtgatataaagttacctttgcagatatgttgatcaaataataatcaacaacttctttgacatttgacagaggtggtttgtaatgtagttatacaagtgttatgacgtgtaatattcattattaactaagtatagcaggtattaaacagaccgggcctgtagattcttgttttctacagaatataaagaaacacgttcttgtgccatcacataacttttaattttgtaacacaaagttctatttttgtataaaagtttttaaaattaaggaaacctaataaggcctaacaaactccattttgcaaaaaattaactattcatgtttgcccaatgattgttttgaacaataatgtgatttctgggtatgctaacttgtcaagatgttcttttatgtataattcagctgaaagaatattttgggaacgtgtatactgtagttttttccaaaatgatttaatcaagctcactcccacgtttaaattanaaaatcacaaaaatatctattctaagtgcttttgntacctacc

SEQ ID NO: 2112 - DNA, 1994 bp, Diabrotica virgifera
cttgtgacaacaggtttataaatccagaaaaactgtcgactcttttttataccattatatacgcgttccttttttctctcaacattaaaatattgcaaatgaaaaaccaactggaattcgagagatcgctgttgtgttgtgtaggagcaactgcgaatgcgtggtcagtaaatgttatacaagtttggctagacagtactgataatttggttattttgtataatagttcttccgtatccaatttttttaaccattttattggtgtatttataatttttcccatatattcactcgtaactttggctaatactacgatatgagtagtaggcgttatcaattctgcctgttagagcatatacatatagctattgggaccgtgcaagttcggaagagccacacctagtgtcatagcatcagcaacatttttagcacttttaattatattggccaattatattattcctggttactggataattgtcaaagccatagcccaaaatagaataagaagaaaaagtaagattgaggttatgttattagaagataaacattgtacgtagtaaataaaattaattattaaaatgcagtactacaagcaaaaatacaattaattaaattcacttaaataattgcatatcatatccatattgtggagcaatatggatgtgatatgcaattatatcaatatggagttatatgcgatatcccattttctgcctatgggagggggtgaaatacacgtcttttttgactatttcgattgcccccctgaattatttaagccaaagtaaaaaaatttttttttttcacccaaattttgcgcactatcgttactctatccccctccttttaccttttccacataatgaccatcaagtctttttgataaaaaaaaaaaaaaataaaaaaccctaaaaaacctcatgtggtgtttttgcccgtgaattgttggtattagtggcctaaatttgccaaaatttcaattttaaaacctttgccccttttggtttttttataacccgctggttctgggggtgtacaggtattgttatagggatgggcccagttcgccaaagcgtccgttttattttctgtctgtatgtgggccacgcttttttaattatattggccaattatatttagtcctggttgttggataattgtcaagaccatagtccaaaaaaaattaataagaagaaaaaaataagatgcaggttatgtttagcaaacgtaaacaattgtatgtagtaaataaaatcagttattaaaatgcagtactgcaagcaaaatacaattaattaaatttacctttatataataattgcatatcatatcaatattgtggagcaatatataatttttctgcgtcaatgacagaaggtatgaaatatacgtcaatttgacaatttcaattgacaatatgaattatttaagatagttgcaatatttctccgcgactcgcgcacggtcgtttctcgtttccctttccaagtacttgcacaccgcgaataggagttcatcagattcactcccgtgaagcaattatttatcactctcctcgtcactattttcttggtatgcactttttggtcaaattccgtagcatcattgtccattaaaatcttagttcttcttctcaatcttagttctcttatcaataaaaaatttgaagtgtcacttgtacacactaatttactacactcaacaagacttgggaggaaacttataaactgaagaaaaatatacactgaatccaccaaaataaataattcttacacgtgtcctggcacctggcagattcgattgagatagttactgacaaaggcttccgagtgtattaaatctctagtaaaattagtcagatctctcgagaacacacttgtaaaattataagtattaaaatattatggcaaatgttaacgaggttgcggggtgcatttctaccccacagtcacttttccaaaaaaagcccttaaacgcagagttttaaaatc

SEQ ID NO: 2113 - DNA, 932 bp, Diabrotica virgifera
  misc_feature (865)..(865): n is a, c, g, or t
caagcagaactttaattttttctcgtcaaattccaacttgcgatacgtcaaaatggcacacagcgattgcacacaacctaaaaaaatatgtatagtcggcagtgggaactggggctctgcaattgcaaagattgtaggtaacaatgcggagcgattggataatctggatcctagagtcacaatgtatgtttatgaagagatgataaatggtaaaaagctgactgaaattatcaatgaaactcatgaaaatgttaaatatcttccaggccataagttaccacccaacgtagtcgctgtaccagatgttgtagacgctgccaaagacgccgacgttctgatcttcgtggtgcctcatcagttcatcaggacgttatgcgctacacttttaggaaaaataaaacctactgcagtagcattatcacttataaaaggattcgaccgcgcaaaaggtggcggtatagacctaatttcccacatcatcacacgccatttgaaaattccttgctcggtccttatgggtgccaatttggcaggagaagtagccgacgaaaaattctgcgaaaccacgataggatgcaaagacgtatcacttgggcctctattaagggatatcattcagactgactatttcagagtggtcgttgttgacgatgaagataccgttgaagtttgcggtgctcttaagaatatcgtagcttgtggtgctggtttcgtggacggtctcggtctaggagataacacaaaggcagctgtcatccgtctaggtctgatggaaatggttaagtttgtagacgtattttaccctggcggaaaactggcaaccttcttcgaaagctgcggtgttgccgaccttatcactacctgntatggaggtagaaaccgaaaagtcagtgaggccttcggtaaaacgggtaaaactattaaggaacttg

SEQ ID NO: 2114 - DNA, 1215 bp, Diabrotica virgifera
aaaagagtgaggaaacaggttaattataatgacggaggaatgacaactgacacacgagaagatacgacatggcaagaaaatctctctgattaccattctgacttttctgcgggatcggatgaggataaggaagacgatgatttcgatgagaagaacgacgccgatttaagcagaaggagtcgaagaaagatggaaaggaaagacgagaaggatcgtcctttaccaccgttactagccagagttggcggcaatattgaagtactcggttttaatgccaggcagcgtaaagcgttccttaatgctattatgcgctacggaatgccaccacaagacgctttcaattcacagtggctggtgagagatcttcgaggaaaatctgagaagatattcaaggcttacgtgtctctctttatgaggcatctttgcgaacctggtgcagataatgctgatacatttgcggacggtgtgccgagggaaggactgagtaggcaacatgttttgacaaggattggtgtgatgtcacttataagaaagaaggttcaggagttcgaacacatcaacggcgagtatagcatgccggaagtaatcaaaaagagcattatggatcaaaataaaatcaatgccgccggcaccgccaccacaagcgaagcagaaacgcctaaaagtgctactaccagtactagtgctacgccagctacaagtgctgctcccagtcccgctcccacacaaggagaagataaagataaggataaagattccgttcagagtgacgaaaataaagataaagaagtggttaataaaacggaaaccgaagatgaagagaagaaaacgggagaatcttcaacagaaaagccgaaaactgaaccggaagaagtgaaagaagcttctccgaaaaccgaaattcccgaagctagttccgaagctgataaatctgagatcaaatccgaagtcgatacctcgtctgtaaccagcgaggaaaagaaagaagagaaagaggaagaggccaaaaaggaagaacccgaagagaccaaaatggaaatacaggaggaggaacttgttaaagaggagaaaaaagaagaagaggatgataagaagaaggaggaaattaagaaagaggtggaaaagaaggaagaggatgacgttatggttattgatgatgataaagataagaaggacaaaaaggaaatcgatctcgaagccaagaagcgtttcatg

SEQ ID NO: 2115 - DNA, 1527 bp, Diabrotica virgifera
aatcgacctattttagttgatggtaaagatgtaatgcctgatgtaaatgctgttcttaatcacatgaaaagctttacagaacaagtgttatctggtgcatggaaaggatactctggcaaaaaaatcactgacgttgtcaacattggtattggaggatcagatttaggaccattaatggttacagaagctttaaaaccttacagcaaaggactcaacctacattttgtttcaaatattgatggtacccatctcgcagaagtgctaaaaaaagtcgtccccgaaactgttctgttcataattgcatccaagacatttaccactcaggaaacctgcacaaacgctaaatcagcaaaagattggttcttggcaacagctcaagatcctgctgctgtggccaaacactttgtagctcttagtacaaatgctgaaaaagtttccgaatttggaattgatactgccaatatgtttggattctgggattgggtaggaggtagatattccctgtggtcagccattggtctgagtatctcattatcgattggatttgataacttcagccaattgcttgatggaggattcttcatggatcaacatttccagtcagcttctttagagcaaaacgcacccgttattttggctctcttgggagtttggtatggtaacttctttggatccgagacacatgctcttcttccctacgaccaatacctacataggtttgctgcctacttccaacaaggtgacatggaaagtaatggaaaatatataacgcgcagtggtcaacaggttaacttccaaactggtccaatagtgtggggagagcctggtactaatggacaacacgctttctatcaacttatccatcaaggtaccaaaaccattccagcggactttatcgccccggccaccacacacaacccaattagcggtggaacgcatcacaagatccttttggccaatttcttggctcaaaccgaggctttaatggccggaaaaactccagaagttgctaaagccgagttggagaagcaaggtttgcaaggagaagctctccagaaaatattaccacacaaagtttttctgggaaatagaccaactaacagtattgttgttaaaaaggttactccatttattcttggagctttatttgctttatatgaacaaaaaatcttcacccaaggaattatctgggatattaactcctacgatcaatggggagtagaattgggtataacagtggcgaaggcaatcgagcccgaaatgcaagactcttaaaccagaatccttcttcaccatgggatccccaaacgggcttatcaacttccattaaagctaataagttccctattttttaatacgttggaatcaggaatggaaaattttttggggttaaaaaatgaaaatcttttatttgaaatgtgtgggcgttgtttttttaaaaaaaaaaatgggggtaaaatttggaaaaaaaaaaaaaaaaaaaaaggggggggcccgcctctttaaaaggatatccacaacctttta

SEQ ID NO: 2116 - DNA, 1415 bp, Diabrotica virgifera
cgcgagcgtccgctcgcgatctagaactagtccagaacattacgcgggcgtccggtagaaatggagccgaaaccacttttaactactgaaccttcttggcaaaaacttcaacaatattatgatagtaaaggcaataaattagtcatcaaggaccttttcgcaagtgatcctgcaagattcgataaattaagtttaaaaattgctactcctaatgatggcgacatactcattgatttctcaaaaaaccgcattgatgaagaaggtttgaagctattgcttgacttggctcgttcaaggaaagtagaagctgcacgagatgctatgtttaatggatccaaaatcaacttcaccgaaaacagagctgtattacacatcgctttaagaaatagatcaaatcgacctattttagttgatggtaaagatgtaatgcctgatgtaaatgctgttcttaatcacatgaaaagctttacagaacaagtgttatctggtgcatggaaaggatactctggcaaaaaaatcactgacgttgtcaacattggtattggaggatcagatttaggaccattaatggttacagaagctttaaaaccttacagcaaaggactcaacctacattttgtttcaaatattgatggtacccatctcgcagaagtgctaaaaaaagtcaaccccgaaactgttctgttcataattgcatccaagacatttaccactcaggaaacctgcacaaacgctaaatcagcaaaagattggttcttggcaacagctcaagatcctgctgctgtggccaaacactttgtagctcttagtacaaatgctgaaaaagtttccgaatttggaattgatactgccaatatgtttggattctgggattgggtaggaggtagatattccctgtggtcagccattggtctgagtatctcattatcgattggatttgataacttcagccaattgcttgatggaggattcttcatggatcaacatttccagtcagcttctttagagcaaaacgcacccgttattttggctctcttgggagtttggtatggtaacttctttggatccaaaacacatgctcttcttccctacaaccaatacctacataggtttgctgcctacttctcacaaggtggggaaagggaaaaaaaaaagggaataacgcgcaaaactcaaacggtgaacaacaagactggtatcatcctaagaggagagcctaaaacagtggggggggggctttttccctgccaatccatccagggaaaaaaaccatttccttttttattttattcgccccgggcccccaccaaacaaccccaattaagggggtggaaacgggattcccaaaaatcctttttttgggccaattttcttttgggctccaaaacccggagggtttttttagggggggcggg

SEQ ID NO: 2117 - DNA, 1249 bp, Diabrotica virgifera
ccatgtatctcttgtagtctaaaataaagtcaatttcaccatagtacgctatttaattcaatacatatcatattggcgacgaatcggaaagaacaccacgttggtataagtcaataagtcattgcaaattttgtgttcagggcagtagtcaatatgccaaagttcgatgagtttaatgctgtgaaggaatcgtttgaagcctgggaagagcgcttgcagcagtatttcatagtgaacgacactgaaaatgaaaaaaaggtagcaaatttaataacatttatgggtgcgagaacgtatgatacgttgaaaacatatttattcccagatacccctgcaatgaaaacatacgatcagttagtaacgatacttaaagccagatatgcaccagctacaagtgtaatctatgaaagatacagatttcatagtagaaaccaacaagcagaagaatcgttagagcagtatgtaaaagaagtaaaagcactgtcaaagtcttgtaaatttgagaaattcctcgatcaagccctacgagacaggttagtttgcggtattagtaatactaatattcggactaagttacttagcgaagctgagaccctaacgtttgaagatgcttgtaagaaagccttaagtcaagaagcagctgaatgtcaaagcaagcttgttcaaggggtggcagcagtatcagtaggcaaactacaaatgtctagtaagcaatatcgtagtcagtcaaaaagtcagtcagagtccaggaaccagtcagtgttgaaaccatgctttcgatgtggaagacgacatcaaccagaaacatgcccagcagttaattgggaatgtttttctgtcaaaaagtgggacacaccagtagagtctgtaaaagaaaaaaagttaatcaggtagaagtgactgaagaggaagagagcagtgaattgttgcaattaggtcatattgcagccctcacaacgggtatggaaaagccctggaaagtgaatgtgcaagttgaaggtgtgcccttggttatggaaatcgatagtggtgcatgtaagtcaatcatccacgtaagtgatttttcaaaatattttaataaatgcaagatgaacagtactaatgttaaatttagagcagttactgccaataacatttcatttgtagatcaaatttatgtaaatgacttgtaccaaaataagatctaccctgtatgccctgataacacatagaatggtaaaatagcatatggcattctgttattttttaa

SEQ ID NO: 2118 - DNA, 844 bp, Diabrotica virgifera
  misc_feature (195)..(195): n is a, c, g, or t
  misc_feature (209)..(209): n is a, c, g, or t
  misc_feature (224)..(224): n is a, c, g, or t
  misc_feature (229)..(229): n is a, c, g, or t
  misc_feature (253)..(253): n is a, c, g, or t
  misc_feature (281)..(281): n is a, c, g, or t
  misc_feature (294)..(295): n is a, c, g, or t
  misc_feature (575)..(576): n is a, c, g, or t
  misc_feature (663)..(663): n is a, c, g, or t
  misc_feature (736)..(736): n is a, c, g, or t
  misc_feature (742)..(742): n is a, c, g, or t
atatataagggtccgaattattttcatattttaaaatatgtttaactaaatttttatatattattatttttattttttataaattttttattaaaatataaatttaaattatttttttttagtaatgatgataatattagtattaaaaaattgtatatttagtaaaaatatataggtttaataaaggaattaggnaatattttttttangtgtttattaaaaanatgtntttttgtattaaatataaagtatngaatggttattgattaatttgaatgggngaggtattttganngtgataaggtagaataacgtccagtttttttattgaaagttggaatgaagggttggatgaaaaaaaaattgtgtttatttaatttataaagaattttatttttaagttaaaaagtttaaatttttttaaaagaagagaagaaggtatagagttttataaaattattaataagtttttttagtattaaatttatttatataataaatttatttaattggggtgattaaaaaataaatttaagtttttttatattattatattaattaataattttttgatnnaatttttttgattataagaataaattatgttagggataagagggtaattttattggagagtttaaattgataataaagattgtgaantcgatgttggattaaagtttataattggtgtaggaggtatattattaagtgtgttcgaattttaaaattttanatgatntgagtttaaaggggtgtgaggaaggttggtttttatgtttaatttattaatatattttagtacgaaaggaaaaaatatataaaataatttttatatttagat

SEQ ID NO: 2119 - DNA, 857 bp, Diabrotica virgifera
cacacgcgtccgcccacgcgtccgccggatttttaaaaccttgtaaaaacattttcttattaatacattttaaattacactcattatttttaaattttagacgtaaccaactaacatcagcttagtctacaatggctttagcaataattttgagaaattcgactagaattcaagcatccccaaatattttcaagactgccatcgctataaactcaaggaagtcattcacacaacttactactggagccaataaaaatttgaatattttaccaagaattaatttggctagctatgtgaaaaggaatatgtctgctgatcacagcaagctatggccaatagaaagggctgtatcaattgcccttttgggaatcaccccactagtttttatatcccctaatactgctctgaatgacatttttgctatcgccactgtagctcatttccattggggattggaagcttgtgtggtggattatgtaagaccaatcgtcgttggacccgttctaccaaaagtgactcttgctttgttgtactttctttcaatttccactttaggaggacttttgtattataatcaccactccgccggtattgggtaacgctgttagagatttctggaagattaagaaataaagaataaatgcaatggcaccttttttgttaactttatatttaatgtatattacagtatttaataataaataatatataaagtttcttttaaaaaaaaaaaaaaaaaaaaaaaaaaaaaaaaaaaaaaaaaaaaaaaaaaaaaaaaaagacgaatcaaaagaaaaaaaaaaaaaaaaaaaaaagaaaaggaaagaaaaaactgggggaaaaaaaaaaatgggggg

SEQ ID NO: 2120 - DNA, 1558 bp, Diabrotica virgifera
  misc_feature (1492)..(1493): n is a, c, g, or t
  misc_feature (1522)..(1522): n is a, c, g, or t
  misc_feature (1540)..(1540): n is a, c, g, or t
cttcgatgtttcacgaccatttcctaacgggctaatgagttagaaaaaaccgtgtttgtagtgaaaagttcttattcttatgatatattttgcatttattcacgtccaatgaggtcaataaagtaaccaaaaagaagttcctgtcgagaccaagtactttaagaggatcacgctgttcacttcaacagactggaggggcacaaggtgcctttgctttccacttcggacccacaaagcacgaggctagctccgtccggctctagtccagatatggacgatggaggcaaacgacaagccaccagggtgttcaagaagagttccccgaatggaaagattacagtatatttaggtaaaagagatttcgtcgaccacatatcatgcgttgatcctatagatggcgttgtattaatagatcccgattatgtaaaagacagaagagtatttggacatgtactcgccgcatttaggtacggtagagaagatctcgatgtcctaggcttaacatttcgcaaggacctctacttagccgccgaacaaatctacccgcaagacagcccacagcaaaacaaacgacctttaacaagactgcaggaacggttgattaagaaattgggatcaaacgcttaccccttctatttcgaattgcctcctcattgtcccgcgtccgtgacgctgcaaccggcaccaggagataccggcaaaccatgcggcatcgactacgaactcaaggcgttcgtcggagaaagccaggacgacaaaccgcacaagaggaattccgtgaggctggccattcgaaaaattatgtatgcaccgaataaacaaggagaacaaccgtccgtcgaagtgagcaaggaatttatgatgagtcctaacaaattatacttagaagcgtctctggataagaaattgtaccaccatggcgaaaatatagctgtcaacgtacacatagcgaataattcaaatcgcacagtcaaaaagatcaaagtgtcagtgagacagttcgctgatatatgtctattttcaacagctcaatacaaatgcacagttgctgaaactgaaagtgaagaagggtgtccgataggacctggcttcacacttagcaaagtttttacgcttactcccttactggccaataacaaagataaatggggcttagccctcgacggtcaattaaaacatgaagacacaaatcttgcgtctagtacacttgtagctgatatgtcacaacgagaaaacttgggaatcatcgtccaatacaaagttaaggtaaaattgtgccttggtgcattgggaggagacctcgtagctgaattaccttttattttgatgcatcctaaaccagaagaggaaattttaccgccagccactccttctaggcgtgtcagtgaagacgtcagaagtgacgtaccagtcgatgccaacttaattcagctggaggaggaaaatcatgacgatgacataatttttgaggatttcgcaagattacgattannaggaggagaaactgatgcatgggaagcgngtactgggccaaaacccngtccatttgtacccctac

SEQ ID NO: 2121 - DNA, 935 bp, Diabrotica virgifera
tagccgtctgacagtccgaagttgtaatttcaaagtgttttcatttctcaataaactaaattaaaataaataaatcatggctactcttgaagatgtttctatttgggaagatggagaggaagcattaggtgaagaggttttacgaatgtccactgatgaaatagttagccggacacgtttactagacaatgaaattaaaataatgaagagtgaagttatgagaatcaatcatgaattacaagcccaaaatgagaaaataaaggagaatactgagaaaattaaagtgaacaaaaccttaccgtacttggtgtccaatgtaatagaactgttagatgtggatccccaagaggaagaggaagatggtgcagttgttgatctggactcacaaagaaaaggaaaatgtgctgttgttaaaacttccactagacaaacctactttttaccagtgataggtctggtggacgaggagaagttaaagccaggtgatttggtaggagtaaacaaagattcataccttattttggaaacattacctgctgaatatgatgccagagttaaagctatggaagtagatgaaagaccaactgaacagtattcagacattggaggtctagataaacaaatccaagaattaattgaagctgttgttttacctatgactcacaaagataaatttgttaatttgggtatacatccaccaaaaggtgtgttgttatatggtccccctggtacaggaaagactcttttggccagagcttgtgctgcacaaaccaaatcaacatttttgaaattggctggtcctcaactcgttcaaatgttcattggagatggtgccaaacttgtcagagatgcttttgctcttgccaaagagaaggcaccagctataatattcattgatgaattagatgctatcggtaccaaaagatttgattctg

SEQ ID NO: 2122 - DNA, 1450 bp, Diabrotica virgifera
tgacagtccgaatttgtaatttcaaagtgttttcatttctcaataaactaaattaaaataaataaatcatggctactcttgaagatgtttctatttgggaagatggagaggaagcattaggtgaagaggttttacgaatgtccactgatgaaatagttagccggacacgtttactagacaatgaaattaaaataatgaagagtgaagttatgagaatcaatcatgaattacaagcccaaaatgagaaaataaaggagaatactgagaaaattaaagtgaacaaaaccttctattacattggacaccaagtacggtaaggttttgttcactttaatagaactgttagatgtggatccccaagaggaagaggaagatggtgcagttgttgatctggactcacaaagaaaaggaaaatgtgctgttgttaaaacttccactaggcaaacctactttttaccagtgataggtctggtggacgaggagaagttaaagccaggtgatttggtaggagtaaacaaagattcataccttattttggaaacattacctgctgaatatgatgccagagttaaagctatggaagtagatgaaagaccaactgaacagtattcagacattggaggtctagataaacaaatccaagaattaattgaagctgtggttttacctatgactcacaaagataaatttgttaatttgggtatacatccaccaaaaggtgtgttgttatatggtccccctggtacaggaaagactcttttggccagagcttgtgctgcacaaaccaaatcaacatttttgaaattggctggtcctcaactcgttcaaatgttcattggagatggtgccaaacttgtcagagatgcttttgctcttgccaaagagaaggcaccagctataatattcattgatgaattagatgctatcggtaccaaaagatttgattctgagaaagctggagacagagaagtccagcgtactatgttagaacttcttaaccagttggatggattcagttcaacagctgatattaaggttatagctgctaccaatcgtgtagatatattggatcctgctctactccgttctggtagattagatcgtaaaatagagttccctcaccccaatgaggaagcgagagctagaatcatgcaaattcattcaagaaaaatgacagtcaatcctgatgtcaactttgaggaattagcaagatcaacagatgacttcaatggagctcaatgtaaagcagtctgtgttgaggcaggtatgatagccctaagaaggagtgctacagctgtaactcatgaagattatatggatgcaattatggaagttcaagctaagaagaaggcaaatcttaattattatgcttaattttgtagttttttataaagataatttataggtattaaaaaaaaaaaagggcggccgctcgcgatctagaactagt

SEQ ID NO: 2123 - DNA, 902 bp, Diabrotica virgifera
  misc_feature (704)..(704): n is a, c, g, or t
  misc_feature (813)..(813): n is a, c, g, or t
cgactgactatagaatttttgcgatataaagtatgaaaatattatattggtgaaactttttgtgaaattaaaggaaaaatggatatagaagaagttcagtcagttagtgtcaggaaacttatttcagcctttgaaaaccaaactaattctcctgaagccacatactttagaccaaggactagatcattgggcaacatactagcaaaaaatgttactgttagagaaaaccaatttgcaacattggatgaaataagtgacgcattggaagtaatacaacaacaactgcaggtttacgacatatacaataaagaaagacatgttgcattccaagaagaactattcaacattctgaccagcattattaatatcgataatgatgatccaatcagagcccgtaatcttatctccactactaaacatttagtttctgtgctgaacaataaacttccatctaataattctgtcgaacaccgatataccaaatattctgagcaggtcaatggtacacatcaatccaatatactagttaaaaagaaagaaacatcgaaaactaataataacatcaaacgggaaaacagtgttgacctcaacaaagacatagtcaagtcgactaaagaaacaaaaggtataggtttaaccaggtctgtttcagttaaaaagcttaaagagctctttcaaagtgacataaagctatctgaacttcncacccatcaaaacaaatatgagtccaagtccgaacaaacagtcaaagtcagcaatacgttaaagaaaagttcaactactaccactgtggtaactgttcctgaagctgtntatagagtaatcaaggatgaacgtgtttatcctttaccagaatactacccagtagaaacagcttctaaggatacagactatgcaatttc

SEQ ID NO: 2124 - DNA, 923 bp, Diabrotica virgifera
aggtggtagacaatgggtgctaatcggcattccattggagaagaggatctgtatgatccgaacttattaaaaaatctagattggacttctgtgcaatctagtttgaatcctgaaataagtagtgacaatccgggagaatcatggattgtagtaagacctttaaaactatccgattacgacaaaggttttctgcaaatcttgtctcaactaaccgaagttggaaatattggaaaactcgaatttgaacgccagttctggaatatgcgtaaagctggaggatattatgtaaccgtcatagaagataccaggagtaacactattattggttcgtcaacattaataacagaatttaaatttattcatgactgtgctttacgagcacgtttagaggatgtagtcgtcaataacacttatagaggaaaacaactaggaaaactgattgtcttaacagttaccctactagcaaaaagattgggatgttataaaatgtccttagactgcaaagatccactgatagcgttttacaagtcccttggatataaactggagccaggaaattccaactcgatgatgttgagatttgaaaaagtggatccatcctgacaattagccgccaatgcatccccaaaatcaaaactttaaattagctgatctgttcttattcatgttcatgccaattattggttttcatcaaaatatgttttcactattcaatcattaaaatattttttcactattcaatcattggactgagtaatcaaattttacaaatagttaaattttttttatttgctatggatgcattggtgcttcgggaccttattttatttttgtagttatttttgtattaactacatcactaataaatatttttatttaaaaaaaaaaattttttaaaaaattggaattacgttaagtgaaaa

SEQ ID NO: 2125 - DNA, 1084 bp, Diabrotica virgifera
aaaaagattgtcattgaaaaaaatactaaacatcaatatttcccattctaaaataattaaaattgtaaaaatgccacaagaaaatggcttcagaactagacaggttttaatgtaaatactaaaggcccatgcggcaattgtgactgtgtctatctttagattttgtatacatagttgtcagatttcaatttgcattccaaaaggtatttttgttttttggccaaacggctgagtttagaaaggaatgttatggcttttttgctctacatggtgccttctacctatacctttaaggaacgcactattttcggggacaccctgtatttataattatattaaacaaggcaacaaagtcctcgttagttgcctaaatgtcttccggtttcatgttcttattctattgcttcgtgtgactcccctgtggatatttttccatatcattccaccgtggtgtccggaatttttacttttacttcaatttctacactttcacaacactaagtactgttagtaattggtttttctttaccttttatcatcaatcttttgttctcgctatattttgttttgttgtatttgcaatagaagataaatatttcttttaaaatgcactataaaaaaaaagaaatattaccaactgtatttgttaactgtatacctatctttgctagatttcgccaaagcaacatttttttgcttaaaatcacaagtactaactattttttgattttattttcacctatggcacacagcagtgctcccaaattaaaaataaggtgttatatttcttcagctattaatgattttcgagtaaggagctactctttctactgtaaaagtagaacaaaatcatcagtagtactagttttattaaaaatttccattcatttaaaaatgtagttctgaaatattgtgatatttttgtgtttatagcagtattttgctcaatttttgttaaatatcagtagttaaagaaccattcccaatttgtgtgttcaatacctttgtattttgattggttttgttgtttaattttaaataaagattaaagatataaaaaaaaaaaaaaagggcggccgctcgc

SEQ ID NO: 2126 - DNA, 999 bp, Diabrotica virgifera
ctaaaagaaatgtattacaatctctcgattgtttttttgttactagcaagttcatctgcatttacacaagacaataatttaggcataacacaaacacaagacaataataaaattactctcacaatacaaattcaaaagcctaactcacatgaaggtataagaggtgctacaatcctgggaaatggaattagtaattctgttggagtatgccaacatttggttggagtcagtaaaggagactattgtccaattactgaaaccaaagttacgaacctaaatattccaggaagctgccaggagatttacagaaatggtaagacaatctccggtacatacgaaatcttaccaactggacaaacaaaaccagtaacggttttatgcgacatggaaattgagggaggtggatggacaatcatacagaagagatttgatggatctgtagacttttatagaccttggagagattataaatttggttttgggaatcttaaaggtgaattttggttgggtttagaaaacattcaccaccttacaagtagcaaatcaaatgagttgctcatagaagtaactgatcataatttgctaaactattatgctagatatccagtttttgaaataggatccgaatatcagggatataagttgaaaactttagggagttatagcggtaattcaagtggtgacagtatgatatatcatttatcccaaaggtttactacattcgatcaggatcaggacagttggagtgagggcaattgtgccaaattttcacatggtggctggtggtataataactgttactctagtaattttaatggatcacctcgaaatattcctcacatcagtcctaaagatacctcaaagcggtatggaatgaactggggacaataacgacacatctcaaagcatttatatggaacagaatgtgataagaccaaaattgtattcacccagatacctaatataaattgtgaagaaaataaagtttttatatttttt

SEQ ID NO: 2127 - DNA, 1325 bp, Diabrotica virgifera
ttcgatttttttatttgtaaaattgacatgaataaatttagattcatttaattagattttccattttttagtccagttgtgtattttattgattgccgactgtaatttttctgctgcttcttcgctggtatcacctactgctaagatagcggtgtcatctgcaaatgtggctatagtatcattttccatttcaggtatatcgtatgtgtataacagttagagaacaggacctaatacgcttccttgagggactcctgctctgatttcttttagatcagtgtacacgtcttcttgcttaattctgaaatatctgtcagatatatatgattgtaaaatttctgaatattgtttaggcataagaattttgagtttgtagactaaaccttcatgccaaactttgtcgaaggccttagctacgtctaaaaagattgtagaacagactttcttttcttctattgatttatcaattatgttagtcattctgtgtacctgatcaatcgtagaatgtttatttctgaagccaaattggtggtttggaatcatttttttctcttctattattggttttattctttttagcagaagtttctcaaaaaacttcgacatcactggtaaaagtgataatggtctatatgaagacacttcatttggtgattttcctggttttggtatcattataacctcagctattttccataaatttggtacatatctcaatctaaatgcagcattgatgatgttggtcaatttgactatggctttacgaggcaagttttttagtaattctccagtaattagatcatatcctggtgccttcttaggatttatattgtcttttatttcatcagctacttccttcggggatgttggtctgattctctcctctgtctgattaggctctatcgatatttgatcattattttggtcatcatgcggtttaaatgtattttctaaatatgtggcaaatctctctgccttttgctcattacttctagcccagctaccatcttctagtttaatgggtggagaatgggttactggtctttttagcctttttgtagctttccatagagagtactctgtgctactattatccgtcaactctctcaggtaataactgattgactcattttttatattttgaatctctcttttaagtttttgactagcattgtttaaatttgttttatcttgtggtgctctggtttgttgccacttccttctaagttttcttttctctttaaataattttttattttctttcggataggtgtttccttttgacgtttgatcttatagaaggagtactttcccatgctgatttt

SEQ ID NO: 2128 - DNA, 1436 bp, Diabrotica virgifera
cagttgaccaattatcagttcttctttaacttatattactacatgatacataatctaagatcttaaccctatggtgtcctcttatttttttttaacaagtatgaaattttaaaactaaaactaacacacaatacaacactatgctctgcttttacactaacactttacactaacttaaatggttttcttcgtttgagtcttctttctagcctagtattatcgaggagctggatggcctcgatgtttacatgactatggagccgttgttcgtgactacctgccatcttcttgataactttgtctacatcttccatctcaagatccttgtggaggtcgacatttcggatataccgaggagcatcaacgatgttccgtaatactttattctggaatctctggataatctgaatattacttgaattggcacagccccagagttggcaaccatacatccatactggtctaagtatttgtttgtataaaagtattttgttacatgtggacaatgcagagtttcttcccatcagccaatacatttttttgtaacggatacctaattcttcccttttctttttaatgtggactttccagcgaagccttgcatcaagtgtgatacctaaatattttgcagaagatgcatatggtatttgggcatcatttattctaattggaatgttttcgatttttttatttgtaaaattgacatgaatagatttagattcatttaatttgattttccattttttagtccagttgtgtattttattgattgccgactgtaatttttctgctgcttcttcgctggtatcacctactgctaagatagcggtgtcatctgcaaatttggctatagtatcattttccatttcaggtatatcgtatgtgtataacaggtagagaacaggacctaatacgcttccttgagggactcctgctctgatttcttttagatcagtgtacgcgtcttcttgcttaattctgaaatatctgtcagatatatatgaatgtaaaatttctgaatatttgtttaggcataagaattttgagtttgtagactaaaaccttcatgccaaaacttttgtccgaaggcctttactacgtctaaaaaagattgaaaaacagaactttcttttcctcctaatgatttctcaattatgttaatcattctgtggaaccctggatcaatcgtaaaatgtttatttctgaagccaaattgtggtttggaaatcatttcttttcccttctattatgggtttaattctttttaacaaaagtttctcaaaaagctttccaacttcactgggaaaaaaggggaaatggcgcaataatgaaaaaccttcctttgggtgattttccggggttttgggattatttaaaacctcccgttattttcccaaaatttgggaactatttccaatctaaaaggaagattttat

SEQ ID NO: 2129 - DNA, 896 bp, Diabrotica virgifera
ccaccgcgggggcggccgctctcgaaactagtggatcccccaaaaatctagacttgttgccctgctttccgtgcgaaatactaccggtacttttgggaaacaagggaacaggagggcgctgctgtgcgcggttctgagtgttcaggattgaagctgaagaaggtgctgaggaagcgtagaactgttgcggacgcgagttctgagaagagctgtaccgattggtgaaagccgaagaagtgagttggtgccctgttgcctggataatgtttgcaactcgctggttctgcagagacggagacaaatgctggctacgatgttgctgattcaggttgatacctcggtcgagatactgttttggtttgatagggtggatttggttgcagagaagagaaaggaaggtcaaagagggaaaactgggcggagggaaggattttgtatcaggcagcaaactgccactgcagtggccctggcagtgccgggcgaggcacccacgcacggccgcgcaaccggttggtccttgcccaccacgaaacccttctgaaaggtcagatggaagtgtgcgacagtgcgcgtccccaagccaatgcaggcgccatggatccactccccacccgcaagatttcactgtgcgttcttattggttgccgcaaggccagccaaagggggaagtatgagtcacagcaccgatacaagaaaattgcagaactaacatatggatgcgcgcgctattctgtagagctctgggcaaagcaccaatcctgcgggtcggtacacacactagcactgccccacctgaggcagtcagccccgctgaccgaattgccagagccaatggagacggaaagccaacgctgatggagcaccatctgaatggacctcgctcgcttgcctggaag

SEQ ID NO: 2130 - DNA, 405 bp, Diabrotica virgifera
acagacgcgtgggtcgtggagagaggtgtggtgttgactaattttaatgttgataatagaaataaataagtagatagttgtttttcttagtattaattaaaatggatagtgaaggtagaaaagtaattgtatgtgataatggtactgggttcgttaagtgtgggtatgccggcagtaacttccctgcttatatattcccttcaatggtaggaaggcccataattagagcagtcaacaaaataggtgatattgaagttaaggatctcatggtaggagatgaagcttcggctcttagatcacttttagaagtcaattacccaatggaaaatggcgtcgtccgaaattgggaagatatgtgccatgtctgggactatacgtttggtcctaaaaagatggactttaatc

SEQ ID NO: 2131 - DNA, 463 bp, Diabrotica virgifera
cttgacttcatatttttaaacatataacataagcataaaatggcttctaaagcttcttttgtctccgtattgatgttgttggttgctgtagccaatgcttatgatgtaacaaattgtccttcaaataccggtcgccagagaaatcttgtttacgacaatcttttatcgggagtgtctatcaatgttcgtatgccaccggcaggatattttaatagacccataacgtgccttcaactaattgatcgacagggaacctctgtttctccaaagatagtggaaggcggatatctcgatacatacatggtagtcaatattacatcattaaatggtcaagtactttattaccaggcacaaatatatattgattaattaaatttctttaattgaattatatcgttattatatatgtatgtcttagttttaaaacttagtttctataaaataaaatcatatccttcaggat

SEQ ID NO: 2132 - DNA, 517 bp, Diabrotica virgifera
acggtcgtattccgggaaaattcgaaccacacttgacttcatatttgtaaacatatagcttaaaatggcttccaaagcttcttttgtctgcgtattgatgttgttggttgttgtagccaatgcgtatgatgcaacaaattgtccttcaaatacaggtcgccaaaaaaatcttgtttacgacagtcttttaacaggagtgtctatcaatgttcgtattccacaggcaggatattttaatagacccataacctgccttcaactaattgatcgacagggaacctctgtttctccaaagatagtggaaggcggatatctcgatacatacatggtagtcaatattacatcattaaatggccaagtactttactactatgcacaaatatatattgattaatttaatttttttagttgaataatatttatgtcaaacttagttttaacaaaataaaagcatatcctttaggataactaaaagtttaaaaaaaaaaaaaaaaaaaaaagacttggggggggggcc

SEQ ID NO: 2133 - DNA, 1930 bp, Diabrotica virgifera
acccacaaactaaggtacgtgccacacagatccagttccaacatgagggaaatcgtacatttgcaagctggacaatgcggaaaccaagtgggagctaagttttgggaagtaatatctgctgagcatggaatcgatcctagcggaatatacataggagatagcgacttgcagttggaacgtatcaatgtatactacaatgaagcgtcagttgcttcttcaacaaatggaggtaaatacgtaccaagagcgatcctgttggatttggaacccggtaccatggacgcagtacgttctggaatgtacggcaaactattcagacctgataacttcgtgttcggccaatccggagctggaaacaattgggccaaaggtcactacacagaaggggctgagctagtagacgctgttctagatgtcgtacgaaaagaagcagaaaactgtgactgtctccagggatttcaactaacacactcgctaggtggtggtaccgggtctgggatgggtacgttgttgatttcaaagatcagagaggagtatcctgataggatcatgaacacttattcagttatgcctagtccaaaagtatctgacactgttgtggaaccatataatgctaccctatccgttcatcaacttgtagaaaataccgatgaaacctactgtatagataatgaagctctttatgacatttgctttagaacattaaaggtaccaaacccaagctacggcgacttaaaccacttagtttcactgacaatgtccggagtaaccacgtgccttagattcccaggtcaattgaatgctgatcttagaaaactggctgtaaacatggtgcctttcccccgccttcacttcttcatgcctggatttgcccctttgacctccagaggtaatcaacaatacagagcactcactgttccagaattgactcagcaaatgttcgattccaagaacatgatggctgcatgtgatccaaggcacggtagatatctaacagttgctgcagtatttagaggcagaatgtcaatgaaagaagtagacgaacaaatgttagcagtccagaacaaaaacagtagctactttgtggaatggatccctaacaacgtcaagactgccgtgtgcgatattcctccagtcggattaaaaatgtcttcaaccttcattggaaatacgaccgccattcaagaacttttcaagcgaatttcagaacagttcgccgctatgtttagaagaaaggctttcttgcattggtacactggcgaaggcatggacgaaatggaattcactgaagctgaatccaacatgaacgatttggtgtctgagtaccaacaatatcaagaagccaccgccgatgatgaatacgaagccgaagaggaacctgctgcggatgacttcaattgttgacgaattctctgagtccctactcaacaatgtttttagaaacttaaaaaaatttaatagaaaaagcaaggaaattatttatttatttggtctacgacccgtttagatattgattgttagtgggaaatgcggtgatttggagaatttgaccaagttctgttgcgaacgtggtaccaatccgcatttggctatagaaattggaaaaaaagtataattaaccgttacactctccaatcgcttcaaaaaattaaactcctattacccggtccagaaaacatttttttttaacccccccccctagatttggaaatccccgttataattttaatttccctatccaaattcaaaatctttccaaaattgaaacccgtttggtctaaaaattccttacatttttcataaccctttctttttttttaaaccgaaaaaaataaacaagttatttgccccccccccaacaaaaaaaaatttttttgggggccgaccaaaaaattaccggcccctctcccaccaaaaaaaaaattccccg

SEQ ID NO: 2134 - DNA, 1191 bp, Diabrotica virgifera
gtacggtgtacgtgacttttggcacaagatattgaatattgaaatatcaaatcaaatttaatcaaattgaattgaaataattcgtttaaggtgtagtggggtagtgtagtacattttattatcagtcaaattcaaataaataaacaacaaacccagttgcgatataaataaatattagcaaacattcgcggcaagtcgcattccgctggtggataggtattaaggtatttggtattttagtttgttgtgaaactctgtgggaggttaacgttaaataaaaacgactgaaccggtaaaacgtaaaaattaaaaatgttgcgagccattagaaatacgattaacgttgtacaaaaatgtaattacagtgcatatgctctacctaaacctcaaccaaacccaaatgtcctgtattctgggattttcatcaataacgaatggcacaaatccaaatctggaaaaaccttcgagagcataaatccctcgacggggcaggtaattacggaaattcaacagggatccaagcaagacgtcgatttggcggtggaagctgccaatgaagccttcagattcggctcgacttggagaacaaccgatgcatcggaaagaggacgtttgttgaataaattggcggatcttatggaaagggatggcgcttatttggcaagtttggagacattggacaatggcaaaccattcacacaagcttgggctgatgtagttggcagtctcaaagtgattcgctacatggccggttatgccgataaagtttgtggcaaatacatccccatggacggaaaatacatgtgttacacccgccacgaacccgtaggagtttgcggacaaatcatcccgtggaacttcccgcttatgatgatggcgtggaaaattggacccgccttgagtatgggaaacacagtcgttctgaagcctgccgaacagacgcctttgtcgtgtttgtacgttgctgaattggccaaggaagctgaaattcctccaggtgttttgaacatcgttcccggatttggagatgctggacaagctttggtcgagaatccaaacgttgataaaatcgccttcactggatcaacggaggttggaaagctgattcaggccaatgctggaaaaaacacttgaagagaacactctagaattggggggcaaaagcccaatatcattttagccgatgccgac

SEQ ID NO: 2135 - DNA, 724 bp, Diabrotica virgifera
ctttttttttgttccatgctgtttcaaatgcacacatttggtacagcatggaacaaaaagagaaaatcaccttggtgtgccctttttacgggagaaaatttaaaggtactggaataccttagagatttgaaatattactggcaagatggctatggacatgagttatcatataaacaagcttgcccagcatttagagacatgtccaatttccttcaaacaaaaactcgattcccaagagtcaacgtgtactttacccactctggaactttgctaaagatgatagctcatgtaggattgtacaaagatgaagagcacctaacggctaaaaattacgataccgcacgtgacaggaagtggagaaccggtcttctagatacttttggaacaaatttagccttcgtagcgtttgaatgtggaagagatactaaaatcctcacaatgcaccaggaaaatattgtgagactaccagcttgtccaaacacagatctgtgcagcttaaagaccttcagggatcattatttccaaagtctatcaaaatgtgattttggtgaaatgtgtcatttaaaatctaaattgtagcacatctaattactttaaaccaaagtaatcttaagcaagaaattgctgacttgtaaagtcacatataactaaaaagtattattgtatttaatttggaagcttaatttattgacctttttgtttttgttttatttgatgatgtatt

SEQ ID NO: 2136 - DNA, 1332 bp, Diabrotica virgifera
ggaaaaagtgttgtttgtgctgatcgcattgttgtgtcaaggcagtttaggccaactcattcgttgcccacgtggcgaaatttggaacaattgtgcgtcgtgtgatcctgaggctacttgtcaaaacagaatcccggaagctccaggtatctgtccagctgtttgtcaacaacgttgtgaatgtgactctaaaaatgggttaatccgtgatcaaatctctggagcatgtgtgcctatagacaaatgtccaggttgttcacggggagaaatatggaatgaatgtgcctcgtgtactcctgaacctacctgccaaaacaggacaagccaaatcccaaaaatttgtccagatgtatgttatccacgatgcgagtgcgatgctaatgctggatttataagagatgcaatttctggacaatgtattcctcgggaacaatgccctggttgttcacggggagaaatatggaatgaatgtgcctcgtgtaatcctgaacctacctgccaaaacaggacaagccaaatcccaaaaatttgtctagatgtatgttatccacgatgcgagtgcgatgctaatgctggatttataagagatgcaatttctggacaatgtattcctcgggaacaatgccctgcaggtcagtgtggcccactagaagttcttaatgaatatgcatcaccgtgtgctcccgagcgaacttgccgaaatcaatctcccgatgttcccgattcatgtatacttccttgcgaacaaagatgcgaatgtgatgaaaaacggggattaataagagatgaggaaaccggcaactgtattgatatcggaaaatgtcaaggcagatgtggcccattggaaatatttaacgagtgtgcgtcgccttgtcttccggagcgaacttgccaatatcaatttccagttgcaccaaaagtctgtatactttcatgtgaacaaagatgtgaatgtgatcgaaatcagggattgataagagataaacaatctggagaatgtattgacattggaaaatgcgaagacagatgcagtagaaatcaattttggggatgcagacgatgttgttccagagcaacttgtgacaatcccaatccttctccatgttcaagaccatgtcctaaaatatgtataaacgaatgtttgtggtacaaaaggttacgtaagaaaacaccaaaaaccggagaatgggtcttaatcaggccagggcccgaagattggggggaaaaatttcaacttgaatacaagaaaaaaaactaaaaaatggggtatttcgttctcgtaatttaaaaaaattaatgggcaaaaaaaaaaaaaaatggaaattggttttg

SEQ ID NO: 2137 - DNA, 1018 bp, Diabrotica virgifera
  misc_feature (972)..(972): n is a, c, g, or t
  misc_feature (981)..(981): n is a, c, g, or t
tggaacaagaaaaagtgaaatttcaattcaattcatggttagaaaagtgcattattttaagaagttaccattacttttgaagagacttaccgctggctgtagtttgaatttaagcaagatggagggtgtcataacaactataagtggtcagaagagaccagctgcaagcatagatgcctcacctaacaaaaagacaacttttgttgggatttcgcccatgagagaattgacaaatgtcaaaacacctgtagatagaccttttagagtgtctgtagaaggtaatattggagcaggaaagtccacactaatcaaatattttcagaatatgcctgggattgaaacatatttggaacctctagaatggtggcggaacgtggatggacacaatctcttagacctaatgtattcagatgttcacgaatggttacgagttttccagacctatgtgcagcttactcgccttaaaatccaaacgtccaaaccaagctcatcatcgacaacagtacaaatgttcgaaagatcgatacagaataatcgatattgttttctggagcaagcttacaggagcgggtatatccacggtgccgattatgctgttatagatcagtggtacaggtggataagagccaatgaagatattgccttagatttgatagtatatcttcgaagtagtcctgaaacagtttatgaacgagtaaaagcgaggaagagacctgaagaaaacagtctttcattggagtatcttaaggaactacacgacagtcatgaaaggtggctaatgtctgacgacgaaagattcaacaccattcctgtattagtattggatgcagacaagacgttagatgaaattatcgaacagtataaacaaaatgaaaacaaaatattaggatacgagaagcgtaagagacaaaaagtggaagcagaggaaaaggcaaagtaaaaaaaccctatttggataataaaagctattantagattagngacaaaaattaacacttatttagaattccgactactt

SEQ ID NO: 2138 - DNA, 1264 bp, Diabrotica virgifera
gggcccaccgacccttcggcccacgaacgttgttacatggtggtttaagtgaaccattttactataccagaaatatggctccgcatctgctcagcaacacaaaccttcttcttgccgaagtaaatgaaacacagaagacacacctgtcgtccaaagaaacttaccaaccgacgcagaccactcaagctaaacctgctaaaaaggaaaaaagcgatggatcggaaatagtatggcttaatgtaatggtatttattctgctacattctgcggctttgtatggattgtggctgatgttgtccctacaaacttcatggaagacatttgtatttagcgcaatctacttatcattcgccagtacaggagtgactggaggagcgcatcgtctctgggcgcacagagcctacaaagcgaagctgcccttcaggatatggttgatgttgggacagacagcagctttgcagaacgacatctacgaatgggtcagggatcacagagtccaccacaaattcacagacaccaatgccgatccccataactccactcgtggattcttcttctgtcacgtaggatggctgatgatgaaaaagcacgaagacgttaaggttaaaggaaagaccatcgatatgagtgacgtagctgctgatcctgtagtcaggtggcaaagaaaatactacatcccactggtaactcttttaactttcttactgccaacctatgtgccatactatttctggaaagaagactttatgatgtctttcttcgtgtgcatattcagatttgtgttgcagttgaatggtacctggtgtgtcaacagtgctgcacacttgtggggatacaagccttacgatggatcaatcaatccagtagaaaaccgtttcgtttcagccatcggttttggagaaagttggcacaactaccaccacaccttcccatgggactacaaagcagccgaacttggcaactacaaaatgaactacaccacccgccttattggacttcatggcacacatcggcccaagcctatgacctgaaaactgtctccgccgaaatgaaaaaggaaaggggaacagaaccgtgacggaccgtggaaaaaagggaagaatgactttaccgcttgggggaaaaaaaaacttgacagacagtcccacaccaaaggcggggggtggggggggggggggaaagaaaaaaaaaaaagaaaaagagggaaaaaaaaaaaaaaaaaaaaaaaaaaaaaaaaaaagagggggggggggggtgtgttttt

SEQ ID NO: 2139 - DNA, 996 bp, Diabrotica virgifera
accgtagatagacaataaaattatgttgtccgtcgcgtttcttctgttttgtgtaatttcgaaaattggcgctctgccacaaacaattaccagtgattacttcgaattgtcggtggttcattttaacgatttccatgccagatttgagcaaaccagtccagatggtaactcctgtaaaaatgaaacagaatgtattggaggattttctagactttatagtaaaataaacagcttattggaagaaaaaccgaagtcagtgttactaaacgccggagataattatcaaggaactctttattatacagttggacattggaatattactcaggagtttatgaacaaactacctatagatgctgaggtacttggcaaccacgaatttgatgatggagtagccggcatagtcccatatattaaatctatccagcatccaattatcgtatcaaatattgacgacagcttggagcccagcatgcaaggaatataccaaaagagtaccattatcgaaagagatggcaaaaagatcggtattatcggagtaataacttcagaatgtgccaaattatctagcactggagacttaaagtttttcgacgaatctaccagcgttaacgctgaagctgagcgactggttaaagaagaaaacgtttttacaattatagttctatcacattctggatatgaagtagatcaagagattgcccaaaatgctcatgagaagatcagccttattgttggtgggcactcacatactttcttatggacgggagataatcctcctggcccagaccccgttggtggaccctatccaaccatagtaaaaagtaaccaaggacataatgtgctagtaacacaagcgtcggcttattgcaaatatgtaggtaacataacggtatatttagatcataatggagaaaattgcagactacactggagcccccaatatccttagctcataatttaccccccggaaccttcaaacccacacccacttac

SEQ ID NO: 2140 - DNA, 912 bp, Diabrotica virgifera
  misc_feature (839)..(839): n is a, c, g, or t
cggacgcgtgggatttagttgtcgcaattatgagatgttctacgaatcgcgtgtacattaattgctaaatttagtttatagagagagattttaaagtatgatttgttgtgtggtttctaaaaaatagttgtggtttaagatgtatagaaaatttttcgagagatggcggcacttattatacttattagtacctcttttattggatctcaagtacataggagcacagttagatgaagatgaagatattaggcggccatgtgcagattttaaaataggagacgatgacttggaggcatatgatttcatccgacgatttcgtcttgatcttctgaacacaccatatcctggtgtatctagagttagaggaaccaatcgtatgcaaacagcgtacagacttgataaagaagcagacctaacggtaccaacaaggagaatatttccattgggactaccggatcagttttcatttatttcgacatttaggactaaaaaaccaccaagaggagtctggcacattattagaatcacggatgtggaattcagaccacaatttttaataactctaaatccaattaaccaaacaattgaattttcaattacaaattacgaaggaagattacagactatccagtttgataatgcaactgtttttgacagaaactggcacaaaattcattttggggtctcaagagattctgttatgctttatgtggactgtcgtaaaatatcacaagaagctttggagccacgaggtgctatcgatataaacgggaaggtatctctatcaaagtatgaaaatagtacagaaacagttccaattactattccgattgatcttncatggatggtaatgagttgtgatcccaccagacctgtcagagaacattgtacggaactccctaagccttcagt

SEQ ID NO: 2141 - DNA, 1204 bp, Diabrotica virgifera
cggacgcgtgggctagttctagatcgcgagcgggccgccctttttttttttttttggatacgtcgtcgtcttcgtcttgaatgagaattggttgtttcgggaagaatttttggttgatgtagtacatcagtctggctatgaatttgtattcgatgataaatagtaatattgaccacaagacaccagaaatcagtgagtacgttacattttttgcgataccattattgtcccatgaaaagtagttgtcgttaagattggtacaaatatcagcgacagtggatggaaattttgaaatgcactcatctttagtaaaattattttgagcacacgagtcaaatactatttcacaaagagtgttgtatgaatagatagcgtagcatttgtttattcctgtagctaaagaatagtgcgggaacacaagaaaaacgttatccaaggtttctcctatacgttttaggtttgtgctttgcgttttaagcacttcaactaaaagaaaagctgcattccctataaatatacccacgagagtcatccttgtgtaacccgtcgatggaactgtgaatattaatgatgctacataataaattggcataaacgaccaaccaaacaaaagtaataggaaaaatagccgacccatatctccacttgtcttaaacccatcttgttggaaacaatatatagtgatcaataatactgaacataccagtaagtagacaaacatatcacaaattatattaacaaaccaaaaaatgtaaaccttcactcctgatacaaactgcaggtgttttgacttggatacgttttctcttatcaagaatataacataaaatgatgagataaacgccatactgaatccaatattaaatgcaaactggaatccctgagattgtccaccaacaatgttgtctatttgggttgcagctttaaaaggtaatggtttgttaacaaattcaatatgtccgttagtgtagtgattgtaaacggaagacaaagccatgcctaaggcaataccaggtgagtggtaaggatcattgttaaaccatgccgtaataacaggatgaattgtcttgatgataccaaattcaaattcttgctctgtgaaagttgatcctataatgtaacttctacgcactacgtttggattagttgcagtcaggtctaacattatacgggtaatattgtcaatatttgttggagacattcc

SEQ ID NO: 2142 - DNA, 1318 bp, Diabrotica virgifera
  misc_feature (1241)..(1241): n is a, c, g, or t
  misc_feature (1270)..(1270): n is a, c, g, or t
  misc_feature (1299)..(1299): n is a, c, g, or t
tgcttatcacggtaatttagaaaaggccgtggaatactataatttggttaaagagaaacaaggctctgactttgccttagatagcagcaaaattttgaggtttgcacacttatatatcaaatcgggccagttcgacgagtgtattaaactgttagaaaataccccacaggataaaaaagatgatgacaggggattctcgtacacttctctggtttggagattattgaatagtcttgcagaggaaggaaaagtagaagaattggataaattgttcgatacactagtcaaaaaagagtttattgaagtcagtaatgtagttctaggacctttaataaaagtacatctgataaaaaaagatttggaaagtgctttgaaaaaattcgaatggtgtgtcaatcatttcaaagccacgccgtggaaaaatgaactagcctgtcagctaattcaaaacgaagatgctgagaagcttcaaaaactcacggatttaagtacatcaatacatggtgaagttaacagtttgtacgatttagtatttgcgtttgttgagtgtggtcgcgttagacaagctagaaaaattttggaaactcctggtttacaagtacggccgcaaagaataaatactgcttgtgaaagataccaacaagagggacttattaaaccgctagaaggattgaaagatgctacaaaagacctcaaccacattgaccgttcagatatctattatcaactgttactaagctacatcaagcaagacgaagttgacaaagctctaggattgtggacgcaaatgcaagaagaagatctagctccgccagagcagttcttattaacattgggagactttttaaaaaataaaggaaggcaagttccttttgttctaccacaaacaacagtccaagcagctgaagttccaaaaccgatcgcaccacaagttactccggctccagttctgttcagacaaaaacttaagtcgggaaatgtcgacgaagccttaaaggtaaaaaagaacagtaaagaagctcttcctgtagtagatttggcagtactaatagaaaaattgttgcaacagaaccgtttgaatgaagcgtccaaggtaacgtttgaaatactcgatcgcggtaatattcctgtaaacagagtattcaggttcttgttaaataaattggccacagctggagatgttgacacattaagtaaaataggacaaaaaataaattcagacgtaaagagaattgtatctnttgataatagaatgtgcccatgcaatttnggtagctggtaatgcggaagcttatttanagaaaagctcacatgacat

SEQ ID NO: 2143 - DNA, 1300 bp, Diabrotica virgifera
  misc_feature (27)..(27): n is a, c, g, or t
cctttaccgctaaaacaaaaatgtcgnaggcttggcaacatccaccaataacttgatcacgtgacatacattttatacttttatgtcagaatttgtccttcaactgacacttttttagtatctgcctgtgaggtacttttaaccggtagtgtacaaaaaacatattcttgcaatatggtgaaaattggaattaacggttttggccgtattggtcgtcttgtactccgtgcagctcttgaaaaaggagttgaagtagtagctgtcaacgatcccttccttgatgtcgactacatggtatacttgttcaaatttgactctacccacggtcgctacaagggatgtgtcaacagtgatggcaaaaacttagttgttgatggcaaagtcatttccgtacaccaagaaagagacccagctgctattccatggggcaaagctggtgcagattatgtagtagaatctaccggagtgttcaccacaattgaaaaggccaagaaacatcttgacggtggtgctaagaaagtcatcatctcagctccatctgctgatgctccaatgtatgtatgtggtgttaacttggatgcctacaatccagctgatcccgtaatctctaacgcttcttgcactaccaactgccttgctccactcgccaaagtcatccacgacaacttcgaaatcgttgaaggtttgatgaccaccgtacatgccacaaccgccacacaaaaaactgtcgacggaccctctggaaaattgtggcgtgacggtcgtggtgccggacaaaacatcatcccagcttccactggtgccgccaaggctgttggcaaggttattccaagccttaatggcaaactcacaggtatggctttccgtgtacctgtaccaaatgtatccgttgttgacttgactgttcgtttgggcaaacccgccagctacgaccaaattaaggccaaggttaaggaagccgcagaaggtcctcttaagggaatcttgggatacaccgacgaagaagtagtctcaaacgacttcgttggagacacccactcctctgtctttgatgctaaagctgatacccaacttatcgacaatttaaacaaccaaatctcatccaaaattttttcttctggggaagaaaaaaggagaaaacggttattcccacccaaagaaattccaatcataaccccctcacatccaaccccaaaaaaaaattttaagggagtggcggggcccttttttttttataaagccgtttttttccgctaacttgggagaatataataggccccccccctcaaaaaaaagtgta

SEQ ID NO: 2144 - DNA, 1654 bp, Diabrotica virgifera
ctttaaaaaaactcaaaaggcagctggtaagctaggtacaaaggttaaagtgcaattgtattttgttttataatctattttgattctacattctacttcaaatttagtattaattcgaatcctggtgtacgtttagatcatcagtaaagattattaaatattttcatttatttaaaatggcatgtcttcagaaggtttccaaggagtttttaaaaaaaggagttcgattaagcccaagtttagctaaatacagttcttctgcacctgggggctacaattttactcttaatgacactcaacgggaattccaggaattagctaggaaattcaccagagaagaaattatcccagtagcagctgaacatgataggacaggaaaatatcctttggacatccttaaaaaggcttgggccttggggctcaccaataatcatattcctgaaaaatatggtggtatggaaatgggagtattcgatggatgtgtcatagctgaagaaatcgcctatggatgtactggaatcaaaactgctttagaaggcagcggtctgggacaaacacccgttttgttaactggtaacgacgaacaaaagaaaaaatatctaggaagattaatagaagagcctttagtggctgcatatgccgttactgaaccatcagctggttctgatgtgaatggaattaaaacacgcgctgagaagaaaggagacgaatggatacttaatggacaaaagatgtggattaccaatggtggagttgctaactggtactttgtattagctcgtacaaatcctgacccgaaggcaccagcaagtaaagcttttactggattcattgtagaaagagaatgggcaggtgtaacacctggaaggaaggaaataaatatgggacagagagcttcagacacaagaggaatcacatttgaggatgttcgcatacccaaagaaaacgttttaattggtgaaggagctggatttaagattgctatgggcacttttgacatgacaaggccacctgttgctgccggagccgtggggctggcccaacgtgcgcttgacgaagcgaccaaatacgccatggaaagaaaagctttcggtgtccctattgctcaccaccaaggtgtagccttcatgttagctgacatggccatcggggtggaaacagctcgtctggcttggatgaaatctgcctgggaagtagaccaaggagtcagaaatactctagcagcttcggtagctaaatgttacgctgctgatatagcgaataagtgtgcaaccgacgcagtccagatttttggtggaaacggattcaacagcgaatatcctgtagaaaaattgatgagagatgcgaagatttatcaaatatacgaaggaacagctcagattcaaaggttgatcatttctagggcaattttcgaaaatgcaaaacaaaaggcataagaacttttttataactataatttaagattaaattttaacaacatcatcttccccgattacccgtataaaaaaatagtcaatttttcttttatataatggccaactaaattggattgttgtttattatttctttcaattactgttttaattcaattaaataataagcatccaggccgaaaaaagtacaaaactttttcatctactacaataatggaaaa

SEQ ID NO: 2145 - DNA, 1174 bp, Diabrotica virgifera
cgttattcatcatcatgtctggttgcatcattttttggttcatcatgtgttggggcatcatcattttttcgatcatcatttcgttattcatcatcatgaatggtatggaaattcaacaatactggaacatgaaccaaaatgttatggaaaccatgaccccaaagcaacacccattaaagcgcctggaacaagtctatcaaaacccgaaccaaagaaatatgacgaaaaattaagactatccagaatataggttcacacggaaatacatgaacccaaactacaacatgccccaaaccttatgatgaacccaaaaaaatggatcacacccagacattgatgattgcataactaaatggatgaacgaaaaaaaatgatgatgccccccaaccacatgatggacccaaaaaaatgatgcaaccagacatgatgatgaataacgaaatgatgaacgaaaaaatgatgatgcccatgatgatgagcaaaagaatgttgggacaacaaatgatgaatcaaaaaatgatggcccctaacatgaggatgagaagagaaatgatgtccgaacacgaagttccacaaatgatgaaccaaaaattgatgcaacctgatatgatgatgaatgaaaaaatgatggaacctgaaatgatgaatcaacaaatgatggtcccaaacatgacgatgagaagacaaatgatgaccgaacaaggagttccacaaacaatgaacgaaaaaatggtggccctcaaaatgatgattaataataacataatgaaagaaaaaatgatgaaacgtgaaatgatgaacaaaaaaatgttggaagaccaaatgataaaccaacaattaatgatgacaagaaaaatgatggctcaaaaacaagtacccctaatgatgaaagaaattgaccagcaaatgatgaatgaaaaaatgatgaacaaagaaatgatgaaccaaaggatgatgtctgataaaatgaccaatatggagatgatgaaaccgatgctaatgaacgaaagaatgatgtaccaaactcgcatgaatactatggaaatttaataatacaattaattagaagtattttttatttattttacattcaatattattattcaaacgagtatattaaataaaacactatttttataaaaaaaaaaaaaaagggcggcccggacgcgtaatg

SEQ ID NO: 2146 - DNA, 1834 bp, Diabrotica virgifera
ttttcgtccgcgtgcatcaacatgaaggttttggtattctttgcgctagtggcttgttgctgtgccgtcagcactttaagcgtcggtgttttagtggacgacgatggtggcatcaatctcctgaacaccaaatacgaaattaatatcagaagaagtttaagcaacccaaagagactcacagtcacactcaagcaaggttccacaagtaaaattgtatacgacttggatgaacccatcaccaataagaatgtagacatcagaaatattttggacaccaaatacatcaagaacttgggagaagtttacacccagatggatgttttggatggtattttcagccaatatgatgtagtagattcaatgacctacggtaaaatcatgaagatgatcaaactgttggttcaaaatgatgtcttacatccaaaggtcctatccgtattgagcatgttggataaccaaatggttgaagaacccatgatgaccatgtatgacaccaaaaatgtcatgaagaaagacttgaaacctgaagtgatgaccaaagatgttgttattcctcttaaagatggaattgaagttatgcatgaagttagtggtgtcgttccggttgaagaagcagaaaacgaattaagaaggatgcaaatgcacatgaatggtatggaagttcaacaatactggaacatgaaccaaaatgttatggaaaccatgaccccaatgcaacgcttattaatgcgccttcaacaagtcagacaaaatcagtaccaaggaaatatgatggaagaacaatactatccagaatatatgctctcacaaagatacatgaaccccgagtactaccaacaaatgtcttatcaaccaagaatggaacaaatgtaccaacaaaaccaaatgagtccattggcccgctttatgcttaacatcagacagccacaaatgcaggaacaacaaatgtcaatgatggaccaaatggtacgtgatcagatgtacccccaacaataccaacaatatatgaacagagttcccttacaaatgatgatgaactcagaaatgatggacagacgtatgatgaacatgcaatcaatgatggacaacaacatgatgtcccaaaacatgattaaccaaagaatgatggaaaataatatgatgccccaacacatgatgaaccaaaaaatgatgcaaccagacatgatgatgaataacgaaatgatgaacgaaaaaatgatgatgccccaacacatgatgaaccaaaaaatgatgcaaccagacatgatgatgaataacgaaatgatgaacgaaaaaatgatgatgccccaacacatgatgaaccaaaaaatgatgcaaccagacatgatgatgaataacgaaatgatgaacgaaaaaatgatgatgcccatgatgatgagcaaaagaatgttgggacaacaaatgatgaatcaaaaaatgatggcccctaacatgaggatgagaagagaaatgatgtccgaacacgaagttccacaaatgatgaaccaaaaattgatgcaacctgatatgatgatgaatgaaaaaatgatggaacctgaaatgatgaatcaacaaatgatggtcccaaacatgacgatgagaagacaaatgatgaccgaacaaggagttccacaaacaatgaacgaaaaaatggtggccctcaaaatgatgattaataaaaaaataaaaaatgaaaagataaaaaaacggaaaaaaaaaaaaaaaaaaaggatggaaaaaaaaaaaaaaaatcaaaaaaaaaccttaaagaaaaaaaccccacgaaacaaaaaatgggcccccaaaaaagaaaaaaaaaaaaattttacccctc

SEQ ID NO: 2147 - DNA, 1567 bp, Diabrotica virgifera
  misc_feature (1447)..(1447): n is a, c, g, or t
taatttttgtaacctcatttctcggcggtcaacgtattacattcacatcctatcgtttagttaacaatgataaaatatcgtgatagtcatcgcaaaccaacgtgtaaacgttgatgtaaataatatatacataatgagataattattatttatcgataggattaccgccaaaaccagacaagaatcgaatgtatattcagtgatagtcagtagtcataatctatcgaagtcgctcaagcttttgaaattggttaatagtaggagatactttagcaacatgtctcagaaaataagtcaaaataaaacatatatttcagtagaaattccggaaacaaccaaaggtgcctcaagaggatttttcagtagaatttttaaaagaaacaaagaagtaaaagaaaaacaagaacctagattgaaaaaatccgaactcaagagattgttttctctcgccaaacctgaaaaatggaagttaactacagcaataggtttccttgtagtgtcgagtacagtaacaatgtcaatcccttatagtttaggaaaaatattagatattatatatgtgggtagtggagactcagatgcagcgagagcacggttaaaccaagtgtgtggtatattgctaggtgtgtttgtgttaggggccatttgtaattatgccagagtttacttaatgtctacagcaggatatagaatgacaaatgctttacgaagacaagtttttggtgcaatattaagacaagaacaaggttggttcgacaaaagacctacaggtgaacttgtgaacagactgtcagcagacacacaaatagtaggatctgctttatctcagaatatatctgatggtttaaggtctctagtcatggtatttgctggtacaggtatgatgttgtacatgtctccacagttggcattggttggtttagcaatagtacctccagtagcagttgttgctgtgctttatggtagatttgtgagaaagatttcaaggaaagtccaagattcgttagcagattctacaaaggtggcagaggaaagaattgcgaatataagaacagtgaaatcatttgcacaagaacctagagaaataactagttataatatttcaattgaaaatgcccttagtccgtgttcgcgagcggcaaaagcaagagctttattttatggcatgacagggtttagtggtcatattataataatatcagttttgtattatggtggggtgatggtgtcttcaaataccataacagtaggtaatctctcatcattcctactatatgccgcatacattggtatttctgttggtggattatccagtttttattcagaactaaacaaatcttttaggggcagcaaccagaatttgggaaataattgacagagaacccacaattcctccccaaggggggttaattccaatgacagacgttgagggtcatattgagttcanaaacgttaagttctgttatccttcaagaagtgacattgaaattttcaaaagtttagttttggacatccaaccaggcaaaacgctcgccgttgttggtcctagtggttcgggcaagagtac

SEQ ID NO: 2148 - DNA, 1031 bp, Diabrotica virgifera
ctttacgcgtccgggattccgagatttctaaggaaaatgacctctttgtcgacttatcttagaattatcattcagccgtgtcataaggttactaataagaaattaaaaagaaaacaataaacaatacaattcaacaatacagtagtgccagtcttctatccgtgtcacatggtaatattgtcctccgtttgagctggttacatactagatcaagatgagtttgttgtatttcattgtgttgttttgttttttaaatcattgttattgtgctccgactcataaaagtcgtgaagtgccctcagtgaaggcattagaatttatgaaaagatatggctacattaaaatggacactggggactccgaggcactatatacagaagggggaatctccgaaattatcaaagtaatgcaaagatttggaggcattgaggagacaggtgaatttgatgatgctacgaaaagactgatgaccttacctcgttgtggagtacctgatataatccaaaatagtcgccaaaaaaagatatgtactaggtcctggaggttgggaaaagaggaatatcagttactatttagcgaattggtctccagtattgggggaagcaaccgttcaaaaacatatccagaaagctttagatacatggggaggatacggtagactaaacttcttcagaagtccttctcaaaacgctgatataatagtacaatttgcacaaggatatcacggagaccgttttccctttgatggaagaagtggcatactagcccacgcattttttcctcatgaacaagatcatcttggaggagacatccattttgatgctgacgaaatctggattgataaatcgcagaaagattatgatgaagatggtaccgatttctactttgtagcattacatgagttggggcactctttgggccttgcccattctccagttagaagttcaatcatgtttccatattaccaggattctggcagtccccctcaattagggtacgatgatatttttggcatgtatgatttatatatt

SEQ ID NO: 2149 - DNA, 1789 bp, Diabrotica virgifera
  misc_feature (1697)..(1698): n is a, c, g, or t
  misc_feature (1707)..(1707): n is a, c, g, or t
  misc_feature (1714)..(1714): n is a, c, g, or t
  misc_feature (1764)..(1764): n is a, c, g, or t
cataaaattcattttaaagtcgtagataaacaaaccgttttttaatgaacgctaacggttcaatgtttatctaattactcaattaaacgagataattaatgatagtgtatttaaatactaaatacatttttagtcatatcaaaatcattaggaccgagaggttatggccagtttggatgtttaaactttctcttttttttaattttaaaaaacctttagattgtgactagcattatattagttcagaatgtttaagtattattttgtagtgttgtgtttttcgttatattttgctgttggatgctttgaatgtttaacctatcggctcaatccatcagaagctgtgccaataacctacgaaatcgtaatcaaacctgatttagataatgatgtatttcatggagaagtcatcatttatgtagtgactaaaataagcttaaatggtattacattacatagcgatgaacttaatataactgatgtttatattaaccaaataaaaggttgttatgtagaagaaacagaagaaagaataacagtcaaatataataatggtcctttacaaccgggagagcacacactgttgtttaagtattctggaaaaattcgaccctcacatggtctaataaaagctttatatgaatataaagatactaaagaatacgtttatgtcacggatttggaaccgaacaaggccaggcgagtatttccctgctttgacgaacctcaatttaaagctaagtaccatattaagctggtatcaccaaacgaaacttatgcggctatttcaaatatgcctgaaattaccaaattccgcacctcgtatggaattgttcatgaatttgcagcctcggttccgatgtcaacatacctggtatcttttgcttttactaattttccttactacagtgaaaatttcgaataccaaggaagacagattccaataagaatattcacggtcaacgcaagtaaagaaaataacgagtttgctatgcaatgtgtcaaaactgcattgtctttttattcggattatacggacattagctacccactacccaaattagatatgattgaatacaaacgagaggaaagtgcagctacagaaaattggggattaattacttttaggcagggtctgcttactacgccgttacgtatttacagcaaatttcaaataaaactggtggcgttccacgaattaagtcatttttggtttggaaatttggtaacgaacgcatggtggaatgatatctggctacaagaaggatttgcaacttatatgagctataaattatcagcacaggataataataatacgcagcttgatgagatgaaatcttataactttaacgaattctttgaaacagaaatttatgagaagagccagccaatcgttcaatatttaccagacccaagtaaaattgctgatgtttttaacggccttgtgtacgaaaaggcttcggcgattcttttaatgttggaggacgaaattggtcaggaaaaattcaaagaaataatcaggacatttctaaagaaatacgcatatcatacagctactacaaatgattttattacagtcgtagaagaagtggtgtcagacatacctctaagaacgtttttggagagttatttgtaccaaaataaatttccagttctcaacgtcgatatttgtaataactcgacgtatgttataacanncacaatttngcgagancgttcaaacagaaaccaattagtgctactaaatggacgattccaattagntaccaaactgattatttctaatgat

SEQ ID NO: 2150 - DNA, 1297 bp, Diabrotica virgifera
atcgatatactaagtgttcgttccagatgaaattatacattctagcagcggtcttctgcgccgtagcttctgcagccaaaaacaaccaacaatacactacccccgtaccgatccttaagcagatcgacaagcataacgaagatggcagctacagctacgggtacgaagcagctgatggaacattcaaaatcgaaacgaagtatcctaatggcgaagtttacggcaaatatggatacatcgacgatactggagcattacgtgaagtcgaatatggtgccagtagaagaggtttcgaacccgctggaaatgaaatacaggtcgctccacctactctaaattccaactcgccaaatgcccgacctctggctccaaatgaagaagatgatggacagtacagggaagatcctgcggcatattaccaagacgatccctatgtccaacgacagcaatctcagcctcaacaaaggccagctcccaggtatagacccgaatcagcatacagacaagaacctgaacctttcgaaccatttgagcctgaaatagtaagaccaaattacaggccacaaacttcatacagaccacaaccagcttacagaccacaaccagcttatagaccacaaccagcttacagaccgcaaccagcttacaaacctcaaagctattacagaaccgatccagaacctgaacctctacctgctccaaggtatcagccacaacctgcttatagaccgcagtcaaactttggattccaaaacgataacaacaactacaaccctgctccaagttggaacagcaatccaagttggaacaacaaccctagttataacgctccccaaccaaacggtcctgtctggacgggccacccagcgcagaacgtggatattaacactgggtcttacacaggtcagtataaaagataaacaatagttaggttaggctaataaactttattaaaagtatcagtactcgtaacgtcgagagaacaaacagattgaatagcatatatatatacaagaattatctctaataaaataacagaaacccagaaatcccagaaaaatcacccctagcaaaatcactgccttcagacttaagatctcacttctgtaataatgaattagattgcgcaatttgccactgtaaatcgcacctcgcttaactctaatacagaacaccttatccccccattacaacacccccaaagccgaccatcgcattatctatccgaaaatagattacaaacgaggaaagtattataacttctcaggcgctaattattgtcataagaccaccgctt

SEQ ID NO: 2151 - DNA, 306 bp, Diabrotica virgifera
acgcgtccggaaaactagcaacatcgcggcttaaacttggagtcagttcagacttaaggtctgtatattcacctagtccaatggcgaaatgtcggaagactccaaccccatcgccaagaagagcatctactccattggttaacataaaaaataaaaaggctgcagaagtttctaccgacgatttgttgaaaattgaagttcccaagaggattcttaaaaggaaaacggcagcagactttttttgaagatataaatgagttttatttatttattgtacagataagataataaagtattttttaattt

SEQ ID NO: 2152 - DNA, 2070 bp, Diabrotica virgifera
cccttgacgtccggacgttcgccatgcgggaaattatgtttaatgttataaattattaaagtacgttataaccgtcaaataaaccaactacattaaattcggacgtccatatttagtgtaattaaagttcaacgatttttgtgggtgccgtaagaggttatgcgatagtaaacatgggagaagccagaattgcaaaaagtggtatttgcacagcagtcgcacttagatattactttatttacgaaaatgtaggcgctggagaacctgaactacgctttgtgcaacatcccttaatcgaattggaagttgatataccaaaagaggacaaagaggaagaactaactccagaaaccgtggactatgaagacgatgttgaatacttgagaagtttagaccctaaagaatggaagtcccaagaccattacaaagtcctaggtatcccaaacataagatacaaagcaacagatgacattatcaaaacggcatacaggaagaaagtcttaaagcatcatcctgacaaacgtaaagctctaggggaagaaatcaaaacagatgatgactattttacctgtataacaatggcttatgaaactctaggaaatataagtaggagaagagcgtatgattctgtcgatccacaattcgacaatgatctaccttgtactagtgatataaaaaaagacttttataaaacgtttacttattactttgacttaaactcccgatggtctgaaaaaacacgggtgcccaaattaggaactgaaaattcgacaagggaagaggtggaacacttttattcattttggtatgattttaaatcatggagggaatattcgtatgaagacgaagaggataaagataaatgtcaagatcgtgatgagagaaggtatgtggataagttaaacaaagctgagaggttaagaaagaaaaaagaagaaatgtccagaatacgccagttagtagacttatcctatagtaacgatcctagaattgcgaaatttaaacaagaagacaaggagaagaaactagcagcaaaaagagccaagcaaaatgcagcacaggcgaaaaaagaagaggaagagaggattctaaaggaagctcagttggcgaaagaacaagccgaagcagctgagagagctaaaatcgaagcaaagagacaagagagagaagtacaaaaaaaggcgctgaagaaagaaagaaaaattctgagagatatttgtaaatcgaataattattatgcagacaatgacgatcagaacttgtcttatatgacagcaatagaagggatgtgtgaaaggttatctttaactgaattagaagatttaaataagaatttaaaaaataatggaaagtccgcttttgtaaaagccattaaagagaatgaagcttatttacaaaaagaaaggatggacttactaaattcagctaaaagtaaagttaacactgaaaataatactactgctgttgttatggtagcacctgattggaacgaagagaatgtccagttactagttaaagctgttaatcttttccctgcaggtaccaatcaaaggtgggatgttgtgtcgaattttattaatcaacacggtactttctcacaaaacagcaacaagttcaacgctaaaatggtactttctaaagcaaaagatcttcaaaacacggatttctctaaaaacaatcttaaggaagttgcaaataagcaagcgtttgacaatttcaagaaggacaagaaaagtgttcttaacattactgaatctgatatatctaaaaaattagacgaagtaaatttaaacgatagtgcgaaaaaaccgacgactaacggagaagcgaaaccgaaggctgaactgccttggacgaccggggagcaaccactcttataacaagctttgaatacctatcctgcttctacgccagaaagatgggataagatctctgaatgtatccctagcatatccagaatggactgtatgacgtaatataaagatttatttgaaaacaaataaaagcgaaaaaaggttgccaaggctccctgggtactaaatcataacttttggaaacctaaagcccttt

SEQ ID NO: 2153 - DNA, 960 bp, Diabrotica virgifera
actacattaagataaaatcatagtttaaaaacttatatttcgtttgaacagaaaataagactcagaatgaaaattttattgaccctcattgggaccatcgtggtagtcaatgctttgtcaactaaacaacaatgggaaaactttaagcgtaaccataataaatcatatgcacatgttctagaagaaaactatcgcttgtctgtttttcgtttaaatctaaagaaaattgaagaacataatgccagataccagaaaggcgaagtttcttattatatgggtgtaaccaaatttgcagatttaacagctgttgaatttatgtctatgcttaataaacaaataagtacaaagccaaatattcaaggtatacttgcacaattgtccgatgatccaatacctgattcctttgattggagaggatcaggtgcagttttggaagttaaggaccaaggcagttgtggatcttgttggtcgtttagtgttactggagcattagaaggacttaatttcttagcaaataacgtaacacttcctctaagtgaacaagaacttgtagactgtacggcactatacggtaacgctggttgcaatggaggaaatatgcaatacggttttaagtatgttaaatctaaaggtatatcaagtgaagcagcatatccgtacgcaggagtagatgagtcttgtagacgaaatgcgagcaatattgtttttaaaataaaaggtttccaaacggtctcaaaagatgatgattcattgagacgtgctattgcgacggttggtcctatatccattgcgatgcaagctacagaaaatcttcagctttataagggcggagtactgggcgatcctagttgttctaaattgggtgggagctataaatcatggtgtattagctgttggctatggacaagaaatgacccacattattggattgtcaaaaaatccctggggaactttcttggg

SEQ ID NO: 2154 - DNA, 2351 bp, Diabrotica virgifera
gcatgtcaagtgtgtccaggacgtacgtgtcaagaagttatgagccggtgaaatttgttgtaaaataataactaaacatgaggatttccacttattatatcttagtattgtcaataattttggcattattctgtgccacaacatatgcaagtataggaggctacattagccaagcagataagaacaaatttattcagattttggaaaaaacactcaaagtcgatggggatgatattgtttctccatactatgcagccagaggatatcaaattcttacagttcctctggataagaagcaaacaggggacaactgtgctcacttgaagaagaactttaagcatcaaagtactgaaagtactttttacgtgtacagtacctggaatatattgggatgccagggagctcttcattcaccagaagttgtaaagacaattcaagcagctctggaagataataagtctactttagcagatattcgttacgctttggaaatcctaactctactaaaacaacaaatacctggacctgctaaagtatcccaggcaattcaagcaaaactgaaagaagatgatagcctccaaaacttgggacaagctgtccacgcagcttctcttttaggagacaatggaaaatttgcattggacagagtagaagatattgttgtgcaagctgatgaagttgatggaaagttgttgcaatgggaaggtggacttactaccacatccttgctccttacaggtctatttaggttgccaggtaattcacctttaacagcagtacaagctgacaaatttgcaaattatttgttgacaagaaaaactgtacaaactgcaaaaggagtactttctttcttagatgcttctttagcattatctagcagtagtgtgtctcctgttagtatctcaatcataggaacacctcaagtctcagcagataaaccagatctgaaggtacaagttagcaatttgtttggagtacctcacaaaacacctccttctcctgtcgtagctgaaaaaatcacaaaattggcagatgacagtgttgtattatctaaacaaactttaaaagcaggagtcccctctgctgaattcgtattacctttgaaactagaccctggtctatataaagtagtcattaatgcaggtagccattcagcagactttgtagtaagagctttgggctctcttacagttaaatccttggaaattgggcttagtgactcagatggaggggctgctgtaaaactgactaagttgacatacaaaaataaacttcctaagcctttacaagctgattccagtcaaagcttgttgattaaattttcattatccagaaccgttcaccaagctttccttaggttatattctggaaagaaagaaatcatatttgtagcagaacaagacagcagtaagttatatttggttgaagttaacttagaaaaggaactttctcagtcaggtaacttcgaaatggaacttatcttaggagatgctttgatcaccaatcctattcgctggggcttgggcactattgaggttaatttggggccaaatgctaaagaagatgttaaagtagtcagaggacccaaacccgagatccagcatttattccgccctgcagaaaaaagaccaccagaagcagtgtctctattcttcactgctttaactgcagctccatttttgatccttctaatttgctggggaagaattggaatcaatttaggaaactttacagtactagcgttacctttccacttaggttttggatctatattggcactattcactctattctggttgaagttagatatgttcatgacatgcgcctggttagttcccataggaggttttactttcctctccgggcacaagctattgagtcatttagctgccaatagaaagcaagataaggctgataagtaagtttagtactgtttattatttgctgataaagcgggtattttgttcacatacagataactttttgtacaagaaattttgttaacatttcagttctattcatttctttaacctatattgagaattcctaaggaattaattggaaaaaaaaatctttatttaaaaaatttccccgggggttttttggtaaggaagtaaaaattatttttttttggaaaaagttatggggaaataaaaattttgagggggggttttttttgggagcggcttggttttttttataaccccccccctatttttttccccaaagggagagcggtgaccaataagaggaatttttgttatggagtttaccaacccctctttttgggccgccaatatttttgttttttttgttttttatttgtcttccccccaaaaaatttttttgtt

SEQ ID NO: 2155 - DNA, 856 bp, Diabrotica virgifera
  misc_feature (813)..(813): n is a, c, g, or t
gtaggtaaacatatttgttgttggtgttgatagttgattagtcagtaattaataaactaaatacaaatttcgtggcacaatacccaaaatgaaacgaaggggagttaaaaaggcacaaaaagcagaagatgactctaatggagtcgaagattttgtagaaaaaaacggcggtgcttcagatgtagaggatgaaagcgacgagcaaccaaaagataagaagagaaaatctaaatcaaaccgcaaaagtgcgtctcctagcaaaaaaacagttgacgaatccatggaagaagctgacccccttgaagacgttgaagaagtaaagaaaccgaaagaaaaaaccaaaaagtcgaaggcagtatctgaggatgaggacgaagatggcacaggcgatgagacccaatacgaggtggagaaagttctcgacgataaaatgatcgctggcgttcgccattatttgattcgctggaaaggctatggacaaggtgatgatacatgggaacctgaagacactttgaattgtccagatgccataaaagcatttaaggatgccaagaaaaagactaaaaaggtcaaaaaagatgctggagaagagtgggacgagaatgaagactttgaggttagtcgaattttggaagtgcaccataacaagaatggcaagagagagtttcttgtatcctggaagggattttcaccgaaagacaattcctgggaaccagaagagaatatggattgtaaagatttaatcgagaaatttatgaaaaaagttgacaaagctaaagatgttgacgaacgcgaacttagagtaaatagaanacacgtgcaacgtttaactttatacacaccagacacatctcgt

SEQ ID NO: 2156 - DNA, 1049 bp, Diabrotica virgifera
ggaaaaatcgcagataataaaacggttcgaggggattttcacaataggttttttccccacgaaaacgtgacaaatagtaaccaatctttctaataaagctacgtctacgtaaatacgtagattctgtagattgtttccatttcagtatttttttagttgtttgtagtgttgtacaagtcgaaaatgggttacaaaaggaacatccaggccacacctttgataagagacaaatgcagagagttgattttaaccaatgaaaaactacacaaattgatgaaagtatttttggaaaatgttcacagaggtttgaaaaaagaaacccacccaacatcgatcgtgaaatgttttccaacatacgtgcaagatcttccaaacggaacagaaaacggcaaatttctagccctagacctgggaggcacgaacttcagagtcctcctcatcgagctcagtggcgaacactttgaaatgaaatccaagatcttcgccattccccaacacatcatgttaggatcaggcgaacaacttttcgatcacatcgccgagtgtctggctattttcgtcaaagaagagcaggtggccgaccaaaagctacctttgggtttcacattcagtttccccttgtcgcagaaaggattgacagttggataccttgaaagatggaccaagggattcaattgctccaacgtagtgggaaacgacgtggtgcaaatgttgaacgaagctattgaaagacgtggggacgtacagattgagatatgtgctattttgaatgacactacaggaacactaatgtcttgcgcttggaaaaatcactcaacacggataggttctattgtgggtaccggctccaacacctgttacgtggaaaaacaagcgaacgccgaaacatggagcgacgtggacatgggctctggaaacgtgctgatcaacctgggaatggggagcctttgggagatgacggcgctttggacttcatcaggactgaatatgatgagacatcgatagaaactctgtaaaccccggaaagcaaagcacgaggagatgatttc

SEQ ID NO: 2157 - DNA, 3221 bp, Diabrotica virgifera
  misc_feature (3186)..(3186): n is a, c, g, or t
gggacgactcgtgccggtcgtggcgaattcctcacattgcaccatcagtttgcgctgaggcgattgctggtcgctttctgtgtttctaccaagacaaaaatgaggttccacactatttttgagcaagtcgacgagctcggaagagtggaagttgatctgttggggctccatggtcatggaggctccgagagttctgttgagtaccacatcactaacgagataagagacaaatgcagagagttgattttaaccaatgaaaaactacacaaattgatgaaagtatttttggaaaatgttcacagaggtttgaaaaaagaaacacacccaacatcgatcgtgaaatgttttccaacatacgtgcaagatcttccaaacggaacagaaaacggcaaatttctagccctagacctgggtggcacgaacttcagagtcctcctcatcgagctcagtggcgaacactttgaaatgaaatccaagatcttcgccattccccaacacattatgttaggatcaggcgaacaacttttcgatcacatcgccgagtgtctggctattttcgtcaaagaagagcaggtggccgaccaaaagctacctttgggtttcacattcagtttccccttgtcgcagaaaggattgacagttggataccttgaaagatggaccaagggattcaattgctccaacgtagtgggaaacgacgtggtgcaaatgttgaacgaagctattgaaagacgtggggacttcgaaatatcagtcatggcaatattgaacgattccactggcactctaatgtcctgtgcttggttgaatcgtcagtgccgaattggtgccatcgttggtaccggctccaacacttgttacgtggaaaaacaagcgaacgccgaaacatggagcgacgtggacatgggctctggaaacgtgctgatcaacctggaatggggagcgtttggggatgacggcgctttagacttcatcaggactgaatatgatgaggacatcgatagaaactctgtaaaccccggaaagcaaaagcacgagaagatgatttctggaatgtacatgggagaattagtgagactggctttagaaagattcacgaaagaagctttactcttcggcggaaaaggatcagacatgttattcgaaagaggacgattctacacaaaatacgtatcagaaatagaaagtgacccaccaggagtattcaacaatcttagagatatttgtgaagaattaggacttaaacacgccacagaacaggactttatcaacatcagatacatctgtgagtgtatatcgagaagatccgcccatctagtgtctgctggtttggccactttacttaacaaaatgggcgagaagaaagtcaccattggcgtcgacggatcagtatacaggtttcacccacatttccacaacctcatgatggagaaaatcaaagaattggccgatcccagcatagagtttgatttgatgctctccgaagacggcagcggtcgaggagcagccctagtagcagcggtggcagcaagactacaaaaagaagcaggccgaacataacatcagctagtttaaaatataaatttgttattttttattagaaaaaaaacgattattcatgattgaatacaaaacaaaaactcatagaaaaatgttaattgggttcctatagactgcatttgtagatattaaacataaaggaatctttacttttttcccgtcgatcctcagatttttttaatcattgagtagttttttttgtgcctgaggagtgactttttaaccctctttaatcactatgtgactatcagaaagctaaatcctaaaatttttattcgagatcttcttactaaaatttcaggattcaatatttttataaagttattctgttaacccttatcaaaaccaaccccggaaacttttttgaggtttcagtcgctatttttgagcgaaatacggcatttgtgaggttatgtccaagttttcgatccaaaataaacctaattatctatgttattttcataaaagttcagtttaaatacattttagaaacatttcgaatgaatacaaaatgccgaaaacaactattatgatgagaatcgtttcaatttggtttatttttatatatctaagacttgtgacaaacttcacagtatgacgtcatcaccaatatggcgtgtagtatgaggttgctttccggggtcggtttgataatcgaaaaattatttattttagatttgttgtcattacattgtgattttgcattgccttttgagaaagaatactccataatgcattcaatggagtccgagttgtacataaaagcaaaaaaatgtccatctagttcaaaaatggcggcatgtagtgaaatgagttgctggacaacgtatatgtaaggccgtttttggataatttgtaattttatcgtttgattttgtcaaatcatacaattagtgattgatatgtagcggatttcggtctacgaatctcaatttcttttcgataacatttttggtactaagtatagtttatgaaaaaatgtagttttaaaatttataatgattcacacgtcagtgtattaacagtatttttttctttttactatgttttggacgatctagaaatacctacattgctataatgttgtttttattttaaaaaatatggatttgtcagttaatatgacaataaatttacattagttaagacgaacacaattcaaaaatgattatcgaactagaaatataactagacactccgcaatttacttttttttgtagaaacccaccattggcatctgaaaaacaagatattgtaccaatacattcacaaatattgatttatttaaccatttgtacaaaaaaaatcagtattttaaagcactaaaagataattcatgttttttaaactaacattacctagaaaaaaagtttcttatacgttttttactgtctttaagcttttatgtacaatgttcgacttttccatcttgtttttattgaatgctgtatagtttttgcaactagtatgatgtaatatgtgatcttagctactagatctacaacttataaatgtatatacacacaatcttgcgcgttcgctgtgaagagtactgtgagtactgggtaatctagagaaacggtacttaacgatgttttataccaaggcaatgggtttattttattngtaaaaaataaaaatatatagtgtaggtaacacgc

SEQ ID NO: 2158 - DNA, 1135 bp, Diabrotica virgifera
atttctcaaatatagtatgggttcattcggtaaacacattcaagaattggattcttgtgttagaaatgatgcagaccatcaatcacaaaaccgcttatcagacttagtggcagaacatttggaccatttgcactacctgaacgacatattatgtttgaatatcacagacctgaatcacgtattgactgatcacttgctccacaaattgctcattccattatacatatattctttatcgtctaaccgaaggaggacgtcttctaacgaggtggtagttcaagcgattggcaaaacatctttgacgccgaagagctcacagaatagcagtccaaaggttcatgatataaccaatggcaaagtatcctgcgtcgtagccctatttctcctatcgcaagtattccttatcctctcgcactcacctttagtacaaacactagcctggataatcctaaaaaccgaccgaacggttttcgaaaacggcgtggacaaacttttggaatactatgaaaaaataaaagaaaggcaaaattccgaggacgaagcttcgggaagtgtgcccagtgatagggaaagtagtagttccaaggagaatatcgtggacgagcagacgaacacgaacgttaccgacgaggagaagcagaggatggtgatccctgccgatggggctggaataacaaactttccttttttagagactgtttatgaggctctagactgtacggagaacgattacgctgccttgtttgggttgagtttgttgtacgcaatggccaataatgcaggtataacttcagatatcaccgagcaagtcctacgaccgaaaaaatcgttcatttcataaatcctcgtcagcatcgaaagacgtccggtacacctacaacaccttcttagtagaaaagatgctgctaataataatcttctcgtgccaaccgtcttgtagagtacgactagtcaccctagaactcgccttaaagctgttcatacaactcacggtgtgtgagggctagactgtatggacatatattcttcatatgtaatacactagaatgccgtgaggttgataagtatgtcgctgtgttggttgtctcttccctgtcctctctcccccttcaccacacccctactcttctttata

SEQ ID NO: 2159 - DNA, 862 bp, Diabrotica virgifera
cgttgattttgttatcttgatattttacttgtttggtcgataattttagttacgtaaaacaaattattttaaataagatgggtcgaaaagtaacaattgcagcttctactttaaatcaatgggctttagattttgaaggaaatctagacaggattttacagtcaattttagaagccaaagaagttggagctacatttagaacaggacccgaattagaaataagtgggtatagttgtgaggaccatttctatgaaagtgatacttttctgcattcttgggaagtcttagcggaactattgaacgcaccattatgtaaagacatattaatagatgtaggtatgcctattatgcacaaaaatgtttcgtacaattgcagagtgatattcttaaataaaaaaatcttactcatcagacctaagaaaattcttgctgacagtggaaattacagagagagcaggtggtttactagttggaaaaaggaaagacaaacagaagatttttatctacctcgtatgatttccagtattactaatcaaaagattgtaccaattggtgatgcagtaatttctacattagatacgtgtataggttttgaaatatgtgaagaactctggtgttcaagcagtccccacattcctttatcattagatggtgttgaaattatatgcaatggttcaggtagtcatactgaattaaggaaaaactacgtgatagccgatttagtaaaaaatgcgactatgaaatgtggaggttgttatgtatacagtaatttaagaggctgtgatggtcaaagagtttatttcgatggagtttcttgtattacgttgaatgggaaaggtttaaatagaactaaacaatttgc

SEQ ID NO: 2160 - DNA, 1327 bp, Diabrotica virgifera
cccacgcgtccggaaaaccagaaacaacaactacaagactttagccaaatgtataatgcccttcagagcacgtttgacgaaagaaatcagcaaatatcgacgttaaaccaacaattacaagtcactcagaacaacaaagaagctgagaagcttgaaaatgagctcactcgctacaaagatgagtgtttgaaacttcaacattatctagatgagtgccaacaacagcttttcaacatcactcaagatcttgctaccaaaactcacgaataccaaaccgttagccaacagttggcttactcccaacaaaatgctgacttccttcaaggacaaataaatgatctgaacggaacgctgcaccaaaaggagcaagagtatttggtgtccttggaaaacttgaacaagagtcggtacaaagaaatcgaaacgcattacgaagaacttatggctgccaaagatttggatatacaaactttaagagcacaagttgctgaatcggtgtataatgcaagcgagcaatctactctcaaggctgaattagaaaatcaagtaaagaaattagaggagcagatagtagaactgactactatcactggagagcagcaatctaaaataaaagaattggaagaaaagctttctgagcagacttctttatccgaagaagaaactaagcaattgtccgaaatgcggggtatcatagaagagcaagttgtaaagatagaagacctgaagaaggaactgttccagaagagtaatgattacgacagtctcatagctcaaatggatatcagcaggagcgcaataactcaacaaccagttgcttccacttcgattgaagtaccgtctcattcgtcgtcgcagagaccgccccttccagaagaagaacctgagctagttaatcgtgccgagctggatatagctctttatatgttgcaccaaagagatgtgcgctgcgaagagcttactgtagaactgacgcatctgttagaagagagggatacgttacaactgagactgtctactgccattcgagaaaaggaggatatgaggaggaagaatgtagggggtggagctactgcagaaccgactacttctaccagtgacgaatctgtatctccaagaagcagaacatcagaaatcttcctcgcagcatccggtactgaactaactagtgaaccagcagaacatttaactgccaaacaagatcttgctagcaagttgtcagaactgaagcaggttggctataggaaaagacagacctttgtagatgaacaagagcttcgtcggcttcaacagatgtccataaatgcacagcacattaaggaagctt

SEQ ID NO: 2161 - DNA, 946 bp, Diabrotica virgifera
gtctccttcgtttatgttacgcttttacgcatgatcttctctttctaacccatagcgaatactgtggaaatagcgaattcgatgtccgtaatacgttaggaaaaaaatcaatgtattgttcatgttgtgtcatgtacggccgggtgtgttgtgtatcgggttgcgcaaaaagtattttctagctataaatacctttttattttctattatacattaccaatttttcagtttaagtacctggtaccaattattttcgagtaaaactgaaacttcggcaggtgataacgacataagaaacatcgtttttgcgttgtagcaaaaatggcttcagaaaaaggggacgccagtgttgatgttgatgctaccgaagaagtcgacatggaaaaagctgtcaacgaagagctcgcggccaaagaaaatgccactgccggtgaaagtttgataagaagaagacccaagaaagttcacagacaaggttccaaagaaggggctctcccagcagggttcgttcacggacctaggtcttggaaaaacagtcgccgatcgaggaatggatttggtagaggtttgccgaagaagaagggcgccggaggcaaaggtgtttggggtctccctggatctgaactgctggaagcttatgaagatgttgatgatccaaattttgataatgaaaatatgagcaatggtgacatagagcttaaggcagttgtacctgaggtttctgatgaagaaatcaagaaaaaagtcgaaccaatcattctcgaatatttcgagaacggcgacacccacgaagcagtgcttaccatcgaagagcagattcctgtgaaaagaagagatacgctggtcgagcagctcatacagatagctatggatcacaaaactgcgcacagagagatgacctccaagctcatctccgatctcttcccaataccataaacgagtctga

SEQ ID NO: 2162 - DNA, 926 bp, Diabrotica virgifera
gattaattaacgtcatagatttttgtgaagacgcttcggttttttcaatttcaagttccgaatgaggtaaaaataaaggaaattgggatactgtgtgataagaaatctaatgggagcacctgtacaacaagggaagccaaatagacgaggtcctggaaatatgagaggtcgtggtggaaatccaaaaatgcgaggacaagggcgtgcgtttaatggacaaccgccatttgggaatcctggaatgatgcgaggtggtttcagaggaaatatgaggcctccacaaggtcccccaatgcgcggtggaagaccccctatgagaggacgtccgcttccccctccgccaccgagaatgatggggccgagagggcccatgatgcccccaatgagaccacctccaccaggcatgaggccacccccaggtatgagaccacctccaccaatgatgatgatgggtcctatgcccccaccaatgagaggtggcatgtttagaggaggaatgagaggcaagggcccatttcgtccaggaccaccaatgatgcctaacaacaatttcagaggtatcaacaaaaaaagcaaaattatcagaaaaggtaaaactgttcctgttgacatagatctaaccaaatcttttgtgacagaagccattaaggcggaatttgaaaagaaagaagaattcttctataaagccaagacttctcagaagaaagaagattggataaaatacaaggagcaacgagataaatgtgcagatgtctatgaggaagccgaaaagggatctgcagggcagcaggaggtgcgtatcccgcagctattgcccgaaactaatttcacacgagttacggcacctattgattatacagcagacatccacttataggacagtagcaaaaagtcagctgaatcagaggtgaaaaaaattctgaaat

SEQ ID NO: 2163 - DNA, 940 bp, Diabrotica virgifera
taaaaatgtacgatttgttatatttacacgcccgaataatattaagaaaagcactcaacacaatggcgattgggtttagacagttgatcaaatttgccaacttttcaagcttggtagcttctagaagcagtgcttttaaatttgagaaagcctcacaagttcaaattacacaaacaaatcatcagtatttaccaaaggttgtaaagaagtttaatcatgaagaaggtcttcaaagtcaggaagtagataatcgagaaagtgataatgacttagttataaaagaacacgtttttattgtagacaaccctgtagtaaaagacttaaatagactaaggtgtttaaattattcagatgtatcaagtaattcagccgccactggcagccagtttagtgtacctaatccacatcagtttagtagtcagaatcaagacgagaagtctaacaaaccaagcttagaaaaattgacacatgtgtatgatgtattggcagaaacattgcccaaaatatttattcaatccttagattataagatttaccacaaagacattgtatttgaggataatattagaaatatcagaacagtaggtttatacaactatgtaaaacaagtagcactgctaaggactatagggcatttaaaatttgcttatgtcaaattcgaaatattaaaaatcacaaaacaccccgaggattcttcagtcaaagttaggtggcagatcagaggcatttcagcattgagagtaatgctaacattttggaaaatcaagttgtggaatttcaaagagatatttgaaaggactgacagttggtatgatggtttctcaacattctatgtgaattctgaaagacaagttatcaaacatgtagctgaaaagatgatgccagattcagatcacgtgccagtgtccagtccaaagccgatagtcgggcgcaagcgcgc

SEQ ID NO: 2164 - DNA, 918 bp, Diabrotica virgifera
gttccttacatttttttggaggtgtttgtttagcctgtttaaataaattaaaagtaattaaacgttttattgctggcagtttgcatgtctgtggtttaaatgtatttttgagcaaaatcctctaattattaaaagaattaaacaaatttttccaagtaatatgaagaaacaaatatacatatctagttcaatattatggttaacgctccttttatcaatatctactacgcacagtagattagaaagaacatttatagatgagaagtataaaacattggtgcgaagactcaaaatccgactagggactcctagtcaacacgctgtaagaactgcaaaaaatatacaactgctgaaaagtagtgatacactggcagaagaatcaccttttaaagattttccgtgcgaccgaagcaacacaaaaataagaagtgacaccgtaccaacaaatgttaatcaagtacgacctggagatatcgatatcatagctgctatgggtgacagcttaagcgctggtactggaatttcgtctgctaccatgcagcaagaattgttctcggaagaaaggggaagatcatggtccataggaggagaagcagattggaaaagattccttacattagcaaacattttaaaagaattcaatccaaaccttttcggttattccttaaacacgtcacaaagttgggcgtggaattcacaatttaacgtagcggagaatggtgccatttcgcagaacttgccgtttatggcaaaagagttagttaaacgtattaagaatgataagagaacggatatgaaaaatcactggaagatgataacaataatggctggtcataacgacttttgttcagaaactgctattacaagaatcctaacgacatcctgaagtaccacagaagtgacgttatagaaattgtg

SEQ ID NO: 2165 - DNA, 1431 bp, Diabrotica virgifera
gtattattccccatcaaataacacaaaagtagcgttacttcaagcagcgtaaactgtaactcggtaaataataatcttcttcttcttcagtttattggcctccacctacttgggtatttggccagctcatcgtctcggaataagggaaaaatctcttacaatttggagttagtacataatccgaatgacatgaacattttggcagtacgcttatgaaggttatggctacggaaatgtcaaatggaaaattcattagagccgccatcttacggttagacccgggacttattgacgacgcattatatctaagccagttcgcgagctcaagcgagggtgctgtcgcttatttggaactagaggatttgggatgaaaatataaatgtatcaacgtcgtttgaaagcttgtcggatgtgttcatttaatgaataatttatttatattaattaattacatcaataacaatattaattataacaaaatacgttatcccaattacatcggccattttcatgcaaccgcacacttatagtcgattgaattcgcgaatacatcctatgaatattgacttagaggcatctgaaggcaggcccgcacagcagtctctgattggctataaaattgctagaaatcaactgtgtacaacatgcaaccgacatctgtcttttttatgttttgtgcacaatttcttgtagttttaggggcaaaagtgtacataagcattgtagttaaacgaacgaaaataaaaaatcaaaaaaagaacgaaagcaggtattaaaattgtgaagattgtatttttgcaggaatctgttcaaaattgaagtatgaatttatttttatacaatattcagtatgttagaaaaagatttcgaaatgaaagaatgtctattgacgtttatgttgtttttttcgctgtttggcagttaaactatcttttaaggcagttgtaaatttatatgttctcaaatacaacatgtatttttttctttatatgtacgagggtaattcctatgcctccaaaaaagggtgcgacgtgacgaatttcttccagaacgactcattctttctgagataggtatagaatcttattttagcgatgacgaatgtcttcgaacataatgatagccctgaagatcaactacctgatctatccgatattgttatatatatttacttctcaaaaatgcctatcacgaagttaaacctgttgaaagatcctgcggagtgtgtgcgaaagatgctaaggataataaagttctaaagttgaaaaaatattatatatatttatattaagaatgatatgtggtaatgaatctctttgaaattattagaatcacataaaaaaaaacaagggttgtcctttttaaggattaaagattaaaaatcgtgaggatgaaagtcaataaatttctttaggggtcccaaaaatccaa

SEQ ID NO: 2166 - DNA, 1011 bp, Diabrotica virgifera
atgattgtacatattgcctttcaggattgccaactgttttcctgttaagtttatgtttatgtggacaatcctttgaactttagacgttctatactgatatggtcaacatttttacagtttcctgtaaaaatatggcttatagacaacaagaccataaactttttaaatccaaaaatgaaaaaacatcgttgtgtatcaaattgtgaaaatacaagaaatgaattgtattgcacaactgatatatgcatataacaatttaagaaaggactgtgagttgtctacatttggcgccactgagctgaataacctgaaaaatttattttaaatgctcttaaatacaatgtttttgttccgacggtaggttgcggaatcaattaaaaataagtgtaaacaatgaacagtaatatatttatttataatatttttatattataatattttattattataatatttttatattataaacaagcgtgcttcgtttattatctcgtaagggttttgttgttttagcgagggtgtgtctgaaccgcgcgcctgctgtgacgatactgcgagaccaccacactattatatcaccatgcttgcggttttacaatatggctagaaaggaaatagattacgacatctgcgttttaaaagatgagaacctttctgtattttaagaagttgacataaagagcgtggcaatctggcctcaaaatctattagtgtttccttgaaaaaaacattaattttatacaatctgcttagggatacattttgtttcttaaacttaacggtccttgttagcatatggtttgtatattaaatgtgaattttaaatgactaatgttatttcgttttgagaaaaggtatttgaaatttagcaaaaatagtaattaaagcgtatcgctatattatatgcatttaacatttcaataaagaactgtgagttgcctacatttggccccactgactgaataacctacaaaatttatttaaaagcctcttaaatacattttttttaat

SEQ ID NO: 2167 - DNA, 456 bp, Diabrotica virgifera
  misc_feature (429)..(430): n is a, c, g, or t
cacacgcgtccgcgtgtttaaggaacccacaactcgactttccttcaataatcttttatttatttctttttcttcccttccagtattagttacagtcgctactaggtattcgaattctgatacttccttaaatttatattcatctccttctcctttaatttttatatagttatcctcttttttatatctcctttcattaccatgtattgtgtttttccttggttgattcttaatcaatacctttttgctttcgcttcgaacttttgggagattttttggaggtggtaattttaactaatagaataataatattaaaacaaactagaaactagtcgctaagcgacctgcacgtccagtcactaccgactgatcactgacgaattacagaccggttaataactactagcgctttgtgcgggatactattannatacatggacagtaactaatacgcag

SEQ ID NO: 2168 - DNA, 940 bp, Diabrotica virgifera
gtgattattgtttacattaatttgtgttgatagaaatatttaaaattataaataatttgaatttgatttattactgcaagcgctcacaatagttgcatattaaaaaagaaacaataatgccttaggctaataactagcagtaataaattgtgtttaaagtagaaatgtaaagattgcaattacaacatgaatctcggcggtaccataagattgaataaattcggaatatttatagtattatgtataatattcatttttggattacacgtatttactaaaaattcagaggctacctcagaaacaaaaaaaattaatttgtccactcttctaaatgtagcaataaaggcagcagaaaatggtggcaagagggtagtagaaagcaaagaaaacatgaatgttcaaagtaaaggtttaaccaaagagggtatgcaagaaagtgtaactaatgctgatattttatctcactgtgatatgacaaaaacaattaaatatttcttccctagagtgaaactgatttcagaagagaatgttaaaaactgtgatgataaagctaatgttgattattcgttaatgaatgctgtggatataaataataatttaattaatgaagaagatattacgatttggatagatccattagatgctacacatgaatatacagagaaattatacatgtatgttactactatggtatgtgtagctgttaaaggaaaacctgtgatgggtgttatacataagccatttgaaaaaactacctcgtgggtttgggtagataaggccaaatcaaaagatttaatcaatcaggaacctgaaaataaaagtcctaatataaaagtaatagtgtctcgttcacataaaggtgatgtggaaaaaattcttcaaataattttaaacaaaaagtagacattataactgcagctggtgctggttataaagcttt

SEQ ID NO: 2169 - DNA, 1281 bp, Diabrotica virgifera
  misc_feature (1151)..(1151): n is a, c, g, or t
  misc_feature (1191)..(1191): n is a, c, g, or t
  misc_feature (1193)..(1194): n is a, c, g, or t
  misc_feature (1196)..(1197): n is a, c, g, or t
ctcacattcgacattaggatattttgtcgattaatacagaaaattccagacttccttagtccaataattgcagtgatcaatttagaatcaaatatctagtcgagaacagtgtttttaaaactatatacatatattttaagtaagtagaaagcgtgcaagtattaggaagcatggtgaatgaaactaaattttatgatattctgggtgtcaaaccagactgttcacctgaggatttaaagaaggcctacaggaaactagccttaaagtaccaccctgataaaaatccaaatgagggagaaaaattcaagcagatctcccaagcctatgaagtcctttcagacccggaaaaaaagaaaatatatgacttaggaggtgaacaagcactcaaggaacgaggagttggcggaggtttttcgagccccatggatttattcgacatgtttttcagtggtggatttggtggtggtcgacggaggaaagaacataggggcaagaatgtcatccatcaacttactgttactttagaggaactttacaaaggagcagttaggaagttggcattgcagaaaaatgttatttgtgataaatgtgagggtagaggaggcaaaaaaggagcagttgaacaatgtacaacatgtagaggtacaggtgtacaagtacaagtgcaacaaattggattaggcatgcttcaacaaattcaaacagtatgtcccgattgtagaggacaaggtgaaaagattaatcctaaagatcgttgcaagcagtgtaatggtaaaaaagtagttcgtgaacgcaaagtattagaagtacacattgacaaaggcatggttgatgaacagaaaatagtattcactggtgaaggtgatcaagaacccgaattggaacctggtgatataattatagtactagatgaaaaagaacatccagtatttaagagatacaatgtgcatgatttatacatgagaatggaaatacaattagtggaagctttgtgcggttttcagaaagctgtcaaaacattagatgatagagaactggtgattactgttttacctgggtgaagttattaaaaatggggactacaaatgtattttaaatgaaggcatgccacaatataaaaatccatttgaaaaaaggacgttccatcattncagtctatgttaagtttcccgatacacttcctccagaatnanntnnctgatttagaaagagttctaccacccagagaagaatccatgatctctgaccatgcagaagaagtgacattggttgactttgatc

SEQ ID NO: 2170 - DNA, 987 bp, Diabrotica virgifera
agactgtgtgcgtgtcatgactttgcttggtagttgatggttgtcaaaaatggttcaagccggtctgaaaaagtcatcaggatcaaaaataaatagcaaagctggaataagtagtttaataattttcgtagtcctacttctagcatggatcgcagggttttcttcacgtctatttgcagtaatcagattcgaaagtatcattcatgaatttgatccctggttcaattacagagccacggcgtatatggtaaaacatggattttataattttttaaattggtttgatgaaagagcatggtaccctctgggaagaattgttgggggtactgtttatccaggtttgatgttaacatcggggagtattcattacattcttcatttactccacataaatgtacatattcgtgatatatgtgtgtttttggctcctgttttcagtggccttacatcaatttccacatattacctgacgaaggaattgtggtcagctggagctggattgtttgcagcatgttttattgccatagtgcctggttatataagtcgttcagtggcaggtagttatgacaatgaaggtatagccatttttgccttacagtttacatattatctctggattaaatctgtgaaaactggatcagtgttttggtctgttgcagcttcattgtcatatttctacatggtgtcagcatggggtggttacgtttttatcatcaacttgatccccctacatgtatttgttctacttttaatgggtagatattctaaccgattatttacgagttacaccacattttatatactagggttgattttctcgatgcaaattccttttgttggtttccaacctatcagaaccagtggacacatggcagccgggcgggtgtgtttgcactgatgtttgctgttgggggctttgaagtacttacaatcaatgatgtcaaaatcagaatttaaatcctttcgtataatttggggacttatatc

SEQ ID NO: 2171 - DNA, 1594 bp, Diabrotica virgifera
gattaaactaaaattccaaaatttcgttctgcattatgcaaaacttgatttatgtttatataaattataaacatgtaaattttggtgctattaaattaagtgtaaaattattaagcatggtaaagttataaaaaaataaccaaatcttttgtttgttaaaattcttagaagtaataagttaattaactatttaaagttattaataaacaattagaaggtaaagtgaaataaaaccacttttaattcgatttctatgaaaaaagtcaatatatgtggaaaaatttaaaatgtcttcaatactgtttccttggtttttacgctaccaaaatacgtttgatttatcgagtcacatcgaaactatcaatgtattaataaatttgtaatgttcattagtcatttaatattaaaatttttaggattacatgtcattattgcgtaatatagttttgcatttcaaagctagtcctattgaactggattctacttgttaggaaaaagaaatgattagaaatttcataaatcttttacaattttcaatattccatgaatgtctttttgcggtttcaaaatttcatttaaatcaaatttcaagacaatctatatttgctttatagctgcctttagttattaaatttgtactatattcctgatccgataaaattggtggtagataacgattgatttttaacattattaggtttgggctaagtatctactagtctgggtatgtctagcgttacaatgtataacgtatagtgcgaataacgtgcgcaaaatggcgattttcgctaagagttacctaaggcccgtccggcgaaacgatcagattttctgcattcattcagtggcgtattttcaagaagttagttaatatattattatgtgtctttatgtaaattttagaatggcttctttatttttgattcaaataatggatatgttaaataatttattagtcgattaaaaatacgctataacctagaccttaagatatataaaattattgttaatttgtccgttaacattttgctatttaataagggccgccgtagctcaggctgtaggatatctgactcgcatgctggtaggccggggttcgaaacccgcgccggcgagaacatctagacatttttaaaaatgtctataggccccaggtcgactcagcctgaataaaattagtactttgggtaaaaccaggggtaataataggcggttgaagcgtagcactgaccctgttacctttcttgtataccgtaggcactagatatagcagactaccctgctataatcccaaagccgctttagcggtataaaacgggagactattataataacagatacagataatagtttcttgttaattactgtgatgcatgctgtattctttcagtttcggctcaggaaatattatttgttaacttcctcagaaattgtgtgcagataataagttaatacaatctaaccccaatttttaatatacacaggaatcgacacgttttttttatattatttcataaaaatttttacacacctacttaaaacgagtcttttaatagtgaattagtgatgctgccaaatatttatgaacccgatt

SEQ ID NO: 2172 - DNA, 3298 bp, Diabrotica virgifera
  misc_feature (2005)..(2005): n is a, c, g, or t
gtagttgcaagtaaaataaaacggaagtatcataaatacatttaatattaaatcattattaatatacataattttaaatatgaagtgacaaatatctttatctaaggtcgggaataatataacaataaagacaaatatattaatataatggtttctacaagttgtgaataaagtaactataaaccagatttacggaaagcaatacataccctactaaacacaatttgtgatactgggaacaacttggtttaacaatacacataaagaaaacaaaactaagttatcctagtttatctaagaaaacttacggttatcagtaagaaatgtgaagtcataacaagaatccagataaagaatgaagatattgaacaaatggacaaaatgaaatacttaggagtctggattaaggaaaatctaaatatgcaatcaaatttaatcaagaatagaccaatcaaaagcagcctttttgaagataaggaaattactaagtatgagtaaccaaaaactcaaattgcaactcctatatcgagtggtaaaatgtccactctactctattcttcttttaaggtactgaagcttggactgctaatgttgacataattataaagttggagacttttgagatttgagatgtgttttcttagaaaaattttgaaaataccatggactgatcatattacgaacgaaatggtgttgcaaaaaccggaggagacagagaacctttgaccaccattaaaaggaggaaaacagcatattttgggcacatacttagaaatgataaatacgatttgttatagctaattatgaagggtagcatagaaggaaaaatgggtcctagcagacgacaaatgtcctggctaaaaacattcgcggctggaccgggtttaacacacaggcgcttttaagaaaagcagaagatagagacgaatttggaattcgtcaaatgatggcataaatgaatattatgtacgttagaatggtacaaaaacaatgaattaaccttgaatgacagaataataatgatatctaataaaaacagattcgcacaaaatgcagttaataaaatgtaatgcaataaaataaatataaatatacaattatacaatacagtttatgaactgcattatgtcggtttgaatatttcgtttggacatattcactattaataattattagtcaacgctagcaaacacaattcacgactattaatctcactggtcacttttttccaactggaggtgtaaagattatcgtttctaccgtcaatgagtaggtaagcgcccctggattatctaataaaatccaaatttttatatctttattatacctaccgcaaatttgaaacgtgacatttcatgaggtataaaccttacccagtgtaatgtatttgcattttaagatatcatttctgttattctttgaattgagaaaaatatttcagttgtttatggctccatcggtacccaaacaaatgcggcttcaatttatttttcagaaaaggctggttttattagattttattgcttctttcaataattctttggaagtggttgtcgtttaattttagtgttctactggtggcttaaagtttagagttgacagaaaaaaataataaataataaaaaaattcttatagactaaatacaataggggggtctatagaccccttgaccctcccctgtatccgcgcctggtaacaagtttttttcaaaagaaataaatattggtttgaaataaactgtgattccatataagtttgattgtgtatattatgtacccacggttttatcttaagaaaatgtaaccagatcaggataagcgcctttcgtgtgaacggtagaaagtcttcatttatttaacatcataaaaactttgtgttcttgtgtttgagcttttgattaaacattgtgattttttcgttcaatttatcaattgctaaaagttattagatcccttgtatcgtccagttgtctgcaaactatgtacttaccgaaacaacacattntcattgttttcatattttataggatttaacagatctcctaacttttagctgatgataaacaatatttagcatatatttttttagtagctaaatttttcttattttggaaaaaaataaatgtattaatcaatgttgagaaaatgtaacgtgtattcaactactacttactacttaattcatcaactacatatcccacaaaaatgatcgaatctcaccattttgtaacttactaataggaagagatatgtatttaggcctaagcaacccaatacaatgtatttttaccttttttaatcaaattcctttattatatataagataattataaactctacgtatgggccggcgtagttcagcggtaggatgtctgactcgcttgctggtagacctgggttcgagacccagcgccggcaagaacaactagacatttttaaataggccccaggtcgactcagcctgaataaaatgagttccttggctaaaaccaggggtaataataggcggttgaagcgtagcactggccctgttatctttcttgtataccgtagccctagagatgacagcctgctataatcctaaagtcgcatatgcggtataaaacggggaaactattctataaattctatgttttattaacaaatttaaagtggtactaatccacatctgtgatagtcatggtcttttgactgtgttcaaaaagtcttaaattatatttcttagttgcaaactagttccaagaataactacaatgattatttacagatttgcctaaagatatacagattctaattgttcgatagttccatcatttcattaatcataattaaaaacctataatgaatcttcaaagcaaaactatactacaaatatctcaaatgtaactttgacatttagcatcgttctgcgacataaatgcaagaaattcgataatttttgtgtggtgttaattttaaagttgttataactttcttccaaagttatttagtgatgattttgacaagtataactactatatcatatttagttttttctgattcgtctactatgttattaaagcagcttctgtttatctgtattcgttacaaaaaactctggatttagtactaaagaacactaaaccacgtttggtttatttttgaattagtattgtttggtactaaattccgatggttcacataatactgctactaaaattgtaaattatattttataagtacattacagtcattgatcacattaacattcacttttttattgtagatttctggacaaatatattttattagtatcagt

SEQ ID NO: 2173 - DNA, 1807 bp, Diabrotica virgifera
  misc_feature (94)..(94): n is a, c, g, or t
  misc_feature (130)..(130): n is a, c, g, or t
  misc_feature (217)..(217): n is a, c, g, or t
aaaaaatgataactcgcaaataaacaaaataaaaaattaaaagacaaagaattgaagaaagtagagaaagtcacttatttgggatcatcatggnaaagaaaaggaggatgcatgaaagacatacaagcangaataacgaaggcacaattcgccttcaatgcgttaaataaaatctggcaaacaagtgaaataacagagtcaacaaaaatcaatatanttcaatacatgtgtaaaaagcatattactctatggagcagaaacttggaagcatgacgaaagcacaacaaagaggctacagacttttgtaaataggtccttaagaaagatcttaaaaatttactggcctaatataataacaaatgaagaactatggaaatgaacgaaacaaaccagtataatagcaacaatcagacagaagaaatggaaatggatcggccatacgttaagtaacatcacaagataagcactcgaatatcaacctgagggtacaaggaagaggggacgaccagataatacttgaaagaaaacagtaaccagagaacacaacagaatcggcttaagttggggggaagtgaaaaacaaagcaagaaacagaggagaatggaaggaactggtacgcagattaaccagagaataaacacaagaagacgcgctgagctggccaccagctgtcttacactatcggccaagaaacgcagatgcgcccaatactccactaggagtgatggtccaagagagatgcataactcgaccaagcgccatttctttaatatcgagataacagcggattctggtgacacatagctaaaactatcttggaaaaaatccctgttattgtcactttaacggttactaagaaaaacaaaattaaaccaagcgacattaatccacttaccattaagcgaccattaagcaaccaagaaacgaaaaactttgaagccatttatctcaaaactatgttttggtgcttggtcgagttatgcataacgccgtccatatgatttactttactgccaaattatcaaaacatgacattttttgtaacattgttttcataaattcgatatctatatgtagcttacttcaccagtttatagcttaagaaaaaaattttgtaatttttgagccgtgggtcacaagatggaattgttttctcccacattttcatttcagttgttttacagtataaaataatttaatcaatataaaatttaatttttttaaatactttacatggctcctagcatgtcaattttattggtgttctattttatgaaactgtacaaaaaatacataaaagttaaaattatcagaaacaacattgactgaaaaatcagtataacttaataatttattccagaaagagagcatccataaactacttcatacagaaagagggagggggactttgcttattaggatggtatatgacaggggagtgggacatcagtgcacatcctacatcatttagtcatttaaatttatcgattttgtctttataaatataattttttactagcttctatcatgtatgtgtagtgtcccaccaaaaaatctgttgaactacatggatcaaaagttcatagaaaaaagcagaatattagctcaatatgcagctgagttcgcccaataaaaattactaaatatagaaatctgaaatgccttttttaaagatactgatgaatctaaatatttagaattgatcgatatagaaaatatatatcctgaagtaactttcccagtagaaaataaagagagcaataaaataatattaatgtcgacatagaatggatgaaataagtgtaag

SEQ ID NO: 2174 - DNA, 904 bp, Diabrotica virgifera
cggacgcgtgggagactattaagattttcagtttttatttactaatataatttgaaatttttattttaaaaatgtctatttcttttaaaggaaaagttgtcctagtcagtggtggcagctctggcttgggtggagctacagccaaacgtttcggaagattgggagccaatgtcgccattgcccacaagaacatacctggagataccatcgaggaagtcgtagctgagatttccaaattttcgacgccactggtaatcgaatgtgatttgactgattccaaacagattgagcacgttgttaaccagaccgtaaagcattttggaaaaatagacgtactagtaaatgcagcaggtattttgcagaatggatccatcgaaaatacaactttggaaatgtttgataaagtgatgaatattaacgttagagctatgtttgaaatgattagagtttgtacacctcatctgatcaaaactcaaggagcaattgtaaatattagcagcgttactggtttgagggcttttccaggtgtgctagcttattgcatttccaaatcagcggtagaccaactgaccagatgcgttgctttggaattggcttcaaaacaagtaagatgcaacagcgtgaatccgggagtcatcgacaccattttgcacaaacgatcagggcttaatgacgagcagtacaaagccttcttggaaaaaagtagactgacacatgcccttggacgtgcaggtaccgctgaagaagttgcttccggtatcactttcttggcaaatactgatgctagtttcgtaactggaaataatttccgaattgatggaggacgtggtattatgtgtccaagataaaaaaaaataattcagtatgggacataaacaataaatgtggacccaatttgcataat

SEQ ID NO: 2175 - DNA, 1413 bp, Diabrotica virgifera
ggctataatgatgaagatcaagttttaggaggaaggaaatttggagatagaccaaaaagtactggagaaagtcgttatggtcgtggaggtgattatggggatgactatgaccatgacactagaccaacacgatccaaatatagtaggtttagaagacatcaagcaacagaaaacgattcagataccgaaccaaacactagagtgagatttaatgagcacaaggagaaggaacgagaacgtgcgtttgatacagaagacgcatctagaggtcctcttagtggaataactaggcttgcagactcacccagggtaatgaaaaaaatgcaggaacatgaaagtggcaaaaccaagaaaaaggaagaacccacccctgcccctgtccaacctaaagttgtgccaaaaaggcctcctccgccagccgtaaggcaagttagtgaagatgacgatatagctagaattaagaaacaaaataaaggggctactacgtcgacggatacaacgacagagacagtgaggcctgctactgaagaaagacagcggaaaacaccagcccctgaggtgagtctagatgaacttgaacagtagcctctttataagcactcaagtacctgattaaacaatttttagaatagagctcttaatagataaatattaaatgttgtgttgcttgtacattctgtaaaaattaacttgaaaagtatagatgactattgattaccccgattacacactggcatgtttctactacttcttcttcaaatcttttttgtgttgtgtgtaaagcatgaagaatgattgaaaaaaaactacacaaatcctaacaccctattttctccaggctgtctccagcgccgaagaaagtgaggagtctagtaaattctcgtcaacagagtcaaaaaaagacatcccctaaaagtgccaccgcagcaactccaaggcgaccatctgatgctagccacaagaaatccgcaagatcaggtagctctgaatctcatacatcttccgaatcctctacgtcctcaagcgcagatcgatctactggagctcctttcaccacagatgaggttaagaagaaaattctctctagagtagaaccaactacaccaagtaaaaagaattcatcacctgtccaaaacaaacctttccaaagtcgatttttagacaagaatacaacagctccaactaaggaagaagaagaagatgaaacggaaactagctctgaagaagaaactgaatctgaagaagaatctgatgaggaaacacagaaaactgatactaaggaaattgccaaatctgatataggtcctcttttagctagaagtgcaaatgcaaaagataatagtgtcgaaaagcgttcgtataaaaagtaaagaggaacctgaatctcctgaaaaaacgagatatgggactact

SEQ ID NO: 2176 - DNA, 3703 bp, Diabrotica virgifera
cgctaagtgatgcatctgccggctttaagacataatttagaaaagtgttaaaaaaattttccacaatttttgcgacaagtgataaacccgatattcagtgcggaacgaaaaatttccatcctaaccttatagcagaggccagctagtgttacagccctacggggcctcggatataagcgccaaagaatctaacctcagctttacgaattaaacgaggaaataaacgactgaaaaatggagcaattcgagcagctattgacatgcgctatttgcttagaccgttacagaaatccaaagcttttaccatgccaacacagcttttgtatggaaccatgcttagaaggcactgtagattacgttagaagacagatcaaatgcccagaatgccgcgcagaacacagaataccatacaatggagtccaaggatttccaacgaacgtaacccttcaacgctttttggaactacacatagaaataaccggagaactgcccgatccaaccagtggacagatcatggaacgatgcaacgtctgttcagaaaaagcatactgcagcttctgttctcactgcgataaaaaaatatgtgaagagtgtaaatcagcacatatggaaatactaagacgagaaatttctaggataaataatcaaatcagaaggggtattcacaggttgcaggatactctagctttggtggaaaagaactcacagaatatgcaaacgaactgtttatcagttggtgaggaagttgaagaaatatatagaagacttagcaaagctttaaaagaccgtactgactatttaagaggagagctagacagataccttggtaccgaagtaagaagtctgactactctaaaagaaaatttagagctagaaatatcgaatattttaagtaattgcgacctagctgataaacatatgaatgaaaacgtagatatctgggatgattgcgagcttatggatgccaaagaaatatttttaaagactgtagagtttattcgtaatttcgaatacgaaaacgctgactacagtcggaaagtaaggttagttttagcacatgatcccaatcaattggtactccatgttgctggttttggagatcttaatttaccaagtcagtcacactttggtcaacagcctggattattgcagcctccaaattctggactaatgagatctaagagcgaccatcgattagcctcacaatttaggcaacaagaagaaagaggatatggggaacgaggctataatgatgaagatcaagttttaggaggaaggaaatttggagatagaccaaaaagtactggagaaagtcgttatggtcgtggaggtgattatggggatgactatgaccatgacactagaccaacacgatccaaatatagtaggtttagaagacatcaagcaacagaaaacgattcagataccgaaccaaacactagagtgagatttaatgagcacaaggagaaggaacgagaacgtgcgtttgatacagaagacgcatctagaggtcctcttagtggaataactaggcttgcagactcacccagggtaatgaaaaaaatgcaggaacatgaaagtggcaaaaccaagaaaaaggaagaacccacccctgcccctgtccaacctaaagttgtgccaaaaaggcctcctccgccagccgtaaggcaagttagtgaagatgacgaaatagctagaattaagaaacaaaataaaggggctactacgtcgacggatacaacgacagagacagtgaggcctgctactgaagaaagacagcggaaaacaccagcccctgaggctgtctccagcgccgaagaaagtgaggagtctgtaaattctcgtcaacagagtcaaaaaaagacatcccctaaaagtgccaccgcagcaactccaaggcgaccatctgatgctagccacaagaaatccgcaagatcagctagctctgaatctcatacatcttccgaatcctctacgtcctcaagcgcagttcgatctactggagctcctttcaccacagatgaggttaagaagaaaattctctctaaagtagaaccaactacaccaagtaaaaagaattcatcacctgtccaaaacaaacctttccaaagtcgattcttaaacaaaaatacaacagctccaactaaggaagaagaagaagatgaaacggaaactagctctgaagaagaaactgaatctgaagaagaatctgatgaggaaacacagaaaactgatactaaggaaattgccaaatctgatataggtcctcttttagctagaagtgcaaatgcaagagataatagtgtcgaaagcgttcgtagaaaaagtagagaggaagctgaatctcctgtaagaacgagatatgggactactagagatgaaccgtccaagtattctagaagcaggacatcgactgtaacggaagaagaaacacctaagtacggttacacaagtcgatttttaagcaaaagcaaaagttctgcagctgtgcctccggaagatgaagattacagttcgagtaggtacaattctaccgcagatgacgttgatagtaagtacccagcaagcggtcgttcccgctatatggctttgaaagaacgtaggcaacgattagctagaagtagaagcagccaacaatttggagacgatgaagatatagacgaaccagtttcaccaacaacttccaatccttcagcgtaccttgcagcaaaggggtatggcacttcatcatcagctcatgaccttgcaagaagccgttcttcccatgcgctgaaatcaagagacaattctccagatcgttcggcagcagccgctgccgaaaaagatggagcagcattaagttcttgggcgagatacctcaagagcaaatacggaaatagaagcggagcgaaagacaaagacgtttcatcgagtgcgagtactccttcagcgagtagttcaggagcggcaagaagattgtctttgggattgcctttaagatcatcaactgagttagcaagttctgatgatgattcaaaaaacatgcaaggctcccccactacccctacagcagctatagcagtggcaggtatcgcccaagcagtagcaggtaccacccctagaagccagtaccttcaaaagtgcgagcagctgtttcaaataggtagccgggggagcgaagccggatgcttcacatggccgcgcggtgttgccgtcggtccagacaataccatcgtcgttgccgattcctccaatcacagagttcaagttttcgacgctaacggacgttttattaaagagttcggacaatatggtaataaagagggagagtttgattgtcttgctggtgttgctgtcaatcgtataggacagtacatcattgctgatagatataaccatagaatacaagttttcgatccatcaggacgctttttaagagcatttggaagccaagggactgcagatggtcgtttcaactatccttggggcataacaacagatgctttaggtttcatatatgtgtgtgataaggaaaatcacagagttcaggttttccaatcggatggcacatttgtgggaaaattcggttccatgggcaacaaagaaggccagttgggacaccctcattacatagcagtctcaatacgaacagagtagtagtttcagactcccacaaccgcagaattcagatatttgacgtaaacggtaaagtcctcacttcctt

SEQ ID NO: 2177 - DNA, 432 bp, Diabrotica virgifera
ccggggccacccacgcatccgaataaattttgctacgtcgcagtaaccttggttttctcttagaagcccataaaaccacttagctcgacttttgtgtatactttgatcaactgttatctgattttttgtaacagcatttttaaacttttttagtttgtctttaaaatgcagacacgtggaatatagatcagcgcttaaagtaaaaaatcaactcattctcctttaggtgccatctccgccacgaaggttggcaatcatcattgcgattctaacttttgagactacagcccgaaagagttcagttgagctgcatccaaaccattctctgagattcctcagccaggacatttttcccctacctatgctgtgccatccttgaatctttctctgcataattaattttaggagtttaaaaaactgtcaacatgagtt

SEQ ID NO: 2178 - DNA, 1563 bp, Diabrotica virgifera
  misc_feature (38)..(38): n is a, c, g, or t
  misc_feature (71)..(71): n is a, c, g, or t
attatctattcgctccgtacatgaaattaaaaaacgantatttggaagttctctgaagaaaatatcaattntaagggtttattttgacatatgacacgtgtttcaaacacgtgaacactgggtgtattgtgtcgttgcagcttgtcattgttgagacccattgagacacacacaccggtcactctctctcctatggcgctacagcccaaatggggccctgacctccaccagcatccggctccagttatgcagcctcaatattatctctttagtatcggttctcgcttctgtctacgcacctcttccttggtcttccttatggccgacgtcgcaccttcttcttctttacgtgccatctccgcaactcatgttggcaaccatcattgctattctaacttttgacactacagcccgaaagagttcagttgagctgcatccagaccattctctgagatttctcagccaggacattttactcctacctatgctgcgccttccttgaatttttccctgcataattaatttcaggaattcatatctgtcaccacgtgttacatgacccaagtattgaagttttcttattttcatggaatccagtatctccctgctgttctgtattcttcttagaacttcctcatgggttattctgtctgtccaggagattctcagcattcttcgatatgtccacattgcgaacgcttccaatctattgaggcattgtttattaagagtccatgtctccacaccatacaagagaacagaaaatacataacattttaatactcgctttctaagatttaggttgaggtctctactacataatatttgtttcatatcaattctagccttttctattctaattcggattcggacgtcccaccacagtttcgctaagcattctactaggtgttctgtcattatccattcttataaggtgacctgcccagcgcaatcttgatatttttgcataatatgctatagaggtctttttaatattggtataactcatggtggaactttattctccatatacttgtaacaaatgtgccccaatatccttcttaatatcattaatatcaataaggtttattgtcttttctaccacatgaaccttggttctacgccatatgttgacgctattggtcgtatgattgttttataaattttaatattgttctgaagctatttctttgtggcatcttatgcaatttactgtttaattgggaaataagccacaatttaagttaaaaatgaaatttattgacgtctcgacttcttccgaagtgtacataacataatatttggatttctttgttcgccattctgtaatcatgacatgacatttgcgtacttcttctattatttcgtccattattataattaaagagcagtgggcttaacgagtcaccttgtctgactccgcttttgtactggtataaactgtgttagttttccatttatctttgcctgtagtcgattgttgttgataaggaaatccaaaattatacagtctggtaaatcaagatgagtcgtatttcggccatgcttatttttgtccattcg

SEQ ID NO: 2179 - DNA, 901 bp, Diabrotica virgifera
  misc_feature (241)..(241): n is a, c, g, or t
accttaataacaaccaaacaacctaataaaattaaataatagtaaaaccattgaatgtaacaaataatatggtaaatttgtaaacctttggccccagatcagtacacctatagaagaatcgagttctgtactgtaactgtatcagttaacaatattgttcagttatttgtagaacatggttttatcaaaagcctcttgtaaattttttaagtttctattttggccaactgttcgaacatcncctgagaacaaaagctataacatgttcaattatcgctaccgctggtaattacacatctcaaaagttatcaggagagaaagtaattaatcatcacagtctgcttgcctatggattatatggattaatttttggcggaaccatcccccattacttctacagcttcctggaaggagcaatatccgaagatgcctcatttgctgttgtcaggaaactgctacttgaaagactgatctatttaccgctctaccaagccttcacattatacgtattagctagaatggaaggaaaaagtcacaatgctgctatgaaacaattgcaagatttgtattgggtgctcctcagcagtagttggaaatatttgactgtcattcacttgctcaatcttagtgttgttcctccagtgctccgagtactcgtcactaacctaatgggcttcttctggaccatctatctagcaaataagagaagacaacaacaagcaaaaagcaagagatcccagtaaacttattaattgatacataatctagtgatgatacttgttctgggattttttaagggttggggttgggattataataactaaattaattggttatatcaagtatttttggattatgcggttaactggaattgtcccaataaaatataataagaattcct

SEQ ID NO: 2180 - DNA, 1356 bp, Diabrotica virgifera
gtggatgatccatcacaccgaatttacgttttataggtatggagatagttatgttaactttaacgcaaacgttaaaaataacttccgtaattcatcacacggctgaatatgtgataatgtaaaacttccaattctggtcattggctcttaaccgaaattcctttttttgtatatacaaaataaagtagacaaaaaacttcgtttcttttaacattaaagtaaatgttggttttcagatcgaatgtatgtacttgcgactgaaagctcaaatggtagaatgtttgactgacactagcgtaaacatgcagatatttctaaaatatccaaaagccccattgcgactcaatatgtaccttgggtaaacctatggctgatatcgaatgaactttacttttaagatgaaaatgtgtacacataaggcaccaagttaatataacaaatgacttgaaaacagatacaaccacttttattatgtttcatggacaattagttagggtacgatatgaagttaatacacattcaattcatgtactaaaaagagacaacggtatgtacaaaacacaaaatttatcgagatgcgaaaattacaactaatatttgggcgtaacattatataaacatctatagaccaattattttacttcgtccatttttcttcatgcgattttatattcagtatgttcggtcacagggaatgtcctggtaatattgataccaccttcaactaaactagaaaaaaacgaatcgattttttatttaaatcacttagaatgacactttcactgtgagttactaaatattttttgttggccaatatgcgaatttgccttattttgatgaatctgtttggactactaaaattgggacataatattttatggagattacggacctttccaaacttataattaatgaaaatccataaaatatgctaaaaactaatttgttcgacataagtcaatctctgtttgcagatttgttttctttatgttaacctacaaagtgaccactattttttattgaagcttacttatgtccatatttttcatgtcttccatcattctttggtttgcatgtcatatttctttcataaatatgttcatacttaaattacagagttgtcggcccagtgactcggcatgcaggcactctcaattgagtgtgagatgtctagaggattgatgacagaaaaataacttaaacgtggcagtttaaaatccaaaacggatctgcgattttcgattgatatacgcgagaggatcggatcggctatggattaatagtacgatagtacttacatcttggtatcactcattcattgatcactaccgaaaggcgttaggggatttttggtac

SEQ ID NO: 2181 - DNA, 1113 bp, Diabrotica virgifera
catcaccaaaaaagtttcacttgcctcatatgtattattagcaaatttaataatttactaaataagaaaaccttaaacttgtactatatataattaaaatatcacaaatacttaaaaaacaacacaaataactgacttacagtttaaaaataattgcattgcagattagtgtctctctttgtctactgctaactgcgttcaatgtgatgccgatggaaggaagactaataatgaaatatgtatgtgtactcttcgggaataatttgtttattgagtaaataaacaaagtttttcttccctttattaaaaatatgaatacccctgggacatttagcctgggtaatttccagtcccgaggaagtttctgatggcagatcgtatttatatattttttatttatttttatttaaaagacatgccttaccgcatttacttcggtgacaaggtatccgctgcagcatgcgctagggaatgcgtttagcacacgccaaaaaggcaagcagtgtgggcataacaattgttttataaccttaaaacacaaaagagacaagtactcacttcatttacttgtaataattattgcacaagtaacactaaggtacttaattgcgcttgcaacctttgtgctaagttgctatagtttagataggtaaagttagtcactttcgttaaatggcgttcgctagtttcaaaatgtagttatgacttaatcttggtgtacatgcgcaactgcttgatagttttcaataggagatgcgtttaactcattttaaaaaaagtaactaacacctatgtccgttagaccaacgatatattctattgtagatttaatcttaggaaattatcaattaattttcccagaatcagtttagttttacttcggtcttttattttttgggtctctgatacagctacagaaattatcctttccttgaatatttctaaagtgaaaccattttgttgcatttaaaaaaattttgggaattcgccctcctcatcctgcaaaaaattaccaaacaaatcaataagcctttgtgaaaatataagattttaaattttcccccctatttttttttacccttaaaaaaaggggggttttttcaaataaagggg

SEQ ID NO: 2182 - DNA, 916 bp, Diabrotica virgifera
agataattaaatagaagcaaactaatattcattaatttactattattatttaactatcagtgtaatttgttattcattctgtgtttgtgaaatatattatgagtgcctaaccaaaagaaaggataagctacaaccaacatgttgcaattaatattagtggctgtggtgataggagttctattttattactatggcgttaagccccttagctattggaaggaaagaggtgtaaaacagacaaatccgtggtggttatgtggagataactggggggtggttcttcaaagacaatctttcccagatttggttcttaagggatacaagacagcacctgaagctaggtatagtggaatgtatcaatttactttaccaacacttgtgataacagacatagacttaatcaaacaattaggggtaaaagattttgattactttatggaccaccgttcttttatcccggagaaagctgatcctctatggggtaaaaacttgttcgcccttacgggacaaagatggaaggaaatgaggccaatacttagcccatcgttcacaagcagcaaaatgaaatcgatgtttatgctgatgtcagaatgtggcgaaaagttggtcaaattttttatggaaaaagaccagaatgctatagaaattgaaatgaaagacacattaacgcgttatactaatgatgttattgcctctgcagcttttggagtacagattgattctttaaacaacactgaaaatgaattctatctcatgagaaaaaatgcaaccaatttccgtggtttctggaggactatgaagttgtttggatatatgattataccaaaaatatttgagttctttcaagtgacattgtttgatatgaacgttcgacgattttttactgaattgattagtggaacaaataagatcaggg

SEQ ID NO: 2183 - DNA, 695 bp, Diabrotica virgifera
aggccacctaacgttcagttcgcgtaccctcctagttcgagccggcaacattttggtgtcgacatcagttggtgaagtttgttaatttttgagttcagggatctaaaacaaatatattcaagcatggagaaacaaggaaatcccccaccatatactggcccatacaacggacctccaggaccccaagctggattccacatgcctccacctggaatgcctcaggatcaacaacaacaaacagtgattgttactcacaccgtagcccaggttcctgttggccccactccaacatcgacaacatgtccatcatgtcatgctcagatagttacttcggtggagactgaaacaacaacaaagacacacttgttcgccttattgctgtgccttttcggatgctgtctttgctcttgcattccgtactgcgtggattcatgccaagccaaaacacattactgccccaattgtagagcatacattggcagattcgaaaattaagaagaacgaaacttcaaagatggcttaaacacaaatagaaaattctttatatacttaatataaacttacaaaaaacccacatatattttatgtatatagataatcagtatattacatatctatacttcattattatacttcttttatttttataattgttattggattgtatcttttaaaataaatcttaatgtataagg

SEQ ID NO: 2184 - DNA, 797 bp, Diabrotica virgifera
acctaacgttcagttcgcgtaccctcctagttcgagccggcaacattttggtgtcgacatcagttggtgaagtttgttaatttttgagttcagggatctaaaacaaatatattcaagcatggagaaacaaggaaatcccccaccatatactggcccatacaacggacctccaggaccccaagctggattccacatgcctccacctggaatgcctcaggatcaacaacaacaaacagtgattgttactcacaccgtagcccaggttcctgttggccccactccaacatcgacaacatgtccatcatgtcatgctcagatagttacttcggtggagactgaaacaacaacaaagacacacttgttcgccttattgctgtgccttttcggatgttggccatgttgcttaattccatattgtgtggattcatgccaagctaaaactcattactgccccaattgcagagcttacatcggaagattcgagaactaagaacgttctaaaattcttaaaaagagttaccaactgaagaagctaaaattccatctaaatctgttttctaagaaacaacttcaatttattttatattttaatactttttatctatacaatatatatgttataaattagaataatatgaaaacgtcaggttatgtttaaatgttttaatgatatacgttttaatcttaacataaatattaagtaagtttaagcatgtcaaacatatgaatatgttattatatccgttattttattaaagaagtaaattctaaaaaaaaaaaaaaagggcggccgctct

SEQ ID NO: 2185 - DNA, 984 bp, Diabrotica virgifera
  misc_feature (831)..(831): n is a, c, g, or t
  misc_feature (911)..(911): n is a, c, g, or t
gttgtatgtacttttcgaaatgttaatcaaatatattgcagtagcagtaattttagtaaactctatattttctgaaccagtcgacgtagataaatatctgcctaaagaatggagaggtatggtcaaaaatgttaaggtccattcggatattgggatgactatttatgactttttaagaaggtacaactatcattacgaaaaccattggatatccacagaagatggctacaaacttcttttgcatcggattccttatggacagaatcaaagtgttcccgatacgaaacctagacctgttgttcttattatgcatgggcttggagcaagttccttgaactggatcatcaaaggaccaaacgatgctttgggactagcgttggctgatcagggatatgacgtgtggttgggcaacactaggggcaatcgttattccagaaatcacgaacgattgaatccagatattgatactactgaattttgggattttagttttgagcttactgggagatatgacgtagcagccaaaatcgactatatacttaaactaacgggccaacaaaaacttttttatataggacactctcagggtacgagtcagtttttcgcattaacatctttaagaccagaatataacgacaaagtagcgttgatgacagctttagcgcccatagcttacttggaatatttgagttcacctattttgagactcgcggctgacaatatggctttattgcagacacttgttaatatttttaatattcatgaatttagtcaaagtccacttacaaacaccttagtaggtttggtatgtgctaaagaatctcctcttanagatatatgttccacgtatacatttttaacatccggatttgataatcaagaatttgacgagggctttttaccactatatntgtcacacgtcggagtcggcatgtcaattaatatgttactgcactttggacaagaaattaatcacatcatttt

SEQ ID NO: 2186 - DNA, 984 bp, Diabrotica virgifera
atccatatgtttagttgtgtggtaaaatttaatttaatatttactaatgaattgtgcctataaatctaaatttcgctaaatgaaatggcacaatttgccaaagtatgtttcctcctaatcgtgataatatcgtgtttctcgagagggactgctcaagacaacaacactacaaaaatagtttcaaatcaaacaagccctgttgtatctaaggcattggtgtctaaggaaacaacagatgaaaaaacgaaggtaactacacaacctcctcctaatagtcataagagcagggagcatgtgacaagtgctacagagaaaacattagatgtaacctcaaataaaacatcaaaaaatgtaacaagtgtgaacacaacaacttcagaagtacttgtatctaaaaatgtttctcagcccctaaacattactgtgaacaacgccccaaaagttgtgaacaccacctcaaaattcgtaaactcttccacccaattaactactaatcatacttccagtactaccaaggcaactacaacatctactactattaagccaaaaaaacctttatttactgaacacgacgaagtggtggtagctccagcaaaaccgaacttggatattcctattttagctcatattgatacgactatggaaaagaaggtgagacgggcagactatgtagtgccaattgtagctgttattctgtctgttccacttgtggctgttattctttctgttttttataaaaaaggtaaggattggtggcaacaccgcaactaccggagaatggactatttaattgaaggaatgtacaacagctgaaaaatactcatataatattacgctagtattttagcttagtctttgtatataaatgttgacagattattatgtaatgtgccttttttatatgcaatacttttgtgatattcttgataatacattgttatatttttatatattattctataaaaaataaagtattatcttttg

SEQ ID NO: 2187 - DNA, 827 bp, Diabrotica virgifera
acaaaacatacgtacaaagagactatttttaaccactgaattaaaaaaaacaacgaattaaaaatatatcaatattttgattgacaataagtgtgataattatttttattaggaactaaaattgcctattttactaaatatctttatgtatatacaacatttctaactatttgctcaaaaacaaatacaaaatttatacaaatcgtttttatatgaatattgttgaattttgaggtttagtaagtaaatcaatacctagggaccaaatgtttaggttgttctatattttttataccatgcaatataaagagttaaacctcaaaaatgtttcttgttatatagtcataaatttctttctagtttttaagtaaatacagtgacatgtatctaaagaatccggtccaatggtgtggtacttaatattttaagagactatcaaatatagatgtctataaaatgtcccaaaatacaacagcctacctaccacataaaaaatcatccagaattttagatatggatgttgcagtttattttaaattttatcatgaccttggtctctttaattacatttcccttttggtcttaattttggtcttaaaatttgtaaaatgacaagaagctacaattaattgcagttctattatgagacattttatatgagagaaactttaattggacgaaaatccaatagattttttttattattgaatgtattttttatagagttttaaattcgagtgtgtatttttagacacaaagggaatgggtgggacaaaattgttttcaaaagaatgttaataaagacaataaaatacatattgatctac

SEQ ID NO: 2188 - DNA, 552 bp, Diabrotica virgifera
agtcagcttcagctcttagcccttttattttcagccgcgtttgctgcatcagatctatctgatttggatcaagctgcatccgatcagttggtggctgtcgttcagttagcgtccgatggacacagaactcctacggaattttacacaaatgaccaatattctgatttatcaaaatattggggtggcgttgacttaggacagctaacaaatctgggaaaacaacagcactatgagctaggacaatttactaggaaaagatatagtaaatggctgccaaagagatatgacaaagctgatttctacgcccagactacagatgtagatcgaacacatatgtcaggacaaacaaatctatactcactatatccagccaaagaagatcaagtatggagaaggcaaactgattggcagcccattccactacatccagccgattccaatatctgggaaacattccccagctgtgctgcttatacaacagaattagccaaagttcttgtgtctgatttgtttaaagctatagataaacaatatgcagaggtatattcatat

SEQ ID NO: 2189 - DNA, 1250 bp, Diabrotica virgifera
ccgtccccttacgcggccgcgctgacacacaataaccaacaatgaagttgcttttattagccttgtgcactttccttgtaggacaagcttacagcaaagggcaagcgtacacagttacacagatttatccaactcaatcattagaattagaatttaatggttctaaggtttgtgtgaatactaacaagggagcaaagaataccacagacggttctaaccaatctggtgaaaaacctcattctggtgaaaaacctcattctggtgaaaaacctcattctggtgaaaaacctcattctggtgaaaacggtgctcccaattcgggtgaagaaaatggtaatagaggtgtcagttatacccttaatagaaccgataaagataacgtcaaaattaccgttatttcattggtatcacgttccgataagaaaactagggatcttccagcaaccaatcaaactctatgtaagattgctattcccaatcgaaaagataaaattattattgttagatttggaaataaaatctcaaaagcagaagctgatgcaggcagaggtgataaccattctaaggaagataaatctaacccaaaagtatactatagaatagaagcagtgcagcaaaatggaggtaaaccccttgtagtcgtcggaaaaggtatcgcctccatttcttatacaaaggtaagtctcaaaataacatacacaatttctgtgagcattcaagaaataagtgtagtggtcgctataaatggtagttgtagctctggagaaaaaggacaagaaacaaacttacacttggaagaaaaacctacgtctccatgtgccagagataattagatattttgtgagcatacttatcttaaaagaaattgtttaatttattaaaaaaaatatttatttaatgttaaataataaaaactatttttgatgtgggggcaaaaaaaaaaaaacaaacataaaacacacaaccggaaagaagggaaaacaaaaattttagaaccgtaaataactggctaaaaaaaaattaaaaataaccttctccctaaaagaccgccgcggacttgatatctctatagagtcaattaccccggtggggggggggcggggccaaaggaagagcgagcgagttttttgtagggccgggggggggggcgggcggggggtttatttttttttttttttttttgtgtcctccctctataattttataaattttttactggggcgcgcgccggtcgggtttttttaaataac

SEQ ID NO: 2190 - DNA, 1031 bp, Diabrotica virgifera
aaaatatttgataattgcaacacatccactaattcgtacatgatatgtgtaactgactacatacttaggaataatattcaacaacaaagaaacccagataaatttttgtcaaaagctcctgaccattaaggtagaagacgtgaagaagaaaaagaaatgtcgaattttatagcgtgtaagaagaaacagtactgatttatctgtcaatattttattatttcgtgtaaattgtaagatctgaaactttctgttactagttaatgaaatgttttactgaacgatattcggtaatacagggtgttgtagaaatatcaaacgtattaggaaaattagtatagtgagaaaacaatgtgatcaaagagtatacatgaacatttaaatttttttatattgtgaacgaggttctaaaaaatatgaaaattataagaagcctatgaacactctgtattaatattaaaatagaaatatatttcatttttctggacacggctcttaacgttttatggttgccaaatttttgtattctacttatttttttcagacaataaaaaaagacaaaatatcattgggtatttcaaatacaatcaaatatagatcttgggtatattttaaggtagttgacaatataaacagaataaaaatcggataactttatcaaaattatacatttcagagatttacccgtgaacttttaagaggatatcaataaagcatgtagtgttcccaatcttcgagatagtgcaggaagtaacaatagaacttatgcgttttcatccagtaatcagcagtgttgtttttgaactcaattggtgagatgaacgaaatagagaaatcagcatcgagctgcaatcagtacataaacccaagactttccaaagaaatgggttcataagcaataagtacctgtataaaagcattgtcttttccacattcgagggttgatttatttttttaagtgctggtttaacctttcctctctctggaaaaacaacccctactgggataatttgtggaaggccttcaaagggacc

SEQ ID NO: 2191 - DNA, 846 bp, Diabrotica virgifera
ttttcgaaacaacatcgcattacttcagttttgaaagtttcgaatataaaaactaaaaaacttttttatgtctttttatgttttttaaacgaatgtaacaatgaaaccaaaaattagccatgggtatttaacacctcaaccaacaaagaaaaaagataaaagggaaaacaataatgcaagatcaagagataacttgaacacaggtttggtgttcaatgaggaacacttttcagaactaatgaaggatccaataaaacgaaatttgataattaatcttataactaaagagaaagataaaattgaagcctataagaaagaacttgcgaaaaagcacccgtctagtccattgctgaaaacaatgaaaagaccttgtgagagtccaactcagttattaaggagaagggctttagaacagatgaataacccacaatcatcagaaacagaaggcggtagtaatagtagacctacatctgggcagtctggggcgtctactgtaccatctccagttagttacgataaaatattggagggtgtcatagctttcgttgaggtcaagactggtactaaagatcgttcagatgctgtgaaagcccatttacaaacaatgggtgctgttatcagagagaaaattacaaaagatgtgacacatgtgatttttaaagatggttcatttactacttatcaaaaagcaaacctactgaaggttcacttagtgtcagttttatggcttgaagcatgcgaatctagacatatgaaggtatctgatgaaaactatcctgccattggcactgaggactatgatcacatatgtatctgtcatttgatcgcaaatgctttgggattata

SEQ ID NO: 2192 - DNA, 2073 bp, Diabrotica virgifera
gcgtgtattgacggcgttaatcagtttgttgtttattcgggcacaatgcctttcgtgccatcagaaagtttgtctaaagtgtcatggccgagcaatgaaagtatccatgccggtagttcgtccagtggttacgcaggaagctgctccagtggttctggattccaaagcccttcttcgccgacgtctttctcgccaatttcttcctctccagatgccacactgagaaaaaggttcagacgagcttccagtctaggaagtgttattcaagaacctttcgtcattcgctctgacgtacgagactcaagaagtcagagcccggctttaagttgtcacgaagaagaagaagatgagtttgtctactcattactctcaaaacttattggttggtatccttgcttcttgctgcgactgatgaaagctctcttcatcgcagtgcttccgcaaacatggagacagcttatatttgcgctacctatgctatggatttctatgtgggtgtggtgtttcacgcagttaatgcagctgcctttgaccataattaaggctattctatctttcatattgtctccgaacacttccaaaaacagcaagaagaggacagtgctcataactggaggaagtacgattcaagctcttcatctggccaggaatttctattcagcaggagcacgagtggtcgtttgtgaagtagaaggacatttcgctttagccaaatattccacagcagtcagtaagttttatacagttcctaaacctactagcgataagcaacagaactatgttagagccctttgtgagatagttgacaaagagcaagcagtgtatttcatcccggttgctgctacaactcctgcttactacgatgctgtggctaaacctcatttagaacttttgggttgttcttgcttttgtccaggtatcagagaagtttgggttcttgatgacactttggaagtattaaaacggtgtcaaaagaaccagattacaacaccaatatatcatgtagtgacctcacgagatgatgttttaaaattgtacgataccggcgctataagaaggggaatgtttgtaatgtccactgcagggccaagaggtttacgtgagcgttcaaaaattcttctacctttgtccagaaacgatttgaaaatacctaacgatatcagcgagcaaaaaccttgggtagtagtacagaatctagaaggtgaccattatttgacttgcactacggtgaaagaatcccatgtaatcgcaaatgttacatgcaagatgaacaagaatactaatgaactggtcccggaagaaaacagagaaattaaccaatggctgacgaatttttttcaataaaatcaacttgttaaggccgatctctggacacatcagcttcaggtttgtactttgcaaagaatctggtacagtgattcctttgagtagcagggtaggagtatctttgccttatatttgttacacttcggtgcatccaaggttggtgtggaagccatgcagacattttagtcgtcaaaattctggtcctttaatcaatggtaatggcgtgtataacatgccacaaacggtgatgcacacagtcagcaatccttccctggaatcagtaacgaggctcataggcacagttttggatagaagagaggctttgttcgcaatgtgggatcctttgccctactgcgcgtactaccacatgcaaattccatttaaaaatgttcttggttttgttagaaggagacaagacagttttcccaggccgatgactacggctgtacggtagtgtttttgtttttctcaatgggagagagacaataaaaagcctgatgtgataaaagacgattattttatattttatttttgaattacttcatgtccaatggtccaaacctctttgtgacttgtgttgaaacatattatttaaaatgttttataaaacctaacttttaatcaaaactcgaaagagtgttaatccctttttgaccaaaattattaattaaagcataatttggatggaaaaattttttttattggtgtgatttcccaaaaaaaaatgggataagtaaggttacatta

SEQ ID NO: 2193 - DNA, 1320 bp, Diabrotica virgifera
  misc_feature (19)..(19): n is a, c, g, or t
  misc_feature (82)..(83): n is a, c, g, or t
  misc_feature (85)..(85): n is a, c, g, or t
  misc_feature (1135)..(1135): n is a, c, g, or t
tctctccagggcgtccggncctttttttttttttttggtcaccttttaaagaattgagaaaagatggaattggagagggatnntntggaggggttaggaaagtatttagtggtagactgacacaaaatgtgcagttacaaaataacacaaataaaagaaacccagaaaggactaaggaaaagaaagaaccatttaaaggaaaaggaagaaccatgaaggaggtggacgataaacctcagaaaccttcagagaaagtttctttgtttgcatttcttgaagataaacttcctgtagccaccaaggaggaaaaattgtatcaaagtcaacccattaaaaataatttcagggacccagaagttctctctgaaaatataaacaaatttgacaaatatgatcacaagtataaaaaaactcaaatagtaccaaaacaatttgaaaaaccaacatataacaacaataggtatcaaagtaacaaagaaaccaataattctagaccaaatacaacagaagcttctcatcagccaaacaaaagtaatttggaggtaacggaacaaaaaccagtgaacaatgcaatgaaatctaaaacatcctatactaacagatatgaatcacaacaacaaaaacaaaatgtagatacttttaataagccgaaacaatcgaataataacttcacgggttacaactcaaacaaccaaaacaggaatcatcagcagcaaaatagcaattctcactattcacagtatgtacctcataattcccaaccaaatgcatttcaacctaataatgtaccatataatatacaaaattcccatccaaatagaagcaacaatcaatattcccatcaaaatcctaatgtacataatacaaccataaacgtaacattaaataaccatcaccataatcagcaaattcctactcagcctagaccatctacaaatccaagtaggccttaccaaaatgatgtcaaccatatcacccaggaaacgcaaagaatgtctatcaatagtcaatttgctagtagaagtttgagacagcatttaaacttgaacccaaacactcctaggaaaaacgaggattatgcagcgaagggtgaagataccatgcatggatgtaatgtaggggatgaggtgttggncaaatattgggaagatggcaagtattacaatgccacagtaatctcagttactcctcgaacattttgcctgtcggttaaaggatatggaaatatcggagagatattaaaaactgattgttttaccagtaccgaaaaacaatgcgagaccaagcataatcaaaatcagcaatatgattataataaac

SEQ ID NO: 2194 - DNA, 401 bp, Diabrotica virgifera
cgcgtccgggccaataggggtgtatgtttgagtatttttagtgctagttaaattttactaaattttatcccaatttgattatagtttaaaggtccagtgtttaaaaagatcggcgaaatgggctcgttatttcgaagtgcggaaatgactttgtgccaactgttcttgcagagtgaggctgcttacgcctgtgtctcggaactgggagaactaggattggtacaattcagagatctaaatcctgacgtaaatgctttccaacgtaagttcgttaatgaagttcgccgatgcgatgaaatggaaaggaaactcaggtatctcgaaaaagagattaacaaaggtggaaaccccaagcctggtaacggggaaaattcccgaacctcaacagcaaagagagatga

SEQ ID NO: 2195 - DNA, 1084 bp, Diabrotica virgifera
ggaccattaactatacagagaggtgtagcaccaagctgagatattgttccccaaaccataattttagtgggaagttttaaaatttgaacggtaacattctcttttcataggacttctagatgatttgcaccaagctggaaaactttcatcagatataaagacattattaaaattatcttctcgaaaacgttgacaaaaatctattcttcgttgcttttgcagaggtgtcattgtagggattttttttggattccttaatatgtagccttgctttttcagtgacatgcggacagtttatgggcacacttttattcttcgttgatttcaaaatctgttcgctaattttcgaaaccataggcgcggattttgtcgtcctaaagccactaaagcatttaaattgttgccgcgaatcttacgcggtctactccaaactggcctatgtctcatatctatgccattttttatcctctttattctctcatacactgcactttctccgagttcagtcaattgcactaattttttaacgtttcggacaccctttccatacacatattccaccacttttttttttctacttgtcacattatttcacaaatcttaagtctgtttacaaacaacaatatttgacagatggtgttgtcatgcgattttgtccataacatctatccgcacaacctacttgatgcattacttttgtcttttgtcaaaatgttacaaaaaggaaatctattaaaattagcaaaaatataaaattccggatactttctagacggactatatcatatttatgtaaaaagtaacaaggaatcaaaaacaatgctgaaatgattatcactggagtggcgtagactgtgagggggaaaaaggggcgaaaatgaagtatatatacgcctctgctaacagcggagaactgtcttttaacactggttaacgtgtcctagcatgtgtaaggtgtgtgtcgggtttgagcaggaagtgttaaggggtgctttagcaatgcgctagaatcattttggaacatttgaataaaactcctccctaaggaggaatattttattgaggggtgttgggttaaatattg

SEQ ID NO: 2196 - DNA, 749 bp, Diabrotica virgifera
ctagttctagactaaaattgcccaaataacaatgaagtggttcacctgtttactcctagttggtgtctgcgccagccaggtgctgtcagctcctaccgaggaaaaaaaagatttcgctactattttgttggaaagagcagctgcacgtgccgaagcaatggccaagagaatcgaagagagcggagtcatcgacaaagcattagctggtgctgaagcaattggcaagaaaattgaagaaactggagtcatcgacagagctctagctggagcagatgctcttgccaaaagagttgaacaaactggaatcatggacaaggccaagcaaacagccggacaactttacaagcaagttgaagacactggaatcatcggaaaagctcaagctgaagccggtaggttatataaatcaatcgacgataccggtgttctaaaccaggctaaagagcaagctaatgcattaatcaatagcccacttgccgaatctatgagacaaagaactcaccaagttttgcagaaagtaggagagtcaaaattaggtgaagctcttgctgccagggcagagccttaccttaagatggtctgaagttacctaccgattaccactgccaagaagaaaatgcttaaatggaggcgacgacactaaggaccttgcactgtggaacacaaccttattatatttctagtcacaaagaagttaattttgtaaacagtgttatttagtatttaaaataaaagtaaaataattaccc

SEQ ID NO: 2197 - DNA, 1006 bp, Diabrotica virgifera
attaaatatattttttaaatcggaaatcaatgaaagataatccttttttatcttgacttcttctgataacactttgaatatacataatagttagcgcaagaaaaattttcagtagttctagactaaaattgcccaaataacaatgaagtggttcacctatttactcctagttggtgtctgcgccagccaggtgctgtcagctcctaccgaggaaaaaaaagatttcgctactgttttgttggaaagagcagctgcacgtgccgaagcaatggccaagagaatcgaagagagcggagtcatcgacaaagcattagctggtgctcaagcagttggcaagaaaattgaagaaactggagttatcgacagagctctagctggagcagatgctcttgccaaaagagttgaacaaactggaatcatggacaaggccaagcaaacagccggacaactttacaagcaagttgaagacactggaatcatcggaaaagctcaagctgaagccggtaggttatataaatcaatcgacgataccggtgttctaaaccaggctaaagagcaagctaatgcattaatcaatagcccacttgccgaatctatgagacaaagaactcaccaagttttggagaaagtaggagagtcaaaattaggtgaagctcttgctgccagggcagagccttacatgcaagctgttgccaaatctggatgtgctctagctaaatcagcaaaccaagatggtctgaagttacctaccgattaccactgccaagaagaaaatgcttaaatggaggcgacgacactaaggaccttgcactgtggaacacaaccttattatatttctagtcacaaagaagttaattttgtaaacagtgttatttagtatttaaaataaaagtaaaataattaccaaaaaaaaaacccacgcgtccgactagttctagatcgcgacaccacagtaacaaaaccaaaaaaaaaatccaaactggagagaaaaaaaaaacatgggggg

SEQ ID NO: 2198 - DNA, 1202 bp, Diabrotica virgifera
gaacaacgtacttgtcttgtgtgcgattcttgcctgtgtcgcagcaataccaacttccgtgttggacagggatgcttctgcggagctgtataaaattcaagatttaagccaaccgatacaactgacaaaaagtgtttgtaatgacgatataaaactatatttcagaaatcagaacgatatggacaatgaacatgcattggatgtaaataatacaagctcactacaaagtcttggattctcaccagagaagtttacgatactcctcatccatggctggcgaaacgagtatgattccgatatcaacaccgtactaactgaagcatatctcagcaaatatgacatcaacgtctttgttgttgactggagcaacttagctgatgacctttacgtaaatgcagcttcagctgttggcggagttggggagattgttggtaactatattcagtctctggtaaaaaataataatttggatttcgatagaacagctgtagtaggacattccttgggagctcacgttgcaggaatagtaggtcatgctcttggtgaaaaacttgactatattgtcggtttggatcccgcattacctttattcttaatggttcacgatgacttcagattggatgccacagatgccaagtttgttcaagtgattcacacttgtgccggttttcttggtatcgacttcaatattggacattccgattactaccctaacggtggaagggaccaaccaggctgttggatggatgtagtaggtacatgtgcacatggaagatcatttagatactttgcagaatcaataaaaactgggggatttattgcaaagaaatgtggcagttatgatgattttcaagacaataattgctccgaagaatcctctaatatgggcgaataccatattgataaaagggcttccggtgcatattatttgaacaccaatgatgacccaccatatgccaaaaactgaccgaacaccaatacgatcattaaaataatataaaggcctttggtcgttttctgttttaagagaatttatttattagtttttttagtgcgtaaaaataaaaacgtcgttgataatataatcttatggtaaatcgatgtttttaaaattgtgtgatatagataataaagataacgttattaaaaaaaaaaaaaaagggcgccgccacgaaaggatcccgagccatacgtacgccgtg

SEQ ID NO: 2199 - DNA, 1606 bp, Diabrotica virgifera
gttgaaaacaatttcacaattttaaaaactaaaacagaataatacaaatgtacagttgcaccaacaagtaatttaacatacagatattttggttttagctaaaaatgtcttcaatcggcggcgataacgacgatgcattcatcgcaaagttgcggggtttaccttggtcggcgactccagatgatattcttaatttttttgacgattgcagtattttggacggaaaagatggtgtacacatgactacatctagagaaggacggcctagcggtgaagctttcgtagaattcgaatctgaagaggatttagagacagctttgcaaaaggatagagaacacattggaaataggtacattgaggtttttaaggtgaacaaggctgaaatggaatgggtggtaaaacggtcaggcacttcatctggcttgaacgatgatggatgcgttaggcttagagggctaccctttggctgttctaaggaagaaattgctcaatttttcacagggttggagattgtacccaacggaataacccttctcactgactactcggggcggagttctggggaggcgtatgttcagtttgttaaccgagaagtcgcagagaaagctctgctgaaacatcgagaaaagatcggacacagatatatagagattttccgaagtagcttgtccgaagtggacacggtgatgagtttccaaggaaactctatgggagtttcgggaagacgcatgggcggcggatccagcatgttcagttccagaccagggccgtacgatagagacccaaggtacggtggtggtggtggtggcggcggtcgctttggtagctccagaggatcgcgcagtttcaaagattacagtagctacgacaggccctctccttggggcggcagtcagcgcaatggaggcgatatgggttctagaagtagctgggattcttggggcggcagcggtggtggtggaggcggcgctggcgtgcattgtgtgcatatgagaggcttgccttttaaagcgagcgaacatgacattgctgatttcttcaagccagtggtaccaatcttcgttcgaatgatccaagactccagtggacgagcttcaggagaagctgacgtagaattcgtcaaccacgaagacgctgttagagccatgagcaaagacaaaggccacatgcaacacagatatatcgagttgttcctgaactcttcaggaggacaaagcaacggaggattctcctatggaattggtcgaagacgaatgtaaagatctgttccaatttttttatcaagcacacaaagccagtagaatatcagtttgactgtagattcgaatttaataattaattcactagtgttgtggtccgttgataattttttttttgtaatttttggtccctcgagcaggataatgacgtcataatgctgcactatctatatatcacttgagattcgtaaatacattaagaaagtagtcagacttataggcttttgtaccttaatgttgttaatattttataaatgatgcagaaaaatgtcattttttcgaaaaatgactctttgattctttgactttttatcttttttctttaaacgaaaaatttaacggggacc

SEQ ID NO: 2200 - DNA, 1200 bp, Diabrotica virgifera
  misc_feature (1180)..(1180): n is a, c, g, or t
ccttctacgtccgccggtacatcaatcaatatgaagttcttcattctcctttcgctggttgctctttgcagctgttcaccagctcatcaaaagcaaaacaaatatgaacaatcaaagaacgctgttcaaggaaataatccttacaacaccttttggaagacatatagccaacagcgtcaaggagaagaaccatggaaccagtgggctcaatatggccaagacaatcaagctggtaattactggagacaatacgtacaaggcaaaaaccaagttggcggtgctactgtaccctggatctaccattactgggataaccaggattacgaaaacttgagccctgcacaacgtgtccaacttgttcttaattatatgcaagttcaccaacagtggaaccaattgaactctgatgtaaacaatgaagattatttgcaccagctgatgtaccaacatcttcctgaatacgtacaatataaccacgaagatgtactaccccacttagtacaatacttcgaacaaaatcccgcaagatataccaatatgttgcaccaagcgtatcaatattcacagtcccaacaacaacttatgtaccatgtaatgtaccaattgtaccaacattatggtcaagctccatggtcccaagaacaaatcagaaaccaaattgtaaagtaccaatcagtttaccctcatcaattatctcagggtcaaatcgaacaattggtagaatttgtataccacattcaacaagaattaacaccaaggcactaccaacaattagaacaagtacaaccccaattagaaaattaccttgaacaaagtccaatgtctcaccaacaatatccatggtctcaaagacaacttatgtaccatgtaatgtatgaattgtaccatcattatggtcaagctccatggtcccaagaacaaatcagaaaccacattgtacaataccaaaatgctttccctaaccaattatctcaagagcaaatcgaacaattggtaggatttgtatacaacattcaacaggaactgatgccaatgcactaccaacaactcgaacaaatgcaaccatggggccaatataccgctcaaccatcaaactatcaaacttattattcaaggaacaaccaaaatggtttgtcatggacctacaaaacaactcaacaaagatatgaagctgcccaancatggtcctacagacaaact

SEQ ID NO: 2201 - DNA, 965 bp, Diabrotica virgifera
cgttaggtaaatagcagtgtattgtatttgtgcaccggattttgacagaaatatattgtatttaaattattaaagtgagaagagtagtatatttaataccgatgtggtcattgtaatttttcttttataaattttgtttagtgtaggaaggagtttctagcaaacaagatgacaacaaataggtttcataaagctgctaaggatggaatgttagaggtcttaaaggagacaacatcgagagactgcaatacaagagatgagcaaggcatgacaccgaccttatacgccgcattttatggaaatttagatgctttgaggttactatgtggacgaggcggaaacccagacaaagctgatctgttcggcaatacggcccttcatctagcagctgcacaaggtcacaaacatatagtaacgtttctagtcaattttggtgcaaacatatactccatggacatcgataaaaggactccacaagaactcgcgggaatcaacaacagagatgatattttaagatttatagatggtatccaagctaaaatggaagcaacagataagaaaaaagctaagactatgcaagataaagccaaagaagaatacaaaaagcgaatgaaaaactttaataaacaaatggcaaaacaagaaaagcaaaacgagaaactagaaaggcgaaaaacgaaaccctcaatgatgtcaacttggaagtcaaaatttatcggcggatccatgtccaacctagctgtcgacaatcaagcagaaagaagacccacttacagttcgattataagcggtacggttaaaggaaatatgagtaccgtacaaaggaaaattttagccaataaaaataatagattaggacaaaatggcgaagaatttagagtaagccacatagaagatggaaagctaactataagctctctcaaaggtattacccgagattcggaggtattatacgggggtactct

SEQ ID NO: 2202 - DNA, 972 bp, Diabrotica virgifera
aacagatttagatagggttaaaattatcttgaacacattgagctaaactgcatatcaaagcaaaggaataatccaaatcacctccggttttttgtagtaattaaattttagttgttttcaaattttggattagaaaatgaaagtgattttcagaatttttgtttagatttaccaattacgtacatgcaatgttaaataatgcagtttccctattgcgtttgttccccacattccgaactttgtgttttacttattgttttaagtatatctatatttgcagcggacacaccttttcaaattatgaaagaaatacatattttacttttatctgattttaatcaaaatatattttcatgttccttgttatgtcccactggatgacatttatgaatagttcatttaattctgtataaaaatacttctagttggcaatcatcatggaaagagtttatcatttttctcgatctgcagcagttctttactgttgttttcactccattgctttaaatcattcaaccaggacatgcttcgtctccccgtagtcttttccttccaccttctcttcttattcctaaacgatcataaaacggcatctcatgtttttaatgacacaaatgttatcgatctcaaaacttacctacctactcttcagtcgtagtgtagactttgaatggagtcagttttaaaaagaaaatgcaaaagtactccaactatgtactacattttgactactagtcaaaaaccagagtaataatttttgtgttaaaaactctttcctcaaagcatgaacatgtttacctgtgaatattgttaactgcacaacggaattcataagtcctatgatctcctgtacgttattgttgctcataaaaacatgttctctgtatgtcccatatgttatgtctttatacatatgttcagttttcgattagatataagcgactgtaagaagtgctaaattcggcaacattg

SEQ ID NO: 2203 - DNA, 732 bp, Diabrotica virgifera
gtccaaaatggcaccgacagctgacaaaactaaaacggttaaagggctccccgcagtcccagaatcagtcttaaaacaccgtaaaagacgtgaagcatcccgtgctaaacaactccagtctgtcatcaaaaagaaggcagaacttcagtttcgataataggtactatacggagtgttacaatgaatcacaaccaacttttaatcgcctttgtaatagtagcaagctttgctttggaaggatactgtgctgctgctgctcccgagagccctcccacaaatgtaaccatcaaagactactgcatcaaagaaacgaaaataagtccagacaaagtaaagaaaattgaggaagaatcagaggaagaaatcgacgagcaaggatactgctatattcaatgcattttcgtttccatggaactcattgatagcaaaggaaatttgaatgttaagaaaaccatggctgcgttcgatgacatggatgaagaatgcttaaagaaggtaaagaagattatggaatgtacggacatggctgcccttgatgactgtgaaaaataaataatctctaaatattagactaaaaccacatattgtaatttgacttttaatttttatttgactgttagagtatgaaattccaattttctcaggccataaatataaaaaaaaaatttgataggatagtactcttcttaaattaactgttgaaatctcttattgacaaaagagcatactact

SEQ ID NO: 2204 - DNA, 920 bp, Diabrotica virgifera
  misc_feature (861)..(862): n is a, c, g, or t
agcccacgcgtcgtgtccaaaatggcaccgacagctgacaaaactaaaacggttaaagggctccccgcagtcccagaatcagtcttaaaacaccgtaaaagacgtgaagcatcccgtgctaaacaactccagtctgtcatcaaaaagaaggcagaacagatcaaaaagaggaaagatattttcaaaagagctgaacagtatgttaaggaataccgtttaaaagaaagagacgaagttaggctagttagacaagccaaaaccagaggaaatttctatgttcctgctgaggctaaattggcttttgttgttcgtattaagggtatcaataaagtagcacctaaagtacgcaaagtactccaactattccggttacttcaaatcaacaatggagttttcgttaagttgaacaaggctactattaacatgcttaggatatgcgaaccttacattacatggggatatcctaacttaaagtcagtaagagaattaatctacaaaagaggatttgccaaagttaatggacagcgtgtagcaattaccagcaatcaaatcgttgaagacaggttgggaaaatctggaatcatttgtgttgaagatttaatccacgaaattttcactgttggacctaagttcaaatatgcctccaacttcttgtggcccttcaagctaaacacacccactggtggatggcgtaagaagactaaccactatgttgaaggaggtgactttggtaatagagaagatagaatcaatgaacttctcagaaggatggtttaaaccaatttgtttataaaataaattatgtataaaacacaaaaaaaaaaaaaaagggcggccgctcgcgatgtggtgagttgctannataaaaatagtatattatagagtatatatataaaaagaatatagtttatttataaagt

SEQ ID NO: 2205 - DNA, 1306 bp, Diabrotica virgifera
  misc_feature (1297)..(1297): n is a, c, g, or t
ggtcgacgacgcgtcccccttaagccccttacagaggggtccaaaccaattcgagatgaagtgttttttgctgttggtgattgtaggaagcttcctaattgtacctctgaacagtaatcctgttagtctttcgcgctcaaagagatcctttagtagccaacccaaaggatactggagcaaaaagttgacatggaaaaccgagtgggtaaaagtttggaagcaagagaaaaagctcaagtgggtttccgagtggaagaagacccaagtacctgcatggaaagaagtccaggtcccaatttggaaggaaatacaagttcccgattggaaagtgatttctaaaccaatatggaaggaaattcaagttccagcatggaaagagatacaagttcctgattggaaggaagtgaaggttccggcttggaaggaaataaaggtgcctgattggaaagaaattcaagtgccagattggaaagaggttcaagttccggcttggaagcaaatttggattccaatctggaaggaagttcaagtgcctgcttggaaagaaatccaagttcctgattggaagaagtcatatgcaccagaatgggtaaaagaaggaatccacggagagcactatttgggcaaggacgaccacggcagtgaatatacagctcatgacatctggaagaagaaactcatctggaaacctgtctggaagaaggtgtggaggacagaaaagaagcaaatctgggttcctcaaaagaagatggagtggaagtccgaatggaaacaaatctggaaaaccgagaaaaaacaaatatggagaacagaaaaagtacagatttggcgaacggaaaaacaacaaatatggatcccaaagaaagaacaaatttggaggactgaaaagaaacaaatttgggtaccaaagaaacagttgatttggaaacaagaaaaagttcaaatctggagaacggagaaagttcaaaagtgggtgacggagaaaaaggagatctggaaggacgaatggaaacagatatgggttccggtatggaaaacgatagaagtgcctgcttggaagaaaatccaaaaaccgatatgggaaaaagtgtgggtgagcgtgcacgtacatgaagaccatcacggtcacggttgggactaatatttgttgtttttttatttttctgtacataattcttttgttctagtacaaaaactgtaaaattgtatatacgacaggtctgccagtgagttattttcttaatagtgtatgcttaggaatattgtttgttgtatttgtttttatttttaggtattnaatattttt

SEQ ID NO: 2206 - DNA, 1663 bp, Diabrotica virgifera
cggacgcgtgggtttttattaggtaggaattgtcaaaataaaaatcatcaaaaactctagtttggaaaatgggaaggagaagtaggtcaaaatccccttttggttcaaggagacgggatcgcgatagagaaagggataaagaaagggacagagacagggatagggacaaagataaggagagacataggcggaaaagatcgagagatcggtcgcgagacagggaaagaagacgttattccacggaaagggatgatcacaggaagtattcccgttcaagatctagatctcggtctccagtggatagaagacgaaaaaataaagttccggaccgacctttgataaccgcagctgatctggaaggaaagagtgcagaggagcaagaaatgatgaaattaatgggattttgtaatttcgatacaacaaaaggtaaaaaagttaatggaaatgacgtgggtgacgtacacgtgatcctcaaacgaaaatataggcaatacatgaataggaaaggcggatttaatcgacctctggactttgtagcataatttgtgattcaacaggcattactttgaacaaccaatacctcaactcagtaacctcattcatcagaatgcaatttttatatttttttgctatacctatacctccatagtttcaggttatttatattgaaccaaggggcatttgcttcattttttagttggtaaataacattattaacatgttaagcgccatggcggtccctagggctcacaatagaaagtaccccatacccctatggaggtccctagagaccactgcgtatttagttcaaattatttgtcatccaagccagcgttcccctgcaaagtctgagcatcgtaaacggacctctatggcttggtgcatacactgaaaaattggagtattgcacattcacaagatgatgataatatatattatttatgagatgtattaataattacattaacgatttaatttttttagtgattttgctaattttctgagaatactaacatttttcagattaatttaaaatgttcttttgcattctcctcctctttggttaatctattaccttagggaagtaaacaaaacatctctgttatagatcctgatcagacaagacttttttatgtattataaacctctatacgttgtttcacgttaagaatagaatgttacgcttatggagatcagcgttgccaaacctctcggcacgggtggctactctactgccgatatacgctaatcagtacggcgtggcatcggcgcgcttctatcgtccataagaaatgcatggggctatctccgcaatgttctattcttaacttgaaacgctctataggacaaaaatctacattctacagtgaataagtgatataacacatatataaagcacttaagaacagaaataatgtttgtatatacaagaggttctaaaaatatgtatatacaaatatacatggtaatatttgttaatatattatgcattgtagtagtatcttaataatttaggtttatttgtaaagatgaagcaaatgcctccacctatttgttgaaatttctgtatatatcacacatacgggttgttcagttagtataatttttgtattatttataagctctaatatcaaacatttgttgttttatattttttatgaat

SEQ ID NO: 2207 - DNA, 860 bp, Diabrotica virgifera
ttcgtccgcacacacatttactgaagtcgaatagggttaaataaaataattatctgttcagctaaacagaggacttttttgttaaaatgccgaaagtgagatccacaactggagcccctcggaagcaggggttcaacagatcgaatcattcgatgaaccccgaaagaccgactgaaggattaaagggggtatctaaagtgagaactaagggaacaataaaaaggcttcagatgtacaggaatttcaaagctaagagggacaaaactggtaaaattctcacaccagcaccttttcagggaaggttgccatcaggtacacaagctagagtggagccaaaccaaaagtggttcggaaatagtagagtaatttccacaaaacaccttacaaaaatttcaaacagaggtaggaagcgcactaaaaaatccatttcaagtggttatgaaacctactacactacctataactttgctcaatgaaaaagccaaaaatgctagagtacatctgttatacacagagagttttcaaagtgtttttggcccagagaaaagtagaaagagaccaaatattggcgtaaaaggcctggaagaattaactgagttagcagacaagtctgctaatgaatattctcaagagaaagactcaaatgtagttcgagatgatggtggagtccgtgatttacctagagactgggttatggcagcaggtcaatccagaagaatatggaatgaactgtacaaggttgtcgacagctctgatgttttgctacaagttttagatgccatagatccaatgataactagatcagcttatgtggaaaagtatgtaaagacagagaaacctcataaacatcttatatttat

SEQ ID NO: 2208 - DNA, 1047 bp, Diabrotica virgifera
ttttgctagttctcccttttttttttttttttatcaaaaccattctcgttaggggtgtttctttgttcaacaggttttatattttatttctattcctatattgtccaccacatttaaacaagggaaaatggcagacgaaaacagaattagatctttcaagaacaaaggcaaggatacagaggaaatgagaagaaggcgtatagggcaaactgttgaactcaggaaagccaggaaagatgatcaactgcttaagagaaggaatatatccaccagtgaagaacctacatctccactccaagagaacaattcagtgtcttcccctactatgtctgcagaagaaattatgtatggtatgatgaactcagatgaagctattcaatatagggctacattggcatgcagaaagattttgagcagagaaaaaacaccaccaattgatcacatgatccgcctaggagtagtacctagatgtgtggaatttctgacaaaagcgcacaatccatccctacaatttgaagcttgctgggccctaaccaacatagcctctggaacatcagaacagaccgcagctgtggttcaggaaggagccattccccgtctgcaaggactcttgtcttcccctcgaatagacgtagcagagcaagctgtttgggcacttggtaacattgcaggagatggttcagcaaccagagatatggttttgtcctgtaacgtccttaatgatcttctttggcttgataacacctaccacctctttgtcattattgaggaataaccgcgtggactattttctaatttggggagaaataaaaaatccttctccagattttaacctttcttcggccaggccttccatttatagcacgtttttttgaatccaagcgaccccaaaaagttaagcagaataccggtttggggttttaagcttcccataaaagaaggcccacaatggaaaaaatccaagcttgttttaaaaattgggattcttcgaggggggtgggtcccgtatctcgtgaagggggaaaccgtacacaccctccgcccccc

SEQ ID NO: 2209 - DNA, 1307 bp, Diabrotica virgifera
cggacgcgtgggcgacgtattcagtcccaagcctccgattacgaagtgttctgtttagtgtccggctggatttttaattcaaactttcaacatgagtgtaatccaattagacaccgaagacaaactagaatacagtttcttccccaattcctctggattcgtccaattccgtgtcagagcagctaacgatgcacatctagcccttaccacccaggcagcagaatgcgaacccatgtacgaaatcttcatcggaggatggggcaactcaaaatccatcatccgtaaaaacagaagcaaaccagacgtagccgaagtaccaactccaggaattttgcaccccaatgaattccgtggattctggatcagatggcaaaatggtaacattgccgtcggcagagaaaacgaacaagctcctttcttgtcttggaacgattatgaacccattcacaacattgaatacgtaggtgtctgcaccggttggggagcaaatggttcatgggtagttgaacccccacaatctggcggtggtggtggtggctatggtgccccccaaaactacacagctccacgttccaacttctcctcagtctgctgggctccaggcagatctggtcaggtaccacctagagccttcgccggaggtgaagacaacggcgaacccctctacgtcatcaggtcccagttcaacggaggtctccttccaggcaaactcgttccaagccatggagtcggttacgttgcatggggtggccaagaaaacgccgtccatgaatacgaagtattgtgcgatttccccggacaatgggttgccacttcaagaggaaacatcccaccaaacgctttaacagctggacagagcgaagacggtgaacctctctacgtaggacgtgtcgtacatgacggagcattgaccgttggaaaggtacaacaaagccatggagtctgttacatcccatacggtggtcaagagatgtctttcccagactacgaaattttggtacaataaacagaactaaattgtttaagctttggatgtgctgcctaggatattaatccacaaaatatatttacatatatataaaaaaaataatagcaagtaaaagctacatgaagatttatatggcttctaggtgcctttattacccttagggatatgtatttttagaaggacataattcatttaatatttgttataaggagtttttatttatttacttgtgaatctctgctattattttagtgtacactcatgcactacttttgtaagtctgtttcatttttattgtaatacattttattaagatatt

SEQ ID NO: 2210 - DNA, 1472 bp, Diabrotica virgifera
cttgtaccgtcagtagcacatgctttgttcctcgaccaaactcatgacaatcctagtccagttgagaaacgatcagtattcgatctgctgcccagtactgcattaatcaacatggcttgctgtgctagtggatcaaacagaggctacgacgagttggttcctcatcatattcacgtagttgatgaagatagggagtatacagaatggactgccactgataatttgtctgtgggcaacttgcgttatgttactcataagtgtggtatcctcaaagccaagaaagcaataaacgatttacattttcttcttggaaaacaaggatttaaccaggtatatgtggaccagatggatgctgatatagtagctgtgactagacactgtcccgttacccatcaaagctatattttggtagcttttacagcatttggacatccaaatgaggatgcaggagagcaccagagaggaataaaacctttaagattcgagggaaatctagacgaaatcgtcttggaggctactttgagtcacgtaaagcacaaatccggtggttctaaatataccaaatggcatccatttatcaaggattgcaaatggatcaacggtcttcctgactaccaagtatgtgtgaaagagcacattcaagttccggactccgatatatttgaaaaagtcgactcgggaacgaagaacgtcactcaactgaacttcaaaaacttcaaaccaggctctgtagttgttattaaatcttcactgccagaaccaatgcgtgctgctataaagaccgtcaggaccttaatcagttctatttcactggctaaacccaccgaactagccaccatagttaacaaaatgacgttagctgatatgaatagagccttgtacagatgcggccaagaagaacgcgacgaaggatttggtttcgatacatacaacattcccagctttggttcgatggtgtatgccggattacaaggtttcatgtcgttacttgcaaatataagaccgaataatgaccttggtcatccgatgtgtgctaatctgagagatggtaactggatgatagaatttatttggaaaaggctcaaactggaccctggcaccaaagaactaggggattggatcgaacgcaataccaagagttttgaaaacattccaagatacttggtaccttgttatttcgacatcgttgtcacgggtctttatctggttctccttgaaaaaacccataaactaatgtccaatttcgtcaaaaatggctcaacgttcgtgagaggcctggctctaggatcggtacaatttcggcgcttatattaagtccgccgatttgccgacattatcaccgaatttagcacctcccaaaccgccatctagaaaaaattggaaaacgacacttggttcaagcttggtgtgaaccttatcagccaggcttggccaattttcctcaagcccggttaaatggaaaaaataggggg

SEQ ID NO: 2211 - DNA, 997 bp, Diabrotica virgifera
  misc_feature (907)..(907): n is a, c, g, or t
gtttatttattgtgtttgtgaaatgcatggataaaaatcctgcaccaaggtttggaatttatgaaagaaaagatggaaggtattttttgaaagttatatttttttatgttatattaacgatcatagggtttaaacgaagactgagcaatttaaggaaaaaatttcgccctttagaaaaaacacaaacattatctttctcacaaaagaatattgatgtaatctcattggaaggatcggataaatacggagactctgtgattttaaaaattaccaggagaaacagtaaacaaacaggatatatgttcttgaaaattggtgaaagcaaatttaaagcttccatcagtttagacccgtatgtagataaaaatgaagattatggagaaaccttttctactgacgatcttaaactaaacataattgaaccgctgaaagcgtggaaagtgacttacagaggagaaatggctgactgtgatcataatattagtaagtcccataaagttgaagttcaaggtatatggataactgatatacccgtcttccattttgaagatgcagatgcattaaattttgcaaaatgcctggcctacgaaaaatggaatagagaccactttcttaatttaaaaagatctaaagctacacattacgagcagtttggaactttgttagtaaaagtaaaaattgatgatcaagtacataaattgaaaatagatacaatcaaaagtcgttacttgggccatgataacatgagttacgtgtggaagggatgtgtgcatcgatttataatagatggaagagattgctttactttacgtcatacctgtaatccaatagttacttctcgattgattgaggcctgggtgcaccaacagatcttaagcttaagacgtgctttaagctcagcttacgnaacatacgcgttgaaccagtgagtcttacatcaattttcagcttaacacaatggattgccatgtggatttcttagataagtatcgaaaat

SEQ ID NO: 2212 - DNA, 460 bp, Diabrotica virgifera
attccggggccagtcacgagtccgcattttcttaacacattgcgtgccacgtcgctcatatatgagagacacagatattttgccaggggccacgtcgcattttgatatacgcgtatgtgtatactttatgaccgtggatatcaatggcccctgagactattctcccgagtaaagcgtggcacgcaatgttttaaatcatgaaaggattccttttgattttttacatgtgcttcaggacggctcttccaatcggttattggtattaataccagtaactgcataaacacttcttcaaaagcgtagattctgtttcttgaatggcttaaattcaatcagccttcaataatttcttcaatttggaaacatcacttctaataaaattaatgaggtttaatgtacaacatgtaatcgatggtgtcatttattatacttccaaacctgtttacttgtgagattttta

SEQ ID NO: 2213 - DNA, 443 bp, Diabrotica virgifera
ggcacacgcgtccgttgagaaggtctattaagtttgttttgttcttttcattatcaagaaatttatctggggataatggcaggttcggtacctcttccacgtagagtgtatgttggcagattaactgaagaaataacggcagaagacgtaagacaatacttcaaaaaattcggcgaagttactgatgtatatatgccaaaagatttcaaagcattctgttttgtcacctttttagatccagaaattgctcaagctctttgtggagaggatcatatcattaaaggatcatcggtttatgtctctgatgccgcccctaaaaacaattctaggaaaccagttacgaatggtagaggcggagacaataacaatgttggtcattcatttaaaggaaataattttcaaataaaaatgacgggatcaatggaaatgatcgggatcaaggc

SEQ ID NO: 2214 - DNA, 900 bp, Diabrotica virgifera
taaattttttgagtgatttgtatttctctatcttaataatcttagtcacatttaaataaaaacaacaaaatggtagaacgcataattccaatacaaatggaagatgacgataattcaggcgaagagtctggggctaatgctaatggtaatgtaaatagtgacactacaaaagagagttgtgtggaaaattcccaagaaaaatcagaccataaagaaagttctccaaacaatgagaaggagcagaagcttctcattttaataaaacccatgtcaaaaactaaagacttattagagaatcttaaaaaatacgatgtttttgaagaacgcagcaaattttctttaccaaacataaatgttcccgaaaaaattattttagttatagatagagcccaagatgaacattgcacaagttttgcagaagccaacggtaaatacacaccattgtcaatgctcagaaagtctctacatctgttcgtaaatctgaaacattcgatcaataagaatcatgagttcgctattgttcttctgaatgaaaatactgccacatgggcactacctttcactagtgagttgagaaaagttaataattgtattgaaaaaataacacagtgtgaagttgaagatacatttaacatgaatttagtttttgaagaaattttacccaacattaagatacctcaagatgaaatcgctccaccttatataattcgtactataatatgttacggaagatcatacacaataccagaaattaaattctcagaaaaaattgtgaaattgttggacaatccgttttttatttgtgatgtactgatgacccatgaaccagtcgatgatagtaattattgtaataaaatatttgaatgtttacagaatattgatagaaagggtatatcatac

SEQ ID NO: 2215 - DNA, 812 bp, Diabrotica virgifera
cttcaagcgattgttccaagataggtaaactgttttactcggtccactggcgtattcttgataagcagttggacgtctgtaattttatttttcctgatgactataaatttagtttttgatatgtttacttgtagtccaaatcttttacttacgttatttactttgttgattagttgctgtaaactgtttaaactgtctgcaaaaataacgctgccatctgcatagcggatgttgtttaggcgttctctatttaggagtgttctatggtcgaaatctgaaaataggtgaaaatatacatatacatccttgtctaacacctcgcagaatctggatcgcttccgtcggttcatcttcaagatttgttcttattgtggctgattggttccagtgtaaattttgtattatacgccggtctttaacaaccatttgagcttttgttagaacatccatcatttttcaatgttgaactgtatcaaatgatttttggtagtacacaacccaggcaaccaaacaacgtttttataacgtagataacacgtcgtaaaaatgaccaattaacgtgtttctagacgtagtactgacgttgaaaatcacgtgtatttatctcatcgatttgaggtcataattgtgacgattttaaaacgtcattgtaccctacgtttttttcacgtcgagatggtgacgattttcaaacgtcaaaaagatgacgacttttacacgtcgccgtcggtaaaatcaagtctttaatactttcaaaaagtgacctctttgagatgtttcaaaataatataaaaaataggtaacatgaaaat

SEQ ID NO: 2216 - DNA, 770 bp, Diabrotica virgifera
ggattatggtaacaagttcggtgaacccttgatttccggcttcgtacggtcttttggtcttgttgacgcggctggagagagaaaagaatggattaaacctatcatgtttagtggaggtattggcagcatggaagccgatatgactgagaagctgccacctaaattaggacaccaaatcatcaaaattggaggacctgtatacagaattggtgtaggtggaggatctgctagttcagtcgaggtacaaggggacaacaaagtagagttagactttaatgctgtacaaagaggtgatgccgaaatggaaaacaaattgaacagagtcgtacgtgcttgcttggaactaggttccaaaaaccctatcgtcagtattcatgaccaaggagctggaggcaatggaaatgttttgaaagaattagtagaaccagtaggaggaattatatacgccaataaatttgatttaggtgatccgacaataaacgttcttgagttgtggggagccgaatatcaagaaaataatgcgttgttgtgtaaaaaagaagatcttcctcgtcttaagagtatttgtgcaagagaaagatgccctgttaacgttgtaggtgaagtaactgatacaagaagagtagttctggctttagacgaaagtaaggctggtacaccgtttaatttgggattgggacatgtatttaggaaagatgcctcagaaggtccttaaactaaacagggcacaaagtagccagtaaaacaataaaattccccaaaagcccttt

SEQ ID NO: 2217 - DNA, 1780 bp, Diabrotica virgifera
gccagaccgatacaagttccaccaggtatggtaggtatgccatttatggccaacgcaggtacgagagtccaatcaattcccgttgaagttcgagcttcaagagctcaacctagatctcagaacggcacacccgacagcaccgcagcagcacctactttcgaactcacttacctacgtgcttccactggcaatgaaactcctaccactacggcttcagatgccggtaccggtagtgatactggtggtactggtgcagataccacacctaacaatcaagaaggccaacaacaaggtgccggccacaactttaacaatccaaacgtggagttcttcatggaagtgactccagaagtactcagaggagcgttaaacggaccccctccagaattgttgaactcccttatgcaaatggcaggtcagataatgaatcgcaatatagcaacaaccactactacagcaagtcccacccctgctactacatcttcagaatcaagtcaagcgcagtctggagctggacaaggaactacccctaacagagggcaaaattctcaaccacgtggaggtgctcaaacaaacccgaccacttcaactcataccaggcaaggttcacggagtggtcgccattttcgtagccgttcccaccgatgtggttttgatccgttccttccatgtagttcccaccatattacaagacgtagagtgaacattgatcatctccccccaccaccaaactggcaacctactgctgcaaccaatgaacccaatacagcaaacaatgatgatgatggaggacctccagattttcagagtttagttaacgcatttctttctgtaaggaacagcgggtcaagaagaatcggtcctctacaagcaaataatgaagcgggtacctctacgagtactacatcgattaatatgccaaatagcatcgatagcataggagcctttaatttacctcagatatcttcaatattttcattgaccgacatgaatggcgatctattacaggaatcaacaaatccactacgtccggattcgactttagaagaactcgttaatcaatttcaagatgaacagtacatcccaggagaaaaccttcttgttgacttaataatgctctttgtgaggaacttttcaatcgtagatatattgtcactatacggtggcagtgtggaacctataaacagacatgttcgtgtgctcaaagcatttttccggaccagaatttgtgagtcagatactacaccgtccggtattgatagaggcatcgatagaattataagggaattgcaaccattcttagaaaatttcagaacttgccagttcaaaacaatatagacatggttagatcggcggaacagttattcagacagagactaccaaatataatttatattggaattaatttaaatggcggcgccacacgtttgttggttgaacagtgcataacgacagcaaaacaacttctagctttaacacttctcgccagttcaacaggtcggaacggagttgaacaagtctacgagcaagtaatgtcatattttatgagagatgttccccaatatgtgcaaaattggacacttatgacgagtcgtgtccgtttacggcaaatattgtcaaatctgaacataccagagagtctattgcagacgtacatcgatcacagacccatgactccgattttggaacctatggtagaaaacgaaaccgaaatagagtccatggaagtagacgctcaagagactagaactgaaaataatccgtcggccatatttcctga

SEQ ID NO: 2218 - DNA, 1826 bp, Diabrotica virgifera
tgtggggtagaatttcagacttttgacaaattaaaattttgaacaatttattttattaatttcaatcacattgcagttttaaaaagaattaaaaatggtatccctaaatcccgtaagaattctcaagcaagaagccgaggaagaaagggcagagattgcccgactcagtagttttgtaggtgctatagctataggagatttggttagaagcaccttgggaccaaaaggaatggataaaattttagtatccagtggtagatctgcaggatcagttgaagttactaacgacggagcaactatcctaaaatcggtgggtgttgataatcctgctgctaaaattttggtggatatgtcaaaagtccaggatgatgaagtaggagatggcaccacatcagtgacagtattagcatctgaactacttaaagaagcagaaaaacttgtagaacagaaaattcacccacaaacaatcattgccggttggaggaaagcagtagatattgccagaaaagctcttctagaaactgccaaagacaacagctctgattcagaaaagttcagagaagatctgatgaacattgccagaactacactcagctcaaagattctttcacaacataaagaatattttgccaaactggcagtagatgctgtgctgagattgaaaggtacaggtgatttacaatccatccagctgattaagaaaactggtggtactttggaagattcctttttggatgaaggttttttattggacaaaaaacctggtgtacatcaaccaaagagagtagaaaatgcaaaaatcctgatagccaacactcctatggacacagataaaatcaaagtatttggttctcacattaaggtagattcaatggctaaaattgcagagctggaatctgcagaaaaggaaaaaatgaaagataaagtgaacaaaattcttaaacataatgctaatgtatttattaatagacagttgatttacaattatcctgaacaattgtttgctgatgcaggagttatggctattgaacatgcagattttgatggaattgaaaggctagcacttgtcacaggaggagagattgtctcaacatttgaccatccagaattggtaaaacttggaacttgtaagcttattgaacaaatcatgattggagaagatatcctgctccgtttcagtggtgttgctcttggggaagcttgcacaattgttatcagaggtgctacacaacagatcattgatgaagctgaccgttcccttcatgatgctttgtgtgtattatcagccacagtcaaagagagtcgaattgtgtatggaggaggttgcagtgaaaccctaatgtccacagcggtatcaagagctgctgctaacactccaggaaaagaagatgtagcaatggaagcgtttgccagagctttgttgcagttgcccacaaatattgcagacaatgcaggttacgactctgcccaattggtcagtgagcttaaggcagcacataacagtggccagagcaccatgggacttaacatggaaaagggtgaattgggggatatgaaaaccttgggaatcacagaatcttttgttgttaaaagacaagtattagtctcggcatctgaagcagctgaaatgatcttgcgtgttgataatatcatcaaggctgcaccaaggaggagaacagaagacaggggaatgtgctagttaaggaattactgatatttttatttaaggctttacttacatatttcgttataatattgcattattactgatcattctgcataagttttctgcactcattcttgattttctaataaagcgaccgttc

SEQ ID NO: 2219 - DNA, 437 bp, Diabrotica virgifera
actagtcctagtcatatactgatatctgtatcaaaatgtacaccaaaattccagttttgtttgtaatagtggcaatatttgcattctcagatggagtgagcgtatccgcctgcgtcgacgtgaacgatggctcgcagttaatttgtgacaaagatcttgaaaacaaaatttccatccacaacaaagctgaaaatatgatctctttcaaactggaaacatgtaggcaggttcagcattacactaatttaggaataggcgcgaacgttgtcgtttcttctgggtcgtgcaacgagccattctatatttctcagtgtacaattcatggcagaggtgccaaatgtattgacacagttactattagaccctttgtatattaaatgtatcgttaaagatctttaaataaatgtattcaatataaaaaaaaaaaaaaaagggca

SEQ ID NO: 2220 - DNA, 1242 bp, Diabrotica virgifera
  misc_feature (7)..(7): n is a, c, g, or t
  misc_feature (39)..(40): n is a, c, g, or t
  misc_feature (45)..(45): n is a, c, g, or t
  misc_feature (55)..(55): n is a, c, g, or t
  misc_feature (85)..(85): n is a, c, g, or t
  misc_feature (93)..(93): n is a, c, g, or t
  misc_feature (118)..(118): n is a, c, g, or t
  misc_feature (135)..(135): n is a, c, g, or t
  misc_feature (214)..(214): n is a, c, g, or t
  misc_feature (218)..(218): n is a, c, g, or t
  misc_feature (241)..(242): n is a, c, g, or t
  misc_feature (270)..(270): n is a, c, g, or t
  misc_feature (1218)..(1218): n is a, c, g, or t
tattttntaaatttctcacccctcatcacccaccattcnntcaanaaaatatttntcccaaaataccttactctatccaaaaacnacttattnaaaataaaaaacacctacacaaaanctataacttacttttcntgtgcatacaatataaacacaacaactaccaaattatctccaattttttacattctactaaaatataactgtcaatggnttanattttcccctttccactctttanntccttttatatcaacttttcccaatccncccataaccaaaatggattataataacaatggagatctagttttagttaatggagagggtgcagagtttatgatttctgtttcaacaccaatgttatcattgcacgaaagattcagcgttaataatccaaaagaagataacataatgatgaacccgttaaatttagaagaaatggatttggaagaaaccggttggattgaaaaaatcaatgaagatgacataacggggagttcttcagacaaacaaaacgaagaaaacagttctgaatcttccgatacagtggcaaatgatgatggtaatgtcgaaaacctaaccgataaaggttcgatagaagacccaaagagcaccccaaatgtgatagtgtgtgataatattagcgaaaaaataaataaccaattaacagatgcaatgcaaaatattaaattaattgtaaataattctaatttaaatattgaacatagtacaaacgttaacaatgaacttagtcaattaaattcgaatgtcactacagaagataaaatcactaatacgaataaagacacaaatgacaacgaacaaaaggtaaatatcaataataacggtactatagaggatgatttgcatttattttactcacacaattattggtatattagtcctgagttgcctttagatccagttttagtctgtggagaggaatcctcgaacatcttaaatggtgctggagattcaatacatttggaaagtaattctgctgatgggagtaaatcagataataataattcaacagtttcaatagatgaaagtgatgttacaaacgatggtacaaatgaaaatagtgttgcggagaagtcagaaccaccagaaccaccacagaagatagtaccgcaaattttagttgatcactacatagcaatgacatatccaatgctatctcttaacatagaatacgaaaatggcataccattngcgcatactctcttccagctgtag

SEQ ID NO: 2221 - DNA, 938 bp, Diabrotica virgifera
  misc_feature (806)..(806): n is a, c, g, or t
cgcttcaaccgctgagtaaacacggtcgaactctgcgttcgaaaaataacatcaataagattgatagtttctgtaacgaagtccagtgacattgtccagtgaagaatcatttgagaaagtcaaaaactgttttatccttaataattataagtggaaataacaatacttccgtgcgtttgtcaaatgttatagtgtgcgaaagatgacaacttcaacaatacaaaatgggaaagaaaaagaaacagctacacccacagaagtagaagtagaacaagaagatattatacaaaaatgtataggagttttaggaaggtggcatatttggttatgctttataatatttctagtcaaatttggtgtttcttggcaccaacttagtatagtatttttagctccacctattaaatattattgtatcaataatgcaacagaaacatgtttatccaattgtactcattatctatatgatacgtccatatttactaataccatatccatggaatgggatcttgtgtgttcaaagtcatatttagtcagtcttactcagacgttaacaatgctgggaatcttagttggaaatatgttatttggatatttgtctgacaaatttggtagaaaattaccacttgttctggctgttgctctgcaaggattgtcgggattaggtgcagctttctccccatggtttacattatttataatcttaaaatttttatctgcagtagcgacaggaggtacaatgataacaagcttcgtacttatcatggagataatcggtaccgaatggagaacagttcttgcgattntgtaccaataccattcaatttaggtcatcttttgatgccactatttagttattatcttcgaaactggaggcattttcaataatgatatcagtgccttcgctttttctgatctcatactattggattcttcct

(The sequence listing continues in the following parts.)

What is claimed is:

1. A method for controlling Western corn rootworm infestation on a plant, comprising topically applying to said plant a pesticide composition comprising a dsRNA targeting for suppression an essential gene in said Western corn rootworm and at least a second pesticidal agent with a different mode of action for controlling said Western corn rootworm, wherein said second pesticidal agent comprises a *Bacillus thuringiensis* insecticidal protein, and providing said plant in the diet of said Western corn rootworm.

2. The method of claim 1, wherein said dsRNA is topically applied using a spray mixer, by expressing said dsRNA in a microbe and applying the microbe onto said plant, or by applying said dsRNA in a topical composition that further comprises said *Bacillus thuringiensis* insecticidal protein.

3. The method of claim 1, wherein said composition comprises dsRNA encapsulated in a synthetic matrix and applied to said plant surface or a seed coating.

4. The method of claim 3, wherein said matrix is a polymer.

5. The method of claim 3, wherein said composition is topically applied as a microbe that is engineered to express said dsRNA or comprises a fermentation product from said microbe.

6. The method of claim 1, wherein said composition further comprises one or more additives selected from stickers, welters, and UV protectants for foliar application.

7. The method of claim 5, wherein said composition comprises a granular formulation for soil application.

8. The method of claim 1, wherein said plant comprises a nucleic acid sequence encoding at least a first *Bacillus thuringiensis* insecticidal protein.

9. The method of claim 1, wherein said *Bacillus thuringiensis* insecticidal protein is selected from the group consisting of a Cry3, a TIC851, a CryET70, a Cry22, a binary insecticidal protein CryET33 and CryET34, a binary insecticidal protein CryET80 and CryET76, a binary insecticidal protein TIC100 and TIC101, a binary insecticidal protein PS149B1, a VIP insecticidal protein, a TIC900 or related protein, a TIC901, a TIC1201, a TIC407, a TIC417, and an insecticidal chimera thereof.

12. The method of claim 11, wherein said pesticidally effective amount ranges from about 10 g to about 2000 g of the pesticide composition per 100 kg of weight of the seed.

13. The method of claim 12, wherein said pesticidally effective amount ranges from about 50 g to about 1000 g of the pesticide composition per 100 kg of weight of the seed.

14. The method of claim 13, wherein said pesticidally effective amount ranges from about 100 g to about 600 g of the pesticide composition per 100 kg of weight of the seed.

15. The method of claim 11, wherein said pesticidally effective amount is over about 60 g of the active ingredient of said composition per 100 kg of weight of the seed.

16. A method for delivering a pesticide composition comprising a double-stranded RNA (dsRNA) that functions upon ingestion by a Western corn rootworm to inhibit the expression of a target sequence within said Western corn rootworm and at least a second pesticidal agent with a different mode of action for controlling said Western corn rootworm, wherein said second pesticidal agent comprises a *Bacillus thuringiensis* insecticidal protein, comprising exposing said Western corn rootworm to a diet containing said composition, or overlaying said composition on top of a Western corn rootworm diet and exposing said Western corn rootworm to said diet.

17. A method for controlling Western corn rootworm infestation on a plant, comprising topically applying to said plant a pesticide composition comprising a dsRNA targeting for suppression an essential gene in said Western corn rootworm and providing said plant in the diet of said Western corn rootworm, wherein the plant comprises a nucleic acid sequence encoding at least a first *Bacillus thuringiensis* insecticidal protein for controlling said Western corn rootworm.

18. The method of claim 17, wherein said *Bacillus thuringiensis* insecticidal protein is selected from the group consisting of a Cry3, a TIC851, a CryET70, a Cry22, a binary insecticidal protein CryET33 and CryET34, a binary insecticidal protein CryET80 and CryET76, a binary insecticidal protein TIC100 and TIC101, a binary insecticidal protein PS149B1, a VIP insecticidal protein, a TIC900 or related protein, a TIC901, a TIC1201, a TIC407, a TIC417, and an insecticidal chimera thereof.

* * * * *

UNITED STATES PATENT AND TRADEMARK OFFICE
CERTIFICATE OF CORRECTION

PATENT NO. : 9,238,822 B2
APPLICATION NO. : 13/226353
DATED : January 19, 2016
INVENTOR(S) : James A. Baum et al.

It is certified that error appears in the above-identified patent and that said Letters Patent is hereby corrected as shown below:

In the claims
Column 99, Lines 52-53, please delete "welters" and please insert --wetters--

Signed and Sealed this
Fourteenth Day of June, 2016

Michelle K. Lee
*Director of the United States Patent and Trademark Office*